United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 6

SEQ ID NO: 199319 - RNA, 22 nt, Human
uuuguuugcugagugaauucaa

SEQ ID NO: 199320 - RNA, 22 nt, Human
uuuuuuccuguuugucuuuggg

SEQ ID NO: 199321 - RNA, 22 nt, Human
uggcccugaaucaaggccagca

SEQ ID NO: 199322 - RNA, 22 nt, Human
uguguuguuggggauguuuuca

SEQ ID NO: 199323 - RNA, 22 nt, Human
uccuuaggaccuagagguagua

SEQ ID NO: 199324 - RNA, 17 nt, Human
ugguucuuuuccugacc

SEQ ID NO: 199325 - RNA, 22 nt, Human
acauucucuuuuagaaagcugu

SEQ ID NO: 199326 - RNA, 22 nt, Human
cagcuguggagauggggugcau

SEQ ID NO: 199327 - RNA, 22 nt, Human
gcuggccugcgagggcaggcug

SEQ ID NO: 199328 - RNA, 20 nt, Human
acuagaaagucacugggggg

SEQ ID NO: 199329 - RNA, 22 nt, Human
uucugugacuccucagagauuu

SEQ ID NO: 199330 - RNA, 22 nt, Human
gugugugucuacuuucaucucu

SEQ ID NO: 199331 - RNA, 22 nt, Human
uacugcaguuccugcugucucc

SEQ ID NO: 199332 - RNA, 22 nt, Human
caggggaagccagcugccaugu

SEQ ID NO: 199333 - RNA, 22 nt, Human
ucuucacagaugcauauacuuc

SEQ ID NO: 199334 - RNA, 22 nt, Human
ugcuuucaaaacucagaggaau

SEQ ID NO: 199335 - RNA, 22 nt, Human
agagcaucgguggaguccccac

SEQ ID NO: 199336 - RNA, 22 nt, Human
uagggaggguuugggguggagg

SEQ ID NO: 199337 - RNA, 22 nt, Human
acuuuauacuagugauaguuug

SEQ ID NO: 199338 - RNA, 22 nt, Human
gggugcuucauaggugaugcug

SEQ ID NO: 199339 - RNA, 22 nt, Human
uuauuuuuguuuguuaagccua

SEQ ID NO: 199340 - RNA, 22 nt, Human
aacgagcugggggggccggggg

SEQ ID NO: 199341 - RNA, 22 nt, Human
auucuuauaaaaaguguugacu

SEQ ID NO: 199342 - RNA, 22 nt, Human
cauccagcuccugggggccacc

SEQ ID NO: 199343 - RNA, 22 nt, Human
uguuuucuauuaccugagauug

SEQ ID NO: 199344 - RNA, 22 nt, Human
cagagagcguccauccggugcc

SEQ ID NO: 199345 - RNA, 22 nt, Human
gauuccuuucgccugccgagcu

SEQ ID NO: 199346 - RNA, 22 nt, Human
uuucacugaguaggagagcacu

SEQ ID NO: 199347 - RNA, 22 nt, Human
agugucugcgggcagaggagcg

SEQ ID NO: 199348 - RNA, 22 nt, Human
gggcuguggggccugcagaagg

SEQ ID NO: 199349 - RNA, 22 nt, Human
ccagcugggucccugcuggggc

SEQ ID NO: 199350 - RNA, 22 nt, Human
ccagggaggucauagugcuggu

SEQ ID NO: 199351 - RNA, 22 nt, Human
guuaaaaugauuugugauuuau

SEQ ID NO: 199352 - RNA, 22 nt, Human
uuucucuuguauuugaaucacu

SEQ ID NO: 199353 - RNA, 22 nt, Human
uucucagagaaagcuccucaug

SEQ ID NO: 199354 - RNA, 22 nt, Human
cucagaauugucaccucaaaaa

SEQ ID NO: 199355 - RNA, 22 nt, Human
ggcuggagcaggcugcacagug

SEQ ID NO: 199356 - RNA, 22 nt, Human
uguuccucuuagucuuaugugu

SEQ ID NO: 199357 - RNA, 22 nt, Human
gaacauauuuagcaccuaauau

SEQ ID NO: 199358 - RNA, 22 nt, Human
auuuuuuuuccugucucuuuca

SEQ ID NO: 199359 - RNA, 22 nt, Human
ugggcagggauuuggggaaacu

SEQ ID NO: 199360 - RNA, 22 nt, Human
uuuuguuuacauuaaauuuuga

SEQ ID NO: 199361 - RNA, 22 nt, Human
aggggaggcugggcuggggggc

SEQ ID NO: 199362 - RNA, 22 nt, Human
aagaaggaaggcaagagauggg

SEQ ID NO: 199363 - RNA, 22 nt, Human
cagcccugagagaaccaucuau

SEQ ID NO: 199364 - RNA, 20 nt, Human
ucugugugccaucaccuaac

SEQ ID NO: 199365 - RNA, 22 nt, Human
gucuuucuuuuacauauuugug

SEQ ID NO: 199366 - RNA, 22 nt, Human
aagagaggcccaaguggcuggc

SEQ ID NO: 199367 - RNA, 21 nt, Human
aucagaaucucuagauuugga

SEQ ID NO: 199368 - RNA, 22 nt, Human
agacacagcaauaacuacuguu

SEQ ID NO: 199369 - RNA, 22 nt, Human
gaggcaggaagggaggguugug

SEQ ID NO: 199370 - RNA, 22 nt, Human
gagccucaggguuuuguugaca

SEQ ID NO: 199371 - RNA, 22 nt, Human
agggcaguuuuacugaaaggug

SEQ ID NO: 199372 - RNA, 22 nt, Human
uaugaauauaccacaauuuagg

SEQ ID NO: 199373 - RNA, 22 nt, Human
acauaaauagcacugugaauuu

SEQ ID NO: 199374 - RNA, 22 nt, Human
aaugaauaaauuuuaaagacag

SEQ ID NO: 199375 - RNA, 22 nt, Human
cauuccuucucagguacuggca

SEQ ID NO: 199376 - RNA, 22 nt, Human
acauuuuaaaaacaguaccugg

SEQ ID NO: 199377 - RNA, 22 nt, Human
auuuucuugucucuguuguagg

SEQ ID NO: 199378 - RNA, 17 nt, Human
auuguuuuuaauuugca

SEQ ID NO: 199379 - RNA, 20 nt, Human
uucacagaggacucagguca

SEQ ID NO: 199380 - RNA, 22 nt, Human
uuuccuuuguuuugguauaugu

SEQ ID NO: 199381 - RNA, 22 nt, Human
auagaaauagacaaugcaaaga

SEQ ID NO: 199382 - RNA, 22 nt, Human
gcagcccucuuggucacuaggc

SEQ ID NO: 199383 - RNA, 22 nt, Human
gggagcucaccaugcucugcau

SEQ ID NO: 199384 - RNA, 22 nt, Human
aucuucuuucaucagccccuca

SEQ ID NO: 199385 - RNA, 22 nt, Human
ggacggggagcuggaaagggga

SEQ ID NO: 199386 - RNA, 22 nt, Human
ggaauuauuuuaaauagacauu

SEQ ID NO: 199387 - RNA, 21 nt, Human
gaaaaucuaaugugacaaugc

SEQ ID NO: 199388 - RNA, 22 nt, Human
gaggggaauguuccugagcugg

SEQ ID NO: 199389 - RNA, 22 nt, Human
aagugugugugcgcaugugcau

SEQ ID NO: 199390 - RNA, 22 nt, Human
uguccuuuauauguuuuuuagu

SEQ ID NO: 199391 - RNA, 22 nt, Human
uaugucuauugacuuaggauuu

SEQ ID NO: 199392 - RNA, 22 nt, Human
auacauauaugcacauuaauau

SEQ ID NO: 199393 - RNA, 22 nt, Human
gagcagcucgagaaggaagcag

SEQ ID NO: 199394 - RNA, 22 nt, Human
ucgcccagguuggagugcagug

SEQ ID NO: 199395 - RNA, 22 nt, Human
cuguucuccacuccugacuucu

SEQ ID NO: 199396 - RNA, 22 nt, Human
auguucucagguuguauuuauu

SEQ ID NO: 199397 - RNA, 22 nt, Human
aauaacuuacucuaugcuuagu

SEQ ID NO: 199398 - RNA, 22 nt, Human
uggagggaagcaaacacuagau

SEQ ID NO: 199399 - RNA, 22 nt, Human
cucaaagcagacuuuucccuuu

SEQ ID NO: 199400 - RNA, 22 nt, Human
aguaaaugaaagcaauuuuaga

SEQ ID NO: 199401 - RNA, 22 nt, Human
ugaaagcuggcucugcagagug

SEQ ID NO: 199402 - RNA, 22 nt, Human
auggugaugaugaugaugauaa

SEQ ID NO: 199403 - RNA, 22 nt, Human
uguaaauucuauacacuuaaaa

SEQ ID NO: 199404 - RNA, 22 nt, Human
agauggaggaaagcaguuagaa

SEQ ID NO: 199405 - RNA, 22 nt, Human
gcacagauaaucugccuuacca

SEQ ID NO: 199406 - RNA, 20 nt, Human
aggggcuguaguuagaugac

SEQ ID NO: 199407 - RNA, 22 nt, Human
aaggugggacugagaggggaca

SEQ ID NO: 199408 - RNA, 22 nt, Human
cuucucugcugccugccucuuu

SEQ ID NO: 199409 - RNA, 23 nt, Human
aaggugaagccaccaggugagga

SEQ ID NO: 199410 - RNA, 22 nt, Human
cagggggacuuguuagguuuua

SEQ ID NO: 199411 - RNA, 22 nt, Human
auaaggaaagugagugcuuaaa

SEQ ID NO: 199412 - RNA, 22 nt, Human
auuuccagcagcauauuugucu

SEQ ID NO: 199413 - RNA, 22 nt, Human
aggcagagaggucuuccuggaa

SEQ ID NO: 199414 - RNA, 22 nt, Human
auugaaauuugcuuccucacug

SEQ ID NO: 199415 - RNA, 22 nt, Human
aaaauauaaaggauguggguuu

SEQ ID NO: 199416 - RNA, 22 nt, Human
uggagucuugcuuugggagugc

SEQ ID NO: 199417 - RNA, 22 nt, Human
cagccuuuucuuaaaaugcaag

SEQ ID NO: 199418 - RNA, 22 nt, Human
auuuuuauuugccuaugauaua

SEQ ID NO: 199419 - RNA, 22 nt, Human
cuuuaaaaauguauuuuugugg

SEQ ID NO: 199420 - RNA, 22 nt, Human
caauggagccaagaggaggaaa

SEQ ID NO: 199421 - RNA, 22 nt, Human
agcaaaauuccaaaaugcuaau

SEQ ID NO: 199422 - RNA, 22 nt, Human
uuucacuucgaucagaguuuuu

SEQ ID NO: 199423 - RNA, 22 nt, Human
uggcaagcuguuggcagauagc

SEQ ID NO: 199424 - RNA, 22 nt, Human
ccauuuggccauucaguuguuc

SEQ ID NO: 199425 - RNA, 22 nt, Human
uguggccaccagagcugcuauu

SEQ ID NO: 199426 - RNA, 22 nt, Human
caaaaaauccauagaaagaggu

SEQ ID NO: 199427 - RNA, 22 nt, Human
cugccucucaugccugcuugcu

SEQ ID NO: 199428 - RNA, 22 nt, Human
cagcuggggagagacauggcag

SEQ ID NO: 199429 - RNA, 22 nt, Human
ggcuggggccuguugaagaugc

SEQ ID NO: 199430 - RNA, 19 nt, Human
ucagcagauuuugcaaaca

SEQ ID NO: 199431 - RNA, 22 nt, Human
gcuuauuagguuauuucaagga

SEQ ID NO: 199432 - RNA, 20 nt, Human
gccaaggaggagaaacaggc

SEQ ID NO: 199433 - RNA, 22 nt, Human
uuucuggacuaaagggagagau

SEQ ID NO: 199434 - RNA, 22 nt, Human
caggaggugugucccaccgggu

SEQ ID NO: 199435 - RNA, 22 nt, Human
uuuuuuuguagguguaugaaaa

SEQ ID NO: 199436 - RNA, 22 nt, Human
uuucuaaaauuacugcagucgg

SEQ ID NO: 199437 - RNA, 22 nt, Human
cuacuucucccuagaucagaaa

SEQ ID NO: 199438 - RNA, 22 nt, Human
gauuucuucauuuaaaaauauu

SEQ ID NO: 199439 - RNA, 22 nt, Human
uuuuucuuugcuuuccacuggc

SEQ ID NO: 199440 - RNA, 22 nt, Human
ggagcucacuacgaaauaagcu

SEQ ID NO: 199441 - RNA, 22 nt, Human
ucauuguuuacugucuuuuuuc

SEQ ID NO: 199442 - RNA, 21 nt, Human
acugggcuagccugacuucug

SEQ ID NO: 199443 - RNA, 22 nt, Human
uuuuuuuaaguuuugauuuuag

SEQ ID NO: 199444 - RNA, 22 nt, Human
ucaccauguuuucauaggaaca

SEQ ID NO: 199445 - RNA, 22 nt, Human
cuucagagugacucagcaucuu

SEQ ID NO: 199446 - RNA, 22 nt, Human
ucugcaugccucaggaggccug

SEQ ID NO: 199447 - RNA, 22 nt, Human
guuuuucuuugauuuagaacca

SEQ ID NO: 199448 - RNA, 22 nt, Human
agagauacugcaggccauaaau

SEQ ID NO: 199449 - RNA, 22 nt, Human
cacaugugugugccuacaugca

SEQ ID NO: 199450 - RNA, 22 nt, Human
ccccccaaauguuacagugacc

SEQ ID NO: 199451 - RNA, 22 nt, Human
gguagacugagcuccuugagga

SEQ ID NO: 199452 - RNA, 22 nt, Human
uacuauuuugacaugaaauuga

SEQ ID NO: 199453 - RNA, 22 nt, Human
uuccacauucggaauuuucuga

SEQ ID NO: 199454 - RNA, 22 nt, Human
auuuuuaucuaaaauccacuuu

SEQ ID NO: 199455 - RNA, 22 nt, Human
uuugaagaaacagucuuaagag

SEQ ID NO: 199456 - RNA, 22 nt, Human
ucuuccuuguaagggcuuuaga

SEQ ID NO: 199457 - RNA, 22 nt, Human
uggaagugggcaucaccaucca

SEQ ID NO: 199458 - RNA, 22 nt, Human
cggggcuggcguuagggaggca

SEQ ID NO: 199459 - RNA, 22 nt, Human
caauccccaggucccagaacag

SEQ ID NO: 199460 - RNA, 19 nt, Human
agagucuccacuccacuug

SEQ ID NO: 199461 - RNA, 22 nt, Human
cuauauucuggaauguccauuu

SEQ ID NO: 199462 - RNA, 22 nt, Human
uggguucaaauccugguuccac

SEQ ID NO: 199463 - RNA, 22 nt, Human
ccucuccuugcuccccuuccuu

SEQ ID NO: 199464 - RNA, 19 nt, Human
ucaggaggucgaccuggca

SEQ ID NO: 199465 - RNA, 22 nt, Human
gaggagcugggucagggagaca

SEQ ID NO: 199466 - RNA, 22 nt, Human
gcagggcucagccgcucccacc

SEQ ID NO: 199467 - RNA, 22 nt, Human
uuauuugcccauguuuagcaga

SEQ ID NO: 199468 - RNA, 22 nt, Human
cagcuuguucugaccugugauu

SEQ ID NO: 199469 - RNA, 22 nt, Human
aaauauauauaauauauauauu

SEQ ID NO: 199470 - RNA, 22 nt, Human
gcuggaaauaacuuguguagaa

SEQ ID NO: 199471 - RNA, 22 nt, Human
aguuuccacuggagacacugug

SEQ ID NO: 199472 - RNA, 22 nt, Human
uauuuuaaaagcauuaauucuu

SEQ ID NO: 199473 - RNA, 22 nt, Human
ucagagccagacacacagcaga

SEQ ID NO: 199474 - RNA, 22 nt, Human
uuuaacauaugaaagaauauuu

SEQ ID NO: 199475 - RNA, 22 nt, Human
guuuaaaagcaaccaacaggcu

SEQ ID NO: 199476 - RNA, 22 nt, Human
uguauaaaauggaaugucagaa

SEQ ID NO: 199477 - RNA, 22 nt, Human
cucaagugacucagccugguug

SEQ ID NO: 199478 - RNA, 22 nt, Human
uuaaagaguuuauuacuuguaa

SEQ ID NO: 199479 - RNA, 22 nt, Human
uucauagaagggaguuuuuccu

SEQ ID NO: 199480 - RNA, 22 nt, Human
uggcucacaggaggcagaggug

SEQ ID NO: 199481 - RNA, 22 nt, Human
cuuuccaugucuucuuucucca

SEQ ID NO: 199482 - RNA, 22 nt, Human
ccucccuucccggcauggcucu

SEQ ID NO: 199483 - RNA, 23 nt, Human
ugggagcuauguuuggaaugggg

SEQ ID NO: 199484 - RNA, 22 nt, Human
cauaaucaagggguugugaugu

SEQ ID NO: 199485 - RNA, 22 nt, Human
ggcaaggaagaaagcagaaguu

SEQ ID NO: 199486 - RNA, 22 nt, Human
cuuuacauuaauuucuacugau

SEQ ID NO: 199487 - RNA, 22 nt, Human
gugcucuagaaauugucagugg

SEQ ID NO: 199488 - RNA, 22 nt, Human
aacaguuaagaggaggcagaga

SEQ ID NO: 199489 - RNA, 22 nt, Human
uuauuuaaaauguagguuggga

SEQ ID NO: 199490 - RNA, 22 nt, Human
uuaacauuguccuuagcagauu

SEQ ID NO: 199491 - RNA, 21 nt, Human
uccugccuggccuucugacua

SEQ ID NO: 199492 - RNA, 17 nt, Human
ugaggcugucucccugg

SEQ ID NO: 199493 - RNA, 22 nt, Human
uuuuuuuuacuccggacagcuc

SEQ ID NO: 199494 - RNA, 22 nt, Human
gaggagggagcuggaagcucuu

SEQ ID NO: 199495 - RNA, 22 nt, Human
ucauacuuuuuugacccuugug

SEQ ID NO: 199496 - RNA, 22 nt, Human
uccaaggacuaaauucuagauu

SEQ ID NO: 199497 - RNA, 19 nt, Human
agcuccucaccucucgcgg

SEQ ID NO: 199498 - RNA, 22 nt, Human
uccagcugugcuccaggaggug

SEQ ID NO: 199499 - RNA, 22 nt, Human
ggcuccaggguaccccuggaug

SEQ ID NO: 199500 - RNA, 22 nt, Human
uucuuuuaauuucugucugcag

SEQ ID NO: 199501 - RNA, 22 nt, Human
gauguuggugcauucacuucug

SEQ ID NO: 199502 - RNA, 22 nt, Human
aaggacaccaaacuaauuggga

SEQ ID NO: 199503 - RNA, 22 nt, Human
uucucuuguaaaauuccuuuuu

SEQ ID NO: 199504 - RNA, 22 nt, Human
acuauauaaugcacacaguaua

SEQ ID NO: 199505 - RNA, 21 nt, Human
guucuuaguuauauucucaau

SEQ ID NO: 199506 - RNA, 22 nt, Human
uaaaugauaguauugaagguag

SEQ ID NO: 199507 - RNA, 22 nt, Human
uacaaaugaucaucucuuugaa

SEQ ID NO: 199508 - RNA, 22 nt, Human
acuuuuccuggguagcuccugg

SEQ ID NO: 199509 - RNA, 22 nt, Human
aagugaggagaccucuucuuca

SEQ ID NO: 199510 - RNA, 22 nt, Human
uccuuuauuuaugggcagugua

SEQ ID NO: 199511 - RNA, 22 nt, Human
gaguucuagauguauuauuaau

SEQ ID NO: 199512 - RNA, 22 nt, Human
aaugcuaaagaagaaggaguag

SEQ ID NO: 199513 - RNA, 22 nt, Human
aauguugaaccuuuuuggccug

SEQ ID NO: 199514 - RNA, 22 nt, Human
guuuuaucuauguaauuauaaa

SEQ ID NO: 199515 - RNA, 22 nt, Human
gugugucucaguugcuccgaag

SEQ ID NO: 199516 - RNA, 22 nt, Human
uucauuuccauuuuauagauaa

SEQ ID NO: 199517 - RNA, 22 nt, Human
uauuuuagccaacagaaugaug

SEQ ID NO: 199518 - RNA, 22 nt, Human
gacauuuauuggauuuuacgag

SEQ ID NO: 199519 - RNA, 22 nt, Human
uuuuccuuaacagagggagaaa

SEQ ID NO: 199520 - RNA, 22 nt, Human
ugagagggagacagcucuagca

SEQ ID NO: 199521 - RNA, 22 nt, Human
ucuuuaucugugagcagucucc

SEQ ID NO: 199522 - RNA, 22 nt, Human
ugcugcacccuucauuuuccca

SEQ ID NO: 199523 - RNA, 22 nt, Human
ugauucacagacuucacaaggc

SEQ ID NO: 199524 - RNA, 22 nt, Human
uaauauauuuuuuaagggaugu

SEQ ID NO: 199525 - RNA, 20 nt, Human
ggcagagcuaugucuguugc

SEQ ID NO: 199526 - RNA, 22 nt, Human
uaccuggauaaauguacaaccg

SEQ ID NO: 199527 - RNA, 22 nt, Human
guuguuuuuguuaaaacaguga

SEQ ID NO: 199528 - RNA, 22 nt, Human
aaccaggcgagagagcggucag

SEQ ID NO: 199529 - RNA, 22 nt, Human
ucacuuccuugcagcuguagaa

SEQ ID NO: 199530 - RNA, 22 nt, Human
uucaugucuuugauucugauaa

SEQ ID NO: 199531 - RNA, 22 nt, Human
ugcagaggagcuggaaggcugg

SEQ ID NO: 199532 - RNA, 22 nt, Human
ccauggaaaagacgggcaggcc

SEQ ID NO: 199533 - RNA, 22 nt, Human
gguuuucacgauccucccuuuu

SEQ ID NO: 199534 - RNA, 22 nt, Human
gucucacuucauuuucuuagcc

SEQ ID NO: 199535 - RNA, 22 nt, Human
auuugcauguuuauuucuuaga

SEQ ID NO: 199536 - RNA, 22 nt, Human
ggagccucuaaacaguuaucaa

SEQ ID NO: 199537 - RNA, 21 nt, Human
acauccaggguccucacugcc

SEQ ID NO: 199538 - RNA, 22 nt, Human
agagggagagauuggcaaucag

SEQ ID NO: 199539 - RNA, 22 nt, Human
guaaauaucucacgaaugauuc

SEQ ID NO: 199540 - RNA, 22 nt, Human
acaggcgucgccugcucuugcc

SEQ ID NO: 199541 - RNA, 22 nt, Human
ucuuuuaucuguuguguaacaa

SEQ ID NO: 199542 - RNA, 22 nt, Human
uuggugaugcccaccuuuucau

SEQ ID NO: 199543 - RNA, 22 nt, Human
gcacccagggcaggaagugagg

SEQ ID NO: 199544 - RNA, 22 nt, Human
aaacccaggguuuugucuuccc

SEQ ID NO: 199545 - RNA, 22 nt, Human
guuuuauguuuuauagacacaa

SEQ ID NO: 199546 - RNA, 22 nt, Human
uuuuccuugagucggggcacag

SEQ ID NO: 199547 - RNA, 22 nt, Human
gcugcagggagcuggaaggcuc

SEQ ID NO: 199548 - RNA, 22 nt, Human
ucaguggaacacacagaguggg

SEQ ID NO: 199549 - RNA, 22 nt, Human
aauguaaauaauuguaaaauuu

SEQ ID NO: 199550 - RNA, 22 nt, Human
aaaugcuuuaauugaguucaug

SEQ ID NO: 199551 - RNA, 22 nt, Human
auuuauuuucccucaaguaccu

SEQ ID NO: 199552 - RNA, 22 nt, Human
uuuugaauaauucagaaacagc

SEQ ID NO: 199553 - RNA, 22 nt, Human
uuggaggucucugugguggugg

SEQ ID NO: 199554 - RNA, 22 nt, Human
cuucuuucuuuucuucuucucu

SEQ ID NO: 199555 - RNA, 22 nt, Human
ucccuucccaccccugccuuuu

SEQ ID NO: 199556 - RNA, 22 nt, Human
ggagagcuagugagcuggaggu

SEQ ID NO: 199557 - RNA, 22 nt, Human
gggagggaggagccccggccau

SEQ ID NO: 199558 - RNA, 22 nt, Human
uccauuuacuauucucauaucg

SEQ ID NO: 199559 - RNA, 22 nt, Human
gucuugugaagacggcagaaag

SEQ ID NO: 199560 - RNA, 22 nt, Human
gcugcaggaggugguagggucu

SEQ ID NO: 199561 - RNA, 22 nt, Human
gggcugagagcuggaaucugag

SEQ ID NO: 199562 - RNA, 22 nt, Human
cagcccuugcgacacccuggcu

SEQ ID NO: 199563 - RNA, 20 nt, Human
auucuuguuccauuucccag

SEQ ID NO: 199564 - RNA, 22 nt, Human
ggaggccagagaagagccaggc

SEQ ID NO: 199565 - RNA, 22 nt, Human
aauaugaugccaaauugcuaca

SEQ ID NO: 199566 - RNA, 22 nt, Human
agcuccucagauuuggguggcg

SEQ ID NO: 199567 - RNA, 22 nt, Human
guucuucagauuccauuucagu

SEQ ID NO: 199568 - RNA, 22 nt, Human
uuuccuaggaaaugauugaagu

SEQ ID NO: 199569 - RNA, 22 nt, Human
gaggggaaggguguucaauggg

SEQ ID NO: 199570 - RNA, 22 nt, Human
uauauauaauguguacagguga

SEQ ID NO: 199571 - RNA, 22 nt, Human
uucacugugauugggguggauu

SEQ ID NO: 199572 - RNA, 22 nt, Human
cccauggaaggguuggcccaga

SEQ ID NO: 199573 - RNA, 22 nt, Human
ucacucuuuaucuuuuaugucu

SEQ ID NO: 199574 - RNA, 22 nt, Human
cuccuuuuccuacucauacuau

SEQ ID NO: 199575 - RNA, 22 nt, Human
cauuuugguaauguucguuugc

SEQ ID NO: 199576 - RNA, 22 nt, Human
guucuacaugacacucaacauu

SEQ ID NO: 199577 - RNA, 22 nt, Human
cuaaaccaauauauuuucuucc

SEQ ID NO: 199578 - RNA, 22 nt, Human
uacauguggagauaacugaagc

SEQ ID NO: 199579 - RNA, 22 nt, Human
aguuuucugccucuggaugcgu

SEQ ID NO: 199580 - RNA, 20 nt, Human
cuguucucuugccacaugag

SEQ ID NO: 199581 - RNA, 22 nt, Human
uuccuuuucuucuaccacaugu

SEQ ID NO: 199582 - RNA, 22 nt, Human
auccuccuggggcagucuuccc

SEQ ID NO: 199583 - RNA, 22 nt, Human
uaaaugaaaggguuuaauuuau

SEQ ID NO: 199584 - RNA, 22 nt, Human
gagggcugccacguugggcgag

SEQ ID NO: 199585 - RNA, 22 nt, Human
aaucauaacaaaagcaauuaua

SEQ ID NO: 199586 - RNA, 22 nt, Human
aggaaauaguuuagucccaaaa

SEQ ID NO: 199587 - RNA, 22 nt, Human
augcugugccuggaaagcggcu

SEQ ID NO: 199588 - RNA, 22 nt, Human
gauauauuucaaauucuuuugc

SEQ ID NO: 199589 - RNA, 22 nt, Human
uuucagaaauggcacugaaauc

SEQ ID NO: 199590 - RNA, 22 nt, Human
gaagaaggaagaucaugcuuga

SEQ ID NO: 199591 - RNA, 22 nt, Human
uuguuauuauuauuuucguucu

SEQ ID NO: 199592 - RNA, 22 nt, Human
aaagcugaaacgaaaugacaac

SEQ ID NO: 199593 - RNA, 22 nt, Human
aagagaggaaagggugugaggu

SEQ ID NO: 199594 - RNA, 22 nt, Human
aauaagaguuaagaaguauauu

SEQ ID NO: 199595 - RNA, 22 nt, Human
guuauuuugucuuguucaugaa

SEQ ID NO: 199596 - RNA, 19 nt, Human
auguuuccauuucuggaua

SEQ ID NO: 199597 - RNA, 19 nt, Human
uccuacaugagacagagag

SEQ ID NO: 199598 - RNA, 22 nt, Human
uuauuguuuggguauaauuuga

SEQ ID NO: 199599 - RNA, 22 nt, Human
uggggcuccuccuggcaggagg

SEQ ID NO: 199600 - RNA, 22 nt, Human
uucuauaagagaugaauacagu

SEQ ID NO: 199601 - RNA, 22 nt, Human
uccuccuggagacuuucucucu

SEQ ID NO: 199602 - RNA, 22 nt, Human
aauucuuuguuccucugccaag

SEQ ID NO: 199603 - RNA, 22 nt, Human
guauauuuaugagcauuagccu

SEQ ID NO: 199604 - RNA, 22 nt, Human
gcuuuggcuucuccuggcagga

SEQ ID NO: 199605 - RNA, 22 nt, Human
uucaaaaugcagaauaguuugg

SEQ ID NO: 199606 - RNA, 22 nt, Human
ugcaggagcccaggaauacuau

SEQ ID NO: 199607 - RNA, 22 nt, Human
cccuguccuucccuccaucuga

SEQ ID NO: 199608 - RNA, 22 nt, Human
uaguuucuucaacugucccagc

SEQ ID NO: 199609 - RNA, 16 nt, Human
gaauuccauugcucug

SEQ ID NO: 199610 - RNA, 22 nt, Human
uugccaggagacaucuggagcc

SEQ ID NO: 199611 - RNA, 22 nt, Human
aggagguagggugugaaacagc

SEQ ID NO: 199612 - RNA, 22 nt, Human
gggggagcuacaggucccuugg

SEQ ID NO: 199613 - RNA, 19 nt, Human
acacaccagugccugugac

SEQ ID NO: 199614 - RNA, 23 nt, Human
ucacugccaagaaaaguuacaga

SEQ ID NO: 199615 - RNA, 22 nt, Human
gagggaggugacaaggacauag

SEQ ID NO: 199616 - RNA, 22 nt, Human
uaguucugaauagcauugaaga

SEQ ID NO: 199617 - RNA, 22 nt, Human
auucuucauguugaagcuguca

SEQ ID NO: 199618 - RNA, 22 nt, Human
gaaagugaauguaacauguuau

SEQ ID NO: 199619 - RNA, 22 nt, Human
uccuuccucuuucaaauuuguu

SEQ ID NO: 199620 - RNA, 21 nt, Human
gggagugaguaaugauggggg

SEQ ID NO: 199621 - RNA, 21 nt, Human
auuauagugacuaaauugaua

SEQ ID NO: 199622 - RNA, 22 nt, Human
uucauggauuugugaaauuuag

SEQ ID NO: 199623 - RNA, 22 nt, Human
guuuguuugccagcuuaguaaa

SEQ ID NO: 199624 - RNA, 22 nt, Human
gcacuguauuuaaauauuuaaa

SEQ ID NO: 199625 - RNA, 22 nt, Human
auagagcuggggaagaagcugg

SEQ ID NO: 199626 - RNA, 22 nt, Human
aaauauauccuucuguccugcc

SEQ ID NO: 199627 - RNA, 22 nt, Human
uucucuugccuucucuuuuauc

SEQ ID NO: 199628 - RNA, 22 nt, Human
caggggcuccaggugagccugg

SEQ ID NO: 199629 - RNA, 22 nt, Human
ugagggaguguggauacaguag

SEQ ID NO: 199630 - RNA, 20 nt, Human
gaauucugaagauaauuugg

SEQ ID NO: 199631 - RNA, 22 nt, Human
gaggggaaggauuucuucagaa

SEQ ID NO: 199632 - RNA, 22 nt, Human
uccucccugcacucagugaagu

SEQ ID NO: 199633 - RNA, 22 nt, Human
agauggaguccugaagccagaa

SEQ ID NO: 199634 - RNA, 22 nt, Human
ugcugcacuuauggcucugagg

SEQ ID NO: 199635 - RNA, 22 nt, Human
ggggcaucguugauugcauggu

SEQ ID NO: 199636 - RNA, 22 nt, Human
uuuauguuuguuuuugaaauaa

SEQ ID NO: 199637 - RNA, 22 nt, Human
uuuuugaauaagugcaucauca

SEQ ID NO: 199638 - RNA, 23 nt, Human
acaaguguuuccaauauggcugg

SEQ ID NO: 199639 - RNA, 22 nt, Human
ggcugcuauuggucuggcuugg

SEQ ID NO: 199640 - RNA, 22 nt, Human
acuggagcccguggaggcgcag

SEQ ID NO: 199641 - RNA, 18 nt, Human
uucucucuggauaguagu

SEQ ID NO: 199642 - RNA, 22 nt, Human
uuuucaauuuucauuugcaaga

SEQ ID NO: 199643 - RNA, 22 nt, Human
aguuucuugaagacugauguuu

SEQ ID NO: 199644 - RNA, 22 nt, Human
uuacuuuuuucccccuuagaug

SEQ ID NO: 199645 - RNA, 22 nt, Human
uggcucagcgcggccuggucuu

SEQ ID NO: 199646 - RNA, 22 nt, Human
ggagacagugacuuagagacug

SEQ ID NO: 199647 - RNA, 22 nt, Human
gcagagcugucuaagucacuuc

SEQ ID NO: 199648 - RNA, 22 nt, Human
agcggccucgcugccugcucag

SEQ ID NO: 199649 - RNA, 18 nt, Human
uucaggcucuugcaugaa

SEQ ID NO: 199650 - RNA, 22 nt, Human
uaaaacuaugcaaccuacuacc

SEQ ID NO: 199651 - RNA, 22 nt, Human
ugaaaaauauuuuuagaaauaa

SEQ ID NO: 199652 - RNA, 22 nt, Human
ggagugaguauguucugaugca

SEQ ID NO: 199653 - RNA, 22 nt, Human
cggggcucugcacaggccagga

SEQ ID NO: 199654 - RNA, 22 nt, Human
cugguacuggaggaguucagag

SEQ ID NO: 199655 - RNA, 22 nt, Human
cguggccacaguggagcugagc

SEQ ID NO: 199656 - RNA, 22 nt, Human
cuuuuuaaaguaaauggcuaga

SEQ ID NO: 199657 - RNA, 19 nt, Human
aacaaaauaguucuaguua

SEQ ID NO: 199658 - RNA, 22 nt, Human
aauauuuaaauagaauuacauc

SEQ ID NO: 199659 - RNA, 21 nt, Human
ggccagauucucccauagcug

SEQ ID NO: 199660 - RNA, 22 nt, Human
auuuuguugaaacccuuguugu

SEQ ID NO: 199661 - RNA, 22 nt, Human
ggugaguagaaguaguuggcuu

SEQ ID NO: 199662 - RNA, 22 nt, Human
uuccuaauugccaugaaguuau

SEQ ID NO: 199663 - RNA, 18 nt, Human
guucaagcauuuugcucu

SEQ ID NO: 199664 - RNA, 22 nt, Human
ggacuggugaagccuucggaga

SEQ ID NO: 199665 - RNA, 22 nt, Human
guuuuguagucuggagacuguc

SEQ ID NO: 199666 - RNA, 22 nt, Human
uugaaaauuaauagguguacaa

SEQ ID NO: 199667 - RNA, 22 nt, Human
uguacauacauagauauacaca

SEQ ID NO: 199668 - RNA, 22 nt, Human
ggcuguggcagcuggaaguggu

SEQ ID NO: 199669 - RNA, 22 nt, Human
uggcucaggccuacgacgccuu

SEQ ID NO: 199670 - RNA, 22 nt, Human
ugugucuuuggcgaugucugga

SEQ ID NO: 199671 - RNA, 22 nt, Human
uuuuaaauggcuuuuacuuuuc

SEQ ID NO: 199672 - RNA, 22 nt, Human
auauauguauauaugugugugu

SEQ ID NO: 199673 - RNA, 22 nt, Human
ccagucuuggugucuguagcac

SEQ ID NO: 199674 - RNA, 22 nt, Human
uuauuuaagaucuuaauauaua

SEQ ID NO: 199675 - RNA, 22 nt, Human
cuucuuuuggggaugaaaaugg

SEQ ID NO: 199676 - RNA, 22 nt, Human
gaggccagcacccagaugcaug

SEQ ID NO: 199677 - RNA, 22 nt, Human
ggagauggucacagguaaacau

SEQ ID NO: 199678 - RNA, 22 nt, Human
ucuggcaguugccgcuucaguc

SEQ ID NO: 199679 - RNA, 22 nt, Human
gagggugguggcggccggcacc

SEQ ID NO: 199680 - RNA, 22 nt, Human
acauauaugugcauacaacuau

SEQ ID NO: 199681 - RNA, 22 nt, Human
gaggcuugccacuguccauggc

SEQ ID NO: 199682 - RNA, 22 nt, Human
uacauuugauuuuugcuucuuu

SEQ ID NO: 199683 - RNA, 22 nt, Human
auggaggugagccccccauccu

SEQ ID NO: 199684 - RNA, 22 nt, Human
ucucucugcuguccagcguuau

SEQ ID NO: 199685 - RNA, 22 nt, Human
ugcacacaguucucaggaaaga

SEQ ID NO: 199686 - RNA, 22 nt, Human
caagggcagaggcagggccccg

SEQ ID NO: 199687 - RNA, 22 nt, Human
uucuucuuuccuauaauuaauu

SEQ ID NO: 199688 - RNA, 22 nt, Human
cugcccgcaugcaggaaugcug

SEQ ID NO: 199689 - RNA, 23 nt, Human
agagggaagagcuuagaugggga

SEQ ID NO: 199690 - RNA, 22 nt, Human
agggcucacuacaacccuggga

SEQ ID NO: 199691 - RNA, 22 nt, Human
ggaggccgugcugugcugccag

SEQ ID NO: 199692 - RNA, 22 nt, Human
gaggcaggcggggcccaggugg

SEQ ID NO: 199693 - RNA, 22 nt, Human
gcacaaaagguacuucauguag

SEQ ID NO: 199694 - RNA, 22 nt, Human
aagcugcagacccccugucuca

SEQ ID NO: 199695 - RNA, 22 nt, Human
uguuuuuauucuuaauguuuca

SEQ ID NO: 199696 - RNA, 21 nt, Human
uuucauuaguacaucaauuug

SEQ ID NO: 199697 - RNA, 22 nt, Human
ucagucucuggggcuucuguuu

SEQ ID NO: 199698 - RNA, 22 nt, Human
aagggagagggagaagguggga

SEQ ID NO: 199699 - RNA, 22 nt, Human
cagagccagcuguccuuggcau

SEQ ID NO: 199700 - RNA, 22 nt, Human
augugccuuaauauaggcgcug

SEQ ID NO: 199701 - RNA, 22 nt, Human
aaaaggaacaauaugguauuuu

SEQ ID NO: 199702 - RNA, 22 nt, Human
aaauagucagaaaucaacgugc

SEQ ID NO: 199703 - RNA, 22 nt, Human
auucuuuucucuaaaugaugaa

SEQ ID NO: 199704 - RNA, 22 nt, Human
uuaucuuuuaaaaacacuugug

SEQ ID NO: 199705 - RNA, 22 nt, Human
agauaagaacauuaguaagccg

SEQ ID NO: 199706 - RNA, 22 nt, Human
uugauagauuuuagaggcaggc

SEQ ID NO: 199707 - RNA, 22 nt, Human
auuagugguguauuuggcacua

SEQ ID NO: 199708 - RNA, 19 nt, Human
cagagacuguaacacuuuu

SEQ ID NO: 199709 - RNA, 20 nt, Human
cauuccaugcaucuuggucc

SEQ ID NO: 199710 - RNA, 22 nt, Human
uuuucauuguuaguuucuccuu

SEQ ID NO: 199711 - RNA, 22 nt, Human
gaaggaaaagacgugcuaagua

SEQ ID NO: 199712 - RNA, 22 nt, Human
ccaaggcuguggggcugugcag

SEQ ID NO: 199713 - RNA, 22 nt, Human
uuuuccuucugauacuccauuu

SEQ ID NO: 199714 - RNA, 20 nt, Human
ugcugugugucuacuguggg

SEQ ID NO: 199715 - RNA, 22 nt, Human
ggcuuguccuucugguugucuu

SEQ ID NO: 199716 - RNA, 22 nt, Human
ccugaagaugguugauccccuu

SEQ ID NO: 199717 - RNA, 23 nt, Human
uuucugaguuuuuuaaaagucca

SEQ ID NO: 199718 - RNA, 22 nt, Human
uauuuuuaccuaauuuaugaga

SEQ ID NO: 199719 - RNA, 22 nt, Human
cacauuuuccagaagaaucaga

SEQ ID NO: 199720 - RNA, 22 nt, Human
cucagcgagggaaagaggccgc

SEQ ID NO: 199721 - RNA, 22 nt, Human
uuagaaauguccuacuaauaug

SEQ ID NO: 199722 - RNA, 22 nt, Human
cucagaagaacaaaggcucuac

SEQ ID NO: 199723 - RNA, 22 nt, Human
gcuuucacugcaauagaugaau

SEQ ID NO: 199724 - RNA, 22 nt, Human
ugggggagggagaguugauggg

SEQ ID NO: 199725 - RNA, 22 nt, Human
agucugugguccucuguaucuc

SEQ ID NO: 199726 - RNA, 22 nt, Human
uuaggggcuuaggcagaguuug

SEQ ID NO: 199727 - RNA, 22 nt, Human
ucuuucugaugggaagggucaa

SEQ ID NO: 199728 - RNA, 22 nt, Human
uuuuccuuccugucucuuuauu

SEQ ID NO: 199729 - RNA, 22 nt, Human
agggaagaggaccagagucucu

SEQ ID NO: 199730 - RNA, 22 nt, Human
caggaacagcaccaggagcuag

SEQ ID NO: 199731 - RNA, 22 nt, Human
gggggcagguuccaggccagcu

SEQ ID NO: 199732 - RNA, 21 nt, Human
cuauaaaaaugguucuuugcg

SEQ ID NO: 199733 - RNA, 22 nt, Human
gcuguggagaagcugccuaugg

SEQ ID NO: 199734 - RNA, 22 nt, Human
uuuuuauaagauuuaaaaugua

SEQ ID NO: 199735 - RNA, 22 nt, Human
uggcagccugcgugaaggagcu

SEQ ID NO: 199736 - RNA, 22 nt, Human
uguauuuuuucccugaaauaaa

SEQ ID NO: 199737 - RNA, 22 nt, Human
uggccccauuuuucuggagccu

SEQ ID NO: 199738 - RNA, 22 nt, Human
uggguauauauguugcuacaga

SEQ ID NO: 199739 - RNA, 20 nt, Human
uacaauauucccacuuugcu

SEQ ID NO: 199740 - RNA, 22 nt, Human
ggcuagggagacagagggcaug

SEQ ID NO: 199741 - RNA, 22 nt, Human
aggauagacuucagaaggcaua

SEQ ID NO: 199742 - RNA, 22 nt, Human
uuuuauuuguauguugaaugua

SEQ ID NO: 199743 - RNA, 18 nt, Human
uucuagaggucucaucca

SEQ ID NO: 199744 - RNA, 22 nt, Human
uucuuaaugcauccuguguuca

SEQ ID NO: 199745 - RNA, 22 nt, Human
aagaggcuacagcccugugucu

SEQ ID NO: 199746 - RNA, 21 nt, Human
ggcugcucgugaugaacuuca

SEQ ID NO: 199747 - RNA, 22 nt, Human
guguucucagcacccacuucau

SEQ ID NO: 199748 - RNA, 22 nt, Human
auuuuugguuucaccugcacgc

SEQ ID NO: 199749 - RNA, 22 nt, Human
caguggacacuuccucuacaau

SEQ ID NO: 199750 - RNA, 22 nt, Human
uuauuucauguaaaauuuaugu

SEQ ID NO: 199751 - RNA, 23 nt, Human
uugcuuuugccccaaaagaguua

SEQ ID NO: 199752 - RNA, 22 nt, Human
guuuugaugugauuucucaugu

SEQ ID NO: 199753 - RNA, 22 nt, Human
ugaauucaaacuuuuuaacaag

SEQ ID NO: 199754 - RNA, 22 nt, Human
ugaccucaagcaugcggagggc

SEQ ID NO: 199755 - RNA, 22 nt, Human
gucuccuucauuuacuguuucc

SEQ ID NO: 199756 - RNA, 22 nt, Human
ugcuuggauuuccaaaugguuu

SEQ ID NO: 199757 - RNA, 22 nt, Human
aaauucuuccaggaggaaauac

SEQ ID NO: 199758 - RNA, 22 nt, Human
cuucuuaaaguugucacagcug

SEQ ID NO: 199759 - RNA, 22 nt, Human
gcucagagaaaacuggggcuug

SEQ ID NO: 199760 - RNA, 22 nt, Human
ugaguucugacugagcaugggg

SEQ ID NO: 199761 - RNA, 22 nt, Human
uuuuaaaacaugucaaaaugug

SEQ ID NO: 199762 - RNA, 22 nt, Human
augaagguggacagauuuuuuu

SEQ ID NO: 199763 - RNA, 22 nt, Human
acauuccugaagguaaugagaa

SEQ ID NO: 199764 - RNA, 22 nt, Human
uucuuuguccuagcauucuaca

SEQ ID NO: 199765 - RNA, 22 nt, Human
ggaaauauaagcaguuugugug

SEQ ID NO: 199766 - RNA, 22 nt, Human
gggggcugugugcccgcucccc

SEQ ID NO: 199767 - RNA, 22 nt, Human
cacacagcuagugacaggagaa

SEQ ID NO: 199768 - RNA, 22 nt, Human
gccccaggggaggugcccugca

SEQ ID NO: 199769 - RNA, 22 nt, Human
ugcuccucugcaugucugcggc

SEQ ID NO: 199770 - RNA, 22 nt, Human
uuuuuaaaagaugauuuaauga

SEQ ID NO: 199771 - RNA, 22 nt, Human
uaggaagagauuuucacauggc

SEQ ID NO: 199772 - RNA, 22 nt, Human
aaaacuuucagggauacagaaa

SEQ ID NO: 199773 - RNA, 22 nt, Human
ugagauguaauguaguacuuug

SEQ ID NO: 199774 - RNA, 22 nt, Human
uuuugccuauuguaucaucgua

SEQ ID NO: 199775 - RNA, 22 nt, Human
uucuucuucuuccucauccuca

SEQ ID NO: 199776 - RNA, 22 nt, Human
agagaaauguacuagucuaacu

SEQ ID NO: 199777 - RNA, 19 nt, Human
uuccuuucuauccugggua

SEQ ID NO: 199778 - RNA, 22 nt, Human
cugcugugcagacagacucucu

SEQ ID NO: 199779 - RNA, 22 nt, Human
uucuugugugaauauaauuaca

SEQ ID NO: 199780 - RNA, 22 nt, Human
uggaagaucugguguagcuccu

SEQ ID NO: 199781 - RNA, 22 nt, Human
agucaccuacagcucaugcuuc

SEQ ID NO: 199782 - RNA, 22 nt, Human
auguuccaugacuaugcaugaa

SEQ ID NO: 199783 - RNA, 22 nt, Human
gauuuuaaaagauguauaaggu

SEQ ID NO: 199784 - RNA, 22 nt, Human
agauauucugccuaacagguuu

SEQ ID NO: 199785 - RNA, 22 nt, Human
agucacuguucugucaugucaa

SEQ ID NO: 199786 - RNA, 22 nt, Human
ggcugggagguggcgaggaggc

SEQ ID NO: 199787 - RNA, 22 nt, Human
gggggacagugugccuggugug

SEQ ID NO: 199788 - RNA, 22 nt, Human
ugguucuagaugagaugaugag

SEQ ID NO: 199789 - RNA, 22 nt, Human
gaggugauuccucccauguaau

SEQ ID NO: 199790 - RNA, 22 nt, Human
ucuugccuuuucuagcuucuag

SEQ ID NO: 199791 - RNA, 22 nt, Human
gaggcucagagggacuuucaag

SEQ ID NO: 199792 - RNA, 22 nt, Human
uccuuucaaauuuauuugacau

SEQ ID NO: 199793 - RNA, 22 nt, Human
agccagugucgugugacaugag

SEQ ID NO: 199794 - RNA, 22 nt, Human
ucccaaaacuugaagcaagccu

SEQ ID NO: 199795 - RNA, 22 nt, Human
cuucucuuggguguggugucuu

SEQ ID NO: 199796 - RNA, 22 nt, Human
ggcucccccauggcugacagac

SEQ ID NO: 199797 - RNA, 18 nt, Human
uauuuacuguguguuacc

SEQ ID NO: 199798 - RNA, 22 nt, Human
uuccuuuuuaauuaaucuaauu

SEQ ID NO: 199799 - RNA, 17 nt, Human
uuagagcuacauguuga

SEQ ID NO: 199800 - RNA, 22 nt, Human
augcaaaaucuuauuuuuucua

SEQ ID NO: 199801 - RNA, 21 nt, Human
ugccuggccuuugcuuuuccu

SEQ ID NO: 199802 - RNA, 22 nt, Human
uuuuaaaagguugcuguuauaa

SEQ ID NO: 199803 - RNA, 17 nt, Human
uuuguuucauacuucau

SEQ ID NO: 199804 - RNA, 22 nt, Human
gccagggcucgagcaggccagc

SEQ ID NO: 199805 - RNA, 22 nt, Human
ggggaggguuuggaugagaguc

SEQ ID NO: 199806 - RNA, 22 nt, Human
guucaaucucucaugcauuuuc

SEQ ID NO: 199807 - RNA, 22 nt, Human
uuauuuuauaaagagaagacuu

SEQ ID NO: 199808 - RNA, 22 nt, Human
aaacuuuugaaggaggaaaaag

SEQ ID NO: 199809 - RNA, 23 nt, Human
uucuuuccuuaucccauuuacuu

SEQ ID NO: 199810 - RNA, 22 nt, Human
aagaaauagauagaggaauacu

SEQ ID NO: 199811 - RNA, 22 nt, Human
uauuuucucugccacacuucca

SEQ ID NO: 199812 - RNA, 22 nt, Human
ucccuguggauuaaggagaugu

SEQ ID NO: 199813 - RNA, 22 nt, Human
ucuccaggaaagacacuggacu

SEQ ID NO: 199814 - RNA, 22 nt, Human
cuguccauuuucgugccuccuu

SEQ ID NO: 199815 - RNA, 20 nt, Human
cuccuccccucggccccacc

SEQ ID NO: 199816 - RNA, 22 nt, Human
gugucacuuucaggagcucuaa

SEQ ID NO: 199817 - RNA, 22 nt, Human
ggaagcuguugugagugcagca

SEQ ID NO: 199818 - RNA, 22 nt, Human
gugcugggaggcccaggaugga

SEQ ID NO: 199819 - RNA, 22 nt, Human
cagguggauggcgagcccugca

SEQ ID NO: 199820 - RNA, 22 nt, Human
ucucugaccuccaccccaggag

SEQ ID NO: 199821 - RNA, 22 nt, Human
gugaaaaauggccaucaggaca

SEQ ID NO: 199822 - RNA, 22 nt, Human
uuuuacaaugcaaauucuugcu

SEQ ID NO: 199823 - RNA, 22 nt, Human
ggggcucauuugcaggggggag

SEQ ID NO: 199824 - RNA, 22 nt, Human
ugguccuuuccauuggagacac

SEQ ID NO: 199825 - RNA, 22 nt, Human
uggacacugguggauauggaau

SEQ ID NO: 199826 - RNA, 22 nt, Human
ccaggaguccgugggucuugag

SEQ ID NO: 199827 - RNA, 22 nt, Human
gacacugccaagugccccgaga

SEQ ID NO: 199828 - RNA, 22 nt, Human
gcuucucacccuuacuaucucu

SEQ ID NO: 199829 - RNA, 22 nt, Human
gccugccucugacuggggcuga

SEQ ID NO: 199830 - RNA, 22 nt, Human
uacuuuaauugcaaaaauaaau

SEQ ID NO: 199831 - RNA, 22 nt, Human
ccuuucuaacagauuguggauc

SEQ ID NO: 199832 - RNA, 19 nt, Human
ugccuggcaccagcuccac

SEQ ID NO: 199833 - RNA, 22 nt, Human
aaauguauuagccuaugugaga

SEQ ID NO: 199834 - RNA, 22 nt, Human
gaggagcuucagaggaaucuua

SEQ ID NO: 199835 - RNA, 21 nt, Human
uaagcuaaacauucaguuaac

SEQ ID NO: 199836 - RNA, 22 nt, Human
uuaagagaagaguaucuagaac

SEQ ID NO: 199837 - RNA, 22 nt, Human
uauauaauacacaaauauguac

SEQ ID NO: 199838 - RNA, 22 nt, Human
uguccuuucagagcuccuuuug

SEQ ID NO: 199839 - RNA, 22 nt, Human
aggguggaggacaggccaguga

SEQ ID NO: 199840 - RNA, 22 nt, Human
uaguuccucuucucagggccau

SEQ ID NO: 199841 - RNA, 22 nt, Human
ugucccaucacagaggagacua

SEQ ID NO: 199842 - RNA, 22 nt, Human
cuccuugguuccggcguuggag

SEQ ID NO: 199843 - RNA, 22 nt, Human
augccugcugucaggaacucuu

SEQ ID NO: 199844 - RNA, 23 nt, Human
cagagaaaauagaauaugcugug

SEQ ID NO: 199845 - RNA, 22 nt, Human
aagagaaaugcuuuaacuuuau

SEQ ID NO: 199846 - RNA, 22 nt, Human
uguugaaacagcuauugacuuu

SEQ ID NO: 199847 - RNA, 22 nt, Human
uacauuccagaaaguuucugua

SEQ ID NO: 199848 - RNA, 22 nt, Human
uucugggguaagcacugaggau

SEQ ID NO: 199849 - RNA, 22 nt, Human
aagccucaugccagauccaggu

SEQ ID NO: 199850 - RNA, 22 nt, Human
guuuccaggcuuugguaugguu

SEQ ID NO: 199851 - RNA, 22 nt, Human
auuuuuagucuugcugcaauca

SEQ ID NO: 199852 - RNA, 22 nt, Human
aggcucagcaucugauucauau

SEQ ID NO: 199853 - RNA, 22 nt, Human
uggagcugguucuggggaagcu

SEQ ID NO: 199854 - RNA, 22 nt, Human
uucucugcgcuccggcccaguu

SEQ ID NO: 199855 - RNA, 20 nt, Human
uaguggaccuugaaggccuc

SEQ ID NO: 199856 - RNA, 22 nt, Human
gcaggaagauugcagaaggcug

SEQ ID NO: 199857 - RNA, 22 nt, Human
auccugugggguauugcugcau

SEQ ID NO: 199858 - RNA, 21 nt, Human
cuuugccuccagcagccgcag

SEQ ID NO: 199859 - RNA, 22 nt, Human
aaggccuaggaguugacauggg

SEQ ID NO: 199860 - RNA, 22 nt, Human
uugucaggaacuaugauuaugc

SEQ ID NO: 199861 - RNA, 22 nt, Human
auucuguaggcuuuuguuaaaa

SEQ ID NO: 199862 - RNA, 22 nt, Human
cuccucccagcccaggcgccac

SEQ ID NO: 199863 - RNA, 22 nt, Human
accuccauggcccacaucuagu

SEQ ID NO: 199864 - RNA, 22 nt, Human
aggggaggggaguaucaggauu

SEQ ID NO: 199865 - RNA, 22 nt, Human
aucuuuguaaguaaucaaagcu

SEQ ID NO: 199866 - RNA, 22 nt, Human
agugaaauaugcccauugcugu

SEQ ID NO: 199867 - RNA, 22 nt, Human
gugccugcucauucucaauauu

SEQ ID NO: 199868 - RNA, 22 nt, Human
ccagggcuggaccagugcuugg

SEQ ID NO: 199869 - RNA, 22 nt, Human
auuuuagagaaacaaacguagg

SEQ ID NO: 199870 - RNA, 20 nt, Human
uggguucaguuguuucuggc

SEQ ID NO: 199871 - RNA, 22 nt, Human
agauggggccugaggacacugu

SEQ ID NO: 199872 - RNA, 20 nt, Human
cucuuucugcuuuaugccuc

SEQ ID NO: 199873 - RNA, 22 nt, Human
uauuaaaagagaaaaagccacc

SEQ ID NO: 199874 - RNA, 22 nt, Human
aggugagaacguggaggggcgg

SEQ ID NO: 199875 - RNA, 22 nt, Human
agugccaucuuuaacuguccca

SEQ ID NO: 199876 - RNA, 20 nt, Human
agcauucaacuuucuauguu

SEQ ID NO: 199877 - RNA, 22 nt, Human
guucucuuaauccuaguuggua

SEQ ID NO: 199878 - RNA, 18 nt, Human
acaaaaauagugcuuugg

SEQ ID NO: 199879 - RNA, 23 nt, Human
aggcugcagaagaauagggucau

SEQ ID NO: 199880 - RNA, 20 nt, Human
uucucugcagcaggcggccc

SEQ ID NO: 199881 - RNA, 22 nt, Human
ccuaggcuggcugucuucaggu

SEQ ID NO: 199882 - RNA, 22 nt, Human
ugaaauuuuuuggagauaauuu

SEQ ID NO: 199883 - RNA, 22 nt, Human
gcucagcuggagagggacgggu

SEQ ID NO: 199884 - RNA, 22 nt, Human
agcuugagauaauucaagcuga

SEQ ID NO: 199885 - RNA, 22 nt, Human
cagcucugcugggaggaugcag

SEQ ID NO: 199886 - RNA, 22 nt, Human
ugaauuuuggcaauuuucugug

SEQ ID NO: 199887 - RNA, 22 nt, Human
uuuuuaaaauuaggacggcacg

SEQ ID NO: 199888 - RNA, 22 nt, Human
ucagcucacaauguugagaaag

SEQ ID NO: 199889 - RNA, 22 nt, Human
uaguauuuguaauuaucaaagc

SEQ ID NO: 199890 - RNA, 22 nt, Human
auuaaaaaaagauaaugaguua

SEQ ID NO: 199891 - RNA, 18 nt, Human
ggccucagccuggccgga

SEQ ID NO: 199892 - RNA, 22 nt, Human
uacagaccaguaguucucagcg

SEQ ID NO: 199893 - RNA, 22 nt, Human
uuuacuuuugguaaggucauuu

SEQ ID NO: 199894 - RNA, 23 nt, Human
cuuauauaaucauuagaaaccau

SEQ ID NO: 199895 - RNA, 22 nt, Human
cuccagagagaaaggaggccgc

SEQ ID NO: 199896 - RNA, 22 nt, Human
ggauggugauguacccagucau

SEQ ID NO: 199897 - RNA, 22 nt, Human
agagaacaggcagcuggugccg

SEQ ID NO: 199898 - RNA, 22 nt, Human
aagcucagcugguggugauugc

SEQ ID NO: 199899 - RNA, 22 nt, Human
auuuuuuuggucauaugagaua

SEQ ID NO: 199900 - RNA, 22 nt, Human
uggagagcaaugaggggcaggc

SEQ ID NO: 199901 - RNA, 22 nt, Human
cuuacauuuguuuaguguuucc

SEQ ID NO: 199902 - RNA, 23 nt, Human
uggaaguugagagucugcuuugu

SEQ ID NO: 199903 - RNA, 19 nt, Human
ucuuugcuuuucuaagagg

SEQ ID NO: 199904 - RNA, 22 nt, Human
uuggugauguagcagcaauugu

SEQ ID NO: 199905 - RNA, 22 nt, Human
auguaugagagauucuuuuauu

SEQ ID NO: 199906 - RNA, 22 nt, Human
uguuggaaucuucuagucuucc

SEQ ID NO: 199907 - RNA, 22 nt, Human
ggaggaagagaccagggggcuu

SEQ ID NO: 199908 - RNA, 22 nt, Human
gugguuuagccuucauuaaccu

SEQ ID NO: 199909 - RNA, 22 nt, Human
gaaacauuuguugaguacuugc

SEQ ID NO: 199910 - RNA, 22 nt, Human
ccuuuccucuucaugacuuucu

SEQ ID NO: 199911 - RNA, 22 nt, Human
guguuggugagcucauuuccac

SEQ ID NO: 199912 - RNA, 22 nt, Human
agguuuuugucauuuucuggua

SEQ ID NO: 199913 - RNA, 22 nt, Human
aaauguuugguggauaaaagga

SEQ ID NO: 199914 - RNA, 22 nt, Human
uaauaaaaauuuaauucacauu

SEQ ID NO: 199915 - RNA, 22 nt, Human
guggguauauauaugugugcug

SEQ ID NO: 199916 - RNA, 22 nt, Human
uauuaauugugguuauuguauu

SEQ ID NO: 199917 - RNA, 20 nt, Human
ucaucuuucaaauuugugac

SEQ ID NO: 199918 - RNA, 18 nt, Human
cccagaggaaugccugga

SEQ ID NO: 199919 - RNA, 17 nt, Human
ccacuagauagguugug

SEQ ID NO: 199920 - RNA, 22 nt, Human
cuguguguauaauguuugauaa

SEQ ID NO: 199921 - RNA, 22 nt, Human
gagaaaaauuucuuugcugcac

SEQ ID NO: 199922 - RNA, 20 nt, Human
acacagccuagaguuuggcu

SEQ ID NO: 199923 - RNA, 22 nt, Human
aagaugaguuacaaaggaguaa

SEQ ID NO: 199924 - RNA, 22 nt, Human
gaguggccugccccagccaggc

SEQ ID NO: 199925 - RNA, 18 nt, Human
aggcuggggaucacaggg

SEQ ID NO: 199926 - RNA, 19 nt, Human
uagaggagaauggcaaaga

SEQ ID NO: 199927 - RNA, 22 nt, Human
ccucaggaauuuauucuucugu

SEQ ID NO: 199928 - RNA, 22 nt, Human
cuccacagccccuccaguggca

SEQ ID NO: 199929 - RNA, 22 nt, Human
cucuuucauucuguccuuguuu

SEQ ID NO: 199930 - RNA, 20 nt, Human
uucacagaucucuaacugag

SEQ ID NO: 199931 - RNA, 22 nt, Human
ggggaggugugcaggacaccuc

SEQ ID NO: 199932 - RNA, 22 nt, Human
cucacugucagcugcagggcuu

SEQ ID NO: 199933 - RNA, 22 nt, Human
cucuugugucaccauggauaaa

SEQ ID NO: 199934 - RNA, 22 nt, Human
agcaagggucucucauggcuug

SEQ ID NO: 199935 - RNA, 22 nt, Human
auaaaucaagggcaguauuucc

SEQ ID NO: 199936 - RNA, 20 nt, Human
uuccuuucuuucuuuuuuuu

SEQ ID NO: 199937 - RNA, 23 nt, Human
aaguggugacugugcuacugaga

SEQ ID NO: 199938 - RNA, 22 nt, Human
ucccaaguguuuggcgaggaga

SEQ ID NO: 199939 - RNA, 22 nt, Human
agguggcuaugaggaugcaguc

SEQ ID NO: 199940 - RNA, 22 nt, Human
uuuguacuuucuaauguauuua

SEQ ID NO: 199941 - RNA, 22 nt, Human
auaaaguaaugcauauaaugug

SEQ ID NO: 199942 - RNA, 22 nt, Human
cagagcugucauuugccaguga

SEQ ID NO: 199943 - RNA, 21 nt, Human
agaugaggauacugaggccua

SEQ ID NO: 199944 - RNA, 22 nt, Human
auaguaaauguuaacagcaaca

SEQ ID NO: 199945 - RNA, 20 nt, Human
ccuuguggaugucuuuuuug

SEQ ID NO: 199946 - RNA, 22 nt, Human
ucucuagaggaauuguucuagg

SEQ ID NO: 199947 - RNA, 22 nt, Human
augaaaacgugugugugugugu

SEQ ID NO: 199948 - RNA, 22 nt, Human
guguucuuuguagaggaucuug

SEQ ID NO: 199949 - RNA, 22 nt, Human
aaaguaaagccuauuuaauaau

SEQ ID NO: 199950 - RNA, 22 nt, Human
ugugaagaauuaaugugaauca

SEQ ID NO: 199951 - RNA, 22 nt, Human
cagaaguugcuugagagagagc

SEQ ID NO: 199952 - RNA, 22 nt, Human
ccaggcucaccuggagccccug

SEQ ID NO: 199953 - RNA, 22 nt, Human
cuguggcugcgcccugggggag

SEQ ID NO: 199954 - RNA, 22 nt, Human
gcugucccccaaagaugcuccu

SEQ ID NO: 199955 - RNA, 22 nt, Human
ggugucuuugauguugggcuga

SEQ ID NO: 199956 - RNA, 22 nt, Human
agggagucuggccgucggcugg

SEQ ID NO: 199957 - RNA, 22 nt, Human
uggggcauacgugaaauaauuu

SEQ ID NO: 199958 - RNA, 20 nt, Human
agagaacaguuuggucacag

SEQ ID NO: 199959 - RNA, 22 nt, Human
acagacuuuuagacuuaugagu

SEQ ID NO: 199960 - RNA, 17 nt, Human
ucuguguccgcucaguc

SEQ ID NO: 199961 - RNA, 22 nt, Human
uuuucacugacuuggucuggaa

SEQ ID NO: 199962 - RNA, 22 nt, Human
uuucuugugauuuugaugaacu

SEQ ID NO: 199963 - RNA, 22 nt, Human
uuauuuuuaggaauguagaggu

SEQ ID NO: 199964 - RNA, 22 nt, Human
ccaaccaguuucuuggcuuuag

SEQ ID NO: 199965 - RNA, 22 nt, Human
uucuccaccugcuccucccacc

SEQ ID NO: 199966 - RNA, 21 nt, Human
uggcaggcagcuggaagcuug

SEQ ID NO: 199967 - RNA, 21 nt, Human
aggugaaggcgagggggacag

SEQ ID NO: 199968 - RNA, 22 nt, Human
uucugcuagugguauauguuga

SEQ ID NO: 199969 - RNA, 22 nt, Human
aauuaaauguuugguuugagcu

SEQ ID NO: 199970 - RNA, 22 nt, Human
cugguuuauuucauaguuuguu

SEQ ID NO: 199971 - RNA, 22 nt, Human
ggugcuucgauagguguccaua

SEQ ID NO: 199972 - RNA, 22 nt, Human
agggcugcugcuccgggcccag

SEQ ID NO: 199973 - RNA, 22 nt, Human
uguuuucuuuccccuucuuuuc

SEQ ID NO: 199974 - RNA, 22 nt, Human
uggggggacagauggagaggac

SEQ ID NO: 199975 - RNA, 22 nt, Human
aagagggguggucugugaggau

SEQ ID NO: 199976 - RNA, 22 nt, Human
agguggucccaauggcugggca

SEQ ID NO: 199977 - RNA, 22 nt, Human
ggcagucuuucccuugagcucu

SEQ ID NO: 199978 - RNA, 22 nt, Human
ugcauucugaacguaaauguga

SEQ ID NO: 199979 - RNA, 20 nt, Human
agaaggagagaugaggcaaa

SEQ ID NO: 199980 - RNA, 22 nt, Human
aagcauuuuagauaaagcauca

SEQ ID NO: 199981 - RNA, 22 nt, Human
ugcagcagaauauggcugcagg

SEQ ID NO: 199982 - RNA, 22 nt, Human
ucacccagacugucugacucuu

SEQ ID NO: 199983 - RNA, 22 nt, Human
ccauuucacaucccugacaugu

SEQ ID NO: 199984 - RNA, 22 nt, Human
agggaggagggacagaaagagg

SEQ ID NO: 199985 - RNA, 22 nt, Human
gagggagugggcccgugggcac

SEQ ID NO: 199986 - RNA, 22 nt, Human
uuauuuuguagcucugaucuuu

SEQ ID NO: 199987 - RNA, 22 nt, Human
uggucuuuccuucauuguccag

SEQ ID NO: 199988 - RNA, 22 nt, Human
ggcucccgugggaugguggagc

SEQ ID NO: 199989 - RNA, 22 nt, Human
augauuauuugaaugaagagga

SEQ ID NO: 199990 - RNA, 22 nt, Human
uaagggagcagaagcugugaaa

SEQ ID NO: 199991 - RNA, 22 nt, Human
aauaauuuuuuugugauuaugu

SEQ ID NO: 199992 - RNA, 22 nt, Human
gccugggguuugcggggcugca

SEQ ID NO: 199993 - RNA, 22 nt, Human
ggcagguggcacugcugcuccc

SEQ ID NO: 199994 - RNA, 22 nt, Human
uggugccuuccgagagcuguga

SEQ ID NO: 199995 - RNA, 22 nt, Human
cugaaagacagccaggcaaagc

SEQ ID NO: 199996 - RNA, 23 nt, Human
ucucacucauucuccucugucca

SEQ ID NO: 199997 - RNA, 22 nt, Human
uuauauuuuauuuaauuaaaua

SEQ ID NO: 199998 - RNA, 20 nt, Human
ucucuuuuucuucuuuucuc

SEQ ID NO: 199999 - RNA, 22 nt, Human
aaauauagugacacuuauaguc

SEQ ID NO: 200000 - RNA, 22 nt, Human
agggcaguuaugaaugucucca

SEQ ID NO: 200001 - RNA, 22 nt, Human
ugugugcuaguuuugucaguau

SEQ ID NO: 200002 - RNA, 22 nt, Human
auuuauuugaagagccauugca

SEQ ID NO: 200003 - RNA, 22 nt, Human
uaaagugaaguucagaauggcu

SEQ ID NO: 200004 - RNA, 22 nt, Human
agagacuguaaugagagguaca

SEQ ID NO: 200005 - RNA, 22 nt, Human
uuauuuaaguauuuauugaagu

SEQ ID NO: 200006 - RNA, 22 nt, Human
ggcugcagggaacaggaugggu

SEQ ID NO: 200007 - RNA, 22 nt, Human
ugcccacuucaaaaucuucauu

SEQ ID NO: 200008 - RNA, 22 nt, Human
cuuucuuuuugguuucccccca

SEQ ID NO: 200009 - RNA, 20 nt, Human
gacaugagggagcaaagagc

SEQ ID NO: 200010 - RNA, 22 nt, Human
acaugugugucugugugugugu

SEQ ID NO: 200011 - RNA, 22 nt, Human
auuaaauagcagaagaaagaug

SEQ ID NO: 200012 - RNA, 22 nt, Human
aacucaggagagaguaacaggg

SEQ ID NO: 200013 - RNA, 22 nt, Human
cagggacugcaggaggacaggu

SEQ ID NO: 200014 - RNA, 22 nt, Human
ugaaguuuagaaaaagugccuu

SEQ ID NO: 200015 - RNA, 22 nt, Human
gaggggacugucuggcuccgag

SEQ ID NO: 200016 - RNA, 22 nt, Human
uaauauaacugccaguuaaggu

SEQ ID NO: 200017 - RNA, 22 nt, Human
ugagggaggggaaugugugcag

SEQ ID NO: 200018 - RNA, 22 nt, Human
ucaccauguacaugaagggcgg

SEQ ID NO: 200019 - RNA, 22 nt, Human
cacagcuggggaagcugaggcc

SEQ ID NO: 200020 - RNA, 22 nt, Human
uuuuuugucuugaagaaauggu

SEQ ID NO: 200021 - RNA, 22 nt, Human
cuucucuuccuucucauccuca

SEQ ID NO: 200022 - RNA, 22 nt, Human
cggcugcagcggagcaggcugg

SEQ ID NO: 200023 - RNA, 22 nt, Human
cggggcuccgaagagcucgguu

SEQ ID NO: 200024 - RNA, 19 nt, Human
acuggggcaggcugggcuu

SEQ ID NO: 200025 - RNA, 22 nt, Human
uagcauuucacugaucuucacu

SEQ ID NO: 200026 - RNA, 22 nt, Human
agucccugauggacuggaugag

SEQ ID NO: 200027 - RNA, 22 nt, Human
agauucucccuccuggcgcugu

SEQ ID NO: 200028 - RNA, 22 nt, Human
agcacagugccugacauauaug

SEQ ID NO: 200029 - RNA, 22 nt, Human
agcaggaaggcuagaagcagga

SEQ ID NO: 200030 - RNA, 21 nt, Human
uccccugugccuggcauacag

SEQ ID NO: 200031 - RNA, 22 nt, Human
uaguuucuaauguugaaauuau

SEQ ID NO: 200032 - RNA, 22 nt, Human
ucuucaugaaauugauugcuua

SEQ ID NO: 200033 - RNA, 22 nt, Human
ucagccuugguuuugguguugg

SEQ ID NO: 200034 - RNA, 22 nt, Human
uaaggaaaugcaaauuuaagaa

SEQ ID NO: 200035 - RNA, 22 nt, Human
uuaccuuggaccggguaucaga

SEQ ID NO: 200036 - RNA, 22 nt, Human
aggcaguguggagggcuguugc

SEQ ID NO: 200037 - RNA, 22 nt, Human
cuccaggacugaggacagagcu

SEQ ID NO: 200038 - RNA, 21 nt, Human
uccugccuuaguccagagcag

SEQ ID NO: 200039 - RNA, 22 nt, Human
ugccuucugccaaggacggugc

SEQ ID NO: 200040 - RNA, 22 nt, Human
ccuccuggaguuacuuccaaaa

SEQ ID NO: 200041 - RNA, 22 nt, Human
aaauuuuguugaaaaauauuuu

SEQ ID NO: 200042 - RNA, 22 nt, Human
gcauaauauugagaaauuauua

SEQ ID NO: 200043 - RNA, 22 nt, Human
auuugccaguuacucacaccac

SEQ ID NO: 200044 - RNA, 23 nt, Human
ucagaccaaccucuugcuggaac

SEQ ID NO: 200045 - RNA, 22 nt, Human
cucuucauguuggugcagaagc

SEQ ID NO: 200046 - RNA, 19 nt, Human
aggaaggggauaaguaaca

SEQ ID NO: 200047 - RNA, 23 nt, Human
uccuccccaccuuuguccccucc

SEQ ID NO: 200048 - RNA, 22 nt, Human
auuaauaucaauauauuauaug

SEQ ID NO: 200049 - RNA, 22 nt, Human
auggagugggaggacaugaagg

SEQ ID NO: 200050 - RNA, 22 nt, Human
aauucuguugguuagaguugga

SEQ ID NO: 200051 - RNA, 20 nt, Human
uuggagaucacguguccagg

SEQ ID NO: 200052 - RNA, 22 nt, Human
uuucuaaaaccagaguuuauaa

SEQ ID NO: 200053 - RNA, 22 nt, Human
cuguuucucugccugcacacau

SEQ ID NO: 200054 - RNA, 22 nt, Human
aguauuuuaaaauacauuaucc

SEQ ID NO: 200055 - RNA, 22 nt, Human
cuuccuuucagaggaaggccug

SEQ ID NO: 200056 - RNA, 22 nt, Human
gggauggggagcuggaaagggg

SEQ ID NO: 200057 - RNA, 22 nt, Human
uuuuuaagguuuguuuauauau

SEQ ID NO: 200058 - RNA, 22 nt, Human
ccaggcuccccaggaggcccuu

SEQ ID NO: 200059 - RNA, 19 nt, Human
ccacacacuggucucuggg

SEQ ID NO: 200060 - RNA, 22 nt, Human
aaaucuuucacauauuuuuuau

SEQ ID NO: 200061 - RNA, 22 nt, Human
gagaugugguucaaggguguuu

SEQ ID NO: 200062 - RNA, 22 nt, Human
uuuucucaguuuuuuucaaaag

SEQ ID NO: 200063 - RNA, 19 nt, Human
augaaauagcauuuucuga

SEQ ID NO: 200064 - RNA, 22 nt, Human
uuuaaucaguugguaauauuga

SEQ ID NO: 200065 - RNA, 22 nt, Human
cacugcacuccagccugggcaa

SEQ ID NO: 200066 - RNA, 22 nt, Human
aaaauacuaggaaaauaaauca

SEQ ID NO: 200067 - RNA, 16 nt, Human
aaguuuuaucuucuca

SEQ ID NO: 200068 - RNA, 22 nt, Human
cuuggggauuuuaaagaccucu

SEQ ID NO: 200069 - RNA, 22 nt, Human
cucuguguguuugugugugugu

SEQ ID NO: 200070 - RNA, 22 nt, Human
aaaauauuuaucuagcucuuaa

SEQ ID NO: 200071 - RNA, 22 nt, Human
gggcagagagcuggaacuccuu

SEQ ID NO: 200072 - RNA, 22 nt, Human
uauuuuuuuaacauuuauugua

SEQ ID NO: 200073 - RNA, 22 nt, Human
guguugaugugucuguauucua

SEQ ID NO: 200074 - RNA, 22 nt, Human
agagacaggguuuugucguguu

SEQ ID NO: 200075 - RNA, 22 nt, Human
uuuguauuguuuauuucauuuu

SEQ ID NO: 200076 - RNA, 22 nt, Human
ugcuuucaaugaauuguauacu

SEQ ID NO: 200077 - RNA, 22 nt, Human
agaugaugugugucuucagcua

SEQ ID NO: 200078 - RNA, 22 nt, Human
agcgcucauuuuccuccugcuc

SEQ ID NO: 200079 - RNA, 21 nt, Human
acuuccacaucacugaguaga

SEQ ID NO: 200080 - RNA, 22 nt, Human
cagcuccaucuugcuuauacca

SEQ ID NO: 200081 - RNA, 22 nt, Human
uagacugugagcuccuugaggg

SEQ ID NO: 200082 - RNA, 22 nt, Human
aaauauuagacauaccuggaga

SEQ ID NO: 200083 - RNA, 22 nt, Human
uauuguuuuaagguguauuaau

SEQ ID NO: 200084 - RNA, 22 nt, Human
aaggucuucgaaccuuauguua

SEQ ID NO: 200085 - RNA, 22 nt, Human
uggaggcccagcugggggccgg

SEQ ID NO: 200086 - RNA, 22 nt, Human
gccuggccaaucgccgucuagg

SEQ ID NO: 200087 - RNA, 20 nt, Human
uuuuuuaaauagagcuguug

SEQ ID NO: 200088 - RNA, 22 nt, Human
cuauguuucagauauauauaua

SEQ ID NO: 200089 - RNA, 22 nt, Human
aaucacuucuuugucuucuuca

SEQ ID NO: 200090 - RNA, 22 nt, Human
acauuuccaaagaugccaguca

SEQ ID NO: 200091 - RNA, 22 nt, Human
aaugcuuuuugcgaaaugugca

SEQ ID NO: 200092 - RNA, 19 nt, Human
caggucuucuuggaggacu

SEQ ID NO: 200093 - RNA, 22 nt, Human
ucuaaagcuccuuccacuaaaa

SEQ ID NO: 200094 - RNA, 23 nt, Human
ccagcugugccuggcccaggagc

SEQ ID NO: 200095 - RNA, 22 nt, Human
caaggaaaugucagaaaggcaa

SEQ ID NO: 200096 - RNA, 22 nt, Human
ucagcuucaucuugagcccaca

SEQ ID NO: 200097 - RNA, 22 nt, Human
uuuaucaggccaucuuaugucu

SEQ ID NO: 200098 - RNA, 22 nt, Human
auauaguacauguauauauaua

SEQ ID NO: 200099 - RNA, 22 nt, Human
uagagaaauuacagcuuucuuu

SEQ ID NO: 200100 - RNA, 22 nt, Human
uugugugugcccaccuguggcc

SEQ ID NO: 200101 - RNA, 22 nt, Human
aaaauauucuauaucaaagaua

SEQ ID NO: 200102 - RNA, 22 nt, Human
aauauuuugggacugaggaauu

SEQ ID NO: 200103 - RNA, 22 nt, Human
uucuagcucauggugacagauc

SEQ ID NO: 200104 - RNA, 23 nt, Human
ucuuuccuuucauacagucagcu

SEQ ID NO: 200105 - RNA, 22 nt, Human
uauuuuuacuguuugaugauuc

SEQ ID NO: 200106 - RNA, 22 nt, Human
uuucauguuggauacuguuuca

SEQ ID NO: 200107 - RNA, 22 nt, Human
ggcugguggcgggcagcacaga

SEQ ID NO: 200108 - RNA, 22 nt, Human
agacuucucuuggcuauauuau

SEQ ID NO: 200109 - RNA, 22 nt, Human
cacauguguaccugccucucug

SEQ ID NO: 200110 - RNA, 22 nt, Human
cauuccaagaaguaguucugca

SEQ ID NO: 200111 - RNA, 22 nt, Human
aaaauaaccuucauuugcauug

SEQ ID NO: 200112 - RNA, 22 nt, Human
aggcaguguguagcuggaagag

SEQ ID NO: 200113 - RNA, 22 nt, Human
uuaaaagaauccuguuauccuc

SEQ ID NO: 200114 - RNA, 22 nt, Human
cucugcuuguaucacauuugcu

SEQ ID NO: 200115 - RNA, 22 nt, Human
gaaaagcucuuuagaagagguu

SEQ ID NO: 200116 - RNA, 22 nt, Human
uggaaauacaagaaguauguca

SEQ ID NO: 200117 - RNA, 21 nt, Human
aaguuuuggcuguacaguugu

SEQ ID NO: 200118 - RNA, 22 nt, Human
cacauuaagcccaagcauagaa

SEQ ID NO: 200119 - RNA, 23 nt, Human
aacugcaagguugcugggaagua

SEQ ID NO: 200120 - RNA, 22 nt, Human
auacaucuuaacgcgcucuugg

SEQ ID NO: 200121 - RNA, 22 nt, Human
uugaaaaaugcccagcagacaa

SEQ ID NO: 200122 - RNA, 22 nt, Human
ccagcaggagacuagcaacaua

SEQ ID NO: 200123 - RNA, 22 nt, Human
guccccugcguguucauccugg

SEQ ID NO: 200124 - RNA, 22 nt, Human
ugccuuuggcuguucugugacc

SEQ ID NO: 200125 - RNA, 22 nt, Human
uugguuuacucuggggauaucu

SEQ ID NO: 200126 - RNA, 22 nt, Human
uauuuguauugucuuaucacuu

SEQ ID NO: 200127 - RNA, 22 nt, Human
ugcucacugcuuguguucaguu

SEQ ID NO: 200128 - RNA, 22 nt, Human
gagugaucuguaggcagcaugg

SEQ ID NO: 200129 - RNA, 22 nt, Human
uuuuuguuauuuagguguagag

SEQ ID NO: 200130 - RNA, 22 nt, Human
uugucuuucguauggaacacua

SEQ ID NO: 200131 - RNA, 22 nt, Human
uucugcuuuaaagcucauguuu

SEQ ID NO: 200132 - RNA, 22 nt, Human
uuuuccuucuuccugccuugcc

SEQ ID NO: 200133 - RNA, 22 nt, Human
auaaaagcacaauagaguuaug

SEQ ID NO: 200134 - RNA, 22 nt, Human
gcuguggaaaaugggucuccaa

SEQ ID NO: 200135 - RNA, 22 nt, Human
ggcagggagagcgccgccaugc

SEQ ID NO: 200136 - RNA, 22 nt, Human
aacacuaaaggucaguuagaag

SEQ ID NO: 200137 - RNA, 22 nt, Human
uaggggguuuuucuagagauug

SEQ ID NO: 200138 - RNA, 22 nt, Human
uuauaucagaaggugagauuga

SEQ ID NO: 200139 - RNA, 22 nt, Human
auuuuacuaugauaguugagaa

SEQ ID NO: 200140 - RNA, 22 nt, Human
auauucaaugaggucauauaag

SEQ ID NO: 200141 - RNA, 22 nt, Human
acaugggggugggacggcagag

SEQ ID NO: 200142 - RNA, 22 nt, Human
ugaggaagugguuguaugguuu

SEQ ID NO: 200143 - RNA, 22 nt, Human
uauuucuagggcaugaaaauaa

SEQ ID NO: 200144 - RNA, 22 nt, Human
uuuugcuucuaguauauuuuuu

SEQ ID NO: 200145 - RNA, 22 nt, Human
agagcuccaggguuuuguagug

SEQ ID NO: 200146 - RNA, 22 nt, Human
cuccaugagccaggagggcuac

SEQ ID NO: 200147 - RNA, 22 nt, Human
gcagaggcugccgugggcagga

SEQ ID NO: 200148 - RNA, 21 nt, Human
auauuguugggguuuucuuuu

SEQ ID NO: 200149 - RNA, 22 nt, Human
uuuauuuacuuucgguucugcu

SEQ ID NO: 200150 - RNA, 22 nt, Human
ugguuuuuuguaggauaaacau

SEQ ID NO: 200151 - RNA, 22 nt, Human
ccugcccaucccaccccagcau

SEQ ID NO: 200152 - RNA, 22 nt, Human
cggugcuuuccauaucagcagc

SEQ ID NO: 200153 - RNA, 22 nt, Human
gcaggggguaaggggcagggcu

SEQ ID NO: 200154 - RNA, 22 nt, Human
ucuugccccugcuuuggaacaa

SEQ ID NO: 200155 - RNA, 22 nt, Human
uccaugauauauaugugcacau

SEQ ID NO: 200156 - RNA, 22 nt, Human
uuuuauaauacccuugacuaau

SEQ ID NO: 200157 - RNA, 22 nt, Human
uuguuauaggaucagugucacu

SEQ ID NO: 200158 - RNA, 22 nt, Human
aggaacaguuucaaagagugaa

SEQ ID NO: 200159 - RNA, 22 nt, Human
ucuucaaauacagucauauuga

SEQ ID NO: 200160 - RNA, 22 nt, Human
aggccccacaaacucgccuuug

SEQ ID NO: 200161 - RNA, 22 nt, Human
ucgagcucagcagggaggugcg

SEQ ID NO: 200162 - RNA, 21 nt, Human
gcagcucaggauauagacuug

SEQ ID NO: 200163 - RNA, 22 nt, Human
ugagguauuuggauuuauauuu

SEQ ID NO: 200164 - RNA, 22 nt, Human
gcaguuugugauguggcaguca

SEQ ID NO: 200165 - RNA, 22 nt, Human
uauauacacgcacauauacaua

SEQ ID NO: 200166 - RNA, 22 nt, Human
ggcagagcugugcgcccaccca

SEQ ID NO: 200167 - RNA, 22 nt, Human
gcagggcucuggagucaggcug

SEQ ID NO: 200168 - RNA, 22 nt, Human
uggaaauagauguaggaaauug

SEQ ID NO: 200169 - RNA, 22 nt, Human
ugcaggagcaccagcucacccu

SEQ ID NO: 200170 - RNA, 22 nt, Human
agugagaguauuaaugugaacu

SEQ ID NO: 200171 - RNA, 20 nt, Human
uuggggacaggagugugaug

SEQ ID NO: 200172 - RNA, 22 nt, Human
ggaaggggagcuggaaagggua

SEQ ID NO: 200173 - RNA, 22 nt, Human
agcacauguuucuuuugcaauu

SEQ ID NO: 200174 - RNA, 22 nt, Human
acuugggaaaugaaaauacaga

SEQ ID NO: 200175 - RNA, 22 nt, Human
cgguuuuuaaaagucucuucua

SEQ ID NO: 200176 - RNA, 22 nt, Human
uggagccuugugagaccacaau

SEQ ID NO: 200177 - RNA, 22 nt, Human
cuccccuuauuccucaacauga

SEQ ID NO: 200178 - RNA, 22 nt, Human
uuuaaaacagcauuuaaaaggu

SEQ ID NO: 200179 - RNA, 22 nt, Human
uccucagcaagacgcuggcagc

SEQ ID NO: 200180 - RNA, 22 nt, Human
acaggaaugaagaugagagagu

SEQ ID NO: 200181 - RNA, 22 nt, Human
aucaaaauguguagucuugauc

SEQ ID NO: 200182 - RNA, 22 nt, Human
agcuuucuauauaugaguugcu

SEQ ID NO: 200183 - RNA, 22 nt, Human
aguuugauuugucuaucuucau

SEQ ID NO: 200184 - RNA, 22 nt, Human
uaugggcaagagauaggugguc

SEQ ID NO: 200185 - RNA, 22 nt, Human
aagcucuuuccacuaaaccacu

SEQ ID NO: 200186 - RNA, 22 nt, Human
gucacuuugcuugcgaugcucc

SEQ ID NO: 200187 - RNA, 22 nt, Human
aauuauguugaaauaugagaac

SEQ ID NO: 200188 - RNA, 22 nt, Human
uaugaggagaacauuccugaac

SEQ ID NO: 200189 - RNA, 23 nt, Human
gucucacaaccaccugagaaaau

SEQ ID NO: 200190 - RNA, 22 nt, Human
uucuaauauuaugauuucuaag

SEQ ID NO: 200191 - RNA, 19 nt, Human
auagcagaagucauuuuca

SEQ ID NO: 200192 - RNA, 22 nt, Human
gcucucuggccugggaggagga

SEQ ID NO: 200193 - RNA, 22 nt, Human
gaggaggcuggagaggccagga

SEQ ID NO: 200194 - RNA, 20 nt, Human
acacaccugcucagacugag

SEQ ID NO: 200195 - RNA, 22 nt, Human
cacaaggagaaauagauauuga

SEQ ID NO: 200196 - RNA, 22 nt, Human
cugggggacagagagaggcggu

SEQ ID NO: 200197 - RNA, 22 nt, Human
uucugugacgcaaagcugggaa

SEQ ID NO: 200198 - RNA, 22 nt, Human
agcagggagacagugcagcauu

SEQ ID NO: 200199 - RNA, 22 nt, Human
ccccauggaaaacccaccuagg

SEQ ID NO: 200200 - RNA, 22 nt, Human
uuuauaauuacguaaaauauuu

SEQ ID NO: 200201 - RNA, 22 nt, Human
ugguugauuaauuuugccaagc

SEQ ID NO: 200202 - RNA, 22 nt, Human
uguaaagugguauuuaauuuua

SEQ ID NO: 200203 - RNA, 22 nt, Human
gaauuccaggugagagaaggua

SEQ ID NO: 200204 - RNA, 22 nt, Human
aaagggagauaaaguaauuuua

SEQ ID NO: 200205 - RNA, 22 nt, Human
gccucucuggcaaagcggugau

SEQ ID NO: 200206 - RNA, 22 nt, Human
gauauuuugugaaaaaacaacu

SEQ ID NO: 200207 - RNA, 22 nt, Human
aaaaacuuaccccagggcaagg

SEQ ID NO: 200208 - RNA, 22 nt, Human
cucuugacagcuuuaguaucau

SEQ ID NO: 200209 - RNA, 22 nt, Human
agauaaacaacucuuagcuguu

SEQ ID NO: 200210 - RNA, 22 nt, Human
cacacaccagaaagccugggac

SEQ ID NO: 200211 - RNA, 22 nt, Human
ggcugcagugcaacucuuucua

SEQ ID NO: 200212 - RNA, 22 nt, Human
aggcaguggagcuggaauaggc

SEQ ID NO: 200213 - RNA, 22 nt, Human
auucauucugaccucaagagaa

SEQ ID NO: 200214 - RNA, 22 nt, Human
acucugcaguaaggaauuguuu

SEQ ID NO: 200215 - RNA, 22 nt, Human
ucugaggacagugcugugccug

SEQ ID NO: 200216 - RNA, 22 nt, Human
uagcauuuauugggcuagcaaa

SEQ ID NO: 200217 - RNA, 22 nt, Human
ggggaaggaaggggagggcacg

SEQ ID NO: 200218 - RNA, 22 nt, Human
agaacauaucuguuuucuaacu

SEQ ID NO: 200219 - RNA, 22 nt, Human
gggaaauagagcuggaaccuug

SEQ ID NO: 200220 - RNA, 22 nt, Human
uuccgcuuucaauggcuuggcu

SEQ ID NO: 200221 - RNA, 22 nt, Human
agugaggggagaaugaggugga

SEQ ID NO: 200222 - RNA, 22 nt, Human
gaauucuaguucuguaucucug

SEQ ID NO: 200223 - RNA, 22 nt, Human
aguaggauguuuagcccuucuu

SEQ ID NO: 200224 - RNA, 22 nt, Human
uguuuuuuagagugauacuuuu

SEQ ID NO: 200225 - RNA, 22 nt, Human
cuggagaacucugugcuucacu

SEQ ID NO: 200226 - RNA, 22 nt, Human
aucguuaugauagagaaagaga

SEQ ID NO: 200227 - RNA, 22 nt, Human
aggcgaagggaccagacgguag

SEQ ID NO: 200228 - RNA, 22 nt, Human
caguggagaccugccugcugga

SEQ ID NO: 200229 - RNA, 21 nt, Human
uuccuccucuggagaagaaga

SEQ ID NO: 200230 - RNA, 22 nt, Human
uauguggcaggugggagaucag

SEQ ID NO: 200231 - RNA, 22 nt, Human
auggauggaagcagccugaacu

SEQ ID NO: 200232 - RNA, 22 nt, Human
ucucaaagagcuacuggucuau

SEQ ID NO: 200233 - RNA, 22 nt, Human
acgugugugugcacguguguau

SEQ ID NO: 200234 - RNA, 22 nt, Human
ggccugcuaccagcugugaccu

SEQ ID NO: 200235 - RNA, 20 nt, Human
gaacauaaauaacucuuuac

SEQ ID NO: 200236 - RNA, 22 nt, Human
ccuuuuaucgcgaagaacucca

SEQ ID NO: 200237 - RNA, 22 nt, Human
uggaagcccagaaggaagcaga

SEQ ID NO: 200238 - RNA, 22 nt, Human
uuucagagaaagcccaaagacu

SEQ ID NO: 200239 - RNA, 22 nt, Human
gggagccucccacugggggaag

SEQ ID NO: 200240 - RNA, 21 nt, Human
uguggccauuugaaaacaggg

SEQ ID NO: 200241 - RNA, 22 nt, Human
ucacuguuucaccgucugaagg

SEQ ID NO: 200242 - RNA, 22 nt, Human
gccaguggucagugggagggug

SEQ ID NO: 200243 - RNA, 22 nt, Human
uggcaaggccacaggugcaguu

SEQ ID NO: 200244 - RNA, 22 nt, Human
acuuuaaauaucauuugguagg

SEQ ID NO: 200245 - RNA, 22 nt, Human
cuaaauucuauauccuugcuuc

SEQ ID NO: 200246 - RNA, 20 nt, Human
ugccagagagcucauacccu

SEQ ID NO: 200247 - RNA, 22 nt, Human
aucauguauauuuuugcuauua

SEQ ID NO: 200248 - RNA, 22 nt, Human
augggagggagcagugaguguu

SEQ ID NO: 200249 - RNA, 22 nt, Human
uagcauuuagaacaccuugaga

SEQ ID NO: 200250 - RNA, 22 nt, Human
uagguuuugugucagaguagaa

SEQ ID NO: 200251 - RNA, 20 nt, Human
ucagugggaaagugagagug

SEQ ID NO: 200252 - RNA, 22 nt, Human
cccagagggcugaggauaugaa

SEQ ID NO: 200253 - RNA, 22 nt, Human
gagaacagauaugaugacuuca

SEQ ID NO: 200254 - RNA, 22 nt, Human
gagcagacugcacaguucuugc

SEQ ID NO: 200255 - RNA, 22 nt, Human
uauaaagaccuuauccuucaua

SEQ ID NO: 200256 - RNA, 22 nt, Human
caaauguuugguggcauuuugu

SEQ ID NO: 200257 - RNA, 22 nt, Human
uggcucaguaaucgagucuccu

SEQ ID NO: 200258 - RNA, 21 nt, Human
ugcuuucugugcuuuuucugc

SEQ ID NO: 200259 - RNA, 22 nt, Human
uauuucaugagugaauaucuag

SEQ ID NO: 200260 - RNA, 22 nt, Human
gcuuucagggucacugucaaca

SEQ ID NO: 200261 - RNA, 22 nt, Human
gugucccaaagauuagaaauca

SEQ ID NO: 200262 - RNA, 22 nt, Human
gaauauuuaucucagcugcaga

SEQ ID NO: 200263 - RNA, 20 nt, Human
cagagccaggguuuuguuuu

SEQ ID NO: 200264 - RNA, 22 nt, Human
auagcacuuaauaugaaacagu

SEQ ID NO: 200265 - RNA, 22 nt, Human
uuucuacauuuguaaccagauu

SEQ ID NO: 200266 - RNA, 22 nt, Human
aaauuaaaguuuuauuuagagc

SEQ ID NO: 200267 - RNA, 22 nt, Human
uuuacuguuuacagcuaaugca

SEQ ID NO: 200268 - RNA, 22 nt, Human
cauaggcucuucagagaacuga

SEQ ID NO: 200269 - RNA, 23 nt, Human
ucugccuccuaauuguugguguc

SEQ ID NO: 200270 - RNA, 22 nt, Human
gugggggugaggaauguucuau

SEQ ID NO: 200271 - RNA, 22 nt, Human
gaauuagguaauagaacuagua

SEQ ID NO: 200272 - RNA, 22 nt, Human
uuuuuuaaucaaguaggaaaca

SEQ ID NO: 200273 - RNA, 21 nt, Human
cuccuguaaaucaccuccgca

SEQ ID NO: 200274 - RNA, 22 nt, Human
caagaaaaaacaugaugagugu

SEQ ID NO: 200275 - RNA, 22 nt, Human
agcugacagugcauggagggac

SEQ ID NO: 200276 - RNA, 22 nt, Human
acucauuuggauuuuggaguuu

SEQ ID NO: 200277 - RNA, 22 nt, Human
cuaagguuggcaguggaauugg

SEQ ID NO: 200278 - RNA, 22 nt, Human
auuugcuuguucaccaguacuu

SEQ ID NO: 200279 - RNA, 22 nt, Human
uacuuacacugaagcaaagaua

SEQ ID NO: 200280 - RNA, 22 nt, Human
guggaaggaauuaacagacuag

SEQ ID NO: 200281 - RNA, 22 nt, Human
gucuuuguaguuuuaauuugag

SEQ ID NO: 200282 - RNA, 20 nt, Human
uugauucacaaaaagcuuag

SEQ ID NO: 200283 - RNA, 22 nt, Human
aggaaauaggaccagacaaagc

SEQ ID NO: 200284 - RNA, 22 nt, Human
auggaguguggccaggcaguaa

SEQ ID NO: 200285 - RNA, 22 nt, Human
aaugauuuucugcaaacaguga

SEQ ID NO: 200286 - RNA, 22 nt, Human
aagaaaccauauuaguuccugg

SEQ ID NO: 200287 - RNA, 22 nt, Human
uggggcugguaccguaauauau

SEQ ID NO: 200288 - RNA, 22 nt, Human
uggaaaauuuagaaagauuuau

SEQ ID NO: 200289 - RNA, 22 nt, Human
uuuaaauuucugaaucuugagg

SEQ ID NO: 200290 - RNA, 22 nt, Human
ucuugugguggaucccucauuu

SEQ ID NO: 200291 - RNA, 22 nt, Human
gggagguaaugggggugcaggg

SEQ ID NO: 200292 - RNA, 20 nt, Human
cuuauuuuggagaacuuuuc

SEQ ID NO: 200293 - RNA, 22 nt, Human
uucauuagcacauuuccuuggu

SEQ ID NO: 200294 - RNA, 22 nt, Human
uuuuacauuuuauucguuuauu

SEQ ID NO: 200295 - RNA, 22 nt, Human
uccauguauugcuaacaaauag

SEQ ID NO: 200296 - RNA, 22 nt, Human
uaaaaucaugacagauugacau

SEQ ID NO: 200297 - RNA, 20 nt, Human
agugauuuguuaguacauug

SEQ ID NO: 200298 - RNA, 22 nt, Human
uagcacauaguaggcacaggcu

SEQ ID NO: 200299 - RNA, 22 nt, Human
guuuggguggcuagagaaagaa

SEQ ID NO: 200300 - RNA, 22 nt, Human
uggaguuuuaaucuguacagaa

SEQ ID NO: 200301 - RNA, 22 nt, Human
cucagaugcacacaggugaggg

SEQ ID NO: 200302 - RNA, 22 nt, Human
auguacugacuguacuuuuaaa

SEQ ID NO: 200303 - RNA, 22 nt, Human
ugagacucuccugugcagccuc

SEQ ID NO: 200304 - RNA, 22 nt, Human
agagggagagaccuccgugccu

SEQ ID NO: 200305 - RNA, 22 nt, Human
uucacccuucucuggcuuucag

SEQ ID NO: 200306 - RNA, 22 nt, Human
caauaccucuuggugauugggc

SEQ ID NO: 200307 - RNA, 21 nt, Human
uccucucuaaguuccgccccg

SEQ ID NO: 200308 - RNA, 22 nt, Human
ugcagcuuuugguuucuagaug

SEQ ID NO: 200309 - RNA, 22 nt, Human
ggacauaguugcuauggagagu

SEQ ID NO: 200310 - RNA, 22 nt, Human
uuguuuuaguagaaguuacaug

SEQ ID NO: 200311 - RNA, 21 nt, Human
uuccuggaggcagaaacguga

SEQ ID NO: 200312 - RNA, 22 nt, Human
uugcuuucuuuguagguuuucc

SEQ ID NO: 200313 - RNA, 22 nt, Human
ggagaggaaguuuaaagaauug

SEQ ID NO: 200314 - RNA, 22 nt, Human
aaauguuucauucuauuuuuag

SEQ ID NO: 200315 - RNA, 22 nt, Human
guugagaaucucuagcuuagga

SEQ ID NO: 200316 - RNA, 22 nt, Human
acugucuuguuguaugugagcu

SEQ ID NO: 200317 - RNA, 17 nt, Human
auucuuauacucuguga

SEQ ID NO: 200318 - RNA, 22 nt, Human
uuuuccuuagaaauacauugau

SEQ ID NO: 200319 - RNA, 22 nt, Human
guggggguaggggguuuccugg

SEQ ID NO: 200320 - RNA, 22 nt, Human
ugucuuugaccuuaagaaguuu

SEQ ID NO: 200321 - RNA, 22 nt, Human
uucauaugaauuggguuuuuuu

SEQ ID NO: 200322 - RNA, 22 nt, Human
gaaccauuuaauggagaugcuc

SEQ ID NO: 200323 - RNA, 22 nt, Human
gagggggaaaagggcagcagag

SEQ ID NO: 200324 - RNA, 22 nt, Human
aagcugccugggaggaagggcu

SEQ ID NO: 200325 - RNA, 22 nt, Human
ggagacagauggcgucucaguu

SEQ ID NO: 200326 - RNA, 22 nt, Human
cauggcaggugcagauucugug

SEQ ID NO: 200327 - RNA, 22 nt, Human
caccucagagcuccuucuucuc

SEQ ID NO: 200328 - RNA, 22 nt, Human
uaggauugguguauguagguuu

SEQ ID NO: 200329 - RNA, 22 nt, Human
gcuggggaucgaaggcagagcc

SEQ ID NO: 200330 - RNA, 22 nt, Human
ucuuccuuacucuggauguuau

SEQ ID NO: 200331 - RNA, 22 nt, Human
ccagggcuggaggaggucagga

SEQ ID NO: 200332 - RNA, 22 nt, Human
uuccacaugaucauuguaauaa

SEQ ID NO: 200333 - RNA, 22 nt, Human
auucuuuauuuucuguacuugc

SEQ ID NO: 200334 - RNA, 22 nt, Human
cuugucuaguuccuggugaugu

SEQ ID NO: 200335 - RNA, 17 nt, Human
ugucuuuuuccuccucc

SEQ ID NO: 200336 - RNA, 22 nt, Human
aacccugaacuuaguucuagga

SEQ ID NO: 200337 - RNA, 22 nt, Human
agggaaauaggagaagaaagga

SEQ ID NO: 200338 - RNA, 22 nt, Human
aagugauuuucccaccaucuac

SEQ ID NO: 200339 - RNA, 22 nt, Human
uuaucaaaaaauaguacuuuga

SEQ ID NO: 200340 - RNA, 22 nt, Human
ggcucagaggagcuggaacggu

SEQ ID NO: 200341 - RNA, 22 nt, Human
ucugagugacguccugacagga

SEQ ID NO: 200342 - RNA, 22 nt, Human
uauauuaaagugcuuugcagug

SEQ ID NO: 200343 - RNA, 22 nt, Human
caugcuaacacguugcucaccg

SEQ ID NO: 200344 - RNA, 21 nt, Human
caguucuaagugucaucuuuu

SEQ ID NO: 200345 - RNA, 22 nt, Human
ucuucaucucuaaaaugggaac

SEQ ID NO: 200346 - RNA, 22 nt, Human
uuuucucuuugcuucucuaaaa

SEQ ID NO: 200347 - RNA, 20 nt, Human
ugauuauuccaacaagaaug

SEQ ID NO: 200348 - RNA, 22 nt, Human
uuaaacauuuccacuugccagu

SEQ ID NO: 200349 - RNA, 22 nt, Human
aaaggaaacuaugaaucucugg

SEQ ID NO: 200350 - RNA, 22 nt, Human
cugcagagaccuaggucagguu

SEQ ID NO: 200351 - RNA, 22 nt, Human
aagugaaaaaagucaguacuga

SEQ ID NO: 200352 - RNA, 17 nt, Human
auucaugaacauguccu

SEQ ID NO: 200353 - RNA, 22 nt, Human
aagacagugacagucacaauug

SEQ ID NO: 200354 - RNA, 18 nt, Human
acuguccucaggacguug

SEQ ID NO: 200355 - RNA, 22 nt, Human
caaaacauucagagagcucacu

SEQ ID NO: 200356 - RNA, 22 nt, Human
caaggaaaacagaugaucaaca

SEQ ID NO: 200357 - RNA, 18 nt, Salmonella enterica enterica serovar Typhi Ty2
gucuggagcgauuucgug

SEQ ID NO: 200358 - RNA, 22 nt, Salmonella enterica enterica serovar Typhi Ty2
gcuggacguugggggcuaccgg

SEQ ID NO: 200359 - RNA, 22 nt, Salmonella enterica enterica serovar Typhi Ty2
gagcuucaauacggcgaucggc

SEQ ID NO: 200360 - RNA, 20 nt, Salmonella enterica enterica serovar Typhi Ty2
aaugcgcugaaaaaacguuu

SEQ ID NO: 200361 - RNA, 22 nt, Salmonella enterica enterica serovar Typhi Ty2
uggcgguagcgauaagcgccug

SEQ ID NO: 200362 - RNA, 22 nt, Salmonella enterica enterica serovar Typhi Ty2
gcagguucgcuggguuuaccug

SEQ ID NO: 200363 - RNA, 22 nt, Salmonella enterica enterica serovar Typhi Ty2
gccagauauauuuuccugcauc

SEQ ID NO: 200364 - RNA, 22 nt, Salmonella enterica enterica serovar Typhi Ty2
ugcguuccgccagguuuacccg

SEQ ID NO: 200365 - RNA, 19 nt, Salmonella enterica enterica serovar Typhi Ty2
gcccuacguccgcacgcgg

SEQ ID NO: 200366 - RNA, 22 nt, Salmonella enterica enterica serovar Typhi Ty2
aguggauauggcguggcacgag

SEQ ID NO: 200367 - RNA, 17 nt, Salmonella enterica enterica serovar Typhi Ty2
uuucaccauccgcauuc

SEQ ID NO: 200368 - RNA, 22 nt, Salmonella enterica enterica serovar Typhi Ty2
caucagcgucaaccguuggcga

SEQ ID NO: 200369 - RNA, 19 nt, Salmonella enterica enterica serovar Typhi Ty2
ggugcgaugaugcuuggcc

SEQ ID NO: 200370 - RNA, 20 nt, Salmonella enterica enterica serovar Typhi Ty2
uucaggucgaugucaucaau

SEQ ID NO: 200371 - RNA, 22 nt, Salmonella enterica enterica serovar Typhi Ty2
augugcuguucgauguagccaa

SEQ ID NO: 200372 - RNA, 18 nt, Salmonella enterica enterica serovar Typhi Ty2
uuaaccgccgugaauagc

SEQ ID NO: 200373 - RNA, 22 nt, Salmonella enterica enterica serovar Typhi Ty2
auauugccguaaaugcuaaugg

SEQ ID NO: 200374 - RNA, 22 nt, Salmonella enterica enterica serovar Typhi Ty2
uuucugcgcgcuguccggcccc

SEQ ID NO: 200375 - RNA, 22 nt, Salmonella enterica enterica serovar Typhi Ty2
cggauaagcauagcgccauccg

SEQ ID NO: 200376 - RNA, 20 nt, Salmonella enterica enterica serovar Typhi Ty2
uguccgacuguuaacguaaa

SEQ ID NO: 200377 - RNA, 22 nt, Salmonella enterica enterica serovar Typhi Ty2
cgcgcaagagaggguaacagcg

SEQ ID NO: 200378 - RNA, 23 nt, Salmonella enterica enterica serovar Typhi Ty2
uggauaacaucaacaggaugacc

SEQ ID NO: 200379 - RNA, 22 nt, Salmonella enterica enterica serovar Typhi Ty2
ggccauuaucgcuacaggcgua

SEQ ID NO: 200380 - RNA, 22 nt, Salmonella enterica enterica serovar Typhi Ty2
gggugacuauggucgcgucuau

SEQ ID NO: 200381 - RNA, 22 nt, Salmonella enterica enterica serovar Typhi Ty2
aggaacgccuccugaggcagcu

SEQ ID NO: 200382 - RNA, 22 nt, Salmonella enterica enterica serovar Typhi Ty2
auaucguaaugcgggcgauacc

SEQ ID NO: 200383 - RNA, 22 nt, Salmonella enterica enterica serovar Typhi Ty2
ucuuggcgcgcuaauuggucug

SEQ ID NO: 200384 - RNA, 22 nt, Salmonella enterica enterica serovar Typhi Ty2
ucggucauugagaucuguugga

SEQ ID NO: 200385 - RNA, 22 nt, Salmonella enterica enterica serovar Typhi Ty2
cguaccggcaaaacagcgucgc

SEQ ID NO: 200386 - RNA, 22 nt, Salmonella enterica enterica serovar Typhi Ty2
guagauuccagccguuugaaug

SEQ ID NO: 200387 - RNA, 22 nt, Salmonella enterica enterica serovar Typhi Ty2
uacgacgcacuuuaugaggucc

SEQ ID NO: 200388 - RNA, 22 nt, Salmonella enterica enterica serovar Typhi Ty2
gaacgggcuuuucaggguguag

SEQ ID NO: 200389 - RNA, 22 nt, Salmonella enterica enterica serovar Typhi Ty2
auuccaggaauaaguauccaga

SEQ ID NO: 200390 - RNA, 19 nt, Salmonella enterica enterica serovar Typhi Ty2
uccggaugacgaacuggcc

SEQ ID NO: 200391 - RNA, 19 nt, Salmonella enterica enterica serovar Typhi Ty2
aaggucagaaacacacuau

SEQ ID NO: 200392 - RNA, 19 nt, Salmonella enterica enterica serovar Typhi Ty2
gcguaagcgcguuuucucc

SEQ ID NO: 200393 - RNA, 22 nt, Salmonella enterica enterica serovar Typhi Ty2
guuauucugcgcucguucuauc

SEQ ID NO: 200394 - RNA, 22 nt, Salmonella enterica enterica serovar Typhi Ty2
ggauaucuggugggauaaccgc

SEQ ID NO: 200395 - RNA, 22 nt, Salmonella enterica enterica serovar Typhi Ty2
ccggauaaggcgaagcugccau

SEQ ID NO: 200396 - RNA, 22 nt, Salmonella enterica enterica serovar Typhi Ty2
cggauucacauaggcguagcug

SEQ ID NO: 200397 - RNA, 22 nt, Salmonella enterica enterica serovar Typhi Ty2
aucaacguuaugauaauaauga

SEQ ID NO: 200398 - RNA, 22 nt, Salmonella enterica enterica serovar Typhi Ty2
gaccggcuuaaucguucugcug

SEQ ID NO: 200399 - RNA, 22 nt, Salmonella enterica enterica serovar Typhi Ty2
ucgcucaagcuggaugacaauc

SEQ ID NO: 200400 - RNA, 22 nt, Salmonella enterica enterica serovar Typhi Ty2
cgcggacuucuaguccggcuug

SEQ ID NO: 200401 - RNA, 22 nt, Salmonella enterica enterica serovar Typhi Ty2
uaggccugaaagcggcgcguca

SEQ ID NO: 200402 - RNA, 22 nt, Salmonella enterica enterica serovar Typhi Ty2
gccgauaaagucgugguuaccc

SEQ ID NO: 200403 - RNA, 22 nt, Salmonella enterica enterica serovar Typhi Ty2
cuggcaaagaaucguacaugcg

SEQ ID NO: 200404 - RNA, 22 nt, Salmonella enterica enterica serovar Typhi Ty2
aguccguugaagagaucacugg

SEQ ID NO: 200405 - RNA, 22 nt, Salmonella enterica enterica serovar Typhi Ty2
gucuggcgaguuuacacggcac

SEQ ID NO: 200406 - RNA, 22 nt, Salmonella enterica enterica serovar Typhi Ty2
uacaucgauuguugcgaauauu

SEQ ID NO: 200407 - RNA, 21 nt, Salmonella enterica enterica serovar Typhi Ty2
gcgcugauggucgugccgcuc

SEQ ID NO: 200408 - RNA, 22 nt, Salmonella enterica enterica serovar Typhi Ty2
uagugguaaauacauuuauuuu

SEQ ID NO: 200409 - RNA, 22 nt, Salmonella enterica enterica serovar Typhi Ty2
uugacgauuuuaccugaucgcu

SEQ ID NO: 200410 - RNA, 22 nt, Salmonella enterica enterica serovar Typhi Ty2
augcgcuggugaugggaaaggc

SEQ ID NO: 200411 - RNA, 17 nt, Salmonella enterica enterica serovar Typhi Ty2
ucugccugauuaucagg

SEQ ID NO: 200412 - RNA, 22 nt, Salmonella enterica enterica serovar Typhi Ty2
cgcggauaaaaugacgcuggcg

SEQ ID NO: 200413 - RNA, 22 nt, Salmonella enterica enterica serovar Typhi Ty2
agcgccgucuacaaaaaagccc

SEQ ID NO: 200414 - RNA, 22 nt, Salmonella enterica enterica serovar Typhi Ty2
ucaugcgcgccuguuaugcgcu

SEQ ID NO: 200415 - RNA, 22 nt, Salmonella enterica enterica serovar Typhi Ty2
uacgcucaauccccauaucgcu

SEQ ID NO: 200416 - RNA, 22 nt, Salmonella enterica enterica serovar Typhi Ty2
cugugagacggcggauugcgug

SEQ ID NO: 200417 - RNA, 22 nt, Salmonella enterica enterica serovar Typhi Ty2
uaccacuuccggcccugcaugc

SEQ ID NO: 200418 - RNA, 22 nt, Salmonella enterica enterica serovar Typhi Ty2
uuucgguaauggcgugcgaaaa

SEQ ID NO: 200419 - RNA, 22 nt, Salmonella enterica enterica serovar Typhi Ty2
gagcugguuaacguguuccgcg

SEQ ID NO: 200420 - RNA, 22 nt, Salmonella enterica enterica serovar Typhi Ty2
cguugucguaugagcgaucgcu

SEQ ID NO: 200421 - RNA, 22 nt, Salmonella enterica enterica serovar Typhi Ty2
uugccggucauccaagccgcaa

SEQ ID NO: 200422 - RNA, 22 nt, Salmonella enterica enterica serovar Typhi Ty2
cugacggguaguaucgcucuau

SEQ ID NO: 200423 - RNA, 22 nt, Salmonella enterica enterica serovar Typhi Ty2
cgcacggucugcacgucacuuc

SEQ ID NO: 200424 - RNA, 22 nt, Salmonella enterica enterica serovar Typhi Ty2
uggcucaagcucaguuaucuga

SEQ ID NO: 200425 - RNA, 22 nt, Salmonella enterica enterica serovar Typhi Ty2
uuuacggaucugcaggaucagg

SEQ ID NO: 200426 - RNA, 22 nt, Salmonella enterica enterica serovar Typhi Ty2
cgguugaaaccuuacagcgccu

SEQ ID NO: 200427 - RNA, 21 nt, Salmonella enterica enterica serovar Typhi Ty2
caggacagugagccagaacca

SEQ ID NO: 200428 - RNA, 22 nt, Salmonella enterica enterica serovar Typhi Ty2
agccagacgcuguuaccuaagu

SEQ ID NO: 200429 - RNA, 22 nt, Salmonella enterica enterica serovar Typhi Ty2
uucgcuauggcuacuaccguua

SEQ ID NO: 200430 - RNA, 23 nt, Salmonella enterica enterica serovar Typhi Ty2
ucgcucauacacucgguaaugca

SEQ ID NO: 200431 - RNA, 22 nt, Salmonella enterica enterica serovar Typhi Ty2
ugaaguuuaucaaaggugacgc

SEQ ID NO: 200432 - RNA, 22 nt, Salmonella enterica enterica serovar Typhi Ty2
ugucugaacggagaaaaggugc

SEQ ID NO: 200433 - RNA, 22 nt, Salmonella enterica enterica serovar Typhi Ty2
cggcaauuuucuuacucaugcg

SEQ ID NO: 200434 - RNA, 22 nt, Salmonella enterica enterica serovar Typhi Ty2
agucaauauuuauucauggaau

SEQ ID NO: 200435 - RNA, 22 nt, Salmonella enterica enterica serovar Typhi Ty2
uugucucgccgaccggcacgcc

SEQ ID NO: 200436 - RNA, 22 nt, Salmonella enterica enterica serovar Typhi Ty2
ucguucagucccaugugccgga

SEQ ID NO: 200437 - RNA, 21 nt, Salmonella enterica enterica serovar Typhi Ty2
gcgguucccaguaccacacca

SEQ ID NO: 200438 - RNA, 22 nt, Salmonella enterica enterica serovar Typhi Ty2
auuccguagcuugagcacguug

SEQ ID NO: 200439 - RNA, 19 nt, Salmonella enterica enterica serovar Typhi Ty2
cuggcauaguaagaaguau

SEQ ID NO: 200440 - RNA, 22 nt, Salmonella enterica enterica serovar Typhi Ty2
agugagccgucuggauaucgug

SEQ ID NO: 200441 - RNA, 22 nt, Salmonella enterica enterica serovar Typhi Ty2
ugcgcgaguauuucgaucugcu

SEQ ID NO: 200442 - RNA, 19 nt, Salmonella enterica enterica serovar Typhi Ty2
cauggcggcauaacacaca

SEQ ID NO: 200443 - RNA, 19 nt, Salmonella enterica enterica serovar Typhi Ty2
cgguuacugggauagagac

SEQ ID NO: 200444 - RNA, 22 nt, Salmonella enterica enterica serovar Typhi Ty2
gcugaucagcugcauuggguuc

SEQ ID NO: 200445 - RNA, 22 nt, Salmonella enterica enterica serovar Typhi Ty2
accugccguugauugucgaugc

SEQ ID NO: 200446 - RNA, 23 nt, Salmonella enterica enterica serovar Typhi Ty2
agcaguucuucagauggcaaugu

SEQ ID NO: 200447 - RNA, 22 nt, Salmonella enterica enterica serovar Typhi Ty2
cgucggguaaggcaaauuuucc

SEQ ID NO: 200448 - RNA, 21 nt, Salmonella enterica enterica serovar Typhi Ty2
uggcugcuguucaucugcgug

SEQ ID NO: 200449 - RNA, 22 nt, Salmonella enterica enterica serovar Typhi Ty2
aacgacucgucuaucaccggca

SEQ ID NO: 200450 - RNA, 18 nt, Salmonella enterica enterica serovar Typhi Ty2
cuggcaguagugaaagua

SEQ ID NO: 200451 - RNA, 22 nt, Salmonella enterica enterica serovar Typhi Ty2
gccgucuuuaacgagguacugg

SEQ ID NO: 200452 - RNA, 22 nt, Salmonella enterica enterica serovar Typhi Ty2
uacacgccggauaaggcgcagc

SEQ ID NO: 200453 - RNA, 22 nt, Salmonella enterica enterica serovar Typhi Ty2
acugcuugaugaggccgaacgu

SEQ ID NO: 200454 - RNA, 22 nt, Salmonella enterica enterica serovar Typhi Ty2
uaccgugaaaacuucagccagc

SEQ ID NO: 200455 - RNA, 22 nt, Salmonella enterica enterica serovar Typhi Ty2
aguuccugcgcgccgaugaauc

SEQ ID NO: 200456 - RNA, 22 nt, Salmonella enterica enterica serovar Typhi Ty2
gucugaugagcgccggauucug

SEQ ID NO: 200457 - RNA, 22 nt, Salmonella enterica enterica serovar Typhi Ty2
gauguauaucguuugcuauaca

SEQ ID NO: 200458 - RNA, 21 nt, Salmonella enterica enterica serovar Typhi Ty2
uacgacgcacuuuaugagguc

SEQ ID NO: 200459 - RNA, 22 nt, Salmonella enterica enterica serovar Typhi Ty2
gacugcugaaccagaacgacgu

SEQ ID NO: 200460 - RNA, 22 nt, Salmonella enterica enterica serovar Typhi Ty2
augggaugugagaacggaggcc

SEQ ID NO: 200461 - RNA, 19 nt, Salmonella enterica enterica serovar Typhi Ty2
cgcaggucaaugguuuuca

SEQ ID NO: 200462 - RNA, 22 nt, Salmonella enterica enterica serovar Typhi Ty2
cgcuccugcuccugcuccaucc

SEQ ID NO: 200463 - RNA, 22 nt, Salmonella enterica enterica serovar Typhi Ty2
gacgaacauuucguucguuaua

SEQ ID NO: 200464 - RNA, 22 nt, Salmonella enterica enterica serovar Typhi Ty2
cgucaauaucagcuuucgcguc

SEQ ID NO: 200465 - RNA, 22 nt, Salmonella enterica enterica serovar Typhi Ty2
ccgaccuggcgucgacggcggc

SEQ ID NO: 200466 - RNA, 22 nt, Salmonella enterica enterica serovar Typhi Ty2
ccacguuucccgcgcccggacu

SEQ ID NO: 200467 - RNA, 19 nt, Salmonella enterica enterica serovar Typhi Ty2
ucgaugacuaucugcaugu

SEQ ID NO: 200468 - RNA, 22 nt, Salmonella enterica enterica serovar Typhi Ty2
ggugagcugugaugcacagcgg

SEQ ID NO: 200469 - RNA, 22 nt, Salmonella enterica enterica serovar Typhi Ty2
cuggcuguagacucgcuuuccc

SEQ ID NO: 200470 - RNA, 22 nt, Salmonella enterica enterica serovar Typhi Ty2
cagcacgcgcugaaugucgccg

SEQ ID NO: 200471 - RNA, 22 nt, Salmonella enterica enterica serovar Typhi Ty2
gugacgauuauuacugacauuu

SEQ ID NO: 200472 - RNA, 22 nt, Salmonella enterica enterica serovar Typhi Ty2
cgguugaugguuugugcgugcg

SEQ ID NO: 200473 - RNA, 22 nt, Salmonella enterica enterica serovar Typhi Ty2
ucuguaggcccgguaagcguca

SEQ ID NO: 200474 - RNA, 22 nt, Salmonella enterica enterica serovar Typhi Ty2
augccgcgucgcuuagugauua

SEQ ID NO: 200475 - RNA, 22 nt, Salmonella enterica enterica serovar Typhi Ty2
cagggcguugauggcuuuggcg

SEQ ID NO: 200476 - RNA, 19 nt, Salmonella enterica enterica serovar Typhi Ty2
gcggcuuuuguagauauug

SEQ ID NO: 200477 - RNA, 22 nt, Salmonella enterica enterica serovar Typhi Ty2
uccgcgaugcucgcccaccacc

SEQ ID NO: 200478 - RNA, 22 nt, Salmonella enterica enterica serovar Typhi Ty2
gccacgcucagucuucacggau

SEQ ID NO: 200479 - RNA, 22 nt, Salmonella enterica enterica serovar Typhi Ty2
uucaggccgauauuuucgacca

SEQ ID NO: 200480 - RNA, 22 nt, Salmonella enterica enterica serovar Typhi Ty2
uagcgugauuacgaccggcgag

SEQ ID NO: 200481 - RNA, 22 nt, Salmonella enterica enterica serovar Typhi Ty2
gugauuaccguacaaggacauu

SEQ ID NO: 200482 - RNA, 22 nt, Salmonella enterica enterica serovar Typhi Ty2
guauuucagguggccuucacgc

SEQ ID NO: 200483 - RNA, 21 nt, Salmonella enterica enterica serovar Typhi Ty2
aagcugacagaguccugaaaa

SEQ ID NO: 200484 - RNA, 22 nt, Salmonella enterica enterica serovar Typhi Ty2
ucgacgcgggcaaagcuggcgu

SEQ ID NO: 200485 - RNA, 22 nt, Salmonella enterica enterica serovar Typhi Ty2
gugugcaaagacugauagccgu

SEQ ID NO: 200486 - RNA, 22 nt, Salmonella enterica enterica serovar Typhi Ty2
cagaacuggguagcggggcuuc

SEQ ID NO: 200487 - RNA, 22 nt, Salmonella enterica enterica serovar Typhi Ty2
guuacgccgccaucaggcaaaa

SEQ ID NO: 200488 - RNA, 22 nt, Salmonella enterica enterica serovar Typhi Ty2
gcuguagcgccagauggaugug

SEQ ID NO: 200489 - RNA, 22 nt, Salmonella enterica enterica serovar Typhi Ty2
gcuuaucgccuuucugccggug

SEQ ID NO: 200490 - RNA, 22 nt, Salmonella enterica enterica serovar Typhi Ty2
ugaagaucagcagcgauuugau

SEQ ID NO: 200491 - RNA, 22 nt, Salmonella enterica enterica serovar Typhi Ty2
ggcgcgaugcuggcgaaggucu

SEQ ID NO: 200492 - RNA, 22 nt, Salmonella enterica enterica serovar Typhi Ty2
cagcucauugguaauaauucuu

SEQ ID NO: 200493 - RNA, 22 nt, Salmonella enterica enterica serovar Typhi Ty2
uaaagcaauauucgguuuaacu

SEQ ID NO: 200494 - RNA, 22 nt, Salmonella enterica enterica serovar Typhi Ty2
acuacgccgccgauagcaucgg

SEQ ID NO: 200495 - RNA, 22 nt, Salmonella enterica enterica serovar Typhi Ty2
agcguauggcugcaagacggua

SEQ ID NO: 200496 - RNA, 22 nt, Salmonella enterica enterica serovar Typhi Ty2
ugcgucugccugagcuggugca

SEQ ID NO: 200497 - RNA, 22 nt, Salmonella enterica enterica serovar Typhi Ty2
cgguuaaagggaauguaguaaa

SEQ ID NO: 200498 - RNA, 20 nt, Salmonella enterica enterica serovar Typhi Ty2
ugugccgauuauucgcgcua

SEQ ID NO: 200499 - RNA, 22 nt, Salmonella enterica enterica serovar Typhi Ty2
uaucacagccagaaaagggcua

SEQ ID NO: 200500 - RNA, 22 nt, Salmonella enterica enterica serovar Typhi Ty2
gauaccgcuaaucgcgacgguc

SEQ ID NO: 200501 - RNA, 22 nt, Salmonella enterica enterica serovar Typhi Ty2
guguuacgccuuauccggccua

SEQ ID NO: 200502 - RNA, 22 nt, Salmonella enterica enterica serovar Typhi Ty2
aaugucgugcauaucggugaac

SEQ ID NO: 200503 - RNA, 22 nt, Salmonella enterica enterica serovar Typhi Ty2
gccauuugccgcugucguuauu

SEQ ID NO: 200504 - RNA, 22 nt, Salmonella enterica enterica serovar Typhi Ty2
agcuggucgccaguugcguuaa

SEQ ID NO: 200505 - RNA, 21 nt, Salmonella enterica enterica serovar Typhi Ty2
ugcgcagaucauauucacaug

SEQ ID NO: 200506 - RNA, 20 nt, Salmonella enterica enterica serovar Typhi Ty2
uaagcgcagcgucaucaggc

SEQ ID NO: 200507 - RNA, 22 nt, Salmonella enterica enterica serovar Typhi Ty2
ucagccgacuucugcgucagcc

SEQ ID NO: 200508 - RNA, 22 nt, Salmonella enterica enterica serovar Typhi Ty2
uuauccgcaagcugaacgcgcc

SEQ ID NO: 200509 - RNA, 22 nt, Salmonella enterica enterica serovar Typhi Ty2
uugcggcagcccgccaggauuu

SEQ ID NO: 200510 - RNA, 23 nt, Salmonella enterica enterica serovar Typhi Ty2
ucagggcugccgaugucgccagc

SEQ ID NO: 200511 - RNA, 22 nt, Salmonella enterica enterica serovar Typhi Ty2
cgccgauguaguacagcgccug

SEQ ID NO: 200512 - RNA, 22 nt, Salmonella enterica enterica serovar Typhi Ty2
ucacugcaggacaacaguaaaa

SEQ ID NO: 200513 - RNA, 22 nt, Salmonella enterica enterica serovar Typhi Ty2
aagaccuugcgggucgugacgu

SEQ ID NO: 200514 - RNA, 22 nt, Salmonella enterica enterica serovar Typhi Ty2
uagcggaaaauugggcuauagc

SEQ ID NO: 200515 - RNA, 22 nt, Salmonella enterica enterica serovar Typhi Ty2
caacagguucgguuguacaguc

SEQ ID NO: 200516 - RNA, 22 nt, Salmonella enterica enterica serovar Typhi Ty2
uuguucaaaguguaguaacguu

SEQ ID NO: 200517 - RNA, 18 nt, Salmonella enterica enterica serovar Typhi Ty2
ugcggcaaugagcuguug

SEQ ID NO: 200518 - RNA, 22 nt, Salmonella enterica enterica serovar Typhi Ty2
auagccgauuuuuuccggauuc

SEQ ID NO: 200519 - RNA, 22 nt, Salmonella enterica enterica serovar Typhi Ty2
agagcggcuggcgaaacuggcg

SEQ ID NO: 200520 - RNA, 22 nt, Salmonella enterica enterica serovar Typhi Ty2
acagacaugauaggcgaagcgc

SEQ ID NO: 200521 - RNA, 21 nt, Salmonella enterica enterica serovar Typhi Ty2
acguugaccaucgguacgccu

SEQ ID NO: 200522 - RNA, 22 nt, Salmonella enterica enterica serovar Typhi Ty2
gcagcaugauaauucacguugg

SEQ ID NO: 200523 - RNA, 22 nt, Salmonella enterica enterica serovar Typhi Ty2
agaagcguucggucagacgagg

SEQ ID NO: 200524 - RNA, 22 nt, Salmonella enterica enterica serovar Typhi Ty2
ucacgcuuuuuccugacccuga

SEQ ID NO: 200525 - RNA, 22 nt, Salmonella enterica enterica serovar Typhi Ty2
gacgguacguugacuacgccgg

SEQ ID NO: 200526 - RNA, 20 nt, Salmonella enterica enterica serovar Typhi Ty2
uauagcgaaaccacccugac

SEQ ID NO: 200527 - RNA, 22 nt, Salmonella enterica enterica serovar Typhi Ty2
cuggcuggagucucagggcgca

SEQ ID NO: 200528 - RNA, 22 nt, Salmonella enterica enterica serovar Typhi Ty2
caggacugaaggagcugauugu

SEQ ID NO: 200529 - RNA, 22 nt, Salmonella enterica enterica serovar Typhi Ty2
gaucagcgugcuauuuuuuucg

SEQ ID NO: 200530 - RNA, 23 nt, Salmonella enterica enterica serovar Typhi Ty2
cggucugcaaacaauucccccgg

SEQ ID NO: 200531 - RNA, 22 nt, Salmonella enterica enterica serovar Typhi Ty2
aguggucagcauugagcugccg

SEQ ID NO: 200532 - RNA, 22 nt, Salmonella enterica enterica serovar Typhi Ty2
uguuaaugcuuuuauugaaugu

SEQ ID NO: 200533 - RNA, 22 nt, Salmonella enterica enterica serovar Typhi Ty2
gaucagcuuaaagggauuauca

SEQ ID NO: 200534 - RNA, 22 nt, Salmonella enterica enterica serovar Typhi Ty2
aucguguaaaucguccagcgcc

SEQ ID NO: 200535 - RNA, 22 nt, Salmonella enterica enterica serovar Typhi Ty2
uagggcuuauccggccugcaaa

SEQ ID NO: 200536 - RNA, 20 nt, Salmonella enterica enterica serovar Typhi Ty2
uguuuacgcgggacauuuua

SEQ ID NO: 200537 - RNA, 22 nt, Salmonella enterica enterica serovar Typhi Ty2
gaaguacgcuauaugccgagug

SEQ ID NO: 200538 - RNA, 22 nt, Salmonella enterica enterica serovar Typhi Ty2
gcagcaauagcagaucaaauua

SEQ ID NO: 200539 - RNA, 19 nt, Salmonella enterica enterica serovar Typhi Ty2
ucgccgauguacagccggg

SEQ ID NO: 200540 - RNA, 20 nt, Salmonella enterica enterica serovar Typhi Ty2
gcgcacuuuaaucgccauga

SEQ ID NO: 200541 - RNA, 22 nt, Salmonella enterica enterica serovar Typhi Ty2
ucucguuauuaacgccguucca

SEQ ID NO: 200542 - RNA, 22 nt, Salmonella enterica enterica serovar Typhi Ty2
ugccgcguaaagcacgaacggg

SEQ ID NO: 200543 - RNA, 22 nt, Salmonella enterica enterica serovar Typhi Ty2
cuggcgcugccugcggaugaaa

SEQ ID NO: 200544 - RNA, 22 nt, Salmonella enterica enterica serovar Typhi Ty2
ccgcugcaaccguuacccgcuu

SEQ ID NO: 200545 - RNA, 17 nt, Salmonella enterica enterica serovar Typhi Ty2
uaucgacaccguaaugg

SEQ ID NO: 200546 - RNA, 22 nt, Salmonella enterica enterica serovar Typhi Ty2
agcggguuuuaccauuaccgau

SEQ ID NO: 200547 - RNA, 22 nt, Salmonella enterica enterica serovar Typhi Ty2
cgcugauugauuaugauacguu

SEQ ID NO: 200548 - RNA, 22 nt, Salmonella enterica enterica serovar Typhi Ty2
cugcuguacauggcugccgcug

SEQ ID NO: 200549 - RNA, 22 nt, Salmonella enterica enterica serovar Typhi Ty2
gucacucucacuuuugugacgu

SEQ ID NO: 200550 - RNA, 22 nt, Salmonella enterica enterica serovar Typhi Ty2
auucgcaaugagaguuugguag

SEQ ID NO: 200551 - RNA, 22 nt, Salmonella enterica enterica serovar Typhi Ty2
gacaacaucccagaaaaugacg

SEQ ID NO: 200552 - RNA, 22 nt, Salmonella enterica enterica serovar Typhi Ty2
uacugugcgcgcugucggucuu

SEQ ID NO: 200553 - RNA, 22 nt, Salmonella enterica enterica serovar Typhi Ty2
uacguuugccgaggugaucgua

SEQ ID NO: 200554 - RNA, 22 nt, Salmonella enterica enterica serovar Typhi Ty2
gugaauuacauugacguuggcg

SEQ ID NO: 200555 - RNA, 22 nt, Salmonella enterica enterica serovar Typhi Ty2
ugauuguacgguagguaaucgc

SEQ ID NO: 200556 - RNA, 22 nt, Salmonella enterica enterica serovar Typhi Ty2
ccaugcggauguugauaucuuc

SEQ ID NO: 200557 - RNA, 22 nt, Salmonella enterica enterica serovar Typhi Ty2
agaugggcaaagccacggugga

SEQ ID NO: 200558 - RNA, 22 nt, Salmonella enterica enterica serovar Typhi Ty2
ugccgcaagccgcuuucccuga

SEQ ID NO: 200559 - RNA, 22 nt, Salmonella enterica enterica serovar Typhi Ty2
uucgcaaacaacaucuuuguug

SEQ ID NO: 200560 - RNA, 22 nt, Salmonella enterica enterica serovar Typhi Ty2
uacgcgaacaacuggaggucag

SEQ ID NO: 200561 - RNA, 22 nt, Salmonella enterica enterica serovar Typhi Ty2
uuggcugacgaauauuauuaaa

SEQ ID NO: 200562 - RNA, 22 nt, Salmonella enterica enterica serovar Typhi Ty2
uaacaacggagaacaguaucuu

SEQ ID NO: 200563 - RNA, 22 nt, Salmonella enterica enterica serovar Typhi Ty2
ggccaucauugaagaacagcug

SEQ ID NO: 200564 - RNA, 22 nt, Salmonella enterica enterica serovar Typhi Ty2
uuugacgauugcuuuaccauug

SEQ ID NO: 200565 - RNA, 22 nt, Salmonella enterica enterica serovar Typhi Ty2
agcucaccacugcacgaaaaug

SEQ ID NO: 200566 - RNA, 22 nt, Salmonella enterica enterica serovar Typhi Ty2
gcugauacugcucguucaacgc

SEQ ID NO: 200567 - RNA, 23 nt, Salmonella enterica enterica serovar Typhi Ty2
uggugccguucagcaggauguuc

SEQ ID NO: 200568 - RNA, 22 nt, Salmonella enterica enterica serovar Typhi Ty2
ucccugauaaaacaguaacggc

SEQ ID NO: 200569 - RNA, 22 nt, Salmonella enterica enterica serovar Typhi Ty2
uugccaggccugcggcgcguua

SEQ ID NO: 200570 - RNA, 20 nt, Salmonella enterica enterica serovar Typhi Ty2
uugcaggccacggcgguuau

SEQ ID NO: 200571 - RNA, 22 nt, Salmonella enterica enterica serovar Typhi Ty2
uacaggauguucggcguaucgu

SEQ ID NO: 200572 - RNA, 22 nt, Salmonella enterica enterica serovar Typhi Ty2
ugauaagguuggugaccauauu

SEQ ID NO: 200573 - RNA, 22 nt, Salmonella enterica enterica serovar Typhi Ty2
auaccagcuugaacuacguuua

SEQ ID NO: 200574 - RNA, 21 nt, Salmonella enterica enterica serovar Typhi Ty2
gugugccacggcauuccggau

SEQ ID NO: 200575 - RNA, 22 nt, Salmonella enterica enterica serovar Typhi Ty2
uaucgccaggcacggauaaggu

SEQ ID NO: 200576 - RNA, 22 nt, Salmonella enterica enterica serovar Typhi Ty2
aauccagaguauuaauuuucgu

SEQ ID NO: 200577 - RNA, 22 nt, Salmonella enterica enterica serovar Typhi Ty2
cuggguuaucgcgcgucguaau

SEQ ID NO: 200578 - RNA, 22 nt, Salmonella enterica enterica serovar Typhi Ty2
auggcguuaucagccgcgcuuu

SEQ ID NO: 200579 - RNA, 22 nt, Salmonella enterica enterica serovar Typhi Ty2
uucauuacuuugaauggcggaa

SEQ ID NO: 200580 - RNA, 22 nt, Salmonella enterica enterica serovar Typhi Ty2
ccgcguaugaagagcggugagc

SEQ ID NO: 200581 - RNA, 19 nt, Salmonella enterica enterica serovar Typhi Ty2
ugggcgaagcguagccgcg

SEQ ID NO: 200582 - RNA, 22 nt, Salmonella enterica enterica serovar Typhi Ty2
uggcggaguacaaauuucgaau

SEQ ID NO: 200583 - RNA, 22 nt, Salmonella enterica enterica serovar Typhi Ty2
gugccgucgccauuggugucuc

SEQ ID NO: 200584 - RNA, 22 nt, Salmonella enterica enterica serovar Typhi Ty2
acaggccgcgccauccggcacg

SEQ ID NO: 200585 - RNA, 22 nt, Salmonella enterica enterica serovar Typhi Ty2
uauaugcauuaaugguuuaacc

SEQ ID NO: 200586 - RNA, 17 nt, Salmonella enterica enterica serovar Typhi Ty2
aggugccgggauuagcc

SEQ ID NO: 200587 - RNA, 22 nt, Salmonella enterica enterica serovar Typhi Ty2
ucgggcgugcgcuauuacaucg

SEQ ID NO: 200588 - RNA, 22 nt, Salmonella enterica enterica serovar Typhi Ty2
cgcgaugauggcauccagaucg

SEQ ID NO: 200589 - RNA, 22 nt, Salmonella enterica enterica serovar Typhi Ty2
cuuguaggucggauaaggcgca

SEQ ID NO: 200590 - RNA, 22 nt, Salmonella enterica enterica serovar Typhi Ty2
cucgcugcacuugcucgaucca

SEQ ID NO: 200591 - RNA, 22 nt, Salmonella enterica enterica serovar Typhi Ty2
auugccggauggcgccguaggc

SEQ ID NO: 200592 - RNA, 22 nt, Salmonella enterica enterica serovar Typhi Ty2
ucgcgcaaauuauguauaugca

SEQ ID NO: 200593 - RNA, 22 nt, Salmonella enterica enterica serovar Typhi Ty2
gaugcuggauaaauauuucgau

SEQ ID NO: 200594 - RNA, 22 nt, Salmonella enterica enterica serovar Typhi Ty2
ugccgcauggcgcuacgcuugu

SEQ ID NO: 200595 - RNA, 22 nt, Salmonella enterica enterica serovar Typhi Ty2
ccguuaguccugcucugugaca

SEQ ID NO: 200596 - RNA, 22 nt, Salmonella enterica enterica serovar Typhi Ty2
aagcaugaaacgauauauacug

SEQ ID NO: 200597 - RNA, 22 nt, Salmonella enterica enterica serovar Typhi Ty2
aucuucaugguuaauggucuga

SEQ ID NO: 200598 - RNA, 22 nt, Salmonella enterica enterica serovar Typhi Ty2
caucaaugaacagcgugcuaca

SEQ ID NO: 200599 - RNA, 21 nt, Salmonella enterica enterica serovar Typhi Ty2
ugaugcggcgaugacgcagcg

SEQ ID NO: 200600 - RNA, 22 nt, Salmonella enterica enterica serovar Typhi Ty2
ccggaaagcuugcuguccauac

SEQ ID NO: 200601 - RNA, 22 nt, Salmonella enterica enterica serovar Typhi Ty2
ugucacgcuggacgacgaaauc

SEQ ID NO: 200602 - RNA, 22 nt, Salmonella enterica enterica serovar Typhi Ty2
gaucaggucgguaaucaauagc

SEQ ID NO: 200603 - RNA, 22 nt, Salmonella enterica enterica serovar Typhi Ty2
acuauucugaagaucacggcgu

SEQ ID NO: 200604 - RNA, 22 nt, Salmonella enterica enterica serovar Typhi Ty2
uguaggcagcauaagcguuagc

SEQ ID NO: 200605 - RNA, 20 nt, Salmonella enterica enterica serovar Typhi Ty2
cgucuggcgccgcaggaacu

SEQ ID NO: 200606 - RNA, 22 nt, Salmonella enterica enterica serovar Typhi Ty2
uugauucgccgcaucgcguaag

SEQ ID NO: 200607 - RNA, 22 nt, Salmonella enterica enterica serovar Typhi Ty2
uugcaguuggcuaauaugcugc

SEQ ID NO: 200608 - RNA, 22 nt, Salmonella enterica enterica serovar Typhi Ty2
gcacaacgcguauugaaaaugc

SEQ ID NO: 200609 - RNA, 22 nt, Salmonella enterica enterica serovar Typhi Ty2
uugguucagggcguuaucuugu

SEQ ID NO: 200610 - RNA, 22 nt, Salmonella enterica enterica serovar Typhi Ty2
ggcuucgcugcuggucggcagu

SEQ ID NO: 200611 - RNA, 21 nt, Salmonella enterica enterica serovar Typhi Ty2
caucauauuuaugagcagggc

SEQ ID NO: 200612 - RNA, 22 nt, Salmonella enterica enterica serovar Typhi Ty2
augcguuauuugaccgccuggg

SEQ ID NO: 200613 - RNA, 21 nt, Salmonella enterica enterica serovar Typhi Ty2
gcgcaucggguuauuguucac

SEQ ID NO: 200614 - RNA, 22 nt, Salmonella enterica enterica serovar Typhi Ty2
gacaacuggauagccgugugga

SEQ ID NO: 200615 - RNA, 19 nt, Salmonella enterica enterica serovar Typhi Ty2
cagauuguuguuuaucuca

SEQ ID NO: 200616 - RNA, 22 nt, Salmonella enterica enterica serovar Typhi Ty2
cgacgccugcuacagcccugua

SEQ ID NO: 200617 - RNA, 22 nt, Salmonella enterica enterica serovar Typhi Ty2
gaucgcucagaacucgauuggc

SEQ ID NO: 200618 - RNA, 22 nt, Salmonella enterica enterica serovar Typhi Ty2
gcugacgcaacguuauccuuca

SEQ ID NO: 200619 - RNA, 22 nt, Salmonella enterica enterica serovar Typhi Ty2
gaacccugcggugaaucgucuu

SEQ ID NO: 200620 - RNA, 22 nt, Salmonella enterica enterica serovar Typhi Ty2
augccuuauccggccuacaacg

SEQ ID NO: 200621 - RNA, 22 nt, Salmonella enterica enterica serovar Typhi Ty2
caggaagucacgcugccagcga

SEQ ID NO: 200622 - RNA, 22 nt, Salmonella enterica enterica serovar Typhi Ty2
gcgcuggaaagcggcaggugau

SEQ ID NO: 200623 - RNA, 22 nt, Salmonella enterica enterica serovar Typhi Ty2
uaagaguaggugaguacgccgu

SEQ ID NO: 200624 - RNA, 22 nt, Salmonella enterica enterica serovar Typhi Ty2
uuaccgcuaugccgaugaacau

SEQ ID NO: 200625 - RNA, 22 nt, Salmonella enterica enterica serovar Typhi Ty2
ccagcagcaggaugccgaaagc

SEQ ID NO: 200626 - RNA, 22 nt, Salmonella enterica enterica serovar Typhi Ty2
uuccgcacaacaguuugagcua

SEQ ID NO: 200627 - RNA, 22 nt, Salmonella enterica enterica serovar Typhi Ty2
uugcaccaaaauagugcuucaa

SEQ ID NO: 200628 - RNA, 22 nt, Salmonella enterica enterica serovar Typhi Ty2
ucggcguuuaccguaggcgacc

SEQ ID NO: 200629 - RNA, 22 nt, Salmonella enterica enterica serovar Typhi Ty2
auucaaucaaauuaagaucaca

SEQ ID NO: 200630 - RNA, 22 nt, Salmonella enterica enterica serovar Typhi Ty2
uacaaacggcgguauaacauga

SEQ ID NO: 200631 - RNA, 22 nt, Salmonella enterica enterica serovar Typhi Ty2
ucaggcuacguucggugagcuc

SEQ ID NO: 200632 - RNA, 22 nt, Salmonella enterica enterica serovar Typhi Ty2
ugcaacgcuuuaugguggcgau

SEQ ID NO: 200633 - RNA, 22 nt, Salmonella enterica enterica serovar Typhi Ty2
cggcggaacauucguuggcgua

SEQ ID NO: 200634 - RNA, 22 nt, Salmonella enterica enterica serovar Typhi Ty2
aucaguuucaggaugaagaccg

SEQ ID NO: 200635 - RNA, 22 nt, Salmonella enterica enterica serovar Typhi Ty2
auucgcgguaauuaaccgucug

SEQ ID NO: 200636 - RNA, 22 nt, Salmonella enterica enterica serovar Typhi Ty2
acgcuacagcgguucaucaauu

SEQ ID NO: 200637 - RNA, 22 nt, Salmonella enterica enterica serovar Typhi Ty2
cgcuguucaggaaggcuucaac

SEQ ID NO: 200638 - RNA, 22 nt, Salmonella enterica enterica serovar Typhi Ty2
ugguacugcagucagcaucauu

SEQ ID NO: 200639 - RNA, 22 nt, Salmonella enterica enterica serovar Typhi Ty2
ugccgcuuauccggccuacaga

SEQ ID NO: 200640 - RNA, 22 nt, Salmonella enterica enterica serovar Typhi Ty2
gcggaacugaaaaaauuugguu

SEQ ID NO: 200641 - RNA, 22 nt, Salmonella enterica enterica serovar Typhi Ty2
uggucgagaggguuucaauauu

SEQ ID NO: 200642 - RNA, 22 nt, Salmonella enterica enterica serovar Typhi Ty2
gaaauguucgugggugucggcg

SEQ ID NO: 200643 - RNA, 22 nt, Salmonella enterica enterica serovar Typhi Ty2
auugacgauaucggcauugacg

SEQ ID NO: 200644 - RNA, 22 nt, Salmonella enterica enterica serovar Typhi Ty2
ucguauccgugacuuccguggc

SEQ ID NO: 200645 - RNA, 22 nt, Salmonella enterica enterica serovar Typhi Ty2
uguccgcguuuguagauuacaa

SEQ ID NO: 200646 - RNA, 19 nt, Salmonella enterica enterica serovar Typhi Ty2
ugccgcaaaaucggcagcc

SEQ ID NO: 200647 - RNA, 22 nt, Salmonella enterica enterica serovar Typhi Ty2
guaaucgcugcuaaaggcuucg

SEQ ID NO: 200648 - RNA, 22 nt, Salmonella enterica enterica serovar Typhi Ty2
gugcgucuuacccggccuacgg

SEQ ID NO: 200649 - RNA, 22 nt, Salmonella enterica enterica serovar Typhi Ty2
aucuugauugcagccagaguuu

SEQ ID NO: 200650 - RNA, 22 nt, Salmonella enterica enterica serovar Typhi Ty2
gggcgcauguuuugaguaaaac

SEQ ID NO: 200651 - RNA, 22 nt, Salmonella enterica enterica serovar Typhi Ty2
uguagcgcgucucaugcguugc

SEQ ID NO: 200652 - RNA, 22 nt, Salmonella enterica enterica serovar Typhi Ty2
aucgccauuaugaucgggaugc

SEQ ID NO: 200653 - RNA, 22 nt, Salmonella enterica enterica serovar Typhi Ty2
ugguaccguuaugacgaucugc

SEQ ID NO: 200654 - RNA, 22 nt, Salmonella enterica enterica serovar Typhi Ty2
cgaacguacuaacgucaccggc

SEQ ID NO: 200655 - RNA, 22 nt, Salmonella enterica enterica serovar Typhi Ty2
agcgcggacgacaguggugucc

SEQ ID NO: 200656 - RNA, 22 nt, Salmonella enterica enterica serovar Typhi Ty2
auggugacuugcaacuugcaga

SEQ ID NO: 200657 - RNA, 22 nt, Salmonella enterica enterica serovar Typhi Ty2
uuaccgucgcccggcgguauug

SEQ ID NO: 200658 - RNA, 21 nt, Salmonella enterica enterica serovar Typhi Ty2
gggcuuaauggcuaucgggcu

SEQ ID NO: 200659 - RNA, 21 nt, Salmonella enterica enterica serovar Typhi Ty2
agacuguuguugcgaugaaga

SEQ ID NO: 200660 - RNA, 22 nt, Salmonella enterica enterica serovar Typhi Ty2
gggcuucuuugcguguguggua

SEQ ID NO: 200661 - RNA, 22 nt, Salmonella enterica enterica serovar Typhi Ty2
aguuaucaacggaagauuagua

SEQ ID NO: 200662 - RNA, 22 nt, Salmonella enterica enterica serovar Typhi Ty2
caccaugacccaggaggauauu

SEQ ID NO: 200663 - RNA, 22 nt, Salmonella enterica enterica serovar Typhi Ty2
ggguaacgcgcgauaguguucc

SEQ ID NO: 200664 - RNA, 22 nt, Salmonella enterica enterica serovar Typhi Ty2
aacgacggaagcaaagaugcga

SEQ ID NO: 200665 - RNA, 22 nt, Salmonella enterica enterica serovar Typhi Ty2
uaaagcaccgcggccuuuuuug

SEQ ID NO: 200666 - RNA, 22 nt, Salmonella enterica enterica serovar Typhi Ty2
gaagcaacgguaagguagguuu

SEQ ID NO: 200667 - RNA, 21 nt, Salmonella enterica enterica serovar Typhi Ty2
augcaggaaaauauaucuggc

SEQ ID NO: 200668 - RNA, 22 nt, Salmonella enterica enterica serovar Typhi Ty2
gaagcagugaugacaccgaggc

SEQ ID NO: 200669 - RNA, 22 nt, Salmonella enterica enterica serovar Typhi Ty2
aguggcguacaugguggaaggu

SEQ ID NO: 200670 - RNA, 22 nt, Salmonella enterica enterica serovar Typhi Ty2
uuuaccguuugauuucaaucgc

SEQ ID NO: 200671 - RNA, 22 nt, Salmonella enterica enterica serovar Typhi Ty2
cggcaugacguugacgucgcua

SEQ ID NO: 200672 - RNA, 20 nt, Salmonella enterica enterica serovar Typhi Ty2
gaacaucggucaucuccggc

SEQ ID NO: 200673 - RNA, 22 nt, Salmonella enterica enterica serovar Typhi Ty2
uauggaugacugugccugcgcu

SEQ ID NO: 200674 - RNA, 16 nt, Salmonella enterica enterica serovar Typhi Ty2
accguugacggucuua

SEQ ID NO: 200675 - RNA, 22 nt, Salmonella enterica enterica serovar Typhi Ty2
gccgaucucuaccugcgcguac

SEQ ID NO: 200676 - RNA, 22 nt, Salmonella enterica enterica serovar Typhi Ty2
ggcaucgaaguccgaucaaccc

SEQ ID NO: 200677 - RNA, 22 nt, Salmonella enterica enterica serovar Typhi Ty2
ucgagcacugcccggcccuaaa

SEQ ID NO: 200678 - RNA, 22 nt, Salmonella enterica enterica serovar Typhi Ty2
agugucguuguugacucgccug

SEQ ID NO: 200679 - RNA, 22 nt, Salmonella enterica enterica serovar Typhi Ty2
aguaugguaagcagcuaucuuu

SEQ ID NO: 200680 - RNA, 22 nt, Salmonella enterica enterica serovar Typhi Ty2
aucaggcgguaguaucagggaa

SEQ ID NO: 200681 - RNA, 22 nt, Salmonella enterica enterica serovar Typhi Ty2
aucgcccgcgauauccuuaccu

SEQ ID NO: 200682 - RNA, 22 nt, Salmonella enterica enterica serovar Typhi Ty2
cguagcuacguuacagaacguu

SEQ ID NO: 200683 - RNA, 22 nt, Salmonella enterica enterica serovar Typhi Ty2
uucgcuaucguuauucugguuu

SEQ ID NO: 200684 - RNA, 22 nt, Salmonella enterica enterica serovar Typhi Ty2
gcgcuuuaacagcagccgaggu

SEQ ID NO: 200685 - RNA, 22 nt, Salmonella enterica enterica serovar Typhi Ty2
agcggcaucggccuguuuaucg

SEQ ID NO: 200686 - RNA, 22 nt, Salmonella enterica enterica serovar Typhi Ty2
agcgguuuuauuuacguugcuc

SEQ ID NO: 200687 - RNA, 22 nt, Salmonella enterica enterica serovar Typhi Ty2
aaagccgcguugaagccuaucc

SEQ ID NO: 200688 - RNA, 22 nt, Salmonella enterica enterica serovar Typhi Ty2
gacgccaugaagcguggguaca

SEQ ID NO: 200689 - RNA, 22 nt, Salmonella enterica enterica serovar Typhi Ty2
gcggauaucgaaguggaucugg

SEQ ID NO: 200690 - RNA, 22 nt, Salmonella enterica enterica serovar Typhi Ty2
ugcgucuuauccggccuacgga

SEQ ID NO: 200691 - RNA, 22 nt, Salmonella enterica enterica serovar Typhi Ty2
uuagcgccgguauuuuuggcgg

SEQ ID NO: 200692 - RNA, 22 nt, Salmonella enterica enterica serovar Typhi Ty2
cacguuagcgggugauguaugg

SEQ ID NO: 200693 - RNA, 21 nt, Salmonella enterica enterica serovar Typhi Ty2
gccagccuuuuuuuguauagc

SEQ ID NO: 200694 - RNA, 22 nt, Salmonella enterica enterica serovar Typhi Ty2
augaccguuuugauaucagugu

SEQ ID NO: 200695 - RNA, 22 nt, Salmonella enterica enterica serovar Typhi Ty2
gcguaucaucaacccgaugcgc

SEQ ID NO: 200696 - RNA, 22 nt, Salmonella enterica enterica serovar Typhi Ty2
augcugcugauguucaucauug

SEQ ID NO: 200697 - RNA, 22 nt, Salmonella enterica enterica serovar Typhi Ty2
auucaggaucgagacugccgua

SEQ ID NO: 200698 - RNA, 22 nt, Salmonella enterica enterica serovar Typhi Ty2
uuucauuguuguggaaccgcuu

SEQ ID NO: 200699 - RNA, 22 nt, Salmonella enterica enterica serovar Typhi Ty2
ggcugcugaagguguucugcgc

SEQ ID NO: 200700 - RNA, 22 nt, Salmonella enterica enterica serovar Typhi Ty2
gcucacgguaacucauugcgug

SEQ ID NO: 200701 - RNA, 22 nt, Salmonella enterica enterica serovar Typhi Ty2
uccgcaggcguucgaaaagggu

SEQ ID NO: 200702 - RNA, 22 nt, Salmonella enterica enterica serovar Typhi Ty2
uauugucggccuggugcuguug

SEQ ID NO: 200703 - RNA, 22 nt, Salmonella enterica enterica serovar Typhi Ty2
gauaacgguagguaucaaucgc

SEQ ID NO: 200704 - RNA, 22 nt, Salmonella enterica enterica serovar Typhi Ty2
ccaggguuugacguuuccacuu

SEQ ID NO: 200705 - RNA, 22 nt, Salmonella enterica enterica serovar Typhi Ty2
agucgucuuuugacgaugccca

SEQ ID NO: 200706 - RNA, 22 nt, Salmonella enterica enterica serovar Typhi Ty2
cggccuguuucuugccgugccu

SEQ ID NO: 200707 - RNA, 22 nt, Salmonella enterica enterica serovar Typhi Ty2
agcgacuucagugccaguacug

SEQ ID NO: 200708 - RNA, 22 nt, Salmonella enterica enterica serovar Typhi Ty2
acugcgguacagcagcgcuauc

SEQ ID NO: 200709 - RNA, 22 nt, Salmonella enterica enterica serovar Typhi Ty2
gcuagcgcuuaccgggccuaca

SEQ ID NO: 200710 - RNA, 22 nt, Salmonella enterica enterica serovar Typhi Ty2
guuagcgcgggaaaaucugcgg

SEQ ID NO: 200711 - RNA, 22 nt, Salmonella enterica enterica serovar Typhi Ty2
ugagagauauuggauuuuacuu

SEQ ID NO: 200712 - RNA, 22 nt, Salmonella enterica enterica serovar Typhi Ty2
gccaggcaaucgaucagggcag

SEQ ID NO: 200713 - RNA, 22 nt, Salmonella enterica enterica serovar Typhi Ty2
uagccgguaauagcgccacuag

SEQ ID NO: 200714 - RNA, 22 nt, Salmonella enterica enterica serovar Typhi Ty2
cggcgagauugucaucgacccg

SEQ ID NO: 200715 - RNA, 22 nt, Salmonella enterica enterica serovar Typhi Ty2
auuggcgacgauaaaucgguuc

SEQ ID NO: 200716 - RNA, 22 nt, Salmonella enterica enterica serovar Typhi Ty2
cgccugguuuuauagccgcauu

SEQ ID NO: 200717 - RNA, 22 nt, Salmonella enterica enterica serovar Typhi Ty2
ccggagcagcuucuugcuggcc

SEQ ID NO: 200718 - RNA, 22 nt, Salmonella enterica enterica serovar Typhi Ty2
agccguuuuccgggucgcgcag

SEQ ID NO: 200719 - RNA, 22 nt, Salmonella enterica enterica serovar Typhi Ty2
ugccggagaugaccgauguuca

SEQ ID NO: 200720 - RNA, 22 nt, Salmonella enterica enterica serovar Typhi Ty2
cgcgauggcuuucauuuccagc

SEQ ID NO: 200721 - RNA, 22 nt, Salmonella enterica enterica serovar Typhi Ty2
acuggagaacaugggcgugagu

SEQ ID NO: 200722 - RNA, 22 nt, Salmonella enterica enterica serovar Typhi Ty2
uuucugcgacguuaucgguaaa

SEQ ID NO: 200723 - RNA, 22 nt, Salmonella enterica enterica serovar Typhi Ty2
accgccugguaaucgguuuuca

SEQ ID NO: 200724 - RNA, 19 nt, Salmonella enterica enterica serovar Typhi Ty2
cgaucauuuacaucccggu

SEQ ID NO: 200725 - RNA, 22 nt, Salmonella enterica enterica serovar Typhi Ty2
agauucaucuaauuugauuacu

SEQ ID NO: 200726 - RNA, 22 nt, Salmonella enterica enterica serovar Typhi Ty2
aucgccauacggcagacgcgcg

SEQ ID NO: 200727 - RNA, 22 nt, Salmonella enterica enterica serovar Typhi Ty2
gaacggcgcuauugucgggaug

SEQ ID NO: 200728 - RNA, 22 nt, Salmonella enterica enterica serovar Typhi Ty2
uggucacccaggaugucgcauu

SEQ ID NO: 200729 - RNA, 20 nt, Salmonella enterica enterica serovar Typhi Ty2
accggcugcgauuacgcugg

SEQ ID NO: 200730 - RNA, 22 nt, Salmonella enterica enterica serovar Typhi Ty2
ccggauaaggcggagccgccau

SEQ ID NO: 200731 - RNA, 22 nt, Salmonella enterica enterica serovar Typhi Ty2
gcgcgauugauaugaauauauu

SEQ ID NO: 200732 - RNA, 22 nt, Salmonella enterica enterica serovar Typhi Ty2
auguuacuggcgugcugaagac

SEQ ID NO: 200733 - RNA, 22 nt, Salmonella enterica enterica serovar Typhi Ty2
ugcgguaguacugacuuugagg

SEQ ID NO: 200734 - RNA, 22 nt, Salmonella enterica enterica serovar Typhi Ty2
cuggcugcugacgguccuguua

SEQ ID NO: 200735 - RNA, 22 nt, Salmonella enterica enterica serovar Typhi Ty2
aaugagcugaugaaugaacuaa

SEQ ID NO: 200736 - RNA, 22 nt, Salmonella enterica enterica serovar Typhi Ty2
caccgguaucgucaugacaggc

SEQ ID NO: 200737 - RNA, 22 nt, Salmonella enterica enterica serovar Typhi Ty2
guggcgauaaacagaucgcccg

SEQ ID NO: 200738 - RNA, 22 nt, Salmonella enterica enterica serovar Typhi Ty2
cuguguccugugcgguaaucug

SEQ ID NO: 200739 - RNA, 22 nt, Salmonella enterica enterica serovar Typhi Ty2
aacgaucagcuuuuugccgaaa

SEQ ID NO: 200740 - RNA, 22 nt, Salmonella enterica enterica serovar Typhi Ty2
uacuacguugucgacgccgguu

SEQ ID NO: 200741 - RNA, 17 nt, Salmonella enterica enterica serovar Typhi Ty2
agcaugauguacggauu

SEQ ID NO: 200742 - RNA, 22 nt, Salmonella enterica enterica serovar Typhi Ty2
uggcucuuuugcggcguggaau

SEQ ID NO: 200743 - RNA, 20 nt, Salmonella enterica enterica serovar Typhi Ty2
ccgaugagccacggucaaac

SEQ ID NO: 200744 - RNA, 22 nt, Salmonella enterica enterica serovar Typhi Ty2
aagugcggcaauacuaucgcug

SEQ ID NO: 200745 - RNA, 22 nt, Salmonella enterica enterica serovar Typhi Ty2
auuaucgaugaaugccagcgag

SEQ ID NO: 200746 - RNA, 22 nt, Salmonella enterica enterica serovar Typhi Ty2
cggugaacccugcgcgucagga

SEQ ID NO: 200747 - RNA, 22 nt, Salmonella enterica enterica serovar Typhi Ty2
aacggauugcuucgcuguuagu

SEQ ID NO: 200748 - RNA, 22 nt, Salmonella enterica enterica serovar Typhi Ty2
auaucuucgcacaugcuuguaa

SEQ ID NO: 200749 - RNA, 22 nt, Salmonella enterica enterica serovar Typhi Ty2
ccguucaucuacggcaaacugg

SEQ ID NO: 200750 - RNA, 22 nt, Salmonella enterica enterica serovar Typhi Ty2
aaaugccuuauccggccuacuc

SEQ ID NO: 200751 - RNA, 22 nt, Salmonella enterica enterica serovar Typhi Ty2
auguugagcagcuuucgcuguu

SEQ ID NO: 200752 - RNA, 20 nt, Salmonella enterica enterica serovar Typhi Ty2
cuguaggcccgguaaggcgu

SEQ ID NO: 200753 - RNA, 20 nt, Salmonella enterica enterica serovar Typhi Ty2
gucugcggcgacuggcggcg

SEQ ID NO: 200754 - RNA, 22 nt, Salmonella enterica enterica serovar Typhi Ty2
ucgaugcugacgguauccugca

SEQ ID NO: 200755 - RNA, 22 nt, Salmonella enterica enterica serovar Typhi Ty2
ucuguaggccugauaagcgcag

SEQ ID NO: 200756 - RNA, 22 nt, Salmonella enterica enterica serovar Typhi Ty2
cccggcaugggcggcguuugca

SEQ ID NO: 200757 - RNA, 22 nt, Salmonella enterica enterica serovar Typhi Ty2
agauuugcuugaguuguuuagc

SEQ ID NO: 200758 - RNA, 22 nt, Salmonella enterica enterica serovar Typhi Ty2
uuauggcgcgggggaaaagaug

SEQ ID NO: 200759 - RNA, 22 nt, Salmonella enterica enterica serovar Typhi Ty2
ugagaauuuucguugcaagggu

SEQ ID NO: 200760 - RNA, 22 nt, Salmonella enterica enterica serovar Typhi Ty2
ccggcgaagauagcgguacugu

SEQ ID NO: 200761 - RNA, 19 nt, Salmonella enterica enterica serovar Typhi Ty2
cgcaggaauggcagaccgg

SEQ ID NO: 200762 - RNA, 22 nt, Salmonella enterica enterica serovar Typhi Ty2
augcgcuguacaaugucgcgau

SEQ ID NO: 200763 - RNA, 22 nt, Salmonella enterica enterica serovar Typhi Ty2
auugaagccgaugccggugaaa

SEQ ID NO: 200764 - RNA, 22 nt, Salmonella enterica enterica serovar Typhi Ty2
aucgucguugcaggcgugcgcc

SEQ ID NO: 200765 - RNA, 22 nt, Salmonella enterica enterica serovar Typhi Ty2
ugauccagaucccgcguaucgg

SEQ ID NO: 200766 - RNA, 22 nt, Salmonella enterica enterica serovar Typhi Ty2
gucugcccgcagacauggucgu

SEQ ID NO: 200767 - RNA, 22 nt, Salmonella enterica enterica serovar Typhi Ty2
ugaugcgcuguguucgcguuau

SEQ ID NO: 200768 - RNA, 22 nt, Salmonella enterica enterica serovar Typhi Ty2
gauguaggccugauaagcguag

SEQ ID NO: 200769 - RNA, 22 nt, Salmonella enterica enterica serovar Typhi Ty2
uuggcgacaaagaaauauuugg

SEQ ID NO: 200770 - RNA, 22 nt, Salmonella enterica enterica serovar Typhi Ty2
gcguuggauaucaugcagauaa

SEQ ID NO: 200771 - RNA, 22 nt, Salmonella enterica enterica serovar Typhi Ty2
gcuuucugcgcgcacgccggag

SEQ ID NO: 200772 - RNA, 22 nt, Salmonella enterica enterica serovar Typhi Ty2
auccggguaacuaugaugagua

SEQ ID NO: 200773 - RNA, 22 nt, Salmonella enterica enterica serovar Typhi Ty2
aacgugaugauacagaauggug

SEQ ID NO: 200774 - RNA, 22 nt, Salmonella enterica enterica serovar Typhi Ty2
cggauguauuugacugcgcgcu

SEQ ID NO: 200775 - RNA, 22 nt, Salmonella enterica enterica serovar Typhi Ty2
cgccaucacguuaauacucaau

SEQ ID NO: 200776 - RNA, 22 nt, Salmonella enterica enterica serovar Typhi Ty2
ugguuuaaaguggcaaugaagg

SEQ ID NO: 200777 - RNA, 22 nt, Salmonella enterica enterica serovar Typhi Ty2
aucugcuucaugcguuucuuac

SEQ ID NO: 200778 - RNA, 22 nt, Salmonella enterica enterica serovar Typhi Ty2
ucugguuaaucgcgcugggugg

SEQ ID NO: 200779 - RNA, 22 nt, Salmonella enterica enterica serovar Typhi Ty2
uaguacgauggaaggccgcaaa

SEQ ID NO: 200780 - RNA, 22 nt, Salmonella enterica enterica serovar Typhi Ty2
ugcguggccucgcccagccgca

SEQ ID NO: 200781 - RNA, 22 nt, Salmonella enterica enterica serovar Typhi Ty2
uauugcgauaaauucuuguagg

SEQ ID NO: 200782 - RNA, 22 nt, Salmonella enterica enterica serovar Typhi Ty2
gauggcggugcugauggugcaa

SEQ ID NO: 200783 - RNA, 22 nt, Salmonella enterica enterica serovar Typhi Ty2
cagcgccaauagcuguuuuugc

SEQ ID NO: 200784 - RNA, 22 nt, Salmonella enterica enterica serovar Typhi Ty2
ggagccugcaucgucggcgcgc

SEQ ID NO: 200785 - RNA, 22 nt, Salmonella enterica enterica serovar Typhi Ty2
caucgccuuaauuuuauccagc

SEQ ID NO: 200786 - RNA, 22 nt, Salmonella enterica enterica serovar Typhi Ty2
guugcgccagcccgacguggcc

SEQ ID NO: 200787 - RNA, 22 nt, Salmonella enterica enterica serovar Typhi Ty2
uuugcccgguaagacuuccugc

SEQ ID NO: 200788 - RNA, 22 nt, Salmonella enterica enterica serovar Typhi Ty2
uggguaagcgcagcgccaucag

SEQ ID NO: 200789 - RNA, 23 nt, Salmonella enterica enterica serovar Typhi Ty2
gcguugacaagguauuuuuacag

SEQ ID NO: 200790 - RNA, 22 nt, Salmonella enterica enterica serovar Typhi Ty2
auggcagcauuaugggcauuaa

SEQ ID NO: 200791 - RNA, 22 nt, Salmonella enterica enterica serovar Typhi Ty2
uucgucugccugauagcgguga

SEQ ID NO: 200792 - RNA, 22 nt, Salmonella enterica enterica serovar Typhi Ty2
uuacgcgcuuugcguaaggucg

SEQ ID NO: 200793 - RNA, 22 nt, Salmonella enterica enterica serovar Typhi Ty2
gaucgguuaggccgggcaggua

SEQ ID NO: 200794 - RNA, 22 nt, Salmonella enterica enterica serovar Typhi Ty2
ucuauauguugugcggcacuuu

SEQ ID NO: 200795 - RNA, 18 nt, Salmonella enterica enterica serovar Typhi Ty2
cgccugguaagucgcagg

SEQ ID NO: 200796 - RNA, 23 nt, Salmonella enterica enterica serovar Typhi Ty2
aagcgguuccacaacaaugaaaa

SEQ ID NO: 200797 - RNA, 22 nt, Salmonella enterica enterica serovar Typhi Ty2
auggcgauuucauagcccgcuu

SEQ ID NO: 200798 - RNA, 22 nt, Salmonella enterica enterica serovar Typhi Ty2
cugcaagcagcucgaugcguuu

SEQ ID NO: 200799 - RNA, 22 nt, Salmonella enterica enterica serovar Typhi Ty2
ucgacgaacugcaagagcggau

SEQ ID NO: 200800 - RNA, 22 nt, Salmonella enterica enterica serovar Typhi Ty2
gccaaugacauaagggauggcc

SEQ ID NO: 200801 - RNA, 22 nt, Salmonella enterica enterica serovar Typhi Ty2
cgccgugaagcgauucgcgaau

SEQ ID NO: 200802 - RNA, 22 nt, Salmonella enterica enterica serovar Typhi Ty2
cauaaugaccucuuauuucccg

SEQ ID NO: 200803 - RNA, 22 nt, Salmonella enterica enterica serovar Typhi Ty2
auugcaccaauguggugcuuaa

SEQ ID NO: 200804 - RNA, 20 nt, Salmonella enterica enterica serovar Typhi Ty2
cgauugauaccuaccguuau

SEQ ID NO: 200805 - RNA, 22 nt, Salmonella enterica enterica serovar Typhi Ty2
cccuugcgucaugaaaacgacg

SEQ ID NO: 200806 - RNA, 22 nt, Salmonella enterica enterica serovar Typhi Ty2
caaugcggcccaagcagcggac

SEQ ID NO: 200807 - RNA, 22 nt, Salmonella enterica enterica serovar Typhi Ty2
ugcuggacaccgacgauaacug

SEQ ID NO: 200808 - RNA, 22 nt, Salmonella enterica enterica serovar Typhi Ty2
gcgacgacauuagacauguuca

SEQ ID NO: 200809 - RNA, 21 nt, Salmonella enterica enterica serovar Typhi Ty2
guugugccgccggcgaagcuu

SEQ ID NO: 200810 - RNA, 22 nt, Salmonella enterica enterica serovar Typhi Ty2
cucauugcggcgaugcgcaggg

SEQ ID NO: 200811 - RNA, 22 nt, Salmonella enterica enterica serovar Typhi Ty2
ggaucgaguggcgaucgccuau

SEQ ID NO: 200812 - RNA, 22 nt, Salmonella enterica enterica serovar Typhi Ty2
gucccguuacccuuuuucaggu

SEQ ID NO: 200813 - RNA, 22 nt, Salmonella enterica enterica serovar Typhi Ty2
uuguccgugcugcugguaauca

SEQ ID NO: 200814 - RNA, 22 nt, Salmonella enterica enterica serovar Typhi Ty2
cacguggagauggcggcggcgu

SEQ ID NO: 200815 - RNA, 22 nt, Salmonella enterica enterica serovar Typhi Ty2
ucagcgcuuucacuuccugguc

SEQ ID NO: 200816 - RNA, 22 nt, Salmonella enterica enterica serovar Typhi Ty2
acaucguaccgauagcaucggg

SEQ ID NO: 200817 - RNA, 22 nt, Salmonella enterica enterica serovar Typhi Ty2
uugccgacgagcaggcaauggu

SEQ ID NO: 200818 - RNA, 20 nt, Salmonella enterica enterica serovar Typhi Ty2
cugggcguugaugauggcgu

SEQ ID NO: 200819 - RNA, 22 nt, Salmonella enterica enterica serovar Typhi Ty2
auggcguuguauuauugagguu

SEQ ID NO: 200820 - RNA, 21 nt, Salmonella enterica enterica serovar Typhi Ty2
aucgucucgaagcgcacguca

SEQ ID NO: 200821 - RNA, 22 nt, Salmonella enterica enterica serovar Typhi Ty2
agcgacaggaaucugugugagg

SEQ ID NO: 200822 - RNA, 22 nt, Salmonella enterica enterica serovar Typhi Ty2
uugaccuugugacugagcagcg

SEQ ID NO: 200823 - RNA, 18 nt, Salmonella enterica enterica serovar Typhi Ty2
gaucguuuuaugucggcg

SEQ ID NO: 200824 - RNA, 22 nt, Salmonella enterica enterica serovar Typhi Ty2
guggcggauauggguuaugaca

SEQ ID NO: 200825 - RNA, 22 nt, Salmonella enterica enterica serovar Typhi Ty2
ugcuccaguuuccacggcgggu

SEQ ID NO: 200826 - RNA, 22 nt, Salmonella enterica enterica serovar Typhi Ty2
auucgcgcaucgcgucgagcag

SEQ ID NO: 200827 - RNA, 18 nt, Salmonella enterica enterica serovar Typhi Ty2
gggcugaugcugugggcg

SEQ ID NO: 200828 - RNA, 22 nt, Salmonella enterica enterica serovar Typhi Ty2
gaugccggauggcgguuggccu

SEQ ID NO: 200829 - RNA, 22 nt, Salmonella enterica enterica serovar Typhi Ty2
aucagcaagcgcugugcaaguu

SEQ ID NO: 200830 - RNA, 22 nt, Salmonella enterica enterica serovar Typhi Ty2
uugcaguucacuaucaaggcaa

SEQ ID NO: 200831 - RNA, 22 nt, Salmonella enterica enterica serovar Typhi Ty2
augucguaugaugcccguguuc

SEQ ID NO: 200832 - RNA, 22 nt, Salmonella enterica enterica serovar Typhi Ty2
cagaaccuggcucaucagugau

SEQ ID NO: 200833 - RNA, 22 nt, Salmonella enterica enterica serovar Typhi Ty2
uucgauuuaugaauggugacga

SEQ ID NO: 200834 - RNA, 22 nt, Salmonella enterica enterica serovar Typhi Ty2
ccugcgcagcgccggagacgaa

SEQ ID NO: 200835 - RNA, 22 nt, Salmonella enterica enterica serovar Typhi Ty2
uggauaagugaaacgccauccg

SEQ ID NO: 200836 - RNA, 22 nt, Salmonella enterica enterica serovar Typhi Ty2
uuuccagaugauucagacaggg

SEQ ID NO: 200837 - RNA, 22 nt, Salmonella enterica enterica serovar Typhi Ty2
ccgugguguuuauugcugugcu

SEQ ID NO: 200838 - RNA, 22 nt, Salmonella enterica enterica serovar Typhi Ty2
gaucugguucccgcugugcagc

SEQ ID NO: 200839 - RNA, 22 nt, Salmonella enterica enterica serovar Typhi Ty2
aauggucguuaucauccagcca

SEQ ID NO: 200840 - RNA, 22 nt, Salmonella enterica enterica serovar Typhi Ty2
cuccugauaucacggauaugcg

SEQ ID NO: 200841 - RNA, 22 nt, Salmonella enterica enterica serovar Typhi Ty2
cgugacgucgaaaccaucgucc

SEQ ID NO: 200842 - RNA, 23 nt, Salmonella enterica enterica serovar Typhi Ty2
agggcgucuggaugaagcauugu

SEQ ID NO: 200843 - RNA, 22 nt, Salmonella enterica enterica serovar Typhi Ty2
ccugucgguacggcgcgccugc

SEQ ID NO: 200844 - RNA, 22 nt, Salmonella enterica enterica serovar Typhi Ty2
auuggugacgauagccuguuug

SEQ ID NO: 200845 - RNA, 22 nt, Salmonella enterica enterica serovar Typhi Ty2
cuggcaggcgacguauggcacg

SEQ ID NO: 200846 - RNA, 22 nt, Salmonella enterica enterica serovar Typhi Ty2
gcagcguauucucacguucggg

SEQ ID NO: 200847 - RNA, 22 nt, Salmonella enterica enterica serovar Typhi Ty2
uggcugauuaucccguguccug

SEQ ID NO: 200848 - RNA, 22 nt, Salmonella enterica enterica serovar Typhi Ty2
gugguuaaucaacgugacuucg

SEQ ID NO: 200849 - RNA, 22 nt, Salmonella enterica enterica serovar Typhi Ty2
acuuucuggcccacuucgauga

SEQ ID NO: 200850 - RNA, 22 nt, Salmonella enterica enterica serovar Typhi Ty2
uaggccugguaagcgaagcgcc

SEQ ID NO: 200851 - RNA, 22 nt, Salmonella enterica enterica serovar Typhi Ty2
gcuauugauuuuccggaugagg

SEQ ID NO: 200852 - RNA, 22 nt, Salmonella enterica enterica serovar Typhi Ty2
uugucgaugagacgcuggcggc

SEQ ID NO: 200853 - RNA, 22 nt, Salmonella enterica enterica serovar Typhi Ty2
gcgauugaucaucaugcugccu

SEQ ID NO: 200854 - RNA, 22 nt, Salmonella enterica enterica serovar Typhi Ty2
gagugcgggcuggauauggaau

SEQ ID NO: 200855 - RNA, 22 nt, Salmonella enterica enterica serovar Typhi Ty2
cauggagcugaaugcaccauca

SEQ ID NO: 200856 - RNA, 17 nt, Salmonella enterica enterica serovar Typhi Ty2
caucuuugugaacuuua

SEQ ID NO: 200857 - RNA, 22 nt, Salmonella enterica enterica serovar Typhi Ty2
uuugauaccaauauccucaucg

SEQ ID NO: 200858 - RNA, 22 nt, Salmonella enterica enterica serovar Typhi Ty2
aucgucagcguguggaggugcu

SEQ ID NO: 200859 - RNA, 22 nt, Salmonella enterica enterica serovar Typhi Ty2
gugcgaaugcgcgacuugccga

SEQ ID NO: 200860 - RNA, 22 nt, Salmonella enterica enterica serovar Typhi Ty2
gucgcugguaaagaugacgaug

SEQ ID NO: 200861 - RNA, 22 nt, Salmonella enterica enterica serovar Typhi Ty2
aucgucacuuuuuuaccgcugu

SEQ ID NO: 200862 - RNA, 22 nt, Salmonella enterica enterica serovar Typhi Ty2
ccuuugaaggucggcagcaggg

SEQ ID NO: 200863 - RNA, 22 nt, Salmonella enterica enterica serovar Typhi Ty2
gcgcucugucugcggacgucac

SEQ ID NO: 200864 - RNA, 23 nt, Salmonella enterica enterica serovar Typhi Ty2
cgaucaaucaauuuaccguuauu

SEQ ID NO: 200865 - RNA, 22 nt, Salmonella enterica enterica serovar Typhi Ty2
uccugaccugaugcgcgagaag

SEQ ID NO: 200866 - RNA, 22 nt, Salmonella enterica enterica serovar Typhi Ty2
uccagcaaaaaucuuucuuugg

SEQ ID NO: 200867 - RNA, 22 nt, Salmonella enterica enterica serovar Typhi Ty2
ugaugagguaaaagacgcccga

SEQ ID NO: 200868 - RNA, 22 nt, Salmonella enterica enterica serovar Typhi Ty2
aggaucuuccacugaugauucg

SEQ ID NO: 200869 - RNA, 22 nt, Salmonella enterica enterica serovar Typhi Ty2
aacagaucgacacgcacaauau

SEQ ID NO: 200870 - RNA, 22 nt, Salmonella enterica enterica serovar Typhi Ty2
auaaucggcugaccagccugcc

SEQ ID NO: 200871 - RNA, 22 nt, Salmonella enterica enterica serovar Typhi Ty2
auaacgauauuucauccccauu

SEQ ID NO: 200872 - RNA, 22 nt, Salmonella enterica enterica serovar Typhi Ty2
uacaauguugaagcagcgcgug

SEQ ID NO: 200873 - RNA, 22 nt, Salmonella enterica enterica serovar Typhi Ty2
uggcacugcuccagcuuuaccu

SEQ ID NO: 200874 - RNA, 22 nt, Salmonella enterica enterica serovar Typhi Ty2
cuacguuuaccuggccuacaga

SEQ ID NO: 200875 - RNA, 22 nt, Salmonella enterica enterica serovar Typhi Ty2
aucaagaauuaauauuugcggg

SEQ ID NO: 200876 - RNA, 22 nt, Salmonella enterica enterica serovar Typhi Ty2
aucgucaucuuuaccagcgaca

SEQ ID NO: 200877 - RNA, 21 nt, Salmonella enterica enterica serovar Typhi Ty2
uauggcgaccaccugcuggac

SEQ ID NO: 200878 - RNA, 23 nt, Salmonella enterica enterica serovar Typhi Ty2
uugucaccuuuucagcuaucagc

SEQ ID NO: 200879 - RNA, 22 nt, Salmonella enterica enterica serovar Typhi Ty2
ccggugaucccaccagcaguug

SEQ ID NO: 200880 - RNA, 22 nt, Salmonella enterica enterica serovar Typhi Ty2
gggcuuaugcacuaaauaagaa

SEQ ID NO: 200881 - RNA, 23 nt, Salmonella enterica enterica serovar Typhi Ty2
auacagggcggacggguaguaag

SEQ ID NO: 200882 - RNA, 22 nt, Salmonella enterica enterica serovar Typhi Ty2
aucaugagcucgucgauuugcg

SEQ ID NO: 200883 - RNA, 22 nt, Salmonella enterica enterica serovar Typhi Ty2
gcgucgcagcuuucauggcgua

SEQ ID NO: 200884 - RNA, 22 nt, Salmonella enterica enterica serovar Typhi Ty2
ucugucauucgacgaaugauua

SEQ ID NO: 200885 - RNA, 22 nt, Salmonella enterica enterica serovar Typhi Ty2
ccgagccuguucuugcgcggug

SEQ ID NO: 200886 - RNA, 22 nt, Salmonella enterica enterica serovar Typhi Ty2
uucauauccgcuuuaaucgcgc

SEQ ID NO: 200887 - RNA, 22 nt, Salmonella enterica enterica serovar Typhi Ty2
uggauuucaaaaacggcgaucc

SEQ ID NO: 200888 - RNA, 18 nt, Salmonella enterica enterica serovar Typhi Ty2
ucgaccucgacaaucacc

SEQ ID NO: 200889 - RNA, 20 nt, Salmonella enterica enterica serovar Typhi Ty2
auugccgauggugguauaca

SEQ ID NO: 200890 - RNA, 22 nt, Salmonella enterica enterica serovar Typhi Ty2
auggucauagcggcagcgccag

SEQ ID NO: 200891 - RNA, 22 nt, Salmonella enterica enterica serovar Typhi Ty2
ugauaaugcugacauuaugcgc

SEQ ID NO: 200892 - RNA, 22 nt, Salmonella enterica enterica serovar Typhi Ty2
augagauuaauacacuggagau

SEQ ID NO: 200893 - RNA, 22 nt, Salmonella enterica enterica serovar Typhi Ty2
ccggccuacucacugcaacgcg

SEQ ID NO: 200894 - RNA, 22 nt, Salmonella enterica enterica serovar Typhi Ty2
cacauuuccuacguuaucgagc

SEQ ID NO: 200895 - RNA, 22 nt, Salmonella enterica enterica serovar Typhi Ty2
ugacuaucugcgcuggugcuua

SEQ ID NO: 200896 - RNA, 22 nt, Salmonella enterica enterica serovar Typhi Ty2
ugauugccagcauaaccgccgc

SEQ ID NO: 200897 - RNA, 22 nt, Salmonella enterica enterica serovar Typhi Ty2
cagguuguugggauguuucaga

SEQ ID NO: 200898 - RNA, 22 nt, Salmonella enterica enterica serovar Typhi Ty2
augcgcuuguugcgucaggcua

SEQ ID NO: 200899 - RNA, 22 nt, Salmonella enterica enterica serovar Typhi Ty2
agcuauucggccagcgccaccg

SEQ ID NO: 200900 - RNA, 22 nt, Salmonella enterica enterica serovar Typhi Ty2
cgcauauccugugggauuaguc

SEQ ID NO: 200901 - RNA, 22 nt, Salmonella enterica enterica serovar Typhi Ty2
augaauacacaggauuugacga

SEQ ID NO: 200902 - RNA, 22 nt, Salmonella enterica enterica serovar Typhi Ty2
aacgcgcagauuaaucugguga

SEQ ID NO: 200903 - RNA, 23 nt, Salmonella enterica enterica serovar Typhi Ty2
cggacugacguugcgaaucaggu

SEQ ID NO: 200904 - RNA, 22 nt, Salmonella enterica enterica serovar Typhi Ty2
ucugcaaacguaggaaaagggu

SEQ ID NO: 200905 - RNA, 22 nt, Salmonella enterica enterica serovar Typhi Ty2
uaggccaaccgccauccggcau

SEQ ID NO: 200906 - RNA, 22 nt, Salmonella enterica enterica serovar Typhi Ty2
uccagcgugccguagcgcugcc

SEQ ID NO: 200907 - RNA, 22 nt, Salmonella enterica enterica serovar Typhi Ty2
aacgccugaagucgugacucgg

SEQ ID NO: 200908 - RNA, 22 nt, Salmonella enterica enterica serovar Typhi Ty2
cguuaucucggcaugucgaugg

SEQ ID NO: 200909 - RNA, 19 nt, Salmonella enterica enterica serovar Typhi Ty2
aucguuggagagacccgcu

SEQ ID NO: 200910 - RNA, 22 nt, Salmonella enterica enterica serovar Typhi Ty2
uucgcugaguucguucagcguc

SEQ ID NO: 200911 - RNA, 22 nt, Salmonella enterica enterica serovar Typhi Ty2
acgcccuggaacagcaggcggu

SEQ ID NO: 200912 - RNA, 22 nt, Salmonella enterica enterica serovar Typhi Ty2
ugucgcuggaaaaguaucgcga

SEQ ID NO: 200913 - RNA, 22 nt, Salmonella enterica enterica serovar Typhi Ty2
gguauucgaaauugucuuuauc

SEQ ID NO: 200914 - RNA, 22 nt, Salmonella enterica enterica serovar Typhi Ty2
ucagccgccgacagaugccauu

SEQ ID NO: 200915 - RNA, 22 nt, Salmonella enterica enterica serovar Typhi Ty2
agcgauaaccugcugaugauca

SEQ ID NO: 200916 - RNA, 22 nt, Salmonella enterica enterica serovar Typhi Ty2
aucccgcgacgacccguucgau

SEQ ID NO: 200917 - RNA, 22 nt, Salmonella enterica enterica serovar Typhi Ty2
agcggccugcuggucucauugu

SEQ ID NO: 200918 - RNA, 22 nt, Salmonella enterica enterica serovar Typhi Ty2
agcaggguuucugaauuugguc

SEQ ID NO: 200919 - RNA, 22 nt, Salmonella enterica enterica serovar Typhi Ty2
cggguuaagcgcggaagaugga

SEQ ID NO: 200920 - RNA, 19 nt, Salmonella enterica enterica serovar Typhi Ty2
ccgcguucauccaugcaga

SEQ ID NO: 200921 - RNA, 20 nt, Salmonella enterica enterica serovar Typhi Ty2
cguuccggcgguguuuguca

SEQ ID NO: 200922 - RNA, 22 nt, Salmonella enterica enterica serovar Typhi Ty2
gcaaucgcauguuaugccacug

SEQ ID NO: 200923 - RNA, 22 nt, Salmonella enterica enterica serovar Typhi Ty2
gcuggaugaaacuggcuggaca

SEQ ID NO: 200924 - RNA, 22 nt, Salmonella enterica enterica serovar Typhi Ty2
uggcgcugcgcuuuccggccua

SEQ ID NO: 200925 - RNA, 22 nt, Salmonella enterica enterica serovar Typhi Ty2
uuucaacugcgcggcacgcuca

SEQ ID NO: 200926 - RNA, 22 nt, Salmonella enterica enterica serovar Typhi Ty2
agucgcuguacugcgcgagcag

SEQ ID NO: 200927 - RNA, 22 nt, Salmonella enterica enterica serovar Typhi Ty2
aucuguuuauucuucgucagau

SEQ ID NO: 200928 - RNA, 22 nt, Salmonella enterica enterica serovar Typhi Ty2
uaggcugagucccccaaagguu

SEQ ID NO: 200929 - RNA, 22 nt, Salmonella enterica enterica serovar Typhi Ty2
caguaccuggugcccacgggac

SEQ ID NO: 200930 - RNA, 22 nt, Salmonella enterica enterica serovar Typhi Ty2
ugccguugaauccagcgccgca

SEQ ID NO: 200931 - RNA, 19 nt, Salmonella enterica enterica serovar Typhi Ty2
ugccggaaaaaggcaagcc

SEQ ID NO: 200932 - RNA, 22 nt, Salmonella enterica enterica serovar Typhi Ty2
guagcuuucgucagaucgcuca

SEQ ID NO: 200933 - RNA, 22 nt, Salmonella enterica enterica serovar Typhi Ty2
cgccugcugaauuugggcgaac

SEQ ID NO: 200934 - RNA, 22 nt, Salmonella enterica enterica serovar Typhi Ty2
uauccaaugguuaacguucugg

SEQ ID NO: 200935 - RNA, 22 nt, Salmonella enterica enterica serovar Typhi Ty2
auagugucuuauucggcaauug

SEQ ID NO: 200936 - RNA, 22 nt, Salmonella enterica enterica serovar Typhi Ty2
guaaagacggcgauaaaagucg

SEQ ID NO: 200937 - RNA, 22 nt, Salmonella enterica enterica serovar Typhi Ty2
uucagccguuuucaggacgcug

SEQ ID NO: 200938 - RNA, 22 nt, Salmonella enterica enterica serovar Typhi Ty2
ugcuggauaaaauuaaggcgau

SEQ ID NO: 200939 - RNA, 23 nt, Salmonella enterica enterica serovar Typhi Ty2
aagcugcuggauacgguagggaa

SEQ ID NO: 200940 - RNA, 22 nt, Salmonella enterica enterica serovar Typhi Ty2
gaacaguuuaaaaagugcauuc

SEQ ID NO: 200941 - RNA, 22 nt, Salmonella enterica enterica serovar Typhi Ty2
auccggguaauguaaaaaaucu

SEQ ID NO: 200942 - RNA, 22 nt, Salmonella enterica enterica serovar Typhi Ty2
ugaucaauuucaaagaagcgac

SEQ ID NO: 200943 - RNA, 22 nt, Salmonella enterica enterica serovar Typhi Ty2
uaggcuuucguaacgugaucgg

SEQ ID NO: 200944 - RNA, 22 nt, Salmonella enterica enterica serovar Typhi Ty2
aacgccaugaucaucggcaccg

SEQ ID NO: 200945 - RNA, 21 nt, Salmonella enterica enterica serovar Typhi Ty2
acgguuggaggguugcugcag

SEQ ID NO: 200946 - RNA, 22 nt, Salmonella enterica enterica serovar Typhi Ty2
aguggaaucagccaggagucgg

SEQ ID NO: 200947 - RNA, 19 nt, Salmonella enterica enterica serovar Typhi Ty2
ucgaacgcugcgaauuuau

SEQ ID NO: 200948 - RNA, 22 nt, Salmonella enterica enterica serovar Typhi Ty2
cgauuacgcccucuuugauuga

SEQ ID NO: 200949 - RNA, 22 nt, Salmonella enterica enterica serovar Typhi Ty2
cggauaaggcgcuugcgccauc

SEQ ID NO: 200950 - RNA, 22 nt, Salmonella enterica enterica serovar Typhi Ty2
aauaacgcgugaugcuugucag

SEQ ID NO: 200951 - RNA, 22 nt, Salmonella enterica enterica serovar Typhi Ty2
agacugcauuucaauggcuucc

SEQ ID NO: 200952 - RNA, 22 nt, Salmonella enterica enterica serovar Typhi Ty2
ggcuuacaccugucagcggcga

SEQ ID NO: 200953 - RNA, 22 nt, Salmonella enterica enterica serovar Typhi Ty2
gccaggaaguuaugcggguuug

SEQ ID NO: 200954 - RNA, 22 nt, Salmonella enterica enterica serovar Typhi Ty2
ggccugauuccccagcauuguu

SEQ ID NO: 200955 - RNA, 17 nt, Salmonella enterica enterica serovar Typhi Ty2
gcagccugcccagccgg

SEQ ID NO: 200956 - RNA, 22 nt, Salmonella enterica enterica serovar Typhi Ty2
cucaaugcuaacuacgcgaugg

SEQ ID NO: 200957 - RNA, 22 nt, Salmonella enterica enterica serovar Typhi Ty2
uggccgugguggucgacgauca

SEQ ID NO: 200958 - RNA, 22 nt, Salmonella enterica enterica serovar Typhi Ty2
ugguguccaucgagguugccag

SEQ ID NO: 200959 - RNA, 18 nt, Salmonella enterica enterica serovar Typhi Ty2
uguugagcugguacaggc

SEQ ID NO: 200960 - RNA, 22 nt, Salmonella enterica enterica serovar Typhi Ty2
acagauuaugcgucauucgcua

SEQ ID NO: 200961 - RNA, 22 nt, Salmonella enterica enterica serovar Typhi Ty2
gugguaauuagugaggauggcg

SEQ ID NO: 200962 - RNA, 22 nt, Salmonella enterica enterica serovar Typhi Ty2
aaggccuuugaccacuauuucg

SEQ ID NO: 200963 - RNA, 22 nt, Salmonella enterica enterica serovar Typhi Ty2
uguaggccggauaagacgcguc

SEQ ID NO: 200964 - RNA, 20 nt, Salmonella enterica enterica serovar Typhi Ty2
aucaaccgucgucugggguu

SEQ ID NO: 200965 - RNA, 22 nt, Salmonella enterica enterica serovar Typhi Ty2
uauggcgguugcguggccgccu

SEQ ID NO: 200966 - RNA, 22 nt, Salmonella enterica enterica serovar Typhi Ty2
ccguggaaucaggucggcacaa

SEQ ID NO: 200967 - RNA, 22 nt, Salmonella enterica enterica serovar Typhi Ty2
uggcggcaccuuccagaacgaa

SEQ ID NO: 200968 - RNA, 22 nt, Salmonella enterica enterica serovar Typhi Ty2
uacguaugggguaugaggcggu

SEQ ID NO: 200969 - RNA, 22 nt, Salmonella enterica enterica serovar Typhi Ty2
ggcuacaacgccauugccgccg

SEQ ID NO: 200970 - RNA, 22 nt, Salmonella enterica enterica serovar Typhi Ty2
gaugcuggcguugcgaacauuu

SEQ ID NO: 200971 - RNA, 22 nt, Salmonella enterica enterica serovar Typhi Ty2
ggaccugaugaugcgccggauu

SEQ ID NO: 200972 - RNA, 22 nt, Salmonella enterica enterica serovar Typhi Ty2
gccgguauggucgaggagugaa

SEQ ID NO: 200973 - RNA, 21 nt, Salmonella enterica enterica serovar Typhi Ty2
aucgaaggucacugcaaauug

SEQ ID NO: 200974 - RNA, 22 nt, Salmonella enterica enterica serovar Typhi Ty2
caguauauaucguuucaugcuu

SEQ ID NO: 200975 - RNA, 22 nt, Salmonella enterica enterica serovar Typhi Ty2
ggauacuugaugccuuuauccg

SEQ ID NO: 200976 - RNA, 22 nt, Salmonella enterica enterica serovar Typhi Ty2
uccugaguuuaucggucgucug

SEQ ID NO: 200977 - RNA, 22 nt, Salmonella enterica enterica serovar Typhi Ty2
ugucuguacguuuccauuugag

SEQ ID NO: 200978 - RNA, 21 nt, Salmonella enterica enterica serovar Typhi Ty2
uugcggcgagagauuugcgaa

SEQ ID NO: 200979 - RNA, 22 nt, Salmonella enterica enterica serovar Typhi Ty2
auccugauacuuuccgagauag

SEQ ID NO: 200980 - RNA, 22 nt, Salmonella enterica enterica serovar Typhi Ty2
ugugaccauuaucgggcaauca

SEQ ID NO: 200981 - RNA, 22 nt, Salmonella enterica enterica serovar Typhi Ty2
cgaucuuguuuggucguuauga

SEQ ID NO: 200982 - RNA, 22 nt, Salmonella enterica enterica serovar Typhi Ty2
aaucuggggcguuaucgcgggu

SEQ ID NO: 200983 - RNA, 22 nt, Salmonella enterica enterica serovar Typhi Ty2
cuuaccgguaugacgcgcuaaa

SEQ ID NO: 200984 - RNA, 22 nt, Salmonella enterica enterica serovar Typhi Ty2
cgugccugauggcgcugugcuu

SEQ ID NO: 200985 - RNA, 22 nt, Salmonella enterica enterica serovar Typhi Ty2
ggcguacauuacaauuuuucau

SEQ ID NO: 200986 - RNA, 19 nt, Salmonella enterica enterica serovar Typhi Ty2
gcugagugaguccgaaaau

SEQ ID NO: 200987 - RNA, 22 nt, Salmonella enterica enterica serovar Typhi Ty2
uuguaggcccggucagcgcagc

SEQ ID NO: 200988 - RNA, 22 nt, Salmonella enterica enterica serovar Typhi Ty2
cagauagcgccggaaaugauug

SEQ ID NO: 200989 - RNA, 22 nt, Salmonella enterica enterica serovar Typhi Ty2
aauucgcuccguuaagccuaug

SEQ ID NO: 200990 - RNA, 22 nt, Salmonella enterica enterica serovar Typhi Ty2
uugaccgugcuggcauucgccg

SEQ ID NO: 200991 - RNA, 22 nt, Salmonella enterica enterica serovar Typhi Ty2
gggcgaugcuggaugaauuacg

SEQ ID NO: 200992 - RNA, 22 nt, Salmonella enterica enterica serovar Typhi Ty2
aagacgcgucgccaucuggcuc

SEQ ID NO: 200993 - RNA, 22 nt, Salmonella enterica enterica serovar Typhi Ty2
gaacccggcaaguucaacgucu

SEQ ID NO: 200994 - RNA, 22 nt, Salmonella enterica enterica serovar Typhi Ty2
cguuggcgucaucgacauuaac

SEQ ID NO: 200995 - RNA, 22 nt, Salmonella enterica enterica serovar Typhi Ty2
cacaggagauucgucaggcggc

SEQ ID NO: 200996 - RNA, 22 nt, Salmonella enterica enterica serovar Typhi Ty2
gacuucauggagucgaguugca

SEQ ID NO: 200997 - RNA, 22 nt, Salmonella enterica enterica serovar Typhi Ty2
cugacugcucagccggaagaac

SEQ ID NO: 200998 - RNA, 22 nt, Salmonella enterica enterica serovar Typhi Ty2
ugcugccggaaaugucugcgga

SEQ ID NO: 200999 - RNA, 22 nt, Salmonella enterica enterica serovar Typhi Ty2
cgccgcaagggacggaggucuc

SEQ ID NO: 201000 - RNA, 19 nt, Salmonella enterica enterica serovar Typhi Ty2
gacgcggauaaucaugcua

SEQ ID NO: 201001 - RNA, 22 nt, Salmonella enterica enterica serovar Typhi Ty2
auuuguaguguucaaagagcuc

SEQ ID NO: 201002 - RNA, 22 nt, Salmonella enterica enterica serovar Typhi Ty2
auccgcugcgcauugguuuauc

SEQ ID NO: 201003 - RNA, 22 nt, Salmonella enterica enterica serovar Typhi Ty2
uaacagccccagcccuggcgua

SEQ ID NO: 201004 - RNA, 17 nt, Salmonella enterica enterica serovar Typhi Ty2
cgccauuuugcaacugg

SEQ ID NO: 201005 - RNA, 22 nt, Salmonella enterica enterica serovar Typhi Ty2
acguuucuccuccauuugacug

SEQ ID NO: 201006 - RNA, 18 nt, Salmonella enterica enterica serovar Typhi Ty2
gcagggcaguaacagcgg

SEQ ID NO: 201007 - RNA, 23 nt, Salmonella enterica enterica serovar Typhi Ty2
uuaagcaccacauuggugcaaua

SEQ ID NO: 201008 - RNA, 23 nt, Salmonella enterica enterica serovar Typhi Ty2
acgccgcaggcgauggaucugcu

SEQ ID NO: 201009 - RNA, 22 nt, Salmonella enterica enterica serovar Typhi Ty2
ccgcgguaucgcggugaagucc

SEQ ID NO: 201010 - RNA, 22 nt, Salmonella enterica enterica serovar Typhi Ty2
guauggcgugccauuguugccu

SEQ ID NO: 201011 - RNA, 20 nt, Salmonella enterica enterica serovar Typhi Ty2
acauaauccggguaaagacc

SEQ ID NO: 201012 - RNA, 22 nt, Salmonella enterica enterica serovar Typhi Ty2
uauugguauacguuuagguaua

SEQ ID NO: 201013 - RNA, 22 nt, Salmonella enterica enterica serovar Typhi Ty2
aacugacuuuguuacuggccgg

SEQ ID NO: 201014 - RNA, 22 nt, Salmonella enterica enterica serovar Typhi Ty2
auccgaaauccgucuguaucuc

SEQ ID NO: 201015 - RNA, 21 nt, Salmonella enterica enterica serovar Typhi Ty2
agcgucaauugccaggagcga

SEQ ID NO: 201016 - RNA, 19 nt, Salmonella enterica enterica serovar Typhi Ty2
aucauccaggcuggacgua

SEQ ID NO: 201017 - RNA, 22 nt, Salmonella enterica enterica serovar Typhi Ty2
uggcuuuagcagguaaugccgc

SEQ ID NO: 201018 - RNA, 22 nt, Salmonella enterica enterica serovar Typhi Ty2
uaggccggauaaggcguuagcc

SEQ ID NO: 201019 - RNA, 22 nt, Salmonella enterica enterica serovar Typhi Ty2
augagcugaccacugacgaaaa

SEQ ID NO: 201020 - RNA, 21 nt, Salmonella enterica enterica serovar Typhi Ty2
aucgcccuaugaugccgagga

SEQ ID NO: 201021 - RNA, 22 nt, Salmonella enterica enterica serovar Typhi Ty2
uaugaagaucguaugguucagc

SEQ ID NO: 201022 - RNA, 22 nt, Salmonella enterica enterica serovar Typhi Ty2
ugagaucguacugcagcagcuc

SEQ ID NO: 201023 - RNA, 22 nt, Salmonella enterica enterica serovar Typhi Ty2
caugcacauuaaaagaaugguu

SEQ ID NO: 201024 - RNA, 22 nt, Salmonella enterica enterica serovar Typhi Ty2
uugcgcgguggcuuggccgauu

SEQ ID NO: 201025 - RNA, 22 nt, Salmonella enterica enterica serovar Typhi Ty2
cacuggugaaaucgccuuccgg

SEQ ID NO: 201026 - RNA, 22 nt, Salmonella enterica enterica serovar Typhi Ty2
uucgugagcuacgucaaaaugu

SEQ ID NO: 201027 - RNA, 22 nt, Salmonella enterica enterica serovar Typhi Ty2
ccugaugcuguugcaugauggu

SEQ ID NO: 201028 - RNA, 22 nt, Salmonella enterica enterica serovar Typhi Ty2
cgcuauccgggauguguugaug

SEQ ID NO: 201029 - RNA, 22 nt, Salmonella enterica enterica serovar Typhi Ty2
ggcgacaauuuuccccuggcga

SEQ ID NO: 201030 - RNA, 21 nt, Salmonella enterica enterica serovar Typhi Ty2
cgcuauucgcgcuaccuuugg

SEQ ID NO: 201031 - RNA, 22 nt, Salmonella enterica enterica serovar Typhi Ty2
cauuccuguuuuucgucuguca

SEQ ID NO: 201032 - RNA, 22 nt, Salmonella enterica enterica serovar Typhi Ty2
guuacugucggcgauauagcgc

SEQ ID NO: 201033 - RNA, 22 nt, Salmonella enterica enterica serovar Typhi Ty2
cacuaaaucagcggcggacgcg

SEQ ID NO: 201034 - RNA, 22 nt, Salmonella enterica enterica serovar Typhi Ty2
uggcaugugguauugauccuga

SEQ ID NO: 201035 - RNA, 22 nt, Salmonella enterica enterica serovar Typhi Ty2
uucugcugcaaaaaacguucgg

SEQ ID NO: 201036 - RNA, 22 nt, Salmonella enterica enterica serovar Typhi Ty2
augcagaugaggaaaaugcugc

SEQ ID NO: 201037 - RNA, 22 nt, Salmonella enterica enterica serovar Typhi Ty2
ucgcccgaacguuagucgcacc

SEQ ID NO: 201038 - RNA, 22 nt, Salmonella enterica enterica serovar Typhi Ty2
cugcaggacucugcaacgucug

SEQ ID NO: 201039 - RNA, 22 nt, Salmonella enterica enterica serovar Typhi Ty2
gauuuccgcaacguggugcugg

SEQ ID NO: 201040 - RNA, 20 nt, Salmonella enterica enterica serovar Typhi Ty2
gcucaacccggauaucgaac

SEQ ID NO: 201041 - RNA, 22 nt, Salmonella enterica enterica serovar Typhi Ty2
auugcguugucccugcuguaug

SEQ ID NO: 201042 - RNA, 22 nt, Salmonella enterica enterica serovar Typhi Ty2
ucacugcaagccucucaggaug

SEQ ID NO: 201043 - RNA, 22 nt, Salmonella enterica enterica serovar Typhi Ty2
cgcccguagcgaucagcuucug

SEQ ID NO: 201044 - RNA, 22 nt, Salmonella enterica enterica serovar Typhi Ty2
aacgccguauuuacgggaggcc

SEQ ID NO: 201045 - RNA, 22 nt, Salmonella enterica enterica serovar Typhi Ty2
accagcgucagaaauaacugaa

SEQ ID NO: 201046 - RNA, 22 nt, Salmonella enterica enterica serovar Typhi Ty2
ucugcgcgugcuggcggaugac

SEQ ID NO: 201047 - RNA, 22 nt, Salmonella enterica enterica serovar Typhi Ty2
gccguuuauaaguauuacgaca

SEQ ID NO: 201048 - RNA, 22 nt, Salmonella enterica enterica serovar Typhi Ty2
uucagauacaaaaaacccugcu

SEQ ID NO: 201049 - RNA, 22 nt, Salmonella enterica enterica serovar Typhi Ty2
gaugaugcacaucggcauccau

SEQ ID NO: 201050 - RNA, 18 nt, Salmonella enterica enterica serovar Typhi Ty2
uccgcuggacucccugaa

SEQ ID NO: 201051 - RNA, 22 nt, Salmonella enterica enterica serovar Typhi Ty2
cagcgaggcaccaucauugaaa

SEQ ID NO: 201052 - RNA, 22 nt, Salmonella enterica enterica serovar Typhi Ty2
gcgguugcugcauacgcuuucc

SEQ ID NO: 201053 - RNA, 22 nt, Salmonella enterica enterica serovar Typhi Ty2
gggaucaguauaccucgucaga

SEQ ID NO: 201054 - RNA, 22 nt, Salmonella enterica enterica serovar Typhi Ty2
cgggcaguuaauggcgacgcug

SEQ ID NO: 201055 - RNA, 22 nt, Salmonella enterica enterica serovar Typhi Ty2
aucgcucuauaaucguuguaua

SEQ ID NO: 201056 - RNA, 18 nt, Salmonella enterica enterica serovar Typhi Ty2
cucgaaggauuucaggau

SEQ ID NO: 201057 - RNA, 22 nt, Salmonella enterica enterica serovar Typhi Ty2
agaugcggcuucagguuaauuu

SEQ ID NO: 201058 - RNA, 22 nt, Salmonella enterica enterica serovar Typhi Ty2
gccagcacuaccguuccuuugg

SEQ ID NO: 201059 - RNA, 22 nt, Salmonella enterica enterica serovar Typhi Ty2
uuucugcacaccuggcgucagc

SEQ ID NO: 201060 - RNA, 22 nt, Salmonella enterica enterica serovar Typhi Ty2
uaauuccguaagcauuucagac

SEQ ID NO: 201061 - RNA, 22 nt, Salmonella enterica enterica serovar Typhi Ty2
acguugcgacaccugcuccggc

SEQ ID NO: 201062 - RNA, 22 nt, Salmonella enterica enterica serovar Typhi Ty2
cuggcugaaaacuugauugcca

SEQ ID NO: 201063 - RNA, 22 nt, Salmonella enterica enterica serovar Typhi Ty2
gauggcauuuuugucggcccua

SEQ ID NO: 201064 - RNA, 22 nt, Salmonella enterica enterica serovar Typhi Ty2
agcaaucgcaagcggaagcgcg

SEQ ID NO: 201065 - RNA, 22 nt, Salmonella enterica enterica serovar Typhi Ty2
aacgacugcuucaucuggggag

SEQ ID NO: 201066 - RNA, 22 nt, Salmonella enterica enterica serovar Typhi Ty2
uggcagcuucgccuuauccggc

SEQ ID NO: 201067 - RNA, 22 nt, Salmonella enterica enterica serovar Typhi Ty2
cagucguaagcgacggcugguu

SEQ ID NO: 201068 - RNA, 22 nt, Salmonella enterica enterica serovar Typhi Ty2
aucgccaauggaaguuaauagg

SEQ ID NO: 201069 - RNA, 22 nt, Salmonella enterica enterica serovar Typhi Ty2
guugucauuuggacaacaguga

SEQ ID NO: 201070 - RNA, 22 nt, Salmonella enterica enterica serovar Typhi Ty2
caggauguaguugaauuugccu

SEQ ID NO: 201071 - RNA, 22 nt, Salmonella enterica enterica serovar Typhi Ty2
gguuucauuuguugccguuaug

SEQ ID NO: 201072 - RNA, 22 nt, Salmonella enterica enterica serovar Typhi Ty2
gaugaacauacguuuggucacg

SEQ ID NO: 201073 - RNA, 22 nt, Salmonella enterica enterica serovar Typhi Ty2
cuuccagcagacacucuuccag

SEQ ID NO: 201074 - RNA, 22 nt, Salmonella enterica enterica serovar Typhi Ty2
ugaggcaucgagauaugcgacu

SEQ ID NO: 201075 - RNA, 17 nt, Salmonella enterica enterica serovar Typhi Ty2
uuuacggcuauaaccag

SEQ ID NO: 201076 - RNA, 23 nt, Salmonella enterica enterica serovar Typhi Ty2
uugccggcgagaugauggcagga

SEQ ID NO: 201077 - RNA, 22 nt, Salmonella enterica enterica serovar Typhi Ty2
cagugaggacgcuaaugccgcu

SEQ ID NO: 201078 - RNA, 22 nt, Salmonella enterica enterica serovar Typhi Ty2
auugauguggguaaagugaugg

SEQ ID NO: 201079 - RNA, 20 nt, Salmonella enterica enterica serovar Typhi Ty2
gauaaacagcucuucccgcg

SEQ ID NO: 201080 - RNA, 22 nt, Salmonella enterica enterica serovar Typhi Ty2
acggguuauguuaucauuugua

SEQ ID NO: 201081 - RNA, 22 nt, Salmonella enterica enterica serovar Typhi Ty2
cgcugacggucucgcuguuuca

SEQ ID NO: 201082 - RNA, 20 nt, Salmonella enterica enterica serovar Typhi Ty2
cgaugccuccggugauauac

SEQ ID NO: 201083 - RNA, 22 nt, Salmonella enterica enterica serovar Typhi Ty2
cauuaugcgcugguggaugagg

SEQ ID NO: 201084 - RNA, 22 nt, Salmonella enterica enterica serovar Typhi Ty2
ccuguggaauggcggucagauc

SEQ ID NO: 201085 - RNA, 22 nt, Salmonella enterica enterica serovar Typhi Ty2
ggcaguugcugagcgcguugau

SEQ ID NO: 201086 - RNA, 22 nt, Salmonella enterica enterica serovar Typhi Ty2
ugcgguaaacaaggcuguaucg

SEQ ID NO: 201087 - RNA, 22 nt, Salmonella enterica enterica serovar Typhi Ty2
uggacaggacacgggauaauca

SEQ ID NO: 201088 - RNA, 22 nt, Salmonella enterica enterica serovar Typhi Ty2
gcgcucaggacucguuugggaa

SEQ ID NO: 201089 - RNA, 22 nt, Salmonella enterica enterica serovar Typhi Ty2
ugcaggauggcguccagcgacc

SEQ ID NO: 201090 - RNA, 20 nt, Salmonella enterica enterica serovar Typhi Ty2
cguuaagguaaagaaaagug

SEQ ID NO: 201091 - RNA, 22 nt, Salmonella enterica enterica serovar Typhi Ty2
gggcaguuugggcuuggcgcag

SEQ ID NO: 201092 - RNA, 22 nt, Salmonella enterica enterica serovar Typhi Ty2
gccuggauuuaaugcgucgcag

SEQ ID NO: 201093 - RNA, 22 nt, Salmonella enterica enterica serovar Typhi Ty2
aucggaugggcuuuaauaaucu

SEQ ID NO: 201094 - RNA, 22 nt, Salmonella enterica enterica serovar Typhi Ty2
gaauaacgacgcugugauaccg

SEQ ID NO: 201095 - RNA, 22 nt, Salmonella enterica enterica serovar Typhi Ty2
cugguuccguaccggucaucgc

SEQ ID NO: 201096 - RNA, 22 nt, Salmonella enterica enterica serovar Typhi Ty2
gccugauggcgcugcgcuuacc

SEQ ID NO: 201097 - RNA, 22 nt, Salmonella enterica enterica serovar Typhi Ty2
acggucaugaaaaucgugccgc

SEQ ID NO: 201098 - RNA, 22 nt, Salmonella enterica enterica serovar Typhi Ty2
ugguggaagaguucggcuugcg

SEQ ID NO: 201099 - RNA, 22 nt, Salmonella enterica enterica serovar Typhi Ty2
gccauugugucucugucuccaa

SEQ ID NO: 201100 - RNA, 22 nt, Salmonella enterica enterica serovar Typhi Ty2
agccagccaguucgaugauuuu

SEQ ID NO: 201101 - RNA, 22 nt, Salmonella enterica enterica serovar Typhi Ty2
gccgaucaauaauagaaacgac

SEQ ID NO: 201102 - RNA, 23 nt, Salmonella enterica enterica serovar Typhi Ty2
acgcggaacacguuaaccagcuc

SEQ ID NO: 201103 - RNA, 22 nt, Salmonella enterica enterica serovar Typhi Ty2
ugagguauuaaucuguagguga

SEQ ID NO: 201104 - RNA, 22 nt, Salmonella enterica enterica serovar Typhi Ty2
cgcguuauauuugucauaaauu

SEQ ID NO: 201105 - RNA, 22 nt, Salmonella enterica enterica serovar Typhi Ty2
agcaguuuaauaagguucuggc

SEQ ID NO: 201106 - RNA, 22 nt, Salmonella enterica enterica serovar Typhi Ty2
gucgauagcuauuaccgcacau

SEQ ID NO: 201107 - RNA, 22 nt, Salmonella enterica enterica serovar Typhi Ty2
caacuuaacgcuggcuacuucu

SEQ ID NO: 201108 - RNA, 20 nt, Salmonella enterica enterica serovar Typhi Ty2
uggugccgcccgccuggcag

SEQ ID NO: 201109 - RNA, 22 nt, Salmonella enterica enterica serovar Typhi Ty2
cacggcgauuacgugaacgaca

SEQ ID NO: 201110 - RNA, 22 nt, Salmonella enterica enterica serovar Typhi Ty2
aauuguguuugucgauauucgu

SEQ ID NO: 201111 - RNA, 22 nt, Salmonella enterica enterica serovar Typhi Ty2
ucaccgcgucgaaacggcagua

SEQ ID NO: 201112 - RNA, 22 nt, Salmonella enterica enterica serovar Typhi Ty2
ucagguaaagcgcccguggcga

SEQ ID NO: 201113 - RNA, 22 nt, Salmonella enterica enterica serovar Typhi Ty2
uggcgcguggccacaucaucaa

SEQ ID NO: 201114 - RNA, 22 nt, Salmonella enterica enterica serovar Typhi Ty2
accuguuugaacuuaccuggcg

SEQ ID NO: 201115 - RNA, 23 nt, Salmonella enterica enterica serovar Typhi Ty2
cgcuggaugauuuuugucagagc

SEQ ID NO: 201116 - RNA, 22 nt, Salmonella enterica enterica serovar Typhi Ty2
gccgguuaucaguuuaucggga

SEQ ID NO: 201117 - RNA, 22 nt, Salmonella enterica enterica serovar Typhi Ty2
agcuauuauguacggccgccaa

SEQ ID NO: 201118 - RNA, 22 nt, Salmonella enterica enterica serovar Typhi Ty2
acgguagcugccggaggugcug

SEQ ID NO: 201119 - RNA, 22 nt, Salmonella enterica enterica serovar Typhi Ty2
caggcaagggaagaagugagga

SEQ ID NO: 201120 - RNA, 22 nt, Salmonella enterica enterica serovar Typhi Ty2
ccuguugguuuacguuauggcu

SEQ ID NO: 201121 - RNA, 22 nt, Salmonella enterica enterica serovar Typhi Ty2
cugcguaauggacuauggcgcc

SEQ ID NO: 201122 - RNA, 22 nt, Salmonella enterica enterica serovar Typhi Ty2
guuuaucgaaggccagaucguc

SEQ ID NO: 201123 - RNA, 22 nt, Salmonella enterica enterica serovar Typhi Ty2
gcuuugcgauccagcuugccau

SEQ ID NO: 201124 - RNA, 22 nt, Salmonella enterica enterica serovar Typhi Ty2
aaacguacuuugcacggcgcau

SEQ ID NO: 201125 - RNA, 22 nt, Salmonella enterica enterica serovar Typhi Ty2
aacgcaggagaucgcugugcgu

SEQ ID NO: 201126 - RNA, 22 nt, Salmonella enterica enterica serovar Typhi Ty2
cuggucuuuauucagccugaca

SEQ ID NO: 201127 - RNA, 18 nt, Salmonella enterica enterica serovar Typhi Ty2
gcggauaagcgcagcgcc

SEQ ID NO: 201128 - RNA, 22 nt, Salmonella enterica enterica serovar Typhi Ty2
ggcggcuacgcuuauccgcuca

SEQ ID NO: 201129 - RNA, 22 nt, Salmonella enterica enterica serovar Typhi Ty2
cuucgcgucaugcguuauauca

SEQ ID NO: 201130 - RNA, 22 nt, Salmonella enterica enterica serovar Typhi Ty2
cucgcggacgucgaggaucugg

SEQ ID NO: 201131 - RNA, 22 nt, Salmonella enterica enterica serovar Typhi Ty2
aucgcuggucaguuugcuguac

SEQ ID NO: 201132 - RNA, 22 nt, Salmonella enterica enterica serovar Typhi Ty2
aauuacgagcaguaaugguauc

SEQ ID NO: 201133 - RNA, 22 nt, Salmonella enterica enterica serovar Typhi Ty2
ccagcgcuucgguauggcgggu

SEQ ID NO: 201134 - RNA, 22 nt, Salmonella enterica enterica serovar Typhi Ty2
aguguugacugccguuuuaguu

SEQ ID NO: 201135 - RNA, 21 nt, Salmonella enterica enterica serovar Typhi Ty2
ucauugcugccggauggcggc

SEQ ID NO: 201136 - RNA, 22 nt, Salmonella enterica enterica serovar Typhi Ty2
agcgcgguaucgcugagcuccu

SEQ ID NO: 201137 - RNA, 22 nt, Salmonella enterica enterica serovar Typhi Ty2
ugguaugcagcccagcaccgga

SEQ ID NO: 201138 - RNA, 22 nt, Salmonella enterica enterica serovar Typhi Ty2
cuucggcaucaaagguaucggc

SEQ ID NO: 201139 - RNA, 22 nt, Salmonella enterica enterica serovar Typhi Ty2
ugacuaauuaucgcccucacua

SEQ ID NO: 201140 - RNA, 22 nt, Salmonella enterica enterica serovar Typhi Ty2
aucagcguaucuucauuuucgc

SEQ ID NO: 201141 - RNA, 22 nt, Salmonella enterica enterica serovar Typhi Ty2
cgcggcuuggcauucuuggcgg

SEQ ID NO: 201142 - RNA, 22 nt, Salmonella enterica enterica serovar Typhi Ty2
guaugcgccuucagaucggagu

SEQ ID NO: 201143 - RNA, 22 nt, Salmonella enterica enterica serovar Typhi Ty2
caguauggaggagauagcgaca

SEQ ID NO: 201144 - RNA, 22 nt, Salmonella enterica enterica serovar Typhi Ty2
uuucaugcauuggacagcacgc

SEQ ID NO: 201145 - RNA, 22 nt, Salmonella enterica enterica serovar Typhi Ty2
aucguggugcuggcgcagauca

SEQ ID NO: 201146 - RNA, 22 nt, Salmonella enterica enterica serovar Typhi Ty2
cuggaagucaugggcauuuaug

SEQ ID NO: 201147 - RNA, 23 nt, Salmonella enterica enterica serovar Typhi Ty2
ccugaucgaugaagcgcguacgc

SEQ ID NO: 201148 - RNA, 22 nt, Salmonella enterica enterica serovar Typhi Ty2
aucugguugaauuugaucagga

SEQ ID NO: 201149 - RNA, 22 nt, Salmonella enterica enterica serovar Typhi Ty2
cugccguauaucgcgcugggua

SEQ ID NO: 201150 - RNA, 22 nt, Salmonella enterica enterica serovar Typhi Ty2
gaguuuaucuucaacagugaaa

SEQ ID NO: 201151 - RNA, 22 nt, Salmonella enterica enterica serovar Typhi Ty2
ucugacugaugggaugcgcuga

SEQ ID NO: 201152 - RNA, 22 nt, Salmonella enterica enterica serovar Typhi Ty2
cugaacgccgaagcguauuuag

SEQ ID NO: 201153 - RNA, 21 nt, Salmonella enterica enterica serovar Typhi Ty2
gcauguuuuucaccguugugc

SEQ ID NO: 201154 - RNA, 22 nt, Salmonella enterica enterica serovar Typhi Ty2
acaucgagauggauuuuugggu

SEQ ID NO: 201155 - RNA, 22 nt, Salmonella enterica enterica serovar Typhi Ty2
gcgaugcgguucaucaacguua

SEQ ID NO: 201156 - RNA, 22 nt, Salmonella enterica enterica serovar Typhi Ty2
uacgcuccagaccaucaugcau

SEQ ID NO: 201157 - RNA, 22 nt, Salmonella enterica enterica serovar Typhi Ty2
gagcuggucgacagugcgcugg

SEQ ID NO: 201158 - RNA, 22 nt, Salmonella enterica enterica serovar Typhi Ty2
agcaacaucaggcccuguaaag

SEQ ID NO: 201159 - RNA, 22 nt, Salmonella enterica enterica serovar Typhi Ty2
cauaccguggugcagggcauug

SEQ ID NO: 201160 - RNA, 22 nt, Salmonella enterica enterica serovar Typhi Ty2
agcguugcuugaucgccugccg

SEQ ID NO: 201161 - RNA, 22 nt, Salmonella enterica enterica serovar Typhi Ty2
ugucgcggauagugaccguugc

SEQ ID NO: 201162 - RNA, 22 nt, Salmonella enterica enterica serovar Typhi Ty2
agguugcugcaccgucaugaga

SEQ ID NO: 201163 - RNA, 22 nt, Salmonella enterica enterica serovar Typhi Ty2
gacagcgcuucccugcuggugg

SEQ ID NO: 201164 - RNA, 22 nt, Salmonella enterica enterica serovar Typhi Ty2
caacaguauuagccacggcauu

SEQ ID NO: 201165 - RNA, 22 nt, Salmonella enterica enterica serovar Typhi Ty2
uuccggcgugaccagaaacugg

SEQ ID NO: 201166 - RNA, 22 nt, Salmonella enterica enterica serovar Typhi Ty2
cagucgcuggaugacaacgcgc

SEQ ID NO: 201167 - RNA, 22 nt, Salmonella enterica enterica serovar Typhi Ty2
ccuguuggaaguaccaggcgug

SEQ ID NO: 201168 - RNA, 22 nt, Salmonella enterica enterica serovar Typhi Ty2
uacgccgcgaccacgccgaucg

SEQ ID NO: 201169 - RNA, 22 nt, Salmonella enterica enterica serovar Typhi Ty2
gcguugaaguucgucauaucgu

SEQ ID NO: 201170 - RNA, 22 nt, Salmonella enterica enterica serovar Typhi Ty2
ucugauugacgucaaucugggc

SEQ ID NO: 201171 - RNA, 22 nt, Salmonella enterica enterica serovar Typhi Ty2
gauaugcagcucauuggcggcg

SEQ ID NO: 201172 - RNA, 22 nt, Salmonella enterica enterica serovar Typhi Ty2
gccgccuugcgcaauaucauug

SEQ ID NO: 201173 - RNA, 22 nt, Salmonella enterica enterica serovar Typhi Ty2
auggcugcccggcgccuguaac

SEQ ID NO: 201174 - RNA, 22 nt, Salmonella enterica enterica serovar Typhi Ty2
guaaugaugccuugcugugccg

SEQ ID NO: 201175 - RNA, 23 nt, Salmonella enterica enterica serovar Typhi Ty2
cgacgcugaacgaacucagcgaa

SEQ ID NO: 201176 - RNA, 22 nt, Salmonella enterica enterica serovar Typhi Ty2
gugcgcuucuucaccgaacaga

SEQ ID NO: 201177 - RNA, 22 nt, Salmonella enterica enterica serovar Typhi Ty2
gcgcagugaggacauauuuguu

SEQ ID NO: 201178 - RNA, 22 nt, Salmonella enterica enterica serovar Typhi Ty2
cuggcaggcgggauggacauua

SEQ ID NO: 201179 - RNA, 22 nt, Salmonella enterica enterica serovar Typhi Ty2
gcuuucaggccuccuggugugg

SEQ ID NO: 201180 - RNA, 22 nt, Salmonella enterica enterica serovar Typhi Ty2
aagaucggucggcgccuuaugu

SEQ ID NO: 201181 - RNA, 22 nt, Salmonella enterica enterica serovar Typhi Ty2
aaauguuggcgaccugaugcag

SEQ ID NO: 201182 - RNA, 22 nt, Salmonella enterica enterica serovar Typhi Ty2
cgccauaagccuugcugacugc

SEQ ID NO: 201183 - RNA, 22 nt, Salmonella enterica enterica serovar Typhi Ty2
gaaccgugaguucgcggcagua

SEQ ID NO: 201184 - RNA, 20 nt, Salmonella enterica enterica serovar Typhi Ty2
guacugaugcuucguccguu

SEQ ID NO: 201185 - RNA, 20 nt, Salmonella enterica enterica serovar Typhi Ty2
cucagcaggccguuguccgg

SEQ ID NO: 201186 - RNA, 20 nt, Salmonella enterica enterica serovar Typhi Ty2
cguuggcuuaauacgcugug

SEQ ID NO: 201187 - RNA, 22 nt, Salmonella enterica enterica serovar Typhi Ty2
gccauugcguuguuagagaagu

SEQ ID NO: 201188 - RNA, 22 nt, Salmonella enterica enterica serovar Typhi Ty2
augccgggucggugccuucugc

SEQ ID NO: 201189 - RNA, 22 nt, Salmonella enterica enterica serovar Typhi Ty2
guuacugagaaaucaaaagcga

SEQ ID NO: 201190 - RNA, 22 nt, Salmonella enterica enterica serovar Typhi Ty2
ugguaaagcaaucgucaaaacc

SEQ ID NO: 201191 - RNA, 22 nt, Salmonella enterica enterica serovar Typhi Ty2
acaggcagcuuaaagcgcuguu

SEQ ID NO: 201192 - RNA, 22 nt, Salmonella enterica enterica serovar Typhi Ty2
gcgcauccuccaguuggcuguu

SEQ ID NO: 201193 - RNA, 22 nt, Salmonella enterica enterica serovar Typhi Ty2
aauguccugacauuaaccggcc

SEQ ID NO: 201194 - RNA, 22 nt, Salmonella enterica enterica serovar Typhi Ty2
augguaaauaagcggauuuucu

SEQ ID NO: 201195 - RNA, 22 nt, Salmonella enterica enterica serovar Typhi Ty2
gcugauuauugacuuucuggcg

SEQ ID NO: 201196 - RNA, 22 nt, Salmonella enterica enterica serovar Typhi Ty2
cugcgugguaguguagguauca

SEQ ID NO: 201197 - RNA, 22 nt, Salmonella enterica enterica serovar Typhi Ty2
ggucacguuuacgcugucgcca

SEQ ID NO: 201198 - RNA, 22 nt, Salmonella enterica enterica serovar Typhi Ty2
gcuuugcggaucaggcccccau

SEQ ID NO: 201199 - RNA, 22 nt, Salmonella enterica enterica serovar Typhi Ty2
ggucugucauucacggaagaca

SEQ ID NO: 201200 - RNA, 22 nt, Salmonella enterica enterica serovar Typhi Ty2
uuuauccgccgcagagacugaa

SEQ ID NO: 201201 - RNA, 22 nt, Salmonella enterica enterica serovar Typhi Ty2
ugauacugucggcaaugcgcuu

SEQ ID NO: 201202 - RNA, 19 nt, Salmonella enterica enterica serovar Typhi Ty2
uccgacgacgagcguauug

SEQ ID NO: 201203 - RNA, 22 nt, Salmonella enterica enterica serovar Typhi Ty2
cagaugccugauccagacgaau

SEQ ID NO: 201204 - RNA, 22 nt, Salmonella enterica enterica serovar Typhi Ty2
gcuguagcgacucuucgccggu

SEQ ID NO: 201205 - RNA, 21 nt, Salmonella enterica enterica serovar Typhi Ty2
cggauuacuggugggaauccu

SEQ ID NO: 201206 - RNA, 22 nt, Salmonella enterica enterica serovar Typhi Ty2
agguuauugccaaucagcacca

SEQ ID NO: 201207 - RNA, 22 nt, Salmonella enterica enterica serovar Typhi Ty2
aauggcuuuugaacacccaggu

SEQ ID NO: 201208 - RNA, 22 nt, Salmonella enterica enterica serovar Typhi Ty2
ucgguauggcaugaugcggaau

SEQ ID NO: 201209 - RNA, 22 nt, Salmonella enterica enterica serovar Typhi Ty2
gcgauugacgccgacgcuaaag

SEQ ID NO: 201210 - RNA, 22 nt, Salmonella enterica enterica serovar Typhi Ty2
gccggaacgggagaucacugcc

SEQ ID NO: 201211 - RNA, 22 nt, Salmonella enterica enterica serovar Typhi Ty2
uaucugcgguauuuaauccaua

SEQ ID NO: 201212 - RNA, 21 nt, Salmonella enterica enterica serovar Typhi Ty2
ggccaugacaucuauccuauc

SEQ ID NO: 201213 - RNA, 22 nt, Salmonella enterica enterica serovar Typhi Ty2
gcgaauaauggagauauucuga

SEQ ID NO: 201214 - RNA, 22 nt, Salmonella enterica enterica serovar Typhi Ty2
caucggcgcuguuucgccagua

SEQ ID NO: 201215 - RNA, 18 nt, Salmonella enterica enterica serovar Typhi Ty2
ucgacguguuugucgguc

SEQ ID NO: 201216 - RNA, 22 nt, Salmonella enterica enterica serovar Typhi Ty2
ucaaucuucauccgcgcgccca

SEQ ID NO: 201217 - RNA, 18 nt, Salmonella enterica enterica serovar Typhi Ty2
aacugggcgucaggcaac

SEQ ID NO: 201218 - RNA, 22 nt, Salmonella enterica enterica serovar Typhi Ty2
ucugaauuuaaaaauccugaac

SEQ ID NO: 201219 - RNA, 21 nt, Salmonella enterica enterica serovar Typhi Ty2
aucgccgguuucugccgcggu

SEQ ID NO: 201220 - RNA, 22 nt, Salmonella enterica enterica serovar Typhi Ty2
gcgguaauuuaagcggcaaucc

SEQ ID NO: 201221 - RNA, 22 nt, Salmonella enterica enterica serovar Typhi Ty2
uuugcuaacuacugucuggcgg

SEQ ID NO: 201222 - RNA, 19 nt, Salmonella enterica enterica serovar Typhi Ty2
auaccguuggccuugaugu

SEQ ID NO: 201223 - RNA, 22 nt, Salmonella enterica enterica serovar Typhi Ty2
ggcucuauuugcgcacgcagau

SEQ ID NO: 201224 - RNA, 22 nt, Salmonella enterica enterica serovar Typhi Ty2
uggucagggauauaugccgguu

SEQ ID NO: 201225 - RNA, 20 nt, Salmonella enterica enterica serovar Typhi Ty2
cauucgugaugucgauagcu

SEQ ID NO: 201226 - RNA, 22 nt, Salmonella enterica enterica serovar Typhi Ty2
gacgcaugauuaaagugcugau

SEQ ID NO: 201227 - RNA, 22 nt, Salmonella enterica enterica serovar Typhi Ty2
agcagguuggcgucgcgaagcc

SEQ ID NO: 201228 - RNA, 22 nt, Salmonella enterica enterica serovar Typhi Ty2
gcagcaaaaugcugugcguugg

SEQ ID NO: 201229 - RNA, 22 nt, Salmonella enterica enterica serovar Typhi Ty2
cgacgguuugcaaaugggugau

SEQ ID NO: 201230 - RNA, 22 nt, Salmonella enterica enterica serovar Typhi Ty2
cgacgcagcgucugaauguuau

SEQ ID NO: 201231 - RNA, 22 nt, Salmonella enterica enterica serovar Typhi Ty2
uaaucguauccuggaugagcua

SEQ ID NO: 201232 - RNA, 22 nt, Salmonella enterica enterica serovar Typhi Ty2
ggguacugagugguggaccgug

SEQ ID NO: 201233 - RNA, 22 nt, Salmonella enterica enterica serovar Typhi Ty2
augacgguaacauuuuguuggc

SEQ ID NO: 201234 - RNA, 18 nt, Salmonella enterica enterica serovar Typhi Ty2
acgcugcccacgucuggg

SEQ ID NO: 201235 - RNA, 22 nt, Salmonella enterica enterica serovar Typhi Ty2
caaguagcguuaauaugacuuu

SEQ ID NO: 201236 - RNA, 22 nt, Salmonella enterica enterica serovar Typhi Ty2
guugcgcuggugguuuacguca

SEQ ID NO: 201237 - RNA, 22 nt, Salmonella enterica enterica serovar Typhi Ty2
ugguucccaaauuucucuacga

SEQ ID NO: 201238 - RNA, 21 nt, Salmonella enterica enterica serovar Typhi Ty2
agcuggguggcggugucgccg

SEQ ID NO: 201239 - RNA, 22 nt, Salmonella enterica enterica serovar Typhi Ty2
ugcgugacauguucgaacaagc

SEQ ID NO: 201240 - RNA, 22 nt, Salmonella enterica enterica serovar Typhi Ty2
uguguccucauuuugcgggagc

SEQ ID NO: 201241 - RNA, 22 nt, Salmonella enterica enterica serovar Typhi Ty2
gcagcgguuguuaccaaagccc

SEQ ID NO: 201242 - RNA, 20 nt, Salmonella enterica enterica serovar Typhi Ty2
cgaucgccucaaguuucugg

SEQ ID NO: 201243 - RNA, 22 nt, Salmonella enterica enterica serovar Typhi Ty2
uuguucaacagucgguagcuga

SEQ ID NO: 201244 - RNA, 22 nt, Salmonella enterica enterica serovar Typhi Ty2
ucgaccagguauucgaccuguu

SEQ ID NO: 201245 - RNA, 22 nt, Salmonella enterica enterica serovar Typhi Ty2
ggccugauaagcgcagcgccau

SEQ ID NO: 201246 - RNA, 22 nt, Salmonella enterica enterica serovar Typhi Ty2
auugaugacaucgaccugaacc

SEQ ID NO: 201247 - RNA, 22 nt, Salmonella enterica enterica serovar Typhi Ty2
cuguucaagcucuauccguggg

SEQ ID NO: 201248 - RNA, 22 nt, Salmonella enterica enterica serovar Typhi Ty2
uuugaugaggugcugaucugcc

SEQ ID NO: 201249 - RNA, 22 nt, Salmonella enterica enterica serovar Typhi Ty2
agcuuuaucucuaaagcgggca

SEQ ID NO: 201250 - RNA, 22 nt, Salmonella enterica enterica serovar Typhi Ty2
uaggccggaugagcguuagcgc

SEQ ID NO: 201251 - RNA, 22 nt, Salmonella enterica enterica serovar Typhi Ty2
ugugaauggaaaaacguacgaa

SEQ ID NO: 201252 - RNA, 22 nt, Salmonella enterica enterica serovar Typhi Ty2
cguagcguccggcguaaugccc

SEQ ID NO: 201253 - RNA, 22 nt, Salmonella enterica enterica serovar Typhi Ty2
cuccaguuggcugauguuguau

SEQ ID NO: 201254 - RNA, 22 nt, Salmonella enterica enterica serovar Typhi Ty2
acugcugcgguaaugcagagua

SEQ ID NO: 201255 - RNA, 22 nt, Salmonella enterica enterica serovar Typhi Ty2
guuugacgccgcgcggcagaau

SEQ ID NO: 201256 - RNA, 22 nt, Salmonella enterica enterica serovar Typhi Ty2
uccguaaccgucuggcggaguc

SEQ ID NO: 201257 - RNA, 22 nt, Salmonella enterica enterica serovar Typhi Ty2
gacaguguaaguaaaccugcua

SEQ ID NO: 201258 - RNA, 21 nt, Salmonella enterica enterica serovar Typhi Ty2
uagcuccauuacgaucaccac

SEQ ID NO: 201259 - RNA, 22 nt, Salmonella enterica enterica serovar Typhi Ty2
agagguucaugaugcgccugca

SEQ ID NO: 201260 - RNA, 22 nt, Salmonella enterica enterica serovar Typhi Ty2
ggcgcguaaaaaacugucugaa

SEQ ID NO: 201261 - RNA, 22 nt, Salmonella enterica enterica serovar Typhi Ty2
cugauucaaauugagcgucuua

SEQ ID NO: 201262 - RNA, 22 nt, Salmonella enterica enterica serovar Typhi Ty2
gcagccagauagcgcuugcuaa

SEQ ID NO: 201263 - RNA, 22 nt, Salmonella enterica enterica serovar Typhi Ty2
guauuaccaggaagagcucaau

SEQ ID NO: 201264 - RNA, 22 nt, Salmonella enterica enterica serovar Typhi Ty2
aggccgguauuuucuccaucag

SEQ ID NO: 201265 - RNA, 22 nt, Salmonella enterica enterica serovar Typhi Ty2
gcauugacgauuuuguacaggu

SEQ ID NO: 201266 - RNA, 22 nt, Salmonella enterica enterica serovar Typhi Ty2
cgguuggccggaaacccgcgcg

SEQ ID NO: 201267 - RNA, 22 nt, Salmonella enterica enterica serovar Typhi Ty2
aauuugcaaauggugaaaugau

SEQ ID NO: 201268 - RNA, 22 nt, Salmonella enterica enterica serovar Typhi Ty2
gcucauccaggauacgauuaag

SEQ ID NO: 201269 - RNA, 22 nt, Salmonella enterica enterica serovar Typhi Ty2
auaacgauaaucucagggguuu

SEQ ID NO: 201270 - RNA, 22 nt, Salmonella enterica enterica serovar Typhi Ty2
gugauucgcuggaaugcgcaaa

SEQ ID NO: 201271 - RNA, 22 nt, Salmonella enterica enterica serovar Typhi Ty2
aagguacgaguaauaacguccu

SEQ ID NO: 201272 - RNA, 22 nt, Salmonella enterica enterica serovar Typhi Ty2
gcgcgcaugauuauucccgccg

SEQ ID NO: 201273 - RNA, 22 nt, Salmonella enterica enterica serovar Typhi Ty2
gcugucgaugacgcuggguauc

SEQ ID NO: 201274 - RNA, 21 nt, Salmonella enterica enterica serovar Typhi Ty2
ugauuucaauauccagccaga

SEQ ID NO: 201275 - RNA, 22 nt, Salmonella enterica enterica serovar Typhi Ty2
ugcccgauaauauuuaccgauu

SEQ ID NO: 201276 - RNA, 22 nt, Salmonella enterica enterica serovar Typhi Ty2
gucauucgacggucgugguaac

SEQ ID NO: 201277 - RNA, 22 nt, Salmonella enterica enterica serovar Typhi Ty2
agauuugcuauauuugcgcccc

SEQ ID NO: 201278 - RNA, 20 nt, Salmonella enterica enterica serovar Typhi Ty2
uagucuuccuggcauccagc

SEQ ID NO: 201279 - RNA, 22 nt, Salmonella enterica enterica serovar Typhi Ty2
augugcaguuugcgaucgaauu

SEQ ID NO: 201280 - RNA, 22 nt, Salmonella enterica enterica serovar Typhi Ty2
gacguuucgcuuaucaggccua

SEQ ID NO: 201281 - RNA, 22 nt, Salmonella enterica enterica serovar Typhi Ty2
gcgcaggaaaguauugcggagc

SEQ ID NO: 201282 - RNA, 22 nt, Salmonella enterica enterica serovar Typhi Ty2
gauaccacguguauucaccuuc

SEQ ID NO: 201283 - RNA, 22 nt, Salmonella enterica enterica serovar Typhi Ty2
ugccggaaagcgauauucgcca

SEQ ID NO: 201284 - RNA, 22 nt, Salmonella enterica enterica serovar Typhi Ty2
gcgcaccagaucaucgcuguga

SEQ ID NO: 201285 - RNA, 22 nt, Salmonella enterica enterica serovar Typhi Ty2
uuucgcgggcuucugccauaau

SEQ ID NO: 201286 - RNA, 22 nt, Salmonella enterica enterica serovar Typhi Ty2
uggcgcugaugaaacgcauucu

SEQ ID NO: 201287 - RNA, 22 nt, Salmonella enterica enterica serovar Typhi Ty2
caucagacaagugaagaagccc

SEQ ID NO: 201288 - RNA, 22 nt, Salmonella enterica enterica serovar Typhi Ty2
gaucgcuaaaacguuuuuaugu

SEQ ID NO: 201289 - RNA, 22 nt, Salmonella enterica enterica serovar Typhi Ty2
agacaacggcccuuugcaggcg

SEQ ID NO: 201290 - RNA, 21 nt, Salmonella enterica enterica serovar Typhi Ty2
ucugauucaucggccaugacc

SEQ ID NO: 201291 - RNA, 22 nt, Salmonella enterica enterica serovar Typhi Ty2
caucggcuggcggagcgucuuc

SEQ ID NO: 201292 - RNA, 21 nt, Salmonella enterica enterica serovar Typhi Ty2
gacgaccgauaaacucaggaa

SEQ ID NO: 201293 - RNA, 22 nt, Salmonella enterica enterica serovar Typhi Ty2
accgugaaaacuucagccagcg

SEQ ID NO: 201294 - RNA, 22 nt, Salmonella enterica enterica serovar Typhi Ty2
acagaauggcauccgccugcuc

SEQ ID NO: 201295 - RNA, 22 nt, Salmonella enterica enterica serovar Typhi Ty2
guggcggaggugauucaacgcu

SEQ ID NO: 201296 - RNA, 22 nt, Salmonella enterica enterica serovar Typhi Ty2
gcaauguugcaaccagagcccu

SEQ ID NO: 201297 - RNA, 22 nt, Salmonella enterica enterica serovar Typhi Ty2
uccgcgaccgguaguaaaaaua

SEQ ID NO: 201298 - RNA, 22 nt, Salmonella enterica enterica serovar Typhi Ty2
uuauccgggcauuaaaguuucc

SEQ ID NO: 201299 - RNA, 22 nt, Salmonella enterica enterica serovar Typhi Ty2
uuagcguuacgcuacugucucc

SEQ ID NO: 201300 - RNA, 22 nt, Salmonella enterica enterica serovar Typhi Ty2
agcgucaaaauuucauguauau

SEQ ID NO: 201301 - RNA, 22 nt, Salmonella enterica enterica serovar Typhi Ty2
cgcugaauauucugcguccgga

SEQ ID NO: 201302 - RNA, 22 nt, Salmonella enterica enterica serovar Typhi Ty2
gcugauaagcaggugaucggcc

SEQ ID NO: 201303 - RNA, 22 nt, Salmonella enterica enterica serovar Typhi Ty2
ucauccguaugguaaccgcgcu

SEQ ID NO: 201304 - RNA, 22 nt, Salmonella enterica enterica serovar Typhi Ty2
cagcgguagaaaagccagugau

SEQ ID NO: 201305 - RNA, 22 nt, Salmonella enterica enterica serovar Typhi Ty2
ggugaauuccggauuaugaugu

SEQ ID NO: 201306 - RNA, 22 nt, Salmonella enterica enterica serovar Typhi Ty2
cccggaaaccaucauggaugcg

SEQ ID NO: 201307 - RNA, 22 nt, Salmonella enterica enterica serovar Typhi Ty2
auaacgguaaauugauugaucg

SEQ ID NO: 201308 - RNA, 22 nt, Salmonella enterica enterica serovar Typhi Ty2
acgaaggcgacauuagcagccg

SEQ ID NO: 201309 - RNA, 22 nt, Salmonella enterica enterica serovar Typhi Ty2
guauagccgaaguugaccgcuu

SEQ ID NO: 201310 - RNA, 22 nt, Salmonella enterica enterica serovar Typhi Ty2
gccugugggugaauccggacug

SEQ ID NO: 201311 - RNA, 22 nt, Salmonella enterica enterica serovar Typhi Ty2
ggcagaccauuuucugcggcgu

SEQ ID NO: 201312 - RNA, 21 nt, Salmonella enterica enterica serovar Typhi Ty2
auuagccguuuuuuugcaugg

SEQ ID NO: 201313 - RNA, 22 nt, Salmonella enterica enterica serovar Typhi Ty2
uaacggcuaugggaaggaugug

SEQ ID NO: 201314 - RNA, 22 nt, Salmonella enterica enterica serovar Typhi Ty2
ccggccuacaagauuugcaaua

SEQ ID NO: 201315 - RNA, 22 nt, Salmonella enterica enterica serovar Typhi Ty2
aggguaucagcagggcaggcuu

SEQ ID NO: 201316 - RNA, 21 nt, Salmonella enterica enterica serovar Typhi Ty2
gcguauuauuuuuaccaguuc

SEQ ID NO: 201317 - RNA, 22 nt, Salmonella enterica enterica serovar Typhi Ty2
aaguggcugggguacgaggauu

SEQ ID NO: 201318 - RNA, 22 nt, Salmonella enterica enterica serovar Typhi Ty2
uuccgcgauucaggaaguggag

SEQ ID NO: 201319 - RNA, 22 nt, Salmonella enterica enterica serovar Typhi Ty2
cuggaagaagccacuauccaac

SEQ ID NO: 201320 - RNA, 16 nt, Salmonella enterica enterica serovar Typhi Ty2
cggucugaauacgcau

SEQ ID NO: 201321 - RNA, 22 nt, Salmonella enterica enterica serovar Typhi Ty2
auagguggcguaaaauccgaac

SEQ ID NO: 201322 - RNA, 22 nt, Salmonella enterica enterica serovar Typhi Ty2
ggcggaauuauugucgucaugc

SEQ ID NO: 201323 - RNA, 22 nt, Salmonella enterica enterica serovar Typhi Ty2
gauugauuuaggcgacuccggu

SEQ ID NO: 201324 - RNA, 22 nt, Salmonella enterica enterica serovar Typhi Ty2
ugccugauggcgcgcuuaucug

SEQ ID NO: 201325 - RNA, 22 nt, Salmonella enterica enterica serovar Typhi Ty2
aaugugggcugucgcccagaug

SEQ ID NO: 201326 - RNA, 22 nt, Salmonella enterica enterica serovar Typhi Ty2
uaguucuucguaagccgucaug

SEQ ID NO: 201327 - RNA, 22 nt, Salmonella enterica enterica serovar Typhi Ty2
ccgacucuaaagcgauugcuca

SEQ ID NO: 201328 - RNA, 22 nt, Salmonella enterica enterica serovar Typhi Ty2
auggcgcugcgcuuaucaggcc

SEQ ID NO: 201329 - RNA, 22 nt, Salmonella enterica enterica serovar Typhi Ty2
aggccugauaagcgcagcgcca

SEQ ID NO: 201330 - RNA, 22 nt, Salmonella enterica enterica serovar Typhi Ty2
cagaugagcuucccgcuauuug

SEQ ID NO: 201331 - RNA, 22 nt, Salmonella enterica enterica serovar Typhi Ty2
uugcggcugucuucgcggcuca

SEQ ID NO: 201332 - RNA, 22 nt, Salmonella enterica enterica serovar Typhi Ty2
aucgcagauagcaaaaaagcgc

SEQ ID NO: 201333 - RNA, 22 nt, Salmonella enterica enterica serovar Typhi Ty2
gggccuguaaucaauuaauugu

SEQ ID NO: 201334 - RNA, 20 nt, Salmonella enterica enterica serovar Typhi Ty2
ccguuauuguugugcccuac

SEQ ID NO: 201335 - RNA, 22 nt, Salmonella enterica enterica serovar Typhi Ty2
ggcgucuuccaguggcacgccg

SEQ ID NO: 201336 - RNA, 22 nt, Salmonella enterica enterica serovar Typhi Ty2
aucaucgcgcgcguaaaguuag

SEQ ID NO: 201337 - RNA, 22 nt, Salmonella enterica enterica serovar Typhi Ty2
agugaucagcguguuuuuguug

SEQ ID NO: 201338 - RNA, 22 nt, Salmonella enterica enterica serovar Typhi Ty2
aaugcgaucagauccgguagau

SEQ ID NO: 201339 - RNA, 22 nt, Salmonella enterica enterica serovar Typhi Ty2
cggucgauuguuucacgaaauc

SEQ ID NO: 201340 - RNA, 22 nt, Salmonella enterica enterica serovar Typhi Ty2
caucauccagaucuuucgcgcc

SEQ ID NO: 201341 - RNA, 22 nt, Salmonella enterica enterica serovar Typhi Ty2
cuggcagugcgucugauacugc

SEQ ID NO: 201342 - RNA, 22 nt, Salmonella enterica enterica serovar Typhi Ty2
auugguacaacgcccuuucgug

SEQ ID NO: 201343 - RNA, 22 nt, Salmonella enterica enterica serovar Typhi Ty2
ucuuucgacuuuucgcccgaag

SEQ ID NO: 201344 - RNA, 22 nt, Salmonella enterica enterica serovar Typhi Ty2
uaguugccgccguuuugccgcu

SEQ ID NO: 201345 - RNA, 22 nt, Salmonella enterica enterica serovar Typhi Ty2
ugcugccaucuuuaggcguaau

SEQ ID NO: 201346 - RNA, 22 nt, Salmonella enterica enterica serovar Typhi Ty2
aacggucaucugcacaaaggcg

SEQ ID NO: 201347 - RNA, 22 nt, Salmonella enterica enterica serovar Typhi Ty2
uugugccggauggcggcgccug

SEQ ID NO: 201348 - RNA, 22 nt, Salmonella enterica enterica serovar Typhi Ty2
accgccaguaacgccgccgcuu

SEQ ID NO: 201349 - RNA, 22 nt, Salmonella enterica enterica serovar Typhi Ty2
aguaauccucugaaacuucggg

SEQ ID NO: 201350 - RNA, 22 nt, Salmonella enterica enterica serovar Typhi Ty2
uaccguguauggaggcgauagc

SEQ ID NO: 201351 - RNA, 22 nt, Salmonella enterica enterica serovar Typhi Ty2
ccauuggugguacugagcugcu

SEQ ID NO: 201352 - RNA, 22 nt, Salmonella enterica enterica serovar Typhi Ty2
guccgacucaaacugaaaucgu

SEQ ID NO: 201353 - RNA, 23 nt, Salmonella enterica enterica serovar Typhi Ty2
gcaagcuggcaaguugcaacagc

SEQ ID NO: 201354 - RNA, 22 nt, Salmonella enterica enterica serovar Typhi Ty2
aaaucgcagguaucguuuccuu

SEQ ID NO: 201355 - RNA, 22 nt, Salmonella enterica enterica serovar Typhi Ty2
ugggcguacucgucuauuaaug

SEQ ID NO: 201356 - RNA, 22 nt, Salmonella enterica enterica serovar Typhi Ty2
agcgcgaggaacuguugcggau

SEQ ID NO: 201357 - RNA, 22 nt, Salmonella enterica enterica serovar Typhi Ty2
ccggucucccgauguaccgcac

SEQ ID NO: 201358 - RNA, 22 nt, Salmonella enterica enterica serovar Typhi Ty2
cgaguacggaaaaaggguccgc

SEQ ID NO: 201359 - RNA, 20 nt, Salmonella enterica enterica serovar Typhi Ty2
uuuggcuaucgcaguaacgu

SEQ ID NO: 201360 - RNA, 22 nt, Salmonella enterica enterica serovar Typhi Ty2
uagugugagauggugcgaugcu

SEQ ID NO: 201361 - RNA, 22 nt, Salmonella enterica enterica serovar Typhi Ty2
cugcgucaggguggggcgaaua

SEQ ID NO: 201362 - RNA, 22 nt, Salmonella enterica enterica serovar Typhi Ty2
ggaucggcguuuuauucuuguu

SEQ ID NO: 201363 - RNA, 22 nt, Salmonella enterica enterica serovar Typhi Ty2
uuagccgggcauucaccgcaca

SEQ ID NO: 201364 - RNA, 22 nt, Salmonella enterica enterica serovar Typhi Ty2
caaccugggaacaagagccauu

SEQ ID NO: 201365 - RNA, 22 nt, Salmonella enterica enterica serovar Typhi Ty2
aucuggcuaaaaucugaaggcg

SEQ ID NO: 201366 - RNA, 22 nt, Salmonella enterica enterica serovar Typhi Ty2
cgucuuauccggccuacgagug

SEQ ID NO: 201367 - RNA, 22 nt, Salmonella enterica enterica serovar Typhi Ty2
gcgacguuaaugacaaugauug

SEQ ID NO: 201368 - RNA, 22 nt, Salmonella enterica enterica serovar Typhi Ty2
augcugaugaugagcgcaggcu

SEQ ID NO: 201369 - RNA, 22 nt, Salmonella enterica enterica serovar Typhi Ty2
ugcgccuuucgcuucaguguau

SEQ ID NO: 201370 - RNA, 22 nt, Salmonella enterica enterica serovar Typhi Ty2
ucgauugcauccggaagaguua

SEQ ID NO: 201371 - RNA, 22 nt, Salmonella enterica enterica serovar Typhi Ty2
uaucuggcaauuuauugcguug

SEQ ID NO: 201372 - RNA, 21 nt, Salmonella enterica enterica serovar Typhi Ty2
cagaaaguuugcuaucagucu

SEQ ID NO: 201373 - RNA, 22 nt, Salmonella enterica enterica serovar Typhi Ty2
gguaaugcacgcaucgaccgcu

SEQ ID NO: 201374 - RNA, 22 nt, Salmonella enterica enterica serovar Typhi Ty2
uguaaagggcauacguaucgcg

SEQ ID NO: 201375 - RNA, 22 nt, Salmonella enterica enterica serovar Typhi Ty2
guugaucugcuuugccgaaauc

SEQ ID NO: 201376 - RNA, 22 nt, Salmonella enterica enterica serovar Typhi Ty2
cuggcguaacgcauuauacuuu

SEQ ID NO: 201377 - RNA, 21 nt, Salmonella enterica enterica serovar Typhi Ty2
uuuggcagucguuuaucggaa

SEQ ID NO: 201378 - RNA, 22 nt, Salmonella enterica enterica serovar Typhi Ty2
aacgcgaccaggugauugagca

SEQ ID NO: 201379 - RNA, 22 nt, Salmonella enterica enterica serovar Typhi Ty2
gguucugacggaaacgacccug

SEQ ID NO: 201380 - RNA, 22 nt, Salmonella enterica enterica serovar Typhi Ty2
caauaucuacaaaggucgugua

SEQ ID NO: 201381 - RNA, 22 nt, Salmonella enterica enterica serovar Typhi Ty2
acggucugucccagucggcgcu

SEQ ID NO: 201382 - RNA, 22 nt, Salmonella enterica enterica serovar Typhi Ty2
gcuaaaggcuugcaagaacugg

SEQ ID NO: 201383 - RNA, 18 nt, Salmonella enterica enterica serovar Typhi Ty2
cagaccaguaaauuaagu

SEQ ID NO: 201384 - RNA, 22 nt, Salmonella enterica enterica serovar Typhi Ty2
aaugcaguagucgcugcggagg

SEQ ID NO: 201385 - RNA, 22 nt, Salmonella enterica enterica serovar Typhi Ty2
ccaugcugugcgucauggcgcu

SEQ ID NO: 201386 - RNA, 22 nt, Salmonella enterica enterica serovar Typhi Ty2
cagccaucacuauggcguaaaa

SEQ ID NO: 201387 - RNA, 22 nt, Salmonella enterica enterica serovar Typhi Ty2
uuaaugguauccaucaugcggu

SEQ ID NO: 201388 - RNA, 23 nt, Salmonella enterica enterica serovar Typhi Ty2
aucgucacgauggucguagcugg

SEQ ID NO: 201389 - RNA, 22 nt, Salmonella enterica enterica serovar Typhi Ty2
caccgguguccuggcaggaagg

SEQ ID NO: 201390 - RNA, 22 nt, Salmonella enterica enterica serovar Typhi Ty2
ucuuaugauguagaacgugcaa

SEQ ID NO: 201391 - RNA, 22 nt, Salmonella enterica enterica serovar Typhi Ty2
gcauuucaccgucgaucguuug

SEQ ID NO: 201392 - RNA, 18 nt, Salmonella enterica enterica serovar Typhi Ty2
gcggauugcuuaauggug

SEQ ID NO: 201393 - RNA, 19 nt, Salmonella enterica enterica serovar Typhi Ty2
ccguuacuguuuuaucagg

SEQ ID NO: 201394 - RNA, 22 nt, Salmonella enterica enterica serovar Typhi Ty2
caucacggccuuuauuuucgcc

SEQ ID NO: 201395 - RNA, 22 nt, Salmonella enterica enterica serovar Typhi Ty2
gauugccuguaauaccgccagu

SEQ ID NO: 201396 - RNA, 22 nt, Salmonella enterica enterica serovar Typhi Ty2
gcgcuacgauuauccgcccuac

SEQ ID NO: 201397 - RNA, 22 nt, Salmonella enterica enterica serovar Typhi Ty2
ugauaucuggcccagguccgau

SEQ ID NO: 201398 - RNA, 22 nt, Salmonella enterica enterica serovar Typhi Ty2
uggaugacaccaugaccuaccg

SEQ ID NO: 201399 - RNA, 22 nt, Salmonella enterica enterica serovar Typhi Ty2
gaaaugguugcuuuugccccug

SEQ ID NO: 201400 - RNA, 22 nt, Salmonella enterica enterica serovar Typhi Ty2
accacgcguggaaaugauguac

SEQ ID NO: 201401 - RNA, 22 nt, Salmonella enterica enterica serovar Typhi Ty2
uugccgucgucagugacguaca

SEQ ID NO: 201402 - RNA, 22 nt, Salmonella enterica enterica serovar Typhi Ty2
aggauaugagauuaugaguacc

SEQ ID NO: 201403 - RNA, 23 nt, Salmonella enterica enterica serovar Typhi Ty2
uguugcgcagaucauauucacau

SEQ ID NO: 201404 - RNA, 22 nt, Salmonella enterica enterica serovar Typhi Ty2
aucuggcaugcagggccggaag

SEQ ID NO: 201405 - RNA, 22 nt, Salmonella enterica enterica serovar Typhi Ty2
gucgccaauaccgagguagcgg

SEQ ID NO: 201406 - RNA, 22 nt, Salmonella enterica enterica serovar Typhi Ty2
guugcagacuguccagacgccc

SEQ ID NO: 201407 - RNA, 22 nt, Salmonella enterica enterica serovar Typhi Ty2
ccgggcaacguagagcauuauu

SEQ ID NO: 201408 - RNA, 22 nt, Salmonella enterica enterica serovar Typhi Ty2
ucaacuucagcagauaccauua

SEQ ID NO: 201409 - RNA, 22 nt, Salmonella enterica enterica serovar Typhi Ty2
ggcgcugugcugguaucuguug

SEQ ID NO: 201410 - RNA, 22 nt, Salmonella enterica enterica serovar Typhi Ty2
gcgcggaugauggcgucggccg

SEQ ID NO: 201411 - RNA, 22 nt, Salmonella enterica enterica serovar Typhi Ty2
gcugaugaccgauaagcugcaa

SEQ ID NO: 201412 - RNA, 22 nt, Salmonella enterica enterica serovar Typhi Ty2
uccaugauuuugucuggugcca

SEQ ID NO: 201413 - RNA, 22 nt, Salmonella enterica enterica serovar Typhi Ty2
cgcuaaggccuuauugugccgc

SEQ ID NO: 201414 - RNA, 22 nt, Salmonella enterica enterica serovar Typhi Ty2
ugcgucgauuucuggugcggua

SEQ ID NO: 201415 - RNA, 21 nt, Salmonella enterica enterica serovar Typhi Ty2
cagcaguucguuguucggcgc

SEQ ID NO: 201416 - RNA, 22 nt, Salmonella enterica enterica serovar Typhi Ty2
ggugaccguugccagaauaucu

SEQ ID NO: 201417 - RNA, 20 nt, Salmonella enterica enterica serovar Typhi Ty2
ucaaugccgauaucgucaau

SEQ ID NO: 201418 - RNA, 22 nt, Salmonella enterica enterica serovar Typhi Ty2
ugaccucgauugcuggcgguac

SEQ ID NO: 201419 - RNA, 22 nt, Salmonella enterica enterica serovar Typhi Ty2
aaacgccggcgugaucgucgcu

SEQ ID NO: 201420 - RNA, 22 nt, Salmonella enterica enterica serovar Typhi Ty2
ucgagcguuucgaauacgcugu

SEQ ID NO: 201421 - RNA, 22 nt, Salmonella enterica enterica serovar Typhi Ty2
ucccgauuagaauuggauuaca

SEQ ID NO: 201422 - RNA, 22 nt, Salmonella enterica enterica serovar Typhi Ty2
uauuugccagcauauagcucag

SEQ ID NO: 201423 - RNA, 22 nt, Salmonella enterica enterica serovar Typhi Ty2
gcuauagaauggauuaguauua

SEQ ID NO: 201424 - RNA, 22 nt, Salmonella enterica enterica serovar Typhi Ty2
guugccgcacgggcagaagcag

SEQ ID NO: 201425 - RNA, 23 nt, Salmonella enterica enterica serovar Typhi Ty2
cugcgcauauuacgccggcguuu

SEQ ID NO: 201426 - RNA, 18 nt, Salmonella enterica enterica serovar Typhi Ty2
uuauccugucguugugcg

SEQ ID NO: 201427 - RNA, 22 nt, Salmonella enterica enterica serovar Typhi Ty2
ugcugguaugacgcgccguuaa

SEQ ID NO: 201428 - RNA, 22 nt, Salmonella enterica enterica serovar Typhi Ty2
ccgaacagguuauuguugcuac

SEQ ID NO: 201429 - RNA, 22 nt, Salmonella enterica enterica serovar Typhi Ty2
ugccgguugucgaugaagaaca

SEQ ID NO: 201430 - RNA, 22 nt, Salmonella enterica enterica serovar Typhi Ty2
aaucguuggggauaaucuggug

SEQ ID NO: 201431 - RNA, 22 nt, Salmonella enterica enterica serovar Typhi Ty2
uuuacgcaucaucgcgcaacgc

SEQ ID NO: 201432 - RNA, 22 nt, Salmonella enterica enterica serovar Typhi Ty2
cgcguuguuaacgaaagcgcug

SEQ ID NO: 201433 - RNA, 22 nt, Salmonella enterica enterica serovar Typhi Ty2
ccggauggcguguagcgauccg

SEQ ID NO: 201434 - RNA, 22 nt, Salmonella enterica enterica serovar Typhi Ty2
cgaugaguugcguuaccgcgaa

SEQ ID NO: 201435 - RNA, 21 nt, Salmonella enterica enterica serovar Typhi Ty2
ucauugcugagacaggcucug

SEQ ID NO: 201436 - RNA, 22 nt, Salmonella enterica enterica serovar Typhi Ty2
aucgccaucuuaugcuuuuucu

SEQ ID NO: 201437 - RNA, 22 nt, Salmonella enterica enterica serovar Typhi Ty2
ugaugcagugcgacuggcccau

SEQ ID NO: 201438 - RNA, 19 nt, Salmonella enterica enterica serovar Typhi Ty2
caucagcguauccgugaag

SEQ ID NO: 201439 - RNA, 22 nt, Salmonella enterica enterica serovar Typhi Ty2
agcgccuggcaacucacggcau

SEQ ID NO: 201440 - RNA, 22 nt, Salmonella enterica enterica serovar Typhi Ty2
aggcguguucaaggcgggcuuu

SEQ ID NO: 201441 - RNA, 22 nt, Salmonella enterica enterica serovar Typhi Ty2
guuggaacgguuaaacugauga

SEQ ID NO: 201442 - RNA, 22 nt, Salmonella enterica enterica serovar Typhi Ty2
uacagaauauccaucagcggcu

SEQ ID NO: 201443 - RNA, 22 nt, Salmonella enterica enterica serovar Typhi Ty2
acgcgcuugccauccagcucgu

SEQ ID NO: 201444 - RNA, 22 nt, Salmonella enterica enterica serovar Typhi Ty2
ugauggcgcagcgcauugaugu

SEQ ID NO: 201445 - RNA, 22 nt, Salmonella enterica enterica serovar Typhi Ty2
gauccguuuguuguuucaaaau

SEQ ID NO: 201446 - RNA, 22 nt, Salmonella enterica enterica serovar Typhi Ty2
guucgaaaucccagguugccca

SEQ ID NO: 201447 - RNA, 22 nt, Salmonella enterica enterica serovar Typhi Ty2
auaugcuggucgugcgcgaggc

SEQ ID NO: 201448 - RNA, 22 nt, Salmonella enterica enterica serovar Typhi Ty2
caggcccugcagccgcaggugg

SEQ ID NO: 201449 - RNA, 22 nt, Salmonella enterica enterica serovar Typhi Ty2
uaagagauaaagaccgaggcga

SEQ ID NO: 201450 - RNA, 22 nt, Salmonella enterica enterica serovar Typhi Ty2
uaugaguuugucgaugccgaua

SEQ ID NO: 201451 - RNA, 22 nt, Salmonella enterica enterica serovar Typhi Ty2
acuggcuggaaaguaauacagu

SEQ ID NO: 201452 - RNA, 18 nt, Salmonella enterica enterica serovar Typhi Ty2
aucaggguggauuccggg

SEQ ID NO: 201453 - RNA, 20 nt, Salmonella enterica enterica serovar Typhi Ty2
acgcuuagcgccauuaguau

SEQ ID NO: 201454 - RNA, 22 nt, Salmonella enterica enterica serovar Typhi Ty2
auuucugucaccuguugcuguu

SEQ ID NO: 201455 - RNA, 22 nt, Salmonella enterica enterica serovar Typhi Ty2
gcgacgcaaagaguacuggaug

SEQ ID NO: 201456 - RNA, 21 nt, Salmonella enterica enterica serovar Typhi Ty2
aucagcaacugaccgagcucg

SEQ ID NO: 201457 - RNA, 22 nt, Salmonella enterica enterica serovar Typhi Ty2
cguguaggccggauuaggcgcu

SEQ ID NO: 201458 - RNA, 22 nt, Salmonella enterica enterica serovar Typhi Ty2
uugcugaacaguugccgggcga

SEQ ID NO: 201459 - RNA, 22 nt, Salmonella enterica enterica serovar Typhi Ty2
uggcgcuacgcuuaucaggccu

SEQ ID NO: 201460 - RNA, 22 nt, Salmonella enterica enterica serovar Typhi Ty2
gucgauacgcagauaguggcgg

SEQ ID NO: 201461 - RNA, 22 nt, Salmonella enterica enterica serovar Typhi Ty2
ccagccagugcgcuaauacuau

SEQ ID NO: 201462 - RNA, 22 nt, Salmonella enterica enterica serovar Typhi Ty2
ucagcgccaguacgcccagcaa

SEQ ID NO: 201463 - RNA, 22 nt, Salmonella enterica enterica serovar Typhi Ty2
ugcugauauuuuccgccuuuau

SEQ ID NO: 201464 - RNA, 22 nt, Salmonella enterica enterica serovar Typhi Ty2
accugcugugcagccacgguag

SEQ ID NO: 201465 - RNA, 19 nt, Salmonella enterica enterica serovar Typhi Ty2
ugcaucugauccgcucguu

SEQ ID NO: 201466 - RNA, 22 nt, Salmonella enterica enterica serovar Typhi Ty2
agguucgcggcauguuaaaggg

SEQ ID NO: 201467 - RNA, 22 nt, Salmonella enterica enterica serovar Typhi Ty2
gcuggcgucaguggcuggaaga

SEQ ID NO: 201468 - RNA, 22 nt, Salmonella enterica enterica serovar Typhi Ty2
uacugguauccagaaacuaucu

SEQ ID NO: 201469 - RNA, 22 nt, Salmonella enterica enterica serovar Typhi Ty2
gcaaugacgccggaagugguac

SEQ ID NO: 201470 - RNA, 22 nt, Salmonella enterica enterica serovar Typhi Ty2
ucgccguggcugcuggcgcugg

SEQ ID NO: 201471 - RNA, 22 nt, Salmonella enterica enterica serovar Typhi Ty2
aaagcuggguagcgcgcguugc

SEQ ID NO: 201472 - RNA, 22 nt, Salmonella enterica enterica serovar Typhi Ty2
gaacgugauaagcgcccgugag

SEQ ID NO: 201473 - RNA, 22 nt, Salmonella enterica enterica serovar Typhi Ty2
uaaggucauguggguggacgcg

SEQ ID NO: 201474 - RNA, 22 nt, Salmonella enterica enterica serovar Typhi Ty2
ucaggguggugauguaguagua

SEQ ID NO: 201475 - RNA, 22 nt, Salmonella enterica enterica serovar Typhi Ty2
augggcuaucuggacagauuga

SEQ ID NO: 201476 - RNA, 22 nt, Salmonella enterica enterica serovar Typhi Ty2
cagauaucgcuaacaguauaua

SEQ ID NO: 201477 - RNA, 22 nt, Salmonella enterica enterica serovar Typhi Ty2
uccgguugauaaacgagcgccu

SEQ ID NO: 201478 - RNA, 22 nt, Salmonella enterica enterica serovar Typhi Ty2
aaagugguuagaguauuuuucg

SEQ ID NO: 201479 - RNA, 22 nt, Salmonella enterica enterica serovar Typhi Ty2
ggagcgacagggucuguuguga

SEQ ID NO: 201480 - RNA, 22 nt, Salmonella enterica enterica serovar Typhi Ty2
gauuucgcuggaucgucaggaa

SEQ ID NO: 201481 - RNA, 22 nt, Salmonella enterica enterica serovar Typhi Ty2
guugcggauaauccagcguaaa

SEQ ID NO: 201482 - RNA, 22 nt, Salmonella enterica enterica serovar Typhi Ty2
cguccggaacgugauaguccau

SEQ ID NO: 201483 - RNA, 22 nt, Salmonella enterica enterica serovar Typhi Ty2
uuaucagucuacaaauuacuuu

SEQ ID NO: 201484 - RNA, 21 nt, Salmonella enterica enterica serovar Typhi Ty2
ugauaacggguuaacaggcgu

SEQ ID NO: 201485 - RNA, 22 nt, Salmonella enterica enterica serovar Typhi Ty2
acggcuaucagucuuugcacac

SEQ ID NO: 201486 - RNA, 22 nt, Salmonella enterica enterica serovar Typhi Ty2
agcagcagcgccuucaguuuga

SEQ ID NO: 201487 - RNA, 22 nt, Salmonella enterica enterica serovar Typhi Ty2
auccgcguuuauugauaugccg

SEQ ID NO: 201488 - RNA, 22 nt, Salmonella enterica enterica serovar Typhi Ty2
uucagcaugguacguacauauu

SEQ ID NO: 201489 - RNA, 22 nt, Salmonella enterica enterica serovar Typhi Ty2
gccguuaucuguuaugccagca

SEQ ID NO: 201490 - RNA, 22 nt, Salmonella enterica enterica serovar Typhi Ty2
ucagcgggaaacagagcguggc

SEQ ID NO: 201491 - RNA, 22 nt, Salmonella enterica enterica serovar Typhi Ty2
cguguaggcccgguaagcgcag

SEQ ID NO: 201492 - RNA, 22 nt, Salmonella enterica enterica serovar Typhi Ty2
ucacugaugagccagguucugg

SEQ ID NO: 201493 - RNA, 22 nt, Salmonella enterica enterica serovar Typhi Ty2
cagcgcuuucguuaacaacgcg

SEQ ID NO: 201494 - RNA, 22 nt, Salmonella enterica enterica serovar Typhi Ty2
cuggcguuggcuaagggguaaa

SEQ ID NO: 201495 - RNA, 22 nt, Salmonella enterica enterica serovar Typhi Ty2
acagagccugucucagcaauga

SEQ ID NO: 201496 - RNA, 22 nt, Salmonella enterica enterica serovar Typhi Ty2
uugucacagguguugccgguaa

SEQ ID NO: 201497 - RNA, 22 nt, Salmonella enterica enterica serovar Typhi Ty2
agucaggaucugacgagcgcga

SEQ ID NO: 201498 - RNA, 22 nt, Salmonella enterica enterica serovar Typhi Ty2
uguaggccggauaagcauuagc

SEQ ID NO: 201499 - RNA, 22 nt, Salmonella enterica enterica serovar Typhi Ty2
ggcgagguguaagaaagcagaa

SEQ ID NO: 201500 - RNA, 22 nt, Salmonella enterica enterica serovar Typhi Ty2
ugaccugcggcaguaucccaga

SEQ ID NO: 201501 - RNA, 22 nt, Salmonella enterica enterica serovar Typhi Ty2
cugaucacuucacuuugcguuc

SEQ ID NO: 201502 - RNA, 20 nt, Salmonella enterica enterica serovar Typhi Ty2
ccgcgauugccgccugacga

SEQ ID NO: 201503 - RNA, 22 nt, Salmonella enterica enterica serovar Typhi Ty2
cgugaacaaacugcuguuucuc

SEQ ID NO: 201504 - RNA, 22 nt, Salmonella enterica enterica serovar Typhi Ty2
cgcauaucugccuguucugcua

SEQ ID NO: 201505 - RNA, 22 nt, Salmonella enterica enterica serovar Typhi Ty2
cuuaucuguauugaugauaaac

SEQ ID NO: 201506 - RNA, 22 nt, Salmonella enterica enterica serovar Typhi Ty2
gggccauacaguuugugagcgg

SEQ ID NO: 201507 - RNA, 22 nt, Salmonella enterica enterica serovar Typhi Ty2
ugaggugauuaaaaucauuaug

SEQ ID NO: 201508 - RNA, 22 nt, Salmonella enterica enterica serovar Typhi Ty2
auuggcgcgguacuggaagucg

SEQ ID NO: 201509 - RNA, 22 nt, Salmonella enterica enterica serovar Typhi Ty2
ggugauccagguaucguuagag

SEQ ID NO: 201510 - RNA, 22 nt, Salmonella enterica enterica serovar Typhi Ty2
uguaaagcaaaugcuauacaag

SEQ ID NO: 201511 - RNA, 22 nt, Salmonella enterica enterica serovar Typhi Ty2
gauagggcgaucgccgguuuug

SEQ ID NO: 201512 - RNA, 22 nt, Salmonella enterica enterica serovar Typhi Ty2
aucgucaugcuguggcuggucg

SEQ ID NO: 201513 - RNA, 22 nt, Salmonella enterica enterica serovar Typhi Ty2
ugaucacgcuugcggugauggu

SEQ ID NO: 201514 - RNA, 22 nt, Salmonella enterica enterica serovar Typhi Ty2
ccauggcugccuggcgcugacu

SEQ ID NO: 201515 - RNA, 22 nt, Salmonella enterica enterica serovar Typhi Ty2
cuuaugcagaucgccauuggcg

SEQ ID NO: 201516 - RNA, 22 nt, Salmonella enterica enterica serovar Typhi Ty2
cggauuguguccuggaagaagg

SEQ ID NO: 201517 - RNA, 22 nt, Salmonella enterica enterica serovar Typhi Ty2
agcguugaugugcugguuaccg

SEQ ID NO: 201518 - RNA, 22 nt, Salmonella enterica enterica serovar Typhi Ty2
gcguaggcccgccauucggcau

SEQ ID NO: 201519 - RNA, 22 nt, Salmonella enterica enterica serovar Typhi Ty2
auccaugcggcagucgcuucug

SEQ ID NO: 201520 - RNA, 22 nt, Salmonella enterica enterica serovar Typhi Ty2
ugacguuccagcgcccacuguu

SEQ ID NO: 201521 - RNA, 22 nt, Salmonella enterica enterica serovar Typhi Ty2
gcgugaaagacuauaucgccau

SEQ ID NO: 201522 - RNA, 22 nt, Salmonella enterica enterica serovar Typhi Ty2
ccagaagcggaaaccgucuuua

SEQ ID NO: 201523 - RNA, 22 nt, Salmonella enterica enterica serovar Typhi Ty2
acguugaugugaacuauucaga

SEQ ID NO: 201524 - RNA, 22 nt, Salmonella enterica enterica serovar Typhi Ty2
ugcguucgguuauugcggaaga

SEQ ID NO: 201525 - RNA, 22 nt, Salmonella enterica enterica serovar Typhi Ty2
cagcguauggcugcaagacggu

SEQ ID NO: 201526 - RNA, 22 nt, Salmonella enterica enterica serovar Typhi Ty2
gauggugaugaccgucaaugcc

SEQ ID NO: 201527 - RNA, 22 nt, Salmonella enterica enterica serovar Typhi Ty2
uggcggcaauggcgauagauuu

SEQ ID NO: 201528 - RNA, 22 nt, Salmonella enterica enterica serovar Typhi Ty2
ugccggaaagacggcagcgcca

SEQ ID NO: 201529 - RNA, 22 nt, Salmonella enterica enterica serovar Typhi Ty2
caacggcauaggugugguccug

SEQ ID NO: 201530 - RNA, 22 nt, Salmonella enterica enterica serovar Typhi Ty2
gccuguuuuugcgcaaagaggg

SEQ ID NO: 201531 - RNA, 22 nt, Salmonella enterica enterica serovar Typhi Ty2
augacaacauuaaaugggagaa

SEQ ID NO: 201532 - RNA, 22 nt, Salmonella enterica enterica serovar Typhi Ty2
auaccuauaacgaaccgggucg

SEQ ID NO: 201533 - RNA, 22 nt, Salmonella enterica enterica serovar Typhi Ty2
agaggcuaauuaucugccagcc

SEQ ID NO: 201534 - RNA, 22 nt, Salmonella enterica enterica serovar Typhi Ty2
uucgaugagguuuguugcaacg

SEQ ID NO: 201535 - RNA, 22 nt, Salmonella enterica enterica serovar Typhi Ty2
cgcgcgaacuucuucgauguug

SEQ ID NO: 201536 - RNA, 22 nt, Salmonella enterica enterica serovar Typhi Ty2
gcugauaucaaugcuggcgagu

SEQ ID NO: 201537 - RNA, 22 nt, Salmonella enterica enterica serovar Typhi Ty2
aucggugacuuugucauuaauu

SEQ ID NO: 201538 - RNA, 22 nt, Salmonella enterica enterica serovar Typhi Ty2
acguggugcgcggcagccguuu

SEQ ID NO: 201539 - RNA, 22 nt, Salmonella enterica enterica serovar Typhi Ty2
augguauugaugguuaugucgu

SEQ ID NO: 201540 - RNA, 22 nt, Salmonella enterica enterica serovar Typhi Ty2
agccgguuuuugcugauguggu

SEQ ID NO: 201541 - RNA, 22 nt, Salmonella enterica enterica serovar Typhi Ty2
ugaugcagacgacgacaugcgc

SEQ ID NO: 201542 - RNA, 22 nt, Salmonella enterica enterica serovar Typhi Ty2
auggcggcuccgccuuauccgg

SEQ ID NO: 201543 - RNA, 22 nt, Salmonella enterica enterica serovar Typhi Ty2
augaucgaaauccgugaagguc

SEQ ID NO: 201544 - RNA, 22 nt, Salmonella enterica enterica serovar Typhi Ty2
augguucgacgagcgcggcauc

SEQ ID NO: 201545 - RNA, 22 nt, Salmonella enterica enterica serovar Typhi Ty2
gauuacccgggagcaauguugu

SEQ ID NO: 201546 - RNA, 22 nt, Salmonella enterica enterica serovar Typhi Ty2
ugcccgucuacgauaaaccgau

SEQ ID NO: 201547 - RNA, 22 nt, Salmonella enterica enterica serovar Typhi Ty2
uggcgagagaccuucgcaacug

SEQ ID NO: 201548 - RNA, 18 nt, Salmonella enterica enterica serovar Typhi Ty2
ucggcgcugucaucgccg

SEQ ID NO: 201549 - RNA, 22 nt, Salmonella enterica enterica serovar Typhi Ty2
ccggauaaggcgaagccgccau

SEQ ID NO: 201550 - RNA, 22 nt, Salmonella enterica enterica serovar Typhi Ty2
ggugguaaaacccgaccagaua

SEQ ID NO: 201551 - RNA, 22 nt, Salmonella enterica enterica serovar Typhi Ty2
uggcgauaugcguguccacugu

SEQ ID NO: 201552 - RNA, 22 nt, Salmonella enterica enterica serovar Typhi Ty2
cucgaugccugacuucgacguu

SEQ ID NO: 201553 - RNA, 22 nt, Salmonella enterica enterica serovar Typhi Ty2
acguucuggugggagcuggcgc

SEQ ID NO: 201554 - RNA, 22 nt, Salmonella enterica enterica serovar Typhi Ty2
cgggucgaggaucgccauaucc

SEQ ID NO: 201555 - RNA, 22 nt, Salmonella enterica enterica serovar Typhi Ty2
gagcugcacuggcguaucacgu

SEQ ID NO: 201556 - RNA, 22 nt, Salmonella enterica enterica serovar Typhi Ty2
agcgacgcgcucuucgauguuu

SEQ ID NO: 201557 - RNA, 22 nt, Salmonella enterica enterica serovar Typhi Ty2
cagcuaacgguugcauaaucug

SEQ ID NO: 201558 - RNA, 22 nt, Salmonella enterica enterica serovar Typhi Ty2
aaauguacagaauacguggaua

SEQ ID NO: 201559 - RNA, 22 nt, Salmonella enterica enterica serovar Typhi Ty2
ugcgcaacaguacgaagcgaaa

SEQ ID NO: 201560 - RNA, 22 nt, Salmonella enterica enterica serovar Typhi Ty2
ucaucuggugccugcgacgguu

SEQ ID NO: 201561 - RNA, 21 nt, Salmonella enterica enterica serovar Typhi Ty2
ucugaaguacaaauuuucauc

SEQ ID NO: 201562 - RNA, 22 nt, Salmonella enterica enterica serovar Typhi Ty2
uguucugaaaaaugaagaucug

SEQ ID NO: 201563 - RNA, 22 nt, Salmonella enterica enterica serovar Typhi Ty2
ugccgggaugggcgacucgauu

SEQ ID NO: 201564 - RNA, 22 nt, Salmonella enterica enterica serovar Typhi Ty2
aaccuucagacucaugguagaa

SEQ ID NO: 201565 - RNA, 22 nt, Salmonella enterica enterica serovar Typhi Ty2
auagagauugggcgcguggaga

SEQ ID NO: 201566 - RNA, 22 nt, Salmonella enterica enterica serovar Typhi Ty2
ggucauuggcccucccaucaga

SEQ ID NO: 201567 - RNA, 22 nt, Salmonella enterica enterica serovar Typhi Ty2
ucgccaguucccggaaucauug

SEQ ID NO: 201568 - RNA, 22 nt, Salmonella enterica enterica serovar Typhi Ty2
guuugcaacgguuccgguagua

SEQ ID NO: 201569 - RNA, 22 nt, Salmonella enterica enterica serovar Typhi Ty2
agacggcgaaggcguuagguau

SEQ ID NO: 201570 - RNA, 22 nt, Salmonella enterica enterica serovar Typhi Ty2
uaucaagucugaagcgaaaacu

SEQ ID NO: 201571 - RNA, 22 nt, Salmonella enterica enterica serovar Typhi Ty2
aagucgauuuccgcuuccugcg

SEQ ID NO: 201572 - RNA, 22 nt, Salmonella enterica enterica serovar Typhi Ty2
aguuucucgcugcauauggcgg

SEQ ID NO: 201573 - RNA, 22 nt, Salmonella enterica enterica serovar Typhi Ty2
ccguaggccugauaagcgcagc

SEQ ID NO: 201574 - RNA, 22 nt, Salmonella enterica enterica serovar Typhi Ty2
cucgaugcauccagaaugauuu

SEQ ID NO: 201575 - RNA, 22 nt, Salmonella enterica enterica serovar Typhi Ty2
aucgguuuuugcagaaucgucu

SEQ ID NO: 201576 - RNA, 22 nt, Salmonella enterica enterica serovar Typhi Ty2
acgcauuuguuggccggauaag

SEQ ID NO: 201577 - RNA, 21 nt, Salmonella enterica enterica serovar Typhi Ty2
auaucgagucauuucgcggcg

SEQ ID NO: 201578 - RNA, 22 nt, Salmonella enterica enterica serovar Typhi Ty2
acgaugacuguaauguuucccg

SEQ ID NO: 201579 - RNA, 22 nt, Salmonella enterica enterica serovar Typhi Ty2
uggaugaacuuuguaugaucuc

SEQ ID NO: 201580 - RNA, 22 nt, Salmonella enterica enterica serovar Typhi Ty2
auccucagaugaagcgggcgcu

SEQ ID NO: 201581 - RNA, 20 nt, Salmonella enterica enterica serovar Typhi Ty2
cguagggcacaaugaaaugc

SEQ ID NO: 201582 - RNA, 21 nt, Salmonella enterica enterica serovar Typhi Ty2
gcgauucgucaauuggcggua

SEQ ID NO: 201583 - RNA, 21 nt, Salmonella enterica enterica serovar Typhi Ty2
aaaugguuucgccgugggaga

SEQ ID NO: 201584 - RNA, 22 nt, Salmonella enterica enterica serovar Typhi Ty2
cauguuuacucuacuggccgua

SEQ ID NO: 201585 - RNA, 22 nt, Salmonella enterica enterica serovar Typhi Ty2
uaggucuggucuaucucuuuuu

SEQ ID NO: 201586 - RNA, 22 nt, Salmonella enterica enterica serovar Typhi Ty2
ggauaacauaguguaagauccu

SEQ ID NO: 201587 - RNA, 22 nt, Salmonella enterica enterica serovar Typhi Ty2
gagcguaucggcgauucccugu

SEQ ID NO: 201588 - RNA, 22 nt, Salmonella enterica enterica serovar Typhi Ty2
augaugaagggcgcgaucaguu

SEQ ID NO: 201589 - RNA, 22 nt, Salmonella enterica enterica serovar Typhi Ty2
ugucaauauuaacggcagcuug

SEQ ID NO: 201590 - RNA, 22 nt, Salmonella enterica enterica serovar Typhi Ty2
aucaccguauuggcgccgcugg

SEQ ID NO: 201591 - RNA, 22 nt, Salmonella enterica enterica serovar Typhi Ty2
ucauguucauuauuaacugcuc

SEQ ID NO: 201592 - RNA, 22 nt, Salmonella enterica enterica serovar Typhi Ty2
gaauaucuguugccaugcccac

SEQ ID NO: 201593 - RNA, 22 nt, Salmonella enterica enterica serovar Typhi Ty2
gaccggaaauagucggcauacg

SEQ ID NO: 201594 - RNA, 22 nt, Salmonella enterica enterica serovar Typhi Ty2
ccguuugccgcgaacgcgcuuu

SEQ ID NO: 201595 - RNA, 20 nt, Salmonella enterica enterica serovar Typhi Ty2
aauccggugccuuaccgcuu

SEQ ID NO: 201596 - RNA, 22 nt, Salmonella enterica enterica serovar Typhi Ty2
ggcaguggaugaccaugauugu

SEQ ID NO: 201597 - RNA, 22 nt, Salmonella enterica enterica serovar Typhi Ty2
ugccgauuuuggucccggcggc

SEQ ID NO: 201598 - RNA, 22 nt, Salmonella enterica enterica serovar Typhi Ty2
ugacggagaucguccgcggcgc

SEQ ID NO: 201599 - RNA, 22 nt, Salmonella enterica enterica serovar Typhi Ty2
cgcgguauuaaugcucacccua

SEQ ID NO: 201600 - RNA, 22 nt, Salmonella enterica enterica serovar Typhi Ty2
cucauuuagcgcucgcguuuug

SEQ ID NO: 201601 - RNA, 22 nt, Salmonella enterica enterica serovar Typhi Ty2
cuuacugucgaaaucauuaaag

SEQ ID NO: 201602 - RNA, 22 nt, Salmonella enterica enterica serovar Typhi Ty2
uaccgcgguggucacggcgauu

SEQ ID NO: 201603 - RNA, 22 nt, Salmonella enterica enterica serovar Typhi Ty2
uccagguuuuugcacaacguuu

SEQ ID NO: 201604 - RNA, 21 nt, Salmonella enterica enterica serovar Typhi Ty2
ucgucggcacgcugaugacgc

SEQ ID NO: 201605 - RNA, 22 nt, Salmonella enterica enterica serovar Typhi Ty2
auuguuacacgauccccuuuuc

SEQ ID NO: 201606 - RNA, 22 nt, Salmonella enterica enterica serovar Typhi Ty2
ccauuggguugucggcgaagaa

SEQ ID NO: 201607 - RNA, 22 nt, Salmonella enterica enterica serovar Typhi Ty2
uugucaaucgcacgcucugguu

SEQ ID NO: 201608 - RNA, 22 nt, Salmonella enterica enterica serovar Typhi Ty2
cacuggaucuugggcugguggu

SEQ ID NO: 201609 - RNA, 22 nt, Salmonella enterica enterica serovar Typhi Ty2
aacgcgaagguaaaauuaucgu

SEQ ID NO: 201610 - RNA, 22 nt, Salmonella enterica enterica serovar Typhi Ty2
uaaugccguuaacgguaauuuc

SEQ ID NO: 201611 - RNA, 22 nt, Salmonella enterica enterica serovar Typhi Ty2
uauccgccccugcgucugcgcg

SEQ ID NO: 201612 - RNA, 22 nt, Salmonella enterica enterica serovar Typhi Ty2
ccggaccuuugucaucggcugg

SEQ ID NO: 201613 - RNA, 22 nt, Salmonella enterica enterica serovar Typhi Ty2
caguugacgguuuuucgccagc

SEQ ID NO: 201614 - RNA, 22 nt, Salmonella enterica enterica serovar Typhi Ty2
ccggaugaagucguuaauaagu

SEQ ID NO: 201615 - RNA, 22 nt, Salmonella enterica enterica serovar Typhi Ty2
uacgucuauccuuaguccguag

SEQ ID NO: 201616 - RNA, 22 nt, Salmonella enterica enterica serovar Typhi Ty2
uucauugagguuuuucucgcug

SEQ ID NO: 201617 - RNA, 22 nt, Salmonella enterica enterica serovar Typhi Ty2
gaccaacuuuauguccaauacc

SEQ ID NO: 201618 - RNA, 22 nt, Salmonella enterica enterica serovar Typhi Ty2
ucaccgucggcucggcggcgua

SEQ ID NO: 201619 - RNA, 22 nt, Salmonella enterica enterica serovar Typhi Ty2
accgucggugauaucgaaucgc

SEQ ID NO: 201620 - RNA, 22 nt, Salmonella enterica enterica serovar Typhi Ty2
gucauggcggcguggcgcugcg

SEQ ID NO: 201621 - RNA, 22 nt, Salmonella enterica enterica serovar Typhi Ty2
cucgugaagauuagcagagcgg

SEQ ID NO: 201622 - RNA, 22 nt, Salmonella enterica enterica serovar Typhi Ty2
guagcgggcgguauccggucaa

SEQ ID NO: 201623 - RNA, 22 nt, Salmonella enterica enterica serovar Typhi Ty2
agaacgcacggucagcauugau

SEQ ID NO: 201624 - RNA, 22 nt, Salmonella enterica enterica serovar Typhi Ty2
uggacgccaaucaugaguaccc

SEQ ID NO: 201625 - RNA, 22 nt, Salmonella enterica enterica serovar Typhi Ty2
auuggacuugccgggauuauuc

SEQ ID NO: 201626 - RNA, 22 nt, Salmonella enterica enterica serovar Typhi Ty2
uggucgaucaggcgaaggcgcg

SEQ ID NO: 201627 - RNA, 22 nt, Salmonella enterica enterica serovar Typhi Ty2
cgcgaugggcguaaacaucaac

SEQ ID NO: 201628 - RNA, 22 nt, Salmonella enterica enterica serovar Typhi Ty2
uaugugaauggaaaaacguacg

SEQ ID NO: 201629 - RNA, 21 nt, Salmonella enterica enterica serovar Typhi Ty2
gcgugaugugguucagcgcgc

SEQ ID NO: 201630 - RNA, 22 nt, Salmonella enterica enterica serovar Typhi Ty2
uuaccucgaacgaucuggugac

SEQ ID NO: 201631 - RNA, 22 nt, Salmonella enterica enterica serovar Typhi Ty2
gaggauuugcacgaugugaaua

SEQ ID NO: 201632 - RNA, 22 nt, Salmonella enterica enterica serovar Typhi Ty2
ggcaccagcacuucaaacugac

SEQ ID NO: 201633 - RNA, 22 nt, Salmonella enterica enterica serovar Typhi Ty2
cgcgaaguaaugccagaagaua

SEQ ID NO: 201634 - RNA, 22 nt, Salmonella enterica enterica serovar Typhi Ty2
uugaucaggcaggcguccgguu

SEQ ID NO: 201635 - RNA, 21 nt, Salmonella enterica enterica serovar Typhi Ty2
uccgaaauggucgucaccauc

SEQ ID NO: 201636 - RNA, 22 nt, Salmonella enterica enterica serovar Typhi Ty2
guuggauaguggcuucuuccag

SEQ ID NO: 201637 - RNA, 21 nt, Salmonella enterica enterica serovar Typhi Ty2
guaucaguaguaccgcaguga

SEQ ID NO: 201638 - RNA, 22 nt, Salmonella enterica enterica serovar Typhi Ty2
uggaucugccuauuuugaaaac

SEQ ID NO: 201639 - RNA, 22 nt, Salmonella enterica enterica serovar Typhi Ty2
auugcucgcgaggcccacguga

SEQ ID NO: 201640 - RNA, 22 nt, Salmonella enterica enterica serovar Typhi Ty2
acgcaggaucaguugccuucgc

SEQ ID NO: 201641 - RNA, 22 nt, Salmonella enterica enterica serovar Typhi Ty2
gcuauuucuggugguucaguau

SEQ ID NO: 201642 - RNA, 22 nt, Salmonella enterica enterica serovar Typhi Ty2
gaggaucauauugucgcgguac

SEQ ID NO: 201643 - RNA, 22 nt, Salmonella enterica enterica serovar Typhi Ty2
acguucuguaacguagcuacgg

SEQ ID NO: 201644 - RNA, 22 nt, Salmonella enterica enterica serovar Typhi Ty2
cauuggcaauagauaaucgucc

SEQ ID NO: 201645 - RNA, 22 nt, Salmonella enterica enterica serovar Typhi Ty2
uaccuggcaugggcgacgaggc

SEQ ID NO: 201646 - RNA, 22 nt, Salmonella enterica enterica serovar Typhi Ty2
augaugaugucuuuauugucgg

SEQ ID NO: 201647 - RNA, 22 nt, Salmonella enterica enterica serovar Typhi Ty2
ucuguaucgggaagcggcgcgc

SEQ ID NO: 201648 - RNA, 22 nt, Salmonella enterica enterica serovar Typhi Ty2
agcaugcucuugcaaacugggu

SEQ ID NO: 201649 - RNA, 21 nt, Salmonella enterica enterica serovar Typhi Ty2
ugacuuucccgguccgcuggc

SEQ ID NO: 201650 - RNA, 22 nt, Salmonella enterica enterica serovar Typhi Ty2
ugcauauuuaauuucuucgcug

SEQ ID NO: 201651 - RNA, 22 nt, Salmonella enterica enterica serovar Typhi Ty2
uuaucgccggagaagcuuacca

SEQ ID NO: 201652 - RNA, 22 nt, Salmonella enterica enterica serovar Typhi Ty2
auccggacgacuuacagcgggu

SEQ ID NO: 201653 - RNA, 22 nt, Salmonella enterica enterica serovar Typhi Ty2
uggugacgucguucugguucag

SEQ ID NO: 201654 - RNA, 22 nt, Salmonella enterica enterica serovar Typhi Ty2
ucauuacccgugaugaagaugc

SEQ ID NO: 201655 - RNA, 22 nt, Salmonella enterica enterica serovar Typhi Ty2
gugaaucggcaugagaguguga

SEQ ID NO: 201656 - RNA, 22 nt, Salmonella enterica enterica serovar Typhi Ty2
ucaccgaacguagccugauugu

SEQ ID NO: 201657 - RNA, 22 nt, Salmonella enterica enterica serovar Typhi Ty2
uaggaaaccagcguuuucccca

SEQ ID NO: 201658 - RNA, 22 nt, Salmonella enterica enterica serovar Typhi Ty2
acgcuuaucaggccuacagaau

SEQ ID NO: 201659 - RNA, 22 nt, Salmonella enterica enterica serovar Typhi Ty2
guaggccggauaaucguagcgc

SEQ ID NO: 201660 - RNA, 22 nt, Salmonella enterica enterica serovar Typhi Ty2
gcugcggauuuuuaacgccugg

SEQ ID NO: 201661 - RNA, 22 nt, Salmonella enterica enterica serovar Typhi Ty2
ggccuacaagaauuuaucgcaa

SEQ ID NO: 201662 - RNA, 22 nt, Salmonella enterica enterica serovar Typhi Ty2
ugggcaccagguacugauuagu

SEQ ID NO: 201663 - RNA, 22 nt, Salmonella enterica enterica serovar Typhi Ty2
ugugcguauugccccccauggg

SEQ ID NO: 201664 - RNA, 22 nt, Salmonella enterica enterica serovar Typhi Ty2
acggucugcacggugguggugg

SEQ ID NO: 201665 - RNA, 22 nt, Salmonella enterica enterica serovar Typhi Ty2
aaucugugcgugauaccaugcu

SEQ ID NO: 201666 - RNA, 22 nt, Salmonella enterica enterica serovar Typhi Ty2
gucuguuauggcuuccagugcg

SEQ ID NO: 201667 - RNA, 19 nt, Salmonella enterica enterica serovar Typhi Ty2
ugcugcgucaugccucgcc

SEQ ID NO: 201668 - RNA, 22 nt, Salmonella enterica enterica serovar Typhi Ty2
guuaccagguucugcucaccgc

SEQ ID NO: 201669 - RNA, 22 nt, Salmonella enterica enterica serovar Typhi Ty2
agcaauaccggccugacgaugc

SEQ ID NO: 201670 - RNA, 22 nt, Salmonella enterica enterica serovar Typhi Ty2
uaaugcuuauccggccuacagg

SEQ ID NO: 201671 - RNA, 22 nt, Salmonella enterica enterica serovar Typhi Ty2
accacgcugguugucgugcagg

SEQ ID NO: 201672 - RNA, 22 nt, Salmonella enterica enterica serovar Typhi Ty2
ccgacgucgcgcuggacgccuu

SEQ ID NO: 201673 - RNA, 22 nt, Salmonella enterica enterica serovar Typhi Ty2
gguugaucugcgaggcggucac

SEQ ID NO: 201674 - RNA, 20 nt, Salmonella enterica enterica serovar Typhi Ty2
gcucggcaaguuugcacagc

SEQ ID NO: 201675 - RNA, 22 nt, Salmonella enterica enterica serovar Typhi Ty2
uagccguggcggacaacggcgc

SEQ ID NO: 201676 - RNA, 22 nt, Salmonella enterica enterica serovar Typhi Ty2
uggcggcaaucggugcugcgau

SEQ ID NO: 201677 - RNA, 22 nt, Salmonella enterica enterica serovar Typhi Ty2
uuccgccaugaaacgcggcgcg

SEQ ID NO: 201678 - RNA, 22 nt, Salmonella enterica enterica serovar Typhi Ty2
cacgcgcugcuucaacauugua

SEQ ID NO: 201679 - RNA, 22 nt, Salmonella enterica enterica serovar Typhi Ty2
auaggccaguacguucgaaucg

SEQ ID NO: 201680 - RNA, 22 nt, Salmonella enterica enterica serovar Typhi Ty2
gugcaggaugacucggcuucgc

SEQ ID NO: 201681 - RNA, 21 nt, Salmonella enterica enterica serovar Typhi Ty2
ggcgucauacagcgacugagg

SEQ ID NO: 201682 - RNA, 22 nt, Salmonella enterica enterica serovar Typhi Ty2
gugaauaaucacccggcggcgc

SEQ ID NO: 201683 - RNA, 21 nt, Salmonella enterica enterica serovar Typhi Ty2
ccguggcuuuauccgcgucga

SEQ ID NO: 201684 - RNA, 22 nt, Salmonella enterica enterica serovar Typhi Ty2
cuacgcuuaucaggccuacagg

SEQ ID NO: 201685 - RNA, 22 nt, Salmonella enterica enterica serovar Typhi Ty2
ucagaccuucuucgauuucgcg

SEQ ID NO: 201686 - RNA, 22 nt, Salmonella enterica enterica serovar Typhi Ty2
ucgacacgguggugaucguucu

SEQ ID NO: 201687 - RNA, 20 nt, Salmonella enterica enterica serovar Typhi Ty2
aucauugcgccgaaccugca

SEQ ID NO: 201688 - RNA, 21 nt, Salmonella enterica enterica serovar Typhi Ty2
uucgagcguaucggucaggga

SEQ ID NO: 201689 - RNA, 22 nt, Salmonella enterica enterica serovar Typhi Ty2
ugauggucguggaauaugcugc

SEQ ID NO: 201690 - RNA, 22 nt, Salmonella enterica enterica serovar Typhi Ty2
agauucauguaugauugccggg

SEQ ID NO: 201691 - RNA, 22 nt, Salmonella enterica enterica serovar Typhi Ty2
uagcaccagcaaaacccgcucc

SEQ ID NO: 201692 - RNA, 22 nt, Salmonella enterica enterica serovar Typhi Ty2
caacagauaccagcacagcgcc

SEQ ID NO: 201693 - RNA, 21 nt, Salmonella enterica enterica serovar Typhi Ty2
cugacgccgcuguuuucacuc

SEQ ID NO: 201694 - RNA, 22 nt, Salmonella enterica enterica serovar Typhi Ty2
ugcgacgcaccauauucaggaa

SEQ ID NO: 201695 - RNA, 23 nt, Salmonella enterica enterica serovar Typhi Ty2
gccaauguauuuaugcgcgcguu

SEQ ID NO: 201696 - RNA, 22 nt, Salmonella enterica enterica serovar Typhi Ty2
cauucugagacgcaugcugugg

SEQ ID NO: 201697 - RNA, 22 nt, Salmonella enterica enterica serovar Typhi Ty2
uuuaccauuaaaaagugaugug

SEQ ID NO: 201698 - RNA, 23 nt, Salmonella enterica enterica serovar Typhi Ty2
cguauugagauggcuauaauaga

SEQ ID NO: 201699 - RNA, 22 nt, Salmonella enterica enterica serovar Typhi Ty2
ucguuaaguucauuaaugcguu

SEQ ID NO: 201700 - RNA, 22 nt, Salmonella enterica enterica serovar Typhi Ty2
ccgggcaacgggcgaaaaucgc

SEQ ID NO: 201701 - RNA, 22 nt, Salmonella enterica enterica serovar Typhi Ty2
cagcgcuacgcgcagauaggca

SEQ ID NO: 201702 - RNA, 22 nt, Salmonella enterica enterica serovar Typhi Ty2
uucgcgauacugcgccaacgcu

SEQ ID NO: 201703 - RNA, 22 nt, Salmonella enterica enterica serovar Typhi Ty2
uuuaucagcuuguugagaagau

SEQ ID NO: 201704 - RNA, 22 nt, Salmonella enterica enterica serovar Typhi Ty2
guugccgugauggucugaaaaa

SEQ ID NO: 201705 - RNA, 22 nt, Salmonella enterica enterica serovar Typhi Ty2
cgcguugucauccagcgacugg

SEQ ID NO: 201706 - RNA, 22 nt, Salmonella enterica enterica serovar Typhi Ty2
gucgagaauauggcguaccaac

SEQ ID NO: 201707 - RNA, 22 nt, Salmonella enterica enterica serovar Typhi Ty2
uugacugcuaugcugagaggau

SEQ ID NO: 201708 - RNA, 22 nt, Salmonella enterica enterica serovar Typhi Ty2
cuggauuaagcgggcugcgugu

SEQ ID NO: 201709 - RNA, 22 nt, Salmonella enterica enterica serovar Typhi Ty2
gacugggugaggcggcuacgcu

SEQ ID NO: 201710 - RNA, 22 nt, Salmonella enterica enterica serovar Typhi Ty2
acuguucaaucugcgucucgcc

SEQ ID NO: 201711 - RNA, 22 nt, Salmonella enterica enterica serovar Typhi Ty2
ucgcguuuauuaaacaguggca

SEQ ID NO: 201712 - RNA, 22 nt, Salmonella enterica enterica serovar Typhi Ty2
guagcguaacuucauuaacggc

SEQ ID NO: 201713 - RNA, 22 nt, Salmonella enterica enterica serovar Typhi Ty2
ucggugcuaaugcuggcgggca

SEQ ID NO: 201714 - RNA, 22 nt, Salmonella enterica enterica serovar Typhi Ty2
acugugguccugcggacgagca

SEQ ID NO: 201715 - RNA, 22 nt, Salmonella enterica enterica serovar Typhi Ty2
uaacgguagugauuauacgacc

SEQ ID NO: 201716 - RNA, 22 nt, Salmonella enterica enterica serovar Typhi Ty2
cggguugccagcacuacggcag

SEQ ID NO: 201717 - RNA, 22 nt, Salmonella enterica enterica serovar Typhi Ty2
ggcuaauugcgguaucuuuuac

SEQ ID NO: 201718 - RNA, 19 nt, Salmonella enterica enterica serovar Typhi Ty2
ggugaucgacgguuacggc

SEQ ID NO: 201719 - RNA, 21 nt, Salmonella enterica enterica serovar Typhi Ty2
cuuguuaacaguugcgauggc

SEQ ID NO: 201720 - RNA, 22 nt, Salmonella enterica enterica serovar Typhi Ty2
cauuucugaaagucagagcaca

SEQ ID NO: 201721 - RNA, 22 nt, Salmonella enterica enterica serovar Typhi Ty2
uagggccgggcagugcucgaaa

SEQ ID NO: 201722 - RNA, 17 nt, Salmonella enterica enterica serovar Typhi Ty2
aucggcauauaggaaug

SEQ ID NO: 201723 - RNA, 22 nt, Salmonella enterica enterica serovar Typhi Ty2
guccagcagugguuucauacuc

SEQ ID NO: 201724 - RNA, 22 nt, Salmonella enterica enterica serovar Typhi Ty2
gcugagccugauuuuaccgcug

SEQ ID NO: 201725 - RNA, 22 nt, Salmonella enterica enterica serovar Typhi Ty2
uuccggcgucauugccguggau

SEQ ID NO: 201726 - RNA, 22 nt, Salmonella enterica enterica serovar Typhi Ty2
agcgacggcgcugccaaguacg

SEQ ID NO: 201727 - RNA, 22 nt, Salmonella enterica enterica serovar Typhi Ty2
ccagccaggccucguuuucguc

SEQ ID NO: 201728 - RNA, 22 nt, Salmonella enterica enterica serovar Typhi Ty2
gccgcgaaaugacucgauauuc

SEQ ID NO: 201729 - RNA, 22 nt, Salmonella enterica enterica serovar Typhi Ty2
uaggccugauaagguaaagccg

SEQ ID NO: 201730 - RNA, 22 nt, Salmonella enterica enterica serovar Typhi Ty2
caauacgcugaacguguaugga

SEQ ID NO: 201731 - RNA, 22 nt, Salmonella enterica enterica serovar Typhi Ty2
cgccaacgccgugggagguauc

SEQ ID NO: 201732 - RNA, 22 nt, Salmonella enterica enterica serovar Typhi Ty2
agcagaauggguagguuuuucu

SEQ ID NO: 201733 - RNA, 22 nt, Salmonella enterica enterica serovar Typhi Ty2
accggcgugccgacgggcguca

SEQ ID NO: 201734 - RNA, 22 nt, Salmonella enterica enterica serovar Typhi Ty2
cugaugacgcugcgcuuauccg

SEQ ID NO: 201735 - RNA, 22 nt, Salmonella enterica enterica serovar Typhi Ty2
uacgcauauggcggaucuggau

SEQ ID NO: 201736 - RNA, 22 nt, Salmonella enterica enterica serovar Typhi Ty2
aacaugguggcggcgggcagug

SEQ ID NO: 201737 - RNA, 22 nt, Salmonella enterica enterica serovar Typhi Ty2
acgggcguugucuccuugcugc

SEQ ID NO: 201738 - RNA, 21 nt, Salmonella enterica enterica serovar Typhi Ty2
uagcguaaaaaaauugaugau

SEQ ID NO: 201739 - RNA, 22 nt, Salmonella enterica enterica serovar Typhi Ty2
cauccguggugauuucaucaau

SEQ ID NO: 201740 - RNA, 22 nt, Salmonella enterica enterica serovar Typhi Ty2
uugaagcacuauuuuggugcaa

SEQ ID NO: 201741 - RNA, 22 nt, Salmonella enterica enterica serovar Typhi Ty2
auggcggcuucgccuuauccgg

SEQ ID NO: 201742 - RNA, 22 nt, Salmonella enterica enterica serovar Typhi Ty2
auuguggcgauggcgggcaucg

SEQ ID NO: 201743 - RNA, 22 nt, Salmonella enterica enterica serovar Typhi Ty2
uuacacuuaaguuggaugauuu

SEQ ID NO: 201744 - RNA, 22 nt, Salmonella enterica enterica serovar Typhi Ty2
aauguucacugccguuauuaug

SEQ ID NO: 201745 - RNA, 22 nt, Salmonella enterica enterica serovar Typhi Ty2
cuguguaugauucauccggaga

SEQ ID NO: 201746 - RNA, 22 nt, Salmonella enterica enterica serovar Typhi Ty2
guauggacagcaagcuuuccgg

SEQ ID NO: 201747 - RNA, 22 nt, Salmonella enterica enterica serovar Typhi Ty2
uuacgcuggacgucauguggga

SEQ ID NO: 201748 - RNA, 22 nt, Salmonella enterica enterica serovar Typhi Ty2
ucugcauccccacgcgggugac

SEQ ID NO: 201749 - RNA, 22 nt, Salmonella enterica enterica serovar Typhi Ty2
cucaguaagggaauagugugau

SEQ ID NO: 201750 - RNA, 22 nt, Salmonella enterica enterica serovar Typhi Ty2
ugcaucucuugaggcuauguuu

SEQ ID NO: 201751 - RNA, 22 nt, Salmonella enterica enterica serovar Typhi Ty2
cagaauaucuggugauaagcgg

SEQ ID NO: 201752 - RNA, 22 nt, Salmonella enterica enterica serovar Typhi Ty2
gugcgccauauucucgacuggg

SEQ ID NO: 201753 - RNA, 22 nt, Salmonella enterica enterica serovar Typhi Ty2
ugcgcacguccagaccacggau

SEQ ID NO: 201754 - RNA, 22 nt, Salmonella enterica enterica serovar Typhi Ty2
gggucuccaccaguugcagcac

SEQ ID NO: 201755 - RNA, 22 nt, Salmonella enterica enterica serovar Typhi Ty2
gcuacaccugugaugcccugaa

SEQ ID NO: 201756 - RNA, 22 nt, Salmonella enterica enterica serovar Typhi Ty2
augcauaaaagcagcggcuaau

SEQ ID NO: 201757 - RNA, 22 nt, Salmonella enterica enterica serovar Typhi Ty2
ccgucgaugauuuuggucaugg

SEQ ID NO: 201758 - RNA, 22 nt, Salmonella enterica enterica serovar Typhi Ty2
ugucgcagccgauaucgcuaug

SEQ ID NO: 201759 - RNA, 22 nt, Salmonella enterica enterica serovar Typhi Ty2
ggaacggccacaguaccagcga

SEQ ID NO: 201760 - RNA, 22 nt, Salmonella enterica enterica serovar Typhi Ty2
gaggcguugaaguucuggaauc

SEQ ID NO: 201761 - RNA, 22 nt, Salmonella enterica enterica serovar Typhi Ty2
guacugauguauacgcuggccu

SEQ ID NO: 201762 - RNA, 22 nt, Salmonella enterica enterica serovar Typhi Ty2
gcguugacgagucgcugauucu

SEQ ID NO: 201763 - RNA, 22 nt, Salmonella enterica enterica serovar Typhi Ty2
ggcguucgcuacaauggccggu

SEQ ID NO: 201764 - RNA, 22 nt, Salmonella enterica enterica serovar Typhi Ty2
ugaccucugaaggacgcgugau

SEQ ID NO: 201765 - RNA, 22 nt, Salmonella enterica enterica serovar Typhi Ty2
ugauacugaggauuuucgcguu

SEQ ID NO: 201766 - RNA, 19 nt, Salmonella enterica enterica serovar Typhi Ty2
uccgcagcccugguuugcc

SEQ ID NO: 201767 - RNA, 22 nt, Salmonella enterica enterica serovar Typhi Ty2
uauccggauggauagacucaag

SEQ ID NO: 201768 - RNA, 22 nt, Salmonella enterica enterica serovar Typhi Ty2
gggcgacacccugaugacgcug

SEQ ID NO: 201769 - RNA, 22 nt, Salmonella enterica enterica serovar Typhi Ty2
caccucguuguaugccgccauu

SEQ ID NO: 201770 - RNA, 22 nt, Salmonella enterica enterica serovar Typhi Ty2
uugcgggacagcuugucgauau

SEQ ID NO: 201771 - RNA, 22 nt, Salmonella enterica enterica serovar Typhi Ty2
uagaugaggugguaauugccac

SEQ ID NO: 201772 - RNA, 22 nt, Salmonella enterica enterica serovar Typhi Ty2
aaacgcaucgguaugauugcgc

SEQ ID NO: 201773 - RNA, 22 nt, Salmonella enterica enterica serovar Typhi Ty2
aaggcguaaaagcgcuucuggc

SEQ ID NO: 201774 - RNA, 22 nt, Salmonella enterica enterica serovar Typhi Ty2
ggcguggacguccuguugaacg

SEQ ID NO: 201775 - RNA, 22 nt, Salmonella enterica enterica serovar Typhi Ty2
aucaggcagguuugccggauau

SEQ ID NO: 201776 - RNA, 22 nt, Salmonella enterica enterica serovar Typhi Ty2
ugcgcugauggccguguuuuuc

SEQ ID NO: 201777 - RNA, 22 nt, Salmonella enterica enterica serovar Typhi Ty2
ugcugauuaaaauccuuguuca

SEQ ID NO: 201778 - RNA, 22 nt, Salmonella enterica enterica serovar Typhi Ty2
aaagcguaggccugauaagcgc

SEQ ID NO: 201779 - RNA, 23 nt, Salmonella enterica enterica serovar Typhi Ty2
cggcaaauuuuuaccguggaugu

SEQ ID NO: 201780 - RNA, 22 nt, Salmonella enterica enterica serovar Typhi Ty2
aacaggguaaaggaggccggag

SEQ ID NO: 201781 - RNA, 22 nt, Salmonella enterica enterica serovar Typhi Ty2
cuggcuuuucuugggauucagg

SEQ ID NO: 201782 - RNA, 22 nt, Salmonella enterica enterica serovar Typhi Ty2
gugaagauucgcgguacggagg

SEQ ID NO: 201783 - RNA, 22 nt, Salmonella enterica enterica serovar Typhi Ty2
auccgcagauccagcacggccu

SEQ ID NO: 201784 - RNA, 22 nt, Salmonella enterica enterica serovar Typhi Ty2
ucagaauaucuccauuauucgc

SEQ ID NO: 201785 - RNA, 22 nt, Salmonella enterica enterica serovar Typhi Ty2
auggcgauauagucuuucacgc

SEQ ID NO: 201786 - RNA, 22 nt, Salmonella enterica enterica serovar Typhi Ty2
ucuuuagcguugagcgauaaua

SEQ ID NO: 201787 - RNA, 22 nt, Salmonella enterica enterica serovar Typhi Ty2
cguuacgucuguaucugcaccc

SEQ ID NO: 201788 - RNA, 22 nt, Salmonella enterica enterica serovar Typhi Ty2
gcucaucagcgcggguauguuc

SEQ ID NO: 201789 - RNA, 22 nt, Salmonella enterica enterica serovar Typhi Ty2
aacuaucgcaaacaagaaaaga

SEQ ID NO: 201790 - RNA, 22 nt, Salmonella enterica enterica serovar Typhi Ty2
agaucgucugcgaaggcugucg

SEQ ID NO: 201791 - RNA, 22 nt, Salmonella enterica enterica serovar Typhi Ty2
cggaugcacuggaugccgccca

SEQ ID NO: 201792 - RNA, 22 nt, Salmonella enterica enterica serovar Typhi Ty2
gcgguugcugcugcgguugaag

SEQ ID NO: 201793 - RNA, 22 nt, Salmonella enterica enterica serovar Typhi Ty2
ggcgacauucagcgcgugcugu

SEQ ID NO: 201794 - RNA, 22 nt, Salmonella enterica enterica serovar Typhi Ty2
ucaguaauauugaugagcgcgu

SEQ ID NO: 201795 - RNA, 22 nt, Salmonella enterica enterica serovar Typhi Ty2
cguccgaaaaaguguuagaucg

SEQ ID NO: 201796 - RNA, 22 nt, Salmonella enterica enterica serovar Typhi Ty2
aaucuguugcgucguacuuuuu

SEQ ID NO: 201797 - RNA, 22 nt, Salmonella enterica enterica serovar Typhi Ty2
ugguaucaacgauagcaaauac

SEQ ID NO: 201798 - RNA, 22 nt, Salmonella enterica enterica serovar Typhi Ty2
ucuucagcgccaaacgcgucug

SEQ ID NO: 201799 - RNA, 22 nt, Salmonella enterica enterica serovar Typhi Ty2
uuacgcgggcaacgagcacaac

SEQ ID NO: 201800 - RNA, 22 nt, Salmonella enterica enterica serovar Typhi Ty2
acaguacuggcacugaagucgc

SEQ ID NO: 201801 - RNA, 22 nt, Salmonella enterica enterica serovar Typhi Ty2
aagcgucgccgggggauauaac

SEQ ID NO: 201802 - RNA, 22 nt, Salmonella enterica enterica serovar Typhi Ty2
ccgguagcaaacuggugaacgc

SEQ ID NO: 201803 - RNA, 22 nt, Salmonella enterica enterica serovar Typhi Ty2
gguauugagcgauaaaccaauc

SEQ ID NO: 201804 - RNA, 22 nt, Salmonella enterica enterica serovar Typhi Ty2
uaacccauuguuuuauuuggug

SEQ ID NO: 201805 - RNA, 22 nt, Salmonella enterica enterica serovar Typhi Ty2
ugccggauggcgguguaaacgu

SEQ ID NO: 201806 - RNA, 22 nt, Salmonella enterica enterica serovar Typhi Ty2
ggauuucaugucgacgcaaggg

SEQ ID NO: 201807 - RNA, 22 nt, Salmonella enterica enterica serovar Typhi Ty2
gucauggucugggggaugaucg

SEQ ID NO: 201808 - RNA, 22 nt, Salmonella enterica enterica serovar Typhi Ty2
ugacgcugaaguugcugccgca

SEQ ID NO: 201809 - RNA, 21 nt, Salmonella enterica enterica serovar Typhi Ty2
gccauggcgggacacagucua

SEQ ID NO: 201810 - RNA, 22 nt, Salmonella enterica enterica serovar Typhi Ty2
ugcacgucggcgaagcgccaaa

SEQ ID NO: 201811 - RNA, 20 nt, Salmonella enterica enterica serovar Typhi Ty2
agcugcugcgcuuuccaggc

SEQ ID NO: 201812 - RNA, 22 nt, Salmonella enterica enterica serovar Typhi Ty2
ggaaccauuuugacuuuacgaa

SEQ ID NO: 201813 - RNA, 22 nt, Salmonella enterica enterica serovar Typhi Ty2
uccggcauuugcgcggcgaccg

SEQ ID NO: 201814 - RNA, 22 nt, Salmonella enterica enterica serovar Typhi Ty2
augcugugaauucagucggguu

SEQ ID NO: 201815 - RNA, 19 nt, Salmonella enterica enterica serovar Typhi Ty2
uucgccaaagacuuaaugg

SEQ ID NO: 201816 - RNA, 22 nt, Salmonella enterica enterica serovar Typhi Ty2
uuugagacuaacgccaggauag

SEQ ID NO: 201817 - RNA, 22 nt, Salmonella enterica enterica serovar Typhi Ty2
gaccguuaucugcugcugccgc

SEQ ID NO: 201818 - RNA, 21 nt, Salmonella enterica enterica serovar Typhi Ty2
cguuccaccuuuaucagcagu

SEQ ID NO: 201819 - RNA, 21 nt, Salmonella enterica enterica serovar Typhi Ty2
cgcucgacaggcuguuaagcc

SEQ ID NO: 201820 - RNA, 22 nt, Salmonella enterica enterica serovar Typhi Ty2
uucuggcgucguuuucgccgcc

SEQ ID NO: 201821 - RNA, 22 nt, Salmonella enterica enterica serovar Typhi Ty2
cgcaucuucgaagaagaagaag

SEQ ID NO: 201822 - RNA, 22 nt, Salmonella enterica enterica serovar Typhi Ty2
acgucuuaucuggccuacguga

SEQ ID NO: 201823 - RNA, 22 nt, Salmonella enterica enterica serovar Typhi Ty2
cgucgagcagauaaaaacgauu

SEQ ID NO: 201824 - RNA, 22 nt, Salmonella enterica enterica serovar Typhi Ty2
ucccggcagaaagguccagcgu

SEQ ID NO: 201825 - RNA, 22 nt, Salmonella enterica enterica serovar Typhi Ty2
caucuuuaccuuuguguugggc

SEQ ID NO: 201826 - RNA, 22 nt, Salmonella enterica enterica serovar Typhi Ty2
aagucgauuuccgcuuccugcg

SEQ ID NO: 201827 - RNA, 22 nt, Salmonella enterica enterica serovar Typhi Ty2
acagagccugucucagcaauga

SEQ ID NO: 201828 - RNA, 22 nt, Salmonella enterica enterica serovar Typhi Ty2
acucuuaacaaauagaaauuac

SEQ ID NO: 201829 - RNA, 22 nt, Salmonella enterica enterica serovar Typhi Ty2
acauugagggcgaaaucucaua

SEQ ID NO: 201830 - RNA, 20 nt, Salmonella enterica enterica serovar Typhi Ty2
acauaauccggguaaagacc

SEQ ID NO: 201831 - RNA, 22 nt, Salmonella enterica enterica serovar Typhi Ty2
acaguacuggcacugaagucgc

SEQ ID NO: 201832 - RNA, 22 nt, Salmonella enterica enterica serovar Typhi Ty2
agggaguuaaaacguacugcgu

SEQ ID NO: 201833 - RNA, 22 nt, Salmonella enterica enterica serovar Typhi Ty2
aguggaaucagccaggagucgg

SEQ ID NO: 201834 - RNA, 22 nt, Salmonella enterica enterica serovar Typhi Ty2
agucaauauuuauucauggaau

SEQ ID NO: 201835 - RNA, 22 nt, Salmonella enterica enterica serovar Typhi Ty2
aguuaucaacggaagauuagua

SEQ ID NO: 201836 - RNA, 22 nt, Salmonella enterica enterica serovar Typhi Ty2
aguucaaaccguuauuaauuaa

SEQ ID NO: 201837 - RNA, 22 nt, Salmonella enterica enterica serovar Typhi Ty2
augccuuauccggccuacaacg

SEQ ID NO: 201838 - RNA, 22 nt, Salmonella enterica enterica serovar Typhi Ty2
augcugugaauucagucggguu

SEQ ID NO: 201839 - RNA, 22 nt, Salmonella enterica enterica serovar Typhi Ty2
augaauacacaggauuugacga

SEQ ID NO: 201840 - RNA, 22 nt, Salmonella enterica enterica serovar Typhi Ty2
aucugguugaauuugaucagga

SEQ ID NO: 201841 - RNA, 22 nt, Salmonella enterica enterica serovar Typhi Ty2
aucuugauugcagccagaguuu

SEQ ID NO: 201842 - RNA, 22 nt, Salmonella enterica enterica serovar Typhi Ty2
aucugcuucaugcguuucuuac

SEQ ID NO: 201843 - RNA, 22 nt, Salmonella enterica enterica serovar Typhi Ty2
auccucagaugaagcgggcgcu

SEQ ID NO: 201844 - RNA, 22 nt, Salmonella enterica enterica serovar Typhi Ty2
auccugauacuuuccgagauag

SEQ ID NO: 201845 - RNA, 22 nt, Salmonella enterica enterica serovar Typhi Ty2
aucaguuucaggaugaagaccg

SEQ ID NO: 201846 - RNA, 18 nt, Salmonella enterica enterica serovar Typhi Ty2
aucaggguggauuccggg

SEQ ID NO: 201847 - RNA, 19 nt, Salmonella enterica enterica serovar Typhi Ty2
cagauuguuguuuaucuca

SEQ ID NO: 201848 - RNA, 20 nt, Salmonella enterica enterica serovar Typhi Ty2
cagcuccaccugcagcccgu

SEQ ID NO: 201849 - RNA, 22 nt, Salmonella enterica enterica serovar Typhi Ty2
cagcuccugguccguaaccugg

SEQ ID NO: 201850 - RNA, 22 nt, Salmonella enterica enterica serovar Typhi Ty2
cacuggugaaaucgccuuccgg

SEQ ID NO: 201851 - RNA, 22 nt, Salmonella enterica enterica serovar Typhi Ty2
auucaaucaaauuaagaucaca

SEQ ID NO: 201852 - RNA, 22 nt, Salmonella enterica enterica serovar Typhi Ty2
auuccaggaauaaguauccaga

SEQ ID NO: 201853 - RNA, 22 nt, Salmonella enterica enterica serovar Typhi Ty2
auggcugcccggcgccuguaac

SEQ ID NO: 201854 - RNA, 22 nt, Salmonella enterica enterica serovar Typhi Ty2
augguauugaugguuaugucgu

SEQ ID NO: 201855 - RNA, 22 nt, Salmonella enterica enterica serovar Typhi Ty2
caacauagauaugagguucacu

SEQ ID NO: 201856 - RNA, 22 nt, Salmonella enterica enterica serovar Typhi Ty2
auuucugucaccuguugcuguu

SEQ ID NO: 201857 - RNA, 22 nt, Salmonella enterica enterica serovar Typhi Ty2
auugauguggguaaagugaugg

SEQ ID NO: 201858 - RNA, 22 nt, Salmonella enterica enterica serovar Typhi Ty2
auugaugacaucgaccugaacc

SEQ ID NO: 201859 - RNA, 22 nt, Salmonella enterica enterica serovar Typhi Ty2
uccagcaaaaaucuuucuuugg

SEQ ID NO: 201860 - RNA, 19 nt, Salmonella enterica enterica serovar Typhi Ty2
uccggaugacgaacuggcc

SEQ ID NO: 201861 - RNA, 22 nt, Salmonella enterica enterica serovar Typhi Ty2
ucugcauccccacgcgggugac

SEQ ID NO: 201862 - RNA, 22 nt, Salmonella enterica enterica serovar Typhi Ty2
ucuuaugauguagaacgugcaa

SEQ ID NO: 201863 - RNA, 21 nt, Salmonella enterica enterica serovar Typhi Ty2
ucugaaguacaaauuuucauc

SEQ ID NO: 201864 - RNA, 22 nt, Salmonella enterica enterica serovar Typhi Ty2
uggcacugcuccagcuuuaccu

SEQ ID NO: 201865 - RNA, 22 nt, Salmonella enterica enterica serovar Typhi Ty2
uguaggccggauaagacgcguc

SEQ ID NO: 201866 - RNA, 22 nt, Salmonella enterica enterica serovar Typhi Ty2
uggcucaagcucaguuaucuga

SEQ ID NO: 201867 - RNA, 22 nt, Salmonella enterica enterica serovar Typhi Ty2
uaaugcuuauccggccuacagg

SEQ ID NO: 201868 - RNA, 22 nt, Salmonella enterica enterica serovar Typhi Ty2
uaacagccccagcccuggcgua

SEQ ID NO: 201869 - RNA, 22 nt, Salmonella enterica enterica serovar Typhi Ty2
ucaggguggugauguaguagua

SEQ ID NO: 201870 - RNA, 23 nt, Salmonella enterica enterica serovar Typhi Ty2
ucagggcugccgaugucgccagc

SEQ ID NO: 201871 - RNA, 22 nt, Salmonella enterica enterica serovar Typhi Ty2
gugcaggaugacucggcuucgc

SEQ ID NO: 201872 - RNA, 22 nt, Salmonella enterica enterica serovar Typhi Ty2
gugccgucgccauuggugucuc

SEQ ID NO: 201873 - RNA, 22 nt, Salmonella enterica enterica serovar Typhi Ty2
gggcuucuuugcguguguggua

SEQ ID NO: 201874 - RNA, 22 nt, Salmonella enterica enterica serovar Typhi Ty2
ggcugcugaagguguucugcgc

SEQ ID NO: 201875 - RNA, 22 nt, Salmonella enterica enterica serovar Typhi Ty2
ggcaccagcacuucaaacugac

SEQ ID NO: 201876 - RNA, 22 nt, Salmonella enterica enterica serovar Typhi Ty2
gccagauauauuuuccugcauc

SEQ ID NO: 201877 - RNA, 22 nt, Salmonella enterica enterica serovar Typhi Ty2
cuuaucuguauugaugauaaac

SEQ ID NO: 201878 - RNA, 22 nt, Salmonella enterica enterica serovar Typhi Ty2
cugauucaaauugagcgucuua

SEQ ID NO: 201879 - RNA, 22 nt, Salmonella enterica enterica serovar Typhi Ty2
cuccaguuggcugauguuguau

SEQ ID NO: 201880 - RNA, 20 nt, Salmonella enterica enterica serovar Typhi Ty2
cucagcaggccguuguccgg

SEQ ID NO: 201881 - RNA, 22 nt, Salmonella enterica enterica serovar Typhi Ty2
cugcaggacucugcaacgucug

SEQ ID NO: 201882 - RNA, 21 nt, Salmonella enterica enterica serovar Typhi Ty2
cguuccaccuuuaucagcagu

SEQ ID NO: 201883 - RNA, 22 nt, Salmonella enterica enterica serovar Typhi Ty2
cgugccugauggcgcugugcuu

SEQ ID NO: 201884 - RNA, 22 nt, Salmonella enterica enterica serovar Typhi Ty2
cagguuguugggauguuucaga

SEQ ID NO: 201885 - RNA, 22 nt, Salmonella enterica enterica serovar Typhi Ty2
cauagcauaacaaagaugcgaa

SEQ ID NO: 201886 - RNA, 22 nt, Salmonella enterica enterica serovar Typhi Ty2
uguucugaaaaaugaagaucug

SEQ ID NO: 201887 - RNA, 22 nt, Salmonella enterica enterica serovar Typhi Ty2
uuagcagacaaaucguuguuga

SEQ ID NO: 201888 - RNA, 22 nt, Salmonella enterica enterica serovar Typhi Ty2
aagcaugaaacgauauauacug

SEQ ID NO: 201889 - RNA, 22 nt, Salmonella enterica enterica serovar Typhi Ty2
agacugcauuucaauggcuucc

SEQ ID NO: 201890 - RNA, 22 nt, Salmonella enterica enterica serovar Typhi Ty2
agagcggcuuugcuuccaggag

SEQ ID NO: 201891 - RNA, 22 nt, Salmonella enterica enterica serovar Typhi Ty2
agaugggcaaagccacggugga

SEQ ID NO: 201892 - RNA, 22 nt, Salmonella enterica enterica serovar Typhi Ty2
agauucaucuaauuugauuacu

SEQ ID NO: 201893 - RNA, 22 nt, Salmonella enterica enterica serovar Typhi Ty2
agauuugcuugaguuguuuagc

SEQ ID NO: 201894 - RNA, 22 nt, Salmonella enterica enterica serovar Typhi Ty2
acgaaggcgacauuagcagccg

SEQ ID NO: 201895 - RNA, 22 nt, Salmonella enterica enterica serovar Typhi Ty2
acgcaaguuaugaaugguauug

SEQ ID NO: 201896 - RNA, 22 nt, Salmonella enterica enterica serovar Typhi Ty2
aaucuguugcgucguacuuuuu

SEQ ID NO: 201897 - RNA, 22 nt, Salmonella enterica enterica serovar Typhi Ty2
aaugagcugaugaaugaacuaa

SEQ ID NO: 201898 - RNA, 22 nt, Salmonella enterica enterica serovar Typhi Ty2
agccagccaguucgaugauuuu

SEQ ID NO: 201899 - RNA, 22 nt, Salmonella enterica enterica serovar Typhi Ty2
agcaguuuaauaagguucuggc

SEQ ID NO: 201900 - RNA, 22 nt, Salmonella enterica enterica serovar Typhi Ty2
agcaugcucuugcaaacugggu

SEQ ID NO: 201901 - RNA, 22 nt, Salmonella enterica enterica serovar Typhi Ty2
agcgucaaaauuucauguauau

SEQ ID NO: 201902 - RNA, 22 nt, Salmonella enterica enterica serovar Typhi Ty2
agcggccugcuggucucauugu

SEQ ID NO: 201903 - RNA, 22 nt, Salmonella enterica enterica serovar Typhi Ty2
agcuuuaucucuaaagcgggca

SEQ ID NO: 201904 - RNA, 22 nt, Salmonella enterica enterica serovar Typhi Ty2
uuucauuguuguggaaccgcuu

SEQ ID NO: 201905 - RNA, 22 nt, Salmonella enterica enterica serovar Typhi Ty2
uuugauaccaauauccucaucg

SEQ ID NO: 201906 - RNA, 22 nt, Salmonella enterica enterica serovar Typhi Ty2
uuaucagucuacaaauuacuuu

SEQ ID NO: 201907 - RNA, 22 nt, Salmonella enterica enterica serovar Typhi Ty2
gauggugaugaccgucaaugcc

SEQ ID NO: 201908 - RNA, 22 nt, Salmonella enterica enterica serovar Typhi Ty2
gauggcggugcugauggugcaa

SEQ ID NO: 201909 - RNA, 22 nt, Salmonella enterica enterica serovar Typhi Ty2
cuggcaggcgacguauggcacg

SEQ ID NO: 201910 - RNA, 22 nt, Salmonella enterica enterica serovar Typhi Ty2
cuggaagucaugggcauuuaug

SEQ ID NO: 201911 - RNA, 22 nt, Salmonella enterica enterica serovar Typhi Ty2
gagcuucaauacggcgaucggc

SEQ ID NO: 201912 - RNA, 22 nt, Salmonella enterica enterica serovar Typhi Ty2
gaucgcuaaaacguuuuuaugu

SEQ ID NO: 201913 - RNA, 22 nt, Salmonella enterica enterica serovar Typhi Ty2
ccaggguuugacguuuccacuu

SEQ ID NO: 201914 - RNA, 22 nt, Salmonella enterica enterica serovar Typhi Ty2
ccagagauugcuaggugacugu

SEQ ID NO: 201915 - RNA, 22 nt, Salmonella enterica enterica serovar Typhi Ty2
aggccugauaagcgcagcgcca

SEQ ID NO: 201916 - RNA, 20 nt, Salmonella enterica enterica serovar Typhi Ty2
ccguuauuguugugcccuac

SEQ ID NO: 201917 - RNA, 22 nt, Salmonella enterica enterica serovar Typhi Ty2
ccuguggaauggcggucagauc

SEQ ID NO: 201918 - RNA, 22 nt, Salmonella enterica enterica serovar Typhi Ty2
ggagccugcaucgucggcgcgc

SEQ ID NO: 201919 - RNA, 22 nt, Salmonella enterica enterica serovar Typhi Ty2
gcuuucaggccuccuggugugg

SEQ ID NO: 201920 - RNA, 22 nt, Salmonella enterica enterica serovar Typhi Ty2
guauuucagguggccuucacgc

SEQ ID NO: 201921 - RNA, 22 nt, Salmonella enterica enterica serovar Typhi Ty2
gucugcccgcagacauggucgu

SEQ ID NO: 201922 - RNA, 22 nt, Salmonella enterica enterica serovar Typhi Ty2
guuauucugcgcucguucuauc

SEQ ID NO: 201923 - RNA, 22 nt, Salmonella enterica enterica serovar Typhi Ty2
guuuaucgaaggccagaucguc

SEQ ID NO: 201924 - RNA, 21 nt, Salmonella enterica enterica serovar Typhi Ty2
uagcuccauuacgaucaccac

SEQ ID NO: 201925 - RNA, 22 nt, Salmonella enterica enterica serovar Typhi Ty2
ugcaucucuugaggcuauguuu

SEQ ID NO: 201926 - RNA, 22 nt, Salmonella enterica enterica serovar Typhi Ty2
ugcaggauggcguccagcgacc

SEQ ID NO: 201927 - RNA, 22 nt, Salmonella enterica enterica serovar Typhi Ty2
ucaacuucagcagauaccauua

SEQ ID NO: 201928 - RNA, 22 nt, Human
aaaaaaacuaauuuuaaaugug

SEQ ID NO: 201929 - RNA, 22 nt, Human
aaaacauuuaggguuuuuuuua

SEQ ID NO: 201930 - RNA, 22 nt, Human
aaaaaguaccacuuggacacuu

SEQ ID NO: 201931 - RNA, 20 nt, Human
aaaaacaguaaugcugaaga

SEQ ID NO: 201932 - RNA, 22 nt, Human
aaaaacuuaccccagggcaagg

SEQ ID NO: 201933 - RNA, 22 nt, Human
aaaaaggagaaagagagggaga

SEQ ID NO: 201934 - RNA, 22 nt, Human
aaaaaauugcuggcagagcugu

SEQ ID NO: 201935 - RNA, 22 nt, Human
aaaagacaaggaucuggaguga

SEQ ID NO: 201936 - RNA, 22 nt, Human
aaaagauguaaacauauauuaa

SEQ ID NO: 201937 - RNA, 20 nt, Human
aaaaauguguuuauggagau

SEQ ID NO: 201938 - RNA, 22 nt, Human
aaaacuuucagggauacagaaa

SEQ ID NO: 201939 - RNA, 21 nt, Human
aaacaugcagccugccaauuc

SEQ ID NO: 201940 - RNA, 22 nt, Human
aaacauaugccuucuuuuguaa

SEQ ID NO: 201941 - RNA, 18 nt, Human
aaacauggcuuaaaggcu

SEQ ID NO: 201942 - RNA, 22 nt, Human
aaaccagaguucauaguauuca

SEQ ID NO: 201943 - RNA, 22 nt, Human
aaacccauauaccagcugugcu

SEQ ID NO: 201944 - RNA, 22 nt, Human
aaacccuagcguuguuuauuga

SEQ ID NO: 201945 - RNA, 22 nt, Human
aaacaaauccaauaauaaaauu

SEQ ID NO: 201946 - RNA, 22 nt, Human
aaaauauaaaggauguggguuu

SEQ ID NO: 201947 - RNA, 22 nt, Human
aaaauaauauuauaccacugcu

SEQ ID NO: 201948 - RNA, 22 nt, Human
aaaauacuaggaaaauaaauca

SEQ ID NO: 201949 - RNA, 22 nt, Human
aaaagcauuauuagucugggug

SEQ ID NO: 201950 - RNA, 22 nt, Human
aaaagcgaagagaacugaaguu

SEQ ID NO: 201951 - RNA, 22 nt, Human
aaaaggaacaauaugguauuuu

SEQ ID NO: 201952 - RNA, 22 nt, Human
aaaagcucucuucuucggcuuu

SEQ ID NO: 201953 - RNA, 22 nt, Human
aaagaauuucaagauucccaca

SEQ ID NO: 201954 - RNA, 22 nt, Human
aaacucaugccagagaacuuaa

SEQ ID NO: 201955 - RNA, 22 nt, Human
aaacugcuuucucugccuuucc

SEQ ID NO: 201956 - RNA, 21 nt, Human
aaagaaguuaguucagugguu

SEQ ID NO: 201957 - RNA, 22 nt, Human
aaacucaucaguuuagaaaccu

SEQ ID NO: 201958 - RNA, 22 nt, Human
aaagaacguuucugggaaucag

SEQ ID NO: 201959 - RNA, 21 nt, Human
aaagaagagcucagagguaga

SEQ ID NO: 201960 - RNA, 22 nt, Human
aaagagcugccaagguuacagu

SEQ ID NO: 201961 - RNA, 22 nt, Human
aaagaccuucacuuucuggcug

SEQ ID NO: 201962 - RNA, 22 nt, Human
aaacuugaggcaaugaaggugu

SEQ ID NO: 201963 - RNA, 23 nt, Human
aaagacuagaagccguggcugca

SEQ ID NO: 201964 - RNA, 21 nt, Human
aaauuucauauggccaaccua

SEQ ID NO: 201965 - RNA, 20 nt, Human
aaauugaacaagccaggcug

SEQ ID NO: 201966 - RNA, 22 nt, Human
aacacuaaaggucaguuagaag

SEQ ID NO: 201967 - RNA, 22 nt, Human
aaauuuauaacuuaaagugaau

SEQ ID NO: 201968 - RNA, 20 nt, Human
aacagcucucgacuuaucuu

SEQ ID NO: 201969 - RNA, 22 nt, Human
aaccaauaagaggaugccauuu

SEQ ID NO: 201970 - RNA, 22 nt, Human
aacagaauaucaaaagauuaug

SEQ ID NO: 201971 - RNA, 22 nt, Human
aacaguaugugagauuuacaca

SEQ ID NO: 201972 - RNA, 22 nt, Human
aacaucugagagcccuugugca

SEQ ID NO: 201973 - RNA, 22 nt, Human
aacaucaaaggaagaaugauau

SEQ ID NO: 201974 - RNA, 22 nt, Human
aacaguuaagaggaggcagaga

SEQ ID NO: 201975 - RNA, 22 nt, Human
aacagaaaucauuuagggcucu

SEQ ID NO: 201976 - RNA, 22 nt, Human
aacagguucaagccuugcagca

SEQ ID NO: 201977 - RNA, 22 nt, Human
aaauuaaaguuuuauuuagagc

SEQ ID NO: 201978 - RNA, 22 nt, Human
aaauguguagaggggagagccg

SEQ ID NO: 201979 - RNA, 22 nt, Human
aaauguuugguggauaaaagga

SEQ ID NO: 201980 - RNA, 22 nt, Human
aaauucggggaguuuugaggau

SEQ ID NO: 201981 - RNA, 22 nt, Human
aaauucagauggcuuucuuuuc

SEQ ID NO: 201982 - RNA, 22 nt, Human
aaauucuuccaggaggaaauac

SEQ ID NO: 201983 - RNA, 20 nt, Human
aaauucgacuaaaaccagaa

SEQ ID NO: 201984 - RNA, 22 nt, Human
aaaugguguucuuuagaugaaa

SEQ ID NO: 201985 - RNA, 22 nt, Human
aaauguaaacuguauuuauaaa

SEQ ID NO: 201986 - RNA, 22 nt, Human
aaauggaaguuuguucucagcc

SEQ ID NO: 201987 - RNA, 22 nt, Human
aaagaggacgugcuauuuuuua

SEQ ID NO: 201988 - RNA, 22 nt, Human
aaccuuucucccugcacacugg

SEQ ID NO: 201989 - RNA, 22 nt, Human
aacgagcugggggggccggggg

SEQ ID NO: 201990 - RNA, 22 nt, Human
aacgaugauaaauuguucucug

SEQ ID NO: 201991 - RNA, 22 nt, Human
aacgauuugaguuaguuuuuag

SEQ ID NO: 201992 - RNA, 21 nt, Human
aacuaaugacugcagcaggaa

SEQ ID NO: 201993 - RNA, 22 nt, Human
aaccugaggguagacaaguuca

SEQ ID NO: 201994 - RNA, 22 nt, Human
aaccuggguguacauuaugguc

SEQ ID NO: 201995 - RNA, 22 nt, Human
aaccuggaggaccuuaugcuaa

SEQ ID NO: 201996 - RNA, 22 nt, Human
aacgucugagaccccuccucuc

SEQ ID NO: 201997 - RNA, 22 nt, Human
aacgugcuuuacaaaugaccuu

SEQ ID NO: 201998 - RNA, 19 nt, Human
aacuacagcgcacuguccu

SEQ ID NO: 201999 - RNA, 22 nt, Human
aacccugaacuuaguucuagga

SEQ ID NO: 202000 - RNA, 22 nt, Human
aacgccgggacucgcagggagc

SEQ ID NO: 202001 - RNA, 22 nt, Human
aacgcaacaacuggagcuguag

SEQ ID NO: 202002 - RNA, 22 nt, Human
aacagggcaguuccuuauagug

SEQ ID NO: 202003 - RNA, 22 nt, Human
aacagggcgugaauaaugaaga

SEQ ID NO: 202004 - RNA, 22 nt, Human
aacaguacaucaugaggucauc

SEQ ID NO: 202005 - RNA, 22 nt, Human
aacagguucaucuuggaagcag

SEQ ID NO: 202006 - RNA, 22 nt, Human
aaccagaagucaucagagcuga

SEQ ID NO: 202007 - RNA, 22 nt, Human
aaccggauugauccuucuuuga

SEQ ID NO: 202008 - RNA, 22 nt, Human
aacauuguggacaagggcaggu

SEQ ID NO: 202009 - RNA, 22 nt, Human
aaccauggauuucaguucaccu

SEQ ID NO: 202010 - RNA, 22 nt, Human
aaccucgggcugcacuuggcac

SEQ ID NO: 202011 - RNA, 22 nt, Human
aaccaagcucaauggucugagu

SEQ ID NO: 202012 - RNA, 22 nt, Human
aaccguguucgggaacacuugu

SEQ ID NO: 202013 - RNA, 22 nt, Human
aaccaggcgagagagcggucag

SEQ ID NO: 202014 - RNA, 22 nt, Human
aaccuuauuguguaucaccaua

SEQ ID NO: 202015 - RNA, 22 nt, Human
aaccucuuuaaaagggauauug

SEQ ID NO: 202016 - RNA, 22 nt, Human
aaccuaagaacagcaggcuccu

SEQ ID NO: 202017 - RNA, 22 nt, Human
aaccucuuugugaaugucauga

SEQ ID NO: 202018 - RNA, 22 nt, Human
aagaaggcggaccagaagggag

SEQ ID NO: 202019 - RNA, 22 nt, Human
aagaacuagauagugguguaaa

SEQ ID NO: 202020 - RNA, 22 nt, Human
aagaaggaaggcaagagauggg

SEQ ID NO: 202021 - RNA, 20 nt, Human
aagacacuguccccacugga

SEQ ID NO: 202022 - RNA, 22 nt, Human
aagaaaagaaacauggguaugc

SEQ ID NO: 202023 - RNA, 22 nt, Human
aagagaaagggaaaaugguaaa

SEQ ID NO: 202024 - RNA, 22 nt, Human
aagagaggaaagggugugaggu

SEQ ID NO: 202025 - RNA, 21 nt, Human
aagagcgccgggcagggcuga

SEQ ID NO: 202026 - RNA, 22 nt, Human
aagaggauuuuaguuugccaga

SEQ ID NO: 202027 - RNA, 22 nt, Human
aagaggcagcuugguaggcauc

SEQ ID NO: 202028 - RNA, 22 nt, Human
aagaggaggacgguucccagaa

SEQ ID NO: 202029 - RNA, 22 nt, Human
aagaugcuucaugagaguuggg

SEQ ID NO: 202030 - RNA, 22 nt, Human
aagauguuguagauuagugaga

SEQ ID NO: 202031 - RNA, 22 nt, Human
aagaguggagcuggaaaguggg

SEQ ID NO: 202032 - RNA, 22 nt, Human
aagauuuaccacuuuauucaag

SEQ ID NO: 202033 - RNA, 22 nt, Human
aagagugugagguugugcuuuu

SEQ ID NO: 202034 - RNA, 22 nt, Human
aagcagaaaaacugagcuccaa

SEQ ID NO: 202035 - RNA, 22 nt, Human
aagcacagggacucaggaccgg

SEQ ID NO: 202036 - RNA, 22 nt, Human
aagcaaguucuaaaguaauucu

SEQ ID NO: 202037 - RNA, 22 nt, Human
aagcaacccagugcuuguauag

SEQ ID NO: 202038 - RNA, 22 nt, Human
aagagcuuguuaugcugcucuu

SEQ ID NO: 202039 - RNA, 22 nt, Human
aagagaaaugcuuuaacuuuau

SEQ ID NO: 202040 - RNA, 22 nt, Human
aagacccuaccccuggagagga

SEQ ID NO: 202041 - RNA, 22 nt, Human
aagaggacagucaaauggccgg

SEQ ID NO: 202042 - RNA, 22 nt, Human
aagaggaggcuggaauccuaaa

SEQ ID NO: 202043 - RNA, 22 nt, Human
aagcauuuuagauaaagcauca

SEQ ID NO: 202044 - RNA, 22 nt, Human
aagcagcauaugacagcaucca

SEQ ID NO: 202045 - RNA, 21 nt, Human
aagcagcugcagaauuucagu

SEQ ID NO: 202046 - RNA, 22 nt, Human
aagcagaacuguuuuguuuucu

SEQ ID NO: 202047 - RNA, 22 nt, Human
aagcaguuuagucaucgggauu

SEQ ID NO: 202048 - RNA, 22 nt, Human
aagcaugagguggugagugaca

SEQ ID NO: 202049 - RNA, 22 nt, Human
aacugcauaagcuucgggaccu

SEQ ID NO: 202050 - RNA, 22 nt, Human
aacugagugcuacauugugauu

SEQ ID NO: 202051 - RNA, 22 nt, Human
aacuggguuuaucuaaugugua

SEQ ID NO: 202052 - RNA, 22 nt, Human
aagaaaagguaaccgcuuaucu

SEQ ID NO: 202053 - RNA, 22 nt, Human
aacuuagagcucuccuaaauga

SEQ ID NO: 202054 - RNA, 22 nt, Human
aacuuucugaaaagcuugauca

SEQ ID NO: 202055 - RNA, 22 nt, Human
aacuuuuaugaaggaaaucaua

SEQ ID NO: 202056 - RNA, 22 nt, Human
aagaaauacagaaauggcagua

SEQ ID NO: 202057 - RNA, 22 nt, Human
aagaaaggcacaagaaagaaaa

SEQ ID NO: 202058 - RNA, 22 nt, Human
aagaaaggagauauucuuuuag

SEQ ID NO: 202059 - RNA, 22 nt, Human
aacuuuacagacuagagcuuuc

SEQ ID NO: 202060 - RNA, 19 nt, Human
aacucugccgaggcaagcc

SEQ ID NO: 202061 - RNA, 22 nt, Human
aacugaaguuuucagauuuugc

SEQ ID NO: 202062 - RNA, 22 nt, Human
aacuagugucuguaugauaagg

SEQ ID NO: 202063 - RNA, 22 nt, Human
aacuguugucacgaauguggcu

SEQ ID NO: 202064 - RNA, 22 nt, Human
aacuugaagacaccccacauuc

SEQ ID NO: 202065 - RNA, 22 nt, Human
aacugguaauuuaguauuacug

SEQ ID NO: 202066 - RNA, 22 nt, Human
aacuuaacucugcaauccagcu

SEQ ID NO: 202067 - RNA, 22 nt, Human
aacgcugugcacuggguccagg

SEQ ID NO: 202068 - RNA, 22 nt, Human
aacucgaugcaauucacuuugu

SEQ ID NO: 202069 - RNA, 22 nt, Human
aacgcagagaguaaugcugaac

SEQ ID NO: 202070 - RNA, 22 nt, Human
aacucugagaaacuugcaguug

SEQ ID NO: 202071 - RNA, 23 nt, Human
aacucuggcuagcauagaauaga

SEQ ID NO: 202072 - RNA, 22 nt, Human
aacuacucugggguggcagguu

SEQ ID NO: 202073 - RNA, 22 nt, Human
aacucugcaaugaaaucauguu

SEQ ID NO: 202074 - RNA, 23 nt, Human
aacugcaagguugcugggaagua

SEQ ID NO: 202075 - RNA, 22 nt, Human
aacgggcacuuuauuuaaaaaa

SEQ ID NO: 202076 - RNA, 22 nt, Human
aagccugguuauuugaggaugu

SEQ ID NO: 202077 - RNA, 22 nt, Human
aagccucaugccagauccaggu

SEQ ID NO: 202078 - RNA, 22 nt, Human
aagcaggaaaugaaaugcuugc

SEQ ID NO: 202079 - RNA, 22 nt, Human
aaggagcuuucauuacagccuu

SEQ ID NO: 202080 - RNA, 22 nt, Human
aaggaucuuucuuuuuaccauu

SEQ ID NO: 202081 - RNA, 19 nt, Human
aaggcuuucugagugaaaa

SEQ ID NO: 202082 - RNA, 22 nt, Human
aaggcgauuuaaagauguuagg

SEQ ID NO: 202083 - RNA, 22 nt, Human
aaggcggcggcggcggcugcgg

SEQ ID NO: 202084 - RNA, 22 nt, Human
aaggcgguuccgguucgcggcg

SEQ ID NO: 202085 - RNA, 22 nt, Human
aaggcgccacagugauugcaaa

SEQ ID NO: 202086 - RNA, 22 nt, Human
aaggcgaggggcacagcugaga

SEQ ID NO: 202087 - RNA, 22 nt, Human
aaggcaggagaguaggaggugg

SEQ ID NO: 202088 - RNA, 22 nt, Human
aaggccuaggaguugacauggg

SEQ ID NO: 202089 - RNA, 22 nt, Human
aaggccacacuugcuggccagc

SEQ ID NO: 202090 - RNA, 22 nt, Human
aaggcaguuaauuuggcuagaa

SEQ ID NO: 202091 - RNA, 23 nt, Human
aagggcgauuaacauucgcucga

SEQ ID NO: 202092 - RNA, 22 nt, Human
aagggcuucucgccugugugca

SEQ ID NO: 202093 - RNA, 22 nt, Human
aagggccacaugccauuuaaaa

SEQ ID NO: 202094 - RNA, 22 nt, Human
aagggaaggaugggcauuuaca

SEQ ID NO: 202095 - RNA, 22 nt, Human
aagggaccucagcaaucaggga

SEQ ID NO: 202096 - RNA, 22 nt, Human
aagggggacaagcauuggcuua

SEQ ID NO: 202097 - RNA, 22 nt, Human
aagguauaaauaacucgggagg

SEQ ID NO: 202098 - RNA, 22 nt, Human
aaggugcugaggguccuggcuu

SEQ ID NO: 202099 - RNA, 22 nt, Human
aaggugggacugagaggggaca

SEQ ID NO: 202100 - RNA, 22 nt, Human
aaggugcauuaguuuggagggg

SEQ ID NO: 202101 - RNA, 22 nt, Human
aagguguaaguagcugguucau

SEQ ID NO: 202102 - RNA, 22 nt, Human
aagguuuuguaugaaaucucug

SEQ ID NO: 202103 - RNA, 21 nt, Human
aaguaaauuuuuacuuaggcc

SEQ ID NO: 202104 - RNA, 22 nt, Human
aagguuuuguuuucgguuuuuu

SEQ ID NO: 202105 - RNA, 22 nt, Human
aaguacugauucuguuccucaa

SEQ ID NO: 202106 - RNA, 22 nt, Human
aauauauaugggugcaugucug

SEQ ID NO: 202107 - RNA, 22 nt, Human
aauauagagcagaucuggcucu

SEQ ID NO: 202108 - RNA, 22 nt, Human
aauagguaaaugaguaagaaau

SEQ ID NO: 202109 - RNA, 22 nt, Human
aauagcuuuuuguuugguguau

SEQ ID NO: 202110 - RNA, 22 nt, Human
aauaggaaggaaauguuuaccu

SEQ ID NO: 202111 - RNA, 22 nt, Human
aauaauuuuuuugugauuaugu

SEQ ID NO: 202112 - RNA, 22 nt, Human
aauaauacaauuggugucaugu

SEQ ID NO: 202113 - RNA, 22 nt, Human
aauacagauggcaugugaagau

SEQ ID NO: 202114 - RNA, 23 nt, Human
aaguugucauguaaaaugggcua

SEQ ID NO: 202115 - RNA, 22 nt, Human
aaguugaaugucuugcugaaug

SEQ ID NO: 202116 - RNA, 22 nt, Human
aauaacuuaaugacuguguaca

SEQ ID NO: 202117 - RNA, 22 nt, Human
aauaagacugucauggaguaaa

SEQ ID NO: 202118 - RNA, 22 nt, Human
aauaacaguuuauuugagggcu

SEQ ID NO: 202119 - RNA, 22 nt, Human
aauaagagaauaaaaucuguua

SEQ ID NO: 202120 - RNA, 22 nt, Human
aaguggugagacccugcugaaa

SEQ ID NO: 202121 - RNA, 23 nt, Human
aaguggugacugugcuacugaga

SEQ ID NO: 202122 - RNA, 17 nt, Human
aagugggcaaagugaga

SEQ ID NO: 202123 - RNA, 22 nt, Human
aaguggcccuaauugggccaaa

SEQ ID NO: 202124 - RNA, 22 nt, Human
aagucauuaucucuucuaaucu

SEQ ID NO: 202125 - RNA, 20 nt, Human
aaguagguuucaguugcugu

SEQ ID NO: 202126 - RNA, 22 nt, Human
aaguauuccccaaguauucugg

SEQ ID NO: 202127 - RNA, 22 nt, Human
aagugguuuauuguaugguuuu

SEQ ID NO: 202128 - RNA, 22 nt, Human
aaguguggguaagcauuucuug

SEQ ID NO: 202129 - RNA, 22 nt, Human
aagugugugagaaggggucgca

SEQ ID NO: 202130 - RNA, 22 nt, Human
aagugugugugcgcaugugcau

SEQ ID NO: 202131 - RNA, 22 nt, Human
aaguuaugauuggcguggacaa

SEQ ID NO: 202132 - RNA, 22 nt, Human
aaguguucucuguuuuaucuac

SEQ ID NO: 202133 - RNA, 22 nt, Human
aagugucucugggaggcccgga

SEQ ID NO: 202134 - RNA, 22 nt, Human
aaguuaauugcuucuaguuaau

SEQ ID NO: 202135 - RNA, 22 nt, Human
aaugaacuuucaguucagagag

SEQ ID NO: 202136 - RNA, 22 nt, Human
aaugaaugaaugaaugauuaug

SEQ ID NO: 202137 - RNA, 22 nt, Human
aaugaacuuugaagauggugaa

SEQ ID NO: 202138 - RNA, 22 nt, Human
aaugaaaaucugucaguucaag

SEQ ID NO: 202139 - RNA, 22 nt, Human
aaugacaguggcacagucacuu

SEQ ID NO: 202140 - RNA, 22 nt, Human
aaugacagccuauacugucugc

SEQ ID NO: 202141 - RNA, 22 nt, Human
aaugagaauguaagugaagaga

SEQ ID NO: 202142 - RNA, 22 nt, Human
aaugagauggaggacucuuaau

SEQ ID NO: 202143 - RNA, 22 nt, Human
aaugaguccuuuagugccauug

SEQ ID NO: 202144 - RNA, 22 nt, Human
aaugaguucaucugaauucugg

SEQ ID NO: 202145 - RNA, 22 nt, Human
aaucuuuuugaaggaggagaga

SEQ ID NO: 202146 - RNA, 22 nt, Human
aaugccuucauuggcgaagugc

SEQ ID NO: 202147 - RNA, 22 nt, Human
aaugauuuucugcaaacaguga

SEQ ID NO: 202148 - RNA, 22 nt, Human
aaugagauaagaaaaccuuugc

SEQ ID NO: 202149 - RNA, 22 nt, Human
aaugaguuuguucuauuauuug

SEQ ID NO: 202150 - RNA, 23 nt, Human
aaugaguugggcagcauacaggc

SEQ ID NO: 202151 - RNA, 22 nt, Human
aaucccaguccuccugggggau

SEQ ID NO: 202152 - RNA, 22 nt, Human
aaucugacaaaauauuuccagu

SEQ ID NO: 202153 - RNA, 22 nt, Human
aaucuacaaugaaaaaauguuu

SEQ ID NO: 202154 - RNA, 19 nt, Human
aaucacaagcaauaggggu

SEQ ID NO: 202155 - RNA, 22 nt, Human
aaucaagcugcuguuuguucua

SEQ ID NO: 202156 - RNA, 22 nt, Human
aaucaugguacaaguaagcacg

SEQ ID NO: 202157 - RNA, 22 nt, Human
aauauuuugggacugaggaauu

SEQ ID NO: 202158 - RNA, 22 nt, Human
aaucaaagccugcaaguugacu

SEQ ID NO: 202159 - RNA, 22 nt, Human
aaucaaauuucuugugguuguu

SEQ ID NO: 202160 - RNA, 22 nt, Human
aaucucuugggaagagugagug

SEQ ID NO: 202161 - RNA, 22 nt, Human
aaucugaccguggagaucucca

SEQ ID NO: 202162 - RNA, 22 nt, Human
aaucugugugugagaaauggca

SEQ ID NO: 202163 - RNA, 22 nt, Human
aaucuguugucaggaauccaca

SEQ ID NO: 202164 - RNA, 22 nt, Human
aaucuuguucaacauuaucugu

SEQ ID NO: 202165 - RNA, 22 nt, Human
aaugaauaaauuuuaaagacag

SEQ ID NO: 202166 - RNA, 22 nt, Human
aaugaaacuaguagaaucuuug

SEQ ID NO: 202167 - RNA, 22 nt, Human
aaugcgcagaguggugugugca

SEQ ID NO: 202168 - RNA, 22 nt, Human
aaugcauaaugguuugugacaa

SEQ ID NO: 202169 - RNA, 22 nt, Human
aaugcagaugugucuuuaauuu

SEQ ID NO: 202170 - RNA, 22 nt, Human
aauggcaaaaguuucggaaauu

SEQ ID NO: 202171 - RNA, 22 nt, Human
aauggcagauaauuuuccagau

SEQ ID NO: 202172 - RNA, 22 nt, Human
aauggauaacaccgguucuguc

SEQ ID NO: 202173 - RNA, 22 nt, Human
aauggcaauagugcauuaugua

SEQ ID NO: 202174 - RNA, 22 nt, Human
aauguaaauaauuguaaaauuu

SEQ ID NO: 202175 - RNA, 22 nt, Human
aauguacucgaaugauguuaag

SEQ ID NO: 202176 - RNA, 22 nt, Human
aaugguuacuacccugggucuu

SEQ ID NO: 202177 - RNA, 22 nt, Human
aaugguggaugucuguucugac

SEQ ID NO: 202178 - RNA, 22 nt, Human
aaugggauuaagaaagaucuug

SEQ ID NO: 202179 - RNA, 22 nt, Human
aauggugaggagugcauugaga

SEQ ID NO: 202180 - RNA, 22 nt, Human
aauguugacguuggccagggcc

SEQ ID NO: 202181 - RNA, 23 nt, Human
aauguugaggguggguuuuuaac

SEQ ID NO: 202182 - RNA, 22 nt, Human
aauguugaaccuuuuuggccug

SEQ ID NO: 202183 - RNA, 22 nt, Human
aauguuuaagcuuuuauuuaca

SEQ ID NO: 202184 - RNA, 22 nt, Human
aauguuuaguuuuauuuuagua

SEQ ID NO: 202185 - RNA, 22 nt, Human
aauguuguaaauauucuuugag

SEQ ID NO: 202186 - RNA, 22 nt, Human
aauuauucucucaacugagaug

SEQ ID NO: 202187 - RNA, 22 nt, Human
aauuagaagcuguuagcaaaau

SEQ ID NO: 202188 - RNA, 22 nt, Human
aauuauguugaaauaugagaac

SEQ ID NO: 202189 - RNA, 22 nt, Human
aauucaggacaaauguuuucaa

SEQ ID NO: 202190 - RNA, 22 nt, Human
aauucaacagucaguuaucuca

SEQ ID NO: 202191 - RNA, 22 nt, Human
aauucagguuauauuugcaacu

SEQ ID NO: 202192 - RNA, 21 nt, Human
aauuauuugcauuuuucuugu

SEQ ID NO: 202193 - RNA, 21 nt, Human
acugccaugcaggagccucca

SEQ ID NO: 202194 - RNA, 22 nt, Human
acugccuugcaccauggcuuuu

SEQ ID NO: 202195 - RNA, 22 nt, Human
acugccauauuaggagcuucag

SEQ ID NO: 202196 - RNA, 22 nt, Human
acugcauuaucaccaagaugua

SEQ ID NO: 202197 - RNA, 22 nt, Human
acugacuacauguccugucauu

SEQ ID NO: 202198 - RNA, 20 nt, Human
acugcaagagacagaugaaa

SEQ ID NO: 202199 - RNA, 22 nt, Human
acugauuuuauauauuaccccg

SEQ ID NO: 202200 - RNA, 20 nt, Human
acuaccaugcaauuccgcuu

SEQ ID NO: 202201 - RNA, 22 nt, Human
acuacucagcaaacauuugcug

SEQ ID NO: 202202 - RNA, 22 nt, Human
acuaauuuacagaaauuucuua

SEQ ID NO: 202203 - RNA, 22 nt, Human
acuggcgucugucuccccugcc

SEQ ID NO: 202204 - RNA, 15 nt, Human
acugggaaggaguau

SEQ ID NO: 202205 - RNA, 22 nt, Human
acuggggauugguucuucaaca

SEQ ID NO: 202206 - RNA, 22 nt, Human
acugggcaaggauaugaugggu

SEQ ID NO: 202207 - RNA, 22 nt, Human
acuggauucucuuacacagaug

SEQ ID NO: 202208 - RNA, 23 nt, Human
acuggauuguucuugggcgcuga

SEQ ID NO: 202209 - RNA, 22 nt, Human
acugcaggucccaucaccugcg

SEQ ID NO: 202210 - RNA, 22 nt, Human
acugcuguugugauggguauuu

SEQ ID NO: 202211 - RNA, 22 nt, Human
acuguggcugcuacccuggcuc

SEQ ID NO: 202212 - RNA, 22 nt, Human
acugugauguaaagaaauaggc

SEQ ID NO: 202213 - RNA, 22 nt, Human
acugugauuuguuuuuguguuu

SEQ ID NO: 202214 - RNA, 22 nt, Human
acugucuuguuguaugugagcu

SEQ ID NO: 202215 - RNA, 22 nt, Human
acuggggaggucuggauggauc

SEQ ID NO: 202216 - RNA, 22 nt, Human
acuggugcucuggccaccgcug

SEQ ID NO: 202217 - RNA, 19 nt, Human
acuggggcaggcugggcuu

SEQ ID NO: 202218 - RNA, 22 nt, Human
acuggguuguuugucucaugag

SEQ ID NO: 202219 - RNA, 22 nt, Human
acuggcuuggaaauggguauuu

SEQ ID NO: 202220 - RNA, 22 nt, Human
acugggacuguaugugcuggac

SEQ ID NO: 202221 - RNA, 19 nt, Human
acugggaugggcagugcca

SEQ ID NO: 202222 - RNA, 22 nt, Human
acuggggcaggaaaguaugcug

SEQ ID NO: 202223 - RNA, 22 nt, Human
acuggcauuccuaggggagggg

SEQ ID NO: 202224 - RNA, 22 nt, Human
acugguuucaaguuggacugaa

SEQ ID NO: 202225 - RNA, 22 nt, Human
acugucauuaaugaauguaaua

SEQ ID NO: 202226 - RNA, 21 nt, Human
acugggcuagccugacuucug

SEQ ID NO: 202227 - RNA, 22 nt, Human
acugguagcugauuaaguauag

SEQ ID NO: 202228 - RNA, 18 nt, Human
acuguggcucagaguugc

SEQ ID NO: 202229 - RNA, 22 nt, Human
acugugcccccucuacugcuga

SEQ ID NO: 202230 - RNA, 18 nt, Human
acuguccucaggacguug

SEQ ID NO: 202231 - RNA, 22 nt, Human
acuguugcuuguuuggaauguu

SEQ ID NO: 202232 - RNA, 22 nt, Human
acuguuauugguguauguggca

SEQ ID NO: 202233 - RNA, 22 nt, Human
acuguugugaauaaugaaaugc

SEQ ID NO: 202234 - RNA, 17 nt, Human
acuuaagacaguggaaa

SEQ ID NO: 202235 - RNA, 22 nt, Human
acuucucuuuucauuaauuuug

SEQ ID NO: 202236 - RNA, 22 nt, Human
acuuccuuuuuuggggauagca

SEQ ID NO: 202237 - RNA, 22 nt, Human
acuuauaaauuuaguacacugu

SEQ ID NO: 202238 - RNA, 22 nt, Human
acuuuuuugccaucccuccagc

SEQ ID NO: 202239 - RNA, 22 nt, Human
acuuuuccuggguagcuccugg

SEQ ID NO: 202240 - RNA, 22 nt, Human
acuuuuagccuucccacaacag

SEQ ID NO: 202241 - RNA, 22 nt, Human
acuuuuaauaguagauuuuuaa

SEQ ID NO: 202242 - RNA, 22 nt, Human
acuuugugaauagaacuggaug

SEQ ID NO: 202243 - RNA, 22 nt, Human
acuuugucuugaucaaaggugu

SEQ ID NO: 202244 - RNA, 22 nt, Human
acuugaagcaugaaaauaagcc

SEQ ID NO: 202245 - RNA, 22 nt, Human
acuuagacaucuuuagugguua

SEQ ID NO: 202246 - RNA, 22 nt, Human
acuugcaucuuagagacucacc

SEQ ID NO: 202247 - RNA, 19 nt, Human
agaaauagccuuccuuguc

SEQ ID NO: 202248 - RNA, 22 nt, Human
agaaagcacccugcacuuucug

SEQ ID NO: 202249 - RNA, 22 nt, Human
agaagaaugguuugaaagauuu

SEQ ID NO: 202250 - RNA, 22 nt, Human
agaagcaaagcaaacacauucu

SEQ ID NO: 202251 - RNA, 22 nt, Human
agaagauucagcaguagggugg

SEQ ID NO: 202252 - RNA, 22 nt, Human
agaaauggggugaagcaaaugg

SEQ ID NO: 202253 - RNA, 22 nt, Human
agaaauggccagacuugccccu

SEQ ID NO: 202254 - RNA, 22 nt, Human
agaagcagaaggaagcagggcc

SEQ ID NO: 202255 - RNA, 22 nt, Human
agaagcauaagggcuuugccag

SEQ ID NO: 202256 - RNA, 22 nt, Human
acuuuuaaggggccuugauuua

SEQ ID NO: 202257 - RNA, 22 nt, Human
agaaauuguaauaaaucugguc

SEQ ID NO: 202258 - RNA, 22 nt, Human
agaacaagaaacccgaaaagug

SEQ ID NO: 202259 - RNA, 20 nt, Human
agaaggagagaugaggcaaa

SEQ ID NO: 202260 - RNA, 22 nt, Human
agaacaggaggaagccagcucc

SEQ ID NO: 202261 - RNA, 22 nt, Human
agaacauaucuguuuucuaacu

SEQ ID NO: 202262 - RNA, 22 nt, Human
agaaucaggaagacagccuggc

SEQ ID NO: 202263 - RNA, 22 nt, Human
agacacugacaggguccaugga

SEQ ID NO: 202264 - RNA, 20 nt, Human
agacauugaggagagagcau

SEQ ID NO: 202265 - RNA, 21 nt, Human
agaaugaagaagaggucuuug

SEQ ID NO: 202266 - RNA, 22 nt, Human
agacagaacauaauuaguacug

SEQ ID NO: 202267 - RNA, 22 nt, Human
agacagcggugcaauaaauggu

SEQ ID NO: 202268 - RNA, 22 nt, Human
agacauuuggugugaagggagg

SEQ ID NO: 202269 - RNA, 22 nt, Human
agacauauuggcuugcuuuaau

SEQ ID NO: 202270 - RNA, 22 nt, Human
agacgcgcagaaggaagcggcc

SEQ ID NO: 202271 - RNA, 22 nt, Human
agacuacggggaggggagggaa

SEQ ID NO: 202272 - RNA, 22 nt, Human
agagaaauguacuagucuaacu

SEQ ID NO: 202273 - RNA, 22 nt, Human
agaccauuuuguagccagcaua

SEQ ID NO: 202274 - RNA, 19 nt, Human
agacccaguuuucuagugu

SEQ ID NO: 202275 - RNA, 22 nt, Human
agacccugauucugcuggcggu

SEQ ID NO: 202276 - RNA, 22 nt, Human
agacuguuuucccaucucuugg

SEQ ID NO: 202277 - RNA, 22 nt, Human
agacuucucuaacuugaggacc

SEQ ID NO: 202278 - RNA, 22 nt, Human
agacuugguaacuagugaagaa

SEQ ID NO: 202279 - RNA, 22 nt, Human
agagacuguaaugagagguaca

SEQ ID NO: 202280 - RNA, 22 nt, Human
agagacaagggaccucuggaga

SEQ ID NO: 202281 - RNA, 19 nt, Human
agacugaagggcccgaguc

SEQ ID NO: 202282 - RNA, 22 nt, Human
agacuggagucuccuuuggagc

SEQ ID NO: 202283 - RNA, 21 nt, Human
agacugaugggaagacucugu

SEQ ID NO: 202284 - RNA, 20 nt, Human
agagaacaguuuggucacag

SEQ ID NO: 202285 - RNA, 22 nt, Human
agagaguacuuucaucagggaa

SEQ ID NO: 202286 - RNA, 22 nt, Human
agacuuugaaugaugacagcgu

SEQ ID NO: 202287 - RNA, 22 nt, Human
agacuuuggcagggccaguggu

SEQ ID NO: 202288 - RNA, 22 nt, Human
agagcaauggugcuuuaauucu

SEQ ID NO: 202289 - RNA, 22 nt, Human
agagaacaggcagcuggugccg

SEQ ID NO: 202290 - RNA, 22 nt, Human
agagaacauuuucaggguuuca

SEQ ID NO: 202291 - RNA, 22 nt, Human
agagauggugaugaggaaaaau

SEQ ID NO: 202292 - RNA, 22 nt, Human
agagauugagcucagaagaccu

SEQ ID NO: 202293 - RNA, 22 nt, Human
agagacugauggaucaccaaau

SEQ ID NO: 202294 - RNA, 22 nt, Human
agagacaggguuuugucguguu

SEQ ID NO: 202295 - RNA, 22 nt, Human
agagaagaauccccugguggag

SEQ ID NO: 202296 - RNA, 22 nt, Human
agagaauuugggaauauaaauc

SEQ ID NO: 202297 - RNA, 22 nt, Human
agagaguagaagggacaguauu

SEQ ID NO: 202298 - RNA, 22 nt, Human
agagcagcuuuucggaaccacu

SEQ ID NO: 202299 - RNA, 22 nt, Human
agagcagcaaucuuugaaauua

SEQ ID NO: 202300 - RNA, 22 nt, Human
agaguguggaaauguucagagu

SEQ ID NO: 202301 - RNA, 22 nt, Human
agaguguagugaaaagagauua

SEQ ID NO: 202302 - RNA, 23 nt, Human
agauaaggaagcauuugagccag

SEQ ID NO: 202303 - RNA, 22 nt, Human
agagggagcuccaagaucaagg

SEQ ID NO: 202304 - RNA, 22 nt, Human
agagggcaggcugguugggguc

SEQ ID NO: 202305 - RNA, 22 nt, Human
agaggugcuuaugcucaugguu

SEQ ID NO: 202306 - RNA, 22 nt, Human
agagggagccugcacagcuuuc

SEQ ID NO: 202307 - RNA, 23 nt, Human
agaggccaacuucuugccccucc

SEQ ID NO: 202308 - RNA, 22 nt, Human
agagauuagagaagaugauaaa

SEQ ID NO: 202309 - RNA, 22 nt, Human
agaggaauuauugaguuagauu

SEQ ID NO: 202310 - RNA, 21 nt, Human
agaggacuuuuuugauguuuu

SEQ ID NO: 202311 - RNA, 22 nt, Human
agaggcagagcugggguuugac

SEQ ID NO: 202312 - RNA, 21 nt, Human
agaguaacucagugaaaaaua

SEQ ID NO: 202313 - RNA, 22 nt, Human
agaggagaauguaaauuuguca

SEQ ID NO: 202314 - RNA, 22 nt, Human
agagcucguggcucauugagga

SEQ ID NO: 202315 - RNA, 22 nt, Human
accccagcucugagccacacca

SEQ ID NO: 202316 - RNA, 22 nt, Human
acccaucauuagucuuucagga

SEQ ID NO: 202317 - RNA, 18 nt, Human
acccauuauauuuguagc

SEQ ID NO: 202318 - RNA, 22 nt, Human
acccggccuacucagugcccag

SEQ ID NO: 202319 - RNA, 22 nt, Human
accaccacauaguaggcacuua

SEQ ID NO: 202320 - RNA, 22 nt, Human
acccgguuuucccagcaccucc

SEQ ID NO: 202321 - RNA, 22 nt, Human
accaguuaaagaauaugaggcc

SEQ ID NO: 202322 - RNA, 22 nt, Human
accaguucuauguagauaauga

SEQ ID NO: 202323 - RNA, 22 nt, Human
accagcgcguuuucaguuucau

SEQ ID NO: 202324 - RNA, 17 nt, Human
accaggggcagcacugc

SEQ ID NO: 202325 - RNA, 22 nt, Human
accagccacccugccgcguccg

SEQ ID NO: 202326 - RNA, 22 nt, Human
accagguugagacuucggcuuu

SEQ ID NO: 202327 - RNA, 22 nt, Human
accauaugaaguugcccauauu

SEQ ID NO: 202328 - RNA, 22 nt, Human
accauaugaagaucacacuauc

SEQ ID NO: 202329 - RNA, 22 nt, Human
accaaucugguauauuccagaa

SEQ ID NO: 202330 - RNA, 22 nt, Human
acauuuuuggguugaugucuga

SEQ ID NO: 202331 - RNA, 22 nt, Human
accaauguucaaccuugacugc

SEQ ID NO: 202332 - RNA, 22 nt, Human
accaagaguccaagugagguug

SEQ ID NO: 202333 - RNA, 22 nt, Human
accaauaaaagcaauucacagu

SEQ ID NO: 202334 - RNA, 22 nt, Human
acauugcagcuccuaccuuguc

SEQ ID NO: 202335 - RNA, 22 nt, Human
acauguggaggaggcgagggua

SEQ ID NO: 202336 - RNA, 22 nt, Human
acauggguuaaagaagauggaa

SEQ ID NO: 202337 - RNA, 22 nt, Human
acauggggaaaaaggccugcuc

SEQ ID NO: 202338 - RNA, 22 nt, Human
acaugguguggcacuaggggcu

SEQ ID NO: 202339 - RNA, 22 nt, Human
accaacacgucugaguauuucc

SEQ ID NO: 202340 - RNA, 22 nt, Human
acauuuuguuuauggaaaagau

SEQ ID NO: 202341 - RNA, 22 nt, Human
acauuguuuuugugacuucuau

SEQ ID NO: 202342 - RNA, 22 nt, Human
accaauguuuuauagaaaugcc

SEQ ID NO: 202343 - RNA, 22 nt, Human
acauugguauuaguguggcuga

SEQ ID NO: 202344 - RNA, 22 nt, Human
accaggaguuuugaccaggggc

SEQ ID NO: 202345 - RNA, 22 nt, Human
accacguccugguggcuguugg

SEQ ID NO: 202346 - RNA, 22 nt, Human
accagccacacacauuagucac

SEQ ID NO: 202347 - RNA, 22 nt, Human
accaggcagcaccaaagccggu

SEQ ID NO: 202348 - RNA, 22 nt, Human
acauuuccaaagaugccaguca

SEQ ID NO: 202349 - RNA, 22 nt, Human
acauuuugggagaaaguuguua

SEQ ID NO: 202350 - RNA, 22 nt, Human
acauuuuaccaucuguggauga

SEQ ID NO: 202351 - RNA, 22 nt, Human
acauuuuaaaaacaguaccugg

SEQ ID NO: 202352 - RNA, 22 nt, Human
acaucuucuauggagguucgga

SEQ ID NO: 202353 - RNA, 22 nt, Human
acaugacagugacuuuauaaga

SEQ ID NO: 202354 - RNA, 22 nt, Human
acauuauuguguagugugggca

SEQ ID NO: 202355 - RNA, 22 nt, Human
acauuccugaagguaaugagaa

SEQ ID NO: 202356 - RNA, 21 nt, Human
acauccaggguccucacugcc

SEQ ID NO: 202357 - RNA, 23 nt, Human
acauuacacgcaguaauugcccc

SEQ ID NO: 202358 - RNA, 22 nt, Human
acaugggggugggacggcagag

SEQ ID NO: 202359 - RNA, 20 nt, Human
acauggagaagcgagguagg

SEQ ID NO: 202360 - RNA, 22 nt, Human
acauuuguuucucuagaguagg

SEQ ID NO: 202361 - RNA, 22 nt, Human
acauggaccucagauccuggcc

SEQ ID NO: 202362 - RNA, 22 nt, Human
acauggaauuucagaagagcau

SEQ ID NO: 202363 - RNA, 22 nt, Human
aauucuuuguuccucugccaag

SEQ ID NO: 202364 - RNA, 22 nt, Human
aauucuguugguuagaguugga

SEQ ID NO: 202365 - RNA, 22 nt, Human
acaugaggaacucaggagucac

SEQ ID NO: 202366 - RNA, 22 nt, Human
aauucgcugcauuccaucuagg

SEQ ID NO: 202367 - RNA, 22 nt, Human
aauucugaggccauuuauuucc

SEQ ID NO: 202368 - RNA, 22 nt, Human
acauggaaacacgcagccccaa

SEQ ID NO: 202369 - RNA, 22 nt, Human
acauaaauagcacugugaauuu

SEQ ID NO: 202370 - RNA, 22 nt, Human
acauggacugguccauuaugac

SEQ ID NO: 202371 - RNA, 22 nt, Human
acaugggcaaucgcuuuauuca

SEQ ID NO: 202372 - RNA, 16 nt, Human
acauggcacacaguuu

SEQ ID NO: 202373 - RNA, 22 nt, Human
acauggcaugaauaauguguac

SEQ ID NO: 202374 - RNA, 22 nt, Human
accuuuuauuuucaugcuugcu

SEQ ID NO: 202375 - RNA, 20 nt, Human
acgaacauauugcaggguuu

SEQ ID NO: 202376 - RNA, 22 nt, Human
acgaagggggcauggugagagu

SEQ ID NO: 202377 - RNA, 22 nt, Human
acgauaacaauaguagcaugua

SEQ ID NO: 202378 - RNA, 19 nt, Human
accuguucaaccucgugcu

SEQ ID NO: 202379 - RNA, 22 nt, Human
accuguagcccaaucauggcag

SEQ ID NO: 202380 - RNA, 22 nt, Human
accuucguuuaguacucauuuu

SEQ ID NO: 202381 - RNA, 22 nt, Human
accuuagcuguuaaaacuaagu

SEQ ID NO: 202382 - RNA, 22 nt, Human
accuucugaccucucggacuuc

SEQ ID NO: 202383 - RNA, 22 nt, Human
accuugauggagugaugaauga

SEQ ID NO: 202384 - RNA, 20 nt, Human
accuucuuugguagacggaa

SEQ ID NO: 202385 - RNA, 22 nt, Human
accuuaagugauuaugacauau

SEQ ID NO: 202386 - RNA, 23 nt, Human
accuggucccaugggugggccug

SEQ ID NO: 202387 - RNA, 22 nt, Human
accuggauauuuucaguugcau

SEQ ID NO: 202388 - RNA, 22 nt, Human
accugguaaccugccugacuaa

SEQ ID NO: 202389 - RNA, 22 nt, Human
acggccgaugacuccagcaugg

SEQ ID NO: 202390 - RNA, 22 nt, Human
acggcuugaacgcgccuguggg

SEQ ID NO: 202391 - RNA, 23 nt, Human
acgggaggcggggcagggcugag

SEQ ID NO: 202392 - RNA, 22 nt, Human
acgcugagcucauggagaugca

SEQ ID NO: 202393 - RNA, 22 nt, Human
acggagggagagagggaggaga

SEQ ID NO: 202394 - RNA, 22 nt, Human
acgcuucacaggugcgcauugu

SEQ ID NO: 202395 - RNA, 22 nt, Human
acgcgcuccagcaggugcuuca

SEQ ID NO: 202396 - RNA, 22 nt, Human
acgauuugguucagugaagaca

SEQ ID NO: 202397 - RNA, 22 nt, Human
acgcaacacugcuauuuuuuuc

SEQ ID NO: 202398 - RNA, 22 nt, Human
accuuuggaggacuagggucau

SEQ ID NO: 202399 - RNA, 22 nt, Human
acgaaugacaugugauuugaaa

SEQ ID NO: 202400 - RNA, 22 nt, Human
acuaaagcagcucagacgagaa

SEQ ID NO: 202401 - RNA, 22 nt, Human
acguuuuagccauguaguuucu

SEQ ID NO: 202402 - RNA, 22 nt, Human
acuaaacauaucacugcuuuac

SEQ ID NO: 202403 - RNA, 22 nt, Human
acgguguuucucguucaggguu

SEQ ID NO: 202404 - RNA, 22 nt, Human
acgguuuggggaggaggauccc

SEQ ID NO: 202405 - RNA, 22 nt, Human
acgguuuugugagguaguacuu

SEQ ID NO: 202406 - RNA, 22 nt, Human
acgggugugauuccuuuugugu

SEQ ID NO: 202407 - RNA, 22 nt, Human
acggguuccuugagggcaggau

SEQ ID NO: 202408 - RNA, 22 nt, Human
acggugagacuggcgaaggaaa

SEQ ID NO: 202409 - RNA, 22 nt, Human
acgggugcuuguucccgcugcu

SEQ ID NO: 202410 - RNA, 22 nt, Human
accgagcaggguguuugcgcac

SEQ ID NO: 202411 - RNA, 22 nt, Human
acccuuucgagauuucugccuu

SEQ ID NO: 202412 - RNA, 23 nt, Human
accuccuuguugaguggggguga

SEQ ID NO: 202413 - RNA, 22 nt, Human
accucccgacggcgcgggagaa

SEQ ID NO: 202414 - RNA, 22 nt, Human
accgauuucaaauggugcuaga

SEQ ID NO: 202415 - RNA, 22 nt, Human
accgcuggcacuggggacgggg

SEQ ID NO: 202416 - RNA, 22 nt, Human
accgggcagcucugccccugcc

SEQ ID NO: 202417 - RNA, 21 nt, Human
accgucaguacuaguauugac

SEQ ID NO: 202418 - RNA, 22 nt, Human
accugauuuuauggauuuugag

SEQ ID NO: 202419 - RNA, 22 nt, Human
accugcagguguuuccacacuu

SEQ ID NO: 202420 - RNA, 23 nt, Human
accgccgcugccgccgcccccgc

SEQ ID NO: 202421 - RNA, 22 nt, Human
accugagauuuuuacucaguaa

SEQ ID NO: 202422 - RNA, 22 nt, Human
accugcucucccucucgcaguc

SEQ ID NO: 202423 - RNA, 22 nt, Human
accugaucugagaaguggaggg

SEQ ID NO: 202424 - RNA, 22 nt, Human
accuggaccugccaccuaugag

SEQ ID NO: 202425 - RNA, 22 nt, Human
accuggacucugaucacuuuug

SEQ ID NO: 202426 - RNA, 21 nt, Human
accugguuuacugaucccagg

SEQ ID NO: 202427 - RNA, 21 nt, Human
accuggugaugaaugggaggc

SEQ ID NO: 202428 - RNA, 22 nt, Human
accucccugaaaaagacagugc

SEQ ID NO: 202429 - RNA, 22 nt, Human
accucuuuuugaauauagcauu

SEQ ID NO: 202430 - RNA, 22 nt, Human
accucauucugcauagaacuuu

SEQ ID NO: 202431 - RNA, 22 nt, Human
accuauuuauacaacugcacca

SEQ ID NO: 202432 - RNA, 20 nt, Human
acccagaguccuccccgcgc

SEQ ID NO: 202433 - RNA, 19 nt, Human
acccaugcucuguggacuu

SEQ ID NO: 202434 - RNA, 21 nt, Human
acccagaauggagccaagccu

SEQ ID NO: 202435 - RNA, 22 nt, Human
accgauguggaaaauuucauuu

SEQ ID NO: 202436 - RNA, 22 nt, Human
accaguuuuuugaccaugggug

SEQ ID NO: 202437 - RNA, 19 nt, Human
accauggguguguuaagaa

SEQ ID NO: 202438 - RNA, 22 nt, Human
accaugacugucacauuauuau

SEQ ID NO: 202439 - RNA, 22 nt, Human
accauuauagaggacauuaugu

SEQ ID NO: 202440 - RNA, 22 nt, Human
accccuuaaauuuguuguuuaa

SEQ ID NO: 202441 - RNA, 22 nt, Human
accuauuguccagagccaggcc

SEQ ID NO: 202442 - RNA, 22 nt, Human
acccugcacagagggcuuuaua

SEQ ID NO: 202443 - RNA, 22 nt, Human
acccugacggugggcagcuuga

SEQ ID NO: 202444 - RNA, 22 nt, Human
acccuauuaacuacuacguugg

SEQ ID NO: 202445 - RNA, 22 nt, Human
accgguucccaucuggagaguu

SEQ ID NO: 202446 - RNA, 22 nt, Human
accgucagguuagaaugagcac

SEQ ID NO: 202447 - RNA, 22 nt, Human
accccuauugcuugugauuaug

SEQ ID NO: 202448 - RNA, 22 nt, Human
accggucucaccaaacgcccca

SEQ ID NO: 202449 - RNA, 22 nt, Human
acccccacuccgcaguagaacu

SEQ ID NO: 202450 - RNA, 22 nt, Human
agcaguucucugucuagcuaga

SEQ ID NO: 202451 - RNA, 22 nt, Human
agcaguugcuuuguauauuaaa

SEQ ID NO: 202452 - RNA, 18 nt, Human
agcaguugucucucucca

SEQ ID NO: 202453 - RNA, 22 nt, Human
agcaguuagauccugguuagcg

SEQ ID NO: 202454 - RNA, 22 nt, Human
agcagggagaccaucucuuccu

SEQ ID NO: 202455 - RNA, 22 nt, Human
agcaggguggcaagucuuucug

SEQ ID NO: 202456 - RNA, 22 nt, Human
agcagggugugggugugagugu

SEQ ID NO: 202457 - RNA, 22 nt, Human
agcaggccuuucaccucugucc

SEQ ID NO: 202458 - RNA, 22 nt, Human
agcagauuguacagugcauuag

SEQ ID NO: 202459 - RNA, 22 nt, Human
agcagggagacagugcagcauu

SEQ ID NO: 202460 - RNA, 22 nt, Human
agcaggauggaguaacgugaaa

SEQ ID NO: 202461 - RNA, 22 nt, Human
agcaggagagacuggcccaaaa

SEQ ID NO: 202462 - RNA, 16 nt, Human
agcagcgugggggugg

SEQ ID NO: 202463 - RNA, 22 nt, Human
agcagcaggcugggaugagucu

SEQ ID NO: 202464 - RNA, 22 nt, Human
agauacaaaagauaagauuuag

SEQ ID NO: 202465 - RNA, 22 nt, Human
agcaucuaucuucaaugugugu

SEQ ID NO: 202466 - RNA, 22 nt, Human
agcaggaggguuuuguagaguc

SEQ ID NO: 202467 - RNA, 22 nt, Human
agcaggaggagagccuggcggu

SEQ ID NO: 202468 - RNA, 22 nt, Human
agcauuugcuguucuagaaagu

SEQ ID NO: 202469 - RNA, 22 nt, Human
agcauucccuuugcagugucau

SEQ ID NO: 202470 - RNA, 22 nt, Human
agcagguucaagggcaaagcug

SEQ ID NO: 202471 - RNA, 22 nt, Human
agcaggucagugguaaucaaaa

SEQ ID NO: 202472 - RNA, 22 nt, Human
agcaucggacggagcaccugcu

SEQ ID NO: 202473 - RNA, 19 nt, Human
agcaucuccacagaaaaag

SEQ ID NO: 202474 - RNA, 21 nt, Human
agcaucugaggcaguuuccua

SEQ ID NO: 202475 - RNA, 22 nt, Human
agcaugaauugccauuuauuaa

SEQ ID NO: 202476 - RNA, 18 nt, Human
agcagugcggaucauuuu

SEQ ID NO: 202477 - RNA, 19 nt, Human
agcaguggagccaugccug

SEQ ID NO: 202478 - RNA, 22 nt, Human
agccacacuuagucacaaagau

SEQ ID NO: 202479 - RNA, 22 nt, Human
agccacagucuguagccagcuu

SEQ ID NO: 202480 - RNA, 19 nt, Human
agcagugaaaucuggugag

SEQ ID NO: 202481 - RNA, 21 nt, Human
agcagucugcggccggugcgg

SEQ ID NO: 202482 - RNA, 22 nt, Human
agccuggacagcuacggagaac

SEQ ID NO: 202483 - RNA, 22 nt, Human
agccccuaaaguagcuguucuu

SEQ ID NO: 202484 - RNA, 22 nt, Human
agcauuuuaaaacuaguuacca

SEQ ID NO: 202485 - RNA, 22 nt, Human
agccugggucgagagacgagaa

SEQ ID NO: 202486 - RNA, 22 nt, Human
agcauucuguggucuucuaugg

SEQ ID NO: 202487 - RNA, 22 nt, Human
agcauuucuacugugucagaaa

SEQ ID NO: 202488 - RNA, 22 nt, Human
agcauugguggcauuugcagcu

SEQ ID NO: 202489 - RNA, 20 nt, Human
agcauucaacuuucuauguu

SEQ ID NO: 202490 - RNA, 23 nt, Human
agcccagcagagaaccuaggucc

SEQ ID NO: 202491 - RNA, 22 nt, Human
agccgcgcagccucauuaagga

SEQ ID NO: 202492 - RNA, 22 nt, Human
agccgauaaauuguuuucuugg

SEQ ID NO: 202493 - RNA, 18 nt, Human
agcccucuguuacuggaa

SEQ ID NO: 202494 - RNA, 22 nt, Human
agcccuuucuuguuuaacugca

SEQ ID NO: 202495 - RNA, 22 nt, Human
agccugugcuguguuugcucca

SEQ ID NO: 202496 - RNA, 22 nt, Human
agccuguacuuagagggauuaa

SEQ ID NO: 202497 - RNA, 22 nt, Human
agccuuucugcgcacucuuccg

SEQ ID NO: 202498 - RNA, 22 nt, Human
agcgaaaagaauggaguggagu

SEQ ID NO: 202499 - RNA, 22 nt, Human
agcgacuugacagacauguccu

SEQ ID NO: 202500 - RNA, 22 nt, Human
agcgcaguuaccgcgcggggcu

SEQ ID NO: 202501 - RNA, 22 nt, Human
agcgcccguugagucgcgcggu

SEQ ID NO: 202502 - RNA, 22 nt, Human
agcggcucaggccccgugggcu

SEQ ID NO: 202503 - RNA, 22 nt, Human
agcguaugaauauuugaagaga

SEQ ID NO: 202504 - RNA, 22 nt, Human
agcggugacauccuucugugcu

SEQ ID NO: 202505 - RNA, 22 nt, Human
agcggcaagguguauguggcag

SEQ ID NO: 202506 - RNA, 22 nt, Human
agcggcgcgucuccgagcugga

SEQ ID NO: 202507 - RNA, 22 nt, Human
agcgcggccuuacacccagggg

SEQ ID NO: 202508 - RNA, 22 nt, Human
agcgccgcugugauuggugagg

SEQ ID NO: 202509 - RNA, 22 nt, Human
agcgggucaugucggccgccca

SEQ ID NO: 202510 - RNA, 22 nt, Human
agcguacuugaggcuuggggcc

SEQ ID NO: 202511 - RNA, 22 nt, Human
agcggccucgcugccugcucag

SEQ ID NO: 202512 - RNA, 22 nt, Human
agcguucuguuccaugcuaaca

SEQ ID NO: 202513 - RNA, 22 nt, Human
agcuaaauauuuuuccugacac

SEQ ID NO: 202514 - RNA, 22 nt, Human
agcuaaaaugagguuuuuggau

SEQ ID NO: 202515 - RNA, 22 nt, Human
agcgucaugugaccagcgcgcc

SEQ ID NO: 202516 - RNA, 22 nt, Human
agccuguuacuguccugugcca

SEQ ID NO: 202517 - RNA, 22 nt, Human
agcugagccagacagguaagca

SEQ ID NO: 202518 - RNA, 22 nt, Human
agcucagugugucuaugaggua

SEQ ID NO: 202519 - RNA, 19 nt, Human
agcucaggcccaucguccc

SEQ ID NO: 202520 - RNA, 22 nt, Human
agcuagugcaguucucaaaugg

SEQ ID NO: 202521 - RNA, 22 nt, Human
agcucucaccauagugcuuaaa

SEQ ID NO: 202522 - RNA, 22 nt, Human
agcucugauccuuuaaaggaga

SEQ ID NO: 202523 - RNA, 22 nt, Human
agcuaauguauguugaaagcac

SEQ ID NO: 202524 - RNA, 22 nt, Human
agcucggcuguccugugccccu

SEQ ID NO: 202525 - RNA, 22 nt, Human
agcucuccuacucucuuucuag

SEQ ID NO: 202526 - RNA, 22 nt, Human
agcugcuggcggauguuggacu

SEQ ID NO: 202527 - RNA, 22 nt, Human
agcugcauguauauucuuaaca

SEQ ID NO: 202528 - RNA, 22 nt, Human
agcugaccugauugcuuuucag

SEQ ID NO: 202529 - RNA, 20 nt, Human
agcugaauaguuuugugaaa

SEQ ID NO: 202530 - RNA, 22 nt, Human
agcucuuuggacuuuguuuuau

SEQ ID NO: 202531 - RNA, 22 nt, Human
agcucugugcaggcagaggcau

SEQ ID NO: 202532 - RNA, 22 nt, Human
agcuucuucugccuugucccug

SEQ ID NO: 202533 - RNA, 22 nt, Human
agcuugauggauugcugaggca

SEQ ID NO: 202534 - RNA, 22 nt, Human
agcuugcccuuguaccagccag

SEQ ID NO: 202535 - RNA, 22 nt, Human
agcuugaaccuaaaacaauaau

SEQ ID NO: 202536 - RNA, 22 nt, Human
agcugugccuauucguggcaag

SEQ ID NO: 202537 - RNA, 22 nt, Human
agcugugaccaguuacgaaauu

SEQ ID NO: 202538 - RNA, 22 nt, Human
agcugugaccuucaagagcuac

SEQ ID NO: 202539 - RNA, 22 nt, Human
agcuguaacagguuaauaugga

SEQ ID NO: 202540 - RNA, 22 nt, Human
agcugcuuuacuggucggcugg

SEQ ID NO: 202541 - RNA, 20 nt, Human
agcuggcccccgguggccug

SEQ ID NO: 202542 - RNA, 22 nt, Human
agcuggauuaaucacagugacu

SEQ ID NO: 202543 - RNA, 22 nt, Human
agcugcugcaaguggugcuaac

SEQ ID NO: 202544 - RNA, 19 nt, Human
agcugcugauugguggagg

SEQ ID NO: 202545 - RNA, 22 nt, Human
agcugaugucucaccuguuaga

SEQ ID NO: 202546 - RNA, 22 nt, Human
agcugauugucuuuuuaaaagu

SEQ ID NO: 202547 - RNA, 22 nt, Human
agcugcauucguaucauauugu

SEQ ID NO: 202548 - RNA, 22 nt, Human
agcuuugcccaaugaguuaugu

SEQ ID NO: 202549 - RNA, 22 nt, Human
agcuuugcugcuggagaagggu

SEQ ID NO: 202550 - RNA, 22 nt, Human
agcuuucaagaaauugucacaa

SEQ ID NO: 202551 - RNA, 22 nt, Human
aggaaaaagaagaaaagaauca

SEQ ID NO: 202552 - RNA, 22 nt, Human
aggaaaaugaaggaagugggaa

SEQ ID NO: 202553 - RNA, 22 nt, Human
aggacuggucucuuuucuccaa

SEQ ID NO: 202554 - RNA, 22 nt, Human
aggacauuugcuuuuuuucuuu

SEQ ID NO: 202555 - RNA, 22 nt, Human
aggauaaaggucauuauuccca

SEQ ID NO: 202556 - RNA, 22 nt, Human
aggagaccugguugugugugug

SEQ ID NO: 202557 - RNA, 22 nt, Human
aggauaaaugggucauuaggca

SEQ ID NO: 202558 - RNA, 22 nt, Human
aggacacuuccugaguggacaa

SEQ ID NO: 202559 - RNA, 22 nt, Human
aggaagucucucaaaacuggaa

SEQ ID NO: 202560 - RNA, 22 nt, Human
aggagaaagaccagccugccga

SEQ ID NO: 202561 - RNA, 22 nt, Human
aggagacaguuuggacguguag

SEQ ID NO: 202562 - RNA, 22 nt, Human
aggaagccuggaguccugccca

SEQ ID NO: 202563 - RNA, 22 nt, Human
aggaagagcuggaccagaggac

SEQ ID NO: 202564 - RNA, 22 nt, Human
aggaagaagggacagaauuuug

SEQ ID NO: 202565 - RNA, 22 nt, Human
aggaaaauggaccagaguuguu

SEQ ID NO: 202566 - RNA, 22 nt, Human
aggaaagacgcauuucuguagg

SEQ ID NO: 202567 - RNA, 20 nt, Human
aggaaggagaaucugagcaa

SEQ ID NO: 202568 - RNA, 23 nt, Human
aggaagucugacacuacagcguu

SEQ ID NO: 202569 - RNA, 19 nt, Human
aggaaggggauaaguaaca

SEQ ID NO: 202570 - RNA, 22 nt, Human
agcuuugucccaagugcucugg

SEQ ID NO: 202571 - RNA, 22 nt, Human
agcuuggcaagcacuguuugag

SEQ ID NO: 202572 - RNA, 20 nt, Human
agcuuucaccaguacuucca

SEQ ID NO: 202573 - RNA, 22 nt, Human
agcuugaugaaagugggugcuc

SEQ ID NO: 202574 - RNA, 22 nt, Human
aggaaaguugagcugucuguag

SEQ ID NO: 202575 - RNA, 22 nt, Human
aggaaaguugcuuguagugcug

SEQ ID NO: 202576 - RNA, 22 nt, Human
aggaaauaagggcacuucagau

SEQ ID NO: 202577 - RNA, 22 nt, Human
agcuggaaucucggcaaagcgu

SEQ ID NO: 202578 - RNA, 22 nt, Human
aggaaauaguuuagucccaaaa

SEQ ID NO: 202579 - RNA, 22 nt, Human
agcuguugaccuucccuuucag

SEQ ID NO: 202580 - RNA, 19 nt, Human
agcuuauuuacugcaggac

SEQ ID NO: 202581 - RNA, 22 nt, Human
agcuucccaggagaucuccgcc

SEQ ID NO: 202582 - RNA, 22 nt, Human
agguauuuuaugucgugugaug

SEQ ID NO: 202583 - RNA, 22 nt, Human
aggucggcuuuuuuccuuucac

SEQ ID NO: 202584 - RNA, 22 nt, Human
aggguuugaauccucuuucuua

SEQ ID NO: 202585 - RNA, 22 nt, Human
aggguuccugaaaaguauguca

SEQ ID NO: 202586 - RNA, 22 nt, Human
aggguugaagucugguccucau

SEQ ID NO: 202587 - RNA, 22 nt, Human
aggguuuucauauauuauuagu

SEQ ID NO: 202588 - RNA, 22 nt, Human
agggggcuccugcaggccccca

SEQ ID NO: 202589 - RNA, 22 nt, Human
aggggaggcugcgggcugccgu

SEQ ID NO: 202590 - RNA, 22 nt, Human
aggggaggcugggcuggggggc

SEQ ID NO: 202591 - RNA, 22 nt, Human
aggggcaagucuggccauuucu

SEQ ID NO: 202592 - RNA, 22 nt, Human
aggguggcacucugggggcucc

SEQ ID NO: 202593 - RNA, 22 nt, Human
aggguggaggacaggccaguga

SEQ ID NO: 202594 - RNA, 21 nt, Human
agguagauagccccaggaagg

SEQ ID NO: 202595 - RNA, 22 nt, Human
agggggaaaauguggauuaugg

SEQ ID NO: 202596 - RNA, 22 nt, Human
aggggcugugucauuuguccua

SEQ ID NO: 202597 - RNA, 22 nt, Human
aggggauggagcuggaaggcag

SEQ ID NO: 202598 - RNA, 22 nt, Human
aggggaagagugagguuuuggu

SEQ ID NO: 202599 - RNA, 22 nt, Human
agggcuguuggugcccucgagg

SEQ ID NO: 202600 - RNA, 22 nt, Human
agggcguacuuucgccccuccu

SEQ ID NO: 202601 - RNA, 22 nt, Human
agggcuuaggcacacugugacu

SEQ ID NO: 202602 - RNA, 22 nt, Human
agggaaguucuagggagucugg

SEQ ID NO: 202603 - RNA, 22 nt, Human
agggacuugugucuguguuuuu

SEQ ID NO: 202604 - RNA, 22 nt, Human
agggaagaggaccagagucucu

SEQ ID NO: 202605 - RNA, 22 nt, Human
agggaaauuaaugugagcaaug

SEQ ID NO: 202606 - RNA, 22 nt, Human
agggcggucccugagacucucc

SEQ ID NO: 202607 - RNA, 22 nt, Human
agggcgugguggugcuggagca

SEQ ID NO: 202608 - RNA, 22 nt, Human
aggcugggaaguguguccugag

SEQ ID NO: 202609 - RNA, 22 nt, Human
aggcugccuaugaaggcagaag

SEQ ID NO: 202610 - RNA, 22 nt, Human
aggcugaagcacacucaugcag

SEQ ID NO: 202611 - RNA, 22 nt, Human
aggcggguuuaggacaaugcuu

SEQ ID NO: 202612 - RNA, 22 nt, Human
aggccgcuggggcagcgcccga

SEQ ID NO: 202613 - RNA, 22 nt, Human
aggccgguggaggagguggagg

SEQ ID NO: 202614 - RNA, 22 nt, Human
aggccugcccuuggggagccuu

SEQ ID NO: 202615 - RNA, 22 nt, Human
aggcgagcgcggccggugcccc

SEQ ID NO: 202616 - RNA, 22 nt, Human
aggcgguuggcuuugucugggu

SEQ ID NO: 202617 - RNA, 22 nt, Human
agggaagagaaacaaagauuca

SEQ ID NO: 202618 - RNA, 22 nt, Human
aggcuguagaucuagacaugua

SEQ ID NO: 202619 - RNA, 22 nt, Human
aggcugucucaccucaggaggg

SEQ ID NO: 202620 - RNA, 22 nt, Human
aggcuucaaggacagcagccac

SEQ ID NO: 202621 - RNA, 22 nt, Human
aggcuucauuacagugguucaa

SEQ ID NO: 202622 - RNA, 22 nt, Human
agggagcagcuagagggggucc

SEQ ID NO: 202623 - RNA, 22 nt, Human
aggcgaagggaccagacgguag

SEQ ID NO: 202624 - RNA, 22 nt, Human
aggccugcuccucuucucaucc

SEQ ID NO: 202625 - RNA, 22 nt, Human
aggccugaggaccagauaaaug

SEQ ID NO: 202626 - RNA, 23 nt, Human
aggcugccacucagggugaggcu

SEQ ID NO: 202627 - RNA, 22 nt, Human
aggccgcgguggcgaaggcguu

SEQ ID NO: 202628 - RNA, 23 nt, Human
aggcugcagaagaauagggucau

SEQ ID NO: 202629 - RNA, 22 nt, Human
aggcucagcaucugauucauau

SEQ ID NO: 202630 - RNA, 22 nt, Human
aggcguggcuucugcuggguug

SEQ ID NO: 202631 - RNA, 22 nt, Human
aggaugagugaagagguaaauu

SEQ ID NO: 202632 - RNA, 22 nt, Human
aggauggaaguaacuggauaau

SEQ ID NO: 202633 - RNA, 19 nt, Human
aggagacuacuucuugcug

SEQ ID NO: 202634 - RNA, 22 nt, Human
aggagagaacaagaguauccug

SEQ ID NO: 202635 - RNA, 22 nt, Human
aggagcugccggauggggcaug

SEQ ID NO: 202636 - RNA, 22 nt, Human
aggagggcggggcuaaaaggga

SEQ ID NO: 202637 - RNA, 22 nt, Human
aggcccagcaccagcggucuuc

SEQ ID NO: 202638 - RNA, 22 nt, Human
aggccgagaugacagagccacu

SEQ ID NO: 202639 - RNA, 22 nt, Human
agguuagcuguaugucuguaaa

SEQ ID NO: 202640 - RNA, 22 nt, Human
agguuaugcacugcacaacccu

SEQ ID NO: 202641 - RNA, 22 nt, Human
aggugucauuauagaccagaua

SEQ ID NO: 202642 - RNA, 22 nt, Human
aggugugcacccggucgcuucc

SEQ ID NO: 202643 - RNA, 22 nt, Human
agguuaaacuuccugcagggcu

SEQ ID NO: 202644 - RNA, 22 nt, Human
agguuaauaugaacagcagaag

SEQ ID NO: 202645 - RNA, 22 nt, Human
agguuaaaagagugaguggaua

SEQ ID NO: 202646 - RNA, 19 nt, Human
aguaaagugguggcauuuu

SEQ ID NO: 202647 - RNA, 22 nt, Human
aguaacagguguacagacuauc

SEQ ID NO: 202648 - RNA, 22 nt, Human
agguuuuugucauuuucuggua

SEQ ID NO: 202649 - RNA, 22 nt, Human
agguuuuacuuuuuuuggaggu

SEQ ID NO: 202650 - RNA, 22 nt, Human
aggugcuuaaagaauguguggu

SEQ ID NO: 202651 - RNA, 22 nt, Human
aggugggaauaauaaucaaagc

SEQ ID NO: 202652 - RNA, 22 nt, Human
agguggucuuguggaugccgca

SEQ ID NO: 202653 - RNA, 22 nt, Human
aggucuugguaggccagagucu

SEQ ID NO: 202654 - RNA, 22 nt, Human
aguauagacaucaaacugaaga

SEQ ID NO: 202655 - RNA, 22 nt, Human
aguauaucugcuucuggguccc

SEQ ID NO: 202656 - RNA, 22 nt, Human
aguacuuuuuguucaauugugc

SEQ ID NO: 202657 - RNA, 22 nt, Human
aguaauuucuuacggagaccuu

SEQ ID NO: 202658 - RNA, 22 nt, Human
aguaauggucucaauaaauucu

SEQ ID NO: 202659 - RNA, 22 nt, Human
aguaauaaacaacucauuuugg

SEQ ID NO: 202660 - RNA, 22 nt, Human
aguaacuuaagcaauuguguau

SEQ ID NO: 202661 - RNA, 22 nt, Human
aguaagaaagaaugauaggccu

SEQ ID NO: 202662 - RNA, 22 nt, Human
aguaucgcuuuguaucaugagg

SEQ ID NO: 202663 - RNA, 22 nt, Human
aguauaagugaugcuaucuucu

SEQ ID NO: 202664 - RNA, 23 nt, Human
aguaucuugguguggugcagaga

SEQ ID NO: 202665 - RNA, 19 nt, Human
aguauauaucuuuaccuca

SEQ ID NO: 202666 - RNA, 22 nt, Human
aguauuggauauaaucuaggaa

SEQ ID NO: 202667 - RNA, 22 nt, Human
aguauggaauuuuuaaugacag

SEQ ID NO: 202668 - RNA, 22 nt, Human
aguaucugccagaaucucaguu

SEQ ID NO: 202669 - RNA, 22 nt, Human
aguauccauccugcuguuucua

SEQ ID NO: 202670 - RNA, 22 nt, Human
aguaugcuggcaccuuugagug

SEQ ID NO: 202671 - RNA, 22 nt, Human
aguauucaguuagugagcuaag

SEQ ID NO: 202672 - RNA, 19 nt, Human
aguauuggcagguccugua

SEQ ID NO: 202673 - RNA, 22 nt, Human
aguauuuuaaaauacauuaucc

SEQ ID NO: 202674 - RNA, 23 nt, Human
aguauuguucaucuucaagacag

SEQ ID NO: 202675 - RNA, 22 nt, Human
aguauuuucuuuaguuuguuag

SEQ ID NO: 202676 - RNA, 22 nt, Human
aguauugguaaguguagcaaau

SEQ ID NO: 202677 - RNA, 22 nt, Human
aguauuuaguauucuauauuag

SEQ ID NO: 202678 - RNA, 21 nt, Human
agucaagcugccugcuuggca

SEQ ID NO: 202679 - RNA, 22 nt, Human
agucaccuacagcucaugcuuc

SEQ ID NO: 202680 - RNA, 22 nt, Human
agucaguaugacuuauaguucu

SEQ ID NO: 202681 - RNA, 22 nt, Human
agucaguguagaaagcccaggc

SEQ ID NO: 202682 - RNA, 22 nt, Human
agucaggggaucuagacuugaa

SEQ ID NO: 202683 - RNA, 22 nt, Human
agucaacauuugagaugcaaug

SEQ ID NO: 202684 - RNA, 22 nt, Human
agucagaaggugucagaucuug

SEQ ID NO: 202685 - RNA, 22 nt, Human
agucacuguuuaaucuagcuaa

SEQ ID NO: 202686 - RNA, 22 nt, Human
agucacuguucugucaugucaa

SEQ ID NO: 202687 - RNA, 22 nt, Human
agucaguaucuucugggcggua

SEQ ID NO: 202688 - RNA, 22 nt, Human
agucaggacagauuuucugggg

SEQ ID NO: 202689 - RNA, 22 nt, Human
agucauuugucauuuuuuugag

SEQ ID NO: 202690 - RNA, 22 nt, Human
aguccagggcuuagucagcggg

SEQ ID NO: 202691 - RNA, 22 nt, Human
agucauuugaggcaugauuaug

SEQ ID NO: 202692 - RNA, 18 nt, Human
agucauguuuuagucacu

SEQ ID NO: 202693 - RNA, 22 nt, Human
agucauuguguucaguaaaauc

SEQ ID NO: 202694 - RNA, 21 nt, Human
agugaagagugggcuugauca

SEQ ID NO: 202695 - RNA, 22 nt, Human
agucugugguccucuguaucuc

SEQ ID NO: 202696 - RNA, 20 nt, Human
agucuuaucugcauuuagaa

SEQ ID NO: 202697 - RNA, 19 nt, Human
agugaacuccauaucaggu

SEQ ID NO: 202698 - RNA, 22 nt, Human
agucggguugcagacacauccu

SEQ ID NO: 202699 - RNA, 22 nt, Human
agucuagcuguguuuugagcug

SEQ ID NO: 202700 - RNA, 22 nt, Human
agucuagcagagauaaagacgu

SEQ ID NO: 202701 - RNA, 22 nt, Human
agucggggagcgugaccagaga

SEQ ID NO: 202702 - RNA, 22 nt, Human
agucggauuucccagguuauug

SEQ ID NO: 202703 - RNA, 23 nt, Human
auacuuuuuuucuacguuaucuc

SEQ ID NO: 202704 - RNA, 22 nt, Human
agugacauuauuuuguguacua

SEQ ID NO: 202705 - RNA, 21 nt, Human
agugagauuuaugccugguuc

SEQ ID NO: 202706 - RNA, 22 nt, Human
auagaugacaguuaggaagcug

SEQ ID NO: 202707 - RNA, 22 nt, Human
auagaugaggaaauucaggugc

SEQ ID NO: 202708 - RNA, 22 nt, Human
auaccaaugaaucccugagaau

SEQ ID NO: 202709 - RNA, 22 nt, Human
auagaguucucuuuggaggagu

SEQ ID NO: 202710 - RNA, 22 nt, Human
auacaugugugugcauacaugu

SEQ ID NO: 202711 - RNA, 22 nt, Human
auacaugacucacacauucugc

SEQ ID NO: 202712 - RNA, 20 nt, Human
auagaguggugugucacauu

SEQ ID NO: 202713 - RNA, 22 nt, Human
auagagcuggggaagaagcugg

SEQ ID NO: 202714 - RNA, 21 nt, Human
auacaguucagcuuuuacuau

SEQ ID NO: 202715 - RNA, 22 nt, Human
auacaucuuaacgcgcucuugg

SEQ ID NO: 202716 - RNA, 22 nt, Human
auacuucaccuaacccaguuuc

SEQ ID NO: 202717 - RNA, 22 nt, Human
auagaaauagacaaugcaaaga

SEQ ID NO: 202718 - RNA, 22 nt, Human
auaccaaugacaggaguuaggg

SEQ ID NO: 202719 - RNA, 20 nt, Human
auacuuguuuucaggcuuuu

SEQ ID NO: 202720 - RNA, 22 nt, Human
auagcaguauuaugagauaacu

SEQ ID NO: 202721 - RNA, 22 nt, Human
auacuuccuuaauuuggggaaa

SEQ ID NO: 202722 - RNA, 22 nt, Human
auaguaaauguuaacagcaaca

SEQ ID NO: 202723 - RNA, 18 nt, Human
auagacaggaaaaaugga

SEQ ID NO: 202724 - RNA, 22 nt, Human
auagaauggcaccagcaucuac

SEQ ID NO: 202725 - RNA, 22 nt, Human
auagacuagccaaagacuucug

SEQ ID NO: 202726 - RNA, 23 nt, Human
auagucaggaacuguuggugugu

SEQ ID NO: 202727 - RNA, 23 nt, Human
auagucuuaaaccagacuucacc

SEQ ID NO: 202728 - RNA, 22 nt, Human
auaguugcugucauuauuugag

SEQ ID NO: 202729 - RNA, 22 nt, Human
auaguuaucuguggauaagguu

SEQ ID NO: 202730 - RNA, 22 nt, Human
auauaagauaauaacuuuuuua

SEQ ID NO: 202731 - RNA, 22 nt, Human
auagaguguguguuauguguga

SEQ ID NO: 202732 - RNA, 22 nt, Human
auaguuuuagauacugagaaaa

SEQ ID NO: 202733 - RNA, 22 nt, Human
auaugaagaaugaucugaagua

SEQ ID NO: 202734 - RNA, 22 nt, Human
auaugagaggaggagcaucagu

SEQ ID NO: 202735 - RNA, 22 nt, Human
auaugcagaaaauaaaggaauu

SEQ ID NO: 202736 - RNA, 22 nt, Human
auaguuaagguguacugaagau

SEQ ID NO: 202737 - RNA, 22 nt, Human
auaggcauaacacugauguccu

SEQ ID NO: 202738 - RNA, 22 nt, Human
auaggcggagccauaucaucca

SEQ ID NO: 202739 - RNA, 22 nt, Human
auaucuaggcugaauguaaaau

SEQ ID NO: 202740 - RNA, 22 nt, Human
auagcuauuauuauuucuguua

SEQ ID NO: 202741 - RNA, 22 nt, Human
auauaugcaacaagaaagcaua

SEQ ID NO: 202742 - RNA, 22 nt, Human
auagauguauucauuguuuggc

SEQ ID NO: 202743 - RNA, 22 nt, Human
auagauuuuaucagauuuuauc

SEQ ID NO: 202744 - RNA, 22 nt, Human
auauaguuggguuucauucuac

SEQ ID NO: 202745 - RNA, 22 nt, Human
auauaguacauguauauauaua

SEQ ID NO: 202746 - RNA, 22 nt, Human
auauaacccaaggcaggcugug

SEQ ID NO: 202747 - RNA, 22 nt, Human
auagcaacucugcuuccuugcc

SEQ ID NO: 202748 - RNA, 22 nt, Human
auaugcacauguacauguauau

SEQ ID NO: 202749 - RNA, 22 nt, Human
auauggugauuuuaugcaggaa

SEQ ID NO: 202750 - RNA, 21 nt, Human
auauggauauuauuuuguguc

SEQ ID NO: 202751 - RNA, 22 nt, Human
auaucuuguuuuugauuucuug

SEQ ID NO: 202752 - RNA, 22 nt, Human
auaucugaugacgugacuaugu

SEQ ID NO: 202753 - RNA, 22 nt, Human
auauuguagcaucacugucuug

SEQ ID NO: 202754 - RNA, 23 nt, Human
auaugucaugcaccagcacuuua

SEQ ID NO: 202755 - RNA, 21 nt, Human
auauuguugggguuuucuuuu

SEQ ID NO: 202756 - RNA, 22 nt, Human
auauuucuacaggcugauuuua

SEQ ID NO: 202757 - RNA, 22 nt, Human
auauuuguacagcuugugaguu

SEQ ID NO: 202758 - RNA, 22 nt, Human
auauuugcccccaugcccuggc

SEQ ID NO: 202759 - RNA, 22 nt, Human
auauaaugcaguaggugauuaa

SEQ ID NO: 202760 - RNA, 22 nt, Human
auauaaugugugcuuuauugaa

SEQ ID NO: 202761 - RNA, 22 nt, Human
auauauguauauacacauauau

SEQ ID NO: 202762 - RNA, 21 nt, Human
auauugguaucuuuuuaaauc

SEQ ID NO: 202763 - RNA, 22 nt, Human
aucaugugacuagguuuggcca

SEQ ID NO: 202764 - RNA, 22 nt, Human
auccuccuuugcccugagauca

SEQ ID NO: 202765 - RNA, 22 nt, Human
auccgugagcgagcgagcaccc

SEQ ID NO: 202766 - RNA, 20 nt, Human
aucaggagucgcggggagag

SEQ ID NO: 202767 - RNA, 22 nt, Human
aucauugaaaauuuaugcauuu

SEQ ID NO: 202768 - RNA, 22 nt, Human
aucagugcacgcgaugggcaga

SEQ ID NO: 202769 - RNA, 22 nt, Human
aucauaccaguuuccaucagga

SEQ ID NO: 202770 - RNA, 22 nt, Human
aucauugcuaguaaggaucuug

SEQ ID NO: 202771 - RNA, 22 nt, Human
aucauuuuuauuagcugggguu

SEQ ID NO: 202772 - RNA, 22 nt, Human
auccagaaguauuuuggguacu

SEQ ID NO: 202773 - RNA, 22 nt, Human
aucaucuaaaauuggcucagau

SEQ ID NO: 202774 - RNA, 22 nt, Human
aucaugcgguuaaggagugugu

SEQ ID NO: 202775 - RNA, 22 nt, Human
aucaugcugacacaguuuaucu

SEQ ID NO: 202776 - RNA, 22 nt, Human
auccaggggucugaauggauau

SEQ ID NO: 202777 - RNA, 22 nt, Human
aucuaaaacuacgaauacuacc

SEQ ID NO: 202778 - RNA, 22 nt, Human
aucccuggccacgaagcugccc

SEQ ID NO: 202779 - RNA, 22 nt, Human
aucuaauguggcaaguugcuga

SEQ ID NO: 202780 - RNA, 23 nt, Human
aucgcccggguccagucccggcu

SEQ ID NO: 202781 - RNA, 22 nt, Human
aucguggcacgucgccgcagcg

SEQ ID NO: 202782 - RNA, 22 nt, Human
auccuccuggggcagucuuccc

SEQ ID NO: 202783 - RNA, 22 nt, Human
auccuugacuguagugauauua

SEQ ID NO: 202784 - RNA, 22 nt, Human
auccugauggaaacugguauga

SEQ ID NO: 202785 - RNA, 20 nt, Human
auccuggucuuuggaagcuu

SEQ ID NO: 202786 - RNA, 22 nt, Human
aucauuuggaaauuuggccuaa

SEQ ID NO: 202787 - RNA, 22 nt, Human
auccacccugcaggccaacucu

SEQ ID NO: 202788 - RNA, 22 nt, Human
auccacggucaauuccccaucc

SEQ ID NO: 202789 - RNA, 22 nt, Human
auccaggguuggggucacgagu

SEQ ID NO: 202790 - RNA, 22 nt, Human
aucauuaacagugcagggguag

SEQ ID NO: 202791 - RNA, 20 nt, Human
aucaugugcacugcugacag

SEQ ID NO: 202792 - RNA, 17 nt, Human
aucagaggauaggacaa

SEQ ID NO: 202793 - RNA, 22 nt, Human
aucaugggauagugggacgagc

SEQ ID NO: 202794 - RNA, 22 nt, Human
aucauccuagaaggaagcuagg

SEQ ID NO: 202795 - RNA, 22 nt, Human
aucagaagaaauggaugugacu

SEQ ID NO: 202796 - RNA, 20 nt, Human
aucaagugucuugccaggca

SEQ ID NO: 202797 - RNA, 22 nt, Human
aucauaugugauaccauaauga

SEQ ID NO: 202798 - RNA, 22 nt, Human
aucaauaaccauagugguuaca

SEQ ID NO: 202799 - RNA, 22 nt, Human
aucacaaauggaaucaccuccc

SEQ ID NO: 202800 - RNA, 22 nt, Human
aucaaaauuuucagauacuaca

SEQ ID NO: 202801 - RNA, 22 nt, Human
aucagcucuugaugccuuucuu

SEQ ID NO: 202802 - RNA, 22 nt, Human
aucagagcuaguacuugcaggu

SEQ ID NO: 202803 - RNA, 19 nt, Human
aucagcaguuuugccugga

SEQ ID NO: 202804 - RNA, 22 nt, Human
aucacacaccuguuaaauugug

SEQ ID NO: 202805 - RNA, 22 nt, Human
aucaaaauguguagucuugauc

SEQ ID NO: 202806 - RNA, 22 nt, Human
auauuuuugcagaauuuuucgu

SEQ ID NO: 202807 - RNA, 21 nt, Human
aucagaaucucuagauuugga

SEQ ID NO: 202808 - RNA, 22 nt, Human
auauuuuacagcucucguugaa

SEQ ID NO: 202809 - RNA, 22 nt, Human
auauuuguuuggcagaguucag

SEQ ID NO: 202810 - RNA, 22 nt, Human
auauuuguuagcugcuuuggag

SEQ ID NO: 202811 - RNA, 22 nt, Human
auauuugucuguuuuaguggca

SEQ ID NO: 202812 - RNA, 22 nt, Human
aucaacucacagugugcuggca

SEQ ID NO: 202813 - RNA, 22 nt, Human
aucaaacuaugguccaugggca

SEQ ID NO: 202814 - RNA, 22 nt, Human
auauucaaugaggucauauaag

SEQ ID NO: 202815 - RNA, 22 nt, Human
auauuauuaaaauagauggaua

SEQ ID NO: 202816 - RNA, 22 nt, Human
auauugcuuuauucuugaauau

SEQ ID NO: 202817 - RNA, 22 nt, Human
auauugagagagugagguguag

SEQ ID NO: 202818 - RNA, 22 nt, Human
augugaaauuugggcucuggga

SEQ ID NO: 202819 - RNA, 22 nt, Human
augugaaagagguguucagugg

SEQ ID NO: 202820 - RNA, 22 nt, Human
augugagcuggaugaauuuaua

SEQ ID NO: 202821 - RNA, 22 nt, Human
auguauguauguauauacacac

SEQ ID NO: 202822 - RNA, 22 nt, Human
auguauuuauguauguguuaua

SEQ ID NO: 202823 - RNA, 22 nt, Human
augguuuuguccucuuugguuc

SEQ ID NO: 202824 - RNA, 22 nt, Human
augguuuugugaaaaugcuuug

SEQ ID NO: 202825 - RNA, 22 nt, Human
auguaaauauuuauauaugcau

SEQ ID NO: 202826 - RNA, 22 nt, Human
augguugccugagauaagacug

SEQ ID NO: 202827 - RNA, 22 nt, Human
augguuagauggaugagaugug

SEQ ID NO: 202828 - RNA, 20 nt, Human
auggcgagucagcacaaaac

SEQ ID NO: 202829 - RNA, 22 nt, Human
auggcuguguuguuccucugaa

SEQ ID NO: 202830 - RNA, 22 nt, Human
auggcuucugucuuggaaauuu

SEQ ID NO: 202831 - RNA, 22 nt, Human
auggcucugcugggcaaagcaa

SEQ ID NO: 202832 - RNA, 19 nt, Human
augggaagcggccagcgga

SEQ ID NO: 202833 - RNA, 22 nt, Human
auggccuuucucaguggugcuu

SEQ ID NO: 202834 - RNA, 22 nt, Human
auggccuguuuccucugaaaga

SEQ ID NO: 202835 - RNA, 18 nt, Human
auggcuccagugucuucc

SEQ ID NO: 202836 - RNA, 22 nt, Human
augugucauuauccagaauaac

SEQ ID NO: 202837 - RNA, 22 nt, Human
auguuuuaaaaaacaggcuacc

SEQ ID NO: 202838 - RNA, 22 nt, Human
auguuagcaucuggcacuaugg

SEQ ID NO: 202839 - RNA, 22 nt, Human
auguguuuugaccccugcuaaa

SEQ ID NO: 202840 - RNA, 22 nt, Human
augugaaccuggguccugggcc

SEQ ID NO: 202841 - RNA, 22 nt, Human
augugggugaggaggccauugu

SEQ ID NO: 202842 - RNA, 22 nt, Human
auguugagaaucucucuucuaa

SEQ ID NO: 202843 - RNA, 19 nt, Human
auguucugaauuacuguaa

SEQ ID NO: 202844 - RNA, 22 nt, Human
auguuccuuuaaaauauagauu

SEQ ID NO: 202845 - RNA, 22 nt, Human
augugcacuggugugugcguuc

SEQ ID NO: 202846 - RNA, 23 nt, Human
augugaggcaaaggcaggcacuc

SEQ ID NO: 202847 - RNA, 22 nt, Human
augugccuuaauauaggcgcug

SEQ ID NO: 202848 - RNA, 22 nt, Human
augguuagcuauuuuucucuca

SEQ ID NO: 202849 - RNA, 22 nt, Human
auguaacauaugugaucgcauu

SEQ ID NO: 202850 - RNA, 22 nt, Human
auguuccaugacuaugcaugaa

SEQ ID NO: 202851 - RNA, 22 nt, Human
auguucccaaaaucccuguaga

SEQ ID NO: 202852 - RNA, 22 nt, Human
auguuccuuaaugugcuuguag

SEQ ID NO: 202853 - RNA, 22 nt, Human
auguucucagguuguauuuauu

SEQ ID NO: 202854 - RNA, 18 nt, Human
auguuccugcaguuauuu

SEQ ID NO: 202855 - RNA, 20 nt, Human
auuaauuuuuagggcucacc

SEQ ID NO: 202856 - RNA, 22 nt, Human
auuacagaagauaugcucaaca

SEQ ID NO: 202857 - RNA, 22 nt, Human
auuacagauuauaaauuugagc

SEQ ID NO: 202858 - RNA, 22 nt, Human
auuagaaaugacaugugggaau

SEQ ID NO: 202859 - RNA, 22 nt, Human
auuaaaaaaagauaaugaguua

SEQ ID NO: 202860 - RNA, 22 nt, Human
auuaucugacugaguagucugu

SEQ ID NO: 202861 - RNA, 22 nt, Human
auuaucuauccgccaacaguaa

SEQ ID NO: 202862 - RNA, 22 nt, Human
auuauaguuuugcccuuaagaa

SEQ ID NO: 202863 - RNA, 23 nt, Human
auuaugaagaagacucgccuguu

SEQ ID NO: 202864 - RNA, 22 nt, Human
auuaugaauuguguuacgaaga

SEQ ID NO: 202865 - RNA, 22 nt, Human
auguuuucuugucuggagaagu

SEQ ID NO: 202866 - RNA, 22 nt, Human
auguuuuauacacauguaucac

SEQ ID NO: 202867 - RNA, 22 nt, Human
auuagcaccccuggauguggga

SEQ ID NO: 202868 - RNA, 22 nt, Human
auucauauagcgcuuacagccu

SEQ ID NO: 202869 - RNA, 22 nt, Human
auucaguucuaaggucagugcc

SEQ ID NO: 202870 - RNA, 22 nt, Human
auucaggacucuuccuugaaga

SEQ ID NO: 202871 - RNA, 22 nt, Human
auuaagucugacuggauuguau

SEQ ID NO: 202872 - RNA, 22 nt, Human
auuaaguuauuaagcuaaauau

SEQ ID NO: 202873 - RNA, 22 nt, Human
auuccauccuggcuuuuuccug

SEQ ID NO: 202874 - RNA, 22 nt, Human
auucauucugaccucaagagaa

SEQ ID NO: 202875 - RNA, 22 nt, Human
auucaucuguacuucaauaucu

SEQ ID NO: 202876 - RNA, 17 nt, Human
auucaugaacauguccu

SEQ ID NO: 202877 - RNA, 22 nt, Human
auucauuuuuacaucaccaaua

SEQ ID NO: 202878 - RNA, 18 nt, Human
auucauuugcguuuggcu

SEQ ID NO: 202879 - RNA, 22 nt, Human
auuaaacuaaauuaugaauugg

SEQ ID NO: 202880 - RNA, 22 nt, Human
auuaagacugcccauguuuuua

SEQ ID NO: 202881 - RNA, 22 nt, Human
auuauuugcuuaagcuggucuc

SEQ ID NO: 202882 - RNA, 20 nt, Human
auuauuucuucugcccaaag

SEQ ID NO: 202883 - RNA, 22 nt, Human
auuauugcaagcagugaaggga

SEQ ID NO: 202884 - RNA, 22 nt, Human
auuauucaaggugaggguaaaa

SEQ ID NO: 202885 - RNA, 22 nt, Human
auuauucuuugggaaaguugaa

SEQ ID NO: 202886 - RNA, 22 nt, Human
auuaugcagcugccuccaaggu

SEQ ID NO: 202887 - RNA, 22 nt, Human
aucugcugccuaggguuugucu

SEQ ID NO: 202888 - RNA, 22 nt, Human
aucugcugcuccuucuucuugc

SEQ ID NO: 202889 - RNA, 22 nt, Human
augaaacuggagcgccuggagg

SEQ ID NO: 202890 - RNA, 22 nt, Human
aucuauguaucucagaagcuag

SEQ ID NO: 202891 - RNA, 21 nt, Human
aucucaguccugggaaugauu

SEQ ID NO: 202892 - RNA, 22 nt, Human
aucucacuucugucauguggca

SEQ ID NO: 202893 - RNA, 22 nt, Human
augagcuaagcagaaagcacac

SEQ ID NO: 202894 - RNA, 22 nt, Human
augagaguuagccugcauaguu

SEQ ID NO: 202895 - RNA, 22 nt, Human
augaggaacagcaagaauauuu

SEQ ID NO: 202896 - RNA, 19 nt, Human
augagccccaguucguucc

SEQ ID NO: 202897 - RNA, 22 nt, Human
aucugucagaccuuggucacag

SEQ ID NO: 202898 - RNA, 22 nt, Human
augagaaauaauuguguacuga

SEQ ID NO: 202899 - RNA, 22 nt, Human
augacugaugcugacucauggg

SEQ ID NO: 202900 - RNA, 22 nt, Human
augaccuucuuuccuuaaauuu

SEQ ID NO: 202901 - RNA, 22 nt, Human
augauucuaccaaugccaucuu

SEQ ID NO: 202902 - RNA, 22 nt, Human
augacuguuaugaggugggugg

SEQ ID NO: 202903 - RNA, 22 nt, Human
augaauuugaacaccagguugg

SEQ ID NO: 202904 - RNA, 22 nt, Human
augacagcuaaggaauguguag

SEQ ID NO: 202905 - RNA, 22 nt, Human
augaauuaucugguguuggaaa

SEQ ID NO: 202906 - RNA, 22 nt, Human
augauuacagcaugauguuuca

SEQ ID NO: 202907 - RNA, 22 nt, Human
augaagugcccugggggccaga

SEQ ID NO: 202908 - RNA, 22 nt, Human
augaaugccggucucgggggaa

SEQ ID NO: 202909 - RNA, 20 nt, Human
augaaugcuccccacguuuc

SEQ ID NO: 202910 - RNA, 22 nt, Human
augaugauuauucauuuucugu

SEQ ID NO: 202911 - RNA, 22 nt, Human
augaucacagugucagucauua

SEQ ID NO: 202912 - RNA, 22 nt, Human
augaugaugguuuaacuucagg

SEQ ID NO: 202913 - RNA, 22 nt, Human
augaucaagaauuuuguauucc

SEQ ID NO: 202914 - RNA, 22 nt, Human
augcggcugugggggaauggga

SEQ ID NO: 202915 - RNA, 22 nt, Human
augccgggguggcuccagcacc

SEQ ID NO: 202916 - RNA, 21 nt, Human
augcgcgguggagugagcgaa

SEQ ID NO: 202917 - RNA, 22 nt, Human
augcuugaaaguuauuucauuu

SEQ ID NO: 202918 - RNA, 22 nt, Human
augcuugcccauguuucugaag

SEQ ID NO: 202919 - RNA, 22 nt, Human
augcugugccuggaaagcggcu

SEQ ID NO: 202920 - RNA, 22 nt, Human
augcugcuccuuuucaggcauu

SEQ ID NO: 202921 - RNA, 22 nt, Human
augcaguuagguaauagucuca

SEQ ID NO: 202922 - RNA, 22 nt, Human
augcugcuuguccauuuauuug

SEQ ID NO: 202923 - RNA, 22 nt, Human
augcuuuauuggagacagucau

SEQ ID NO: 202924 - RNA, 22 nt, Human
auggccugaagcuaaccccccu

SEQ ID NO: 202925 - RNA, 18 nt, Human
augcugacacaaugugga

SEQ ID NO: 202926 - RNA, 22 nt, Human
augcuaaucaaacuuucugcag

SEQ ID NO: 202927 - RNA, 22 nt, Human
augcuagaaaauuucauauuau

SEQ ID NO: 202928 - RNA, 22 nt, Human
augccccuuuauauguuaaguc

SEQ ID NO: 202929 - RNA, 22 nt, Human
augccucuugagagccagugcu

SEQ ID NO: 202930 - RNA, 22 nt, Human
augccugcugucaggaacucuu

SEQ ID NO: 202931 - RNA, 22 nt, Human
augauggagaacaaagaaaauc

SEQ ID NO: 202932 - RNA, 22 nt, Human
augcagauguagauucugaaau

SEQ ID NO: 202933 - RNA, 22 nt, Human
augcacuacuagaugcaaaagu

SEQ ID NO: 202934 - RNA, 22 nt, Human
augcgcugugcacacucuuaac

SEQ ID NO: 202935 - RNA, 22 nt, Human
augccugggcuuuaggguucuc

SEQ ID NO: 202936 - RNA, 22 nt, Human
augcacuaugaugagcuagucu

SEQ ID NO: 202937 - RNA, 22 nt, Human
augcagaaucucuuuccugagg

SEQ ID NO: 202938 - RNA, 22 nt, Human
augcagcggucagaggaacuca

SEQ ID NO: 202939 - RNA, 22 nt, Human
augcuacuugugaaaacccagg

SEQ ID NO: 202940 - RNA, 22 nt, Human
augcucuggucucuucuuuccu

SEQ ID NO: 202941 - RNA, 22 nt, Human
augcucuuaauugcuagauaag

SEQ ID NO: 202942 - RNA, 22 nt, Human
augcugacaacaaagaaggaag

SEQ ID NO: 202943 - RNA, 22 nt, Human
caagagcgugugcagggcaagu

SEQ ID NO: 202944 - RNA, 22 nt, Human
caagagcucccagaccugggca

SEQ ID NO: 202945 - RNA, 19 nt, Human
cacagcccucacuuuuagc

SEQ ID NO: 202946 - RNA, 22 nt, Human
cacagauaaggcuuugucccca

SEQ ID NO: 202947 - RNA, 20 nt, Human
cacagcugacgaguauccaa

SEQ ID NO: 202948 - RNA, 22 nt, Human
caagaaccuagcgaucagguaa

SEQ ID NO: 202949 - RNA, 22 nt, Human
cacagcaggcagaacgugggca

SEQ ID NO: 202950 - RNA, 22 nt, Human
cacacguuuagcuucuggcggc

SEQ ID NO: 202951 - RNA, 22 nt, Human
cacacagcuagugacaggagaa

SEQ ID NO: 202952 - RNA, 22 nt, Human
cacagaauuaagggagaaauau

SEQ ID NO: 202953 - RNA, 22 nt, Human
cacagcagcaucauuuaucugg

SEQ ID NO: 202954 - RNA, 17 nt, Human
cacauggagcuuguugc

SEQ ID NO: 202955 - RNA, 22 nt, Human
cacaucugaaggcggcucuagg

SEQ ID NO: 202956 - RNA, 22 nt, Human
cacauguguaccugccucucug

SEQ ID NO: 202957 - RNA, 22 nt, Human
cacaugugggcacagggcugca

SEQ ID NO: 202958 - RNA, 22 nt, Human
cacauuaagcccaagcauagaa

SEQ ID NO: 202959 - RNA, 22 nt, Human
caagcagauauuuuagucaaga

SEQ ID NO: 202960 - RNA, 22 nt, Human
cacagcuggggaagcugaggcc

SEQ ID NO: 202961 - RNA, 22 nt, Human
cacaucaaacuuacuaagauuu

SEQ ID NO: 202962 - RNA, 22 nt, Human
cacauaguuuaucuucauuuuc

SEQ ID NO: 202963 - RNA, 22 nt, Human
caagagcuuuagaaaugcucau

SEQ ID NO: 202964 - RNA, 22 nt, Human
caaggggagcugguauggaugg

SEQ ID NO: 202965 - RNA, 22 nt, Human
caagggcagaggcagggccccg

SEQ ID NO: 202966 - RNA, 22 nt, Human
caaggcuaagcuuuggcuuucu

SEQ ID NO: 202967 - RNA, 22 nt, Human
caaggaguuuggggaccaagga

SEQ ID NO: 202968 - RNA, 22 nt, Human
caccagcgacugugaccagcaa

SEQ ID NO: 202969 - RNA, 22 nt, Human
caccacuuggcccugagguccu

SEQ ID NO: 202970 - RNA, 22 nt, Human
caccaucagacuucugggcagg

SEQ ID NO: 202971 - RNA, 22 nt, Human
caccaccaguaccaucacacgc

SEQ ID NO: 202972 - RNA, 22 nt, Human
caagugaguauguauuguguag

SEQ ID NO: 202973 - RNA, 22 nt, Human
caauaauugcuuuccagaguua

SEQ ID NO: 202974 - RNA, 22 nt, Human
caaguugcaugugcuugaaaua

SEQ ID NO: 202975 - RNA, 22 nt, Human
caauaguaaucaaugcaguuag

SEQ ID NO: 202976 - RNA, 22 nt, Human
caccuuccgcccacugaccgcc

SEQ ID NO: 202977 - RNA, 22 nt, Human
caccuggaggcagcaccgggcu

SEQ ID NO: 202978 - RNA, 22 nt, Human
caccugcaaauuccagauuucu

SEQ ID NO: 202979 - RNA, 20 nt, Human
caccggguugcugguuucuu

SEQ ID NO: 202980 - RNA, 22 nt, Human
cacccugacuggcccugcagga

SEQ ID NO: 202981 - RNA, 22 nt, Human
caccgagagccacuuccggaac

SEQ ID NO: 202982 - RNA, 20 nt, Human
cacccgguccucagcgacuc

SEQ ID NO: 202983 - RNA, 22 nt, Human
caagcgcgccgcuuccuuccgc

SEQ ID NO: 202984 - RNA, 22 nt, Human
caagagguaugagccgggauga

SEQ ID NO: 202985 - RNA, 22 nt, Human
caaggaaaugucagaaaggcaa

SEQ ID NO: 202986 - RNA, 22 nt, Human
caagaugcaagaccagucaggc

SEQ ID NO: 202987 - RNA, 22 nt, Human
caaagagaugcaccauauuucu

SEQ ID NO: 202988 - RNA, 22 nt, Human
caagaaaaaacaugaugagugu

SEQ ID NO: 202989 - RNA, 22 nt, Human
caaaacauucagagagcucacu

SEQ ID NO: 202990 - RNA, 22 nt, Human
auuaguccuaguucauucugag

SEQ ID NO: 202991 - RNA, 22 nt, Human
caagaaguugacagccagguga

SEQ ID NO: 202992 - RNA, 22 nt, Human
caaggaagguugguugaaggua

SEQ ID NO: 202993 - RNA, 22 nt, Human
caagguauugaggccagugucc

SEQ ID NO: 202994 - RNA, 22 nt, Human
caaguaugagaaagcuauuacc

SEQ ID NO: 202995 - RNA, 22 nt, Human
caagucucuagaaugcaauagu

SEQ ID NO: 202996 - RNA, 22 nt, Human
caaguauuuauugaggcccugu

SEQ ID NO: 202997 - RNA, 22 nt, Human
caauaccucuuggugauugggc

SEQ ID NO: 202998 - RNA, 22 nt, Human
caaaggauguguagugcaacca

SEQ ID NO: 202999 - RNA, 22 nt, Human
caaaggaauuacauguuucgga

SEQ ID NO: 203000 - RNA, 22 nt, Human
caauagcuauguaaccugaaga

SEQ ID NO: 203001 - RNA, 22 nt, Human
caaaucuguuaauuucaaguug

SEQ ID NO: 203002 - RNA, 20 nt, Human
caauguuggcaguauagagc

SEQ ID NO: 203003 - RNA, 22 nt, Human
caaugggagaugcagaacagcu

SEQ ID NO: 203004 - RNA, 22 nt, Human
caaauggggaauagaugauggg

SEQ ID NO: 203005 - RNA, 22 nt, Human
caacguggauucuuccaggggc

SEQ ID NO: 203006 - RNA, 22 nt, Human
caacuucuauucagucugcagu

SEQ ID NO: 203007 - RNA, 22 nt, Human
cacaaagugucaggggagagaa

SEQ ID NO: 203008 - RNA, 22 nt, Human
caacaagcgcucagagcaaagc

SEQ ID NO: 203009 - RNA, 22 nt, Human
auuuuuauuugccuaugauaua

SEQ ID NO: 203010 - RNA, 23 nt, Human
auuuuuccacacacagacucagu

SEQ ID NO: 203011 - RNA, 22 nt, Human
caaauacaaauacgggcagcuu

SEQ ID NO: 203012 - RNA, 22 nt, Human
caacauuucaaggucuuuagga

SEQ ID NO: 203013 - RNA, 22 nt, Human
auuuuuuuaggcugucagccgc

SEQ ID NO: 203014 - RNA, 22 nt, Human
caaccaguagcugaguucaaaa

SEQ ID NO: 203015 - RNA, 22 nt, Human
auuuuuuuggucauaugagaua

SEQ ID NO: 203016 - RNA, 22 nt, Human
auuuugcaguuuauugccaauc

SEQ ID NO: 203017 - RNA, 22 nt, Human
caaagaagagauuuacagagcu

SEQ ID NO: 203018 - RNA, 22 nt, Human
auuuuggguguuaacaaugaaa

SEQ ID NO: 203019 - RNA, 22 nt, Human
caaagccuggggagaguaagga

SEQ ID NO: 203020 - RNA, 22 nt, Human
caaagaugccaaaaggaagaca

SEQ ID NO: 203021 - RNA, 22 nt, Human
auuuuucucucaugugcaacua

SEQ ID NO: 203022 - RNA, 22 nt, Human
auuuuucuuucacauuuucuua

SEQ ID NO: 203023 - RNA, 22 nt, Human
auuuggucuguaauuacaugga

SEQ ID NO: 203024 - RNA, 18 nt, Human
auuuguggggguuauaga

SEQ ID NO: 203025 - RNA, 21 nt, Human
auuuggucaaugucugcguga

SEQ ID NO: 203026 - RNA, 22 nt, Human
auuuggaaacaugcugaccaug

SEQ ID NO: 203027 - RNA, 22 nt, Human
auuuuugguuucaccugcacgc

SEQ ID NO: 203028 - RNA, 22 nt, Human
auuugaaguauaaguaauugcu

SEQ ID NO: 203029 - RNA, 22 nt, Human
auuugcaucagugagcgaugug

SEQ ID NO: 203030 - RNA, 22 nt, Human
auuugcauguuuauuucuuaga

SEQ ID NO: 203031 - RNA, 22 nt, Human
auuuuuaucuaaaauccacuuu

SEQ ID NO: 203032 - RNA, 22 nt, Human
auuucagaguagaucguuauuu

SEQ ID NO: 203033 - RNA, 21 nt, Human
auuuguggugcaauuguggua

SEQ ID NO: 203034 - RNA, 22 nt, Human
auuuccacaaauuaagauugca

SEQ ID NO: 203035 - RNA, 22 nt, Human
auuugaaaaucuaugaugugca

SEQ ID NO: 203036 - RNA, 22 nt, Human
auuuuacuaugauaguugagaa

SEQ ID NO: 203037 - RNA, 22 nt, Human
auuaauaucaauauauuauaug

SEQ ID NO: 203038 - RNA, 22 nt, Human
auuacugaggcaaaguaguuuu

SEQ ID NO: 203039 - RNA, 22 nt, Human
auuauacauuaggagauugauu

SEQ ID NO: 203040 - RNA, 21 nt, Human
auuauagugacuaaauugaua

SEQ ID NO: 203041 - RNA, 22 nt, Human
auuauaauucauuaggcuuagu

SEQ ID NO: 203042 - RNA, 22 nt, Human
auugugaaugccugucagucuu

SEQ ID NO: 203043 - RNA, 22 nt, Human
auugaaauuugcuuccucacug

SEQ ID NO: 203044 - RNA, 17 nt, Human
auuguuuuuaauuugca

SEQ ID NO: 203045 - RNA, 22 nt, Human
auugacagagguguaguugaga

SEQ ID NO: 203046 - RNA, 22 nt, Human
auuuaaaggaagugggugauaa

SEQ ID NO: 203047 - RNA, 22 nt, Human
auuuauauauuuuguucuggua

SEQ ID NO: 203048 - RNA, 22 nt, Human
auuuaggacagugucugaauug

SEQ ID NO: 203049 - RNA, 22 nt, Human
auuuauccuugggguagagcca

SEQ ID NO: 203050 - RNA, 22 nt, Human
auuucagaaugaaaggaaaaau

SEQ ID NO: 203051 - RNA, 22 nt, Human
auuuaaagaguaauacaaucca

SEQ ID NO: 203052 - RNA, 22 nt, Human
auuuauuugaagagccauugca

SEQ ID NO: 203053 - RNA, 22 nt, Human
auuugcuuguucaccaguacuu

SEQ ID NO: 203054 - RNA, 22 nt, Human
auuuaaaaacugguacaacagg

SEQ ID NO: 203055 - RNA, 22 nt, Human
auuuggaaggcguuucucugua

SEQ ID NO: 203056 - RNA, 22 nt, Human
auuggcugucagcccggauggg

SEQ ID NO: 203057 - RNA, 22 nt, Human
auuucaacagaguuugaaggca

SEQ ID NO: 203058 - RNA, 22 nt, Human
auuucacucuuaauugcuuccu

SEQ ID NO: 203059 - RNA, 22 nt, Human
auuuauuuucccucaaguaccu

SEQ ID NO: 203060 - RNA, 22 nt, Human
auuguuuugugaaacauaguga

SEQ ID NO: 203061 - RNA, 22 nt, Human
auuucccugcagugcuuaggaa

SEQ ID NO: 203062 - RNA, 19 nt, Human
auuuccuggcauauaucac

SEQ ID NO: 203063 - RNA, 22 nt, Human
auuucauuuuagaaauaagugu

SEQ ID NO: 203064 - RNA, 22 nt, Human
auuucauaaaaacuuuaccuga

SEQ ID NO: 203065 - RNA, 22 nt, Human
auuucauccauuaagaguacuc

SEQ ID NO: 203066 - RNA, 22 nt, Human
cagugcaacguugugcauucaa

SEQ ID NO: 203067 - RNA, 22 nt, Human
cagucucuggugaguugacagu

SEQ ID NO: 203068 - RNA, 22 nt, Human
cagucaaauuugaaaacuuuga

SEQ ID NO: 203069 - RNA, 22 nt, Human
caucuuuguuuuggauauaauc

SEQ ID NO: 203070 - RNA, 22 nt, Human
cagugcuggaggggugcuugca

SEQ ID NO: 203071 - RNA, 22 nt, Human
cagugcucauagcuguuccucc

SEQ ID NO: 203072 - RNA, 22 nt, Human
caugaauaauucuuuuucuugg

SEQ ID NO: 203073 - RNA, 22 nt, Human
caugaacucucggguuuggaau

SEQ ID NO: 203074 - RNA, 22 nt, Human
caugauguuaucaagcacaaag

SEQ ID NO: 203075 - RNA, 22 nt, Human
caugaugagaguaauaacacag

SEQ ID NO: 203076 - RNA, 20 nt, Human
caugaugcaaacaguaacgu

SEQ ID NO: 203077 - RNA, 22 nt, Human
caugaugaacugugcuguuagg

SEQ ID NO: 203078 - RNA, 22 nt, Human
caugaugacagcauuccuuuua

SEQ ID NO: 203079 - RNA, 20 nt, Human
caugaguccgugaguggccc

SEQ ID NO: 203080 - RNA, 22 nt, Human
caguuaaugauaggaauucggu

SEQ ID NO: 203081 - RNA, 22 nt, Human
caguguuuagcacagugcuugg

SEQ ID NO: 203082 - RNA, 22 nt, Human
caguggggcuuccagacgcuga

SEQ ID NO: 203083 - RNA, 17 nt, Human
cagugcuguuuuagaaa

SEQ ID NO: 203084 - RNA, 22 nt, Human
caguggaugucucauaguguga

SEQ ID NO: 203085 - RNA, 21 nt, Human
caguuugcuauuuuaguauga

SEQ ID NO: 203086 - RNA, 22 nt, Human
caguugcuauugagagaacaca

SEQ ID NO: 203087 - RNA, 21 nt, Human
caguucuaagugucaucuuuu

SEQ ID NO: 203088 - RNA, 22 nt, Human
caguuuuucaaaauuacaugau

SEQ ID NO: 203089 - RNA, 22 nt, Human
caugcagcagaauaaugacuau

SEQ ID NO: 203090 - RNA, 22 nt, Human
caguuuuauacacugcagcucc

SEQ ID NO: 203091 - RNA, 22 nt, Human
caugcgucugcauuggguggug

SEQ ID NO: 203092 - RNA, 22 nt, Human
caugccaguagccggcuugacu

SEQ ID NO: 203093 - RNA, 22 nt, Human
caugccucuguuuuaguuguug

SEQ ID NO: 203094 - RNA, 22 nt, Human
cauaaauuuuaccuuguaagug

SEQ ID NO: 203095 - RNA, 22 nt, Human
cauggcggcgcucucccugccu

SEQ ID NO: 203096 - RNA, 22 nt, Human
cauagcguuuacauguggauua

SEQ ID NO: 203097 - RNA, 22 nt, Human
cauagacauugauagguuauau

SEQ ID NO: 203098 - RNA, 22 nt, Human
cauagcauguguuuauuuucuu

SEQ ID NO: 203099 - RNA, 22 nt, Human
cauaccuugguaagagugauca

SEQ ID NO: 203100 - RNA, 22 nt, Human
cauggccaaagaauuauauuuu

SEQ ID NO: 203101 - RNA, 19 nt, Human
cauggcgguaaagaggcug

SEQ ID NO: 203102 - RNA, 22 nt, Human
cauguaaguucacagucgaugu

SEQ ID NO: 203103 - RNA, 22 nt, Human
cagguuguucugggcauggagg

SEQ ID NO: 203104 - RNA, 22 nt, Human
caggucauaacuaugcaugaac

SEQ ID NO: 203105 - RNA, 22 nt, Human
cagguauaugugugucuaauac

SEQ ID NO: 203106 - RNA, 22 nt, Human
caggguaagagagagugacauu

SEQ ID NO: 203107 - RNA, 22 nt, Human
cagggggacuuguuagguuuua

SEQ ID NO: 203108 - RNA, 22 nt, Human
caggggcuuuccuguuuaugga

SEQ ID NO: 203109 - RNA, 22 nt, Human
caggggacacuccugcuugggc

SEQ ID NO: 203110 - RNA, 19 nt, Human
caggggcuuaugcgaccuc

SEQ ID NO: 203111 - RNA, 22 nt, Human
cauaauuggugcuuauuaaaug

SEQ ID NO: 203112 - RNA, 22 nt, Human
caggggucccccggcucccugg

SEQ ID NO: 203113 - RNA, 22 nt, Human
cagggugaagaugcgccuccug

SEQ ID NO: 203114 - RNA, 22 nt, Human
cagguuucuggaugcagcccca

SEQ ID NO: 203115 - RNA, 20 nt, Human
caucaacaccuugucagccu

SEQ ID NO: 203116 - RNA, 22 nt, Human
cagguuguugacugcauauagg

SEQ ID NO: 203117 - RNA, 22 nt, Human
caguacugucuuccugauggca

SEQ ID NO: 203118 - RNA, 22 nt, Human
caguaaccaguaguuuuggaaa

SEQ ID NO: 203119 - RNA, 22 nt, Human
caucgagaauuggcagcuaaag

SEQ ID NO: 203120 - RNA, 22 nt, Human
caucccaacaggugaucuggua

SEQ ID NO: 203121 - RNA, 22 nt, Human
cauccagggguacccuggagcc

SEQ ID NO: 203122 - RNA, 22 nt, Human
caguaucucccauucacagugu

SEQ ID NO: 203123 - RNA, 22 nt, Human
caucauuuggcuuuagggccug

SEQ ID NO: 203124 - RNA, 22 nt, Human
caggccgccacugcagcagcug

SEQ ID NO: 203125 - RNA, 22 nt, Human
caggccccagggacugggcgcu

SEQ ID NO: 203126 - RNA, 22 nt, Human
caggcgcauggugagcagauga

SEQ ID NO: 203127 - RNA, 22 nt, Human
cagggacgugagccaugucagu

SEQ ID NO: 203128 - RNA, 22 nt, Human
cagggcagaguuaagaugcugg

SEQ ID NO: 203129 - RNA, 22 nt, Human
cagggccaggccucaggggcgc

SEQ ID NO: 203130 - RNA, 22 nt, Human
caguuuuggaagaaacaaggaa

SEQ ID NO: 203131 - RNA, 22 nt, Human
cagggcuugaaucaaggaaguc

SEQ ID NO: 203132 - RNA, 22 nt, Human
caggggaagccagcugccaugu

SEQ ID NO: 203133 - RNA, 22 nt, Human
caguaugagcacagugccugga

SEQ ID NO: 203134 - RNA, 22 nt, Human
caguccaugaugacuuuugcuc

SEQ ID NO: 203135 - RNA, 22 nt, Human
caggcagagagggcagugugga

SEQ ID NO: 203136 - RNA, 22 nt, Human
cagguuuuuauuacaacuuuga

SEQ ID NO: 203137 - RNA, 22 nt, Human
caggguuuuauuuggcuuuaaa

SEQ ID NO: 203138 - RNA, 22 nt, Human
caggucagcacuuggaggugca

SEQ ID NO: 203139 - RNA, 21 nt, Human
caguagcgcgacaugguuagc

SEQ ID NO: 203140 - RNA, 22 nt, Human
cagguauuugaaggcaguggga

SEQ ID NO: 203141 - RNA, 22 nt, Human
caguaguucucauaacucauga

SEQ ID NO: 203142 - RNA, 22 nt, Human
caguaucucuaaaauuacucuu

SEQ ID NO: 203143 - RNA, 18 nt, Human
cacgcaacuguaaaaccc

SEQ ID NO: 203144 - RNA, 22 nt, Human
caauugcuuccuucuguaagua

SEQ ID NO: 203145 - RNA, 22 nt, Human
cacaauuuccauugagcagcag

SEQ ID NO: 203146 - RNA, 22 nt, Human
cacaacaaaaaauaaguaugag

SEQ ID NO: 203147 - RNA, 22 nt, Human
cagagcagaaaccugggugauu

SEQ ID NO: 203148 - RNA, 22 nt, Human
cagagaugaggcuggcgugguu

SEQ ID NO: 203149 - RNA, 22 nt, Human
cagagcucacaaacugaaaacc

SEQ ID NO: 203150 - RNA, 22 nt, Human
cagauguuugaaugcuuaccac

SEQ ID NO: 203151 - RNA, 22 nt, Human
cagauggagaaagagugaaugg

SEQ ID NO: 203152 - RNA, 20 nt, Human
cagaucuuauguuuuucugu

SEQ ID NO: 203153 - RNA, 22 nt, Human
cacuuuuucccccuggugucau

SEQ ID NO: 203154 - RNA, 19 nt, Human
cagcaaacacuguaaaugg

SEQ ID NO: 203155 - RNA, 22 nt, Human
cagaggauggaaaugagaacaa

SEQ ID NO: 203156 - RNA, 22 nt, Human
cagaguaaugugauuuccaugu

SEQ ID NO: 203157 - RNA, 22 nt, Human
cagauaagcuauaaguaguacc

SEQ ID NO: 203158 - RNA, 22 nt, Human
cagaggcugagcugcgggauga

SEQ ID NO: 203159 - RNA, 22 nt, Human
cagcugcgcagcgccgggccug

SEQ ID NO: 203160 - RNA, 22 nt, Human
cagcugacaagaguccuuggag

SEQ ID NO: 203161 - RNA, 22 nt, Human
cagcuggaggagcagcuuccag

SEQ ID NO: 203162 - RNA, 22 nt, Human
cagcucuggcuauugaggacca

SEQ ID NO: 203163 - RNA, 22 nt, Human
cagagaagaggucuugaccccu

SEQ ID NO: 203164 - RNA, 22 nt, Human
cagacuccugcuccucuggggc

SEQ ID NO: 203165 - RNA, 18 nt, Human
cagcauuagcagcuucca

SEQ ID NO: 203166 - RNA, 22 nt, Human
cagcaugguggagcugcucuuu

SEQ ID NO: 203167 - RNA, 22 nt, Human
cagacagagcucacaagucuuu

SEQ ID NO: 203168 - RNA, 22 nt, Human
cagacagagucuucccaucagu

SEQ ID NO: 203169 - RNA, 22 nt, Human
cagacacgucccuguugaccug

SEQ ID NO: 203170 - RNA, 22 nt, Human
cagacaaauccuuaugagacug

SEQ ID NO: 203171 - RNA, 22 nt, Human
cagcagccuccccggccgaccu

SEQ ID NO: 203172 - RNA, 22 nt, Human
cagcacuuccuccgugagcccc

SEQ ID NO: 203173 - RNA, 22 nt, Human
cagcuguauuucucugguuaga

SEQ ID NO: 203174 - RNA, 22 nt, Human
cagcagaugacuauuggagcug

SEQ ID NO: 203175 - RNA, 21 nt, Human
cagcagaaaugagaggagaaa

SEQ ID NO: 203176 - RNA, 22 nt, Human
cagcagaggagguggcagcacc

SEQ ID NO: 203177 - RNA, 22 nt, Human
cagauuuaauaaaaaaugcauc

SEQ ID NO: 203178 - RNA, 22 nt, Human
cagauuuagcacugauaggacu

SEQ ID NO: 203179 - RNA, 22 nt, Human
cagaugccauagguauaguaua

SEQ ID NO: 203180 - RNA, 22 nt, Human
cagccuuuucuuaaaaugcaag

SEQ ID NO: 203181 - RNA, 22 nt, Human
cagccuggccucuggauauuug

SEQ ID NO: 203182 - RNA, 22 nt, Human
cagccuacaucagaauaccaau

SEQ ID NO: 203183 - RNA, 22 nt, Human
cagcuuguucugaccugugauu

SEQ ID NO: 203184 - RNA, 22 nt, Human
cagcuuuugcagacuucuugcc

SEQ ID NO: 203185 - RNA, 22 nt, Human
cagcccaggcucagauguuggg

SEQ ID NO: 203186 - RNA, 22 nt, Human
cagcuugcccugauguggaaga

SEQ ID NO: 203187 - RNA, 22 nt, Human
cagcuucaugacaaacaguuuu

SEQ ID NO: 203188 - RNA, 22 nt, Human
cagcuuauggcuucuccaguag

SEQ ID NO: 203189 - RNA, 22 nt, Human
cagccagaucgccuuccgccuc

SEQ ID NO: 203190 - RNA, 22 nt, Human
cagcuguggagauggggugcau

SEQ ID NO: 203191 - RNA, 22 nt, Human
cagcuuaccucccacagcucuc

SEQ ID NO: 203192 - RNA, 22 nt, Human
caggcaggagaaaaggcgcggg

SEQ ID NO: 203193 - RNA, 22 nt, Human
caggcagggagcuggaaaggau

SEQ ID NO: 203194 - RNA, 22 nt, Human
caggcacagcuaagacuggcca

SEQ ID NO: 203195 - RNA, 22 nt, Human
caggccagcuggaggggcagcu

SEQ ID NO: 203196 - RNA, 22 nt, Human
cagggagcggggagaucucggg

SEQ ID NO: 203197 - RNA, 22 nt, Human
cagggagguuggauuggggccu

SEQ ID NO: 203198 - RNA, 22 nt, Human
caggccacagcuaaagaggauu

SEQ ID NO: 203199 - RNA, 22 nt, Human
caggcagggcugccuucugcuu

SEQ ID NO: 203200 - RNA, 22 nt, Human
cagcucugcugggaggaugcag

SEQ ID NO: 203201 - RNA, 22 nt, Human
cagcucgaauaauggagaacug

SEQ ID NO: 203202 - RNA, 22 nt, Human
cagcuauggaauuggcccagau

SEQ ID NO: 203203 - RNA, 22 nt, Human
cagcuccagcccaggcagcucc

SEQ ID NO: 203204 - RNA, 22 nt, Human
cagggccagggcuauggugaag

SEQ ID NO: 203205 - RNA, 22 nt, Human
cagggcuuuuuccuccucuuug

SEQ ID NO: 203206 - RNA, 22 nt, Human
cagggggcagcguagaaaauga

SEQ ID NO: 203207 - RNA, 22 nt, Human
caggguaccaagcuucgcccuc

SEQ ID NO: 203208 - RNA, 22 nt, Human
caggguaguaauuuaauacaag

SEQ ID NO: 203209 - RNA, 22 nt, Human
cuguagaugucagguuaaugag

SEQ ID NO: 203210 - RNA, 22 nt, Human
cucuggcaacgauggugcuuau

SEQ ID NO: 203211 - RNA, 18 nt, Human
cucuggacagcaggcauc

SEQ ID NO: 203212 - RNA, 22 nt, Human
cucugcuuguaucacauuugcu

SEQ ID NO: 203213 - RNA, 22 nt, Human
cucugcuuagacaggcuuuaag

SEQ ID NO: 203214 - RNA, 20 nt, Human
cucugggaggcuugucaccu

SEQ ID NO: 203215 - RNA, 17 nt, Human
cucugggucuccugcuu

SEQ ID NO: 203216 - RNA, 22 nt, Human
cucugguuucgcaggaaauaga

SEQ ID NO: 203217 - RNA, 20 nt, Human
cuggugccuucugcgauuua

SEQ ID NO: 203218 - RNA, 22 nt, Human
cucugcccacaguccccgagga

SEQ ID NO: 203219 - RNA, 22 nt, Human
cucugaguuuacaguauguuuu

SEQ ID NO: 203220 - RNA, 22 nt, Human
cucuuuuuccuaugaaaucuau

SEQ ID NO: 203221 - RNA, 22 nt, Human
cucuuuucaaaccuguuuaugg

SEQ ID NO: 203222 - RNA, 22 nt, Human
cuguggaaugcaguugcgagca

SEQ ID NO: 203223 - RNA, 22 nt, Human
cuguggcugcgcccugggggag

SEQ ID NO: 203224 - RNA, 22 nt, Human
cuguggaguccuggggaaugga

SEQ ID NO: 203225 - RNA, 22 nt, Human
cugucucugucucuguuuaucc

SEQ ID NO: 203226 - RNA, 22 nt, Human
cugugaaugguggccacgcguu

SEQ ID NO: 203227 - RNA, 22 nt, Human
cugugcauaugucuugaggucu

SEQ ID NO: 203228 - RNA, 22 nt, Human
cucugucuggggaggggagagg

SEQ ID NO: 203229 - RNA, 22 nt, Human
cucuucauguuggugcagaagc

SEQ ID NO: 203230 - RNA, 19 nt, Human
cucuucauuggaggguuga

SEQ ID NO: 203231 - RNA, 22 nt, Human
cucuucauuauucacgcccugu

SEQ ID NO: 203232 - RNA, 22 nt, Human
cugugcuguuagcgauuuuuaa

SEQ ID NO: 203233 - RNA, 22 nt, Human
cuguguuaggaucuugcuggca

SEQ ID NO: 203234 - RNA, 22 nt, Human
cugugugugcacacguguaugg

SEQ ID NO: 203235 - RNA, 22 nt, Human
cugugugcagggcacaauggaa

SEQ ID NO: 203236 - RNA, 22 nt, Human
cugaaucaaaugacuuagccau

SEQ ID NO: 203237 - RNA, 22 nt, Human
cugaagcugggcacuuccuuuu

SEQ ID NO: 203238 - RNA, 22 nt, Human
cugaccugugagcuaugccggc

SEQ ID NO: 203239 - RNA, 22 nt, Human
cugaccucuaaguaacagagaa

SEQ ID NO: 203240 - RNA, 22 nt, Human
cuguuuggaugccauggucaag

SEQ ID NO: 203241 - RNA, 22 nt, Human
cugaauucuuguugucggagca

SEQ ID NO: 203242 - RNA, 22 nt, Human
cugagaaauacccaagucuggu

SEQ ID NO: 203243 - RNA, 22 nt, Human
cugacugaggaucaguucauca

SEQ ID NO: 203244 - RNA, 22 nt, Human
cugagcugcucccgcugcagcg

SEQ ID NO: 203245 - RNA, 22 nt, Human
cugagcggugagggcauacagc

SEQ ID NO: 203246 - RNA, 22 nt, Human
cugagcuuuucucugcuucuua

SEQ ID NO: 203247 - RNA, 22 nt, Human
cuucaacuucuguuuuaaggaa

SEQ ID NO: 203248 - RNA, 22 nt, Human
cugauagagcauuagugugaga

SEQ ID NO: 203249 - RNA, 22 nt, Human
cugaguuuuucaaaucugaauu

SEQ ID NO: 203250 - RNA, 22 nt, Human
cuggaaagauuuacacggggaa

SEQ ID NO: 203251 - RNA, 22 nt, Human
cuggaaaaauggauccugucuu

SEQ ID NO: 203252 - RNA, 22 nt, Human
cugacugauuuugcuuuuuaau

SEQ ID NO: 203253 - RNA, 22 nt, Human
cucaaugagcuauuuguuucau

SEQ ID NO: 203254 - RNA, 22 nt, Human
cuggagaacucugugcuucacu

SEQ ID NO: 203255 - RNA, 22 nt, Human
cuggagaagagguaguauguag

SEQ ID NO: 203256 - RNA, 22 nt, Human
cucaggugagcgagcuaaauua

SEQ ID NO: 203257 - RNA, 22 nt, Human
cugcuuuggaucucucucugcc

SEQ ID NO: 203258 - RNA, 22 nt, Human
cuggacucuuuguuuaguucug

SEQ ID NO: 203259 - RNA, 22 nt, Human
cuggagcuucaggguucucggg

SEQ ID NO: 203260 - RNA, 22 nt, Human
cuggauagaggaugguaggcac

SEQ ID NO: 203261 - RNA, 22 nt, Human
cuggaucgccccgaugugcccc

SEQ ID NO: 203262 - RNA, 22 nt, Human
cuggcccugucagcacagaauc

SEQ ID NO: 203263 - RNA, 22 nt, Human
cuggccugugggcugucuccgg

SEQ ID NO: 203264 - RNA, 22 nt, Human
cuggccagccucccagguaccc

SEQ ID NO: 203265 - RNA, 22 nt, Human
cuccuuccuccgcccuuccucg

SEQ ID NO: 203266 - RNA, 22 nt, Human
cuccuuuuuuuaaagauggauu

SEQ ID NO: 203267 - RNA, 22 nt, Human
cuccugauuucuaggccuuauc

SEQ ID NO: 203268 - RNA, 22 nt, Human
cugggaaggaagggaaaaacag

SEQ ID NO: 203269 - RNA, 22 nt, Human
cugggaaucuagagggcucauu

SEQ ID NO: 203270 - RNA, 22 nt, Human
cuggcuuucauggcgcaguuga

SEQ ID NO: 203271 - RNA, 22 nt, Human
cucccgagccuuacucuguucc

SEQ ID NO: 203272 - RNA, 22 nt, Human
cuccagggcuaccagguuuuag

SEQ ID NO: 203273 - RNA, 22 nt, Human
cuggccuuaucacaaagcuaga

SEQ ID NO: 203274 - RNA, 22 nt, Human
cucccccugccucuccucccug

SEQ ID NO: 203275 - RNA, 22 nt, Human
cuccccauuuucaugggcaggu

SEQ ID NO: 203276 - RNA, 22 nt, Human
cuccaugagccaggagggcuac

SEQ ID NO: 203277 - RNA, 22 nt, Human
cugcuguugagguuccaggcca

SEQ ID NO: 203278 - RNA, 22 nt, Human
cugcugccagcuuaauacucac

SEQ ID NO: 203279 - RNA, 22 nt, Human
cugcugugcagacagacucucu

SEQ ID NO: 203280 - RNA, 22 nt, Human
cugcugcuugauugcaggaagu

SEQ ID NO: 203281 - RNA, 22 nt, Human
cugcuguuuuccccaccaucuc

SEQ ID NO: 203282 - RNA, 22 nt, Human
cuugucuaguuccuggugaugu

SEQ ID NO: 203283 - RNA, 22 nt, Human
cuuggguacaguaaagggaggu

SEQ ID NO: 203284 - RNA, 22 nt, Human
cugcuucacccugccugagaac

SEQ ID NO: 203285 - RNA, 22 nt, Human
cuuggugagcuccuggcgcagc

SEQ ID NO: 203286 - RNA, 22 nt, Human
cuuggggcuugcuguuguagcc

SEQ ID NO: 203287 - RNA, 22 nt, Human
cugcucugagaggcucuuccua

SEQ ID NO: 203288 - RNA, 22 nt, Human
cugcuacgguguccgguggggc

SEQ ID NO: 203289 - RNA, 22 nt, Human
cuugcugggagagcuuuagaga

SEQ ID NO: 203290 - RNA, 22 nt, Human
cuuggcacccaucuuuccaccu

SEQ ID NO: 203291 - RNA, 18 nt, Human
cuuuagcugucaucuuug

SEQ ID NO: 203292 - RNA, 22 nt, Human
cuggagaucaguuggacaacag

SEQ ID NO: 203293 - RNA, 22 nt, Human
cuggagaacagagcuguuuaga

SEQ ID NO: 203294 - RNA, 22 nt, Human
cuuuaaaaauguauuuuugugg

SEQ ID NO: 203295 - RNA, 22 nt, Human
cuuuccugaaaucucuucugca

SEQ ID NO: 203296 - RNA, 22 nt, Human
cuggaugagcuucgugcgcacg

SEQ ID NO: 203297 - RNA, 22 nt, Human
cuuucuuucaaguucugcuuua

SEQ ID NO: 203298 - RNA, 22 nt, Human
cuggaagcgucggaggaagggc

SEQ ID NO: 203299 - RNA, 22 nt, Human
cuggaauugcuugagcuaggaa

SEQ ID NO: 203300 - RNA, 22 nt, Human
cuuguuaacaauugguaucuuu

SEQ ID NO: 203301 - RNA, 20 nt, Human
cuuguuaaauaugcagguag

SEQ ID NO: 203302 - RNA, 22 nt, Human
cuuguuuuaaacuguuguggcu

SEQ ID NO: 203303 - RNA, 22 nt, Human
cuggaaauggcagaguugcauu

SEQ ID NO: 203304 - RNA, 22 nt, Human
cugauuucaaauggugcuagau

SEQ ID NO: 203305 - RNA, 22 nt, Human
cugcacuggguacauagaaaca

SEQ ID NO: 203306 - RNA, 22 nt, Human
cuuccagugcauagguagauca

SEQ ID NO: 203307 - RNA, 22 nt, Human
cuucauuucaggcugaagaaua

SEQ ID NO: 203308 - RNA, 22 nt, Human
cuucauuacagcaaccauuuga

SEQ ID NO: 203309 - RNA, 22 nt, Human
cuucaggaccugaagcccaucu

SEQ ID NO: 203310 - RNA, 22 nt, Human
cugaugucaaauuuaucaaagc

SEQ ID NO: 203311 - RNA, 21 nt, Human
cugauguaccucaagccuagu

SEQ ID NO: 203312 - RNA, 19 nt, Human
cuucaguguucaccuggcc

SEQ ID NO: 203313 - RNA, 22 nt, Human
cugauggagagugugauuuggg

SEQ ID NO: 203314 - RNA, 20 nt, Human
cugauguucgugcuuccugg

SEQ ID NO: 203315 - RNA, 22 nt, Human
cuucccuacuucagugcucccu

SEQ ID NO: 203316 - RNA, 23 nt, Human
cuucggcgcucgcugggcggagg

SEQ ID NO: 203317 - RNA, 21 nt, Human
cuucgcuguuccagcucuugg

SEQ ID NO: 203318 - RNA, 22 nt, Human
cugccaggagaggccagggccc

SEQ ID NO: 203319 - RNA, 22 nt, Human
cuucucugcugccugccucuuu

SEQ ID NO: 203320 - RNA, 22 nt, Human
cuucucuuggguguggugucuu

SEQ ID NO: 203321 - RNA, 22 nt, Human
cuucuguggcugagaaggcagc

SEQ ID NO: 203322 - RNA, 22 nt, Human
cuucugaugugugcucuuaguu

SEQ ID NO: 203323 - RNA, 22 nt, Human
cuucuuuucuacuggccuagaa

SEQ ID NO: 203324 - RNA, 22 nt, Human
cuucuuuuggggaugaaaaugg

SEQ ID NO: 203325 - RNA, 22 nt, Human
cuucuucuagaagauggggaag

SEQ ID NO: 203326 - RNA, 22 nt, Human
cugcccauggcuccuggcugug

SEQ ID NO: 203327 - RNA, 22 nt, Human
cugcccgcaugcaggaaugcug

SEQ ID NO: 203328 - RNA, 22 nt, Human
cugcccugcagcuccacggacu

SEQ ID NO: 203329 - RNA, 22 nt, Human
cugccgaugcgcaguggcgccu

SEQ ID NO: 203330 - RNA, 22 nt, Human
cugccggcugcugcagagaggu

SEQ ID NO: 203331 - RNA, 22 nt, Human
cuuccuuucagaggaaggccug

SEQ ID NO: 203332 - RNA, 22 nt, Human
cuugccuuugaaagcauuucuc

SEQ ID NO: 203333 - RNA, 22 nt, Human
gaaagugaauguaacauguuau

SEQ ID NO: 203334 - RNA, 22 nt, Human
gaaauaggcccuuacauggaaa

SEQ ID NO: 203335 - RNA, 22 nt, Human
gagagguuaucugcuaagguag

SEQ ID NO: 203336 - RNA, 22 nt, Human
gaaaugggggcaugcguuacau

SEQ ID NO: 203337 - RNA, 22 nt, Human
gaaaugucaagauauguuugga

SEQ ID NO: 203338 - RNA, 22 nt, Human
gaacaaggauucccaaagaaga

SEQ ID NO: 203339 - RNA, 22 nt, Human
gaacaguuucccuguagaaaau

SEQ ID NO: 203340 - RNA, 22 nt, Human
gaacauauuuagcaccuaauau

SEQ ID NO: 203341 - RNA, 22 nt, Human
gagauuugaguuccuacugagu

SEQ ID NO: 203342 - RNA, 22 nt, Human
gagauuguggcagcagcuguuu

SEQ ID NO: 203343 - RNA, 22 nt, Human
gagagugggagauuuccagcag

SEQ ID NO: 203344 - RNA, 22 nt, Human
gagaguuggaggguauguuagu

SEQ ID NO: 203345 - RNA, 22 nt, Human
gagcagcucgagaaggaagcag

SEQ ID NO: 203346 - RNA, 22 nt, Human
gagcagccugaggauucugcuc

SEQ ID NO: 203347 - RNA, 22 nt, Human
gagcagcaggccagguugcagg

SEQ ID NO: 203348 - RNA, 22 nt, Human
gaaccuggcagcccuauaucug

SEQ ID NO: 203349 - RNA, 22 nt, Human
gagcacuucagcauaaaucaca

SEQ ID NO: 203350 - RNA, 22 nt, Human
gagcaacacauugaaugaggau

SEQ ID NO: 203351 - RNA, 22 nt, Human
gagcacauguggagagucuggg

SEQ ID NO: 203352 - RNA, 22 nt, Human
gaacaugaguuuuaugguauuu

SEQ ID NO: 203353 - RNA, 22 nt, Human
gagcaggucucaguucugccuc

SEQ ID NO: 203354 - RNA, 22 nt, Human
gaacuuaauauacaaucaguuc

SEQ ID NO: 203355 - RNA, 22 nt, Human
gaagaugcugcuuguucacggg

SEQ ID NO: 203356 - RNA, 22 nt, Human
gagcagcugagcuggaaugaga

SEQ ID NO: 203357 - RNA, 22 nt, Human
gaacugggguagggguagcuuu

SEQ ID NO: 203358 - RNA, 22 nt, Human
gaacuugagugugcuauuucuu

SEQ ID NO: 203359 - RNA, 22 nt, Human
gaagaagagauaauggggagca

SEQ ID NO: 203360 - RNA, 22 nt, Human
gaaaaaccacaauugguauuuu

SEQ ID NO: 203361 - RNA, 22 nt, Human
gacuggcucuaucaggauaaau

SEQ ID NO: 203362 - RNA, 22 nt, Human
gacuggucuuuugugauggaug

SEQ ID NO: 203363 - RNA, 22 nt, Human
gacugggacucaacccaccauu

SEQ ID NO: 203364 - RNA, 22 nt, Human
gaaaagaaaggaugguaugugu

SEQ ID NO: 203365 - RNA, 22 nt, Human
gaaacguuguggaaaauccucu

SEQ ID NO: 203366 - RNA, 22 nt, Human
gaaagagaugucguuugucuuc

SEQ ID NO: 203367 - RNA, 22 nt, Human
gagaauuauacaugagcuauuu

SEQ ID NO: 203368 - RNA, 22 nt, Human
gaaagcuuggaaacgacuuuau

SEQ ID NO: 203369 - RNA, 22 nt, Human
gaaaggagacugcacuggagcc

SEQ ID NO: 203370 - RNA, 22 nt, Human
gaaagaggcugucagggaaugg

SEQ ID NO: 203371 - RNA, 22 nt, Human
gagaagguggaccugaaggagc

SEQ ID NO: 203372 - RNA, 22 nt, Human
gagaaguagcgucuucccgggg

SEQ ID NO: 203373 - RNA, 22 nt, Human
gagaaggagcagaaaaucuccu

SEQ ID NO: 203374 - RNA, 22 nt, Human
gagaauaauaauaggcauggug

SEQ ID NO: 203375 - RNA, 22 nt, Human
gagaaugagucagagcuggcug

SEQ ID NO: 203376 - RNA, 19 nt, Human
gaauugcacgagcagaggc

SEQ ID NO: 203377 - RNA, 18 nt, Human
gacaaaaguacagacaga

SEQ ID NO: 203378 - RNA, 22 nt, Human
cuuuacauuaauuucuacugau

SEQ ID NO: 203379 - RNA, 22 nt, Human
gacaucuguccauggcacugga

SEQ ID NO: 203380 - RNA, 22 nt, Human
gacauuuauuggauuuuacgag

SEQ ID NO: 203381 - RNA, 22 nt, Human
gaccacugaaugcacuucuaau

SEQ ID NO: 203382 - RNA, 20 nt, Human
gacaugagggagcaaagagc

SEQ ID NO: 203383 - RNA, 22 nt, Human
gacccgacaaguaaucagguga

SEQ ID NO: 203384 - RNA, 22 nt, Human
cuuuuaccuuaauuucgacaca

SEQ ID NO: 203385 - RNA, 20 nt, Human
gacgaacuagaacaguggua

SEQ ID NO: 203386 - RNA, 22 nt, Human
cuuuucauuucauggaauacaa

SEQ ID NO: 203387 - RNA, 22 nt, Human
cuuuuucuugugguuaauaucu

SEQ ID NO: 203388 - RNA, 22 nt, Human
gacgacgggccccguggccacc

SEQ ID NO: 203389 - RNA, 22 nt, Human
gacuacauuugguauugacgag

SEQ ID NO: 203390 - RNA, 22 nt, Human
gacuaaauaaaagccaaacuuc

SEQ ID NO: 203391 - RNA, 22 nt, Human
cuucucuugugauguuagcgga

SEQ ID NO: 203392 - RNA, 22 nt, Human
cuucucuuugacaguugggugu

SEQ ID NO: 203393 - RNA, 22 nt, Human
cuucuggaggcugcagaaaaga

SEQ ID NO: 203394 - RNA, 22 nt, Human
cuucccugucuacaacccugcc

SEQ ID NO: 203395 - RNA, 22 nt, Human
cuucuggaggcucuagaggaga

SEQ ID NO: 203396 - RNA, 22 nt, Human
cuucuucaucuuuuggaggaac

SEQ ID NO: 203397 - RNA, 22 nt, Human
cuucuuaaaguugucacagcug

SEQ ID NO: 203398 - RNA, 22 nt, Human
gaaggauaauuuugcuggaugu

SEQ ID NO: 203399 - RNA, 22 nt, Human
gaaggaagcugucuggaugugu

SEQ ID NO: 203400 - RNA, 22 nt, Human
gaaggcagucuggggagcagcc

SEQ ID NO: 203401 - RNA, 22 nt, Human
cuuccguuacugacaaaauguu

SEQ ID NO: 203402 - RNA, 22 nt, Human
cuucaugucacugucuuaggua

SEQ ID NO: 203403 - RNA, 22 nt, Human
cuucaguuaguuucaugugagc

SEQ ID NO: 203404 - RNA, 22 nt, Human
cuucauccguaccacggccaca

SEQ ID NO: 203405 - RNA, 22 nt, Human
cuucauaagauuguugugagga

SEQ ID NO: 203406 - RNA, 22 nt, Human
gaaggaaaagacgugcuaagua

SEQ ID NO: 203407 - RNA, 22 nt, Human
gaagcuucgaaagagugauuuc

SEQ ID NO: 203408 - RNA, 22 nt, Human
gaagcgugcagguccguauacu

SEQ ID NO: 203409 - RNA, 22 nt, Human
cuucagcgucgucaguguugcu

SEQ ID NO: 203410 - RNA, 22 nt, Human
gaagcggguucacuggauggcu

SEQ ID NO: 203411 - RNA, 22 nt, Human
gaagcgucaugaaagaaaggcu

SEQ ID NO: 203412 - RNA, 22 nt, Human
gaauaauuuugaucagaaggga

SEQ ID NO: 203413 - RNA, 22 nt, Human
cuucuuucuuuucuucuucucu

SEQ ID NO: 203414 - RNA, 20 nt, Human
gaaucuggucaaaugucuau

SEQ ID NO: 203415 - RNA, 22 nt, Human
gaaucucuuugucccugaguuu

SEQ ID NO: 203416 - RNA, 22 nt, Human
cuugcucugggaauaugaguuu

SEQ ID NO: 203417 - RNA, 22 nt, Human
gaaugacuugcucauucugugu

SEQ ID NO: 203418 - RNA, 22 nt, Human
gaaugcacacgugugugcaugc

SEQ ID NO: 203419 - RNA, 22 nt, Human
cuugcuguccgaugggucugua

SEQ ID NO: 203420 - RNA, 21 nt, Human
cuuggagacucuuggccacau

SEQ ID NO: 203421 - RNA, 22 nt, Human
cuugcuuuaucugguuucucau

SEQ ID NO: 203422 - RNA, 22 nt, Human
gaauggagaacccuggacacug

SEQ ID NO: 203423 - RNA, 22 nt, Human
gaauggaugcuggucaguuugg

SEQ ID NO: 203424 - RNA, 22 nt, Human
gaaugccugggguucuucgauc

SEQ ID NO: 203425 - RNA, 22 nt, Human
gaauccccugucggaacagugg

SEQ ID NO: 203426 - RNA, 22 nt, Human
cuuggugcgaagagucagggga

SEQ ID NO: 203427 - RNA, 21 nt, Human
cuuuggcaagggagaagucac

SEQ ID NO: 203428 - RNA, 19 nt, Human
cuuugugguuuucagaacu

SEQ ID NO: 203429 - RNA, 22 nt, Human
cuggaugucugggaggcuuccc

SEQ ID NO: 203430 - RNA, 22 nt, Human
cuggccaggugggggguagugg

SEQ ID NO: 203431 - RNA, 22 nt, Human
cuggauuaaacaguuugauacu

SEQ ID NO: 203432 - RNA, 22 nt, Human
cuggcaguguccagcucgugau

SEQ ID NO: 203433 - RNA, 22 nt, Human
gaaagcauucuggaggggcaga

SEQ ID NO: 203434 - RNA, 22 nt, Human
cugugcauguucucuagcugau

SEQ ID NO: 203435 - RNA, 22 nt, Human
cugugcuguuaagaaauuuagu

SEQ ID NO: 203436 - RNA, 22 nt, Human
cuguggcuaggaagcuguggga

SEQ ID NO: 203437 - RNA, 22 nt, Human
cugugucucccaaggaggguca

SEQ ID NO: 203438 - RNA, 22 nt, Human
gaaagggggcuuggacacuggc

SEQ ID NO: 203439 - RNA, 22 nt, Human
cuguguggccuaaguggagaca

SEQ ID NO: 203440 - RNA, 23 nt, Human
cuuauauaaucauuagaaaccau

SEQ ID NO: 203441 - RNA, 20 nt, Human
cuuaugcaaaauguuaggga

SEQ ID NO: 203442 - RNA, 22 nt, Human
gaagcaccuggacggugccugg

SEQ ID NO: 203443 - RNA, 22 nt, Human
cuguuacggaggcuuucuaguu

SEQ ID NO: 203444 - RNA, 22 nt, Human
cuguucagugcauauguauuga

SEQ ID NO: 203445 - RNA, 22 nt, Human
cuguucuccacuccugacuucu

SEQ ID NO: 203446 - RNA, 22 nt, Human
cuguuuggcuuccacugcuucu

SEQ ID NO: 203447 - RNA, 22 nt, Human
cuguuucuuugcugucagagag

SEQ ID NO: 203448 - RNA, 22 nt, Human
cccaggaaugagcaggcagggg

SEQ ID NO: 203449 - RNA, 22 nt, Human
cccagccuuugcuuccugguuc

SEQ ID NO: 203450 - RNA, 22 nt, Human
cccagccgcuguggucuagggu

SEQ ID NO: 203451 - RNA, 22 nt, Human
cccagcuggcaaaggcguccuu

SEQ ID NO: 203452 - RNA, 22 nt, Human
cccagcugaacuugcauuccaa

SEQ ID NO: 203453 - RNA, 22 nt, Human
ccagcaggagacuagcaacaua

SEQ ID NO: 203454 - RNA, 22 nt, Human
ccagcaucagcucuuggcuggc

SEQ ID NO: 203455 - RNA, 22 nt, Human
ccagccacagcuuccagcuccu

SEQ ID NO: 203456 - RNA, 20 nt, Human
ccccagcauccuuuucaucu

SEQ ID NO: 203457 - RNA, 22 nt, Human
cccagccgaaugcucccuuccc

SEQ ID NO: 203458 - RNA, 22 nt, Human
cccagcccaucauuccugcaaa

SEQ ID NO: 203459 - RNA, 22 nt, Human
cauauuaugcauguuguucuuu

SEQ ID NO: 203460 - RNA, 22 nt, Human
caugucaagacugaagauccag

SEQ ID NO: 203461 - RNA, 22 nt, Human
caucaaaugcaagagcguucuu

SEQ ID NO: 203462 - RNA, 23 nt, Human
cauauucagaaacaccuaguggu

SEQ ID NO: 203463 - RNA, 22 nt, Human
ccagggcggacaaggucuuuga

SEQ ID NO: 203464 - RNA, 22 nt, Human
ccaggcccugcuccucacacca

SEQ ID NO: 203465 - RNA, 22 nt, Human
cccgggccgagucuuccagcga

SEQ ID NO: 203466 - RNA, 22 nt, Human
cccggcucggcuucuuccccac

SEQ ID NO: 203467 - RNA, 22 nt, Human
ccaggcagaggggucuggagca

SEQ ID NO: 203468 - RNA, 22 nt, Human
cccgaaaauuguuguacugcag

SEQ ID NO: 203469 - RNA, 22 nt, Human
cccggagcagucgggcuccggg

SEQ ID NO: 203470 - RNA, 22 nt, Human
cccgccggccacaccggccgcc

SEQ ID NO: 203471 - RNA, 22 nt, Human
cccgacuccuccugguaccuaa

SEQ ID NO: 203472 - RNA, 22 nt, Human
cccccucuuccccucauugcuu

SEQ ID NO: 203473 - RNA, 22 nt, Human
cccccauccccugaaggagcug

SEQ ID NO: 203474 - RNA, 22 nt, Human
ccagccugccaagcccagcccu

SEQ ID NO: 203475 - RNA, 22 nt, Human
ccagcaugcucagucuaaauug

SEQ ID NO: 203476 - RNA, 22 nt, Human
ccccacaugaauacaguguagu

SEQ ID NO: 203477 - RNA, 22 nt, Human
ccagccugagcuugcugcccuc

SEQ ID NO: 203478 - RNA, 22 nt, Human
ccagcugcugcaccgugcaugg

SEQ ID NO: 203479 - RNA, 23 nt, Human
ccagcugugccuggcccaggagc

SEQ ID NO: 203480 - RNA, 22 nt, Human
ccagcucgaggcaggggcugca

SEQ ID NO: 203481 - RNA, 22 nt, Human
ccccugcucagggaggagaccg

SEQ ID NO: 203482 - RNA, 22 nt, Human
ccauguaagcuggacuccuggg

SEQ ID NO: 203483 - RNA, 22 nt, Human
ccaugugaccugugucaguugc

SEQ ID NO: 203484 - RNA, 22 nt, Human
ccauuuuccuguauggacucga

SEQ ID NO: 203485 - RNA, 18 nt, Human
cccaccugcccagguuca

SEQ ID NO: 203486 - RNA, 22 nt, Human
ccgauuuauucugacaguuuau

SEQ ID NO: 203487 - RNA, 22 nt, Human
ccgauuuaugucucugacuuga

SEQ ID NO: 203488 - RNA, 22 nt, Human
ccgcagggcccggcgggcucag

SEQ ID NO: 203489 - RNA, 22 nt, Human
ccgcagucugcaaucucccugg

SEQ ID NO: 203490 - RNA, 22 nt, Human
ccgcaccgucugccauacacgc

SEQ ID NO: 203491 - RNA, 21 nt, Human
ccgaggagugcggggagcccc

SEQ ID NO: 203492 - RNA, 22 nt, Human
ccgaggaguagggugucuacgg

SEQ ID NO: 203493 - RNA, 22 nt, Human
ccauggccaauugcaccuugcu

SEQ ID NO: 203494 - RNA, 22 nt, Human
ccaucccugagucacaggaggg

SEQ ID NO: 203495 - RNA, 22 nt, Human
ccauggaaaagacgggcaggcc

SEQ ID NO: 203496 - RNA, 22 nt, Human
ccaugauguugccuacacugcu

SEQ ID NO: 203497 - RNA, 22 nt, Human
ccaugaggcaaagacugauaua

SEQ ID NO: 203498 - RNA, 21 nt, Human
cccuugccugcacuccucggc

SEQ ID NO: 203499 - RNA, 21 nt, Human
ccgacggcgcagaugccggcc

SEQ ID NO: 203500 - RNA, 22 nt, Human
ccgaaaaacagaaucuuggaac

SEQ ID NO: 203501 - RNA, 22 nt, Human
cccuuuuuuauggaguuggcca

SEQ ID NO: 203502 - RNA, 22 nt, Human
ccagucagccuaguucuucuuu

SEQ ID NO: 203503 - RNA, 22 nt, Human
ccagguggacggcgaguacagg

SEQ ID NO: 203504 - RNA, 22 nt, Human
ccagggcuggguuugucggugu

SEQ ID NO: 203505 - RNA, 22 nt, Human
ccagggucggcaucagcguggg

SEQ ID NO: 203506 - RNA, 22 nt, Human
ccagggcuggaggaggucagga

SEQ ID NO: 203507 - RNA, 22 nt, Human
cccgugggaugagaggcccugg

SEQ ID NO: 203508 - RNA, 22 nt, Human
cccuaaucuuggaaaugccauu

SEQ ID NO: 203509 - RNA, 22 nt, Human
cccuccagugucccagugggga

SEQ ID NO: 203510 - RNA, 22 nt, Human
ccagucuuggugucuguagcac

SEQ ID NO: 203511 - RNA, 22 nt, Human
ccaguguguuuuucucugacuc

SEQ ID NO: 203512 - RNA, 22 nt, Human
cccuguccugcuaggcccuggu

SEQ ID NO: 203513 - RNA, 22 nt, Human
cccuguccuucccuccaucuga

SEQ ID NO: 203514 - RNA, 22 nt, Human
cccugcacuguguggacucugg

SEQ ID NO: 203515 - RNA, 22 nt, Human
ccagugcagacgcggaacuggc

SEQ ID NO: 203516 - RNA, 22 nt, Human
ccgugcaguuucucacacacau

SEQ ID NO: 203517 - RNA, 22 nt, Human
ccgguguggguuucucgguagu

SEQ ID NO: 203518 - RNA, 22 nt, Human
ccguccgcuccuccagccgcug

SEQ ID NO: 203519 - RNA, 22 nt, Human
cccaugacucucauucacaguc

SEQ ID NO: 203520 - RNA, 22 nt, Human
cccagggguugaggccguaggg

SEQ ID NO: 203521 - RNA, 22 nt, Human
ccccaggcagcccuccaggagc

SEQ ID NO: 203522 - RNA, 22 nt, Human
ccucacaaagaaugucuagaca

SEQ ID NO: 203523 - RNA, 22 nt, Human
ccuauauuacaggcuugcucua

SEQ ID NO: 203524 - RNA, 22 nt, Human
ccuauuuucaaaauuguuuauc

SEQ ID NO: 203525 - RNA, 22 nt, Human
ccguuugugcugcaggagaucg

SEQ ID NO: 203526 - RNA, 23 nt, Human
ccccugcauggcaccacauuccc

SEQ ID NO: 203527 - RNA, 18 nt, Human
ccccucuuccagacagag

SEQ ID NO: 203528 - RNA, 22 nt, Human
cccagcaccauaacucaggccu

SEQ ID NO: 203529 - RNA, 22 nt, Human
ccgcuggccgacuuccgagagc

SEQ ID NO: 203530 - RNA, 22 nt, Human
ccgcucgggugcagagggcaga

SEQ ID NO: 203531 - RNA, 16 nt, Human
cccaccuggacuaccu

SEQ ID NO: 203532 - RNA, 22 nt, Human
cccagaagaguauguguuugcu

SEQ ID NO: 203533 - RNA, 22 nt, Human
ccgcgcccccggcugugccccc

SEQ ID NO: 203534 - RNA, 22 nt, Human
ccgcggcagaggcgggggcgcc

SEQ ID NO: 203535 - RNA, 22 nt, Human
ccgcggcuguaguggaggugga

SEQ ID NO: 203536 - RNA, 22 nt, Human
ccggauuugggagccaccaggg

SEQ ID NO: 203537 - RNA, 22 nt, Human
ccggcggaaacauggcggcgcc

SEQ ID NO: 203538 - RNA, 22 nt, Human
ccggcugagccucgccgcggcc

SEQ ID NO: 203539 - RNA, 22 nt, Human
cccagccugaucucggccagcu

SEQ ID NO: 203540 - RNA, 22 nt, Human
cccagcuuugcggacccgggag

SEQ ID NO: 203541 - RNA, 22 nt, Human
cccagcgccugcccuccgccgc

SEQ ID NO: 203542 - RNA, 22 nt, Human
ccggguucuuguucuaggaugu

SEQ ID NO: 203543 - RNA, 19 nt, Human
ccggucaugcauuccuuug

SEQ ID NO: 203544 - RNA, 22 nt, Human
cccaggccguguaaucagcagc

SEQ ID NO: 203545 - RNA, 22 nt, Human
ccgggcuuccuuagagcaagau

SEQ ID NO: 203546 - RNA, 19 nt, Human
ccuccgcauccucaucugu

SEQ ID NO: 203547 - RNA, 22 nt, Human
ccucccuucccggcauggcucu

SEQ ID NO: 203548 - RNA, 22 nt, Human
cccgcucaccccacuccaccag

SEQ ID NO: 203549 - RNA, 22 nt, Human
cccggcgccucguuuccuaguc

SEQ ID NO: 203550 - RNA, 22 nt, Human
ccuccuuuccuguuuuccugag

SEQ ID NO: 203551 - RNA, 22 nt, Human
ccuccuuucaggaaguaggugg

SEQ ID NO: 203552 - RNA, 19 nt, Human
cccgauggagacuuagcag

SEQ ID NO: 203553 - RNA, 22 nt, Human
ccccuuuguagcccagcaguug

SEQ ID NO: 203554 - RNA, 22 nt, Human
ccucuccuugcuccccuuccuu

SEQ ID NO: 203555 - RNA, 22 nt, Human
cccuccgccagugcccgccccg

SEQ ID NO: 203556 - RNA, 22 nt, Human
cccgguggagaugugggacagg

SEQ ID NO: 203557 - RNA, 23 nt, Human
cccgggaagugcugcuuaucugg

SEQ ID NO: 203558 - RNA, 22 nt, Human
cccgguugggguuccagggcgc

SEQ ID NO: 203559 - RNA, 22 nt, Human
cccgggcucuggcagaggcggu

SEQ ID NO: 203560 - RNA, 22 nt, Human
ccucuaugcccuucuggggguc

SEQ ID NO: 203561 - RNA, 22 nt, Human
cccugaggcccacaagucccag

SEQ ID NO: 203562 - RNA, 22 nt, Human
ccucucugcgaaugcugauagu

SEQ ID NO: 203563 - RNA, 20 nt, Human
ccucucugcaugcucccuga

SEQ ID NO: 203564 - RNA, 22 nt, Human
ccugaagaugguugauccccuu

SEQ ID NO: 203565 - RNA, 22 nt, Human
cccuggucucugacuugauccu

SEQ ID NO: 203566 - RNA, 22 nt, Human
ccugagacucuccugugcagcc

SEQ ID NO: 203567 - RNA, 22 nt, Human
ccugacuugguuuaggagaugg

SEQ ID NO: 203568 - RNA, 22 nt, Human
ccugacucugauuucgcugcau

SEQ ID NO: 203569 - RNA, 20 nt, Human
cccuggcuggcaucuggacu

SEQ ID NO: 203570 - RNA, 22 nt, Human
cccuggcucaggcagcuuuguu

SEQ ID NO: 203571 - RNA, 22 nt, Human
cccugggccccgaacugcugag

SEQ ID NO: 203572 - RNA, 22 nt, Human
ccugaccauuugccacaugggu

SEQ ID NO: 203573 - RNA, 20 nt, Human
cccuggaaugagaugcauau

SEQ ID NO: 203574 - RNA, 22 nt, Human
ccugccagaaaagagggaguuc

SEQ ID NO: 203575 - RNA, 22 nt, Human
ccugccugggcucacuugccag

SEQ ID NO: 203576 - RNA, 22 nt, Human
ccugcucccccugcaagccuug

SEQ ID NO: 203577 - RNA, 18 nt, Human
ccugcguggauguccucu

SEQ ID NO: 203578 - RNA, 22 nt, Human
ccugcugagccuggugggcagc

SEQ ID NO: 203579 - RNA, 19 nt, Human
ccugcugaagugaugcagc

SEQ ID NO: 203580 - RNA, 22 nt, Human
cccuuuuuugccauuccuuccu

SEQ ID NO: 203581 - RNA, 19 nt, Human
cucuggcuccugggcugcc

SEQ ID NO: 203582 - RNA, 22 nt, Human
cucuggagggaggcugagcugg

SEQ ID NO: 203583 - RNA, 22 nt, Human
cucuggacaucugcggugcuuc

SEQ ID NO: 203584 - RNA, 22 nt, Human
cucuccagucauauucucaguc

SEQ ID NO: 203585 - RNA, 22 nt, Human
cucuccaguuauagcugauuug

SEQ ID NO: 203586 - RNA, 22 nt, Human
cucuggggaagugcacucgcug

SEQ ID NO: 203587 - RNA, 22 nt, Human
cucuguauauugagugcuuacu

SEQ ID NO: 203588 - RNA, 22 nt, Human
cucuguugucaguggaagcagc

SEQ ID NO: 203589 - RNA, 22 nt, Human
cucuguguguuugugugugugu

SEQ ID NO: 203590 - RNA, 22 nt, Human
cucuuucauucuguccuuguuu

SEQ ID NO: 203591 - RNA, 22 nt, Human
cucuucugugggugcuauguca

SEQ ID NO: 203592 - RNA, 22 nt, Human
cucuuuguauucuagaagcucu

SEQ ID NO: 203593 - RNA, 22 nt, Human
cugaaacuauggggaggggagc

SEQ ID NO: 203594 - RNA, 22 nt, Human
cggcgcugguacaguggaagag

SEQ ID NO: 203595 - RNA, 22 nt, Human
cggcgccccgcgcgggcggcuc

SEQ ID NO: 203596 - RNA, 22 nt, Human
cugaaacucaagauaggaggaa

SEQ ID NO: 203597 - RNA, 22 nt, Human
cggcugcagcggagcaggcugg

SEQ ID NO: 203598 - RNA, 22 nt, Human
cgggaggcggagcuccgcgggg

SEQ ID NO: 203599 - RNA, 22 nt, Human
cgggagcagcucuggggcuggg

SEQ ID NO: 203600 - RNA, 22 nt, Human
cggggcaaggggggcuggugga

SEQ ID NO: 203601 - RNA, 20 nt, Human
cgggacacucaagcucuggg

SEQ ID NO: 203602 - RNA, 22 nt, Human
cgggagagacagaggaggcgcc

SEQ ID NO: 203603 - RNA, 22 nt, Human
cggcuucucgggucggauuccg

SEQ ID NO: 203604 - RNA, 22 nt, Human
cugaaagcaaaguaauucuuaa

SEQ ID NO: 203605 - RNA, 22 nt, Human
cugaagaaagaaaauggccauc

SEQ ID NO: 203606 - RNA, 22 nt, Human
cggggcucugcacaggccagga

SEQ ID NO: 203607 - RNA, 22 nt, Human
cugaaucugccuccgaggguuu

SEQ ID NO: 203608 - RNA, 22 nt, Human
cugaccgugccgcgguacugcu

SEQ ID NO: 203609 - RNA, 20 nt, Human
cugaccagcagccugucucc

SEQ ID NO: 203610 - RNA, 22 nt, Human
cugacagaucuggaucugaacu

SEQ ID NO: 203611 - RNA, 22 nt, Human
cugaaggacacgugaggagcca

SEQ ID NO: 203612 - RNA, 22 nt, Human
cugaaggcuuugaauggaauga

SEQ ID NO: 203613 - RNA, 20 nt, Human
cugaauaccacagagccauc

SEQ ID NO: 203614 - RNA, 22 nt, Human
cggggucuggaguuguggugug

SEQ ID NO: 203615 - RNA, 22 nt, Human
cggggggguuggaaaagggaga

SEQ ID NO: 203616 - RNA, 22 nt, Human
cgggucgcacaggagaaaggcg

SEQ ID NO: 203617 - RNA, 19 nt, Human
cgguaugaauguacuaugg

SEQ ID NO: 203618 - RNA, 23 nt, Human
cgagagccugcaggaccuucgga

SEQ ID NO: 203619 - RNA, 22 nt, Human
cgaccccugaaaauggcagcca

SEQ ID NO: 203620 - RNA, 22 nt, Human
cuauaagguguuucuauugguc

SEQ ID NO: 203621 - RNA, 22 nt, Human
cuaguuuucacaaaggaagggc

SEQ ID NO: 203622 - RNA, 22 nt, Human
cuaauugcuggcugcuggcaga

SEQ ID NO: 203623 - RNA, 22 nt, Human
cuauguuuugcuagugaugggu

SEQ ID NO: 203624 - RNA, 22 nt, Human
cuauuaauggccaggagucaug

SEQ ID NO: 203625 - RNA, 22 nt, Human
cgccuggccccgcagcgcuugu

SEQ ID NO: 203626 - RNA, 22 nt, Human
cuauaauuguacuuguuuuuua

SEQ ID NO: 203627 - RNA, 22 nt, Human
cuauaucuguggauaguguaug

SEQ ID NO: 203628 - RNA, 22 nt, Human
cuauauucuggaauguccauuu

SEQ ID NO: 203629 - RNA, 22 nt, Human
cuauugguaucacacugauuuc

SEQ ID NO: 203630 - RNA, 19 nt, Human
cgcugcucccgcuguggcu

SEQ ID NO: 203631 - RNA, 22 nt, Human
cucagcugcuuuguuuugcuuu

SEQ ID NO: 203632 - RNA, 22 nt, Human
cucaggaaaauauugaagaagu

SEQ ID NO: 203633 - RNA, 22 nt, Human
cucagaugcacacaggugaggg

SEQ ID NO: 203634 - RNA, 22 nt, Human
cgcucggcuuucccuccgccgg

SEQ ID NO: 203635 - RNA, 22 nt, Human
cgcucggugagccaguggcgga

SEQ ID NO: 203636 - RNA, 22 nt, Human
cuccaucccccugugugucaau

SEQ ID NO: 203637 - RNA, 22 nt, Human
cuccaggcccagggccaagagc

SEQ ID NO: 203638 - RNA, 22 nt, Human
cuccagucccuccuugcccagc

SEQ ID NO: 203639 - RNA, 22 nt, Human
cuccuggagcagcaggcgcagg

SEQ ID NO: 203640 - RNA, 22 nt, Human
cuccugcuuuuucuucuuccga

SEQ ID NO: 203641 - RNA, 22 nt, Human
cgcuuugacuuuagaaggccaa

SEQ ID NO: 203642 - RNA, 22 nt, Human
cggaagcacuagacacugacac

SEQ ID NO: 203643 - RNA, 22 nt, Human
cggacugaccugcucggggaga

SEQ ID NO: 203644 - RNA, 22 nt, Human
cggagagacaagucugcuuugg

SEQ ID NO: 203645 - RNA, 22 nt, Human
cucggaggaccuguuuuaugca

SEQ ID NO: 203646 - RNA, 22 nt, Human
cucuaaauguggucugcagaua

SEQ ID NO: 203647 - RNA, 22 nt, Human
cggccuuuggcuucuccugugu

SEQ ID NO: 203648 - RNA, 22 nt, Human
cggccuuugcccgucauucugg

SEQ ID NO: 203649 - RNA, 22 nt, Human
cucuauucuaauggauucuggg

SEQ ID NO: 203650 - RNA, 22 nt, Human
cucuauuuuuucaucuuucagg

SEQ ID NO: 203651 - RNA, 22 nt, Human
cucgccugacucggaugggcug

SEQ ID NO: 203652 - RNA, 22 nt, Human
cuccuuuuugggaccgugcagc

SEQ ID NO: 203653 - RNA, 22 nt, Human
cuccuuuuccuacucauacuau

SEQ ID NO: 203654 - RNA, 22 nt, Human
ccugugacucugucugaugguc

SEQ ID NO: 203655 - RNA, 22 nt, Human
ccugucuuuucugaucauacua

SEQ ID NO: 203656 - RNA, 22 nt, Human
cggggcggcgagcgggccgggc

SEQ ID NO: 203657 - RNA, 22 nt, Human
ccugugcuucacucaacaagcc

SEQ ID NO: 203658 - RNA, 22 nt, Human
ccugggcauaaaucacuccaag

SEQ ID NO: 203659 - RNA, 22 nt, Human
ccugggugaugugcugcccucg

SEQ ID NO: 203660 - RNA, 22 nt, Human
ccugggcauuuguuucacaggu

SEQ ID NO: 203661 - RNA, 20 nt, Human
ccugggcuccaggagccccg

SEQ ID NO: 203662 - RNA, 22 nt, Human
ccuggcccugcugcuugccagc

SEQ ID NO: 203663 - RNA, 23 nt, Human
ccuggcugaccugaagguguagu

SEQ ID NO: 203664 - RNA, 22 nt, Human
cggcuacccaugucauauucgu

SEQ ID NO: 203665 - RNA, 22 nt, Human
ccuguuccaacccucccuggcu

SEQ ID NO: 203666 - RNA, 22 nt, Human
cggggcuggcguuagggaggca

SEQ ID NO: 203667 - RNA, 19 nt, Human
cggggcuugguggguucuc

SEQ ID NO: 203668 - RNA, 22 nt, Human
cggggcgggcgugggaggugga

SEQ ID NO: 203669 - RNA, 22 nt, Human
cggggugugacggugcgggccu

SEQ ID NO: 203670 - RNA, 22 nt, Human
cgguggcccauuguacgcagcu

SEQ ID NO: 203671 - RNA, 19 nt, Human
cggugcugauuggugcagu

SEQ ID NO: 203672 - RNA, 22 nt, Human
cggucggagagaaugaccugga

SEQ ID NO: 203673 - RNA, 22 nt, Human
cgggucgagugcuguaguucga

SEQ ID NO: 203674 - RNA, 19 nt, Human
cggugaagagaguuuagau

SEQ ID NO: 203675 - RNA, 22 nt, Human
cggucuauuguguaucauuuca

SEQ ID NO: 203676 - RNA, 22 nt, Human
ccuucccagacggcucagcugu

SEQ ID NO: 203677 - RNA, 22 nt, Human
ccuuuuaagggagacuagagau

SEQ ID NO: 203678 - RNA, 22 nt, Human
ccuuuuagagaagugcauccag

SEQ ID NO: 203679 - RNA, 20 nt, Human
ccuuuuguugcuguuuggau

SEQ ID NO: 203680 - RNA, 22 nt, Human
cgugugugugcgugugcgugug

SEQ ID NO: 203681 - RNA, 22 nt, Human
ccuuuuguuucccuuuauguuc

SEQ ID NO: 203682 - RNA, 20 nt, Human
cguugccagcccggcccggg

SEQ ID NO: 203683 - RNA, 17 nt, Human
cguuccagaacaaauga

SEQ ID NO: 203684 - RNA, 22 nt, Human
cuaaaaauguucuaguaguuca

SEQ ID NO: 203685 - RNA, 22 nt, Human
cuaagaaggaggaaaagugcca

SEQ ID NO: 203686 - RNA, 22 nt, Human
cgaaggaaucacuuaacacuuu

SEQ ID NO: 203687 - RNA, 22 nt, Human
cgaacggcagagagcccguccc

SEQ ID NO: 203688 - RNA, 22 nt, Human
cgacagauuauuuugugacugc

SEQ ID NO: 203689 - RNA, 19 nt, Human
cgacauggguaaugggaga

SEQ ID NO: 203690 - RNA, 22 nt, Human
cgacaagagaaaugcuuuguuu

SEQ ID NO: 203691 - RNA, 22 nt, Human
cgcucugccugcccuaacuucc

SEQ ID NO: 203692 - RNA, 22 nt, Human
cgcuagggagcacuuggcagug

SEQ ID NO: 203693 - RNA, 22 nt, Human
cgccugucugcauggccacugg

SEQ ID NO: 203694 - RNA, 22 nt, Human
cgcgggcuugggcaccugcgga

SEQ ID NO: 203695 - RNA, 22 nt, Human
ccugaaaugaguucugcucacu

SEQ ID NO: 203696 - RNA, 22 nt, Human
ccucuuuugaaccaguucuuca

SEQ ID NO: 203697 - RNA, 22 nt, Human
ccucuggacuugggacagugag

SEQ ID NO: 203698 - RNA, 22 nt, Human
ccugaauuuaucugaauggugg

SEQ ID NO: 203699 - RNA, 22 nt, Human
ccugacagcgugucccuggccc

SEQ ID NO: 203700 - RNA, 22 nt, Human
cgcgcgguguuccgcauucugc

SEQ ID NO: 203701 - RNA, 22 nt, Human
ccugccagccugccaucccaca

SEQ ID NO: 203702 - RNA, 22 nt, Human
ccugcaguuuuuccaugauaca

SEQ ID NO: 203703 - RNA, 22 nt, Human
ccugcaugacuuugucagaccu

SEQ ID NO: 203704 - RNA, 22 nt, Human
cggcggcgaaccgaccugggug

SEQ ID NO: 203705 - RNA, 22 nt, Human
ccugcugcugaugcuguuucac

SEQ ID NO: 203706 - RNA, 22 nt, Human
ccugcuggagucuaguuggucu

SEQ ID NO: 203707 - RNA, 22 nt, Human
ccgccacggggcaugggaggca

SEQ ID NO: 203708 - RNA, 22 nt, Human
ccgccccaggcccugagccaag

SEQ ID NO: 203709 - RNA, 22 nt, Human
ccucaggaauuuauucuucugu

SEQ ID NO: 203710 - RNA, 22 nt, Human
ccugccuuccagcucuggggag

SEQ ID NO: 203711 - RNA, 22 nt, Human
ccugcucuaauucauucaugcu

SEQ ID NO: 203712 - RNA, 22 nt, Human
cgcacuugugagcgacagggcu

SEQ ID NO: 203713 - RNA, 22 nt, Human
cgccaaccaggcuguccuccca

SEQ ID NO: 203714 - RNA, 22 nt, Human
cgccaguggcagcuggaacagg

SEQ ID NO: 203715 - RNA, 22 nt, Human
ccucaucagaaagcagaaagca

SEQ ID NO: 203716 - RNA, 22 nt, Human
cgacuacuaacuacuguagaaa

SEQ ID NO: 203717 - RNA, 22 nt, Human
cgacgacaggcgcccgaggagg

SEQ ID NO: 203718 - RNA, 22 nt, Human
uuuuuuuguagguguaugaaaa

SEQ ID NO: 203719 - RNA, 22 nt, Human
uuuuugggaagaauucugauau

SEQ ID NO: 203720 - RNA, 22 nt, Human
uuuuugcuuuuuugucaucuaa

SEQ ID NO: 203721 - RNA, 22 nt, Human
uuuuugcccuaaagaagucauu

SEQ ID NO: 203722 - RNA, 21 nt, Human
uuuuucuccagaguuuccacu

SEQ ID NO: 203723 - RNA, 22 nt, Human
uuuuucuccauuccaggugccu

SEQ ID NO: 203724 - RNA, 22 nt, Human
uuuuugaauaagugcaucauca

SEQ ID NO: 203725 - RNA, 22 nt, Human
uuuuucugccucucucccacau

SEQ ID NO: 203726 - RNA, 22 nt, Human
uuuuuuguggcuggaagaaaaa

SEQ ID NO: 203727 - RNA, 22 nt, Human
uuuuuugucuugaagaaauggu

SEQ ID NO: 203728 - RNA, 22 nt, Human
uuuuuugguuuggggauuauuu

SEQ ID NO: 203729 - RNA, 22 nt, Human
uuuuuuuaaguuuugauuuuag

SEQ ID NO: 203730 - RNA, 22 nt, Human
uuuuuuuagaaagaucauaguu

SEQ ID NO: 203731 - RNA, 22 nt, Human
uuuuuuccuguuugucuuuggg

SEQ ID NO: 203732 - RNA, 22 nt, Human
uuuuuuccagcuucuagaggcc

SEQ ID NO: 203733 - RNA, 22 nt, Human
uuuuuguuauuuagguguagag

SEQ ID NO: 203734 - RNA, 22 nt, Human
uuuuuguggggggcggugugaa

SEQ ID NO: 203735 - RNA, 20 nt, Human
uuuuuuaaauagagcuguug

SEQ ID NO: 203736 - RNA, 22 nt, Human
uuuuuuaaucaaguaggaaaca

SEQ ID NO: 203737 - RNA, 22 nt, Human
uuuguucuucucaugcacacaa

SEQ ID NO: 203738 - RNA, 22 nt, Human
uuuguucuagauaacugguaau

SEQ ID NO: 203739 - RNA, 21 nt, Human
uuuguucaggggcaaaguuaa

SEQ ID NO: 203740 - RNA, 22 nt, Human
uuuguucaccuagcaaacuuuu

SEQ ID NO: 203741 - RNA, 23 nt, Human
uuuguugguuuaagaguagcaga

SEQ ID NO: 203742 - RNA, 22 nt, Human
uuuguuuuggugucaugcguga

SEQ ID NO: 203743 - RNA, 22 nt, Human
uuuuaaaacaugucaaaaugug

SEQ ID NO: 203744 - RNA, 22 nt, Human
uuuguugucuucauaauacuuu

SEQ ID NO: 203745 - RNA, 19 nt, Human
uuuaaugugugcugcaauc

SEQ ID NO: 203746 - RNA, 19 nt, Human
uuuacuuaggccacagaau

SEQ ID NO: 203747 - RNA, 22 nt, Human
uuuacuguuuacagcuaaugca

SEQ ID NO: 203748 - RNA, 22 nt, Human
uuuguguuggaagaaaugcuac

SEQ ID NO: 203749 - RNA, 21 nt, Human
uuuguucacacacagggcagc

SEQ ID NO: 203750 - RNA, 22 nt, Human
uuuguuaugguuggaagcagga

SEQ ID NO: 203751 - RNA, 22 nt, Human
uuuguguuuugaggucuugcaa

SEQ ID NO: 203752 - RNA, 22 nt, Human
uuuuaaaagguugcuguuauaa

SEQ ID NO: 203753 - RNA, 22 nt, Human
uuuuaaauaaacuacacugauu

SEQ ID NO: 203754 - RNA, 22 nt, Human
uuuuaauaguauaucuagacac

SEQ ID NO: 203755 - RNA, 22 nt, Human
uuuuaaauggcuuuuacuuuuc

SEQ ID NO: 203756 - RNA, 23 nt, Human
uuuuaauaguaugacaugagcug

SEQ ID NO: 203757 - RNA, 22 nt, Human
uuuuaauccucuugguaucuua

SEQ ID NO: 203758 - RNA, 22 nt, Human
uuuuacauuuuauucguuuauu

SEQ ID NO: 203759 - RNA, 22 nt, Human
uuuuaucuuacauggaaucucc

SEQ ID NO: 203760 - RNA, 22 nt, Human
uuuuauuuguauguugaaugua

SEQ ID NO: 203761 - RNA, 22 nt, Human
uuuucaaucaaguuuauuuaua

SEQ ID NO: 203762 - RNA, 22 nt, Human
uuuucaauuuucauuugcaaga

SEQ ID NO: 203763 - RNA, 22 nt, Human
uuuucacugacuuggucuggaa

SEQ ID NO: 203764 - RNA, 22 nt, Human
uuuuagccagcaucugggucga

SEQ ID NO: 203765 - RNA, 22 nt, Human
uuuuagccagaguuuaucacag

SEQ ID NO: 203766 - RNA, 22 nt, Human
uuuuagagacagcauggagaaa

SEQ ID NO: 203767 - RNA, 22 nt, Human
uuuugaugaccauucuucuuuu

SEQ ID NO: 203768 - RNA, 22 nt, Human
uuuucuugagucacuccaguga

SEQ ID NO: 203769 - RNA, 22 nt, Human
uuuucucuuugcuucucuaaaa

SEQ ID NO: 203770 - RNA, 22 nt, Human
uuuucuguuuaugaaauugugu

SEQ ID NO: 203771 - RNA, 22 nt, Human
uuuucuaggcccuggauuaugu

SEQ ID NO: 203772 - RNA, 22 nt, Human
uuuuccuucugauacuccauuu

SEQ ID NO: 203773 - RNA, 22 nt, Human
uuuuccuuagaaauacauugau

SEQ ID NO: 203774 - RNA, 22 nt, Human
uuuugcuucuaguauauuuuuu

SEQ ID NO: 203775 - RNA, 22 nt, Human
uuuuguggacugugagggugca

SEQ ID NO: 203776 - RNA, 22 nt, Human
uuuuguggacugauccgaggac

SEQ ID NO: 203777 - RNA, 22 nt, Human
uuuuguagauagggaaacagag

SEQ ID NO: 203778 - RNA, 22 nt, Human
uuuugucagggcaggaggaaga

SEQ ID NO: 203779 - RNA, 22 nt, Human
uuuuuauaagauuuaaaaugua

SEQ ID NO: 203780 - RNA, 22 nt, Human
uuuuuagcuguuauuguggaag

SEQ ID NO: 203781 - RNA, 22 nt, Human
uuuuuagggauuaguguuugag

SEQ ID NO: 203782 - RNA, 22 nt, Human
uuuuuaccugguguccagcuuc

SEQ ID NO: 203783 - RNA, 22 nt, Human
uuuuuagcauaugucaaaucag

SEQ ID NO: 203784 - RNA, 22 nt, Human
uuuuuaauuuuaagcuauuugu

SEQ ID NO: 203785 - RNA, 22 nt, Human
uuuuuaagguuuguuuauauau

SEQ ID NO: 203786 - RNA, 22 nt, Human
uuuuguuacugauuauuaaaau

SEQ ID NO: 203787 - RNA, 22 nt, Human
uuuuuaaaagaugauuuaauga

SEQ ID NO: 203788 - RNA, 22 nt, Human
gaggggcgaggacgcugaagua

SEQ ID NO: 203789 - RNA, 22 nt, Human
gaggggcuccagguguugagga

SEQ ID NO: 203790 - RNA, 22 nt, Human
gcagaugagagugugaucuggg

SEQ ID NO: 203791 - RNA, 22 nt, Human
gcagcaaucuucacagugucau

SEQ ID NO: 203792 - RNA, 20 nt, Human
gcagcagacagacaggggac

SEQ ID NO: 203793 - RNA, 22 nt, Human
gaggggggcacuuguuuugacu

SEQ ID NO: 203794 - RNA, 22 nt, Human
gagggugugguauggauguguu

SEQ ID NO: 203795 - RNA, 22 nt, Human
gaggggcugggguugacuccaa

SEQ ID NO: 203796 - RNA, 22 nt, Human
gagggggaaaagggcagcagag

SEQ ID NO: 203797 - RNA, 22 nt, Human
gcagaggcaaagucuggaugac

SEQ ID NO: 203798 - RNA, 22 nt, Human
gcagagcacccugcagugguau

SEQ ID NO: 203799 - RNA, 22 nt, Human
gaggggaaggagcgaaggcggg

SEQ ID NO: 203800 - RNA, 22 nt, Human
gaggggcaagaaguuggccucu

SEQ ID NO: 203801 - RNA, 22 nt, Human
gcagauaaaauuuuugauggga

SEQ ID NO: 203802 - RNA, 22 nt, Human
gcagcauuaccaagacauggca

SEQ ID NO: 203803 - RNA, 22 nt, Human
gcagccauggcuggccgggcau

SEQ ID NO: 203804 - RNA, 22 nt, Human
gcagccaugcacgucauuauga

SEQ ID NO: 203805 - RNA, 22 nt, Human
gaggguuagauuuuaagaaaga

SEQ ID NO: 203806 - RNA, 22 nt, Human
gcagccauuugcaucuaauuaa

SEQ ID NO: 203807 - RNA, 22 nt, Human
gagguagaggaaaagauuauca

SEQ ID NO: 203808 - RNA, 22 nt, Human
gaggguuucagugggacggguu

SEQ ID NO: 203809 - RNA, 22 nt, Human
gaggucggaagugaggguaacu

SEQ ID NO: 203810 - RNA, 22 nt, Human
gcaggacugauggagcauaugu

SEQ ID NO: 203811 - RNA, 22 nt, Human
gcaggaagauugcagaaggcug

SEQ ID NO: 203812 - RNA, 22 nt, Human
gcaggaaugguacauaccuguu

SEQ ID NO: 203813 - RNA, 22 nt, Human
gcagcguuaacauuuuuccugu

SEQ ID NO: 203814 - RNA, 22 nt, Human
gcagcucagcacgcacagguaa

SEQ ID NO: 203815 - RNA, 20 nt, Human
gcagcugacccuagugcuug

SEQ ID NO: 203816 - RNA, 22 nt, Human
gcagccugaguuuagcucgucg

SEQ ID NO: 203817 - RNA, 22 nt, Human
gaggccagcacccagaugcaug

SEQ ID NO: 203818 - RNA, 22 nt, Human
gaggccauguggcccgggcugc

SEQ ID NO: 203819 - RNA, 22 nt, Human
gcaccgagaaggaagcaugccu

SEQ ID NO: 203820 - RNA, 22 nt, Human
gcacauaugcuguaagcacaug

SEQ ID NO: 203821 - RNA, 22 nt, Human
gcacccagggcaggaagugagg

SEQ ID NO: 203822 - RNA, 22 nt, Human
gcacaggcugcacgaccccagc

SEQ ID NO: 203823 - RNA, 22 nt, Human
gcacagucaacacuuauucacc

SEQ ID NO: 203824 - RNA, 22 nt, Human
gcaccacccaaaggcggggcuc

SEQ ID NO: 203825 - RNA, 22 nt, Human
gaggcagaggaugggacuguau

SEQ ID NO: 203826 - RNA, 22 nt, Human
gaggaugacaaagaaggcagac

SEQ ID NO: 203827 - RNA, 22 nt, Human
gaggauuugagggucacuccac

SEQ ID NO: 203828 - RNA, 22 nt, Human
gcacucuguggagacaagauag

SEQ ID NO: 203829 - RNA, 22 nt, Human
gcacucugggucaucugcugcc

SEQ ID NO: 203830 - RNA, 22 nt, Human
gaggcggcgacgcgggcccggg

SEQ ID NO: 203831 - RNA, 22 nt, Human
gaggcggugguggcgagaguca

SEQ ID NO: 203832 - RNA, 22 nt, Human
gaggcgcgcugcgagggcgcgg

SEQ ID NO: 203833 - RNA, 22 nt, Human
gagggagagaugcuggaccggg

SEQ ID NO: 203834 - RNA, 22 nt, Human
gcacagcuaugagcugaauugu

SEQ ID NO: 203835 - RNA, 22 nt, Human
gcacacuguaugcugguauuug

SEQ ID NO: 203836 - RNA, 22 nt, Human
gaggaggucaccuggugagcaa

SEQ ID NO: 203837 - RNA, 22 nt, Human
gaggaggagacggaggccuggg

SEQ ID NO: 203838 - RNA, 22 nt, Human
gcacaaaagguacuucauguag

SEQ ID NO: 203839 - RNA, 22 nt, Human
gaggaggacauuggaaagaacu

SEQ ID NO: 203840 - RNA, 22 nt, Human
gaggagcugggucagggagaca

SEQ ID NO: 203841 - RNA, 22 nt, Human
gaggagcggugcaugugggggc

SEQ ID NO: 203842 - RNA, 22 nt, Human
gcaauagccuacaugcgucaga

SEQ ID NO: 203843 - RNA, 22 nt, Human
gaggagcaggcaggaucugguc

SEQ ID NO: 203844 - RNA, 22 nt, Human
gaggagaaacagccgugauagu

SEQ ID NO: 203845 - RNA, 22 nt, Human
gaggacugguugggaaugugaa

SEQ ID NO: 203846 - RNA, 22 nt, Human
gagcagguuauuagaaauggaa

SEQ ID NO: 203847 - RNA, 22 nt, Human
gagcaggucuuugguaaugcuu

SEQ ID NO: 203848 - RNA, 22 nt, Human
gagcaggcuggcagggccaggg

SEQ ID NO: 203849 - RNA, 22 nt, Human
gagcagggagaggcagagaggc

SEQ ID NO: 203850 - RNA, 22 nt, Human
gauguuggugcauucacuucug

SEQ ID NO: 203851 - RNA, 22 nt, Human
gauuaucaccaaauggccuccu

SEQ ID NO: 203852 - RNA, 19 nt, Human
gagcaugacuggccuugca

SEQ ID NO: 203853 - RNA, 22 nt, Human
gagcaugacgcaacaccaagug

SEQ ID NO: 203854 - RNA, 22 nt, Human
gagcaguuagggaccgcaggcu

SEQ ID NO: 203855 - RNA, 22 nt, Human
gagccgcagcugcguagggucc

SEQ ID NO: 203856 - RNA, 22 nt, Human
gauucagagcugcaacaaagaa

SEQ ID NO: 203857 - RNA, 22 nt, Human
gagccauggaggaugugcagca

SEQ ID NO: 203858 - RNA, 22 nt, Human
gauucugaaauuaacagacugg

SEQ ID NO: 203859 - RNA, 20 nt, Human
gauuuaacgcugcgucuguc

SEQ ID NO: 203860 - RNA, 22 nt, Human
gauugggagugugacauuguau

SEQ ID NO: 203861 - RNA, 22 nt, Human
gauugauuuaauaugagaggau

SEQ ID NO: 203862 - RNA, 22 nt, Human
gauugcauaugcauucugauac

SEQ ID NO: 203863 - RNA, 22 nt, Human
gauuccuuucgccugccgagcu

SEQ ID NO: 203864 - RNA, 22 nt, Human
gagcgacucuuuuaguccagag

SEQ ID NO: 203865 - RNA, 22 nt, Human
gagcgcacagaaggaagcagcc

SEQ ID NO: 203866 - RNA, 22 nt, Human
gagccggggcucccugaggucc

SEQ ID NO: 203867 - RNA, 22 nt, Human
gagccuggagcuggaacgaagc

SEQ ID NO: 203868 - RNA, 19 nt, Human
gagccgcucccgcagccgg

SEQ ID NO: 203869 - RNA, 22 nt, Human
gauuuucauuauagcuaguuuc

SEQ ID NO: 203870 - RNA, 22 nt, Human
gauuuuaaaagauguauaaggu

SEQ ID NO: 203871 - RNA, 22 nt, Human
gaggaaaauggaguguaauuaa

SEQ ID NO: 203872 - RNA, 21 nt, Human
gcaaccagaccacagggcagu

SEQ ID NO: 203873 - RNA, 22 nt, Human
gagcuggagaaacacauaagaa

SEQ ID NO: 203874 - RNA, 22 nt, Human
gagcuggacauacaggaaacca

SEQ ID NO: 203875 - RNA, 22 nt, Human
gagcggcggugagaaguguggg

SEQ ID NO: 203876 - RNA, 22 nt, Human
gagcggcucaguggccauguga

SEQ ID NO: 203877 - RNA, 22 nt, Human
gagauuaauuaaaaccuuuaug

SEQ ID NO: 203878 - RNA, 22 nt, Human
gagauggauuuuuuugccaguc

SEQ ID NO: 203879 - RNA, 22 nt, Human
gagaugugguucaaggguguuu

SEQ ID NO: 203880 - RNA, 22 nt, Human
gagauuucauuugugaggcuca

SEQ ID NO: 203881 - RNA, 22 nt, Human
gagagucuuaaguuacagaacu

SEQ ID NO: 203882 - RNA, 22 nt, Human
gagaucuguguuugcugaagcu

SEQ ID NO: 203883 - RNA, 22 nt, Human
gauggugcaauuaucgugcaug

SEQ ID NO: 203884 - RNA, 22 nt, Human
gauggugauggcccuaagcuga

SEQ ID NO: 203885 - RNA, 22 nt, Human
gaugguaucugcuggcuuucag

SEQ ID NO: 203886 - RNA, 22 nt, Human
gaugguagauauagaaagggga

SEQ ID NO: 203887 - RNA, 22 nt, Human
gauggguuugagauguuugggu

SEQ ID NO: 203888 - RNA, 22 nt, Human
gagcagcacagaccaaacagaa

SEQ ID NO: 203889 - RNA, 22 nt, Human
gagcagacugcacaguucuugc

SEQ ID NO: 203890 - RNA, 22 nt, Human
gaugguuuuacauuuuaauguu

SEQ ID NO: 203891 - RNA, 22 nt, Human
gauguaucugagcugcuuaggu

SEQ ID NO: 203892 - RNA, 20 nt, Human
gagaauuccagguuucugug

SEQ ID NO: 203893 - RNA, 22 nt, Human
gagcccuguagcaagucauguc

SEQ ID NO: 203894 - RNA, 22 nt, Human
gagccaugagauaagagcaccu

SEQ ID NO: 203895 - RNA, 22 nt, Human
gagagaaggaagugaauuuccc

SEQ ID NO: 203896 - RNA, 23 nt, Human
gaugauggcaacuacauccggug

SEQ ID NO: 203897 - RNA, 22 nt, Human
gaugauugaauaaauaugguca

SEQ ID NO: 203898 - RNA, 22 nt, Human
gaugauuuuguaacuggggaca

SEQ ID NO: 203899 - RNA, 22 nt, Human
gagagcugucagcguagcaccg

SEQ ID NO: 203900 - RNA, 22 nt, Human
gagaggcugagcaguccggguu

SEQ ID NO: 203901 - RNA, 22 nt, Human
gagaggguugggaggcagcaga

SEQ ID NO: 203902 - RNA, 22 nt, Human
gagagaguaucugcugguucac

SEQ ID NO: 203903 - RNA, 22 nt, Human
gagagaggggaagagaagcucu

SEQ ID NO: 203904 - RNA, 22 nt, Human
gaugcauccuuucugucuucuc

SEQ ID NO: 203905 - RNA, 22 nt, Human
gagaggugaagcuaauuaauuu

SEQ ID NO: 203906 - RNA, 20 nt, Human
gagaggguuaggauauuugc

SEQ ID NO: 203907 - RNA, 22 nt, Human
gauggacgguuuuaccagacag

SEQ ID NO: 203908 - RNA, 22 nt, Human
gauggcauucacaaacuuaacu

SEQ ID NO: 203909 - RNA, 22 nt, Human
gauggcaaugcuagaaauuuag

SEQ ID NO: 203910 - RNA, 22 nt, Human
gauuucauaaaacgagaaacuc

SEQ ID NO: 203911 - RNA, 22 nt, Human
gauuggucacacaauaguauau

SEQ ID NO: 203912 - RNA, 21 nt, Human
gccgugcgccuccaggcgcgc

SEQ ID NO: 203913 - RNA, 22 nt, Human
gccguuccuacucucucugugu

SEQ ID NO: 203914 - RNA, 22 nt, Human
gccggguguuccugggaagaug

SEQ ID NO: 203915 - RNA, 22 nt, Human
gccgcgggucugggucuggcuc

SEQ ID NO: 203916 - RNA, 22 nt, Human
gauugcugccagcguguccgug

SEQ ID NO: 203917 - RNA, 22 nt, Human
gauugcaucaauauuuagagua

SEQ ID NO: 203918 - RNA, 22 nt, Human
gccgggagugcagcgggcgcgc

SEQ ID NO: 203919 - RNA, 22 nt, Human
gccggcccugcgcggggcggaa

SEQ ID NO: 203920 - RNA, 22 nt, Human
gauugauguaggugauaaaucu

SEQ ID NO: 203921 - RNA, 22 nt, Human
gccgccgcucaccugggcgccg

SEQ ID NO: 203922 - RNA, 15 nt, Human
gccgcgcuggggagc

SEQ ID NO: 203923 - RNA, 21 nt, Human
gccgaugugacucuacguagu

SEQ ID NO: 203924 - RNA, 22 nt, Human
gccgcaacggacccugggaguc

SEQ ID NO: 203925 - RNA, 22 nt, Human
gccgcagauucugagacgugua

SEQ ID NO: 203926 - RNA, 22 nt, Human
gaugguggaggaaucgcugaag

SEQ ID NO: 203927 - RNA, 22 nt, Human
gaugguggggggcagcugggag

SEQ ID NO: 203928 - RNA, 22 nt, Human
gcccugaagagguagagaauuu

SEQ ID NO: 203929 - RNA, 22 nt, Human
gccuuuauauuacauuuggaag

SEQ ID NO: 203930 - RNA, 23 nt, Human
gcacuguuugaggagcacugugc

SEQ ID NO: 203931 - RNA, 22 nt, Human
gcacuguauuuaaauauuuaaa

SEQ ID NO: 203932 - RNA, 22 nt, Human
gccugggccgggcgcggccccc

SEQ ID NO: 203933 - RNA, 20 nt, Human
gccugggagaagaucaggga

SEQ ID NO: 203934 - RNA, 22 nt, Human
gccuggcagggagauuguaaga

SEQ ID NO: 203935 - RNA, 22 nt, Human
gcacagaguguaaaaguuucau

SEQ ID NO: 203936 - RNA, 22 nt, Human
gcacagauaaucugccuuacca

SEQ ID NO: 203937 - RNA, 22 nt, Human
gccugagucaagauguggcacc

SEQ ID NO: 203938 - RNA, 22 nt, Human
gccugcaaagacuuccuucucu

SEQ ID NO: 203939 - RNA, 21 nt, Human
gccugcuguucacccugccac

SEQ ID NO: 203940 - RNA, 22 nt, Human
gccuggccaaucgccgucuagg

SEQ ID NO: 203941 - RNA, 22 nt, Human
gccuagaagaaugagcgcaggg

SEQ ID NO: 203942 - RNA, 22 nt, Human
gauuugucuauauucaaauaug

SEQ ID NO: 203943 - RNA, 22 nt, Human
gcaaaugacuuagucacuccag

SEQ ID NO: 203944 - RNA, 22 nt, Human
gcaacccugggucaugguugac

SEQ ID NO: 203945 - RNA, 22 nt, Human
gcaaagaauugauucauuuugc

SEQ ID NO: 203946 - RNA, 22 nt, Human
gcaaaaacaguguagucuucug

SEQ ID NO: 203947 - RNA, 22 nt, Human
gcaacguauauggguaaggaua

SEQ ID NO: 203948 - RNA, 22 nt, Human
gcaagagaagaaagaauaguuu

SEQ ID NO: 203949 - RNA, 22 nt, Human
gcaacuccuaggcgaggccuuc

SEQ ID NO: 203950 - RNA, 22 nt, Human
gagguuggagggcugcccugca

SEQ ID NO: 203951 - RNA, 19 nt, Human
gaguaaaacuagagagaaa

SEQ ID NO: 203952 - RNA, 22 nt, Human
gcagcuuuggagguggaacucu

SEQ ID NO: 203953 - RNA, 22 nt, Human
gagguucgauacagcguauuua

SEQ ID NO: 203954 - RNA, 22 nt, Human
gagguuauucuucuaucaguau

SEQ ID NO: 203955 - RNA, 20 nt, Human
gcauggcuggcugcugucug

SEQ ID NO: 203956 - RNA, 22 nt, Human
gcauggaaaagggaugcuaacu

SEQ ID NO: 203957 - RNA, 22 nt, Human
gaguuggggcugcguguuucca

SEQ ID NO: 203958 - RNA, 22 nt, Human
gaguuucacguagaucaggguc

SEQ ID NO: 203959 - RNA, 22 nt, Human
gcauuuaaauuugaacuucaga

SEQ ID NO: 203960 - RNA, 20 nt, Human
gauagcacaaagagaauggg

SEQ ID NO: 203961 - RNA, 22 nt, Human
gcauuagacuaguacacggcag

SEQ ID NO: 203962 - RNA, 22 nt, Human
gauagcacacuuguugcuucug

SEQ ID NO: 203963 - RNA, 22 nt, Human
gcaugguuuccugcaacguucu

SEQ ID NO: 203964 - RNA, 22 nt, Human
gcaugguuagacaucaauguga

SEQ ID NO: 203965 - RNA, 22 nt, Human
gcauguucaaguuaguauauuu

SEQ ID NO: 203966 - RNA, 22 nt, Human
gauagaaagagaaucagaacuu

SEQ ID NO: 203967 - RNA, 22 nt, Human
gauaccugccaagcugcacuca

SEQ ID NO: 203968 - RNA, 22 nt, Human
gaugccggggucguagccgugg

SEQ ID NO: 203969 - RNA, 22 nt, Human
gccauguuuugguaaauaccau

SEQ ID NO: 203970 - RNA, 22 nt, Human
gcccgccaacuugccagcggug

SEQ ID NO: 203971 - RNA, 22 nt, Human
gccauggugagccaccuggugg

SEQ ID NO: 203972 - RNA, 22 nt, Human
gaugccuccaggaaagaggacg

SEQ ID NO: 203973 - RNA, 22 nt, Human
gccaucuucggcagccgccugg

SEQ ID NO: 203974 - RNA, 22 nt, Human
gaugcuaauuaaugaagaggag

SEQ ID NO: 203975 - RNA, 22 nt, Human
gaugcucuugauuggaccaggg

SEQ ID NO: 203976 - RNA, 19 nt, Human
gauauugagcugagaauuc

SEQ ID NO: 203977 - RNA, 22 nt, Human
gcauuuuaauuggggcaguuag

SEQ ID NO: 203978 - RNA, 22 nt, Human
gaugauuccuuuguucauugug

SEQ ID NO: 203979 - RNA, 22 nt, Human
gccaguaaaguaucuccuuuug

SEQ ID NO: 203980 - RNA, 22 nt, Human
gaugauaacagcauuucaacug

SEQ ID NO: 203981 - RNA, 22 nt, Human
gccaggugauuucaaaguccuu

SEQ ID NO: 203982 - RNA, 22 nt, Human
gauauuaguuuuggaaggaggg

SEQ ID NO: 203983 - RNA, 22 nt, Human
gcggcaguccuuccaguacagg

SEQ ID NO: 203984 - RNA, 22 nt, Human
gcggcccggguccccagcagca

SEQ ID NO: 203985 - RNA, 22 nt, Human
gcagccagggaccuuugacuau

SEQ ID NO: 203986 - RNA, 23 nt, Human
gcagccaacccacgugagagaag

SEQ ID NO: 203987 - RNA, 22 nt, Human
gcagccaauggcgagccccaca

SEQ ID NO: 203988 - RNA, 22 nt, Human
gcaggacuucuguuuaaccagu

SEQ ID NO: 203989 - RNA, 22 nt, Human
gcggguggaggagggacgggca

SEQ ID NO: 203990 - RNA, 22 nt, Human
gcgguguuuuaacacucccucg

SEQ ID NO: 203991 - RNA, 22 nt, Human
gcagcgcugagaugauuuguug

SEQ ID NO: 203992 - RNA, 22 nt, Human
gcggcggcggaggcgggggcag

SEQ ID NO: 203993 - RNA, 22 nt, Human
gcagcguguggcuaauggcucu

SEQ ID NO: 203994 - RNA, 22 nt, Human
gcgggccggcaggggaggaguu

SEQ ID NO: 203995 - RNA, 22 nt, Human
gcggcuggcuguccaaacuggg

SEQ ID NO: 203996 - RNA, 22 nt, Human
gcggcgucccagcuccgacggc

SEQ ID NO: 203997 - RNA, 19 nt, Human
gcggcggugccggcuggga

SEQ ID NO: 203998 - RNA, 22 nt, Human
gcgugcauguguguaugcgugu

SEQ ID NO: 203999 - RNA, 22 nt, Human
gcguggaugauuuugagucggu

SEQ ID NO: 204000 - RNA, 22 nt, Human
gcgugcauggccguguguaugc

SEQ ID NO: 204001 - RNA, 22 nt, Human
gcguggccugcugaaggacuuc

SEQ ID NO: 204002 - RNA, 22 nt, Human
gcaggggguaaggggcagggcu

SEQ ID NO: 204003 - RNA, 22 nt, Human
gcgugugugauaugccucugca

SEQ ID NO: 204004 - RNA, 22 nt, Human
gcguguauuccagaccuuaacg

SEQ ID NO: 204005 - RNA, 22 nt, Human
gcuacaaaaccagggcaaagga

SEQ ID NO: 204006 - RNA, 22 nt, Human
gcuacaaauaaaaugggugacu

SEQ ID NO: 204007 - RNA, 22 nt, Human
gcaguuaccuauuuuguagaaa

SEQ ID NO: 204008 - RNA, 22 nt, Human
gcuauacuugccuccucuccac

SEQ ID NO: 204009 - RNA, 22 nt, Human
gcaguugguccagccucggcug

SEQ ID NO: 204010 - RNA, 22 nt, Human
gcuauuggcuaauuguugcaac

SEQ ID NO: 204011 - RNA, 22 nt, Human
gcaguuguagcuguuucuacuc

SEQ ID NO: 204012 - RNA, 22 nt, Human
gcauaaaggacuauaaggauca

SEQ ID NO: 204013 - RNA, 22 nt, Human
gcauaacaacagacucuguguu

SEQ ID NO: 204014 - RNA, 22 nt, Human
gcaucuguuagagugugcaugc

SEQ ID NO: 204015 - RNA, 22 nt, Human
gcaucuguuguguuaauuuaca

SEQ ID NO: 204016 - RNA, 22 nt, Human
gcucaacuucuaggacuucagg

SEQ ID NO: 204017 - RNA, 22 nt, Human
gcucaaggucacacagggguga

SEQ ID NO: 204018 - RNA, 21 nt, Human
gcucccgaagugcucggcguu

SEQ ID NO: 204019 - RNA, 22 nt, Human
gcugccucacuagauagguaug

SEQ ID NO: 204020 - RNA, 22 nt, Human
gccagucgucuuuauuacagcu

SEQ ID NO: 204021 - RNA, 22 nt, Human
gccaguuuguuuacugaugguu

SEQ ID NO: 204022 - RNA, 22 nt, Human
gcugcuuagaaccauauuuaaa

SEQ ID NO: 204023 - RNA, 22 nt, Human
gccaggcggcccaggagauggc

SEQ ID NO: 204024 - RNA, 22 nt, Human
gcugcucaaaaaaacacuagcu

SEQ ID NO: 204025 - RNA, 22 nt, Human
gcugcuggcggagcuggcgcug

SEQ ID NO: 204026 - RNA, 22 nt, Human
gcuggaaauaacuuguguagaa

SEQ ID NO: 204027 - RNA, 22 nt, Human
gcuggaagggccagcuuucagg

SEQ ID NO: 204028 - RNA, 22 nt, Human
gccaucugcuuagauugcuggg

SEQ ID NO: 204029 - RNA, 22 nt, Human
gcuggauaaggaucaguuucuu

SEQ ID NO: 204030 - RNA, 22 nt, Human
gcuggcgauggccgagucuccg

SEQ ID NO: 204031 - RNA, 22 nt, Human
gcccagaagguagcgaguaguc

SEQ ID NO: 204032 - RNA, 22 nt, Human
gcccagacaucuguugggaccu

SEQ ID NO: 204033 - RNA, 21 nt, Human
gcuggcugucucuuacacggu

SEQ ID NO: 204034 - RNA, 22 nt, Human
gccaugguggggccucccugac

SEQ ID NO: 204035 - RNA, 22 nt, Human
gccauguucuugaaucuggguc

SEQ ID NO: 204036 - RNA, 22 nt, Human
gcucuggcuacuguggcuaccg

SEQ ID NO: 204037 - RNA, 22 nt, Human
gcucugaacugucaugaauugg

SEQ ID NO: 204038 - RNA, 22 nt, Human
gcucugcuccaucuguuuccuc

SEQ ID NO: 204039 - RNA, 22 nt, Human
gcugcacgguccuggcaccacg

SEQ ID NO: 204040 - RNA, 22 nt, Human
gcauuucauaaccagccaugcu

SEQ ID NO: 204041 - RNA, 23 nt, Human
gcauuugcaggaaacuggaaaag

SEQ ID NO: 204042 - RNA, 22 nt, Human
gcugauucuucugcuuuuucuc

SEQ ID NO: 204043 - RNA, 23 nt, Human
gcugcagugaauguuguuguugu

SEQ ID NO: 204044 - RNA, 22 nt, Human
gcugcccucccagggcaagcuu

SEQ ID NO: 204045 - RNA, 19 nt, Human
gccacguuggcuaguugcc

SEQ ID NO: 204046 - RNA, 22 nt, Human
gcugcagggagcuggaaggcuc

SEQ ID NO: 204047 - RNA, 19 nt, Human
gccacccaucauauggagg

SEQ ID NO: 204048 - RNA, 22 nt, Human
gccaaccagucgguccaggaag

SEQ ID NO: 204049 - RNA, 22 nt, Human
gccagcuuagaucccccagccc

SEQ ID NO: 204050 - RNA, 16 nt, Human
gccagauugaacuuug

SEQ ID NO: 204051 - RNA, 22 nt, Human
gcugcgccgggagccggggccg

SEQ ID NO: 204052 - RNA, 23 nt, Human
gcugccguuucccaucgugguga

SEQ ID NO: 204053 - RNA, 22 nt, Human
gcugcgcgcagccggcgccgag

SEQ ID NO: 204054 - RNA, 22 nt, Human
gccacucaguuuaggggcaagc

SEQ ID NO: 204055 - RNA, 22 nt, Human
gggucuggagauccgggugaag

SEQ ID NO: 204056 - RNA, 20 nt, Human
gggucuggcaucucucucug

SEQ ID NO: 204057 - RNA, 22 nt, Human
ggaggcggaaguccaagcaggu

SEQ ID NO: 204058 - RNA, 22 nt, Human
ggguauuugacaaacugacacu

SEQ ID NO: 204059 - RNA, 22 nt, Human
ggguacaccaauggaugccagg

SEQ ID NO: 204060 - RNA, 22 nt, Human
ggauaaaugaaggcauacagau

SEQ ID NO: 204061 - RNA, 22 nt, Human
ggaguucaaaucuuuuggaucu

SEQ ID NO: 204062 - RNA, 22 nt, Human
ggaguucaaaucuggaccuugc

SEQ ID NO: 204063 - RNA, 22 nt, Human
ggggcguugccacggggacggg

SEQ ID NO: 204064 - RNA, 22 nt, Human
ggggcgaguguggaccgcagcc

SEQ ID NO: 204065 - RNA, 22 nt, Human
ggggcggcgugggcgcggugau

SEQ ID NO: 204066 - RNA, 22 nt, Human
ggggugaggcagggcagggguc

SEQ ID NO: 204067 - RNA, 22 nt, Human
gggguaggaagagaaaauagug

SEQ ID NO: 204068 - RNA, 22 nt, Human
ggggucugaucccuucuggcuu

SEQ ID NO: 204069 - RNA, 22 nt, Human
gggguauuugguagacauuuug

SEQ ID NO: 204070 - RNA, 22 nt, Human
ggagaugaaugugguaaaacug

SEQ ID NO: 204071 - RNA, 22 nt, Human
ggggcugggaggccggcgcgca

SEQ ID NO: 204072 - RNA, 17 nt, Human
ggggcguguauuugaug

SEQ ID NO: 204073 - RNA, 22 nt, Human
ggagaaacuaguuagauccaau

SEQ ID NO: 204074 - RNA, 22 nt, Human
ggggaaggaaggggagggcacg

SEQ ID NO: 204075 - RNA, 22 nt, Human
gggcugagagcuggaaucugag

SEQ ID NO: 204076 - RNA, 22 nt, Human
gggcugcuccgcccgcugcgcc

SEQ ID NO: 204077 - RNA, 22 nt, Human
gggcuguggggccugcagaagg

SEQ ID NO: 204078 - RNA, 22 nt, Human
ggacauggccguaguccccacg

SEQ ID NO: 204079 - RNA, 22 nt, Human
ggggaauuaaaugagaagccuu

SEQ ID NO: 204080 - RNA, 22 nt, Human
ggggacuugguuuuaaugagcu

SEQ ID NO: 204081 - RNA, 22 nt, Human
ggggaggaagcuggaacacggg

SEQ ID NO: 204082 - RNA, 22 nt, Human
ggagaagaggagcuggaagccu

SEQ ID NO: 204083 - RNA, 17 nt, Human
ggacuuucugccugucc

SEQ ID NO: 204084 - RNA, 22 nt, Human
ggagagcguggaugggcuucca

SEQ ID NO: 204085 - RNA, 22 nt, Human
ggagaccaauuaaugaaggaau

SEQ ID NO: 204086 - RNA, 22 nt, Human
ggaagucuacucuuccgaaaac

SEQ ID NO: 204087 - RNA, 22 nt, Human
ggaaggugagugcugugugauu

SEQ ID NO: 204088 - RNA, 22 nt, Human
ggaaagagaaacaugaacuaga

SEQ ID NO: 204089 - RNA, 22 nt, Human
gggcaguuucaugugguucaac

SEQ ID NO: 204090 - RNA, 22 nt, Human
gggcaugcagcaauucuguggu

SEQ ID NO: 204091 - RNA, 22 nt, Human
ggaacaguacucggaggccaga

SEQ ID NO: 204092 - RNA, 17 nt, Human
ggaagaaaaggaucauc

SEQ ID NO: 204093 - RNA, 22 nt, Human
gggcggugccugucuccgaagc

SEQ ID NO: 204094 - RNA, 22 nt, Human
gggcggggcuuccguccuccac

SEQ ID NO: 204095 - RNA, 22 nt, Human
gggcggggggagcuggaaugaa

SEQ ID NO: 204096 - RNA, 22 nt, Human
ggaaguggauucagggcugcua

SEQ ID NO: 204097 - RNA, 22 nt, Human
gggcgcgcggagccucgccggg

SEQ ID NO: 204098 - RNA, 22 nt, Human
ggacaauuguacucgauuucaa

SEQ ID NO: 204099 - RNA, 22 nt, Human
ggacagacagcauggaaccaua

SEQ ID NO: 204100 - RNA, 22 nt, Human
gcuuuguugauggugagucugu

SEQ ID NO: 204101 - RNA, 21 nt, Human
gggaggagcuucccuuugccc

SEQ ID NO: 204102 - RNA, 22 nt, Human
gcuguggaaaaugggucuccaa

SEQ ID NO: 204103 - RNA, 22 nt, Human
gcuguggacacagcucucuuca

SEQ ID NO: 204104 - RNA, 22 nt, Human
gcuguggcuccaauggugagcc

SEQ ID NO: 204105 - RNA, 22 nt, Human
gggagcugagcuggaagagaau

SEQ ID NO: 204106 - RNA, 22 nt, Human
gcuuuggcuucuccuggcagga

SEQ ID NO: 204107 - RNA, 22 nt, Human
gggauuaaaaaucaccaaagua

SEQ ID NO: 204108 - RNA, 22 nt, Human
ggaaaagccauauuauaggcaa

SEQ ID NO: 204109 - RNA, 22 nt, Human
gggauguauguuuguguggaga

SEQ ID NO: 204110 - RNA, 22 nt, Human
gggauggggagcuggaaagggg

SEQ ID NO: 204111 - RNA, 22 nt, Human
gggaggucgaggcugggccgca

SEQ ID NO: 204112 - RNA, 22 nt, Human
gggagggucugagagcugcacc

SEQ ID NO: 204113 - RNA, 22 nt, Human
gggaguauguccgggcucuaga

SEQ ID NO: 204114 - RNA, 22 nt, Human
ggaaaaugcugaagcaucugaa

SEQ ID NO: 204115 - RNA, 22 nt, Human
gggcaagagaggaagagauggc

SEQ ID NO: 204116 - RNA, 22 nt, Human
gggcaagaggguuugacaugag

SEQ ID NO: 204117 - RNA, 22 nt, Human
ggccugcucuggcuguggucag

SEQ ID NO: 204118 - RNA, 22 nt, Human
ggccuucuuuucaugucuuucg

SEQ ID NO: 204119 - RNA, 22 nt, Human
ggccuggccuccugcuuuucca

SEQ ID NO: 204120 - RNA, 22 nt, Human
ggccugagaagcaaggacacaa

SEQ ID NO: 204121 - RNA, 20 nt, Human
ggccugagcauggcuggcag

SEQ ID NO: 204122 - RNA, 18 nt, Human
ggccucagccuggccgga

SEQ ID NO: 204123 - RNA, 22 nt, Human
ggccgggugggaggcagcggag

SEQ ID NO: 204124 - RNA, 22 nt, Human
ggccgccgcuuagcugagcccc

SEQ ID NO: 204125 - RNA, 22 nt, Human
ggccgccacuuuccagugcugc

SEQ ID NO: 204126 - RNA, 22 nt, Human
guacuuccauccacauauaugu

SEQ ID NO: 204127 - RNA, 22 nt, Human
guagagcagaaacauggagaaa

SEQ ID NO: 204128 - RNA, 22 nt, Human
guagaauggggcucucaaagca

SEQ ID NO: 204129 - RNA, 22 nt, Human
guagauaauuuuggaaagcugg

SEQ ID NO: 204130 - RNA, 22 nt, Human
guacugguuuucuuacucuggc

SEQ ID NO: 204131 - RNA, 22 nt, Human
guacugggaauggagccugggc

SEQ ID NO: 204132 - RNA, 22 nt, Human
guaggugggcuuccaagguccu

SEQ ID NO: 204133 - RNA, 22 nt, Human
guagccauuuucuagagaguua

SEQ ID NO: 204134 - RNA, 22 nt, Human
guaaauaucucacgaaugauuc

SEQ ID NO: 204135 - RNA, 22 nt, Human
guaacuuuuuccucauuggcua

SEQ ID NO: 204136 - RNA, 22 nt, Human
guaaauuaugucugggucaguu

SEQ ID NO: 204137 - RNA, 22 nt, Human
guaauucugugugaaucuauua

SEQ ID NO: 204138 - RNA, 22 nt, Human
guaacugguuuucuucccucuc

SEQ ID NO: 204139 - RNA, 22 nt, Human
ggcccugcuuccccaguguaca

SEQ ID NO: 204140 - RNA, 22 nt, Human
gguugccuguggcucccuguua

SEQ ID NO: 204141 - RNA, 22 nt, Human
gguugauuuuuaugaagccaug

SEQ ID NO: 204142 - RNA, 22 nt, Human
ggccgccacacagauucccccg

SEQ ID NO: 204143 - RNA, 22 nt, Human
ggcccuggggcaggagcagagg

SEQ ID NO: 204144 - RNA, 22 nt, Human
gguuuuccaguagaucagaaga

SEQ ID NO: 204145 - RNA, 22 nt, Human
gguguauucuccaguuuuagca

SEQ ID NO: 204146 - RNA, 22 nt, Human
ggucugcaaugauuugaaaaac

SEQ ID NO: 204147 - RNA, 22 nt, Human
ggucugagcaaguuaccauggg

SEQ ID NO: 204148 - RNA, 22 nt, Human
ggucuucauaugccacagaguc

SEQ ID NO: 204149 - RNA, 22 nt, Human
ggucgaguuccuuguuuuuuau

SEQ ID NO: 204150 - RNA, 22 nt, Human
ggcaagauccagcacaaacaca

SEQ ID NO: 204151 - RNA, 22 nt, Human
ggauuugaugagacuaucuacu

SEQ ID NO: 204152 - RNA, 22 nt, Human
ggcaaagaguacaucguccugg

SEQ ID NO: 204153 - RNA, 22 nt, Human
ggauaauugaugauuuauaaga

SEQ ID NO: 204154 - RNA, 22 nt, Human
gggugugcuaaaccuacgcaca

SEQ ID NO: 204155 - RNA, 22 nt, Human
ggguguggaggugacacauuug

SEQ ID NO: 204156 - RNA, 19 nt, Human
ggauaagguuggagugauc

SEQ ID NO: 204157 - RNA, 22 nt, Human
gguaauguucugaugaauuugu

SEQ ID NO: 204158 - RNA, 22 nt, Human
gguaccuggcccuggggcugcu

SEQ ID NO: 204159 - RNA, 22 nt, Human
gguaauugaaaguuuguugaug

SEQ ID NO: 204160 - RNA, 18 nt, Human
gguacguuuugaucaaug

SEQ ID NO: 204161 - RNA, 21 nt, Human
gguagggaagguguuccucau

SEQ ID NO: 204162 - RNA, 20 nt, Human
ggauugaacuauuucucagc

SEQ ID NO: 204163 - RNA, 22 nt, Human
ggauugaagggaaccucagaau

SEQ ID NO: 204164 - RNA, 22 nt, Human
ggauuucuucucauaacugaga

SEQ ID NO: 204165 - RNA, 22 nt, Human
ggugacauuggagagacaggug

SEQ ID NO: 204166 - RNA, 22 nt, Human
ggugcagucuggggcacauuau

SEQ ID NO: 204167 - RNA, 22 nt, Human
ggcagcagaaccaacuguggcu

SEQ ID NO: 204168 - RNA, 22 nt, Human
ggcagcagaacuggcccuguau

SEQ ID NO: 204169 - RNA, 22 nt, Human
ggcagggaauucagagggaagg

SEQ ID NO: 204170 - RNA, 22 nt, Human
ggcagcgcuuggcugcucgaca

SEQ ID NO: 204171 - RNA, 22 nt, Human
ggcagguccugaguccugaggc

SEQ ID NO: 204172 - RNA, 22 nt, Human
gguguaaucacaagcuggaauu

SEQ ID NO: 204173 - RNA, 22 nt, Human
ggcagugguaggagcccaggag

SEQ ID NO: 204174 - RNA, 22 nt, Human
ggugguucagugguuagggcca

SEQ ID NO: 204175 - RNA, 22 nt, Human
gguggucaggagcgcccguugg

SEQ ID NO: 204176 - RNA, 22 nt, Human
gguggggacuuggggucagcgg

SEQ ID NO: 204177 - RNA, 22 nt, Human
ggcagucuuucccuugagcucu

SEQ ID NO: 204178 - RNA, 22 nt, Human
ggcagucaucacuuauucauca

SEQ ID NO: 204179 - RNA, 22 nt, Human
gcugggagaggcagcuuucgga

SEQ ID NO: 204180 - RNA, 22 nt, Human
gcuggccugcgagggcaggcug

SEQ ID NO: 204181 - RNA, 22 nt, Human
gcuggcggguuggggaggcgga

SEQ ID NO: 204182 - RNA, 21 nt, Human
ggcugcucgugaugaacuuca

SEQ ID NO: 204183 - RNA, 22 nt, Human
ggcugcagugcaacucuuucua

SEQ ID NO: 204184 - RNA, 22 nt, Human
ggcugcuugauagauaugagua

SEQ ID NO: 204185 - RNA, 22 nt, Human
ggcugcuggaguugggucucuc

SEQ ID NO: 204186 - RNA, 22 nt, Human
ggcugcugcccaccccugcaug

SEQ ID NO: 204187 - RNA, 22 nt, Human
ggcugcaagacguuauuagcgu

SEQ ID NO: 204188 - RNA, 22 nt, Human
ggcugaugacgccugagucuga

SEQ ID NO: 204189 - RNA, 22 nt, Human
ggcucuggcgagcuuuaguaca

SEQ ID NO: 204190 - RNA, 22 nt, Human
ggcucuccacuauggaugagaa

SEQ ID NO: 204191 - RNA, 22 nt, Human
gcuggauuuaggguucccuccu

SEQ ID NO: 204192 - RNA, 22 nt, Human
gcuggaugucugugccaggcac

SEQ ID NO: 204193 - RNA, 22 nt, Human
gcugcuucgcugcacacccgag

SEQ ID NO: 204194 - RNA, 22 nt, Human
gcugcuggcuuccugcuguuuu

SEQ ID NO: 204195 - RNA, 22 nt, Human
ggcucagaggagcuggaacggu

SEQ ID NO: 204196 - RNA, 22 nt, Human
ggcucacuguaccugccgccgc

SEQ ID NO: 204197 - RNA, 22 nt, Human
ggcuccaggguaccccuggaug

SEQ ID NO: 204198 - RNA, 22 nt, Human
gcuguauaucuuuugaagugau

SEQ ID NO: 204199 - RNA, 18 nt, Human
gcuguccgguagcuggug

SEQ ID NO: 204200 - RNA, 22 nt, Human
gcugucaggaacaugccuuggu

SEQ ID NO: 204201 - RNA, 21 nt, Human
gcuguagauucacaaagaggu

SEQ ID NO: 204202 - RNA, 22 nt, Human
ggcuuacgcgcuaacagugaau

SEQ ID NO: 204203 - RNA, 22 nt, Human
ggcugugguggacgcgggaaac

SEQ ID NO: 204204 - RNA, 22 nt, Human
ggcugugggguccuguggugug

SEQ ID NO: 204205 - RNA, 22 nt, Human
ggcuuauauguauucccagaga

SEQ ID NO: 204206 - RNA, 19 nt, Human
gcugggauaggauguauuu

SEQ ID NO: 204207 - RNA, 22 nt, Human
gcugggccucuuacuucuuacg

SEQ ID NO: 204208 - RNA, 22 nt, Human
gcugguggcagagcuccgcggc

SEQ ID NO: 204209 - RNA, 22 nt, Human
gcuggugugagauucucgaggg

SEQ ID NO: 204210 - RNA, 22 nt, Human
gcuggguuguucuccuggucca

SEQ ID NO: 204211 - RNA, 22 nt, Human
gcuggucuggcaauccucaugg

SEQ ID NO: 204212 - RNA, 22 nt, Human
gcugguuacuucauuagguccu

SEQ ID NO: 204213 - RNA, 22 nt, Human
ggcugggagguggcgaggaggc

SEQ ID NO: 204214 - RNA, 22 nt, Human
ggcugguggcgggcagcacaga

SEQ ID NO: 204215 - RNA, 22 nt, Human
ggcugugaaguacguugaaggu

SEQ ID NO: 204216 - RNA, 22 nt, Human
gcugcgcugggacgccaccaac

SEQ ID NO: 204217 - RNA, 22 nt, Human
gcugcuacagagcuggaggggg

SEQ ID NO: 204218 - RNA, 22 nt, Human
ggcgaggcgggccgcggggucu

SEQ ID NO: 204219 - RNA, 22 nt, Human
ggcgauuggccgggaggaggca

SEQ ID NO: 204220 - RNA, 22 nt, Human
gcugccuugaacuuggccuggg

SEQ ID NO: 204221 - RNA, 22 nt, Human
ggcgacuacugaaugcuugaaa

SEQ ID NO: 204222 - RNA, 22 nt, Human
ggccuugggauguggcugcagc

SEQ ID NO: 204223 - RNA, 22 nt, Human
ggccuugguggcuuugcugaug

SEQ ID NO: 204224 - RNA, 22 nt, Human
ggcgccauuuuugccuucggag

SEQ ID NO: 204225 - RNA, 22 nt, Human
ggcgccuuguggaaugagagcu

SEQ ID NO: 204226 - RNA, 22 nt, Human
ggcggagggcuguguccccggc

SEQ ID NO: 204227 - RNA, 22 nt, Human
ggcgcuccccgccugcgucgcg

SEQ ID NO: 204228 - RNA, 22 nt, Human
ggcggaggucacgcacccgcca

SEQ ID NO: 204229 - RNA, 22 nt, Human
ggcuaaggacgggcaaguccca

SEQ ID NO: 204230 - RNA, 22 nt, Human
ggcgggggagccaggaacccag

SEQ ID NO: 204231 - RNA, 22 nt, Human
ggccuggcacauaguaggcagu

SEQ ID NO: 204232 - RNA, 22 nt, Human
ggccugcuaccagcugugaccu

SEQ ID NO: 204233 - RNA, 22 nt, Human
ggccgggcaugcgagcugagcg

SEQ ID NO: 204234 - RNA, 22 nt, Human
ggccccggaggccguuagcuua

SEQ ID NO: 204235 - RNA, 22 nt, Human
ggcccgcgcugcuggcgcgcca

SEQ ID NO: 204236 - RNA, 22 nt, Human
gcugcaggaggugguagggucu

SEQ ID NO: 204237 - RNA, 22 nt, Human
ggccagcgugggggaguagcgg

SEQ ID NO: 204238 - RNA, 22 nt, Human
gcugccgcugcggggcgcgggc

SEQ ID NO: 204239 - RNA, 18 nt, Human
gcugaaauucuaaacaaa

SEQ ID NO: 204240 - RNA, 22 nt, Human
gcucuugcuuuuucuagaaaga

SEQ ID NO: 204241 - RNA, 23 nt, Human
gcugaagcccacucccugggucu

SEQ ID NO: 204242 - RNA, 22 nt, Human
gcucuggcugccuuaguuuugu

SEQ ID NO: 204243 - RNA, 22 nt, Human
gcgguggcuacuaaaguucgaa

SEQ ID NO: 204244 - RNA, 22 nt, Human
gcgggugagauucgagagaugg

SEQ ID NO: 204245 - RNA, 22 nt, Human
gcuaagcuuugagucuggacag

SEQ ID NO: 204246 - RNA, 22 nt, Human
ggcagcuuucaauaggguuaug

SEQ ID NO: 204247 - RNA, 22 nt, Human
ggcaggaaguaaggaugcuaca

SEQ ID NO: 204248 - RNA, 22 nt, Human
gcggggcucuacuuggccugga

SEQ ID NO: 204249 - RNA, 22 nt, Human
gcggggggcucgggcagcucgg

SEQ ID NO: 204250 - RNA, 22 nt, Human
ggcagagguagcuggaaccagg

SEQ ID NO: 204251 - RNA, 22 nt, Human
gcgggcuuggcuccagggccca

SEQ ID NO: 204252 - RNA, 22 nt, Human
ggcagaggaagcuggaaguggg

SEQ ID NO: 204253 - RNA, 20 nt, Human
ggcagagcuaugucuguugc

SEQ ID NO: 204254 - RNA, 22 nt, Human
gcuacaggggucaguccuuugc

SEQ ID NO: 204255 - RNA, 22 nt, Human
ggcagggacugggauauggaga

SEQ ID NO: 204256 - RNA, 22 nt, Human
ggcaggauggagcagggcuaaa

SEQ ID NO: 204257 - RNA, 22 nt, Human
gcuauuuagaaaggcuuggaga

SEQ ID NO: 204258 - RNA, 22 nt, Human
gcuacauuagcuucaauggcua

SEQ ID NO: 204259 - RNA, 22 nt, Human
gcuccagcuccauaaacauaag

SEQ ID NO: 204260 - RNA, 23 nt, Human
gcucauguugcuucuguucuguc

SEQ ID NO: 204261 - RNA, 18 nt, Human
ggcagggcucagcugcuc

SEQ ID NO: 204262 - RNA, 22 nt, Human
gcucagccuuuuguucuauuca

SEQ ID NO: 204263 - RNA, 22 nt, Human
ggcagggagagcaugcugauaa

SEQ ID NO: 204264 - RNA, 22 nt, Human
ggcagggagagcgccgccaugc

SEQ ID NO: 204265 - RNA, 22 nt, Human
ggaugcguuugaauguguuugu

SEQ ID NO: 204266 - RNA, 23 nt, Human
ggauggacauacguaugcacagg

SEQ ID NO: 204267 - RNA, 22 nt, Human
ggaugauacuuggagaaauauu

SEQ ID NO: 204268 - RNA, 20 nt, Human
ggagcgggcauuuguguucc

SEQ ID NO: 204269 - RNA, 22 nt, Human
ggagccaguuuagaccucaguu

SEQ ID NO: 204270 - RNA, 22 nt, Human
ggagccuuccgagucccagguu

SEQ ID NO: 204271 - RNA, 22 nt, Human
ggaucagcgagaagggcugaaa

SEQ ID NO: 204272 - RNA, 22 nt, Human
ggaucgauuccaaauguagauc

SEQ ID NO: 204273 - RNA, 22 nt, Human
gcggccucuuugcugccucagg

SEQ ID NO: 204274 - RNA, 22 nt, Human
gcgggcgcuguggccccggccu

SEQ ID NO: 204275 - RNA, 22 nt, Human
ggcagaaaacaauaaccauuuc

SEQ ID NO: 204276 - RNA, 22 nt, Human
ggcaagcacugggugucuuagc

SEQ ID NO: 204277 - RNA, 22 nt, Human
ggauuguaugcagcaguaggca

SEQ ID NO: 204278 - RNA, 22 nt, Human
ggauggugauguacccagucau

SEQ ID NO: 204279 - RNA, 22 nt, Human
gcgccgacccucccugccggac

SEQ ID NO: 204280 - RNA, 22 nt, Human
ggagaggaaguuuaaagaauug

SEQ ID NO: 204281 - RNA, 22 nt, Human
ggagagcuagugagcuggaggu

SEQ ID NO: 204282 - RNA, 20 nt, Human
ggagagggaaaggcuguacu

SEQ ID NO: 204283 - RNA, 22 nt, Human
ggagaugucugugccacgucuc

SEQ ID NO: 204284 - RNA, 22 nt, Human
ggagcaagagugagcaagcaga

SEQ ID NO: 204285 - RNA, 22 nt, Human
ggagaugacaucccagcccggc

SEQ ID NO: 204286 - RNA, 22 nt, Human
ggagaucugggcuguuucuggc

SEQ ID NO: 204287 - RNA, 22 nt, Human
gcgccuugccuguccucuaacc

SEQ ID NO: 204288 - RNA, 22 nt, Human
ggagaucucauugauacugaua

SEQ ID NO: 204289 - RNA, 22 nt, Human
gccuucccuccucugcucucag

SEQ ID NO: 204290 - RNA, 22 nt, Human
ggacagacuuuacagccccggg

SEQ ID NO: 204291 - RNA, 22 nt, Human
gcgcacaaccccguggcgguga

SEQ ID NO: 204292 - RNA, 22 nt, Human
gcccagccucagggcaucagcu

SEQ ID NO: 204293 - RNA, 22 nt, Human
ggaagugagcucauuacuuuag

SEQ ID NO: 204294 - RNA, 22 nt, Human
ggaaguuaguucuuggcaaagg

SEQ ID NO: 204295 - RNA, 22 nt, Human
ggaaggggagcuggaaagggua

SEQ ID NO: 204296 - RNA, 20 nt, Human
ggaaguauccacaaauuccu

SEQ ID NO: 204297 - RNA, 18 nt, Human
ggaaggugcuggagugca

SEQ ID NO: 204298 - RNA, 22 nt, Human
gccuggaaugcaaugugacgaa

SEQ ID NO: 204299 - RNA, 22 nt, Human
gccugcuugaaagcacuuucug

SEQ ID NO: 204300 - RNA, 22 nt, Human
ggaauacggguuuauuuagucu

SEQ ID NO: 204301 - RNA, 22 nt, Human
gccugcugggcucuuccugcug

SEQ ID NO: 204302 - RNA, 22 nt, Human
ggaauaaaaggagguggcgaga

SEQ ID NO: 204303 - RNA, 22 nt, Human
gcuggguaguucuuguuuggga

SEQ ID NO: 204304 - RNA, 22 nt, Human
gcuggggaucgaaggcagagcc

SEQ ID NO: 204305 - RNA, 22 nt, Human
gcugggucucucccugguccug

SEQ ID NO: 204306 - RNA, 22 nt, Human
gcugggagucgcgucuguggcc

SEQ ID NO: 204307 - RNA, 22 nt, Human
gcugggacacacagucuucuuu

SEQ ID NO: 204308 - RNA, 22 nt, Human
ggaagccugggcgcaggcaggg

SEQ ID NO: 204309 - RNA, 22 nt, Human
ggaagcuguugugagugcagca

SEQ ID NO: 204310 - RNA, 22 nt, Human
gcccagcuuuuugaggcaggca

SEQ ID NO: 204311 - RNA, 22 nt, Human
guguuugagagguacaagggaa

SEQ ID NO: 204312 - RNA, 22 nt, Human
guguuucccuggcacaagaacc

SEQ ID NO: 204313 - RNA, 22 nt, Human
guguuguaguguguguuucuuu

SEQ ID NO: 204314 - RNA, 22 nt, Human
guguugcaggaagauauagcug

SEQ ID NO: 204315 - RNA, 22 nt, Human
guguuggugagcucauuuccac

SEQ ID NO: 204316 - RNA, 22 nt, Human
ggggaauaaacacuuugucacu

SEQ ID NO: 204317 - RNA, 22 nt, Human
ggggaagagagaagaaugaucu

SEQ ID NO: 204318 - RNA, 22 nt, Human
guguugaugugucuguauucua

SEQ ID NO: 204319 - RNA, 22 nt, Human
ggggagaugauaagugcauuug

SEQ ID NO: 204320 - RNA, 22 nt, Human
ggggacugccgacagucucaaa

SEQ ID NO: 204321 - RNA, 22 nt, Human
ggggauuucccaaugcgaagca

SEQ ID NO: 204322 - RNA, 22 nt, Human
ggggauuuuucuuacucuuagg

SEQ ID NO: 204323 - RNA, 22 nt, Human
guguuuugagaggaugguuuua

SEQ ID NO: 204324 - RNA, 22 nt, Human
ggggccgggccggcagacuggg

SEQ ID NO: 204325 - RNA, 22 nt, Human
guuacagagcugcuaugugugc

SEQ ID NO: 204326 - RNA, 22 nt, Human
guuaauaugcaaaacggaugcg

SEQ ID NO: 204327 - RNA, 22 nt, Human
guuaaaugcagauucugacuca

SEQ ID NO: 204328 - RNA, 22 nt, Human
ggggcggggagcaugagcuggg

SEQ ID NO: 204329 - RNA, 22 nt, Human
guuauugggagagggaauggga

SEQ ID NO: 204330 - RNA, 23 nt, Human
guuauugcuggugcuggccagcc

SEQ ID NO: 204331 - RNA, 22 nt, Human
guuaguucccaccccuguaaga

SEQ ID NO: 204332 - RNA, 22 nt, Human
gggucagggaggccccaccaug

SEQ ID NO: 204333 - RNA, 22 nt, Human
gggucauugcgugacgcgagca

SEQ ID NO: 204334 - RNA, 22 nt, Human
guuauacuuaugugcaaaaaua

SEQ ID NO: 204335 - RNA, 22 nt, Human
gggggcugugugcccgcucccc

SEQ ID NO: 204336 - RNA, 22 nt, Human
gggggcgccgccgcucaucuca

SEQ ID NO: 204337 - RNA, 22 nt, Human
guuacuacccacccuucucccc

SEQ ID NO: 204338 - RNA, 22 nt, Human
ggggcuggguuugcgcaggcuc

SEQ ID NO: 204339 - RNA, 22 nt, Human
ggggcuuccagcgcccgccggu

SEQ ID NO: 204340 - RNA, 22 nt, Human
ggggcuuggguaagaaugcaaa

SEQ ID NO: 204341 - RNA, 22 nt, Human
ggguggugagagaacuuugcag

SEQ ID NO: 204342 - RNA, 22 nt, Human
ggguggugauacugcuucugcc

SEQ ID NO: 204343 - RNA, 22 nt, Human
guucuuagguacucauauuuaa

SEQ ID NO: 204344 - RNA, 22 nt, Human
ggguguuaugccucugagucag

SEQ ID NO: 204345 - RNA, 22 nt, Human
gggugguuccuggaucugacug

SEQ ID NO: 204346 - RNA, 22 nt, Human
gggugguggagguuugacagac

SEQ ID NO: 204347 - RNA, 22 nt, Human
gggugcuucauaggugaugcug

SEQ ID NO: 204348 - RNA, 22 nt, Human
guucuccaggggcuguucaucu

SEQ ID NO: 204349 - RNA, 22 nt, Human
guucuggaggagagccuggugu

SEQ ID NO: 204350 - RNA, 22 nt, Human
guucuguauauauccuagcaaa

SEQ ID NO: 204351 - RNA, 22 nt, Human
guucuguuguugaucuuuggag

SEQ ID NO: 204352 - RNA, 22 nt, Human
guucggcuuccuaugucaugag

SEQ ID NO: 204353 - RNA, 22 nt, Human
guucagauucuuucucuuucac

SEQ ID NO: 204354 - RNA, 22 nt, Human
guucauuucaagucuaauccau

SEQ ID NO: 204355 - RNA, 22 nt, Human
guucgucuguggugugaggugc

SEQ ID NO: 204356 - RNA, 22 nt, Human
gggucggcacucuggcagcacc

SEQ ID NO: 204357 - RNA, 22 nt, Human
guugauuuaaccucaccuuuga

SEQ ID NO: 204358 - RNA, 22 nt, Human
gguaagcacuucauguacauga

SEQ ID NO: 204359 - RNA, 22 nt, Human
guugagacguguauuggaaucu

SEQ ID NO: 204360 - RNA, 22 nt, Human
gguaagguugggugucagaggg

SEQ ID NO: 204361 - RNA, 22 nt, Human
gguaagcugcuguagggucaga

SEQ ID NO: 204362 - RNA, 22 nt, Human
gguagauacaaaaagauugugg

SEQ ID NO: 204363 - RNA, 22 nt, Human
ggguuacgaugauuucaugugu

SEQ ID NO: 204364 - RNA, 22 nt, Human
ggguuaaauggauggcauuugc

SEQ ID NO: 204365 - RNA, 22 nt, Human
ggguguuuuuggugacagggag

SEQ ID NO: 204366 - RNA, 22 nt, Human
guugagaaucucuagcuuagga

SEQ ID NO: 204367 - RNA, 22 nt, Human
guugagacugaaguucugaaag

SEQ ID NO: 204368 - RNA, 22 nt, Human
guugaacagucacccugggagu

SEQ ID NO: 204369 - RNA, 22 nt, Human
guucuuuacuucgcaucugcua

SEQ ID NO: 204370 - RNA, 22 nt, Human
guguccuguagaaacuguucca

SEQ ID NO: 204371 - RNA, 22 nt, Human
gugucuuauugauguuggcacu

SEQ ID NO: 204372 - RNA, 22 nt, Human
gggcuggcaguuuucugaguuc

SEQ ID NO: 204373 - RNA, 22 nt, Human
gggcugaugcuuauacauacug

SEQ ID NO: 204374 - RNA, 22 nt, Human
gggcuggggcucuggggcuagg

SEQ ID NO: 204375 - RNA, 22 nt, Human
gggcuguaggagcuggaauggg

SEQ ID NO: 204376 - RNA, 22 nt, Human
gggcuguuugcauauguuuaua

SEQ ID NO: 204377 - RNA, 22 nt, Human
gugugguguuaagcaaauuaau

SEQ ID NO: 204378 - RNA, 22 nt, Human
guguguauguagguauauaugu

SEQ ID NO: 204379 - RNA, 22 nt, Human
gugugcacaaucuggcaugugc

SEQ ID NO: 204380 - RNA, 22 nt, Human
gggcuuguuaacuuggcuucca

SEQ ID NO: 204381 - RNA, 22 nt, Human
gugugugucuacuuucaucucu

SEQ ID NO: 204382 - RNA, 22 nt, Human
guguuaaucauuuuugauuuug

SEQ ID NO: 204383 - RNA, 22 nt, Human
gggcuuuuccaacacucuggag

SEQ ID NO: 204384 - RNA, 20 nt, Human
gggcuuugagcucagggcuu

SEQ ID NO: 204385 - RNA, 22 nt, Human
ggggaaauauuucugaccugug

SEQ ID NO: 204386 - RNA, 22 nt, Human
guguucccauccacaccaagcc

SEQ ID NO: 204387 - RNA, 22 nt, Human
guguucuuuguagaggaucuug

SEQ ID NO: 204388 - RNA, 22 nt, Human
guguugaaaaguagcacugcuu

SEQ ID NO: 204389 - RNA, 22 nt, Human
guguugacacagccaucuuguc

SEQ ID NO: 204390 - RNA, 22 nt, Human
gugguaagugcuccuauuggcg

SEQ ID NO: 204391 - RNA, 22 nt, Human
gggcgcuguguuaggugcugua

SEQ ID NO: 204392 - RNA, 22 nt, Human
gggcgccgggagugagagugag

SEQ ID NO: 204393 - RNA, 22 nt, Human
gggcgcgccaggagcugcgcgg

SEQ ID NO: 204394 - RNA, 22 nt, Human
gggcgcaagcaugugucugggu

SEQ ID NO: 204395 - RNA, 22 nt, Human
gggcgagcgucucagccgggcg

SEQ ID NO: 204396 - RNA, 22 nt, Human
guggugauuugggucuagcuuu

SEQ ID NO: 204397 - RNA, 22 nt, Human
gggcgcuuucugggucagggcu

SEQ ID NO: 204398 - RNA, 22 nt, Human
guggucaagaccgggaauagga

SEQ ID NO: 204399 - RNA, 22 nt, Human
gggcggggcucacggugcggca

SEQ ID NO: 204400 - RNA, 22 nt, Human
gggcggcguccucagucgggug

SEQ ID NO: 204401 - RNA, 22 nt, Human
gggcuacugagcuggaacuggg

SEQ ID NO: 204402 - RNA, 22 nt, Human
guggugggcgugguguaugccu

SEQ ID NO: 204403 - RNA, 22 nt, Human
guggugguguuggugacaaguu

SEQ ID NO: 204404 - RNA, 22 nt, Human
guguauuucuagaagaaaugaa

SEQ ID NO: 204405 - RNA, 22 nt, Human
guguaucagaggcuguguuaua

SEQ ID NO: 204406 - RNA, 22 nt, Human
gugguuugacccuucagguaaa

SEQ ID NO: 204407 - RNA, 21 nt, Human
gggccugggccagggccgggu

SEQ ID NO: 204408 - RNA, 22 nt, Human
gugggggcuaaauugaggggug

SEQ ID NO: 204409 - RNA, 22 nt, Human
guggggguaggggguuuucugg

SEQ ID NO: 204410 - RNA, 22 nt, Human
gugggccaguuccucacaggua

SEQ ID NO: 204411 - RNA, 22 nt, Human
guggguauauauaugugugcug

SEQ ID NO: 204412 - RNA, 22 nt, Human
guggggcgggucccccgccugg

SEQ ID NO: 204413 - RNA, 22 nt, Human
gugggcuuuuuugaaaccugaa

SEQ ID NO: 204414 - RNA, 18 nt, Human
gugggcacacacucuguu

SEQ ID NO: 204415 - RNA, 22 nt, Human
gugggauaaccugagauaacau

SEQ ID NO: 204416 - RNA, 22 nt, Human
gugggaaacagccuugcuucua

SEQ ID NO: 204417 - RNA, 22 nt, Human
gugggagaaugggaggaguaau

SEQ ID NO: 204418 - RNA, 22 nt, Human
guggcuuuguuuccaaaugaaa

SEQ ID NO: 204419 - RNA, 20 nt, Human
guggcagugguggcagcagu

SEQ ID NO: 204420 - RNA, 22 nt, Human
guggcagguguacagcucagcu

SEQ ID NO: 204421 - RNA, 22 nt, Human
guggcagagagcaagugucuga

SEQ ID NO: 204422 - RNA, 22 nt, Human
guggauuucaggcuccccucag

SEQ ID NO: 204423 - RNA, 22 nt, Human
guggauaaguuguuugaccuac

SEQ ID NO: 204424 - RNA, 22 nt, Human
guggauggagcuggaagccauu

SEQ ID NO: 204425 - RNA, 22 nt, Human
guggcuuauguccagcagauau

SEQ ID NO: 204426 - RNA, 22 nt, Human
guggcuggguggaacugagucu

SEQ ID NO: 204427 - RNA, 18 nt, Human
guggccauugaccagcuu

SEQ ID NO: 204428 - RNA, 22 nt, Human
gggcagagggcgagcugggaga

SEQ ID NO: 204429 - RNA, 22 nt, Human
gggcacggaaggcgccaggggu

SEQ ID NO: 204430 - RNA, 22 nt, Human
gggcagaaaggaaggcuggggg

SEQ ID NO: 204431 - RNA, 22 nt, Human
gggcaggggcagugguggcauu

SEQ ID NO: 204432 - RNA, 22 nt, Human
gggcagucagauucgggggccu

SEQ ID NO: 204433 - RNA, 22 nt, Human
guggaaauuuuaggaucaucuu

SEQ ID NO: 204434 - RNA, 22 nt, Human
guggaaauaugggcaacaaaga

SEQ ID NO: 204435 - RNA, 22 nt, Human
guggaaggaauuaacagacuag

SEQ ID NO: 204436 - RNA, 22 nt, Human
ggccuugauuccggucauugaa

SEQ ID NO: 204437 - RNA, 23 nt, Human
ggccuuuuuaaccgcgagcgaca

SEQ ID NO: 204438 - RNA, 22 nt, Human
gugcuuugcuaggaccgauugu

SEQ ID NO: 204439 - RNA, 22 nt, Human
gggccggcuggggcggggcggg

SEQ ID NO: 204440 - RNA, 22 nt, Human
guggagauauuugugauagggg

SEQ ID NO: 204441 - RNA, 22 nt, Human
gggcaugugauggacgugugcc

SEQ ID NO: 204442 - RNA, 22 nt, Human
guggagaagggaccgggaagga

SEQ ID NO: 204443 - RNA, 22 nt, Human
guggacagacauaauccuaauu

SEQ ID NO: 204444 - RNA, 22 nt, Human
uaagagauuuauugaggacuuc

SEQ ID NO: 204445 - RNA, 22 nt, Human
uaagaggucugaaacgguggga

SEQ ID NO: 204446 - RNA, 22 nt, Human
guauuauauaaccauugguucu

SEQ ID NO: 204447 - RNA, 22 nt, Human
guauuaagaaaugccugugaaa

SEQ ID NO: 204448 - RNA, 23 nt, Human
uaagccugugccugcuaccugcu

SEQ ID NO: 204449 - RNA, 21 nt, Human
uaagccaccaugugaaaccag

SEQ ID NO: 204450 - RNA, 21 nt, Human
guaucuuucuuuuaaaauauc

SEQ ID NO: 204451 - RNA, 22 nt, Human
uaagaaacauuuuuaugacagu

SEQ ID NO: 204452 - RNA, 22 nt, Human
guaucaggacuaaauuauggau

SEQ ID NO: 204453 - RNA, 22 nt, Human
uaagcgagccaguggaaaaagc

SEQ ID NO: 204454 - RNA, 22 nt, Human
gucaaugcuuaguuugccugaa

SEQ ID NO: 204455 - RNA, 22 nt, Human
gucaccgguuuuuagguaaaca

SEQ ID NO: 204456 - RNA, 22 nt, Human
gucacaaaugauuuagcaauca

SEQ ID NO: 204457 - RNA, 22 nt, Human
guauuugcaaucacaaacaaaa

SEQ ID NO: 204458 - RNA, 23 nt, Human
uaagccacgugacccuuuauuug

SEQ ID NO: 204459 - RNA, 22 nt, Human
gucagacugaguuccuggguac

SEQ ID NO: 204460 - RNA, 22 nt, Human
gucagaagauagaggaaguuug

SEQ ID NO: 204461 - RNA, 22 nt, Human
gucacuguuucacuguucauua

SEQ ID NO: 204462 - RNA, 22 nt, Human
gucacuuugcuugcgaugcucc

SEQ ID NO: 204463 - RNA, 22 nt, Human
gucaagaugcuacauaauggga

SEQ ID NO: 204464 - RNA, 22 nt, Human
uaacaguggucugugguaucug

SEQ ID NO: 204465 - RNA, 22 nt, Human
uaacauuuaguuuuaagauggu

SEQ ID NO: 204466 - RNA, 22 nt, Human
uaaccaggaaaaagauaugcau

SEQ ID NO: 204467 - RNA, 22 nt, Human
guaauaggagggagucugcuuu

SEQ ID NO: 204468 - RNA, 22 nt, Human
guaaugcuuuuauuucggggaa

SEQ ID NO: 204469 - RNA, 22 nt, Human
uaaauuugugaauuagcuauca

SEQ ID NO: 204470 - RNA, 23 nt, Human
uaaauuuuauucugauaacacag

SEQ ID NO: 204471 - RNA, 22 nt, Human
uaacuuuucuguucaauuuucc

SEQ ID NO: 204472 - RNA, 22 nt, Human
uaacucugcuguggaaauggga

SEQ ID NO: 204473 - RNA, 18 nt, Human
uaacugguuucuucccau

SEQ ID NO: 204474 - RNA, 22 nt, Human
uaacgcaucuggaaacaggaca

SEQ ID NO: 204475 - RNA, 22 nt, Human
guaguuuucaugguuagaaaua

SEQ ID NO: 204476 - RNA, 22 nt, Human
guauaaagaugccauacuuacu

SEQ ID NO: 204477 - RNA, 22 nt, Human
uaaccuuuuuuaaaguuuccug

SEQ ID NO: 204478 - RNA, 22 nt, Human
guaguuuuucuugcaagaguag

SEQ ID NO: 204479 - RNA, 22 nt, Human
guaguuuuugagcuguaaucuu

SEQ ID NO: 204480 - RNA, 22 nt, Human
guaguggaauuuagaguauaau

SEQ ID NO: 204481 - RNA, 22 nt, Human
guaguauuuucugaggacuggu

SEQ ID NO: 204482 - RNA, 22 nt, Human
ggugcuggggaaauuaggguag

SEQ ID NO: 204483 - RNA, 22 nt, Human
gguggagacucagauuuguugc

SEQ ID NO: 204484 - RNA, 22 nt, Human
guuuuauaacuauagugagaau

SEQ ID NO: 204485 - RNA, 22 nt, Human
guugcuggggcugaguccccag

SEQ ID NO: 204486 - RNA, 22 nt, Human
gguaugaggaugaggguggcau

SEQ ID NO: 204487 - RNA, 22 nt, Human
ggucaauuuggucaaucguuua

SEQ ID NO: 204488 - RNA, 20 nt, Human
ggucagccaagaaguuaccu

SEQ ID NO: 204489 - RNA, 22 nt, Human
guuuugaugugauuucucaugu

SEQ ID NO: 204490 - RNA, 22 nt, Human
ggugggaauccaggccuucauc

SEQ ID NO: 204491 - RNA, 22 nt, Human
guuuuguagucuggagacuguc

SEQ ID NO: 204492 - RNA, 22 nt, Human
guuuuguucaugaacauugggu

SEQ ID NO: 204493 - RNA, 22 nt, Human
guuuucuuguuaauuuugaacg

SEQ ID NO: 204494 - RNA, 22 nt, Human
guuuuauguuuuauagacacaa

SEQ ID NO: 204495 - RNA, 22 nt, Human
gguggcauucaguaaguauaua

SEQ ID NO: 204496 - RNA, 22 nt, Human
gguggccggcaccccacccucg

SEQ ID NO: 204497 - RNA, 22 nt, Human
gguguagggaaacuugacuaau

SEQ ID NO: 204498 - RNA, 22 nt, Human
gguuuuuggcucaauauuuugg

SEQ ID NO: 204499 - RNA, 22 nt, Human
guaaauacuaugagauaaugaa

SEQ ID NO: 204500 - RNA, 22 nt, Human
guaaacugaauuggauacugug

SEQ ID NO: 204501 - RNA, 22 nt, Human
gguuuaucuuuacaaaugaaau

SEQ ID NO: 204502 - RNA, 23 nt, Human
uaaagauaguuuaaaggugaguu

SEQ ID NO: 204503 - RNA, 22 nt, Human
uaaagaggagaauuaagucagc

SEQ ID NO: 204504 - RNA, 22 nt, Human
gguugggauuauccaaggcaga

SEQ ID NO: 204505 - RNA, 22 nt, Human
uaaacugacagugagggagagu

SEQ ID NO: 204506 - RNA, 22 nt, Human
gguucuggaaaagaaagcaaag

SEQ ID NO: 204507 - RNA, 22 nt, Human
gguucaaagccugaugggguug

SEQ ID NO: 204508 - RNA, 22 nt, Human
gguugccuuugcaguuggauca

SEQ ID NO: 204509 - RNA, 22 nt, Human
gguugcggaccagcugggcugc

SEQ ID NO: 204510 - RNA, 22 nt, Human
gguuaacaccacagcugggaca

SEQ ID NO: 204511 - RNA, 22 nt, Human
guuuuucuuugauuuagaacca

SEQ ID NO: 204512 - RNA, 22 nt, Human
guuuuuaguuuaaguuuuugca

SEQ ID NO: 204513 - RNA, 22 nt, Human
gugauuucagguuuuucauacu

SEQ ID NO: 204514 - RNA, 19 nt, Human
uagagcagcuucagauucc

SEQ ID NO: 204515 - RNA, 22 nt, Human
gugaugugugaaggucugcagg

SEQ ID NO: 204516 - RNA, 22 nt, Human
uagacuggaagcuccuugaggc

SEQ ID NO: 204517 - RNA, 22 nt, Human
uagagaaauuacagcuuucuuu

SEQ ID NO: 204518 - RNA, 22 nt, Human
gugaugaagguggagaaucaga

SEQ ID NO: 204519 - RNA, 22 nt, Human
gugaggugauugcugguguuug

SEQ ID NO: 204520 - RNA, 17 nt, Human
gugagcugagucaggac

SEQ ID NO: 204521 - RNA, 22 nt, Human
uagaaguuaaaggaauacagaa

SEQ ID NO: 204522 - RNA, 22 nt, Human
gugaguguguccgacuccaagg

SEQ ID NO: 204523 - RNA, 22 nt, Human
gugauaguucuuacuccaaagu

SEQ ID NO: 204524 - RNA, 22 nt, Human
gugaggcccaggugaaauuaac

SEQ ID NO: 204525 - RNA, 22 nt, Human
uagaccugugggggcagcgggc

SEQ ID NO: 204526 - RNA, 22 nt, Human
uagacauuuacuuugaaaaaau

SEQ ID NO: 204527 - RNA, 22 nt, Human
gugaucagaagaaccugccgaa

SEQ ID NO: 204528 - RNA, 22 nt, Human
gugaugaaggccugcaccuggu

SEQ ID NO: 204529 - RNA, 22 nt, Human
gugcagcugggcgcugaccuuc

SEQ ID NO: 204530 - RNA, 19 nt, Human
gugcacugucacuuugcuc

SEQ ID NO: 204531 - RNA, 22 nt, Human
uagaugaacagaaagccacugu

SEQ ID NO: 204532 - RNA, 22 nt, Human
uagaugguguccagaaagagaa

SEQ ID NO: 204533 - RNA, 22 nt, Human
uagaucccauugguugguuggu

SEQ ID NO: 204534 - RNA, 22 nt, Human
uagauccaagguuggauugggg

SEQ ID NO: 204535 - RNA, 22 nt, Human
gugcaucuguaauuacaauggu

SEQ ID NO: 204536 - RNA, 22 nt, Human
gugccaccagaugcuguugcua

SEQ ID NO: 204537 - RNA, 22 nt, Human
gugcauauguguguauacaaac

SEQ ID NO: 204538 - RNA, 22 nt, Human
uagcagcacuauuuguuguagu

SEQ ID NO: 204539 - RNA, 22 nt, Human
uagcagaacaauagucaaugau

SEQ ID NO: 204540 - RNA, 22 nt, Human
gugccuggaaucuuuucuucac

SEQ ID NO: 204541 - RNA, 22 nt, Human
gugccuggugcaggauaaucac

SEQ ID NO: 204542 - RNA, 22 nt, Human
gugcgaaagaagcgacuccagu

SEQ ID NO: 204543 - RNA, 22 nt, Human
gugccuuuuucccaguucauug

SEQ ID NO: 204544 - RNA, 22 nt, Human
gugcuacacaaauguuaguugu

SEQ ID NO: 204545 - RNA, 20 nt, Human
gugcggcucuaccacucggu

SEQ ID NO: 204546 - RNA, 22 nt, Human
uagauuuaaaaagggugggaug

SEQ ID NO: 204547 - RNA, 22 nt, Human
uagcaaucugugaugugugugu

SEQ ID NO: 204548 - RNA, 22 nt, Human
gugccugcucauucucaauauu

SEQ ID NO: 204549 - RNA, 22 nt, Human
gugccucuaguuuucuccuaaa

SEQ ID NO: 204550 - RNA, 22 nt, Human
gugccgggcugcggcaaggugu

SEQ ID NO: 204551 - RNA, 22 nt, Human
uacaccaugcuccagcaggaca

SEQ ID NO: 204552 - RNA, 22 nt, Human
gucugccagauucugcuggauc

SEQ ID NO: 204553 - RNA, 22 nt, Human
gucugcccuuggccugggacuu

SEQ ID NO: 204554 - RNA, 18 nt, Human
uacagauguaugucuaca

SEQ ID NO: 204555 - RNA, 20 nt, Human
uacaaggauguucaucagag

SEQ ID NO: 204556 - RNA, 22 nt, Human
uaauaaaaauuuaauucacauu

SEQ ID NO: 204557 - RNA, 22 nt, Human
uaaguuguagaacguuuucuua

SEQ ID NO: 204558 - RNA, 21 nt, Human
uaauaauugggggcagggugg

SEQ ID NO: 204559 - RNA, 22 nt, Human
uaauaagugcuggcuguacauc

SEQ ID NO: 204560 - RNA, 22 nt, Human
gucuaccuucuuucucaacugg

SEQ ID NO: 204561 - RNA, 22 nt, Human
uacuaaagaaugaguuaaguuu

SEQ ID NO: 204562 - RNA, 22 nt, Human
uacuauuuugacaugaaauuga

SEQ ID NO: 204563 - RNA, 20 nt, Human
uacccgcagcugggucuggc

SEQ ID NO: 204564 - RNA, 22 nt, Human
uacccauuuugguucuugaugc

SEQ ID NO: 204565 - RNA, 22 nt, Human
uaccauaaagcaggcaaaugag

SEQ ID NO: 204566 - RNA, 23 nt, Human
uaccauugauuuuaugguuuucu

SEQ ID NO: 204567 - RNA, 22 nt, Human
uacagugaggcgagauucacca

SEQ ID NO: 204568 - RNA, 23 nt, Human
uaccagacccugaaagaaagugu

SEQ ID NO: 204569 - RNA, 21 nt, Human
uacagcucaucaauuacugcu

SEQ ID NO: 204570 - RNA, 22 nt, Human
gugaagcacaugggcguugggu

SEQ ID NO: 204571 - RNA, 22 nt, Human
uacuuacacugaagcaaagaua

SEQ ID NO: 204572 - RNA, 22 nt, Human
gugaagaugccucaggugaccc

SEQ ID NO: 204573 - RNA, 20 nt, Human
gugaacuggagaacugaugu

SEQ ID NO: 204574 - RNA, 22 nt, Human
uacugccauuauccugcugaaa

SEQ ID NO: 204575 - RNA, 22 nt, Human
uacuggaugcaacaaagcccag

SEQ ID NO: 204576 - RNA, 22 nt, Human
uacugaaagagugguggacucu

SEQ ID NO: 204577 - RNA, 22 nt, Human
uacucauuggagaauuacgagg

SEQ ID NO: 204578 - RNA, 22 nt, Human
uacugagcauaaaacccauacu

SEQ ID NO: 204579 - RNA, 22 nt, Human
uacugacguaguagaguugcuu

SEQ ID NO: 204580 - RNA, 22 nt, Human
uacugaauuacugcugguaaau

SEQ ID NO: 204581 - RNA, 22 nt, Human
uacugaagaugccaucacaagc

SEQ ID NO: 204582 - RNA, 22 nt, Human
uaaugcucauuuggcucugcaa

SEQ ID NO: 204583 - RNA, 22 nt, Human
ucauugguugcguaauuugauu

SEQ ID NO: 204584 - RNA, 20 nt, Human
ucauucagaaucaguaugca

SEQ ID NO: 204585 - RNA, 22 nt, Human
ucauucucucguauucgcgaau

SEQ ID NO: 204586 - RNA, 22 nt, Human
uaauaauuaacagugauggguc

SEQ ID NO: 204587 - RNA, 22 nt, Human
uaagugugcauguguauuauau

SEQ ID NO: 204588 - RNA, 22 nt, Human
uaagugguagaaagagaaaggu

SEQ ID NO: 204589 - RNA, 22 nt, Human
uacaagcucuuguagggggaaa

SEQ ID NO: 204590 - RNA, 22 nt, Human
uacaaauuguuuugccacaaag

SEQ ID NO: 204591 - RNA, 22 nt, Human
uacaacuuacuugaauggcuuu

SEQ ID NO: 204592 - RNA, 22 nt, Human
uccaacuuaauugggaagauua

SEQ ID NO: 204593 - RNA, 22 nt, Human
uccaaauagcuggaugauggug

SEQ ID NO: 204594 - RNA, 20 nt, Human
uacaauauucccacuuugcu

SEQ ID NO: 204595 - RNA, 22 nt, Human
uaauuauuaauuuuagguugcu

SEQ ID NO: 204596 - RNA, 22 nt, Human
uaauggagggucugagucuggg

SEQ ID NO: 204597 - RNA, 22 nt, Human
ucauuguguaguagagguggca

SEQ ID NO: 204598 - RNA, 22 nt, Human
uacaaauugccugacggcaggu

SEQ ID NO: 204599 - RNA, 22 nt, Human
uaagaauguuuguugaguaaau

SEQ ID NO: 204600 - RNA, 22 nt, Human
ucaucagccaaagaguccuuca

SEQ ID NO: 204601 - RNA, 22 nt, Human
uaaagacaauuucgagcuguag

SEQ ID NO: 204602 - RNA, 22 nt, Human
ucaggacacuuaauaggaacag

SEQ ID NO: 204603 - RNA, 22 nt, Human
uaaagcacucaaaauuguagcu

SEQ ID NO: 204604 - RNA, 22 nt, Human
uaacuuuuuauccuguuaaaug

SEQ ID NO: 204605 - RNA, 22 nt, Human
uaagcguuugggaguuaugaac

SEQ ID NO: 204606 - RNA, 22 nt, Human
ucauccugaagaaccugcuucc

SEQ ID NO: 204607 - RNA, 22 nt, Human
ucauccucguccucuggugccc

SEQ ID NO: 204608 - RNA, 22 nt, Human
ucauccgcaaccacuuuagccu

SEQ ID NO: 204609 - RNA, 21 nt, Human
ucauccagguccugcuucuuc

SEQ ID NO: 204610 - RNA, 22 nt, Human
ucaucccuuccugcacuauuag

SEQ ID NO: 204611 - RNA, 22 nt, Human
ucauccugucucuguucggaau

SEQ ID NO: 204612 - RNA, 22 nt, Human
uaaggcuguuaggaggauuaaa

SEQ ID NO: 204613 - RNA, 22 nt, Human
uaaguaauugugguuuuugcca

SEQ ID NO: 204614 - RNA, 22 nt, Human
ucaugacaacuugcacaguuuu

SEQ ID NO: 204615 - RNA, 22 nt, Human
ucaucuuuauaaugcaaguuuu

SEQ ID NO: 204616 - RNA, 22 nt, Human
uacaccuuaagccgcggcuccc

SEQ ID NO: 204617 - RNA, 22 nt, Human
uccacagcagagcacgguaccu

SEQ ID NO: 204618 - RNA, 22 nt, Human
uacaguauuuuuuaagaaaaaa

SEQ ID NO: 204619 - RNA, 22 nt, Human
uacagucauaagguuucucucc

SEQ ID NO: 204620 - RNA, 22 nt, Human
uccaccuaagucuccgggagcu

SEQ ID NO: 204621 - RNA, 21 nt, Human
uacaucaguuuucuuggcuca

SEQ ID NO: 204622 - RNA, 22 nt, Human
uccacuaucagaccuguagucu

SEQ ID NO: 204623 - RNA, 19 nt, Human
uccaccgcgugcaccucua

SEQ ID NO: 204624 - RNA, 22 nt, Human
uccacagggaugccugcggcuu

SEQ ID NO: 204625 - RNA, 22 nt, Human
uacauggauguuauccuuacug

SEQ ID NO: 204626 - RNA, 22 nt, Human
uacauuguguuaaaacagaaga

SEQ ID NO: 204627 - RNA, 21 nt, Human
uaccacugaaauugaucguuc

SEQ ID NO: 204628 - RNA, 20 nt, Human
uccacugagcgucacggcag

SEQ ID NO: 204629 - RNA, 22 nt, Human
uccagcacacagguggcucuca

SEQ ID NO: 204630 - RNA, 19 nt, Human
uaccagguuggagaggccc

SEQ ID NO: 204631 - RNA, 22 nt, Human
uacucuggaguugagaugcgag

SEQ ID NO: 204632 - RNA, 17 nt, Human
uccauugagacaagaag

SEQ ID NO: 204633 - RNA, 22 nt, Human
ucccaaaacuugaagcaagccu

SEQ ID NO: 204634 - RNA, 22 nt, Human
ucccacgugccaucugcucugu

SEQ ID NO: 204635 - RNA, 22 nt, Human
uccagugaacaucauggcucca

SEQ ID NO: 204636 - RNA, 22 nt, Human
uccagguuuggcuuuauaacuu

SEQ ID NO: 204637 - RNA, 22 nt, Human
uccaguggcaccuuggcccuca

SEQ ID NO: 204638 - RNA, 20 nt, Human
uccaguuuuggagacauucu

SEQ ID NO: 204639 - RNA, 22 nt, Human
uccagugguggcucccggaccu

SEQ ID NO: 204640 - RNA, 22 nt, Human
uccauucccugacagccucuuu

SEQ ID NO: 204641 - RNA, 19 nt, Human
uacccggauagccagguag

SEQ ID NO: 204642 - RNA, 22 nt, Human
uaccgaagcugcuuuugcaugu

SEQ ID NO: 204643 - RNA, 22 nt, Human
uccagguucaguucaucaucua

SEQ ID NO: 204644 - RNA, 22 nt, Human
uccagccauaucuuguagcccu

SEQ ID NO: 204645 - RNA, 22 nt, Human
ucgcggccgcuccacaugcaca

SEQ ID NO: 204646 - RNA, 22 nt, Human
ucgccccccgccucacccucgg

SEQ ID NO: 204647 - RNA, 22 nt, Human
ucgcucgcuggcuccugcccgc

SEQ ID NO: 204648 - RNA, 22 nt, Human
ucgccauguacaugaagggcgg

SEQ ID NO: 204649 - RNA, 22 nt, Human
ucgcccagguuggagugcagug

SEQ ID NO: 204650 - RNA, 22 nt, Human
uaggauauuuuagaaugguaca

SEQ ID NO: 204651 - RNA, 22 nt, Human
uccuuuuuagguuauuguacau

SEQ ID NO: 204652 - RNA, 22 nt, Human
ucgacguuguuuuuucucuguc

SEQ ID NO: 204653 - RNA, 22 nt, Human
uaggcaguagcuuuggauguca

SEQ ID NO: 204654 - RNA, 20 nt, Human
ucgcugcaagggaaauggag

SEQ ID NO: 204655 - RNA, 22 nt, Human
uaggccugcugaagagcaagcu

SEQ ID NO: 204656 - RNA, 22 nt, Human
ucggccggagggggcgggcgca

SEQ ID NO: 204657 - RNA, 19 nt, Human
ucggaaugugggaagcaug

SEQ ID NO: 204658 - RNA, 22 nt, Human
ucgcuuuaauggucuucacagc

SEQ ID NO: 204659 - RNA, 22 nt, Human
ucgcuugaacccaggaagugga

SEQ ID NO: 204660 - RNA, 22 nt, Human
uaggggggugaaggaggucccu

SEQ ID NO: 204661 - RNA, 21 nt, Human
ucgggcggcggcugaggcggc

SEQ ID NO: 204662 - RNA, 22 nt, Human
ucgggaggaggcggagcucguu

SEQ ID NO: 204663 - RNA, 22 nt, Human
ucggguguguguguuggguaug

SEQ ID NO: 204664 - RNA, 22 nt, Human
ucgggcccggcucccgacgccc

SEQ ID NO: 204665 - RNA, 22 nt, Human
ucgggcgaauguuguuuuucuc

SEQ ID NO: 204666 - RNA, 22 nt, Human
ucgucaaaguaaugucauagca

SEQ ID NO: 204667 - RNA, 22 nt, Human
uagguggaaccauaugaaauuu

SEQ ID NO: 204668 - RNA, 22 nt, Human
uaguaauagcuguaaagugugu

SEQ ID NO: 204669 - RNA, 22 nt, Human
uagguauguuaacugugcaauu

SEQ ID NO: 204670 - RNA, 22 nt, Human
ucgugaagaaauguggacuuca

SEQ ID NO: 204671 - RNA, 22 nt, Human
uaguauuuguaauuaucaaagc

SEQ ID NO: 204672 - RNA, 20 nt, Human
uaguaugggagaagaucucc

SEQ ID NO: 204673 - RNA, 22 nt, Human
uaguacuugauuuuaaauguua

SEQ ID NO: 204674 - RNA, 22 nt, Human
ucuaaagcuccuuccacuaaaa

SEQ ID NO: 204675 - RNA, 22 nt, Human
uccuuuggaaacuggaugucuu

SEQ ID NO: 204676 - RNA, 22 nt, Human
uagccguugggguaacuggaca

SEQ ID NO: 204677 - RNA, 22 nt, Human
uagccacuccgcagcaccgggu

SEQ ID NO: 204678 - RNA, 17 nt, Human
uagccagcuugugauuu

SEQ ID NO: 204679 - RNA, 22 nt, Human
uagccacagaauucugaguaga

SEQ ID NO: 204680 - RNA, 22 nt, Human
uagcaaugugggugggcuccaa

SEQ ID NO: 204681 - RNA, 22 nt, Human
uccugaaugguguaauagguuu

SEQ ID NO: 204682 - RNA, 21 nt, Human
uccugcagggcagcagagugg

SEQ ID NO: 204683 - RNA, 22 nt, Human
uagcauuuauugggcuagcaaa

SEQ ID NO: 204684 - RNA, 22 nt, Human
uagcauacagauauuuaacucu

SEQ ID NO: 204685 - RNA, 22 nt, Human
uccugcaugcuagugagugcuu

SEQ ID NO: 204686 - RNA, 22 nt, Human
uagcaggagagaaguuuuaagu

SEQ ID NO: 204687 - RNA, 22 nt, Human
uagcaggaggcaguuccucgcu

SEQ ID NO: 204688 - RNA, 22 nt, Human
uccucuucaaaauagcucugaa

SEQ ID NO: 204689 - RNA, 19 nt, Human
uagaggagaauggcaaaga

SEQ ID NO: 204690 - RNA, 22 nt, Human
uagagcucaagaagcaaaagcu

SEQ ID NO: 204691 - RNA, 22 nt, Human
uagagauagccaaguccuucaa

SEQ ID NO: 204692 - RNA, 22 nt, Human
uacuucaguuacaugaagguau

SEQ ID NO: 204693 - RNA, 22 nt, Human
uacuuaucuuagggaugcuugc

SEQ ID NO: 204694 - RNA, 22 nt, Human
ucccagguugaggccuugccug

SEQ ID NO: 204695 - RNA, 22 nt, Human
guuuuuacuuccaaugcuauga

SEQ ID NO: 204696 - RNA, 22 nt, Human
guuuugugugugugcccacacg

SEQ ID NO: 204697 - RNA, 22 nt, Human
guuuugaagagaagcaagucug

SEQ ID NO: 204698 - RNA, 22 nt, Human
guuuugauggaguguguuaaau

SEQ ID NO: 204699 - RNA, 22 nt, Human
ucagauaauccaauagagagga

SEQ ID NO: 204700 - RNA, 22 nt, Human
ucagagccagacacacagcaga

SEQ ID NO: 204701 - RNA, 22 nt, Human
ucagagaaguaggcuaauggug

SEQ ID NO: 204702 - RNA, 21 nt, Human
ucagaccaacucuuguauccu

SEQ ID NO: 204703 - RNA, 22 nt, Human
guuuuucuagaaaucuccuccu

SEQ ID NO: 204704 - RNA, 22 nt, Human
guuuucuccugcuauacagugc

SEQ ID NO: 204705 - RNA, 21 nt, Human
ucagaaucguuccagguagau

SEQ ID NO: 204706 - RNA, 22 nt, Human
ucagaaggagagacagcgugga

SEQ ID NO: 204707 - RNA, 22 nt, Human
ucagaaacuaaauguggauuug

SEQ ID NO: 204708 - RNA, 22 nt, Human
guuuuaucuauguaauuauaaa

SEQ ID NO: 204709 - RNA, 22 nt, Human
ucagaacugcggggaagguggg

SEQ ID NO: 204710 - RNA, 22 nt, Human
guuuuaaucuccuuauuccuaa

SEQ ID NO: 204711 - RNA, 22 nt, Human
ucagcaggugcuuuguuuacuc

SEQ ID NO: 204712 - RNA, 22 nt, Human
ucagcaguuaagcuucccugcc

SEQ ID NO: 204713 - RNA, 23 nt, Human
ucagccgcuggcgaguccacugg

SEQ ID NO: 204714 - RNA, 22 nt, Human
ucagcacagcugcuuuuacuuc

SEQ ID NO: 204715 - RNA, 22 nt, Human
ucagauagcaagggauaccugu

SEQ ID NO: 204716 - RNA, 22 nt, Human
ucagcaaugggauucaggcuuu

SEQ ID NO: 204717 - RNA, 22 nt, Human
uaaaaaccuuguauuuaacucu

SEQ ID NO: 204718 - RNA, 23 nt, Human
guuuuugcugcagcugaagaagg

SEQ ID NO: 204719 - RNA, 21 nt, Human
uaaaagaugacaagacagcuc

SEQ ID NO: 204720 - RNA, 22 nt, Human
ucagcucaggggauguggggga

SEQ ID NO: 204721 - RNA, 22 nt, Human
ucagcguuaguuuuucaucuaa

SEQ ID NO: 204722 - RNA, 22 nt, Human
ucagcguuggccuccuccaggg

SEQ ID NO: 204723 - RNA, 21 nt, Human
ucaggaagagccaguucaugc

SEQ ID NO: 204724 - RNA, 22 nt, Human
uaaagaagaaaaggcuucaggc

SEQ ID NO: 204725 - RNA, 22 nt, Human
uaaaccuuauuugaauaccaac

SEQ ID NO: 204726 - RNA, 22 nt, Human
uaaaaucaugacagauugacau

SEQ ID NO: 204727 - RNA, 22 nt, Human
uaaacgaagcuucaugcuugaa

SEQ ID NO: 204728 - RNA, 22 nt, Human
uaaaaugcucagauaaauauau

SEQ ID NO: 204729 - RNA, 22 nt, Human
ucacucuuuaucuuuuaugucu

SEQ ID NO: 204730 - RNA, 22 nt, Human
ucaccuuuugaauugcuguugu

SEQ ID NO: 204731 - RNA, 22 nt, Human
ucacuguugccacggugauaau

SEQ ID NO: 204732 - RNA, 22 nt, Human
guuugcagacuauguaaacuuc

SEQ ID NO: 204733 - RNA, 22 nt, Human
guuuauuucuuaucaucacuau

SEQ ID NO: 204734 - RNA, 22 nt, Human
guuuccaggcuuugguaugguu

SEQ ID NO: 204735 - RNA, 22 nt, Human
guuuccaagucucucaacaccc

SEQ ID NO: 204736 - RNA, 22 nt, Human
guuuaucagagagcagaggugg

SEQ ID NO: 204737 - RNA, 22 nt, Human
guuuauucuuuuauuugugaga

SEQ ID NO: 204738 - RNA, 22 nt, Human
ucacccuguggcuauaaggcaa

SEQ ID NO: 204739 - RNA, 22 nt, Human
ucaccccagccuuaugacucag

SEQ ID NO: 204740 - RNA, 22 nt, Human
ucacccagacugucugacucuu

SEQ ID NO: 204741 - RNA, 22 nt, Human
ucacaggagucaaggaauagua

SEQ ID NO: 204742 - RNA, 21 nt, Human
ucaagugcccaagguuuguuu

SEQ ID NO: 204743 - RNA, 22 nt, Human
ucacaagaagaaauuaaacugu

SEQ ID NO: 204744 - RNA, 22 nt, Human
ucacauugcauuuucucauuug

SEQ ID NO: 204745 - RNA, 22 nt, Human
ucaccaggauugggcuguaggc

SEQ ID NO: 204746 - RNA, 22 nt, Human
guuuaaaagcaaccaacaggcu

SEQ ID NO: 204747 - RNA, 22 nt, Human
guugucuggcucugaccauucu

SEQ ID NO: 204748 - RNA, 22 nt, Human
guugauuuaggguuuugguuuu

SEQ ID NO: 204749 - RNA, 22 nt, Human
guugcaaaugggaagaugguua

SEQ ID NO: 204750 - RNA, 22 nt, Human
ucaagguauuauuuuuguggug

SEQ ID NO: 204751 - RNA, 22 nt, Human
ucaagggaccaagcauucauua

SEQ ID NO: 204752 - RNA, 21 nt, Human
guugugaccaugggaguugcu

SEQ ID NO: 204753 - RNA, 22 nt, Human
guugugcaaaacaggaaggucu

SEQ ID NO: 204754 - RNA, 19 nt, Human
guuguguuugguucuuuug

SEQ ID NO: 204755 - RNA, 22 nt, Human
guuguugcuauguuauuguuau

SEQ ID NO: 204756 - RNA, 22 nt, Human
uauaagaaaagucauuaucaaa

SEQ ID NO: 204757 - RNA, 22 nt, Human
uauaagaaacaaggcaaauuuu

SEQ ID NO: 204758 - RNA, 22 nt, Human
uauaaagaccuuauccuucaua

SEQ ID NO: 204759 - RNA, 18 nt, Human
uauaaacacacuuagguu

SEQ ID NO: 204760 - RNA, 22 nt, Human
uauacucaauaaauauuuggag

SEQ ID NO: 204761 - RNA, 22 nt, Human
uauauacacgcacauauacaua

SEQ ID NO: 204762 - RNA, 22 nt, Human
uauauauaauguguacagguga

SEQ ID NO: 204763 - RNA, 22 nt, Human
uauauaauacacaaauauguac

SEQ ID NO: 204764 - RNA, 22 nt, Human
uagcauaaaguuucuguguggu

SEQ ID NO: 204765 - RNA, 22 nt, Human
gugcuaugugcugaacucaggu

SEQ ID NO: 204766 - RNA, 22 nt, Human
uaguugguggagcgauuugucu

SEQ ID NO: 204767 - RNA, 22 nt, Human
uaguuggguagacaguucuaca

SEQ ID NO: 204768 - RNA, 22 nt, Human
uaguucauucucucuauuccug

SEQ ID NO: 204769 - RNA, 22 nt, Human
uaguugaauuuaucaguagcau

SEQ ID NO: 204770 - RNA, 22 nt, Human
uaguuuucuuuuguguuauucu

SEQ ID NO: 204771 - RNA, 22 nt, Human
uaguuuuaagcugacauuguuc

SEQ ID NO: 204772 - RNA, 19 nt, Human
uaugacaaguacuaguucu

SEQ ID NO: 204773 - RNA, 22 nt, Human
gugugaguggcuaagugugccu

SEQ ID NO: 204774 - RNA, 19 nt, Human
uaugaaguugauaaaaguu

SEQ ID NO: 204775 - RNA, 22 nt, Human
guguccaugugggugcucuccu

SEQ ID NO: 204776 - RNA, 22 nt, Human
uaugcacacguguccaugugca

SEQ ID NO: 204777 - RNA, 22 nt, Human
uaugagguuaucuaugucguau

SEQ ID NO: 204778 - RNA, 22 nt, Human
uaugagugccaaguuaccuggg

SEQ ID NO: 204779 - RNA, 22 nt, Human
guguggcgacucagagcugccu

SEQ ID NO: 204780 - RNA, 22 nt, Human
uaugcagauaguuugccauuca

SEQ ID NO: 204781 - RNA, 19 nt, Human
uaucccccauagcagugcg

SEQ ID NO: 204782 - RNA, 22 nt, Human
uaucuccauucuagccccuugu

SEQ ID NO: 204783 - RNA, 22 nt, Human
gugucacuuucaggagcucuaa

SEQ ID NO: 204784 - RNA, 22 nt, Human
uauaugcacucagguguaugug

SEQ ID NO: 204785 - RNA, 22 nt, Human
uauauauaugcaccacaugugu

SEQ ID NO: 204786 - RNA, 22 nt, Human
uauaugaggauauuuuaaagcu

SEQ ID NO: 204787 - RNA, 22 nt, Human
uauuuguuucuaguggcagcaa

SEQ ID NO: 204788 - RNA, 22 nt, Human
uauuuguauugucuuaucacuu

SEQ ID NO: 204789 - RNA, 22 nt, Human
uauuucuagggcaugaaaauaa

SEQ ID NO: 204790 - RNA, 22 nt, Human
uauuucaugagugaauaucuag

SEQ ID NO: 204791 - RNA, 22 nt, Human
uauuucaucugaacuucccaac

SEQ ID NO: 204792 - RNA, 22 nt, Human
guugagaagaccauuuuguuca

SEQ ID NO: 204793 - RNA, 22 nt, Human
guugauaauuaauagcuuuuga

SEQ ID NO: 204794 - RNA, 22 nt, Human
uauuguuuuaagguguauuaau

SEQ ID NO: 204795 - RNA, 22 nt, Human
guuccucucacaggcuggagcu

SEQ ID NO: 204796 - RNA, 22 nt, Human
uauuggcucagucagaaguuuu

SEQ ID NO: 204797 - RNA, 22 nt, Human
uauugauuuuguugcuaccugg

SEQ ID NO: 204798 - RNA, 22 nt, Human
uauuuaaagucagcaacuuuuc

SEQ ID NO: 204799 - RNA, 23 nt, Human
guuaccgaccugauucggcagcc

SEQ ID NO: 204800 - RNA, 18 nt, Human
uaugugucuguuacaacu

SEQ ID NO: 204801 - RNA, 22 nt, Human
uauguuaaauguuugauguuua

SEQ ID NO: 204802 - RNA, 22 nt, Human
uaugggaaggauuugucuuuca

SEQ ID NO: 204803 - RNA, 22 nt, Human
uauggcuucucagucaugaaaa

SEQ ID NO: 204804 - RNA, 22 nt, Human
uauggcuaguguguuuguaaca

SEQ ID NO: 204805 - RNA, 22 nt, Human
guguguggacgucugagcccag

SEQ ID NO: 204806 - RNA, 22 nt, Human
guguuagcauggaacagaacgc

SEQ ID NO: 204807 - RNA, 22 nt, Human
guuagaauggacaaagcugaaa

SEQ ID NO: 204808 - RNA, 22 nt, Human
guuauuguuauugcguugucga

SEQ ID NO: 204809 - RNA, 22 nt, Human
guuauuuugucuuguucaugaa

SEQ ID NO: 204810 - RNA, 22 nt, Human
guucaaucucucaugcauuuuc

SEQ ID NO: 204811 - RNA, 22 nt, Human
guucacauccuugugaggauuu

SEQ ID NO: 204812 - RNA, 22 nt, Human
uauguuuugcaaauaucaaaca

SEQ ID NO: 204813 - RNA, 22 nt, Human
uauucuucaacuuuucuccucu

SEQ ID NO: 204814 - RNA, 21 nt, Human
uauucgcauuucugucuuuac

SEQ ID NO: 204815 - RNA, 22 nt, Human
guucaccaguagcugggcuguu

SEQ ID NO: 204816 - RNA, 22 nt, Human
guuccgcggccucgcgcugagc

SEQ ID NO: 204817 - RNA, 22 nt, Human
guuccgcugcaaggccaggaaa

SEQ ID NO: 204818 - RNA, 22 nt, Human
ugaagcuaguauuaacucagau

SEQ ID NO: 204819 - RNA, 22 nt, Human
ucaagagauauaugcugguuua

SEQ ID NO: 204820 - RNA, 22 nt, Human
ucaagcaaggaauccuuuugua

SEQ ID NO: 204821 - RNA, 22 nt, Human
ucaagcuggaaaugaagaaucu

SEQ ID NO: 204822 - RNA, 22 nt, Human
ucaagcacugugcaaugagcuu

SEQ ID NO: 204823 - RNA, 22 nt, Human
ugaaggggaaagucuugcuaua

SEQ ID NO: 204824 - RNA, 22 nt, Human
ugaagguggcuugcagcuaguc

SEQ ID NO: 204825 - RNA, 22 nt, Human
ugaauaaauaaacuuuuacuac

SEQ ID NO: 204826 - RNA, 22 nt, Human
ugaaucugagccugcgcaaagu

SEQ ID NO: 204827 - RNA, 22 nt, Human
ugaaucaaugaauugcacuuca

SEQ ID NO: 204828 - RNA, 22 nt, Human
ugaaugaacugaugaacuuaac

SEQ ID NO: 204829 - RNA, 23 nt, Human
ucacaaggcuauguuauauguac

SEQ ID NO: 204830 - RNA, 22 nt, Human
ugaaucuuguuuacugauuccu

SEQ ID NO: 204831 - RNA, 22 nt, Human
ucaauuuauguggcuauucauu

SEQ ID NO: 204832 - RNA, 22 nt, Human
ugaauuacacugggaucagggc

SEQ ID NO: 204833 - RNA, 22 nt, Human
ugaaugaguucaccgcucaguu

SEQ ID NO: 204834 - RNA, 22 nt, Human
ugaaugcuacccugcuggcucu

SEQ ID NO: 204835 - RNA, 22 nt, Human
ugaauguggucaggaaauuguu

SEQ ID NO: 204836 - RNA, 22 nt, Human
ucacauggauuaacucauuuau

SEQ ID NO: 204837 - RNA, 22 nt, Human
ucaccaugcccuucucugcucu

SEQ ID NO: 204838 - RNA, 22 nt, Human
ucaccauguuuucauaggaaca

SEQ ID NO: 204839 - RNA, 22 nt, Human
ucaccauguacaugaagggcgg

SEQ ID NO: 204840 - RNA, 22 nt, Human
ugaaucagaccuucauugggua

SEQ ID NO: 204841 - RNA, 22 nt, Human
ucacaguucaacuaguucagau

SEQ ID NO: 204842 - RNA, 23 nt, Human
ucacugccaagaaaaguuacaga

SEQ ID NO: 204843 - RNA, 22 nt, Human
ucacugaauuucaagcuagugg

SEQ ID NO: 204844 - RNA, 22 nt, Human
ucacugaacucucauagagaaa

SEQ ID NO: 204845 - RNA, 22 nt, Human
ugaauuauaugguauugaacau

SEQ ID NO: 204846 - RNA, 22 nt, Human
ugaauucaaacuuuuuaacaag

SEQ ID NO: 204847 - RNA, 22 nt, Human
ucacuggauucauguuucuuua

SEQ ID NO: 204848 - RNA, 22 nt, Human
ucaccugccuggguggucaccu

SEQ ID NO: 204849 - RNA, 22 nt, Human
ucaccgucucaguacggaggga

SEQ ID NO: 204850 - RNA, 22 nt, Human
ucaccuggagagcuugcuaaua

SEQ ID NO: 204851 - RNA, 22 nt, Human
ucaccuguucaacagcaauaau

SEQ ID NO: 204852 - RNA, 22 nt, Human
ucacucgccuuuucguucgccg

SEQ ID NO: 204853 - RNA, 22 nt, Human
ucacucagucugagcaauugcu

SEQ ID NO: 204854 - RNA, 19 nt, Human
ucacggucaaccagagccu

SEQ ID NO: 204855 - RNA, 23 nt, Human
ugacagguucuaugguuuccaac

SEQ ID NO: 204856 - RNA, 22 nt, Human
ucagaagguacugaagacaugg

SEQ ID NO: 204857 - RNA, 22 nt, Human
ugacaguuugacugcaaccuuu

SEQ ID NO: 204858 - RNA, 23 nt, Human
ucagaccaaccucuugcuggaac

SEQ ID NO: 204859 - RNA, 22 nt, Human
ucagaaugaaauuucuuucaga

SEQ ID NO: 204860 - RNA, 22 nt, Human
ugaauuuuggcaauuuucugug

SEQ ID NO: 204861 - RNA, 22 nt, Human
ugaauuuuaacauucugcugga

SEQ ID NO: 204862 - RNA, 22 nt, Human
ugacaagagaccccuccgcagg

SEQ ID NO: 204863 - RNA, 20 nt, Human
ucacuguaauugccuacauu

SEQ ID NO: 204864 - RNA, 22 nt, Human
ugacagaaaccaccccccaggu

SEQ ID NO: 204865 - RNA, 22 nt, Human
ucacuuccuugcagcuguagaa

SEQ ID NO: 204866 - RNA, 22 nt, Human
ucacuuuacaucuguaaaagga

SEQ ID NO: 204867 - RNA, 23 nt, Human
ucacuucucuuacccucucucug

SEQ ID NO: 204868 - RNA, 22 nt, Human
ucaggaggucugcugcggggug

SEQ ID NO: 204869 - RNA, 22 nt, Human
ugacguuugcgccgcgcacgac

SEQ ID NO: 204870 - RNA, 22 nt, Human
ugacugguauuuguaaaccaua

SEQ ID NO: 204871 - RNA, 22 nt, Human
ugacugaggaaggugggguggg

SEQ ID NO: 204872 - RNA, 22 nt, Human
ugacugagacugcaaugaccga

SEQ ID NO: 204873 - RNA, 22 nt, Human
ucagcuauccauucuccuauga

SEQ ID NO: 204874 - RNA, 22 nt, Human
ucagcucacaauguugagaaag

SEQ ID NO: 204875 - RNA, 22 nt, Human
ucagcgucuccaaaagagcccg

SEQ ID NO: 204876 - RNA, 22 nt, Human
ucagcucucucuuggugaucuc

SEQ ID NO: 204877 - RNA, 22 nt, Human
ucagcugggagaaaguuuuagg

SEQ ID NO: 204878 - RNA, 23 nt, Human
ugaccauauauccaucagauaua

SEQ ID NO: 204879 - RNA, 19 nt, Human
ucagcagauuuugcaaaca

SEQ ID NO: 204880 - RNA, 22 nt, Human
ucagauggucauucacuagggu

SEQ ID NO: 204881 - RNA, 22 nt, Human
ugacgggacacaggugccaaca

SEQ ID NO: 204882 - RNA, 22 nt, Human
ugaccuuuuuaaauuauuuuua

SEQ ID NO: 204883 - RNA, 21 nt, Human
ucagccuguccaguguuaacc

SEQ ID NO: 204884 - RNA, 22 nt, Human
uauuugauggaacucuugcuuu

SEQ ID NO: 204885 - RNA, 22 nt, Human
ucuuuuuaugucaaaaucgaug

SEQ ID NO: 204886 - RNA, 22 nt, Human
ucuuuuucccugguuccuuuuu

SEQ ID NO: 204887 - RNA, 22 nt, Human
uauuuuaaaagcauuaauucuu

SEQ ID NO: 204888 - RNA, 18 nt, Human
uauuugugugugugugug

SEQ ID NO: 204889 - RNA, 22 nt, Human
uauuuacuuugaggaaguuguu

SEQ ID NO: 204890 - RNA, 22 nt, Human
uauuucaguuaagaugagguca

SEQ ID NO: 204891 - RNA, 22 nt, Human
ucuuuucagccagcugguagga

SEQ ID NO: 204892 - RNA, 22 nt, Human
ucuuuuaucuguuguguaacaa

SEQ ID NO: 204893 - RNA, 22 nt, Human
ucuuuugaacauccaggauguc

SEQ ID NO: 204894 - RNA, 23 nt, Human
uauuuuccccuguaauauguauu

SEQ ID NO: 204895 - RNA, 22 nt, Human
uauuuuauuuagguuuaguugu

SEQ ID NO: 204896 - RNA, 22 nt, Human
uauuuugaggugaaagaguuug

SEQ ID NO: 204897 - RNA, 22 nt, Human
uauuuucucugccacacuucca

SEQ ID NO: 204898 - RNA, 22 nt, Human
uauuuuggaugcauugagaugc

SEQ ID NO: 204899 - RNA, 22 nt, Human
ugaaauugaguaccucuuuaua

SEQ ID NO: 204900 - RNA, 22 nt, Human
ugaaauguggagaugguaagua

SEQ ID NO: 204901 - RNA, 22 nt, Human
ugaaagccuacagcucacuguu

SEQ ID NO: 204902 - RNA, 22 nt, Human
ugaaaaaugcuuuaaugcaugu

SEQ ID NO: 204903 - RNA, 22 nt, Human
ugaaaaauauuuuuagaaauaa

SEQ ID NO: 204904 - RNA, 22 nt, Human
uauuuuucacagauuggugcuu

SEQ ID NO: 204905 - RNA, 22 nt, Human
ucaaaaauaagauauucuggac

SEQ ID NO: 204906 - RNA, 22 nt, Human
ugaagacuucuuuuggucacca

SEQ ID NO: 204907 - RNA, 22 nt, Human
ugaagccacacuagcuuguccu

SEQ ID NO: 204908 - RNA, 22 nt, Human
ugaagccaugcuaaauguuaca

SEQ ID NO: 204909 - RNA, 22 nt, Human
ugaagacaguuuuacucaugag

SEQ ID NO: 204910 - RNA, 22 nt, Human
ugaacagacuauucucccaugu

SEQ ID NO: 204911 - RNA, 22 nt, Human
ugaacauuuuugcuugcagcuu

SEQ ID NO: 204912 - RNA, 21 nt, Human
ugaacaccaggagaaaucggu

SEQ ID NO: 204913 - RNA, 22 nt, Human
ugaaccgcuucauggugccugu

SEQ ID NO: 204914 - RNA, 22 nt, Human
ugaaccaugaauuacaggagca

SEQ ID NO: 204915 - RNA, 22 nt, Human
ugaaccugagggcaaagggaca

SEQ ID NO: 204916 - RNA, 22 nt, Human
ugaacuguccuuguugucuaga

SEQ ID NO: 204917 - RNA, 22 nt, Human
ugaacuggauuugugagcuccu

SEQ ID NO: 204918 - RNA, 22 nt, Human
ugaagaauuccauggcuuccau

SEQ ID NO: 204919 - RNA, 22 nt, Human
uauuuuggcuccugagcucuga

SEQ ID NO: 204920 - RNA, 22 nt, Human
uauuuuuaccuaauuuaugaga

SEQ ID NO: 204921 - RNA, 22 nt, Human
uauuuuuacuguuugaugauuc

SEQ ID NO: 204922 - RNA, 22 nt, Human
uauuuaugcaucacuuuuuucc

SEQ ID NO: 204923 - RNA, 19 nt, Human
ucuuugcuuuucuaagagg

SEQ ID NO: 204924 - RNA, 22 nt, Human
uauuuacuguguucaucccucu

SEQ ID NO: 204925 - RNA, 18 nt, Human
uauuuacuguguguuacc

SEQ ID NO: 204926 - RNA, 22 nt, Human
uauugugaaggccaugugcuaa

SEQ ID NO: 204927 - RNA, 22 nt, Human
uauuuacgcaaacaauugugca

SEQ ID NO: 204928 - RNA, 22 nt, Human
ucuugcucuguucuaaaggauu

SEQ ID NO: 204929 - RNA, 20 nt, Human
ucuugucuggcagccuggag

SEQ ID NO: 204930 - RNA, 22 nt, Human
ucuucuuuccuuuugugcauuu

SEQ ID NO: 204931 - RNA, 22 nt, Human
ucuucuuauuuuaugaucgcuu

SEQ ID NO: 204932 - RNA, 22 nt, Human
uauuguauuagcucuuggagau

SEQ ID NO: 204933 - RNA, 22 nt, Human
uauugaucuuugaaaccuuggu

SEQ ID NO: 204934 - RNA, 22 nt, Human
ucuucuuaggaaagucaggagg

SEQ ID NO: 204935 - RNA, 22 nt, Human
ucuuccauuccccuccuacgcc

SEQ ID NO: 204936 - RNA, 22 nt, Human
ucuacuccaucugccagggcuu

SEQ ID NO: 204937 - RNA, 22 nt, Human
ucuaaugcuuccucucauccca

SEQ ID NO: 204938 - RNA, 22 nt, Human
uaguggaaacagacugagcccg

SEQ ID NO: 204939 - RNA, 22 nt, Human
uaguggccacugaagugcuaga

SEQ ID NO: 204940 - RNA, 22 nt, Human
uagugcuagaagcaaagacaaa

SEQ ID NO: 204941 - RNA, 22 nt, Human
ucaggcgcucuucguggcugcc

SEQ ID NO: 204942 - RNA, 22 nt, Human
ugaggcuuucacuuggcaaaga

SEQ ID NO: 204943 - RNA, 22 nt, Human
ugagggaagguugauaauguuc

SEQ ID NO: 204944 - RNA, 22 nt, Human
ugagggauuucuggccuuaacu

SEQ ID NO: 204945 - RNA, 22 nt, Human
ugagguugggaggacugccuaa

SEQ ID NO: 204946 - RNA, 22 nt, Human
ugagguuacauuaggaauaacc

SEQ ID NO: 204947 - RNA, 22 nt, Human
ugaguuucuuacucaggagcug

SEQ ID NO: 204948 - RNA, 22 nt, Human
ugaguguuguaaccauaugauu

SEQ ID NO: 204949 - RNA, 22 nt, Human
ucauugugugugcuucuugggc

SEQ ID NO: 204950 - RNA, 22 nt, Human
ucauuguuuacugucuuuuuuc

SEQ ID NO: 204951 - RNA, 23 nt, Human
ucauugcucaagauaaugguuga

SEQ ID NO: 204952 - RNA, 22 nt, Human
ucauugguugcauaauuugauc

SEQ ID NO: 204953 - RNA, 20 nt, Human
ugauaggcauugacauaagg

SEQ ID NO: 204954 - RNA, 22 nt, Human
ugauaguaucugauuauuucac

SEQ ID NO: 204955 - RNA, 22 nt, Human
ugaucauugaacaucgaguuaa

SEQ ID NO: 204956 - RNA, 22 nt, Human
ucauuagcuaucagaguggaac

SEQ ID NO: 204957 - RNA, 22 nt, Human
ucauuauuuggaauaugggacu

SEQ ID NO: 204958 - RNA, 22 nt, Human
ugaucuuugcuuuuggcuuagu

SEQ ID NO: 204959 - RNA, 22 nt, Human
ugaugaucaugcagguugguuu

SEQ ID NO: 204960 - RNA, 21 nt, Human
uccaaaggagacugagugugu

SEQ ID NO: 204961 - RNA, 22 nt, Human
ugaugaaguuggaaggaaaguu

SEQ ID NO: 204962 - RNA, 22 nt, Human
ugaugccauaguaaaauuugcu

SEQ ID NO: 204963 - RNA, 22 nt, Human
uccacaaagucuaugagaguug

SEQ ID NO: 204964 - RNA, 22 nt, Human
ugaugcuagaacuuccaagaua

SEQ ID NO: 204965 - RNA, 22 nt, Human
uccagguggcuuuccuggggga

SEQ ID NO: 204966 - RNA, 22 nt, Human
uccagugccagcuguuaaaguu

SEQ ID NO: 204967 - RNA, 22 nt, Human
ugauuuggcaucaguguauccu

SEQ ID NO: 204968 - RNA, 22 nt, Human
ugauuuguuuaaauugcucguu

SEQ ID NO: 204969 - RNA, 23 nt, Human
ugcaaaauuugcagaguucgaug

SEQ ID NO: 204970 - RNA, 22 nt, Human
ugcaaaaguuuuauacacagau

SEQ ID NO: 204971 - RNA, 22 nt, Human
uccaugauauauaugugcacau

SEQ ID NO: 204972 - RNA, 22 nt, Human
uccauaugaucuguuguauggu

SEQ ID NO: 204973 - RNA, 22 nt, Human
ugcaaauucuuuacucugugau

SEQ ID NO: 204974 - RNA, 22 nt, Human
uccaccugucccugcuuccugc

SEQ ID NO: 204975 - RNA, 22 nt, Human
uccaccaccaucacagucagac

SEQ ID NO: 204976 - RNA, 22 nt, Human
ugauguggaucuauaacuguaa

SEQ ID NO: 204977 - RNA, 22 nt, Human
ugauguauaaaaagagugaaau

SEQ ID NO: 204978 - RNA, 22 nt, Human
uccaccacgaaacugcagcugc

SEQ ID NO: 204979 - RNA, 22 nt, Human
uccagaaaucucuguugauugu

SEQ ID NO: 204980 - RNA, 22 nt, Human
ugauuugauuuguuuaugccug

SEQ ID NO: 204981 - RNA, 22 nt, Human
uccaggcagcugcuugaugaua

SEQ ID NO: 204982 - RNA, 22 nt, Human
uccagguaggagaccaggcugu

SEQ ID NO: 204983 - RNA, 23 nt, Human
ugcaaugcagcuagauguaaaau

SEQ ID NO: 204984 - RNA, 22 nt, Human
ugcaaugagcuucuuugauaaa

SEQ ID NO: 204985 - RNA, 22 nt, Human
ugcacagagggaggcauaaaau

SEQ ID NO: 204986 - RNA, 22 nt, Human
ugcacauuucucacaauguaca

SEQ ID NO: 204987 - RNA, 22 nt, Human
ugcaagauccagucuugagaag

SEQ ID NO: 204988 - RNA, 22 nt, Human
ugcaaggcacccacucugcuuu

SEQ ID NO: 204989 - RNA, 22 nt, Human
uccaugcgcgauggccuggcuu

SEQ ID NO: 204990 - RNA, 22 nt, Human
uccccgcugcgcccgcugcugc

SEQ ID NO: 204991 - RNA, 22 nt, Human
ugcagccucacgcauccgcauu

SEQ ID NO: 204992 - RNA, 22 nt, Human
ugcagcgugaggacagcugagc

SEQ ID NO: 204993 - RNA, 20 nt, Human
ugcagcucccccgcaguuuc

SEQ ID NO: 204994 - RNA, 18 nt, Human
ugcagcuuugugauuggc

SEQ ID NO: 204995 - RNA, 18 nt, Human
ugcacccuaagggcccca

SEQ ID NO: 204996 - RNA, 22 nt, Human
ugcagaacacaguagacagaac

SEQ ID NO: 204997 - RNA, 22 nt, Human
ugcacugccuuucuuggcauga

SEQ ID NO: 204998 - RNA, 22 nt, Human
ugcagaauauucuggugacaau

SEQ ID NO: 204999 - RNA, 22 nt, Human
ugcucgggcuccuuugagugag

SEQ ID NO: 205000 - RNA, 22 nt, Human
ugcucugcuaggagaagaauga

SEQ ID NO: 205001 - RNA, 23 nt, Human
ugcucgccuucaggacuugggcu

SEQ ID NO: 205002 - RNA, 22 nt, Human
ucggccuuuucuuauacccaca

SEQ ID NO: 205003 - RNA, 22 nt, Human
ucguauaguugcugcagauggu

SEQ ID NO: 205004 - RNA, 23 nt, Human
ucgucgucagccacuaccucccc

SEQ ID NO: 205005 - RNA, 22 nt, Human
ucguauucagugcaagucaacg

SEQ ID NO: 205006 - RNA, 22 nt, Human
ugcucugguccucccucggcgc

SEQ ID NO: 205007 - RNA, 22 nt, Human
ugcucuuguauccaaaagugau

SEQ ID NO: 205008 - RNA, 22 nt, Human
ugcucuuuguagcugcuuugcu

SEQ ID NO: 205009 - RNA, 22 nt, Human
ucguguuggaacugcuuuguaa

SEQ ID NO: 205010 - RNA, 22 nt, Human
ucguggaugaagaauagaggcc

SEQ ID NO: 205011 - RNA, 22 nt, Human
ucguuucuuuuucuucccugga

SEQ ID NO: 205012 - RNA, 22 nt, Human
ucuaaaaauuagaaauuagguc

SEQ ID NO: 205013 - RNA, 22 nt, Human
ugcugcacuuauggcucugagg

SEQ ID NO: 205014 - RNA, 22 nt, Human
ugcugcacccuucauuuuccca

SEQ ID NO: 205015 - RNA, 22 nt, Human
ucuaaucuuugaaaucaggguc

SEQ ID NO: 205016 - RNA, 22 nt, Human
ugcuauccagacacauaugauc

SEQ ID NO: 205017 - RNA, 22 nt, Human
ugcuaaugagugcugugugaag

SEQ ID NO: 205018 - RNA, 22 nt, Human
ugcuaucuagaaauacuggguu

SEQ ID NO: 205019 - RNA, 22 nt, Human
ugcuauucuuggagcugaugga

SEQ ID NO: 205020 - RNA, 22 nt, Human
ucggcgaccugucauggaccaa

SEQ ID NO: 205021 - RNA, 22 nt, Human
ugcucacugcuuguguucaguu

SEQ ID NO: 205022 - RNA, 22 nt, Human
ugcgccaggacacccguggcgg

SEQ ID NO: 205023 - RNA, 22 nt, Human
ucgaugcuggcgcagguuucac

SEQ ID NO: 205024 - RNA, 22 nt, Human
ucgauccaggaaggcugguuua

SEQ ID NO: 205025 - RNA, 22 nt, Human
ucgagcgcucccugugcucucg

SEQ ID NO: 205026 - RNA, 22 nt, Human
ugcguuuaguuucaagacacgu

SEQ ID NO: 205027 - RNA, 21 nt, Human
ugcuaagugucacaugucugc

SEQ ID NO: 205028 - RNA, 22 nt, Human
uccguugaggcugccaggcgag

SEQ ID NO: 205029 - RNA, 22 nt, Human
ugcaugacugaucuguuuguca

SEQ ID NO: 205030 - RNA, 23 nt, Human
ucccuuuguucuugcuaggaugu

SEQ ID NO: 205031 - RNA, 22 nt, Human
ugcagcuucucugcaacaggag

SEQ ID NO: 205032 - RNA, 22 nt, Human
ucccuuuuagccccgcccuccu

SEQ ID NO: 205033 - RNA, 22 nt, Human
ucccuuuucauccuaucccagc

SEQ ID NO: 205034 - RNA, 22 nt, Human
ucccuuuuuccugaucugugaa

SEQ ID NO: 205035 - RNA, 22 nt, Human
ugccaaugauuccacaauggaa

SEQ ID NO: 205036 - RNA, 22 nt, Human
ugcauucugggucgcagagugg

SEQ ID NO: 205037 - RNA, 22 nt, Human
uccucagcaagacgcuggcagc

SEQ ID NO: 205038 - RNA, 22 nt, Human
ugccauagaaguccaacccaau

SEQ ID NO: 205039 - RNA, 22 nt, Human
ugccagucggcacuuuaucugg

SEQ ID NO: 205040 - RNA, 22 nt, Human
ugccagugugccuuccgcucac

SEQ ID NO: 205041 - RNA, 20 nt, Human
ugccagagagcucauacccu

SEQ ID NO: 205042 - RNA, 20 nt, Human
uccugaaauuacgugauuca

SEQ ID NO: 205043 - RNA, 22 nt, Human
uccucuucucuagagccggaau

SEQ ID NO: 205044 - RNA, 22 nt, Human
ugccaugguuguacaguagcag

SEQ ID NO: 205045 - RNA, 22 nt, Human
ugccauuggucuuaaggcuagc

SEQ ID NO: 205046 - RNA, 22 nt, Human
ugccaucaugucagauuuggga

SEQ ID NO: 205047 - RNA, 22 nt, Human
uccugggucugugagccauacu

SEQ ID NO: 205048 - RNA, 22 nt, Human
ugcccuuucuccagugaccauu

SEQ ID NO: 205049 - RNA, 22 nt, Human
uccuggcuguuagagaggcaag

SEQ ID NO: 205050 - RNA, 22 nt, Human
uccugaaggccugaguuccacc

SEQ ID NO: 205051 - RNA, 22 nt, Human
uccugagaagcacuuaauacac

SEQ ID NO: 205052 - RNA, 22 nt, Human
ugccgccccggggcccccagcc

SEQ ID NO: 205053 - RNA, 22 nt, Human
ugccgcaggaggggcgauuucu

SEQ ID NO: 205054 - RNA, 23 nt, Human
ugccggaucuacuuuggguucuc

SEQ ID NO: 205055 - RNA, 22 nt, Human
uccuuacuccuggagauucuga

SEQ ID NO: 205056 - RNA, 22 nt, Human
uccugguaaagaguaucagauu

SEQ ID NO: 205057 - RNA, 19 nt, Human
ugccggccgcgggguuccu

SEQ ID NO: 205058 - RNA, 21 nt, Human
ugccuggccuuugcuuuuccu

SEQ ID NO: 205059 - RNA, 22 nt, Human
ucgaaacuucucauuuaucugu

SEQ ID NO: 205060 - RNA, 22 nt, Human
uccuuucaaauuuauuugacau

SEQ ID NO: 205061 - RNA, 22 nt, Human
ucuuacuguccucuguuuuucu

SEQ ID NO: 205062 - RNA, 22 nt, Human
ucuuauucuuuuaaacaacgca

SEQ ID NO: 205063 - RNA, 22 nt, Human
ucuuauugugaugaugaagaac

SEQ ID NO: 205064 - RNA, 22 nt, Human
ucuuauugguaaugauggcauu

SEQ ID NO: 205065 - RNA, 22 nt, Human
uggcacugcccugucucggugg

SEQ ID NO: 205066 - RNA, 22 nt, Human
uggcagcauuuuuuccagaaca

SEQ ID NO: 205067 - RNA, 22 nt, Human
uggcacugaagcuggaaagccu

SEQ ID NO: 205068 - RNA, 22 nt, Human
uggcacagcuugucauaaacuc

SEQ ID NO: 205069 - RNA, 22 nt, Human
uggaguuuuaaucuguacagaa

SEQ ID NO: 205070 - RNA, 20 nt, Human
uggaugacuucaggcagccu

SEQ ID NO: 205071 - RNA, 22 nt, Human
ucuguuuuucagaccuuuuugg

SEQ ID NO: 205072 - RNA, 22 nt, Human
ucuuaaauaugaaaaggauuau

SEQ ID NO: 205073 - RNA, 22 nt, Human
uggauuagugcugaaaugaugg

SEQ ID NO: 205074 - RNA, 21 nt, Human
uggaggcguaaucacuguuga

SEQ ID NO: 205075 - RNA, 22 nt, Human
uggaguucauauuggacauaag

SEQ ID NO: 205076 - RNA, 22 nt, Human
uggcagccugcgugaaggagcu

SEQ ID NO: 205077 - RNA, 21 nt, Human
uggcaggcagcuggaagcuug

SEQ ID NO: 205078 - RNA, 22 nt, Human
uggcaggggaaaagggguggga

SEQ ID NO: 205079 - RNA, 20 nt, Human
uggcaugcucucuuuuuagg

SEQ ID NO: 205080 - RNA, 22 nt, Human
uggcaguaaagcuggaaaagug

SEQ ID NO: 205081 - RNA, 22 nt, Human
uggccaugagaaucuuugcugu

SEQ ID NO: 205082 - RNA, 22 nt, Human
ucuugcuguggcagaucuggag

SEQ ID NO: 205083 - RNA, 22 nt, Human
ucuugcuguagcuguuucuucu

SEQ ID NO: 205084 - RNA, 22 nt, Human
uggccauuuacucuguaagagu

SEQ ID NO: 205085 - RNA, 22 nt, Human
ucuugauggugauguuguguca

SEQ ID NO: 205086 - RNA, 22 nt, Human
ucuugccccugcuuuggaacaa

SEQ ID NO: 205087 - RNA, 19 nt, Human
ucuugaggaaaguaaggca

SEQ ID NO: 205088 - RNA, 19 nt, Human
ucuuucauuucuagcucug

SEQ ID NO: 205089 - RNA, 22 nt, Human
uggccucauggccuuaucuggg

SEQ ID NO: 205090 - RNA, 22 nt, Human
ucuuucucauccaaacuaguug

SEQ ID NO: 205091 - RNA, 23 nt, Human
ucuuuccuuucauacagucagcu

SEQ ID NO: 205092 - RNA, 22 nt, Human
ucuuuauuucccuaacuugcua

SEQ ID NO: 205093 - RNA, 22 nt, Human
ucuuggcaguucuugugcuuuu

SEQ ID NO: 205094 - RNA, 22 nt, Human
ucuuggucccugagcucuuuca

SEQ ID NO: 205095 - RNA, 22 nt, Human
ucuugucacagcuugacuccua

SEQ ID NO: 205096 - RNA, 22 nt, Human
uggcaguagagcuggaacuuga

SEQ ID NO: 205097 - RNA, 22 nt, Human
ucuuuaaauucuuaugagugaa

SEQ ID NO: 205098 - RNA, 22 nt, Human
uggcccagaucucugaccuuga

SEQ ID NO: 205099 - RNA, 22 nt, Human
ucuugugagcugagauaaagcc

SEQ ID NO: 205100 - RNA, 22 nt, Human
ucugguuuggguugcuauggcu

SEQ ID NO: 205101 - RNA, 22 nt, Human
uggacuguucauugauacugga

SEQ ID NO: 205102 - RNA, 22 nt, Human
uggagaaauaacauuuggauuc

SEQ ID NO: 205103 - RNA, 22 nt, Human
uggaauuaucugaagugauuug

SEQ ID NO: 205104 - RNA, 22 nt, Human
uggaaggggagcuggaaagggg

SEQ ID NO: 205105 - RNA, 22 nt, Human
ucuggggaugagugaugucgua

SEQ ID NO: 205106 - RNA, 22 nt, Human
uggaaggaaauguguaucauaa

SEQ ID NO: 205107 - RNA, 22 nt, Human
ucugggccaacccuuccauggg

SEQ ID NO: 205108 - RNA, 22 nt, Human
ucugggagaguagauaaaggaa

SEQ ID NO: 205109 - RNA, 22 nt, Human
uggagccagcaggacucagagg

SEQ ID NO: 205110 - RNA, 22 nt, Human
uggagcaagaagggaggcagaa

SEQ ID NO: 205111 - RNA, 22 nt, Human
uggaggaggaugcauuuguugu

SEQ ID NO: 205112 - RNA, 22 nt, Human
uggaggcccagcugggggccgg

SEQ ID NO: 205113 - RNA, 22 nt, Human
uggaggaugacagagaugggcu

SEQ ID NO: 205114 - RNA, 22 nt, Human
uggagcugguucuggggaagcu

SEQ ID NO: 205115 - RNA, 22 nt, Human
ugcugccgccgccaccgccgcc

SEQ ID NO: 205116 - RNA, 22 nt, Human
ugcugccucccaucccucccga

SEQ ID NO: 205117 - RNA, 22 nt, Human
ucuacugagugcugagauuuug

SEQ ID NO: 205118 - RNA, 22 nt, Human
uggaaagauuuaaaauaacgag

SEQ ID NO: 205119 - RNA, 22 nt, Human
uggaaauagauguaggaaauug

SEQ ID NO: 205120 - RNA, 22 nt, Human
uggaaaggcccauaaaaggaua

SEQ ID NO: 205121 - RNA, 22 nt, Human
ucugcagggcccuuggcuccug

SEQ ID NO: 205122 - RNA, 22 nt, Human
uggaaaggaguucuguuuauuu

SEQ ID NO: 205123 - RNA, 22 nt, Human
uggaaaguuggaagucucagga

SEQ ID NO: 205124 - RNA, 22 nt, Human
uggaaauacaagaaguauguca

SEQ ID NO: 205125 - RNA, 22 nt, Human
uggaaauaguugugagucaggc

SEQ ID NO: 205126 - RNA, 22 nt, Human
uggaacuagugucugagauggg

SEQ ID NO: 205127 - RNA, 22 nt, Human
uggaagaaaugguugagccaug

SEQ ID NO: 205128 - RNA, 22 nt, Human
ucuggaggucucagggcgggaa

SEQ ID NO: 205129 - RNA, 22 nt, Human
ucuggcacuugccaguuucuau

SEQ ID NO: 205130 - RNA, 22 nt, Human
ucugcaugccucaggaggccug

SEQ ID NO: 205131 - RNA, 17 nt, Human
ucugccaguuuuagaau

SEQ ID NO: 205132 - RNA, 22 nt, Human
ucugcccguucaaauccuuguu

SEQ ID NO: 205133 - RNA, 22 nt, Human
uggaacugauuaaaagggcaga

SEQ ID NO: 205134 - RNA, 22 nt, Human
ucugcggccggaauucccuuca

SEQ ID NO: 205135 - RNA, 22 nt, Human
uggggcggaaggaggagaggug

SEQ ID NO: 205136 - RNA, 22 nt, Human
uggggcuauggcccgaccacgu

SEQ ID NO: 205137 - RNA, 22 nt, Human
uggggcgcaggcccagcgggcu

SEQ ID NO: 205138 - RNA, 22 nt, Human
uggggcuccuccuggcaggagg

SEQ ID NO: 205139 - RNA, 18 nt, Human
ugggggacgcuuuuuuuc

SEQ ID NO: 205140 - RNA, 22 nt, Human
ugggggagggagaguugauggg

SEQ ID NO: 205141 - RNA, 22 nt, Human
ugaaugaagcacuguaauucuc

SEQ ID NO: 205142 - RNA, 22 nt, Human
ugaauguguacacgauuguuug

SEQ ID NO: 205143 - RNA, 22 nt, Human
ugaauuuguaggaauucuccau

SEQ ID NO: 205144 - RNA, 22 nt, Human
ugaauuucuuuuuaaaauauua

SEQ ID NO: 205145 - RNA, 22 nt, Human
ugacagugugcccggagguuag

SEQ ID NO: 205146 - RNA, 22 nt, Human
ugacagucacagcagaaacucg

SEQ ID NO: 205147 - RNA, 22 nt, Human
ugacacagaccaaguggugcug

SEQ ID NO: 205148 - RNA, 22 nt, Human
ugggcuguuucuuaaggauaug

SEQ ID NO: 205149 - RNA, 21 nt, Human
uggggaugcauugcagaggca

SEQ ID NO: 205150 - RNA, 22 nt, Human
uggggaguaggaggggaacaga

SEQ ID NO: 205151 - RNA, 22 nt, Human
uggggagucccaacgguggaag

SEQ ID NO: 205152 - RNA, 22 nt, Human
uggggagcucagcaccaucagu

SEQ ID NO: 205153 - RNA, 22 nt, Human
uggggacucacugacuaucuug

SEQ ID NO: 205154 - RNA, 22 nt, Human
uggggaauguaauucuuuggcu

SEQ ID NO: 205155 - RNA, 22 nt, Human
ugaaguuuagaaaaagugccuu

SEQ ID NO: 205156 - RNA, 22 nt, Human
ugggccgugagacgucucuggg

SEQ ID NO: 205157 - RNA, 22 nt, Human
ugaauaaucuuggguauuaaua

SEQ ID NO: 205158 - RNA, 22 nt, Human
ugaauagcaccuugaguaauga

SEQ ID NO: 205159 - RNA, 22 nt, Human
ugaauagucaaagcacaagagg

SEQ ID NO: 205160 - RNA, 23 nt, Human
ugaagugaaauuucacaagggac

SEQ ID NO: 205161 - RNA, 21 nt, Human
ugaagggugagauauaaguga

SEQ ID NO: 205162 - RNA, 22 nt, Human
ugggcagggagcuggaaccaca

SEQ ID NO: 205163 - RNA, 22 nt, Human
ugggcagggauuuggggaaacu

SEQ ID NO: 205164 - RNA, 22 nt, Human
ugaagcuagguucaugaggucg

SEQ ID NO: 205165 - RNA, 22 nt, Human
ugaaggaggugaauccaugcau

SEQ ID NO: 205166 - RNA, 22 nt, Human
ugggaggcugugggaauggguc

SEQ ID NO: 205167 - RNA, 22 nt, Human
ugggauucucagaaacacagag

SEQ ID NO: 205168 - RNA, 22 nt, Human
ugaaaugccucuuugguucuaa

SEQ ID NO: 205169 - RNA, 22 nt, Human
ugaaauuuuuuggagauaauuu

SEQ ID NO: 205170 - RNA, 22 nt, Human
uggcuucuggccaggcacagga

SEQ ID NO: 205171 - RNA, 22 nt, Human
uggcuugagcugggcccaccug

SEQ ID NO: 205172 - RNA, 22 nt, Human
ugaaagcuggcucugcagagug

SEQ ID NO: 205173 - RNA, 22 nt, Human
uggcugaugucuguucuguuau

SEQ ID NO: 205174 - RNA, 22 nt, Human
uggcuguuggagcuggaagaug

SEQ ID NO: 205175 - RNA, 22 nt, Human
uggcugggagcuggaacugggc

SEQ ID NO: 205176 - RNA, 22 nt, Human
uggcugagcugcagcguggcuu

SEQ ID NO: 205177 - RNA, 22 nt, Human
uggcucuucucaagcauuggcu

SEQ ID NO: 205178 - RNA, 23 nt, Human
uggcucugagcuuccugguggcc

SEQ ID NO: 205179 - RNA, 22 nt, Human
uggccugauuuugcuaagagaa

SEQ ID NO: 205180 - RNA, 22 nt, Human
ucuuugcauggacauguguuuu

SEQ ID NO: 205181 - RNA, 22 nt, Human
ucuuugcugacacuuacacugu

SEQ ID NO: 205182 - RNA, 17 nt, Human
ucuuuuacuuucucucc

SEQ ID NO: 205183 - RNA, 22 nt, Human
ugggagagauaggcuucuggac

SEQ ID NO: 205184 - RNA, 22 nt, Human
ugaacuuacauugaggaauucu

SEQ ID NO: 205185 - RNA, 22 nt, Human
ugaacuucccauguacagacug

SEQ ID NO: 205186 - RNA, 22 nt, Human
ugggagagaagcugaggcaggg

SEQ ID NO: 205187 - RNA, 22 nt, Human
ugggagccuuccacugggggaa

SEQ ID NO: 205188 - RNA, 22 nt, Human
ugggaauuuaugagaaaauaua

SEQ ID NO: 205189 - RNA, 22 nt, Human
ugggagagaaauuuaaguuuuu

SEQ ID NO: 205190 - RNA, 22 nt, Human
ugggacaugaugcauuugaaag

SEQ ID NO: 205191 - RNA, 21 nt, Human
ugaagcccugugaggugcuua

SEQ ID NO: 205192 - RNA, 22 nt, Human
ugggaugagcuauauagaaagu

SEQ ID NO: 205193 - RNA, 22 nt, Human
ugggauauagaauuggcagagu

SEQ ID NO: 205194 - RNA, 22 nt, Human
ugggaagaguuagagacagcug

SEQ ID NO: 205195 - RNA, 22 nt, Human
ugaaccgacaggggaagauugu

SEQ ID NO: 205196 - RNA, 22 nt, Human
ugaaccuaacauuucuggcagu

SEQ ID NO: 205197 - RNA, 22 nt, Human
ugaacagugugagggugugacc

SEQ ID NO: 205198 - RNA, 22 nt, Human
ugggaaacucuaaacuugagua

SEQ ID NO: 205199 - RNA, 22 nt, Human
ugggaacuggaaaaaaugaagu

SEQ ID NO: 205200 - RNA, 22 nt, Human
ugggaaaauugugauucuuucu

SEQ ID NO: 205201 - RNA, 22 nt, Human
ugggaaaauagcuauuuugaaa

SEQ ID NO: 205202 - RNA, 22 nt, Human
uggcuuuuuucuccccuuggau

SEQ ID NO: 205203 - RNA, 22 nt, Human
uguagcuccuaaagcccagcug

SEQ ID NO: 205204 - RNA, 22 nt, Human
ugauggaucuguuggcggguuu

SEQ ID NO: 205205 - RNA, 22 nt, Human
ugauguaaaauaggaaguucua

SEQ ID NO: 205206 - RNA, 22 nt, Human
ugauggugagaugucccguguu

SEQ ID NO: 205207 - RNA, 22 nt, Human
uguagacaugcuuuucugauga

SEQ ID NO: 205208 - RNA, 22 nt, Human
uguaucuguguguauguguuua

SEQ ID NO: 205209 - RNA, 22 nt, Human
uguauguguuuuauguguguuu

SEQ ID NO: 205210 - RNA, 22 nt, Human
uguaucucugacacagucucac

SEQ ID NO: 205211 - RNA, 22 nt, Human
ugauuagauacuucagaugaca

SEQ ID NO: 205212 - RNA, 22 nt, Human
ugauguuucugaagggguuacu

SEQ ID NO: 205213 - RNA, 20 nt, Human
ugauuauuccaacaagaaug

SEQ ID NO: 205214 - RNA, 22 nt, Human
uguauaugucugugagcuauua

SEQ ID NO: 205215 - RNA, 22 nt, Human
uguauuuuuucccugaaauaaa

SEQ ID NO: 205216 - RNA, 22 nt, Human
ugcaaaaagagcgaggagcccu

SEQ ID NO: 205217 - RNA, 22 nt, Human
ugucagacagggcugcagucag

SEQ ID NO: 205218 - RNA, 22 nt, Human
ugauugcucgacacucugcuug

SEQ ID NO: 205219 - RNA, 22 nt, Human
uguauuuauuuuucaacuacca

SEQ ID NO: 205220 - RNA, 22 nt, Human
ugauugcucagcuagccucuuu

SEQ ID NO: 205221 - RNA, 22 nt, Human
ugauugaauaauguuaugugaa

SEQ ID NO: 205222 - RNA, 22 nt, Human
ugucauuuauucucuuauucua

SEQ ID NO: 205223 - RNA, 22 nt, Human
ugcaagagcccaaacuauauac

SEQ ID NO: 205224 - RNA, 21 nt, Human
ugcaacugaaaggaauauggu

SEQ ID NO: 205225 - RNA, 19 nt, Human
ugcaagcuuuuucuuguua

SEQ ID NO: 205226 - RNA, 22 nt, Human
ugucugucugccauuuauucuc

SEQ ID NO: 205227 - RNA, 22 nt, Human
ugcacgcacuugcucuccagcg

SEQ ID NO: 205228 - RNA, 22 nt, Human
ugguugauuaauuuugccaagc

SEQ ID NO: 205229 - RNA, 22 nt, Human
ugagguauuuggauuuauauuu

SEQ ID NO: 205230 - RNA, 22 nt, Human
ugguugggguaacaaaaaggaa

SEQ ID NO: 205231 - RNA, 22 nt, Human
ugguugcaguggugcuuauaca

SEQ ID NO: 205232 - RNA, 22 nt, Human
ugaguuagcucuauucuuuugg

SEQ ID NO: 205233 - RNA, 22 nt, Human
ugguugugcuucuuugccucag

SEQ ID NO: 205234 - RNA, 22 nt, Human
ugagugugugucuuggguaccg

SEQ ID NO: 205235 - RNA, 22 nt, Human
ugaguuuuggaagauguuacag

SEQ ID NO: 205236 - RNA, 22 nt, Human
ugaguugcagucaauauugcaa

SEQ ID NO: 205237 - RNA, 22 nt, Human
ugaucauguucuccaaaagcgu

SEQ ID NO: 205238 - RNA, 22 nt, Human
ugaugaugauacauuucuucag

SEQ ID NO: 205239 - RNA, 22 nt, Human
uguacauacauagauauacaca

SEQ ID NO: 205240 - RNA, 22 nt, Human
uguaaagguuuuagagcagaga

SEQ ID NO: 205241 - RNA, 22 nt, Human
uguaaauucuauacacuuaaaa

SEQ ID NO: 205242 - RNA, 22 nt, Human
ugaugaugaagaaauauuauca

SEQ ID NO: 205243 - RNA, 22 nt, Human
ugagccugaguguguauugaac

SEQ ID NO: 205244 - RNA, 22 nt, Human
uggugacaucuaccuagguaaa

SEQ ID NO: 205245 - RNA, 22 nt, Human
uggucugggaagaucacaauua

SEQ ID NO: 205246 - RNA, 22 nt, Human
ugaccgucagcugucuuccauu

SEQ ID NO: 205247 - RNA, 22 nt, Human
ugacaucuagauaaaugggaca

SEQ ID NO: 205248 - RNA, 22 nt, Human
ugacauccuacaccccuggguc

SEQ ID NO: 205249 - RNA, 22 nt, Human
ugggggguuuagaaucugcccu

SEQ ID NO: 205250 - RNA, 22 nt, Human
ugggggaugacuugcucuuuca

SEQ ID NO: 205251 - RNA, 22 nt, Human
uggggggacagauggagaggac

SEQ ID NO: 205252 - RNA, 19 nt, Human
ugguggaggugcaccugac

SEQ ID NO: 205253 - RNA, 22 nt, Human
ugguggaggugggggguauuuu

SEQ ID NO: 205254 - RNA, 22 nt, Human
ugaggccaagccuccucugcca

SEQ ID NO: 205255 - RNA, 22 nt, Human
ugaggaaugugacaaaaccaag

SEQ ID NO: 205256 - RNA, 22 nt, Human
uguuccucuuagucuuaugugu

SEQ ID NO: 205257 - RNA, 22 nt, Human
ugccuuuggcuguucugugacc

SEQ ID NO: 205258 - RNA, 22 nt, Human
ugccuuuuguguuuggcuaauc

SEQ ID NO: 205259 - RNA, 22 nt, Human
uguuaaaaagucccuguuuugu

SEQ ID NO: 205260 - RNA, 22 nt, Human
uguuaacuuagcugaccuuaaa

SEQ ID NO: 205261 - RNA, 22 nt, Human
uguuaacugccaggacagaucg

SEQ ID NO: 205262 - RNA, 22 nt, Human
ugccuggacgacaucacaguga

SEQ ID NO: 205263 - RNA, 22 nt, Human
uguguguguguguguguuugug

SEQ ID NO: 205264 - RNA, 20 nt, Human
ugccugagcgcagcuccagg

SEQ ID NO: 205265 - RNA, 22 nt, Human
uguguguuguuuugccagaaua

SEQ ID NO: 205266 - RNA, 22 nt, Human
uguguuagguuuugggauggcu

SEQ ID NO: 205267 - RNA, 22 nt, Human
uguguguucauccccucaacau

SEQ ID NO: 205268 - RNA, 22 nt, Human
uguguuucggauagcagauucu

SEQ ID NO: 205269 - RNA, 22 nt, Human
ugccuguguuugggguggggaa

SEQ ID NO: 205270 - RNA, 22 nt, Human
uguguuccugucuuauucuuau

SEQ ID NO: 205271 - RNA, 22 nt, Human
uguguuuaaacuauaugccugc

SEQ ID NO: 205272 - RNA, 22 nt, Human
uguugauuaauuuucccaaaca

SEQ ID NO: 205273 - RNA, 22 nt, Human
uguugaugaccacaauuuaugc

SEQ ID NO: 205274 - RNA, 22 nt, Human
uguugcauguggcuguuugcca

SEQ ID NO: 205275 - RNA, 22 nt, Human
uguuggaauaagugcuugaagg

SEQ ID NO: 205276 - RNA, 23 nt, Human
ugcuaaaggcagaauauucaccu

SEQ ID NO: 205277 - RNA, 22 nt, Human
ugcguugaggaccgcgagggcg

SEQ ID NO: 205278 - RNA, 22 nt, Human
ugcguggauuuaggagugaggg

SEQ ID NO: 205279 - RNA, 22 nt, Human
ugcuaaugaauggaggaucuga

SEQ ID NO: 205280 - RNA, 21 nt, Human
ugcguaugucuuguauuacuc

SEQ ID NO: 205281 - RNA, 22 nt, Human
uguugaaacagcuauugacuuu

SEQ ID NO: 205282 - RNA, 22 nt, Human
uguucugaggaggguuucaagg

SEQ ID NO: 205283 - RNA, 22 nt, Human
ugcggagggagcagucggcugu

SEQ ID NO: 205284 - RNA, 22 nt, Human
ugcggugcgcccgggcgagugc

SEQ ID NO: 205285 - RNA, 19 nt, Human
uguucuacuugcuaguauu

SEQ ID NO: 205286 - RNA, 22 nt, Human
ugcggaaggcagcgcagggugg

SEQ ID NO: 205287 - RNA, 19 nt, Human
ugcgggcugcggucagggc

SEQ ID NO: 205288 - RNA, 23 nt, Human
uguuccugaugccucguccuguc

SEQ ID NO: 205289 - RNA, 22 nt, Human
ugcgccuccugcugccugcccu

SEQ ID NO: 205290 - RNA, 22 nt, Human
ugcauaugcauguaccuguguu

SEQ ID NO: 205291 - RNA, 22 nt, Human
ugcauuauaacaauaaggcuua

SEQ ID NO: 205292 - RNA, 22 nt, Human
ugcauaagguuaaauuagcaga

SEQ ID NO: 205293 - RNA, 22 nt, Human
ugcauugccauagcagggggau

SEQ ID NO: 205294 - RNA, 22 nt, Human
ugcauugccucuauucauuaua

SEQ ID NO: 205295 - RNA, 22 nt, Human
ugcauuccagcucccuucuggc

SEQ ID NO: 205296 - RNA, 22 nt, Human
ugcagggucuccuguacuuggg

SEQ ID NO: 205297 - RNA, 22 nt, Human
ugcagguggcagcggggcacca

SEQ ID NO: 205298 - RNA, 22 nt, Human
ugcaggguuucaauacacagga

SEQ ID NO: 205299 - RNA, 22 nt, Human
ugugcagugcguggguguugaa

SEQ ID NO: 205300 - RNA, 22 nt, Human
ugugcaucuggaggcaauguuu

SEQ ID NO: 205301 - RNA, 22 nt, Human
ugugccuuucacuaugucauuc

SEQ ID NO: 205302 - RNA, 22 nt, Human
ugugcgucuguguacagaugug

SEQ ID NO: 205303 - RNA, 22 nt, Human
ugugcgcgugugcuuugugugu

SEQ ID NO: 205304 - RNA, 22 nt, Human
ugcaggagaaaguacggagcgu

SEQ ID NO: 205305 - RNA, 22 nt, Human
ugcaggagcaccagcucacccu

SEQ ID NO: 205306 - RNA, 22 nt, Human
ugucuucagguuccucaccacu

SEQ ID NO: 205307 - RNA, 22 nt, Human
ugcacgcgcccuucgauggccc

SEQ ID NO: 205308 - RNA, 20 nt, Human
ugucugugugugauaauagu

SEQ ID NO: 205309 - RNA, 22 nt, Human
ugccucucuggaucugcuguga

SEQ ID NO: 205310 - RNA, 22 nt, Human
uguguguauauauauguaucau

SEQ ID NO: 205311 - RNA, 22 nt, Human
ugccgggcugagcaagugcugc

SEQ ID NO: 205312 - RNA, 22 nt, Human
uguggugcucagggaggauggg

SEQ ID NO: 205313 - RNA, 22 nt, Human
uguggugacuugagcuuccuaa

SEQ ID NO: 205314 - RNA, 22 nt, Human
uguggguggucagcgugugaug

SEQ ID NO: 205315 - RNA, 22 nt, Human
ugugggaucguaaauuugggac

SEQ ID NO: 205316 - RNA, 22 nt, Human
ugccaucuuugccccuauuuua

SEQ ID NO: 205317 - RNA, 22 nt, Human
ugcccaaucaauuguagcuauu

SEQ ID NO: 205318 - RNA, 22 nt, Human
ugugggaucauggaucagggcc

SEQ ID NO: 205319 - RNA, 22 nt, Human
ugcauuugcaauggguacacaa

SEQ ID NO: 205320 - RNA, 22 nt, Human
ugcauuuuuaauuuggaaaaaa

SEQ ID NO: 205321 - RNA, 22 nt, Human
ugccaacaggcuugccugaugu

SEQ ID NO: 205322 - RNA, 22 nt, Human
ugugcuugucuguuuugauugu

SEQ ID NO: 205323 - RNA, 22 nt, Human
uguggacauuccaaaaggacca

SEQ ID NO: 205324 - RNA, 22 nt, Human
uguggauauauuuuaaaaggaa

SEQ ID NO: 205325 - RNA, 22 nt, Human
uugcugccagcgcccugcaggg

SEQ ID NO: 205326 - RNA, 22 nt, Human
uugcugcgcugaccuccaguga

SEQ ID NO: 205327 - RNA, 22 nt, Human
uguggcucugaugucauaaagg

SEQ ID NO: 205328 - RNA, 21 nt, Human
uguggccauuugaaaacaggg

SEQ ID NO: 205329 - RNA, 22 nt, Human
uguggacaccuauuaccaguga

SEQ ID NO: 205330 - RNA, 22 nt, Human
uguggcuuaggugagcauguga

SEQ ID NO: 205331 - RNA, 22 nt, Human
ugugggaggauuuaggugaauc

SEQ ID NO: 205332 - RNA, 22 nt, Human
ugugcaguauugaaauauaugu

SEQ ID NO: 205333 - RNA, 20 nt, Human
uugcucucuuguguugaugu

SEQ ID NO: 205334 - RNA, 22 nt, Human
ugugcuggcuucugugagcuga

SEQ ID NO: 205335 - RNA, 20 nt, Human
uuggagaucacguguccagg

SEQ ID NO: 205336 - RNA, 22 nt, Human
ugugguuuguaagcaaagcaaa

SEQ ID NO: 205337 - RNA, 22 nt, Human
ugugguuggggucagauaggga

SEQ ID NO: 205338 - RNA, 22 nt, Human
ugugugguaaugagagauccaa

SEQ ID NO: 205339 - RNA, 22 nt, Human
ugugugcuaguuuugucaguau

SEQ ID NO: 205340 - RNA, 22 nt, Human
uguguggaaaugcuguauaugu

SEQ ID NO: 205341 - RNA, 22 nt, Human
uuggauagaauuuaaauugucu

SEQ ID NO: 205342 - RNA, 22 nt, Human
uuggaguucuucaugcucugua

SEQ ID NO: 205343 - RNA, 22 nt, Human
uuggaggucucugugguggugg

SEQ ID NO: 205344 - RNA, 22 nt, Human
uuggaaaugcauuuguuauuau

SEQ ID NO: 205345 - RNA, 22 nt, Human
ugugggcugcuguuuccuugua

SEQ ID NO: 205346 - RNA, 22 nt, Human
ugugguagagcuuaaaugaggu

SEQ ID NO: 205347 - RNA, 22 nt, Human
ugugggcguggguuggggaggg

SEQ ID NO: 205348 - RNA, 22 nt, Human
uugcuuucuuuguagguuuucc

SEQ ID NO: 205349 - RNA, 22 nt, Human
uugcuugcggccuuugugccuu

SEQ ID NO: 205350 - RNA, 23 nt, Human
uugcuugagcccaggaaguggag

SEQ ID NO: 205351 - RNA, 22 nt, Human
uugcuuuuugggguuuacuggg

SEQ ID NO: 205352 - RNA, 22 nt, Human
uugcuuugcuucuuuaugguca

SEQ ID NO: 205353 - RNA, 22 nt, Human
uuggccuuacgcauggucggca

SEQ ID NO: 205354 - RNA, 22 nt, Human
uuggcuguguugaaaacgugga

SEQ ID NO: 205355 - RNA, 22 nt, Human
uuggcuuuucaguuuuaaguua

SEQ ID NO: 205356 - RNA, 22 nt, Human
uguuacugaaugucucugcuuu

SEQ ID NO: 205357 - RNA, 22 nt, Human
uguucccgaugacaggaccagg

SEQ ID NO: 205358 - RNA, 22 nt, Human
uguuccggucuaucgugucaau

SEQ ID NO: 205359 - RNA, 22 nt, Human
uuggcuucuugcuaggaagcug

SEQ ID NO: 205360 - RNA, 22 nt, Human
uugggaaauuugaaaauaaaag

SEQ ID NO: 205361 - RNA, 22 nt, Human
uuggccugcuccagaacaaggg

SEQ ID NO: 205362 - RNA, 22 nt, Human
uuggccauuacugagccuggag

SEQ ID NO: 205363 - RNA, 22 nt, Human
ugugugggcgaagacagccuuu

SEQ ID NO: 205364 - RNA, 22 nt, Human
uguguguauauauuuuuauaug

SEQ ID NO: 205365 - RNA, 22 nt, Human
uugggagaaauaguugauccgc

SEQ ID NO: 205366 - RNA, 20 nt, Human
uguuccgugguguccuuuuc

SEQ ID NO: 205367 - RNA, 22 nt, Human
uugggaguaauacugaagagag

SEQ ID NO: 205368 - RNA, 22 nt, Human
uugggauucugucagugugugu

SEQ ID NO: 205369 - RNA, 22 nt, Human
uguugaagcaccucugucuuuc

SEQ ID NO: 205370 - RNA, 21 nt, Human
uguugguugugggaaggagga

SEQ ID NO: 205371 - RNA, 22 nt, Human
uugguguaauacaagcaauuug

SEQ ID NO: 205372 - RNA, 22 nt, Human
uugguguuucacuuccuugucg

SEQ ID NO: 205373 - RNA, 22 nt, Human
uugguuaccuucagaaaugagu

SEQ ID NO: 205374 - RNA, 22 nt, Human
uguuucaugcagcccccuguca

SEQ ID NO: 205375 - RNA, 22 nt, Human
uguuuccuaagugucucugaag

SEQ ID NO: 205376 - RNA, 19 nt, Human
uguugcagcuugaucggua

SEQ ID NO: 205377 - RNA, 22 nt, Human
uguugccaucuaaaauguuacu

SEQ ID NO: 205378 - RNA, 22 nt, Human
uuggugaugaaagugcugcgcu

SEQ ID NO: 205379 - RNA, 22 nt, Human
uuggugaugcccaccuuuucau

SEQ ID NO: 205380 - RNA, 22 nt, Human
uguuggauuuugugaaauauga

SEQ ID NO: 205381 - RNA, 22 nt, Human
uuggugauugggaauggauggg

SEQ ID NO: 205382 - RNA, 22 nt, Human
ugucacggccggguggcaccga

SEQ ID NO: 205383 - RNA, 22 nt, Human
ugucauauagaauguucuauga

SEQ ID NO: 205384 - RNA, 20 nt, Human
ugucccuggagagcugcaga

SEQ ID NO: 205385 - RNA, 21 nt, Human
uugauuuagcagaucuagcug

SEQ ID NO: 205386 - RNA, 18 nt, Human
uguauuguucacuucugu

SEQ ID NO: 205387 - RNA, 22 nt, Human
uguauugaggauucauuuuugu

SEQ ID NO: 205388 - RNA, 22 nt, Human
uguauggguaggaaacagcugg

SEQ ID NO: 205389 - RNA, 22 nt, Human
uguauauguguguagcauguua

SEQ ID NO: 205390 - RNA, 22 nt, Human
uguauauuuucuguauaaaaua

SEQ ID NO: 205391 - RNA, 22 nt, Human
ugucaccucauacaguaccuca

SEQ ID NO: 205392 - RNA, 22 nt, Human
ugucacaccucguuuagcauuc

SEQ ID NO: 205393 - RNA, 19 nt, Human
uguauuuauauuucugugc

SEQ ID NO: 205394 - RNA, 22 nt, Human
uguauuugaagaaagagcuucu

SEQ ID NO: 205395 - RNA, 22 nt, Human
uugcagaauucuucccacucag

SEQ ID NO: 205396 - RNA, 23 nt, Human
ugucugccuaucaugugaaggac

SEQ ID NO: 205397 - RNA, 22 nt, Human
uugcaagauaguguauuuuuca

SEQ ID NO: 205398 - RNA, 22 nt, Human
uguccuuuauauguuuuuuagu

SEQ ID NO: 205399 - RNA, 22 nt, Human
uugcacagaugcacaugguugc

SEQ ID NO: 205400 - RNA, 22 nt, Human
ugucuuucuuucucuugacaga

SEQ ID NO: 205401 - RNA, 22 nt, Human
ugucugcauucgaguucaugga

SEQ ID NO: 205402 - RNA, 19 nt, Human
ugugaagaccucagugcgg

SEQ ID NO: 205403 - RNA, 22 nt, Human
ugugaagaauuaaugugaauca

SEQ ID NO: 205404 - RNA, 17 nt, Human
ugucuuuuuccuccucc

SEQ ID NO: 205405 - RNA, 22 nt, Human
ugucuuuuaaaaauguguaaaa

SEQ ID NO: 205406 - RNA, 22 nt, Human
ugugauugcauugcagauuacu

SEQ ID NO: 205407 - RNA, 22 nt, Human
uugccuagugguagugacuguu

SEQ ID NO: 205408 - RNA, 22 nt, Human
uugccucuaauuagcucuguga

SEQ ID NO: 205409 - RNA, 22 nt, Human
ugugagucuugcaggucgcuca

SEQ ID NO: 205410 - RNA, 22 nt, Human
ugugcagaaggagguucuccgg

SEQ ID NO: 205411 - RNA, 22 nt, Human
ugugauuucaaagggugucuuu

SEQ ID NO: 205412 - RNA, 22 nt, Human
ugugaagugaugggugaccgag

SEQ ID NO: 205413 - RNA, 22 nt, Human
ugugagauuuuauuugauaugc

SEQ ID NO: 205414 - RNA, 22 nt, Human
uugaacauuagaauaaguaauu

SEQ ID NO: 205415 - RNA, 23 nt, Human
uguauacacccugugcaucuggg

SEQ ID NO: 205416 - RNA, 22 nt, Human
uugaaaauuaauagguguacaa

SEQ ID NO: 205417 - RNA, 22 nt, Human
uugaaaacugucaccuuuauuc

SEQ ID NO: 205418 - RNA, 22 nt, Human
uguaauuugguuagauuucuuu

SEQ ID NO: 205419 - RNA, 22 nt, Human
ugguugugcucuguuugaaagu

SEQ ID NO: 205420 - RNA, 22 nt, Human
ugguuuacucuguaaaccagga

SEQ ID NO: 205421 - RNA, 18 nt, Human
ugguuggugggggugaag

SEQ ID NO: 205422 - RNA, 22 nt, Human
ugguuuguauauguuugugaga

SEQ ID NO: 205423 - RNA, 21 nt, Human
ugguuuuaucuugguggcugc

SEQ ID NO: 205424 - RNA, 22 nt, Human
uucuuuucuucccuguuuauua

SEQ ID NO: 205425 - RNA, 22 nt, Human
uucuuuuuagcugguuguaaga

SEQ ID NO: 205426 - RNA, 23 nt, Human
uguaaaacaccguuauugcaccu

SEQ ID NO: 205427 - RNA, 22 nt, Human
uguaaagaaagacgcagaguua

SEQ ID NO: 205428 - RNA, 22 nt, Human
ugguggcaauuuuuggggucaa

SEQ ID NO: 205429 - RNA, 22 nt, Human
uucuucauucccuuacuuccga

SEQ ID NO: 205430 - RNA, 22 nt, Human
uucuuauuuuucguaaauccug

SEQ ID NO: 205431 - RNA, 22 nt, Human
uucuuagauuuuauuucuucug

SEQ ID NO: 205432 - RNA, 20 nt, Human
ugguguacauuuccauaguu

SEQ ID NO: 205433 - RNA, 22 nt, Human
uucuuggcacagaugagauucu

SEQ ID NO: 205434 - RNA, 22 nt, Human
uucuugucuuuguuauguagga

SEQ ID NO: 205435 - RNA, 22 nt, Human
uggugguaggggugguuucuga

SEQ ID NO: 205436 - RNA, 22 nt, Human
ugguggcuuuucguagguucac

SEQ ID NO: 205437 - RNA, 22 nt, Human
ugguggccucaguggcuucugu

SEQ ID NO: 205438 - RNA, 20 nt, Human
uucugcagcagguguugaag

SEQ ID NO: 205439 - RNA, 22 nt, Human
uucugaugccuggguugcuucu

SEQ ID NO: 205440 - RNA, 22 nt, Human
uucugagccacaguaaggaucu

SEQ ID NO: 205441 - RNA, 23 nt, Human
uggugcagcgcaggccggguggc

SEQ ID NO: 205442 - RNA, 22 nt, Human
uggugcaggauuuauuuaacua

SEQ ID NO: 205443 - RNA, 22 nt, Human
uucuguuuauaauuugcaguug

SEQ ID NO: 205444 - RNA, 22 nt, Human
uggugcagacaggagccccgcu

SEQ ID NO: 205445 - RNA, 22 nt, Human
uucuguucugcuuucuccaucc

SEQ ID NO: 205446 - RNA, 22 nt, Human
uucuguguauggaagaaugucc

SEQ ID NO: 205447 - RNA, 22 nt, Human
uucuguuuaaccuggaaagugu

SEQ ID NO: 205448 - RNA, 22 nt, Human
uucuguucuuuguccccuuggu

SEQ ID NO: 205449 - RNA, 22 nt, Human
ugcucagaagacuuacugguua

SEQ ID NO: 205450 - RNA, 22 nt, Human
ugcuauuuuguuuucaguccau

SEQ ID NO: 205451 - RNA, 22 nt, Human
ugcuauuaagagaaagugaaca

SEQ ID NO: 205452 - RNA, 22 nt, Human
uuauuggcagcuccugcacaug

SEQ ID NO: 205453 - RNA, 22 nt, Human
uuauucuuagccucgguauuuc

SEQ ID NO: 205454 - RNA, 22 nt, Human
uuauuccauagaagucaaggaa

SEQ ID NO: 205455 - RNA, 22 nt, Human
uuauuaauacaugcaccugcau

SEQ ID NO: 205456 - RNA, 22 nt, Human
uggaggagaacugauuuggcuu

SEQ ID NO: 205457 - RNA, 22 nt, Human
uuauuguagcacuuuggcagug

SEQ ID NO: 205458 - RNA, 22 nt, Human
uuauuucuucucgaagcuuggg

SEQ ID NO: 205459 - RNA, 22 nt, Human
uuauuucaggcauuuguaaaug

SEQ ID NO: 205460 - RNA, 22 nt, Human
uuauuucauguaaaauuuaugu

SEQ ID NO: 205461 - RNA, 22 nt, Human
uuauuuuguagcucugaucuuu

SEQ ID NO: 205462 - RNA, 22 nt, Human
uuauuuucgugugugugugugu

SEQ ID NO: 205463 - RNA, 22 nt, Human
uuauuugguuuuggcuuuagcu

SEQ ID NO: 205464 - RNA, 22 nt, Human
uuauuuuauaaagagaagacuu

SEQ ID NO: 205465 - RNA, 22 nt, Human
uggaggauaacacaagaaguga

SEQ ID NO: 205466 - RNA, 22 nt, Human
uggaggauggaaggaaagcugg

SEQ ID NO: 205467 - RNA, 22 nt, Human
uggaggaggagaacuuggcacu

SEQ ID NO: 205468 - RNA, 22 nt, Human
uuauuuuuguaacacuguauag

SEQ ID NO: 205469 - RNA, 22 nt, Human
uggagucucacuuccuggaauu

SEQ ID NO: 205470 - RNA, 19 nt, Human
uggaggcggguggcccaga

SEQ ID NO: 205471 - RNA, 22 nt, Human
uggagggaagcaaacacuagau

SEQ ID NO: 205472 - RNA, 20 nt, Human
uggagggaggaggggcccaa

SEQ ID NO: 205473 - RNA, 22 nt, Human
uggaguuuauuugaauucuugg

SEQ ID NO: 205474 - RNA, 22 nt, Human
uucaaacaguguagaauauaug

SEQ ID NO: 205475 - RNA, 22 nt, Human
uucaaacacugugcaauugggu

SEQ ID NO: 205476 - RNA, 22 nt, Human
uggaugagugaauggauaaauc

SEQ ID NO: 205477 - RNA, 20 nt, Human
uucacagaucucuaacugag

SEQ ID NO: 205478 - RNA, 22 nt, Human
uucaaugcaagggaggucugaa

SEQ ID NO: 205479 - RNA, 22 nt, Human
uucaauuacaucagaaucuaaa

SEQ ID NO: 205480 - RNA, 21 nt, Human
uggauauugaguaguuucuga

SEQ ID NO: 205481 - RNA, 22 nt, Human
uggauauuuuguaugugcguuu

SEQ ID NO: 205482 - RNA, 22 nt, Human
uggaugacaaccauuggaagag

SEQ ID NO: 205483 - RNA, 22 nt, Human
uggauucucuguagccugguuc

SEQ ID NO: 205484 - RNA, 22 nt, Human
uggauuguuuacaucaugucug

SEQ ID NO: 205485 - RNA, 22 nt, Human
uggauuuuggaauguuucagua

SEQ ID NO: 205486 - RNA, 22 nt, Human
uggaugccauuugauuaaggcu

SEQ ID NO: 205487 - RNA, 22 nt, Human
uggaugccuugggggaggagga

SEQ ID NO: 205488 - RNA, 22 nt, Human
uggaugcuccaaguagaccuua

SEQ ID NO: 205489 - RNA, 22 nt, Human
uucacccuucucuggcuuucag

SEQ ID NO: 205490 - RNA, 22 nt, Human
uggcaaggccacaggugcaguu

SEQ ID NO: 205491 - RNA, 18 nt, Human
uggcaaugccaaaggcuu

SEQ ID NO: 205492 - RNA, 22 nt, Human
uggcaagcuguuggcagauagc

SEQ ID NO: 205493 - RNA, 22 nt, Human
uggcaaacacaauauggguaca

SEQ ID NO: 205494 - RNA, 22 nt, Human
uggcacguuggauugggaguuc

SEQ ID NO: 205495 - RNA, 22 nt, Human
uggcacaguuaaaguuguagaa

SEQ ID NO: 205496 - RNA, 22 nt, Human
uggcagaaugaagacuggggcc

SEQ ID NO: 205497 - RNA, 22 nt, Human
uggcagccucugguccuuaguu

SEQ ID NO: 205498 - RNA, 22 nt, Human
uucacuuuuuccugguccauuu

SEQ ID NO: 205499 - RNA, 22 nt, Human
uggcacaggcagaaggugccgc

SEQ ID NO: 205500 - RNA, 22 nt, Human
uucaggacuauccaguggucuc

SEQ ID NO: 205501 - RNA, 22 nt, Human
uucaggaaacaaauuugcaguu

SEQ ID NO: 205502 - RNA, 22 nt, Human
uucaggugguuuaagaauugga

SEQ ID NO: 205503 - RNA, 19 nt, Human
uucaggcuuuucauuuuuc

SEQ ID NO: 205504 - RNA, 18 nt, Human
uucaggcucuugcaugaa

SEQ ID NO: 205505 - RNA, 23 nt, Human
uucagcucuccugaagcaucugu

SEQ ID NO: 205506 - RNA, 22 nt, Human
uucagcauaggcugcucuucaa

SEQ ID NO: 205507 - RNA, 18 nt, Human
uggcaugcuuugauacau

SEQ ID NO: 205508 - RNA, 22 nt, Human
uggcaugugaauuguuacauug

SEQ ID NO: 205509 - RNA, 20 nt, Human
uggcaugaaauuuuccaagc

SEQ ID NO: 205510 - RNA, 22 nt, Human
uucagaauguacugauagaaca

SEQ ID NO: 205511 - RNA, 22 nt, Human
uggcagcucauuuggaaaugga

SEQ ID NO: 205512 - RNA, 22 nt, Human
uggcaucacagacaaggcagca

SEQ ID NO: 205513 - RNA, 22 nt, Human
uggcaucucggugcugguucuu

SEQ ID NO: 205514 - RNA, 22 nt, Human
uucagcaagugucucuacuguc

SEQ ID NO: 205515 - RNA, 22 nt, Human
uggcagugggaagcuggaaguc

SEQ ID NO: 205516 - RNA, 22 nt, Human
uggcgcgcucgcucucgcugag

SEQ ID NO: 205517 - RNA, 22 nt, Human
uggcggcggggagguaggcaga

SEQ ID NO: 205518 - RNA, 22 nt, Human
uggcggcuggacuggggggcca

SEQ ID NO: 205519 - RNA, 22 nt, Human
uggcgugaagcuggaaggcgga

SEQ ID NO: 205520 - RNA, 22 nt, Human
uucauugauuuccuuggaauaa

SEQ ID NO: 205521 - RNA, 22 nt, Human
uggcggagacauggacuucaga

SEQ ID NO: 205522 - RNA, 22 nt, Human
uucauugcagaauuuggccuca

SEQ ID NO: 205523 - RNA, 22 nt, Human
uucauugcuacuuaaaauacca

SEQ ID NO: 205524 - RNA, 22 nt, Human
uucauuagcacauuuccuuggu

SEQ ID NO: 205525 - RNA, 22 nt, Human
uucauauuuaauuggucaucaa

SEQ ID NO: 205526 - RNA, 22 nt, Human
uuccacuguucaguucugguca

SEQ ID NO: 205527 - RNA, 22 nt, Human
uggcucagcgcggccuggucuu

SEQ ID NO: 205528 - RNA, 22 nt, Human
uggcuacguacaauggaacuuu

SEQ ID NO: 205529 - RNA, 22 nt, Human
uggcuucagacuucugcuacgu

SEQ ID NO: 205530 - RNA, 22 nt, Human
uuccagucugggcucuucacug

SEQ ID NO: 205531 - RNA, 22 nt, Human
uuccagguggcuuuccuggggg

SEQ ID NO: 205532 - RNA, 22 nt, Human
uuccagauguuuaaguucugcu

SEQ ID NO: 205533 - RNA, 22 nt, Human
uuccagaacaauguggacguau

SEQ ID NO: 205534 - RNA, 22 nt, Human
uucaucauuuuccauuccucuu

SEQ ID NO: 205535 - RNA, 20 nt, Human
uggcccgcgcuccuccugcu

SEQ ID NO: 205536 - RNA, 22 nt, Human
uucaugcaagagugugaggucc

SEQ ID NO: 205537 - RNA, 20 nt, Human
uggccgacccugaggaguug

SEQ ID NO: 205538 - RNA, 22 nt, Human
uucauacucuucccugggcaaa

SEQ ID NO: 205539 - RNA, 22 nt, Human
uggccaaucagcugugaccugc

SEQ ID NO: 205540 - RNA, 22 nt, Human
uggcccaucagggcaccugaga

SEQ ID NO: 205541 - RNA, 20 nt, Human
uggcccagcacgacgaggac

SEQ ID NO: 205542 - RNA, 22 nt, Human
uucagguacuaagugcugauuc

SEQ ID NO: 205543 - RNA, 22 nt, Human
uucagguuuuuaaguucugccu

SEQ ID NO: 205544 - RNA, 22 nt, Human
uggcauuuuguagcuguguauc

SEQ ID NO: 205545 - RNA, 22 nt, Human
uggccagucuuagcugugccug

SEQ ID NO: 205546 - RNA, 22 nt, Human
uucaguaugcugaaugauuuuu

SEQ ID NO: 205547 - RNA, 22 nt, Human
ugggggauucaucucagagcgu

SEQ ID NO: 205548 - RNA, 22 nt, Human
ugggggcacccagccgaugagg

SEQ ID NO: 205549 - RNA, 22 nt, Human
uggggucuggcauaugguagau

SEQ ID NO: 205550 - RNA, 22 nt, Human
ugggggaggaggagacagacug

SEQ ID NO: 205551 - RNA, 22 nt, Human
uggggcuuucgcggagcgucgg

SEQ ID NO: 205552 - RNA, 22 nt, Human
uucguucagcgcuugcgcaugc

SEQ ID NO: 205553 - RNA, 20 nt, Human
uucguuucaguguuggauca

SEQ ID NO: 205554 - RNA, 22 nt, Human
ugggugaagaggcuaugcuacu

SEQ ID NO: 205555 - RNA, 22 nt, Human
uucucagagaaagcuccucaug

SEQ ID NO: 205556 - RNA, 20 nt, Human
uucuccacaggguggaggag

SEQ ID NO: 205557 - RNA, 22 nt, Human
uucucuggggacugucucuauu

SEQ ID NO: 205558 - RNA, 22 nt, Human
ugggucagauugagccccuggu

SEQ ID NO: 205559 - RNA, 22 nt, Human
ugggucaguagccuugcagaac

SEQ ID NO: 205560 - RNA, 22 nt, Human
ugggguguuacacaacauugag

SEQ ID NO: 205561 - RNA, 22 nt, Human
uuccccuucuaauacucaauuu

SEQ ID NO: 205562 - RNA, 22 nt, Human
uuccccuuaagagacaguugga

SEQ ID NO: 205563 - RNA, 18 nt, Human
uuccauuuuucagucuuc

SEQ ID NO: 205564 - RNA, 22 nt, Human
uucccagggaucucuaguauuu

SEQ ID NO: 205565 - RNA, 20 nt, Human
ugggauggaaucaccugcac

SEQ ID NO: 205566 - RNA, 22 nt, Human
uggcuuuucaccugcuccucug

SEQ ID NO: 205567 - RNA, 22 nt, Human
uggcuuuugaaaaggugaugua

SEQ ID NO: 205568 - RNA, 22 nt, Human
uggggcugguaccguaauauau

SEQ ID NO: 205569 - RNA, 22 nt, Human
uuccuuuuuaauuaaucuaauu

SEQ ID NO: 205570 - RNA, 22 nt, Human
ugggcaguccagcuggaaacgg

SEQ ID NO: 205571 - RNA, 22 nt, Human
ugggauggacuuuagagaaucg

SEQ ID NO: 205572 - RNA, 22 nt, Human
ugggcaaaugcuuuuuagucaa

SEQ ID NO: 205573 - RNA, 22 nt, Human
ugggcagagggugaggaaggcg

SEQ ID NO: 205574 - RNA, 22 nt, Human
ugggcacacugaaucugcuauu

SEQ ID NO: 205575 - RNA, 22 nt, Human
uuucaagccucacugcguuuug

SEQ ID NO: 205576 - RNA, 22 nt, Human
uuuauuuuccaugucucuaggu

SEQ ID NO: 205577 - RNA, 22 nt, Human
uuuauuugugguaguguaaucu

SEQ ID NO: 205578 - RNA, 19 nt, Human
uuucacaaagagagcguga

SEQ ID NO: 205579 - RNA, 22 nt, Human
uuauaaaccgcuaacagcacuu

SEQ ID NO: 205580 - RNA, 22 nt, Human
uuuaugauguagccuagagcug

SEQ ID NO: 205581 - RNA, 22 nt, Human
uuaguuauaggugaaucagaga

SEQ ID NO: 205582 - RNA, 22 nt, Human
uuuauuuagguaaacaugaguu

SEQ ID NO: 205583 - RNA, 22 nt, Human
uuuaggucacuccaccgaagag

SEQ ID NO: 205584 - RNA, 22 nt, Human
uuagagagguuggagugguaga

SEQ ID NO: 205585 - RNA, 22 nt, Human
uuagcgcucucuccauucuuaa

SEQ ID NO: 205586 - RNA, 22 nt, Human
uguuacaucucugcccagccua

SEQ ID NO: 205587 - RNA, 22 nt, Human
uuaggagugaguuacuuagggu

SEQ ID NO: 205588 - RNA, 22 nt, Human
uuuauauauauguaggagcaca

SEQ ID NO: 205589 - RNA, 22 nt, Human
uuuaucaggccaucuuaugucu

SEQ ID NO: 205590 - RNA, 22 nt, Human
uuuaucucugcauagaagugau

SEQ ID NO: 205591 - RNA, 22 nt, Human
uuuauccacucauccaugccuc

SEQ ID NO: 205592 - RNA, 22 nt, Human
uuuauaagccagacacugcguu

SEQ ID NO: 205593 - RNA, 22 nt, Human
uguuugagaauuugcugauguu

SEQ ID NO: 205594 - RNA, 22 nt, Human
uuuacaaggcaguuauuuuccu

SEQ ID NO: 205595 - RNA, 22 nt, Human
uuguaugcugggaagcgggagg

SEQ ID NO: 205596 - RNA, 22 nt, Human
uuguauaaagauggcuagaucc

SEQ ID NO: 205597 - RNA, 22 nt, Human
uuuacucagucugagcaggugu

SEQ ID NO: 205598 - RNA, 22 nt, Human
uuaccauaguacuaucaguuua

SEQ ID NO: 205599 - RNA, 22 nt, Human
uuuacaagucuguugaucccaa

SEQ ID NO: 205600 - RNA, 22 nt, Human
uuacaugcuugugcagguuuug

SEQ ID NO: 205601 - RNA, 20 nt, Human
uuacugagguauuuuuauca

SEQ ID NO: 205602 - RNA, 22 nt, Human
uuacuggaauauaaagauaaga

SEQ ID NO: 205603 - RNA, 22 nt, Human
uuagagaagcacuguaggugaa

SEQ ID NO: 205604 - RNA, 21 nt, Human
uuacuggcagcagaaaccuga

SEQ ID NO: 205605 - RNA, 22 nt, Human
uuagagaauagacuuuacccug

SEQ ID NO: 205606 - RNA, 22 nt, Human
uuuagcaguuuauuuaaggggg

SEQ ID NO: 205607 - RNA, 22 nt, Human
uuuagguccguguugcaguugg

SEQ ID NO: 205608 - RNA, 22 nt, Human
uuuagcugugugugucgcucca

SEQ ID NO: 205609 - RNA, 22 nt, Human
uuuaggaagaucugaaggaaga

SEQ ID NO: 205610 - RNA, 22 nt, Human
uuuccugcagacaguuuaagca

SEQ ID NO: 205611 - RNA, 22 nt, Human
uuaugugcuuuuugagcucuaa

SEQ ID NO: 205612 - RNA, 22 nt, Human
uuauguugauaggaaucugauu

SEQ ID NO: 205613 - RNA, 22 nt, Human
uuuccaguaaguggcaaggagc

SEQ ID NO: 205614 - RNA, 22 nt, Human
uuaugugcuacacauaauuugu

SEQ ID NO: 205615 - RNA, 22 nt, Human
uuaugucauuugaauuaauuuu

SEQ ID NO: 205616 - RNA, 22 nt, Human
uuuccugacuucaccuuuuacc

SEQ ID NO: 205617 - RNA, 18 nt, Human
uuuccucauuugcagacu

SEQ ID NO: 205618 - RNA, 22 nt, Human
uuuccaguuguucuagaaagcu

SEQ ID NO: 205619 - RNA, 22 nt, Human
uuucgcuuguucggagugcuuu

SEQ ID NO: 205620 - RNA, 19 nt, Human
uuucucacugagucguuug

SEQ ID NO: 205621 - RNA, 22 nt, Human
uuucuauuuacagugcuaggua

SEQ ID NO: 205622 - RNA, 22 nt, Human
uuucuaaguuugaggcgaagca

SEQ ID NO: 205623 - RNA, 22 nt, Human
uuucuacacuucgugguguuuu

SEQ ID NO: 205624 - RNA, 22 nt, Human
uuucagacugcccauguuugcc

SEQ ID NO: 205625 - RNA, 22 nt, Human
uuucagcaugacuguuaucuuu

SEQ ID NO: 205626 - RNA, 22 nt, Human
uuucagguggaaguuuuagaug

SEQ ID NO: 205627 - RNA, 22 nt, Human
uuucaucccugucagugaaggc

SEQ ID NO: 205628 - RNA, 22 nt, Human
uuaguuagucuaugccugacca

SEQ ID NO: 205629 - RNA, 22 nt, Human
uuucacugaguaggagagcacu

SEQ ID NO: 205630 - RNA, 22 nt, Human
uuauaucagaaggugagauuga

SEQ ID NO: 205631 - RNA, 22 nt, Human
uuauacugaaagucuuuuaaua

SEQ ID NO: 205632 - RNA, 22 nt, Human
uuauaguuuucaaggauuggag

SEQ ID NO: 205633 - RNA, 22 nt, Human
uuaugcaaaggggccucuuccu

SEQ ID NO: 205634 - RNA, 22 nt, Human
uuaugccuguuaggcagcaucu

SEQ ID NO: 205635 - RNA, 22 nt, Human
uuaugggcgaugcaaaccugau

SEQ ID NO: 205636 - RNA, 22 nt, Human
uuaucuuuuaaaaacacuugug

SEQ ID NO: 205637 - RNA, 22 nt, Human
uuaucugugcuuuacugacaga

SEQ ID NO: 205638 - RNA, 22 nt, Human
uuucauggaggccaggacagag

SEQ ID NO: 205639 - RNA, 21 nt, Human
uuucauuaguacaucaauuug

SEQ ID NO: 205640 - RNA, 22 nt, Human
uucauuuccauuuuauagauaa

SEQ ID NO: 205641 - RNA, 22 nt, Human
uuugguguuuucaggaauauac

SEQ ID NO: 205642 - RNA, 22 nt, Human
uuuguacuuucuaauguauuua

SEQ ID NO: 205643 - RNA, 21 nt, Human
uucauucauggcauaauauag

SEQ ID NO: 205644 - RNA, 22 nt, Human
uuuguauuucaaggcacucuca

SEQ ID NO: 205645 - RNA, 22 nt, Human
uuccaaaugacaaugggcugua

SEQ ID NO: 205646 - RNA, 22 nt, Human
uuuguaguuguggaugcugaag

SEQ ID NO: 205647 - RNA, 22 nt, Human
uucccauuccagcucgaucaau

SEQ ID NO: 205648 - RNA, 22 nt, Human
uuugugauaaguggauucaagg

SEQ ID NO: 205649 - RNA, 22 nt, Human
uuccccaccagagacagagcug

SEQ ID NO: 205650 - RNA, 22 nt, Human
uuccccaugugaugcuauugcu

SEQ ID NO: 205651 - RNA, 22 nt, Human
uuuguguuuucaggcacauggc

SEQ ID NO: 205652 - RNA, 22 nt, Human
uuugcauuugagagaggaaaca

SEQ ID NO: 205653 - RNA, 22 nt, Human
uucaggggcaaauacauuuuga

SEQ ID NO: 205654 - RNA, 23 nt, Human
uuugcaaauuggacacaaccaca

SEQ ID NO: 205655 - RNA, 22 nt, Human
uuugcaaaguccauugaaguua

SEQ ID NO: 205656 - RNA, 22 nt, Human
uuugauuuuguuuauagugccg

SEQ ID NO: 205657 - RNA, 22 nt, Human
uucagacugcccauguuugcca

SEQ ID NO: 205658 - RNA, 22 nt, Human
uucauccucuuuaucuaccugu

SEQ ID NO: 205659 - RNA, 22 nt, Human
uuuggucaucaaagacaaguaa

SEQ ID NO: 205660 - RNA, 22 nt, Human
uuugggccugucugccugcuuu

SEQ ID NO: 205661 - RNA, 18 nt, Human
uuugggauccucuuuucu

SEQ ID NO: 205662 - RNA, 22 nt, Human
uucauacuguuuaaguucuguu

SEQ ID NO: 205663 - RNA, 22 nt, Human
uucaguuuugcuuuuaaucaug

SEQ ID NO: 205664 - RNA, 22 nt, Human
uuauuuuuaggaauguagaggu

SEQ ID NO: 205665 - RNA, 22 nt, Human
uuucuuuuucuacaccuuagcu

SEQ ID NO: 205666 - RNA, 22 nt, Human
uuugaagauaaauauggagaaa

SEQ ID NO: 205667 - RNA, 22 nt, Human
uuugaagaaacagucuuaagag

SEQ ID NO: 205668 - RNA, 22 nt, Human
uuauuuuuguuuguuaagccua

SEQ ID NO: 205669 - RNA, 22 nt, Human
uucaaaccuaucuaagaaauag

SEQ ID NO: 205670 - RNA, 22 nt, Human
uucaacacaaguugugcaguaa

SEQ ID NO: 205671 - RNA, 22 nt, Human
uucaacaacuugguucaaaugg

SEQ ID NO: 205672 - RNA, 22 nt, Human
uuugagaagauaggggaauacu

SEQ ID NO: 205673 - RNA, 21 nt, Human
uuugacagaccagguauaguu

SEQ ID NO: 205674 - RNA, 22 nt, Human
uucacagugguaaggguuguga

SEQ ID NO: 205675 - RNA, 22 nt, Human
uuugaguacagcugccuuuuug

SEQ ID NO: 205676 - RNA, 22 nt, Human
uuugagguuuagcucacuauuu

SEQ ID NO: 205677 - RNA, 22 nt, Human
uuugaugagaaaugacuuaagu

SEQ ID NO: 205678 - RNA, 22 nt, Human
uuugagugccucgaguguggga

SEQ ID NO: 205679 - RNA, 22 nt, Human
uuucugggggucgugcuggcug

SEQ ID NO: 205680 - RNA, 22 nt, Human
uuucuggaaacuguaaagagga

SEQ ID NO: 205681 - RNA, 22 nt, Human
uuucuggacuaaagggagagau

SEQ ID NO: 205682 - RNA, 22 nt, Human
uuucuguucuguuggauucuuu

SEQ ID NO: 205683 - RNA, 22 nt, Human
uuucuguugugaccugacucuu

SEQ ID NO: 205684 - RNA, 22 nt, Human
uuucuugugauuuugaugaacu

SEQ ID NO: 205685 - RNA, 22 nt, Human
uuucuuccuucuugaucauuug

SEQ ID NO: 205686 - RNA, 22 nt, Human
uuauuugcccauguuuagcaga

SEQ ID NO: 205687 - RNA, 22 nt, Human
uuucuuaguuaaguagguaggc

SEQ ID NO: 205688 - RNA, 22 nt, Human
uuucucuuucaaucugcaguac

SEQ ID NO: 205689 - RNA, 20 nt, Human
uuucucccacaaugacccuc

SEQ ID NO: 205690 - RNA, 23 nt, Human
uuucugaguuuuuuaaaagucca

SEQ ID NO: 205691 - RNA, 22 nt, Human
uuauuuaaguauuuauugaagu

SEQ ID NO: 205692 - RNA, 22 nt, Human
uuauuuaagaucuuaauauaua

SEQ ID NO: 205693 - RNA, 22 nt, Human
uuauuuaaaauguagguuggga

SEQ ID NO: 205694 - RNA, 22 nt, Human
uuucucuccucgaaauucuuau

SEQ ID NO: 205695 - RNA, 22 nt, Human
uuauuguuuggguauaauuuga

SEQ ID NO: 205696 - RNA, 22 nt, Human
uugccuguuugagagcuguguu

SEQ ID NO: 205697 - RNA, 22 nt, Human
uugccgacuggccaaggaguaa

SEQ ID NO: 205698 - RNA, 22 nt, Human
uugccaggggacaucuggagcc

SEQ ID NO: 205699 - RNA, 23 nt, Human
uugcauuaauguggaggcacagg

SEQ ID NO: 205700 - RNA, 22 nt, Human
uugcggauguccacgucacacu

SEQ ID NO: 205701 - RNA, 18 nt, Human
uugcucucucugggggca

SEQ ID NO: 205702 - RNA, 22 nt, Human
uugcucaugucaccaaagcaca

SEQ ID NO: 205703 - RNA, 22 nt, Human
uugcagagaacuaaagggagua

SEQ ID NO: 205704 - RNA, 22 nt, Human
uugcagcuguugcaaagucucu

SEQ ID NO: 205705 - RNA, 22 nt, Human
uugcagugucaucuagacgugg

SEQ ID NO: 205706 - RNA, 22 nt, Human
uugcauauguccagccaugcau

SEQ ID NO: 205707 - RNA, 22 nt, Human
uugcaugugugaaaugcacaga

SEQ ID NO: 205708 - RNA, 20 nt, Human
uugcaugcagccggaugcug

SEQ ID NO: 205709 - RNA, 22 nt, Human
uugcaucagcaggcauaauugg

SEQ ID NO: 205710 - RNA, 20 nt, Human
uugcaaagugaauagcaauu

SEQ ID NO: 205711 - RNA, 22 nt, Human
uugauuuggaauuuuuagagcu

SEQ ID NO: 205712 - RNA, 22 nt, Human
uugcaagcccugaagggcugga

SEQ ID NO: 205713 - RNA, 22 nt, Human
uugcuggaguagaaaacuuaac

SEQ ID NO: 205714 - RNA, 21 nt, Human
uugcuggagcaauguaaauca

SEQ ID NO: 205715 - RNA, 22 nt, Human
uugcugggauucauugaagggu

SEQ ID NO: 205716 - RNA, 22 nt, Human
uugcugagcugaaccagccacc

SEQ ID NO: 205717 - RNA, 22 nt, Human
uugcucuuaccauuauguguga

SEQ ID NO: 205718 - RNA, 22 nt, Human
uugcugaggcuggggagaggug

SEQ ID NO: 205719 - RNA, 22 nt, Human
uugcuugaacccaggaagugga

SEQ ID NO: 205720 - RNA, 22 nt, Human
uugcugugucauuuguuuaauc

SEQ ID NO: 205721 - RNA, 22 nt, Human
uugcugguggcucugauuucau

SEQ ID NO: 205722 - RNA, 22 nt, Human
uuggaagugucuaauacaggua

SEQ ID NO: 205723 - RNA, 22 nt, Human
uugcuuuuuuggguuuacuggg

SEQ ID NO: 205724 - RNA, 22 nt, Human
uuggaagagagauggggagaga

SEQ ID NO: 205725 - RNA, 22 nt, Human
uuggagagggugggcuuugaag

SEQ ID NO: 205726 - RNA, 22 nt, Human
uuggagaaagcugcaggcucug

SEQ ID NO: 205727 - RNA, 22 nt, Human
uuggaagacagccgucuuuauu

SEQ ID NO: 205728 - RNA, 22 nt, Human
uuggaaaagaaauacucauaua

SEQ ID NO: 205729 - RNA, 23 nt, Human
uugcuuuugccccaaaagaguua

SEQ ID NO: 205730 - RNA, 22 nt, Human
uuuaaguuaguauggguuaggu

SEQ ID NO: 205731 - RNA, 22 nt, Human
uuuaauauucucuuugaaggaa

SEQ ID NO: 205732 - RNA, 22 nt, Human
uuuaauauuacacuuaccuugu

SEQ ID NO: 205733 - RNA, 22 nt, Human
uuuaaucaguugguaauauuga

SEQ ID NO: 205734 - RNA, 22 nt, Human
uuuaaucaauaaccuccugggu

SEQ ID NO: 205735 - RNA, 22 nt, Human
uuuaaaccuaucuaagaaauag

SEQ ID NO: 205736 - RNA, 20 nt, Human
uuuaacuggccuucuggcuc

SEQ ID NO: 205737 - RNA, 22 nt, Human
uuuaaauuucugaaucuugagg

SEQ ID NO: 205738 - RNA, 22 nt, Human
uuuaacauaugaaagaauauuu

SEQ ID NO: 205739 - RNA, 22 nt, Human
uuguuugguugacugauuuacc

SEQ ID NO: 205740 - RNA, 22 nt, Human
uuguuuguaaggcucuuagaau

SEQ ID NO: 205741 - RNA, 22 nt, Human
uuguuucagcuuccuccuccau

SEQ ID NO: 205742 - RNA, 22 nt, Human
uuguuucauggggacgacuggc

SEQ ID NO: 205743 - RNA, 22 nt, Human
uuguuuacuugagcugcacucu

SEQ ID NO: 205744 - RNA, 22 nt, Human
uuuaaaauguuuuauuuauuua

SEQ ID NO: 205745 - RNA, 22 nt, Human
uuuaaaacaguacguuuucuua

SEQ ID NO: 205746 - RNA, 22 nt, Human
uugucccuaugagugguaauca

SEQ ID NO: 205747 - RNA, 20 nt, Human
uuguacuuaugugagaagga

SEQ ID NO: 205748 - RNA, 22 nt, Human
uuggugaugcuaggaauguagu

SEQ ID NO: 205749 - RNA, 22 nt, Human
uuggucagaugugucuccuccu

SEQ ID NO: 205750 - RNA, 19 nt, Human
uuggugaagguucacugac

SEQ ID NO: 205751 - RNA, 22 nt, Human
uuggcaggcugcauguuuaugu

SEQ ID NO: 205752 - RNA, 22 nt, Human
uuggcaaaagauuggguacuua

SEQ ID NO: 205753 - RNA, 22 nt, Human
uuggcaaagagaugcauaagga

SEQ ID NO: 205754 - RNA, 22 nt, Human
uuggcacagagcugcagccugg

SEQ ID NO: 205755 - RNA, 22 nt, Human
uugguauuuguuuaaauuacac

SEQ ID NO: 205756 - RNA, 22 nt, Human
uugggggccuccuguuccccca

SEQ ID NO: 205757 - RNA, 22 nt, Human
uucugaguguugucaccaugug

SEQ ID NO: 205758 - RNA, 22 nt, Human
uucugauacagucccaacacaa

SEQ ID NO: 205759 - RNA, 22 nt, Human
uucugcccuugccagacaagua

SEQ ID NO: 205760 - RNA, 17 nt, Human
uucugcucaggaacaga

SEQ ID NO: 205761 - RNA, 22 nt, Human
uucugaaggcaggggcuaucuu

SEQ ID NO: 205762 - RNA, 22 nt, Human
uuuuccuuaacagagggagaaa

SEQ ID NO: 205763 - RNA, 22 nt, Human
uuuuccuguccuugggucugca

SEQ ID NO: 205764 - RNA, 22 nt, Human
uucugaaccauugagcacugcc

SEQ ID NO: 205765 - RNA, 22 nt, Human
uucugaaacauugcuauuuucc

SEQ ID NO: 205766 - RNA, 20 nt, Human
uucucugcagcaggcggccc

SEQ ID NO: 205767 - RNA, 22 nt, Human
uucucugcgcuccggcccaguu

SEQ ID NO: 205768 - RNA, 22 nt, Human
uuuuggauugcuaacucagggu

SEQ ID NO: 205769 - RNA, 19 nt, Human
uucugguacauacugccug

SEQ ID NO: 205770 - RNA, 22 nt, Human
uucuguacuagaucuuaucagu

SEQ ID NO: 205771 - RNA, 23 nt, Human
uucugcuucccauagcacuuugu

SEQ ID NO: 205772 - RNA, 22 nt, Human
uucuggacuuccaaauggcuuc

SEQ ID NO: 205773 - RNA, 22 nt, Human
uucuggccagggaagagggguc

SEQ ID NO: 205774 - RNA, 22 nt, Human
uucuggggccgugacgaggggc

SEQ ID NO: 205775 - RNA, 22 nt, Human
uucuggagacccagcaacaggg

SEQ ID NO: 205776 - RNA, 22 nt, Human
uuuugauacaaguuguaaaaaa

SEQ ID NO: 205777 - RNA, 19 nt, Human
uucugcucaguaacacccu

SEQ ID NO: 205778 - RNA, 22 nt, Human
uuuucaacuuuauuuuccccca

SEQ ID NO: 205779 - RNA, 22 nt, Human
uuuuauguuccugaagcuaucu

SEQ ID NO: 205780 - RNA, 19 nt, Human
uuuucaacguccgguucau

SEQ ID NO: 205781 - RNA, 22 nt, Human
uucuagcucauggugacagauc

SEQ ID NO: 205782 - RNA, 22 nt, Human
uucuagccauagaaauuagauu

SEQ ID NO: 205783 - RNA, 22 nt, Human
uuuuaguaauacuuuggccuuu

SEQ ID NO: 205784 - RNA, 22 nt, Human
uuuuauaaaaccuguuugaccu

SEQ ID NO: 205785 - RNA, 22 nt, Human
uuccgcuuucaauggcuuggcu

SEQ ID NO: 205786 - RNA, 22 nt, Human
uuuuacgucuuugcugccucgu

SEQ ID NO: 205787 - RNA, 22 nt, Human
uucccuuggcuuugauuguguu

SEQ ID NO: 205788 - RNA, 22 nt, Human
uuuuuucuucucuaucuuaaua

SEQ ID NO: 205789 - RNA, 22 nt, Human
uuuuuucuggaguuugggguuu

SEQ ID NO: 205790 - RNA, 22 nt, Human
uugaacucagcuacugguuggu

SEQ ID NO: 205791 - RNA, 22 nt, Human
uugaaccaggauaaacauagaa

SEQ ID NO: 205792 - RNA, 22 nt, Human
uugaacguguaggaagcugguu

SEQ ID NO: 205793 - RNA, 22 nt, Human
uuuuuguauaugcuucgaggau

SEQ ID NO: 205794 - RNA, 22 nt, Human
uugaaaaaauguguuuaaggag

SEQ ID NO: 205795 - RNA, 20 nt, Human
uugaaagucagggcuccagu

SEQ ID NO: 205796 - RNA, 22 nt, Human
uugaaaaguuuguuacucacau

SEQ ID NO: 205797 - RNA, 22 nt, Human
uugaaagaacaauucugugaug

SEQ ID NO: 205798 - RNA, 22 nt, Human
uuuuuuuuacuccggacagcuc

SEQ ID NO: 205799 - RNA, 22 nt, Human
uugacuauacucuggcggaaaa

SEQ ID NO: 205800 - RNA, 22 nt, Human
uugacucuuucauuuauuauuu

SEQ ID NO: 205801 - RNA, 18 nt, Human
uuuuuuguucuguuuugu

SEQ ID NO: 205802 - RNA, 22 nt, Human
uuuuuuguuccuugguuuuugu

SEQ ID NO: 205803 - RNA, 22 nt, Human
uugaauggaauuggaaucuuau

SEQ ID NO: 205804 - RNA, 19 nt, Human
uugaauguuugauagucuc

SEQ ID NO: 205805 - RNA, 19 nt, Human
uucuguggucccaggccuu

SEQ ID NO: 205806 - RNA, 22 nt, Human
uuuugguuugaguauuuuuuuu

SEQ ID NO: 205807 - RNA, 22 nt, Human
uuuuguagauuggaaaaucugg

SEQ ID NO: 205808 - RNA, 22 nt, Human
uucuuaaugcauccuguguuca

SEQ ID NO: 205809 - RNA, 18 nt, Human
uuuuguguuuauucugca

SEQ ID NO: 205810 - RNA, 21 nt, Human
uuuuguguugcgcacuuugag

SEQ ID NO: 205811 - RNA, 22 nt, Human
uuuuguuuacauuaaauuuuga

SEQ ID NO: 205812 - RNA, 22 nt, Human
uucuucuuuccuauaauuaauu

SEQ ID NO: 205813 - RNA, 22 nt, Human
uuuuuauaagagcagcagaguu

SEQ ID NO: 205814 - RNA, 19 nt, Human
uuuuucccccucuccucag

SEQ ID NO: 205815 - RNA, 22 nt, Human
uuuuucuccucucucuuucauu

SEQ ID NO: 205816 - RNA, 22 nt, Human
uuuuuauguaaaauauuaaaag

SEQ ID NO: 205817 - RNA, 22 nt, Human
uuuuucagacuaauagggcaua

SEQ ID NO: 205818 - RNA, 22 nt, Human
uuuuucacacuccuuuccaguu

SEQ ID NO: 205819 - RNA, 22 nt, Human
aaaacauuuuacugccaucuca

SEQ ID NO: 205820 - RNA, 22 nt, Human
aaaaccugcaagaugaaaucag

SEQ ID NO: 205821 - RNA, 22 nt, Human
aaaaauuucuggugaaaugccu

SEQ ID NO: 205822 - RNA, 22 nt, Human
aaaagaaugaugggagcugggu

SEQ ID NO: 205823 - RNA, 22 nt, Human
aaaaggacaguagccuugaggu

SEQ ID NO: 205824 - RNA, 22 nt, Human
aaaagggucugacacugcuuga

SEQ ID NO: 205825 - RNA, 22 nt, Human
aaaagguauuuagcgauugcau

SEQ ID NO: 205826 - RNA, 22 nt, Human
aaaagguuauagcuuugccuug

SEQ ID NO: 205827 - RNA, 22 nt, Human
aaaaggucacuguaaaaugacg

SEQ ID NO: 205828 - RNA, 22 nt, Human
aaaauaaccuucauuugcauug

SEQ ID NO: 205829 - RNA, 22 nt, Human
aaaaggauauuuggugcaaagc

SEQ ID NO: 205830 - RNA, 22 nt, Human
aaacagcugcaguacacggccu

SEQ ID NO: 205831 - RNA, 22 nt, Human
aaacaccaagagcuagcuauua

SEQ ID NO: 205832 - RNA, 22 nt, Human
aaaauauucuauaucaaagaua

SEQ ID NO: 205833 - RNA, 22 nt, Human
aaaauauguugagauacugaaa

SEQ ID NO: 205834 - RNA, 22 nt, Human
aaaauauuuaucuagcucuuaa

SEQ ID NO: 205835 - RNA, 17 nt, Human
aaaaucaaaggaggugc

SEQ ID NO: 205836 - RNA, 22 nt, Human
aaaaguauaagugucuccugau

SEQ ID NO: 205837 - RNA, 22 nt, Human
aaacacacaacauauuuuggaa

SEQ ID NO: 205838 - RNA, 18 nt, Human
aaacccacguauucaggc

SEQ ID NO: 205839 - RNA, 22 nt, Human
aaacccaggguuuugucuuccc

SEQ ID NO: 205840 - RNA, 22 nt, Human
aaacaagagcuuacauggcugc

SEQ ID NO: 205841 - RNA, 22 nt, Human
aaacaauaauaauuaggaagga

SEQ ID NO: 205842 - RNA, 22 nt, Human
aaaccgguacccuccugccugc

SEQ ID NO: 205843 - RNA, 22 nt, Human
aaacagguuugaacuucuuaac

SEQ ID NO: 205844 - RNA, 23 nt, Human
aaacuacauuuauaguuuuucuc

SEQ ID NO: 205845 - RNA, 18 nt, Human
aaacgguuucaugcugua

SEQ ID NO: 205846 - RNA, 22 nt, Human
aaaaugggaaaauuuuagauua

SEQ ID NO: 205847 - RNA, 22 nt, Human
aaagcagguugcaauuacagug

SEQ ID NO: 205848 - RNA, 22 nt, Human
aaagagggaaggaaggagugaa

SEQ ID NO: 205849 - RNA, 23 nt, Human
aaagaggugaauccaggacaagc

SEQ ID NO: 205850 - RNA, 22 nt, Human
aaagagccaacuaccgcaaauu

SEQ ID NO: 205851 - RNA, 22 nt, Human
aaagagacaacaacaacuucua

SEQ ID NO: 205852 - RNA, 22 nt, Human
aaagcaaauaguugcuuaauau

SEQ ID NO: 205853 - RNA, 22 nt, Human
aaagaugaaguucagcgaagaa

SEQ ID NO: 205854 - RNA, 22 nt, Human
aaagacagccuguuggcuuucu

SEQ ID NO: 205855 - RNA, 22 nt, Human
aaacgcaauuucuugcauguca

SEQ ID NO: 205856 - RNA, 22 nt, Human
aaacgcauucuuacaugcuucc

SEQ ID NO: 205857 - RNA, 22 nt, Human
aaacuuuaggcacauggaucua

SEQ ID NO: 205858 - RNA, 22 nt, Human
aaacuuuugaaggaggaaaaag

SEQ ID NO: 205859 - RNA, 22 nt, Human
aaagacaauaauucucucuagc

SEQ ID NO: 205860 - RNA, 22 nt, Human
aaagagugugcauguaccugug

SEQ ID NO: 205861 - RNA, 22 nt, Human
aaagaagugucuuacucccucu

SEQ ID NO: 205862 - RNA, 22 nt, Human
aaagcccuccaggguauacauu

SEQ ID NO: 205863 - RNA, 22 nt, Human
aaagggcugaaguagucucugu

SEQ ID NO: 205864 - RNA, 22 nt, Human
aaagcauuuguuucuccuggaa

SEQ ID NO: 205865 - RNA, 22 nt, Human
aaagcagucuguuuuaaccuga

SEQ ID NO: 205866 - RNA, 22 nt, Human
aaagcauucuaaccgaucgacg

SEQ ID NO: 205867 - RNA, 22 nt, Human
aaaggagugaaaugagaggaaa

SEQ ID NO: 205868 - RNA, 22 nt, Human
aaagccagggacagugugcaug

SEQ ID NO: 205869 - RNA, 22 nt, Human
aaagcugaaacgaaaugacaac

SEQ ID NO: 205870 - RNA, 22 nt, Human
aaagccaagguccauguacuuu

SEQ ID NO: 205871 - RNA, 22 nt, Human
aaagcaaagaucuguagcccaa

SEQ ID NO: 205872 - RNA, 22 nt, Human
aaagccauaucuauucuauucu

SEQ ID NO: 205873 - RNA, 22 nt, Human
aaagccaagucugauuuuguug

SEQ ID NO: 205874 - RNA, 20 nt, Human
aaagauacuuuuuguaaugg

SEQ ID NO: 205875 - RNA, 22 nt, Human
aaagaucaguuaacgccaucaa

SEQ ID NO: 205876 - RNA, 22 nt, Human
aaagaugucauacacauuaaga

SEQ ID NO: 205877 - RNA, 22 nt, Human
aaaguaaagccuauuuaauaau

SEQ ID NO: 205878 - RNA, 22 nt, Human
aaagggaugauuucugaagaua

SEQ ID NO: 205879 - RNA, 22 nt, Human
aaaggucagaugugucgaggag

SEQ ID NO: 205880 - RNA, 22 nt, Human
aaagguggugguuagggaauau

SEQ ID NO: 205881 - RNA, 22 nt, Human
aaagguguagacucaguuaugc

SEQ ID NO: 205882 - RNA, 22 nt, Human
aaauaggucaaucagacuauga

SEQ ID NO: 205883 - RNA, 22 nt, Human
aaagucugaaaaaguuuguggg

SEQ ID NO: 205884 - RNA, 21 nt, Human
aaagugguaaggauuauuuug

SEQ ID NO: 205885 - RNA, 22 nt, Human
aaaguagaugagaauuuuguug

SEQ ID NO: 205886 - RNA, 22 nt, Human
aaaguagaauaauaaacccuug

SEQ ID NO: 205887 - RNA, 22 nt, Human
aaagcgagccggcuuggaggga

SEQ ID NO: 205888 - RNA, 22 nt, Human
aaagcuccaaauggguggaagu

SEQ ID NO: 205889 - RNA, 17 nt, Human
aaagccgaucagauguu

SEQ ID NO: 205890 - RNA, 22 nt, Human
aaaucauagccaugaacauuug

SEQ ID NO: 205891 - RNA, 22 nt, Human
aaaucccacucacgaguuuugc

SEQ ID NO: 205892 - RNA, 20 nt, Human
aaauccuugggaguggugca

SEQ ID NO: 205893 - RNA, 22 nt, Human
aaauagauuugacuacuuggug

SEQ ID NO: 205894 - RNA, 22 nt, Human
aaauaggaguagugauguauua

SEQ ID NO: 205895 - RNA, 23 nt, Human
aaauaauaauuucucuguuggga

SEQ ID NO: 205896 - RNA, 22 nt, Human
aaaguuuguacugggaguuacu

SEQ ID NO: 205897 - RNA, 22 nt, Human
aaauagucagaaaucaacgugc

SEQ ID NO: 205898 - RNA, 22 nt, Human
aaaucaaaagugguuauuuuau

SEQ ID NO: 205899 - RNA, 22 nt, Human
aaaucaagucagcugaauucca

SEQ ID NO: 205900 - RNA, 22 nt, Human
aaauauuaaugaugaagguagu

SEQ ID NO: 205901 - RNA, 22 nt, Human
aaaguuaauucuuguuuuuuau

SEQ ID NO: 205902 - RNA, 22 nt, Human
aaauauauccuucuguccugcc

SEQ ID NO: 205903 - RNA, 22 nt, Human
aaaguugcauccuaugaccuca

SEQ ID NO: 205904 - RNA, 22 nt, Human
aaagucgugucagaaguuggga

SEQ ID NO: 205905 - RNA, 22 nt, Human
aaaguguuaacacuggcuacuu

SEQ ID NO: 205906 - RNA, 22 nt, Human
aaaguguuuaacaaauugcuuu

SEQ ID NO: 205907 - RNA, 22 nt, Human
aaauauagugacacuuauaguc

SEQ ID NO: 205908 - RNA, 22 nt, Human
aacaggcuaaauuguccauuuc

SEQ ID NO: 205909 - RNA, 19 nt, Human
aacaaaauaguucuaguua

SEQ ID NO: 205910 - RNA, 22 nt, Human
aacaggaagaauccagauggug

SEQ ID NO: 205911 - RNA, 22 nt, Human
aacacguuuauccuaagaacuc

SEQ ID NO: 205912 - RNA, 22 nt, Human
aacacaucagcacacuaacgga

SEQ ID NO: 205913 - RNA, 22 nt, Human
aacaaccuaguaguaucuuuca

SEQ ID NO: 205914 - RNA, 22 nt, Human
aacauuuccggccuuuuguucu

SEQ ID NO: 205915 - RNA, 22 nt, Human
aacauuuauguuuugaccaagu

SEQ ID NO: 205916 - RNA, 22 nt, Human
aacauuguuuaaguuaaauugu

SEQ ID NO: 205917 - RNA, 22 nt, Human
aacaaagaaaagcuugagguuu

SEQ ID NO: 205918 - RNA, 21 nt, Human
aacaaaagggaagaacagcug

SEQ ID NO: 205919 - RNA, 22 nt, Human
aaauugcauuuuaaagguagau

SEQ ID NO: 205920 - RNA, 22 nt, Human
aaauugucuuuaaucaggucau

SEQ ID NO: 205921 - RNA, 22 nt, Human
aaaucauguuaaagagggaguu

SEQ ID NO: 205922 - RNA, 22 nt, Human
aaauaugguaucugccaaacua

SEQ ID NO: 205923 - RNA, 22 nt, Human
aaauauugaauuugaggaugua

SEQ ID NO: 205924 - RNA, 22 nt, Human
aaauauuagacauaccuggaga

SEQ ID NO: 205925 - RNA, 22 nt, Human
aaaucuuucacauauuuuuuau

SEQ ID NO: 205926 - RNA, 22 nt, Human
aaauauauauaauauauauauu

SEQ ID NO: 205927 - RNA, 22 nt, Human
aaaucgcuugaacccaggaagu

SEQ ID NO: 205928 - RNA, 22 nt, Human
aaauccaucaaaucuucuagaa

SEQ ID NO: 205929 - RNA, 22 nt, Human
aaauauuugaaugguguaagau

SEQ ID NO: 205930 - RNA, 22 nt, Human
aaaucugaauuaaaaucugguu

SEQ ID NO: 205931 - RNA, 22 nt, Human
aaaucugaaggaaacagcuuca

SEQ ID NO: 205932 - RNA, 22 nt, Human
aaauggauaaucaagauaauca

SEQ ID NO: 205933 - RNA, 22 nt, Human
aaauuagucacaccagugucuu

SEQ ID NO: 205934 - RNA, 22 nt, Human
aaauguauuagccuaugugaga

SEQ ID NO: 205935 - RNA, 22 nt, Human
aaaugcacaauaaaguaaaggc

SEQ ID NO: 205936 - RNA, 22 nt, Human
aaaugcuuuaauugaguucaug

SEQ ID NO: 205937 - RNA, 23 nt, Human
aagcaacagacuucaucagauau

SEQ ID NO: 205938 - RNA, 22 nt, Human
aagcaauucacaguucacuuaa

SEQ ID NO: 205939 - RNA, 22 nt, Human
aagcaaaaucgcaucuggggcc

SEQ ID NO: 205940 - RNA, 22 nt, Human
aagcagugacucucagaggcag

SEQ ID NO: 205941 - RNA, 22 nt, Human
aagccagccaguuccagcagcu

SEQ ID NO: 205942 - RNA, 22 nt, Human
aagccgagggaggugauggaga

SEQ ID NO: 205943 - RNA, 22 nt, Human
aagcaugaaauaauguccuugu

SEQ ID NO: 205944 - RNA, 22 nt, Human
aagcgggcagcggccugcgcca

SEQ ID NO: 205945 - RNA, 22 nt, Human
aagcugcagacccccugucuca

SEQ ID NO: 205946 - RNA, 22 nt, Human
aagccuccgugcugcuggaucu

SEQ ID NO: 205947 - RNA, 22 nt, Human
aaggaaaaaauggcuugugaua

SEQ ID NO: 205948 - RNA, 22 nt, Human
aaggacaccaaacuaauuggga

SEQ ID NO: 205949 - RNA, 22 nt, Human
aagccuguugacagcugucagu

SEQ ID NO: 205950 - RNA, 22 nt, Human
aagcucagcugguggugauugc

SEQ ID NO: 205951 - RNA, 22 nt, Human
aagcgcggccgccgcggucgcu

SEQ ID NO: 205952 - RNA, 22 nt, Human
aagcgcaaggugucagcagguu

SEQ ID NO: 205953 - RNA, 22 nt, Human
aagcuguuauuucacagguuca

SEQ ID NO: 205954 - RNA, 22 nt, Human
aagcuuugaauauuagaccuug

SEQ ID NO: 205955 - RNA, 20 nt, Human
aagcuguguucaagauggga

SEQ ID NO: 205956 - RNA, 22 nt, Human
aagcugccugggaggaagggcu

SEQ ID NO: 205957 - RNA, 18 nt, Human
aaggaggaaugaauagca

SEQ ID NO: 205958 - RNA, 22 nt, Human
aaggaggaugaauugucugcaa

SEQ ID NO: 205959 - RNA, 20 nt, Human
aaggaggcuuaaaguuagaa

SEQ ID NO: 205960 - RNA, 22 nt, Human
aaggaguacagggagggucccu

SEQ ID NO: 205961 - RNA, 22 nt, Human
aaggauuuccaggccugcgccu

SEQ ID NO: 205962 - RNA, 22 nt, Human
aaggauguuuaaacuacuuucc

SEQ ID NO: 205963 - RNA, 22 nt, Human
aaggcagagggaaaacgggaau

SEQ ID NO: 205964 - RNA, 22 nt, Human
aaggcacauauuuuagagucac

SEQ ID NO: 205965 - RNA, 22 nt, Human
aagaaauagauagaggaauacu

SEQ ID NO: 205966 - RNA, 22 nt, Human
aagaacaugggugugggcauuc

SEQ ID NO: 205967 - RNA, 22 nt, Human
aagaacaacugcuuuaaaagca

SEQ ID NO: 205968 - RNA, 22 nt, Human
aagaaagaucugaaagaagcga

SEQ ID NO: 205969 - RNA, 22 nt, Human
aagaaaagcaucuuuguaguag

SEQ ID NO: 205970 - RNA, 22 nt, Human
aagaagagaauauauuuacguc

SEQ ID NO: 205971 - RNA, 22 nt, Human
aagaagcuacugucacuaucag

SEQ ID NO: 205972 - RNA, 22 nt, Human
aagagaaaaaucuuaaucuagu

SEQ ID NO: 205973 - RNA, 22 nt, Human
aagagaaacauauggccagauu

SEQ ID NO: 205974 - RNA, 22 nt, Human
aagaaugaaaugaaagaacuaa

SEQ ID NO: 205975 - RNA, 23 nt, Human
aagaaugcuucugaagagcugcc

SEQ ID NO: 205976 - RNA, 22 nt, Human
aagacagaaaagcagagagagg

SEQ ID NO: 205977 - RNA, 21 nt, Human
aagacguaguuggguggacca

SEQ ID NO: 205978 - RNA, 22 nt, Human
aagaaguccuugaggcgcaccc

SEQ ID NO: 205979 - RNA, 22 nt, Human
aagcagacugggccauaaggaa

SEQ ID NO: 205980 - RNA, 22 nt, Human
aagaucugaccgugauggcggc

SEQ ID NO: 205981 - RNA, 22 nt, Human
aagauauauaaggaaguucagu

SEQ ID NO: 205982 - RNA, 22 nt, Human
aagauagaaugauguuggcuca

SEQ ID NO: 205983 - RNA, 22 nt, Human
aagcaaaugguauugguauuau

SEQ ID NO: 205984 - RNA, 22 nt, Human
aagcaaaagguuacacuucugg

SEQ ID NO: 205985 - RNA, 22 nt, Human
aagauuugaaaguggugcauuu

SEQ ID NO: 205986 - RNA, 22 nt, Human
aagcaaagucaucuagaguagu

SEQ ID NO: 205987 - RNA, 22 nt, Human
aagaggcuacagcccugugucu

SEQ ID NO: 205988 - RNA, 22 nt, Human
aagaugcaagcauuuugaacug

SEQ ID NO: 205989 - RNA, 22 nt, Human
aagaugaguuacaaaggaguaa

SEQ ID NO: 205990 - RNA, 22 nt, Human
aagaugaucagagggcaagagg

SEQ ID NO: 205991 - RNA, 22 nt, Human
aaggaaaaccugacugaagaac

SEQ ID NO: 205992 - RNA, 22 nt, Human
aagcuuugggcagaagaggauu

SEQ ID NO: 205993 - RNA, 22 nt, Human
aaggagaggagucauugggaua

SEQ ID NO: 205994 - RNA, 22 nt, Human
aaggacaaaacagcuguucuaa

SEQ ID NO: 205995 - RNA, 22 nt, Human
aaggaacuucagggcgaaugga

SEQ ID NO: 205996 - RNA, 22 nt, Human
aaggcugaccaguuuacacuuu

SEQ ID NO: 205997 - RNA, 22 nt, Human
aaggcuguuugagcacuggagc

SEQ ID NO: 205998 - RNA, 22 nt, Human
aaggcuuguugucacgcucuug

SEQ ID NO: 205999 - RNA, 22 nt, Human
aagggaaaagcugaaugagaug

SEQ ID NO: 206000 - RNA, 22 nt, Human
aaggcuuugugcugaguugucg

SEQ ID NO: 206001 - RNA, 22 nt, Human
aaggucuucgaaccuuauguua

SEQ ID NO: 206002 - RNA, 22 nt, Human
aaggggaggccugcgcuuucgg

SEQ ID NO: 206003 - RNA, 22 nt, Human
aaggggggcaccugcaugcccg

SEQ ID NO: 206004 - RNA, 22 nt, Human
aaggggauuuaagguaagaaga

SEQ ID NO: 206005 - RNA, 22 nt, Human
aaggggaauaguaggaccuggg

SEQ ID NO: 206006 - RNA, 19 nt, Human
aaguauagucagccuucua

SEQ ID NO: 206007 - RNA, 22 nt, Human
aaguccgggcagcaggaauucu

SEQ ID NO: 206008 - RNA, 22 nt, Human
aaguagaaaaccgcacuggacu

SEQ ID NO: 206009 - RNA, 22 nt, Human
aaguaauuugugaaggcauguu

SEQ ID NO: 206010 - RNA, 22 nt, Human
aagguggugaucaucuugaagg

SEQ ID NO: 206011 - RNA, 23 nt, Human
aaggugaagccaccaggugagga

SEQ ID NO: 206012 - RNA, 22 nt, Human
aagucuuugagaucggacauag

SEQ ID NO: 206013 - RNA, 22 nt, Human
aagugaagccaauuuuuuuagg

SEQ ID NO: 206014 - RNA, 22 nt, Human
aagugaaaaaagucaguacuga

SEQ ID NO: 206015 - RNA, 22 nt, Human
aagucuguucuacagcaccaga

SEQ ID NO: 206016 - RNA, 22 nt, Human
aagugaggagaccucuucuuca

SEQ ID NO: 206017 - RNA, 22 nt, Human
aagugauuuagagagcucuuag

SEQ ID NO: 206018 - RNA, 22 nt, Human
aagugagaugggagucagagga

SEQ ID NO: 206019 - RNA, 22 nt, Human
aagugauauaaaucgagaggga

SEQ ID NO: 206020 - RNA, 22 nt, Human
aauaucuugaguuauaaauuca

SEQ ID NO: 206021 - RNA, 22 nt, Human
aauaugaugccaaauugcuaca

SEQ ID NO: 206022 - RNA, 22 nt, Human
aauagcaauuacccuucaacuc

SEQ ID NO: 206023 - RNA, 22 nt, Human
aauaucuagccuuuagcagcuu

SEQ ID NO: 206024 - RNA, 22 nt, Human
aauaugcaaagcguguuaucug

SEQ ID NO: 206025 - RNA, 20 nt, Human
aauagcacagcucaaacauu

SEQ ID NO: 206026 - RNA, 22 nt, Human
aauauuuaaauagaauuacauc

SEQ ID NO: 206027 - RNA, 22 nt, Human
aauagcacauguugguugagua

SEQ ID NO: 206028 - RNA, 22 nt, Human
aauacaaucagauuaugguagu

SEQ ID NO: 206029 - RNA, 22 nt, Human
aauaugccaaauccugucacau

SEQ ID NO: 206030 - RNA, 22 nt, Human
aaucaucuguuguucccuugga

SEQ ID NO: 206031 - RNA, 22 nt, Human
aaucacuuagaacccaggaagu

SEQ ID NO: 206032 - RNA, 22 nt, Human
aauauuuaccuaccugucaucu

SEQ ID NO: 206033 - RNA, 22 nt, Human
aaucacuggcuccucacggcaa

SEQ ID NO: 206034 - RNA, 22 nt, Human
aaucaauuauccauuuguuagu

SEQ ID NO: 206035 - RNA, 22 nt, Human
aauaaagcuugaaagcagggaa

SEQ ID NO: 206036 - RNA, 21 nt, Human
aaguuuuggcuguacaguugu

SEQ ID NO: 206037 - RNA, 22 nt, Human
aauaaugguuugauucucacau

SEQ ID NO: 206038 - RNA, 22 nt, Human
aauaagaguuaagaaguauauu

SEQ ID NO: 206039 - RNA, 22 nt, Human
aauaauacaugugaugagaauu

SEQ ID NO: 206040 - RNA, 20 nt, Human
aagugcuguuagcugccuga

SEQ ID NO: 206041 - RNA, 22 nt, Human
aagugcuggccuacucaaucga

SEQ ID NO: 206042 - RNA, 22 nt, Human
aagugauuuuccuacuugcuaa

SEQ ID NO: 206043 - RNA, 22 nt, Human
aaguucuuauguucugaugugc

SEQ ID NO: 206044 - RNA, 20 nt, Human
aaguugaaguuacuucaugg

SEQ ID NO: 206045 - RNA, 22 nt, Human
aaguucaccugcauuuacuaaa

SEQ ID NO: 206046 - RNA, 22 nt, Human
aaguucuugguuaauuagggaa

SEQ ID NO: 206047 - RNA, 22 nt, Human
aaguuuaagguagugaugauga

SEQ ID NO: 206048 - RNA, 22 nt, Human
acaagaaaggucugggaacaau

SEQ ID NO: 206049 - RNA, 22 nt, Human
acaacccacacguuccgggugg

SEQ ID NO: 206050 - RNA, 22 nt, Human
acaaggaagaaaacauuacuuu

SEQ ID NO: 206051 - RNA, 22 nt, Human
acaauaauguuuuuagguuauu

SEQ ID NO: 206052 - RNA, 21 nt, Human
acaaugaguuugaggcaucag

SEQ ID NO: 206053 - RNA, 22 nt, Human
acaaucuuauuaguaguauaga

SEQ ID NO: 206054 - RNA, 22 nt, Human
acaaucagcacugaguuuaucu

SEQ ID NO: 206055 - RNA, 22 nt, Human
acacaagaaugugcacucagcc

SEQ ID NO: 206056 - RNA, 22 nt, Human
acacacaugccuuuccuaagua

SEQ ID NO: 206057 - RNA, 20 nt, Human
acacagccuagaguuuggcu

SEQ ID NO: 206058 - RNA, 19 nt, Human
acacaccagugccugugac

SEQ ID NO: 206059 - RNA, 20 nt, Human
acacaccugcucagacugag

SEQ ID NO: 206060 - RNA, 22 nt, Human
acacgcacaccugugcacucgu

SEQ ID NO: 206061 - RNA, 22 nt, Human
acacaggacacaaaagucacca

SEQ ID NO: 206062 - RNA, 22 nt, Human
acacgguggccagcaguaggug

SEQ ID NO: 206063 - RNA, 21 nt, Human
acagaaguggcuuggucucag

SEQ ID NO: 206064 - RNA, 14 nt, Human
acagaagucugcua

SEQ ID NO: 206065 - RNA, 22 nt, Human
acacuagcgcaaauacgcccau

SEQ ID NO: 206066 - RNA, 22 nt, Human
acagacuuuuagacuuaugagu

SEQ ID NO: 206067 - RNA, 22 nt, Human
acagacuugaccuuggagaggc

SEQ ID NO: 206068 - RNA, 22 nt, Human
acagaauugggguucuugggga

SEQ ID NO: 206069 - RNA, 23 nt, Human
acagcaagaggaccagaugugag

SEQ ID NO: 206070 - RNA, 22 nt, Human
acagagguuaggauggguugua

SEQ ID NO: 206071 - RNA, 22 nt, Human
acacuuuugcgagagcaugcag

SEQ ID NO: 206072 - RNA, 22 nt, Human
acagaugccagcuacaccaccg

SEQ ID NO: 206073 - RNA, 22 nt, Human
acagacaucaucaacaucuucc

SEQ ID NO: 206074 - RNA, 22 nt, Human
acagcagguuauuguuauggca

SEQ ID NO: 206075 - RNA, 22 nt, Human
acagcauagaggaaauguggaa

SEQ ID NO: 206076 - RNA, 22 nt, Human
acagccaacgucuuucuuacuu

SEQ ID NO: 206077 - RNA, 20 nt, Human
acagccguaaugguccuugg

SEQ ID NO: 206078 - RNA, 23 nt, Human
acagaggcaucagagcagcaggc

SEQ ID NO: 206079 - RNA, 22 nt, Human
acagcaauccuggcagaggguu

SEQ ID NO: 206080 - RNA, 22 nt, Human
acaggaaugaagaugagagagu

SEQ ID NO: 206081 - RNA, 22 nt, Human
acagcuggaggucugugagcac

SEQ ID NO: 206082 - RNA, 22 nt, Human
acagccacuaugacagauuuag

SEQ ID NO: 206083 - RNA, 22 nt, Human
acagcugguugaaggggaccaa

SEQ ID NO: 206084 - RNA, 22 nt, Human
acagcuauuuaaaggcuuuagg

SEQ ID NO: 206085 - RNA, 22 nt, Human
acaggacgugugugcgcaugug

SEQ ID NO: 206086 - RNA, 22 nt, Human
acaggccuggguucaaauuugg

SEQ ID NO: 206087 - RNA, 22 nt, Human
acaggauuuucagggaagguga

SEQ ID NO: 206088 - RNA, 21 nt, Human
acaguaugaucaaaugugcca

SEQ ID NO: 206089 - RNA, 22 nt, Human
acagucuuggauuccaggaguc

SEQ ID NO: 206090 - RNA, 22 nt, Human
acaggcgucgccugcucuugcc

SEQ ID NO: 206091 - RNA, 22 nt, Human
acaggcugcccgcuccccaccu

SEQ ID NO: 206092 - RNA, 22 nt, Human
acaggguauauaggcaaagcua

SEQ ID NO: 206093 - RNA, 22 nt, Human
acaggguaagggagggugagug

SEQ ID NO: 206094 - RNA, 22 nt, Human
acagguaucccuuucuaccuga

SEQ ID NO: 206095 - RNA, 22 nt, Human
acagguuucuccccugguuauu

SEQ ID NO: 206096 - RNA, 22 nt, Human
acaggaaaugaaaugguaucua

SEQ ID NO: 206097 - RNA, 19 nt, Human
acaggaaggaaaauuucaa

SEQ ID NO: 206098 - RNA, 22 nt, Human
acagguuggagguguggaguca

SEQ ID NO: 206099 - RNA, 22 nt, Human
acagguauuaugaagccuauuu

SEQ ID NO: 206100 - RNA, 22 nt, Human
acauauggcagguugaucaaug

SEQ ID NO: 206101 - RNA, 22 nt, Human
acaucacuugguuaaugugguc

SEQ ID NO: 206102 - RNA, 22 nt, Human
acauccagcagauuguccagag

SEQ ID NO: 206103 - RNA, 22 nt, Human
acagugugcaagaaauggggga

SEQ ID NO: 206104 - RNA, 22 nt, Human
acaguuagguccuaaaauucug

SEQ ID NO: 206105 - RNA, 22 nt, Human
acaguuuuccuugguauagaac

SEQ ID NO: 206106 - RNA, 22 nt, Human
acagugguggagggcuguccug

SEQ ID NO: 206107 - RNA, 22 nt, Human
acauaaacaugcagccugccaa

SEQ ID NO: 206108 - RNA, 19 nt, Human
acaguucuguggccuguuc

SEQ ID NO: 206109 - RNA, 22 nt, Human
acaguuuucugagaaucacagg

SEQ ID NO: 206110 - RNA, 22 nt, Human
acauauaugugcauacaacuau

SEQ ID NO: 206111 - RNA, 22 nt, Human
aauggaaaggagccugacuaua

SEQ ID NO: 206112 - RNA, 22 nt, Human
aaugcugugauuuauuaaguau

SEQ ID NO: 206113 - RNA, 22 nt, Human
aauggaaaaauccacagggaac

SEQ ID NO: 206114 - RNA, 22 nt, Human
aaucaugagguguuucuuugca

SEQ ID NO: 206115 - RNA, 22 nt, Human
aaugcugugggauagggcuccu

SEQ ID NO: 206116 - RNA, 22 nt, Human
aauggcaagccacaugcuuuuc

SEQ ID NO: 206117 - RNA, 22 nt, Human
aauggaugauuaaauggaugaa

SEQ ID NO: 206118 - RNA, 22 nt, Human
aauggagaaaagacaauguuga

SEQ ID NO: 206119 - RNA, 22 nt, Human
aauggaaaaagaacuguuuaaa

SEQ ID NO: 206120 - RNA, 22 nt, Human
aaucgacuguagagacuuggcg

SEQ ID NO: 206121 - RNA, 22 nt, Human
aaugcugaaugcauguuuccau

SEQ ID NO: 206122 - RNA, 22 nt, Human
aaucauaacaaaagcaauuaua

SEQ ID NO: 206123 - RNA, 22 nt, Human
aauggcuagcauguaaaauauc

SEQ ID NO: 206124 - RNA, 22 nt, Human
aaugggauaggucuucaggaau

SEQ ID NO: 206125 - RNA, 22 nt, Human
aauguauuuuuaggcagaauau

SEQ ID NO: 206126 - RNA, 23 nt, Human
aaugggcggaaguguuaaguugc

SEQ ID NO: 206127 - RNA, 22 nt, Human
aaugguagaguauuuuaauccu

SEQ ID NO: 206128 - RNA, 22 nt, Human
aauguucauauggguagcagau

SEQ ID NO: 206129 - RNA, 22 nt, Human
aaugugcugguaacugcuuugc

SEQ ID NO: 206130 - RNA, 22 nt, Human
aaugugguauuuuggcauucuu

SEQ ID NO: 206131 - RNA, 22 nt, Human
aauguguauguguauauauaug

SEQ ID NO: 206132 - RNA, 22 nt, Human
aaugugugggagaacagucuuu

SEQ ID NO: 206133 - RNA, 22 nt, Human
aauguuaguauuuaagagcuug

SEQ ID NO: 206134 - RNA, 22 nt, Human
aauguuugaacuuugcauauuu

SEQ ID NO: 206135 - RNA, 22 nt, Human
aauuaaauguuugguuugagcu

SEQ ID NO: 206136 - RNA, 22 nt, Human
aauguuuuucaaguguggagca

SEQ ID NO: 206137 - RNA, 22 nt, Human
aauuauuauguggaagacgacg

SEQ ID NO: 206138 - RNA, 22 nt, Human
aauuauuaucauuaucuuccug

SEQ ID NO: 206139 - RNA, 22 nt, Human
aauuaacuggguucucagaugc

SEQ ID NO: 206140 - RNA, 22 nt, Human
aauuauuaagcuuucuccagug

SEQ ID NO: 206141 - RNA, 22 nt, Human
aauuauguuugcuuuagaugga

SEQ ID NO: 206142 - RNA, 20 nt, Human
acaaccacugcucacaguuu

SEQ ID NO: 206143 - RNA, 22 nt, Human
acaaacugggauaggauccugu

SEQ ID NO: 206144 - RNA, 22 nt, Human
acaaaucccuguaaacacagcu

SEQ ID NO: 206145 - RNA, 18 nt, Human
acaaaaauagugcuuugg

SEQ ID NO: 206146 - RNA, 22 nt, Human
aauuugcuccaaugucaguucu

SEQ ID NO: 206147 - RNA, 22 nt, Human
aauuucuuuagagguacugauc

SEQ ID NO: 206148 - RNA, 22 nt, Human
aauuucuccuuuucaguuagau

SEQ ID NO: 206149 - RNA, 22 nt, Human
aauuucaucugagacugggagc

SEQ ID NO: 206150 - RNA, 21 nt, Human
acaaaaccuaacuuggcugcu

SEQ ID NO: 206151 - RNA, 22 nt, Human
acaaaaauauuguagaagugcu

SEQ ID NO: 206152 - RNA, 22 nt, Human
aauuuuauuuuuuccccuagau

SEQ ID NO: 206153 - RNA, 22 nt, Human
aauuuuauuagacaggcauaau

SEQ ID NO: 206154 - RNA, 22 nt, Human
aauuuuagcuaaagauccaugg

SEQ ID NO: 206155 - RNA, 20 nt, Human
aauuuagaguuuuaccaagg

SEQ ID NO: 206156 - RNA, 22 nt, Human
aauuuauccuuuugcuaaagca

SEQ ID NO: 206157 - RNA, 22 nt, Human
aauuucagaccaacgagucagg

SEQ ID NO: 206158 - RNA, 22 nt, Human
aauuuaauugguuuuuacuugu

SEQ ID NO: 206159 - RNA, 22 nt, Human
aauugguuugaauaaauaaaga

SEQ ID NO: 206160 - RNA, 22 nt, Human
aauuuaaguuauugcuaaugug

SEQ ID NO: 206161 - RNA, 22 nt, Human
aauuguuagaaaugacuguuuu

SEQ ID NO: 206162 - RNA, 22 nt, Human
aauuggagaguugugaaaggau

SEQ ID NO: 206163 - RNA, 22 nt, Human
aauuauugucuuuuuuaaaagc

SEQ ID NO: 206164 - RNA, 22 nt, Human
aauuauucuugccuagguuuaa

SEQ ID NO: 206165 - RNA, 22 nt, Human
aauuauucaugucugggcagcc

SEQ ID NO: 206166 - RNA, 22 nt, Human
aauugcuuucacaaguguuaua

SEQ ID NO: 206167 - RNA, 22 nt, Human
aauugccaagaauuagugauac

SEQ ID NO: 206168 - RNA, 22 nt, Human
aauugcauucauuuguauauuu

SEQ ID NO: 206169 - RNA, 22 nt, Human
aauucugcagucguacuauaau

SEQ ID NO: 206170 - RNA, 22 nt, Human
aauugauauuagauuugucuca

SEQ ID NO: 206171 - RNA, 19 nt, Human
agcagccaucgaccaugga

SEQ ID NO: 206172 - RNA, 22 nt, Human
agcagcaggugaccucgaugcc

SEQ ID NO: 206173 - RNA, 17 nt, Human
agcagcuggguugaucu

SEQ ID NO: 206174 - RNA, 22 nt, Human
agcagccgccgccgccgcgcac

SEQ ID NO: 206175 - RNA, 22 nt, Human
agcaugucuaacucuucagggu

SEQ ID NO: 206176 - RNA, 22 nt, Human
agcaggagaaagaguaugggcu

SEQ ID NO: 206177 - RNA, 22 nt, Human
agcaggacuugcugagcccucc

SEQ ID NO: 206178 - RNA, 22 nt, Human
agcaggaaggcuagaagcagga

SEQ ID NO: 206179 - RNA, 22 nt, Human
agcagauaaagguugcauuucu

SEQ ID NO: 206180 - RNA, 22 nt, Human
agcagcugagccccagcuguga

SEQ ID NO: 206181 - RNA, 22 nt, Human
agcaauucagagcauggacuuu

SEQ ID NO: 206182 - RNA, 22 nt, Human
agcaauucugaaauuacuugac

SEQ ID NO: 206183 - RNA, 22 nt, Human
agcacagugccugacauauaug

SEQ ID NO: 206184 - RNA, 20 nt, Human
agcacaggcagucauucagu

SEQ ID NO: 206185 - RNA, 22 nt, Human
agcagcaaugacaauucaacca

SEQ ID NO: 206186 - RNA, 22 nt, Human
agcacgcccaccuccugcggcg

SEQ ID NO: 206187 - RNA, 22 nt, Human
agauuuuacggaguauuagggu

SEQ ID NO: 206188 - RNA, 22 nt, Human
agauuuggaauggggguucaua

SEQ ID NO: 206189 - RNA, 22 nt, Human
agauuucaauggauauugcaag

SEQ ID NO: 206190 - RNA, 22 nt, Human
agcaaaacuaaagacacagaca

SEQ ID NO: 206191 - RNA, 22 nt, Human
agauucucccuccuggcgcugu

SEQ ID NO: 206192 - RNA, 22 nt, Human
agcaaaguacugagcucaaagg

SEQ ID NO: 206193 - RNA, 22 nt, Human
agcaacauggaguuugugcgca

SEQ ID NO: 206194 - RNA, 22 nt, Human
agcaaauaauugucuuugaggg

SEQ ID NO: 206195 - RNA, 22 nt, Human
agcaagggucucucauggcuug

SEQ ID NO: 206196 - RNA, 22 nt, Human
agcaauguuggccuauauaccu

SEQ ID NO: 206197 - RNA, 22 nt, Human
agcacuaccggucacggccaug

SEQ ID NO: 206198 - RNA, 22 nt, Human
agcacguucuucauuacuucac

SEQ ID NO: 206199 - RNA, 22 nt, Human
agcacuagcugcuugucucaag

SEQ ID NO: 206200 - RNA, 22 nt, Human
agcaaagccucuuugaaaaaaa

SEQ ID NO: 206201 - RNA, 22 nt, Human
agcagagaacauucauucaugu

SEQ ID NO: 206202 - RNA, 19 nt, Human
agcgccucuacugcaugga

SEQ ID NO: 206203 - RNA, 22 nt, Human
agcgcgcggggcugcggcaggg

SEQ ID NO: 206204 - RNA, 21 nt, Human
agcgcugcauccaccauggcu

SEQ ID NO: 206205 - RNA, 22 nt, Human
agcgcucauuuuccuccugcuc

SEQ ID NO: 206206 - RNA, 22 nt, Human
agccugugacucugugaaacca

SEQ ID NO: 206207 - RNA, 22 nt, Human
agccugagucugcacauagaac

SEQ ID NO: 206208 - RNA, 22 nt, Human
agccuggagcaggcucugcucu

SEQ ID NO: 206209 - RNA, 22 nt, Human
agccugaaccaauauagcagcc

SEQ ID NO: 206210 - RNA, 21 nt, Human
agccgggacaacguggacccc

SEQ ID NO: 206211 - RNA, 22 nt, Human
agccuaauuuguaggucugugu

SEQ ID NO: 206212 - RNA, 22 nt, Human
agccuauucaucugaucuugaa

SEQ ID NO: 206213 - RNA, 22 nt, Human
agccgcugaauuugaaacaagc

SEQ ID NO: 206214 - RNA, 22 nt, Human
agccggccucggacagagggag

SEQ ID NO: 206215 - RNA, 22 nt, Human
agccgcgcuguuccugcugcug

SEQ ID NO: 206216 - RNA, 22 nt, Human
agccuacauuugacuauagucu

SEQ ID NO: 206217 - RNA, 22 nt, Human
agcccgggagggcugucuggga

SEQ ID NO: 206218 - RNA, 22 nt, Human
agcccugaccuguccuguucug

SEQ ID NO: 206219 - RNA, 22 nt, Human
agccccggugagggaguccugu

SEQ ID NO: 206220 - RNA, 22 nt, Human
agcauacuaggauguuuucugg

SEQ ID NO: 206221 - RNA, 22 nt, Human
agccaucuggugucaaugauuc

SEQ ID NO: 206222 - RNA, 22 nt, Human
agccauggagaacagacuugaa

SEQ ID NO: 206223 - RNA, 22 nt, Human
agcauaacaaagggcauaauug

SEQ ID NO: 206224 - RNA, 22 nt, Human
agcaguuuauccucauaaugga

SEQ ID NO: 206225 - RNA, 22 nt, Human
agcaggggcaggguuuugugcu

SEQ ID NO: 206226 - RNA, 22 nt, Human
agccagugcagcuggaaauuca

SEQ ID NO: 206227 - RNA, 21 nt, Human
agccagguuuccuuugaagag

SEQ ID NO: 206228 - RNA, 22 nt, Human
agccaugcuguuuugccuggga

SEQ ID NO: 206229 - RNA, 22 nt, Human
agccagugucgugugacaugag

SEQ ID NO: 206230 - RNA, 22 nt, Human
agccacggcaaugauaggcugc

SEQ ID NO: 206231 - RNA, 22 nt, Human
agccagcauauauauaguugaa

SEQ ID NO: 206232 - RNA, 22 nt, Human
agccagauuuuuugagaggcga

SEQ ID NO: 206233 - RNA, 22 nt, Human
agccauggaggaugugcagcau

SEQ ID NO: 206234 - RNA, 22 nt, Human
agccauggagauguggguuggg

SEQ ID NO: 206235 - RNA, 19 nt, Human
agaucaggauguauuuuug

SEQ ID NO: 206236 - RNA, 22 nt, Human
agaugaugugugucuucagcua

SEQ ID NO: 206237 - RNA, 21 nt, Human
agaugcaguuugcaggugggu

SEQ ID NO: 206238 - RNA, 22 nt, Human
agauggaggaaagcaguuagaa

SEQ ID NO: 206239 - RNA, 22 nt, Human
agauaucuuguuggcauaaaug

SEQ ID NO: 206240 - RNA, 23 nt, Human
agaugaugaauaaagagugagga

SEQ ID NO: 206241 - RNA, 22 nt, Human
agaugaguaaauggagucuucc

SEQ ID NO: 206242 - RNA, 22 nt, Human
agauauuauuuucuauuuauca

SEQ ID NO: 206243 - RNA, 22 nt, Human
agaugacuuuguccugagcuga

SEQ ID NO: 206244 - RNA, 22 nt, Human
agauuauuuaagacaggaacca

SEQ ID NO: 206245 - RNA, 22 nt, Human
agauuaagcauuauaauuauaa

SEQ ID NO: 206246 - RNA, 22 nt, Human
agauguugucucuuacguuuga

SEQ ID NO: 206247 - RNA, 21 nt, Human
agaugaggauacugaggccua

SEQ ID NO: 206248 - RNA, 22 nt, Human
agaugaacuuuuuuaaacugga

SEQ ID NO: 206249 - RNA, 22 nt, Human
agauggcuccaguguccagagg

SEQ ID NO: 206250 - RNA, 19 nt, Human
agauggcaaaaugcaaaga

SEQ ID NO: 206251 - RNA, 22 nt, Human
agaugguucagaauuauaaaga

SEQ ID NO: 206252 - RNA, 22 nt, Human
agauugaacgagcuggcaugga

SEQ ID NO: 206253 - RNA, 22 nt, Human
agauggggccugaggacacugu

SEQ ID NO: 206254 - RNA, 22 nt, Human
agauuuucuuuuccaucuuugu

SEQ ID NO: 206255 - RNA, 22 nt, Human
agcaaagguagcagcucccagg

SEQ ID NO: 206256 - RNA, 22 nt, Human
agaugggacauuugucccuagg

SEQ ID NO: 206257 - RNA, 22 nt, Human
agaugucauguguugcuccaag

SEQ ID NO: 206258 - RNA, 22 nt, Human
agcaaaauuccaaaaugcuaau

SEQ ID NO: 206259 - RNA, 22 nt, Human
agauguuaauaaccuuagggca

SEQ ID NO: 206260 - RNA, 22 nt, Human
agacagaaaaguugucaaucau

SEQ ID NO: 206261 - RNA, 22 nt, Human
agacucacuucuuucucguauu

SEQ ID NO: 206262 - RNA, 22 nt, Human
agagcagaggcauggccguggg

SEQ ID NO: 206263 - RNA, 22 nt, Human
agaccguguguggguugcggug

SEQ ID NO: 206264 - RNA, 22 nt, Human
agacccuugcagucugguuguc

SEQ ID NO: 206265 - RNA, 22 nt, Human
agacgacucuuaaggcagaauu

SEQ ID NO: 206266 - RNA, 22 nt, Human
acuccuauuugguagauggaag

SEQ ID NO: 206267 - RNA, 22 nt, Human
agacuauuuugugauaacuaau

SEQ ID NO: 206268 - RNA, 22 nt, Human
agacgggacagacuuuugagug

SEQ ID NO: 206269 - RNA, 22 nt, Human
agagggagagauuggcaaucag

SEQ ID NO: 206270 - RNA, 22 nt, Human
agaggggaaggaugugauguga

SEQ ID NO: 206271 - RNA, 22 nt, Human
agagcuagaaggaagcauuucu

SEQ ID NO: 206272 - RNA, 22 nt, Human
agaggcaugaacucccguagcc

SEQ ID NO: 206273 - RNA, 22 nt, Human
agaggcaggcagcagagaagau

SEQ ID NO: 206274 - RNA, 22 nt, Human
agagggagagaccuccgugccu

SEQ ID NO: 206275 - RNA, 23 nt, Human
agagggaagagcuuagaugggga

SEQ ID NO: 206276 - RNA, 22 nt, Human
agagcugggacuuggacucaau

SEQ ID NO: 206277 - RNA, 22 nt, Human
agagcacaggguuuugugccgg

SEQ ID NO: 206278 - RNA, 22 nt, Human
agagcaucgguggaguccccac

SEQ ID NO: 206279 - RNA, 22 nt, Human
agagccaugcuugugcauauau

SEQ ID NO: 206280 - RNA, 22 nt, Human
agagccggagucuucuuguuug

SEQ ID NO: 206281 - RNA, 22 nt, Human
agauauguuaggcuuguucccu

SEQ ID NO: 206282 - RNA, 22 nt, Human
agauaaacaacucuuagcuguu

SEQ ID NO: 206283 - RNA, 22 nt, Human
agauaaaucauuuauuaagcgg

SEQ ID NO: 206284 - RNA, 22 nt, Human
agaguucaccccacugaugagu

SEQ ID NO: 206285 - RNA, 21 nt, Human
agaguuuucuccauuucaggc

SEQ ID NO: 206286 - RNA, 22 nt, Human
agaguuaaugcaggccaagccu

SEQ ID NO: 206287 - RNA, 22 nt, Human
agaguguguggggcugagguca

SEQ ID NO: 206288 - RNA, 22 nt, Human
agaguuaguggccucagcaggg

SEQ ID NO: 206289 - RNA, 22 nt, Human
agagugagauaugugguuggua

SEQ ID NO: 206290 - RNA, 22 nt, Human
agaguggcaccuuaccugagac

SEQ ID NO: 206291 - RNA, 22 nt, Human
agaguaauguggaguuugugcu

SEQ ID NO: 206292 - RNA, 22 nt, Human
agaugacuaacauaguauugcu

SEQ ID NO: 206293 - RNA, 22 nt, Human
agaugaccaguaagugguugaa

SEQ ID NO: 206294 - RNA, 22 nt, Human
agauagaaggauugugacacau

SEQ ID NO: 206295 - RNA, 17 nt, Human
agaucugaaggagaaca

SEQ ID NO: 206296 - RNA, 22 nt, Human
agaucauuaaccaccuguucug

SEQ ID NO: 206297 - RNA, 22 nt, Human
agauaaucacaaucuagacuuu

SEQ ID NO: 206298 - RNA, 22 nt, Human
agauauucugccuaacagguuu

SEQ ID NO: 206299 - RNA, 22 nt, Human
agauaacauguugcagauucug

SEQ ID NO: 206300 - RNA, 22 nt, Human
agauaagaacauuaguaagccg

SEQ ID NO: 206301 - RNA, 21 nt, Human
agaguugaaggcaguaaagag

SEQ ID NO: 206302 - RNA, 22 nt, Human
agaagaucccugugguuacgac

SEQ ID NO: 206303 - RNA, 22 nt, Human
agaagaagacccuaaggaaagg

SEQ ID NO: 206304 - RNA, 19 nt, Human
agaacccccuuccucugcu

SEQ ID NO: 206305 - RNA, 22 nt, Human
agaagguggaguagaacaagcu

SEQ ID NO: 206306 - RNA, 22 nt, Human
agaagguagaugcaucaggagg

SEQ ID NO: 206307 - RNA, 22 nt, Human
agaaaauagguaguagacgggc

SEQ ID NO: 206308 - RNA, 22 nt, Human
agaaccauccugguuccagcuu

SEQ ID NO: 206309 - RNA, 22 nt, Human
agaaggcagaaaagcuuuacaa

SEQ ID NO: 206310 - RNA, 22 nt, Human
agaaggcaucugcucgcuucca

SEQ ID NO: 206311 - RNA, 22 nt, Human
agaauacaauuguucaguaaua

SEQ ID NO: 206312 - RNA, 22 nt, Human
agaagcaauuggaaaguacagg

SEQ ID NO: 206313 - RNA, 22 nt, Human
agaaguagacaguuggauauaa

SEQ ID NO: 206314 - RNA, 21 nt, Human
agaagcggucgaaucgcagac

SEQ ID NO: 206315 - RNA, 22 nt, Human
agaagggcugcuuagaauauac

SEQ ID NO: 206316 - RNA, 22 nt, Human
agaaucucuagaaaugggucuc

SEQ ID NO: 206317 - RNA, 22 nt, Human
agaauguaagaaugcaaagauu

SEQ ID NO: 206318 - RNA, 22 nt, Human
agaaucugcauuuuaacaagau

SEQ ID NO: 206319 - RNA, 21 nt, Human
agaaguuauuccauggguguu

SEQ ID NO: 206320 - RNA, 22 nt, Human
agaaguuuguuauguaaacaaa

SEQ ID NO: 206321 - RNA, 22 nt, Human
agaauaagucuaauauauuggu

SEQ ID NO: 206322 - RNA, 22 nt, Human
agaccauagugauguuuacguc

SEQ ID NO: 206323 - RNA, 22 nt, Human
agacacauuuucagcucugcca

SEQ ID NO: 206324 - RNA, 22 nt, Human
agacacagcaauaacuacuguu

SEQ ID NO: 206325 - RNA, 22 nt, Human
agacaagagcugaggacauauu

SEQ ID NO: 206326 - RNA, 22 nt, Human
agacaaggggauuuuugauggu

SEQ ID NO: 206327 - RNA, 22 nt, Human
agaauauaguaaauauuuucua

SEQ ID NO: 206328 - RNA, 19 nt, Human
agaauuggaaccaugaacc

SEQ ID NO: 206329 - RNA, 22 nt, Human
agacaaucaacuguugaugccu

SEQ ID NO: 206330 - RNA, 22 nt, Human
agacaauuccauccuacguggg

SEQ ID NO: 206331 - RNA, 22 nt, Human
agaaaagaggcuuucuaagcau

SEQ ID NO: 206332 - RNA, 22 nt, Human
agaaaaggaagcuuagacugua

SEQ ID NO: 206333 - RNA, 22 nt, Human
acuuuggugcgaagucacuuua

SEQ ID NO: 206334 - RNA, 19 nt, Human
agaaacaacauucuggaga

SEQ ID NO: 206335 - RNA, 20 nt, Human
agaaaggaguaaagaagaga

SEQ ID NO: 206336 - RNA, 22 nt, Human
agaaacaagcccuagaaguccu

SEQ ID NO: 206337 - RNA, 22 nt, Human
acuuugccuucuuacuguguug

SEQ ID NO: 206338 - RNA, 22 nt, Human
acuugagcuugaaagguaugcu

SEQ ID NO: 206339 - RNA, 22 nt, Human
acuugaugcauauggaagagca

SEQ ID NO: 206340 - RNA, 22 nt, Human
acuuuaaaucuguugcuuagcu

SEQ ID NO: 206341 - RNA, 22 nt, Human
acuuguuuacaagcaguucuga

SEQ ID NO: 206342 - RNA, 22 nt, Human
acuuccuuccagcaaauggcau

SEQ ID NO: 206343 - RNA, 22 nt, Human
acuucaggagcagucucuggaa

SEQ ID NO: 206344 - RNA, 22 nt, Human
acuucagugugguauaaaacgu

SEQ ID NO: 206345 - RNA, 22 nt, Human
acuuuaaauaucauuugguagg

SEQ ID NO: 206346 - RNA, 22 nt, Human
acuuuccuggcuuugcaaggua

SEQ ID NO: 206347 - RNA, 22 nt, Human
acuucccacugcagugacugag

SEQ ID NO: 206348 - RNA, 23 nt, Human
acuuugaggagaagaaugucagu

SEQ ID NO: 206349 - RNA, 22 nt, Human
acuuugccagcucccugcuggc

SEQ ID NO: 206350 - RNA, 22 nt, Human
acuguugagggaagcagaugaa

SEQ ID NO: 206351 - RNA, 22 nt, Human
acuuggucguggugcagcaugg

SEQ ID NO: 206352 - RNA, 22 nt, Human
acuucaggacggcaguggaggg

SEQ ID NO: 206353 - RNA, 22 nt, Human
acugcguuucuaaaguagcaua

SEQ ID NO: 206354 - RNA, 22 nt, Human
acugcucugugguuggaagccu

SEQ ID NO: 206355 - RNA, 22 nt, Human
acuggcaugauagaccauaaca

SEQ ID NO: 206356 - RNA, 22 nt, Human
acuggauuuugugguguaucuu

SEQ ID NO: 206357 - RNA, 22 nt, Human
acuucugcccuggcgagggcgu

SEQ ID NO: 206358 - RNA, 22 nt, Human
acucucaauuaucuggacugaa

SEQ ID NO: 206359 - RNA, 22 nt, Human
acucucugcugcugagcuuggg

SEQ ID NO: 206360 - RNA, 22 nt, Human
acucugaaaggcuacaaaugcu

SEQ ID NO: 206361 - RNA, 18 nt, Human
acucugaagcuaagucac

SEQ ID NO: 206362 - RNA, 22 nt, Human
acucugagaugugucuugauuc

SEQ ID NO: 206363 - RNA, 22 nt, Human
acucuguaauucugaagcaccu

SEQ ID NO: 206364 - RNA, 23 nt, Human
acucucuguuuggaggcacuggu

SEQ ID NO: 206365 - RNA, 22 nt, Human
acucggcggccucgagugcugg

SEQ ID NO: 206366 - RNA, 22 nt, Human
acuccuucauauuuuaauugaa

SEQ ID NO: 206367 - RNA, 21 nt, Human
acuccagccacugacugucuc

SEQ ID NO: 206368 - RNA, 22 nt, Human
acucauucgccuugcccaaggc

SEQ ID NO: 206369 - RNA, 22 nt, Human
acucaguuuugaucguucuuau

SEQ ID NO: 206370 - RNA, 22 nt, Human
acucggaggccaaggccaacgg

SEQ ID NO: 206371 - RNA, 22 nt, Human
acucagucauuuggggaacagu

SEQ ID NO: 206372 - RNA, 22 nt, Human
acucaucauuuuacggagcagc

SEQ ID NO: 206373 - RNA, 22 nt, Human
acucaaccaucugcauuuuuga

SEQ ID NO: 206374 - RNA, 22 nt, Human
acucagcaccuagaaagugugc

SEQ ID NO: 206375 - RNA, 22 nt, Human
acuaugugucuguaucuggugc

SEQ ID NO: 206376 - RNA, 22 nt, Human
acucaaacuuuuuguggacauu

SEQ ID NO: 206377 - RNA, 22 nt, Human
acucuuauuuugaaguaauaau

SEQ ID NO: 206378 - RNA, 22 nt, Human
acucuugacuaaugcuaauguc

SEQ ID NO: 206379 - RNA, 22 nt, Human
acugaauguucucaaaggggag

SEQ ID NO: 206380 - RNA, 18 nt, Human
acucuuccuuauguucuu

SEQ ID NO: 206381 - RNA, 22 nt, Human
acugaaaguugaugagucacug

SEQ ID NO: 206382 - RNA, 22 nt, Human
acugaacuaaagaaaugggcaa

SEQ ID NO: 206383 - RNA, 22 nt, Human
acugaaauuuauauuuugggca

SEQ ID NO: 206384 - RNA, 18 nt, Human
acugagcccaggacacac

SEQ ID NO: 206385 - RNA, 22 nt, Human
acugacucacauuuugguuugc

SEQ ID NO: 206386 - RNA, 22 nt, Human
acugaaauggggacaguccuua

SEQ ID NO: 206387 - RNA, 22 nt, Human
acugaaggcuggaccaugcauc

SEQ ID NO: 206388 - RNA, 22 nt, Human
acuggagcccguggaggcgcag

SEQ ID NO: 206389 - RNA, 22 nt, Human
acugcugauuauugaaguagag

SEQ ID NO: 206390 - RNA, 22 nt, Human
acugcacuccagcccgagcaac

SEQ ID NO: 206391 - RNA, 22 nt, Human
acugauuccaagcuuguggagg

SEQ ID NO: 206392 - RNA, 22 nt, Human
acugaucuguguaauauguuac

SEQ ID NO: 206393 - RNA, 22 nt, Human
acugcagauccucugagaaacc

SEQ ID NO: 206394 - RNA, 22 nt, Human
acugaugacaaugugaguguuc

SEQ ID NO: 206395 - RNA, 22 nt, Human
acuauggaguucagaucuugag

SEQ ID NO: 206396 - RNA, 22 nt, Human
acucacuguuuugaaauugaac

SEQ ID NO: 206397 - RNA, 22 nt, Human
acuaucaacagcaucagggugu

SEQ ID NO: 206398 - RNA, 22 nt, Human
acuauugcuuuagggggaaacc

SEQ ID NO: 206399 - RNA, 22 nt, Human
acuacuguaauuuauuguuaca

SEQ ID NO: 206400 - RNA, 22 nt, Human
acuaggaaguaaauaugucauc

SEQ ID NO: 206401 - RNA, 22 nt, Human
acgucuacaugcaauucuuaua

SEQ ID NO: 206402 - RNA, 22 nt, Human
acguccaccccguaccagauca

SEQ ID NO: 206403 - RNA, 22 nt, Human
acguccgcugauucuuuggaag

SEQ ID NO: 206404 - RNA, 22 nt, Human
acgucaucguugucaucgucau

SEQ ID NO: 206405 - RNA, 22 nt, Human
acguugaaaugggcauuuuccg

SEQ ID NO: 206406 - RNA, 22 nt, Human
acuauacaguauguacgugcac

SEQ ID NO: 206407 - RNA, 22 nt, Human
acuauauaaugcacacaguaua

SEQ ID NO: 206408 - RNA, 22 nt, Human
acgugguaaaagaucuguaaaa

SEQ ID NO: 206409 - RNA, 22 nt, Human
acgccaggagcuucuccguuca

SEQ ID NO: 206410 - RNA, 22 nt, Human
acgcauguacuuguaugcaaug

SEQ ID NO: 206411 - RNA, 22 nt, Human
acgccuugagccuugccugaau

SEQ ID NO: 206412 - RNA, 22 nt, Human
acgccggguaaggucauucugc

SEQ ID NO: 206413 - RNA, 22 nt, Human
acgccugccuguacuugugggg

SEQ ID NO: 206414 - RNA, 22 nt, Human
acaucuaugucugaggccuugg

SEQ ID NO: 206415 - RNA, 22 nt, Human
acaucccccuacuuguguccug

SEQ ID NO: 206416 - RNA, 22 nt, Human
acauccaguaucagaagcauca

SEQ ID NO: 206417 - RNA, 22 nt, Human
acggggagcgucggccucuccc

SEQ ID NO: 206418 - RNA, 22 nt, Human
acggcggguuccgggccagccc

SEQ ID NO: 206419 - RNA, 20 nt, Human
acgccgcgaggugagcuggu

SEQ ID NO: 206420 - RNA, 20 nt, Human
acgcauguauaugcaucacc

SEQ ID NO: 206421 - RNA, 23 nt, Human
acgcagacacauguaugggccuc

SEQ ID NO: 206422 - RNA, 22 nt, Human
acgggggagucuuuuacaucau

SEQ ID NO: 206423 - RNA, 22 nt, Human
aggcaggcucaaugcccagucu

SEQ ID NO: 206424 - RNA, 22 nt, Human
aggcaguggagcuggaauaggc

SEQ ID NO: 206425 - RNA, 22 nt, Human
aggcaguggcuuuuguuguguu

SEQ ID NO: 206426 - RNA, 22 nt, Human
aggcaggggagcuggaagggua

SEQ ID NO: 206427 - RNA, 22 nt, Human
aggcaucguguuuuucugcuuu

SEQ ID NO: 206428 - RNA, 21 nt, Human
aggcagcgauuuucauauugc

SEQ ID NO: 206429 - RNA, 20 nt, Human
aggcagacaaggagucuguu

SEQ ID NO: 206430 - RNA, 22 nt, Human
aggcaagauuaggaccagaaga

SEQ ID NO: 206431 - RNA, 22 nt, Human
aggcagagauggcugcagggcc

SEQ ID NO: 206432 - RNA, 22 nt, Human
aggcagagaggucuuccuggaa

SEQ ID NO: 206433 - RNA, 22 nt, Human
aggcaggauuugcgaugugguu

SEQ ID NO: 206434 - RNA, 22 nt, Human
aggcaggagcugugguggugag

SEQ ID NO: 206435 - RNA, 22 nt, Human
aggcaauuauacuagguuuugg

SEQ ID NO: 206436 - RNA, 22 nt, Human
aggcagcagggagggagaaaug

SEQ ID NO: 206437 - RNA, 23 nt, Human
aggcagcaugcaacaggccauuu

SEQ ID NO: 206438 - RNA, 23 nt, Human
aggcagaguccuggggcacagcc

SEQ ID NO: 206439 - RNA, 19 nt, Human
aggcagccccaacuugcau

SEQ ID NO: 206440 - RNA, 22 nt, Human
aggcagaugggagcuggaaguu

SEQ ID NO: 206441 - RNA, 23 nt, Human
aggcaagaacggguuguucaccc

SEQ ID NO: 206442 - RNA, 22 nt, Human
aggcccugcugaggccucccuc

SEQ ID NO: 206443 - RNA, 20 nt, Human
aggccgcccgcugccgcuuc

SEQ ID NO: 206444 - RNA, 22 nt, Human
aggcugcuggcaggcguggacg

SEQ ID NO: 206445 - RNA, 21 nt, Human
aggccaaguuggauuucuuca

SEQ ID NO: 206446 - RNA, 22 nt, Human
aggccagggacaaugaggcaga

SEQ ID NO: 206447 - RNA, 19 nt, Human
aggcugccucacccucccu

SEQ ID NO: 206448 - RNA, 22 nt, Human
aggccagugcagcuggaacaga

SEQ ID NO: 206449 - RNA, 22 nt, Human
aggccauuucacagguuuugga

SEQ ID NO: 206450 - RNA, 22 nt, Human
aggccacucagggggccaagau

SEQ ID NO: 206451 - RNA, 22 nt, Human
aggcauuuaucaggaaauguuc

SEQ ID NO: 206452 - RNA, 22 nt, Human
aggcagugguguuugcuggugg

SEQ ID NO: 206453 - RNA, 22 nt, Human
aggcaguguggagggcuguugc

SEQ ID NO: 206454 - RNA, 22 nt, Human
aggcaguguguagcuggaagag

SEQ ID NO: 206455 - RNA, 22 nt, Human
aggcauuuaaagauguaagacu

SEQ ID NO: 206456 - RNA, 21 nt, Human
aggcauuuucuuggagauucu

SEQ ID NO: 206457 - RNA, 22 nt, Human
aggcauuuucuuguuauuuuua

SEQ ID NO: 206458 - RNA, 22 nt, Human
aggccaggcgccggcgcgagac

SEQ ID NO: 206459 - RNA, 19 nt, Human
agcggccgccgcgggcgcc

SEQ ID NO: 206460 - RNA, 22 nt, Human
agcggcaggacgucuucuucga

SEQ ID NO: 206461 - RNA, 22 nt, Human
agcgcugugaaggcugggccac

SEQ ID NO: 206462 - RNA, 22 nt, Human
agcggaggaggcggagcaggga

SEQ ID NO: 206463 - RNA, 22 nt, Human
agcggcaggaagcgcgcaagcg

SEQ ID NO: 206464 - RNA, 22 nt, Human
agcgcuguguucccgugggcau

SEQ ID NO: 206465 - RNA, 22 nt, Human
aggaauuucacugcguuuuuua

SEQ ID NO: 206466 - RNA, 22 nt, Human
aggaaguucuggaauuacuagg

SEQ ID NO: 206467 - RNA, 22 nt, Human
aggaaauaggaccagacaaagc

SEQ ID NO: 206468 - RNA, 22 nt, Human
aggaauugucgucauguauaau

SEQ ID NO: 206469 - RNA, 19 nt, Human
agcggagguuguauauugu

SEQ ID NO: 206470 - RNA, 22 nt, Human
aggaacaguuucaaagagugaa

SEQ ID NO: 206471 - RNA, 20 nt, Human
aggaacuggaagggaggaaa

SEQ ID NO: 206472 - RNA, 22 nt, Human
aggaacaacagccuuuauaucc

SEQ ID NO: 206473 - RNA, 16 nt, Human
aggagcagaaagcagu

SEQ ID NO: 206474 - RNA, 22 nt, Human
aggagcacugggcaugucaccc

SEQ ID NO: 206475 - RNA, 22 nt, Human
aggaauuugggguuacaugaug

SEQ ID NO: 206476 - RNA, 22 nt, Human
aggaauuuuaauaugcuugucu

SEQ ID NO: 206477 - RNA, 22 nt, Human
aggaggcguuugcuaaacgggc

SEQ ID NO: 206478 - RNA, 22 nt, Human
aggaggcucucagguccucccc

SEQ ID NO: 206479 - RNA, 22 nt, Human
aggcaauuuuuaggguuguugu

SEQ ID NO: 206480 - RNA, 22 nt, Human
aggcacagaauccagucugcug

SEQ ID NO: 206481 - RNA, 22 nt, Human
aggcaauagagggugaggagga

SEQ ID NO: 206482 - RNA, 22 nt, Human
aggauggauagcaaggaagccg

SEQ ID NO: 206483 - RNA, 20 nt, Human
aggauuauguacauggaugc

SEQ ID NO: 206484 - RNA, 22 nt, Human
aggauuuauuccagaaaugcaa

SEQ ID NO: 206485 - RNA, 22 nt, Human
aggcaacagacaggcuugguuc

SEQ ID NO: 206486 - RNA, 22 nt, Human
aggauuuagcaugaaaugugaa

SEQ ID NO: 206487 - RNA, 22 nt, Human
aggagguagggugugaaacagc

SEQ ID NO: 206488 - RNA, 22 nt, Human
aggacaaaggaccagaucugga

SEQ ID NO: 206489 - RNA, 22 nt, Human
aggauugucuccugugaugugc

SEQ ID NO: 206490 - RNA, 22 nt, Human
aggauucuccuguuucccaccc

SEQ ID NO: 206491 - RNA, 22 nt, Human
aggauauguccuuuuuuucccc

SEQ ID NO: 206492 - RNA, 22 nt, Human
aggauuuaauugcauuuuucuc

SEQ ID NO: 206493 - RNA, 21 nt, Human
aggugguuccaauaaguaggu

SEQ ID NO: 206494 - RNA, 22 nt, Human
agguggugacgaugcuccguac

SEQ ID NO: 206495 - RNA, 22 nt, Human
agguggggacuccaccgaugcu

SEQ ID NO: 206496 - RNA, 22 nt, Human
agguggucccaauggcugggca

SEQ ID NO: 206497 - RNA, 22 nt, Human
aggugguauuuaaaauuauuug

SEQ ID NO: 206498 - RNA, 22 nt, Human
agguuagaauauuuuuucaaga

SEQ ID NO: 206499 - RNA, 22 nt, Human
aggugcacugguacaggcuuca

SEQ ID NO: 206500 - RNA, 22 nt, Human
aggugcauuuacuuggggcccu

SEQ ID NO: 206501 - RNA, 22 nt, Human
aggugcagcugguggagucugg

SEQ ID NO: 206502 - RNA, 19 nt, Human
aggugaugugacucuagaa

SEQ ID NO: 206503 - RNA, 22 nt, Human
aggugggcuuagaaaucuguau

SEQ ID NO: 206504 - RNA, 22 nt, Human
agguggcuaugaggaugcaguc

SEQ ID NO: 206505 - RNA, 22 nt, Human
agguggcguauguguucguguu

SEQ ID NO: 206506 - RNA, 18 nt, Human
aggugagaauuuggcuuu

SEQ ID NO: 206507 - RNA, 22 nt, Human
aggucuuuaguggcagagucua

SEQ ID NO: 206508 - RNA, 22 nt, Human
aggucuugcggaagauauggcu

SEQ ID NO: 206509 - RNA, 18 nt, Human
agguugcaucugugcaga

SEQ ID NO: 206510 - RNA, 22 nt, Human
agguuuauggagcaccacaucu

SEQ ID NO: 206511 - RNA, 22 nt, Human
agguuuggccuuggggggaguu

SEQ ID NO: 206512 - RNA, 22 nt, Human
aggugcuugcauacugcuugac

SEQ ID NO: 206513 - RNA, 22 nt, Human
agguuguugagaucaucuggcu

SEQ ID NO: 206514 - RNA, 22 nt, Human
agguuuggguucauugcuggcu

SEQ ID NO: 206515 - RNA, 22 nt, Human
agguuuggaaguggcgauccau

SEQ ID NO: 206516 - RNA, 22 nt, Human
aguaaaggaaggaagggacagc

SEQ ID NO: 206517 - RNA, 22 nt, Human
agguuuuagaagcugaagccaa

SEQ ID NO: 206518 - RNA, 22 nt, Human
agguuuuagagagccaggaugu

SEQ ID NO: 206519 - RNA, 21 nt, Human
aguaccugugugccugugugu

SEQ ID NO: 206520 - RNA, 20 nt, Human
aguacauauuugugauuuuu

SEQ ID NO: 206521 - RNA, 21 nt, Human
agggccagaucaccaaggagc

SEQ ID NO: 206522 - RNA, 22 nt, Human
agggccagcagcuuggccaacc

SEQ ID NO: 206523 - RNA, 22 nt, Human
agggcaugugaaguaaccuagg

SEQ ID NO: 206524 - RNA, 22 nt, Human
aggggcagaggaugauggaaga

SEQ ID NO: 206525 - RNA, 22 nt, Human
aggggcaaacuuguucuagggu

SEQ ID NO: 206526 - RNA, 22 nt, Human
aggggauucgggugccccuagu

SEQ ID NO: 206527 - RNA, 22 nt, Human
agggccggggagggcugugggg

SEQ ID NO: 206528 - RNA, 22 nt, Human
agggcugggcuuggcaggcugg

SEQ ID NO: 206529 - RNA, 22 nt, Human
agggcaggguuggugcuggugc

SEQ ID NO: 206530 - RNA, 20 nt, Human
agggauuugguugguauugu

SEQ ID NO: 206531 - RNA, 22 nt, Human
agggaugcaguaaaaacuguag

SEQ ID NO: 206532 - RNA, 22 nt, Human
agggaguuccgaucugugcacc

SEQ ID NO: 206533 - RNA, 22 nt, Human
agggagucuggccgucggcugg

SEQ ID NO: 206534 - RNA, 19 nt, Human
agggaggcaagagaaaugu

SEQ ID NO: 206535 - RNA, 22 nt, Human
agggaggcccagcagacuggcg

SEQ ID NO: 206536 - RNA, 22 nt, Human
agggcaguuuuacugaaaggug

SEQ ID NO: 206537 - RNA, 22 nt, Human
agggccaagaaagaguggcuuu

SEQ ID NO: 206538 - RNA, 22 nt, Human
agggaaauaggagaagaaagga

SEQ ID NO: 206539 - RNA, 22 nt, Human
agggcaguguggugggacugac

SEQ ID NO: 206540 - RNA, 22 nt, Human
agggcaguuaugaaugucucca

SEQ ID NO: 206541 - RNA, 22 nt, Human
aggcuuaacuacaauuuuugcc

SEQ ID NO: 206542 - RNA, 22 nt, Human
aggcuuuugcucuggcuccucu

SEQ ID NO: 206543 - RNA, 22 nt, Human
aggcugucucagccugcuugca

SEQ ID NO: 206544 - RNA, 18 nt, Human
aggcuggggaucacaggg

SEQ ID NO: 206545 - RNA, 22 nt, Human
aggcugcucucgccggcggugu

SEQ ID NO: 206546 - RNA, 20 nt, Human
agggguucuguuaugaaaua

SEQ ID NO: 206547 - RNA, 22 nt, Human
aggguauguuuuuaucuacugu

SEQ ID NO: 206548 - RNA, 22 nt, Human
aggguaauaacaguauggugau

SEQ ID NO: 206549 - RNA, 22 nt, Human
agggucgucuggguccgugggg

SEQ ID NO: 206550 - RNA, 22 nt, Human
aggguguuugggagcagaggau

SEQ ID NO: 206551 - RNA, 22 nt, Human
aggguggcuggaguggucuggu

SEQ ID NO: 206552 - RNA, 22 nt, Human
agggcugcugcuccgggcccag

SEQ ID NO: 206553 - RNA, 22 nt, Human
agggcuuacaucccacaguuag

SEQ ID NO: 206554 - RNA, 20 nt, Human
aggggcuguaguuagaugac

SEQ ID NO: 206555 - RNA, 22 nt, Human
aggggcugagaguuugaugugg

SEQ ID NO: 206556 - RNA, 22 nt, Human
agggcuucugcugcagagaccu

SEQ ID NO: 206557 - RNA, 22 nt, Human
aggucgugggugagagagagac

SEQ ID NO: 206558 - RNA, 23 nt, Human
aggucucggaugaagguaaggag

SEQ ID NO: 206559 - RNA, 22 nt, Human
aggucugcccaggaugcugcuu

SEQ ID NO: 206560 - RNA, 22 nt, Human
aggguuucucuccaguguggac

SEQ ID NO: 206561 - RNA, 22 nt, Human
aggguuaugcuccuucaucuug

SEQ ID NO: 206562 - RNA, 22 nt, Human
agggguacuagaggauugagau

SEQ ID NO: 206563 - RNA, 22 nt, Human
agggggaauccugcuuauggau

SEQ ID NO: 206564 - RNA, 22 nt, Human
agggggcaugaaauaaaggaaa

SEQ ID NO: 206565 - RNA, 22 nt, Human
aggggcuuguggaguugcuggu

SEQ ID NO: 206566 - RNA, 22 nt, Human
agugucugcgggcagaggagcg

SEQ ID NO: 206567 - RNA, 22 nt, Human
aguguggcccaugaauuauugg

SEQ ID NO: 206568 - RNA, 22 nt, Human
aguggggcccaagaaucugcau

SEQ ID NO: 206569 - RNA, 22 nt, Human
aguggcugugaaauacauggga

SEQ ID NO: 206570 - RNA, 22 nt, Human
aguggcuggcaggggagggucc

SEQ ID NO: 206571 - RNA, 22 nt, Human
aguggcuguuccaggugaggac

SEQ ID NO: 206572 - RNA, 22 nt, Human
aguggugccuaagcgcggaggc

SEQ ID NO: 206573 - RNA, 22 nt, Human
agugucagcagcuucauugucu

SEQ ID NO: 206574 - RNA, 22 nt, Human
aguggggaaauaucaauauuug

SEQ ID NO: 206575 - RNA, 22 nt, Human
agugucuuuagucgcugagcaa

SEQ ID NO: 206576 - RNA, 22 nt, Human
aguguauuugccuauaaaaaug

SEQ ID NO: 206577 - RNA, 22 nt, Human
aguguuugggagagggugugag

SEQ ID NO: 206578 - RNA, 20 nt, Human
aguguugaacuacacuuccc

SEQ ID NO: 206579 - RNA, 22 nt, Human
aguguucaauuugagcucaaag

SEQ ID NO: 206580 - RNA, 22 nt, Human
aguguggccaaugaggaugggc

SEQ ID NO: 206581 - RNA, 22 nt, Human
aguuaauuauagugcuuaauau

SEQ ID NO: 206582 - RNA, 22 nt, Human
aguguuuuaagaaaguaauuuu

SEQ ID NO: 206583 - RNA, 22 nt, Human
aguguuuuaugugccaguuuaa

SEQ ID NO: 206584 - RNA, 17 nt, Human
aguuacugcacuugcca

SEQ ID NO: 206585 - RNA, 23 nt, Human
aguuaucuaaugaaguucuucca

SEQ ID NO: 206586 - RNA, 22 nt, Human
aguucaugugguuuaacuuaau

SEQ ID NO: 206587 - RNA, 22 nt, Human
aguucaauuguuuuguaaaagu

SEQ ID NO: 206588 - RNA, 22 nt, Human
aguuauggguauguauuauaau

SEQ ID NO: 206589 - RNA, 22 nt, Human
aguuaugcaagcaaguaccacu

SEQ ID NO: 206590 - RNA, 22 nt, Human
aguuauuuuucacuauuaggcu

SEQ ID NO: 206591 - RNA, 22 nt, Human
aguuauuaagaaaauuuugcca

SEQ ID NO: 206592 - RNA, 22 nt, Human
aguucaugcuuagaucucauuu

SEQ ID NO: 206593 - RNA, 20 nt, Human
aguucagguuauuuuccucc

SEQ ID NO: 206594 - RNA, 21 nt, Human
agugagugacagaagaagguu

SEQ ID NO: 206595 - RNA, 22 nt, Human
agugaugcuuuggagaagaucc

SEQ ID NO: 206596 - RNA, 22 nt, Human
agugaagauagagccaggucug

SEQ ID NO: 206597 - RNA, 23 nt, Human
agugaagcugguuagugaugacc

SEQ ID NO: 206598 - RNA, 22 nt, Human
agucugaaccagauggcaaggu

SEQ ID NO: 206599 - RNA, 20 nt, Human
aguacugacaauauucugug

SEQ ID NO: 206600 - RNA, 22 nt, Human
aguacuuugacuagaggcagcu

SEQ ID NO: 206601 - RNA, 22 nt, Human
agucugaguaucucugagccag

SEQ ID NO: 206602 - RNA, 22 nt, Human
agugaaaacugaaucaccuucc

SEQ ID NO: 206603 - RNA, 20 nt, Human
agucuucaggugugaggauu

SEQ ID NO: 206604 - RNA, 22 nt, Human
agugaaagaaaacuguuagaac

SEQ ID NO: 206605 - RNA, 22 nt, Human
agugaaauaugcccauugcugu

SEQ ID NO: 206606 - RNA, 22 nt, Human
agugauguaauggugaauguga

SEQ ID NO: 206607 - RNA, 20 nt, Human
agugauuuguuaguacauug

SEQ ID NO: 206608 - RNA, 23 nt, Human
agugaugcaguaucugggucugu

SEQ ID NO: 206609 - RNA, 22 nt, Human
agugaugauccaaaugaauuga

SEQ ID NO: 206610 - RNA, 20 nt, Human
agugaguuaucagcuacagu

SEQ ID NO: 206611 - RNA, 22 nt, Human
aguggagguuacagcuguacau

SEQ ID NO: 206612 - RNA, 23 nt, Human
aguggaggucgggguggggagac

SEQ ID NO: 206613 - RNA, 22 nt, Human
agugccauggcugcuagauggc

SEQ ID NO: 206614 - RNA, 22 nt, Human
agugcgagaugaggacagaagc

SEQ ID NO: 206615 - RNA, 22 nt, Human
agugccuuaaaggucuugcagc

SEQ ID NO: 206616 - RNA, 22 nt, Human
agugccaucuuuaacuguccca

SEQ ID NO: 206617 - RNA, 19 nt, Human
agugggauggcuuuuuccc

SEQ ID NO: 206618 - RNA, 19 nt, Human
agugggcaaggaagaugac

SEQ ID NO: 206619 - RNA, 22 nt, Human
agugggaaagcugccuuguaga

SEQ ID NO: 206620 - RNA, 22 nt, Human
aguggcuucucuggggucaaga

SEQ ID NO: 206621 - RNA, 22 nt, Human
aguggcuagaucaugagugagc

SEQ ID NO: 206622 - RNA, 22 nt, Human
aguggugaucuguuacagucac

SEQ ID NO: 206623 - RNA, 21 nt, Human
aguggcacuguuucuucccua

SEQ ID NO: 206624 - RNA, 22 nt, Human
agugccuggcugauggguccug

SEQ ID NO: 206625 - RNA, 22 nt, Human
agugcuuuauguuguugugcaa

SEQ ID NO: 206626 - RNA, 22 nt, Human
aguucuggcccugaaacaggga

SEQ ID NO: 206627 - RNA, 22 nt, Human
aguucugggaggugcacgucca

SEQ ID NO: 206628 - RNA, 22 nt, Human
aguucuuugcucccugcuuuuu

SEQ ID NO: 206629 - RNA, 22 nt, Human
aguucccgcgggagggcgcagg

SEQ ID NO: 206630 - RNA, 22 nt, Human
aguugggaaaugcugcaguagu

SEQ ID NO: 206631 - RNA, 22 nt, Human
aguugcuucccuauucuuagca

SEQ ID NO: 206632 - RNA, 22 nt, Human
aguugcugccagguccugggag

SEQ ID NO: 206633 - RNA, 22 nt, Human
aguucuguucccccaguuacau

SEQ ID NO: 206634 - RNA, 22 nt, Human
aguugguauuuacugcaguugg

SEQ ID NO: 206635 - RNA, 22 nt, Human
aguugguucgucucgccuugag

SEQ ID NO: 206636 - RNA, 22 nt, Human
aguugguggaagcuaagcuucu

SEQ ID NO: 206637 - RNA, 21 nt, Human
aguuguacuguauagcagaug

SEQ ID NO: 206638 - RNA, 22 nt, Human
aguuugauuugucuaucuucau

SEQ ID NO: 206639 - RNA, 23 nt, Human
aguuuacguauucauucuuacuc

SEQ ID NO: 206640 - RNA, 22 nt, Human
aguuuaaauuguucuaucagaa

SEQ ID NO: 206641 - RNA, 22 nt, Human
aguugugagaaugaacacugaa

SEQ ID NO: 206642 - RNA, 22 nt, Human
aguuuguagguuaggaucagca

SEQ ID NO: 206643 - RNA, 22 nt, Human
aguuuacccacuguugaaauua

SEQ ID NO: 206644 - RNA, 22 nt, Human
aguuuuugagaauucuucugaa

SEQ ID NO: 206645 - RNA, 22 nt, Human
aguuuuguuuguuuguuuguua

SEQ ID NO: 206646 - RNA, 22 nt, Human
aguuuucugccucuggaugcgu

SEQ ID NO: 206647 - RNA, 22 nt, Human
aguuuccacuggagacacugug

SEQ ID NO: 206648 - RNA, 22 nt, Human
aguuucccucacaggucugcau

SEQ ID NO: 206649 - RNA, 22 nt, Human
aguuuuugccucgaauucugcg

SEQ ID NO: 206650 - RNA, 22 nt, Human
auaaaaaguggcugcuauugga

SEQ ID NO: 206651 - RNA, 22 nt, Human
auacaggcaguaagauucucag

SEQ ID NO: 206652 - RNA, 22 nt, Human
auacagccuaguuugaguccca

SEQ ID NO: 206653 - RNA, 22 nt, Human
auaaaucaagggcaguauuucc

SEQ ID NO: 206654 - RNA, 22 nt, Human
auacaaaaaguggugaguguau

SEQ ID NO: 206655 - RNA, 22 nt, Human
auacacauguuauuguggaagc

SEQ ID NO: 206656 - RNA, 22 nt, Human
auaaccaaaaauaguuuaguac

SEQ ID NO: 206657 - RNA, 22 nt, Human
auaaauuugacagcucuucaug

SEQ ID NO: 206658 - RNA, 22 nt, Human
auaaggacuugaauuagacauu

SEQ ID NO: 206659 - RNA, 22 nt, Human
auaauugaauaagagcugcagg

SEQ ID NO: 206660 - RNA, 22 nt, Human
auaaggcauagugagucaucau

SEQ ID NO: 206661 - RNA, 22 nt, Human
auaagccugccuuaucuccaga

SEQ ID NO: 206662 - RNA, 22 nt, Human
auaagguuuucuuuuguucccu

SEQ ID NO: 206663 - RNA, 22 nt, Human
auaaguuauuuuaguaaaucag

SEQ ID NO: 206664 - RNA, 22 nt, Human
auaaaaucugaagcaagaauaa

SEQ ID NO: 206665 - RNA, 23 nt, Human
auaaugauaaugcuauuuuuugu

SEQ ID NO: 206666 - RNA, 20 nt, Human
auaaauaggauuuucugaca

SEQ ID NO: 206667 - RNA, 22 nt, Human
auaaaguaaugcauauaaugug

SEQ ID NO: 206668 - RNA, 22 nt, Human
auaacgaaagcaauuauuuuca

SEQ ID NO: 206669 - RNA, 22 nt, Human
auaacccuauuaaauggugcgc

SEQ ID NO: 206670 - RNA, 22 nt, Human
auaagcuucucugcaguucagu

SEQ ID NO: 206671 - RNA, 22 nt, Human
auaaucuuugaguagaguugag

SEQ ID NO: 206672 - RNA, 22 nt, Human
auaaauucuaugauggauuggg

SEQ ID NO: 206673 - RNA, 18 nt, Human
aguuuuuuuggcaaaagg

SEQ ID NO: 206674 - RNA, 22 nt, Human
aguuuuuaacgccauguuugaa

SEQ ID NO: 206675 - RNA, 22 nt, Human
auaaaagcacaauagaguuaug

SEQ ID NO: 206676 - RNA, 22 nt, Human
auaaaacagaucaggagaauga

SEQ ID NO: 206677 - RNA, 22 nt, Human
auaaaaauguuuuuguguggua

SEQ ID NO: 206678 - RNA, 22 nt, Human
auugagacugaaauuacugaag

SEQ ID NO: 206679 - RNA, 22 nt, Human
auucuguuuaauacacgaaagg

SEQ ID NO: 206680 - RNA, 22 nt, Human
auucuguugguuuaauagucaa

SEQ ID NO: 206681 - RNA, 22 nt, Human
auucuguaggcuuuuguuaaaa

SEQ ID NO: 206682 - RNA, 22 nt, Human
auucugcugccuaguuuaugaa

SEQ ID NO: 206683 - RNA, 22 nt, Human
auucugcaauaaucaguccuua

SEQ ID NO: 206684 - RNA, 22 nt, Human
auucucugaugcagguggaaga

SEQ ID NO: 206685 - RNA, 22 nt, Human
auucugaagcagaaaaggcaga

SEQ ID NO: 206686 - RNA, 22 nt, Human
auugauuuugugcuuuccuacg

SEQ ID NO: 206687 - RNA, 22 nt, Human
auugaugccugaaaaauaugua

SEQ ID NO: 206688 - RNA, 22 nt, Human
auugaguacuugcugggcucuc

SEQ ID NO: 206689 - RNA, 18 nt, Human
auugagcaugacagaccu

SEQ ID NO: 206690 - RNA, 22 nt, Human
auugaugaaaauaguuauuuua

SEQ ID NO: 206691 - RNA, 22 nt, Human
auucuuauaaaaaguguugacu

SEQ ID NO: 206692 - RNA, 17 nt, Human
auucuuauacucuguga

SEQ ID NO: 206693 - RNA, 22 nt, Human
auugaaauuaauuucugcuuuc

SEQ ID NO: 206694 - RNA, 21 nt, Human
auuggcagaucucuggauugu

SEQ ID NO: 206695 - RNA, 22 nt, Human
auugccauaauagagccaugua

SEQ ID NO: 206696 - RNA, 19 nt, Human
auucuucucuuccugcugu

SEQ ID NO: 206697 - RNA, 22 nt, Human
auucuuuucucuaaaugaugaa

SEQ ID NO: 206698 - RNA, 22 nt, Human
auucccuuugacgaucccuagg

SEQ ID NO: 206699 - RNA, 22 nt, Human
auucuucauguugaagcuguca

SEQ ID NO: 206700 - RNA, 22 nt, Human
auuccccagcaggccuuuuguu

SEQ ID NO: 206701 - RNA, 22 nt, Human
auuccuguggcuggguaaagua

SEQ ID NO: 206702 - RNA, 22 nt, Human
auucgcggcuugaucugcuugc

SEQ ID NO: 206703 - RNA, 22 nt, Human
auucuagaguuucaauccaagg

SEQ ID NO: 206704 - RNA, 22 nt, Human
auugaagcauggagaugaggca

SEQ ID NO: 206705 - RNA, 22 nt, Human
auugagaaaauucgagcaaguu

SEQ ID NO: 206706 - RNA, 22 nt, Human
auucaccaucuugauccccucu

SEQ ID NO: 206707 - RNA, 22 nt, Human
auucuguuuuaccauuuucuuu

SEQ ID NO: 206708 - RNA, 22 nt, Human
auucugcauuucuaaccagguc

SEQ ID NO: 206709 - RNA, 21 nt, Human
auucugauguuucuauuguuu

SEQ ID NO: 206710 - RNA, 22 nt, Human
auucucuguacagaagguaccg

SEQ ID NO: 206711 - RNA, 23 nt, Human
auuauuucaggguuuugacuugc

SEQ ID NO: 206712 - RNA, 22 nt, Human
auguuguugaacucuuugcaug

SEQ ID NO: 206713 - RNA, 22 nt, Human
auuaaagcuaguugagauuuaa

SEQ ID NO: 206714 - RNA, 22 nt, Human
auuaaauagcagaagaaagaug

SEQ ID NO: 206715 - RNA, 22 nt, Human
auuaacaggcucuguucuaguu

SEQ ID NO: 206716 - RNA, 21 nt, Human
auuaagacaauggcaaugggu

SEQ ID NO: 206717 - RNA, 22 nt, Human
auucgaucacugccgaggaccu

SEQ ID NO: 206718 - RNA, 22 nt, Human
auuauggacuuucuuguuuggg

SEQ ID NO: 206719 - RNA, 22 nt, Human
auuaugugagggacuuaaucau

SEQ ID NO: 206720 - RNA, 22 nt, Human
auucucauguuaccaaauucua

SEQ ID NO: 206721 - RNA, 22 nt, Human
auucuccucaaaacaucugcug

SEQ ID NO: 206722 - RNA, 22 nt, Human
auucuacucuuuaaauaugaaa

SEQ ID NO: 206723 - RNA, 22 nt, Human
auucuaugaaugacuguuagau

SEQ ID NO: 206724 - RNA, 22 nt, Human
auuucagcagcccauguuugga

SEQ ID NO: 206725 - RNA, 22 nt, Human
auuuaagugagucuuuaaaaua

SEQ ID NO: 206726 - RNA, 22 nt, Human
auuuacugagguaaauaaacug

SEQ ID NO: 206727 - RNA, 22 nt, Human
auuuaucugcucuucgcguuga

SEQ ID NO: 206728 - RNA, 22 nt, Human
auuggccaguggacagcgccgu

SEQ ID NO: 206729 - RNA, 19 nt, Human
auugcaguguaaaacuauu

SEQ ID NO: 206730 - RNA, 22 nt, Human
auuguauugcguuugcgaaugu

SEQ ID NO: 206731 - RNA, 22 nt, Human
auuuccagcagcauauuugucu

SEQ ID NO: 206732 - RNA, 22 nt, Human
auuguucuagaauuuuuuuucc

SEQ ID NO: 206733 - RNA, 22 nt, Human
auuguuacuggguuaauuugga

SEQ ID NO: 206734 - RNA, 22 nt, Human
auuguuuccccggaauuauuca

SEQ ID NO: 206735 - RNA, 23 nt, Human
auuugcugaucguagaugacuag

SEQ ID NO: 206736 - RNA, 22 nt, Human
auuugacuugguaagacuuaag

SEQ ID NO: 206737 - RNA, 22 nt, Human
auuugccaguuacucacaccac

SEQ ID NO: 206738 - RNA, 22 nt, Human
auugaguucaccucuuucagaa

SEQ ID NO: 206739 - RNA, 22 nt, Human
auugaguauuguaaauaaaaca

SEQ ID NO: 206740 - RNA, 22 nt, Human
auugagcuguugaagucccaca

SEQ ID NO: 206741 - RNA, 22 nt, Human
auuuaagacuguggugcaguuu

SEQ ID NO: 206742 - RNA, 22 nt, Human
auugcaggucguguggaaguga

SEQ ID NO: 206743 - RNA, 22 nt, Human
auugcauucaugcuccccuuag

SEQ ID NO: 206744 - RNA, 23 nt, Human
auugccuguagaucuucacuuuc

SEQ ID NO: 206745 - RNA, 22 nt, Human
auugguuucuuguggguuaucc

SEQ ID NO: 206746 - RNA, 22 nt, Human
auucuuuauuuucuguacuugc

SEQ ID NO: 206747 - RNA, 22 nt, Human
auucuuuagaguccuucaaaua

SEQ ID NO: 206748 - RNA, 22 nt, Human
auugaaguguacguuugaucua

SEQ ID NO: 206749 - RNA, 22 nt, Human
auugaauuagauguuguagucc

SEQ ID NO: 206750 - RNA, 22 nt, Human
auugacagaaaauuggauggca

SEQ ID NO: 206751 - RNA, 22 nt, Human
auuuuguugaaacccuuguugu

SEQ ID NO: 206752 - RNA, 22 nt, Human
auuucuguaauucugaggagug

SEQ ID NO: 206753 - RNA, 22 nt, Human
auuuucuucauuuugauuguau

SEQ ID NO: 206754 - RNA, 22 nt, Human
auuuucuugucucuguuguagg

SEQ ID NO: 206755 - RNA, 22 nt, Human
auuuccugugaacuuuucugau

SEQ ID NO: 206756 - RNA, 22 nt, Human
auuuuagagaaacaaacguagg

SEQ ID NO: 206757 - RNA, 22 nt, Human
auuuuauuuugggaucuuuuua

SEQ ID NO: 206758 - RNA, 22 nt, Human
auuuucauauggguuauuugua

SEQ ID NO: 206759 - RNA, 22 nt, Human
auuuucgcaccucgcgaguugc

SEQ ID NO: 206760 - RNA, 21 nt, Human
auuuuucagaaggaugugaua

SEQ ID NO: 206761 - RNA, 22 nt, Human
auuuuucacauuuugggggaca

SEQ ID NO: 206762 - RNA, 22 nt, Human
auuuugcuuuucuaguggguuu

SEQ ID NO: 206763 - RNA, 22 nt, Human
auuuuuagucuugcugcaauca

SEQ ID NO: 206764 - RNA, 22 nt, Human
auuuuaccauuaguuuguaaua

SEQ ID NO: 206765 - RNA, 19 nt, Human
auuuugguucuuuccauuc

SEQ ID NO: 206766 - RNA, 22 nt, Human
auuuuugugcuuuauuggggua

SEQ ID NO: 206767 - RNA, 22 nt, Human
auuuuugugucacaucuaggaa

SEQ ID NO: 206768 - RNA, 22 nt, Human
caaauuuuuauuuaccaucugc

SEQ ID NO: 206769 - RNA, 22 nt, Human
auuuuugguuauaaaauaguuu

SEQ ID NO: 206770 - RNA, 22 nt, Human
caaaaaauccauagaaagaggu

SEQ ID NO: 206771 - RNA, 22 nt, Human
auuuuuuuuccugucucuuuca

SEQ ID NO: 206772 - RNA, 22 nt, Human
caaaaauacuugccuguaucug

SEQ ID NO: 206773 - RNA, 22 nt, Human
auuuuuucaugugugguugaga

SEQ ID NO: 206774 - RNA, 19 nt, Human
caagagcaaagucuuauga

SEQ ID NO: 206775 - RNA, 22 nt, Human
caaaguauuuagcugacucgcu

SEQ ID NO: 206776 - RNA, 22 nt, Human
caaauacguuuggcuggagcac

SEQ ID NO: 206777 - RNA, 22 nt, Human
caaaucagaucagagacaggcu

SEQ ID NO: 206778 - RNA, 22 nt, Human
caaaugaugcauggcuagugag

SEQ ID NO: 206779 - RNA, 22 nt, Human
caaaugcaguggucgugcugga

SEQ ID NO: 206780 - RNA, 22 nt, Human
caaaggagcccuuugccggguu

SEQ ID NO: 206781 - RNA, 22 nt, Human
auuuuuagagugaaagaauuaa

SEQ ID NO: 206782 - RNA, 22 nt, Human
auacuuccugcuucccugaucu

SEQ ID NO: 206783 - RNA, 22 nt, Human
aucuccaguuagcaguacugau

SEQ ID NO: 206784 - RNA, 22 nt, Human
aucuccagcagugcuuuugagc

SEQ ID NO: 206785 - RNA, 22 nt, Human
auccuggcuuuccugauuuacu

SEQ ID NO: 206786 - RNA, 22 nt, Human
auccugugggguauugcugcau

SEQ ID NO: 206787 - RNA, 22 nt, Human
auccuucaaaaggaauagcagg

SEQ ID NO: 206788 - RNA, 22 nt, Human
auacuaagcucauuacauuuug

SEQ ID NO: 206789 - RNA, 22 nt, Human
auaaugccucauaggguguucc

SEQ ID NO: 206790 - RNA, 22 nt, Human
auacacuucauguuuucaucug

SEQ ID NO: 206791 - RNA, 22 nt, Human
aucugacaaccuauugacuuga

SEQ ID NO: 206792 - RNA, 18 nt, Human
auccuucggccuagugga

SEQ ID NO: 206793 - RNA, 18 nt, Human
auccuuugaucaucuguc

SEQ ID NO: 206794 - RNA, 22 nt, Human
aucgcagaguggaaauugauga

SEQ ID NO: 206795 - RNA, 22 nt, Human
aucugcuguaguuggugccagu

SEQ ID NO: 206796 - RNA, 22 nt, Human
aucuggaacuucucugcauuga

SEQ ID NO: 206797 - RNA, 23 nt, Human
aucugagccuggucccacccgcu

SEQ ID NO: 206798 - RNA, 22 nt, Human
aucugggaaggggaaaaugcug

SEQ ID NO: 206799 - RNA, 22 nt, Human
aucugugguacaugacggcugc

SEQ ID NO: 206800 - RNA, 22 nt, Human
aucugugauuuuggcaagauuu

SEQ ID NO: 206801 - RNA, 20 nt, Human
aucugguggggaauaacuuc

SEQ ID NO: 206802 - RNA, 22 nt, Human
aucuuggccuucuccuggagug

SEQ ID NO: 206803 - RNA, 22 nt, Human
aucuuggauccuuugccagcuu

SEQ ID NO: 206804 - RNA, 22 nt, Human
aucugcauguggcagguggauu

SEQ ID NO: 206805 - RNA, 22 nt, Human
aucuuuguaaguaaucaaagcu

SEQ ID NO: 206806 - RNA, 22 nt, Human
aucuucucucucaucaggauca

SEQ ID NO: 206807 - RNA, 22 nt, Human
aucuucaggggcaauggagaua

SEQ ID NO: 206808 - RNA, 22 nt, Human
aucuucaaggacgccaagaucc

SEQ ID NO: 206809 - RNA, 20 nt, Human
aucuuaucuaucuuuuguuc

SEQ ID NO: 206810 - RNA, 22 nt, Human
aucuuagagagucguguuuugu

SEQ ID NO: 206811 - RNA, 21 nt, Human
aucugugucauuagguggcag

SEQ ID NO: 206812 - RNA, 22 nt, Human
aucuguuccccuaugcucucua

SEQ ID NO: 206813 - RNA, 22 nt, Human
aucguuaugauagagaaagaga

SEQ ID NO: 206814 - RNA, 22 nt, Human
aucggucuccuauaauucaaac

SEQ ID NO: 206815 - RNA, 22 nt, Human
augacagcucuagcacacagua

SEQ ID NO: 206816 - RNA, 22 nt, Human
augaccauccagaaguccagcu

SEQ ID NO: 206817 - RNA, 22 nt, Human
aucuuugccuuuaugccucuag

SEQ ID NO: 206818 - RNA, 22 nt, Human
augacuauaaauaggagauugu

SEQ ID NO: 206819 - RNA, 22 nt, Human
augaguaaguucugauuagauu

SEQ ID NO: 206820 - RNA, 22 nt, Human
aucuuugauuuuggcuuuuagg

SEQ ID NO: 206821 - RNA, 22 nt, Human
aucuuuuuucacaauuuauuuu

SEQ ID NO: 206822 - RNA, 22 nt, Human
augaaaacggaccagagcuauu

SEQ ID NO: 206823 - RNA, 22 nt, Human
augaaggauagggcaaaauuuu

SEQ ID NO: 206824 - RNA, 22 nt, Human
augaagguggacagauuuuuuu

SEQ ID NO: 206825 - RNA, 22 nt, Human
augaacugcaguauaaacuugg

SEQ ID NO: 206826 - RNA, 22 nt, Human
aucuguggguaaggauaagcau

SEQ ID NO: 206827 - RNA, 20 nt, Human
aucugugaugagaacgguuu

SEQ ID NO: 206828 - RNA, 22 nt, Human
augauaucuuguuuuucaugca

SEQ ID NO: 206829 - RNA, 22 nt, Human
augaaaacgugugugugugugu

SEQ ID NO: 206830 - RNA, 23 nt, Human
augaaaugauacuuuauucacug

SEQ ID NO: 206831 - RNA, 23 nt, Human
augaacgcacugagaucauaauu

SEQ ID NO: 206832 - RNA, 22 nt, Human
augaaacucuagcuuucagcac

SEQ ID NO: 206833 - RNA, 19 nt, Human
augaaauagcauuuucuga

SEQ ID NO: 206834 - RNA, 19 nt, Human
augcacgugaaaugcauuu

SEQ ID NO: 206835 - RNA, 19 nt, Human
augcaauguuaucaauaac

SEQ ID NO: 206836 - RNA, 22 nt, Human
augcacaagguagauuauuauu

SEQ ID NO: 206837 - RNA, 22 nt, Human
augaggauuagcaucugcaaau

SEQ ID NO: 206838 - RNA, 22 nt, Human
augaggagucaaggagucggag

SEQ ID NO: 206839 - RNA, 21 nt, Human
augagguggcuacuaaagagu

SEQ ID NO: 206840 - RNA, 22 nt, Human
augaggccacaguuauagauuu

SEQ ID NO: 206841 - RNA, 22 nt, Human
augcaggcuaagaguaaagacg

SEQ ID NO: 206842 - RNA, 22 nt, Human
augcauaugugugcaagugugu

SEQ ID NO: 206843 - RNA, 22 nt, Human
augauuaagguacgucauuucu

SEQ ID NO: 206844 - RNA, 22 nt, Human
augaguuaaguagcccuucaug

SEQ ID NO: 206845 - RNA, 22 nt, Human
augauguuggaauuuuaacuua

SEQ ID NO: 206846 - RNA, 18 nt, Human
augauaauguuugcauca

SEQ ID NO: 206847 - RNA, 22 nt, Human
auguaccgccuuggagaaaugc

SEQ ID NO: 206848 - RNA, 22 nt, Human
auguggaaagcuugucuuagag

SEQ ID NO: 206849 - RNA, 22 nt, Human
auggggucagagaauggugggu

SEQ ID NO: 206850 - RNA, 19 nt, Human
augguauugcuggguuuuu

SEQ ID NO: 206851 - RNA, 22 nt, Human
auggugaugaugaugaugauaa

SEQ ID NO: 206852 - RNA, 22 nt, Human
auguccugguccacagaaggga

SEQ ID NO: 206853 - RNA, 22 nt, Human
auggugugugugugugugugug

SEQ ID NO: 206854 - RNA, 22 nt, Human
augguguaagacuguauuucuu

SEQ ID NO: 206855 - RNA, 22 nt, Human
augggagggagcagugaguguu

SEQ ID NO: 206856 - RNA, 22 nt, Human
augggaauggauugagugggug

SEQ ID NO: 206857 - RNA, 22 nt, Human
augguaaguuuuuaaaaagcgu

SEQ ID NO: 206858 - RNA, 22 nt, Human
auggugaaaugauuugauguca

SEQ ID NO: 206859 - RNA, 22 nt, Human
augguguaggugaagagaacau

SEQ ID NO: 206860 - RNA, 22 nt, Human
augggcuuuacccucagagcuu

SEQ ID NO: 206861 - RNA, 22 nt, Human
auggggaauugaccguggaucu

SEQ ID NO: 206862 - RNA, 22 nt, Human
augggagggugaggaggcagcu

SEQ ID NO: 206863 - RNA, 22 nt, Human
augggcauggauggccgagucu

SEQ ID NO: 206864 - RNA, 22 nt, Human
auguguguaugugugcauguau

SEQ ID NO: 206865 - RNA, 21 nt, Human
auguguucugauagugcuugc

SEQ ID NO: 206866 - RNA, 22 nt, Human
auguauauauacauguauugua

SEQ ID NO: 206867 - RNA, 23 nt, Human
auguagcugcucccgaugcccuc

SEQ ID NO: 206868 - RNA, 22 nt, Human
augugauacuccuucuagugga

SEQ ID NO: 206869 - RNA, 22 nt, Human
augugcauguauguaucauauu

SEQ ID NO: 206870 - RNA, 22 nt, Human
auguugcugauccuguggcugu

SEQ ID NO: 206871 - RNA, 22 nt, Human
auuaaagcaugaauaauaugua

SEQ ID NO: 206872 - RNA, 22 nt, Human
auuaaaaaugagaguagggauu

SEQ ID NO: 206873 - RNA, 22 nt, Human
auguuuuuugaaaauguauuuu

SEQ ID NO: 206874 - RNA, 22 nt, Human
auguuuugaguuuuuuuacacc

SEQ ID NO: 206875 - RNA, 22 nt, Human
auguuuucauuuagaagcuaau

SEQ ID NO: 206876 - RNA, 20 nt, Human
augugcuaauauuaauaugu

SEQ ID NO: 206877 - RNA, 22 nt, Human
auguuuaauuugaaauuuuauu

SEQ ID NO: 206878 - RNA, 22 nt, Human
auguuugugauugcugaaaaga

SEQ ID NO: 206879 - RNA, 22 nt, Human
augccaccucuucugauuccag

SEQ ID NO: 206880 - RNA, 22 nt, Human
augcccagaacccccuggaugg

SEQ ID NO: 206881 - RNA, 22 nt, Human
augauuuguuaacagacuuaau

SEQ ID NO: 206882 - RNA, 22 nt, Human
augcaaaaucuuauuuuuucua

SEQ ID NO: 206883 - RNA, 22 nt, Human
augauuauuugaaugaagagga

SEQ ID NO: 206884 - RNA, 22 nt, Human
augcccugggagugcuguacca

SEQ ID NO: 206885 - RNA, 22 nt, Human
augccacuguuuaugucacuua

SEQ ID NO: 206886 - RNA, 22 nt, Human
augcaugaucccgguaugugaa

SEQ ID NO: 206887 - RNA, 22 nt, Human
auggaggagcagaggguuucca

SEQ ID NO: 206888 - RNA, 22 nt, Human
auggagcagagcugaugggccu

SEQ ID NO: 206889 - RNA, 22 nt, Human
augcugccuaaagcuacuuaca

SEQ ID NO: 206890 - RNA, 22 nt, Human
auggagguuugucugguuuugu

SEQ ID NO: 206891 - RNA, 22 nt, Human
augcugccuccucuucagccgc

SEQ ID NO: 206892 - RNA, 22 nt, Human
auggauggaagcagccugaacu

SEQ ID NO: 206893 - RNA, 22 nt, Human
auggaagagacaaugcuaucug

SEQ ID NO: 206894 - RNA, 22 nt, Human
auggaaggggagguagggagga

SEQ ID NO: 206895 - RNA, 22 nt, Human
auggacguuuguguauuaugua

SEQ ID NO: 206896 - RNA, 22 nt, Human
augcuacauuuugguuuauaaa

SEQ ID NO: 206897 - RNA, 22 nt, Human
auggggaucugcaguguugauc

SEQ ID NO: 206898 - RNA, 22 nt, Human
augggcggugcauuugcacagu

SEQ ID NO: 206899 - RNA, 22 nt, Human
auggacagcucuuaugugggca

SEQ ID NO: 206900 - RNA, 18 nt, Human
augggggaggaggaaagg

SEQ ID NO: 206901 - RNA, 22 nt, Human
auggggaggcggauggagugcu

SEQ ID NO: 206902 - RNA, 22 nt, Human
augggggccagggacccuggca

SEQ ID NO: 206903 - RNA, 22 nt, Human
auggagcgggaggauggaggag

SEQ ID NO: 206904 - RNA, 22 nt, Human
auggaggugagccccccauccu

SEQ ID NO: 206905 - RNA, 22 nt, Human
auggaggaugugcagcaugggc

SEQ ID NO: 206906 - RNA, 22 nt, Human
augauaccacucaauagggcau

SEQ ID NO: 206907 - RNA, 22 nt, Human
augggugggagugaaggggcuc

SEQ ID NO: 206908 - RNA, 22 nt, Human
auggauuggguugauggcauac

SEQ ID NO: 206909 - RNA, 22 nt, Human
augggcauacaaaugcuacccu

SEQ ID NO: 206910 - RNA, 22 nt, Human
auggaacauuaaucuucaaaug

SEQ ID NO: 206911 - RNA, 22 nt, Human
auggaacccgggcgucugcucu

SEQ ID NO: 206912 - RNA, 22 nt, Human
auggcagcggagcuggaaauga

SEQ ID NO: 206913 - RNA, 22 nt, Human
auggcaucuucgguuggacugc

SEQ ID NO: 206914 - RNA, 20 nt, Human
auggaaacacgcagccccaa

SEQ ID NO: 206915 - RNA, 22 nt, Human
cagguugaagagguuaacgaua

SEQ ID NO: 206916 - RNA, 22 nt, Human
caggugggauuuugcugcuuga

SEQ ID NO: 206917 - RNA, 20 nt, Human
cagguugcugcccccgccuc

SEQ ID NO: 206918 - RNA, 22 nt, Human
caggagaaauucacauuaguga

SEQ ID NO: 206919 - RNA, 22 nt, Human
caggaacucggagcccaucucu

SEQ ID NO: 206920 - RNA, 22 nt, Human
caggacacaaaagguggagaag

SEQ ID NO: 206921 - RNA, 19 nt, Human
caggacaguuugccaagaa

SEQ ID NO: 206922 - RNA, 22 nt, Human
caggaacucuucugggugcuug

SEQ ID NO: 206923 - RNA, 22 nt, Human
caggaagucugaauucugagag

SEQ ID NO: 206924 - RNA, 22 nt, Human
caggaagagaacugcucagccu

SEQ ID NO: 206925 - RNA, 22 nt, Human
caguggacacuuccucuacaau

SEQ ID NO: 206926 - RNA, 22 nt, Human
caggcacaaugagcgccaucuu

SEQ ID NO: 206927 - RNA, 22 nt, Human
cagucugcuggcuuuuucagca

SEQ ID NO: 206928 - RNA, 23 nt, Human
cagucgacugugcccucccgagc

SEQ ID NO: 206929 - RNA, 22 nt, Human
cagugccggccaggaccuccug

SEQ ID NO: 206930 - RNA, 22 nt, Human
cagguuuuccuuuuaaaaggaa

SEQ ID NO: 206931 - RNA, 19 nt, Human
caggauuguuuaaagcuuu

SEQ ID NO: 206932 - RNA, 22 nt, Human
caggaggugugucccaccgggu

SEQ ID NO: 206933 - RNA, 22 nt, Human
caggaguggugagguuagcaga

SEQ ID NO: 206934 - RNA, 22 nt, Human
caggauauguucaagguuuucu

SEQ ID NO: 206935 - RNA, 22 nt, Human
caguuuccagacauuauugaua

SEQ ID NO: 206936 - RNA, 22 nt, Human
caggguuuuaguugcagguuau

SEQ ID NO: 206937 - RNA, 22 nt, Human
caggguugaugaauugucugua

SEQ ID NO: 206938 - RNA, 22 nt, Human
caguucacggcugguaugaauu

SEQ ID NO: 206939 - RNA, 22 nt, Human
caguucuguaccaggagaagcu

SEQ ID NO: 206940 - RNA, 22 nt, Human
caguugcagagugauguguuug

SEQ ID NO: 206941 - RNA, 22 nt, Human
caguggagaccugccugcugga

SEQ ID NO: 206942 - RNA, 22 nt, Human
caguggggaggccaggauagaa

SEQ ID NO: 206943 - RNA, 22 nt, Human
caggggcuccaggugagccugg

SEQ ID NO: 206944 - RNA, 23 nt, Human
caggggacaggugaccugggcuc

SEQ ID NO: 206945 - RNA, 22 nt, Human
cauauacauauacaugcauaca

SEQ ID NO: 206946 - RNA, 22 nt, Human
cauaucuuaaacaucaucucug

SEQ ID NO: 206947 - RNA, 22 nt, Human
cauaucuccagguucugcugga

SEQ ID NO: 206948 - RNA, 22 nt, Human
cauaagaauauuuaguggcagc

SEQ ID NO: 206949 - RNA, 22 nt, Human
cauaaucaagggguugugaugu

SEQ ID NO: 206950 - RNA, 22 nt, Human
cagguggauggcgagcccugca

SEQ ID NO: 206951 - RNA, 22 nt, Human
cauaacuugguguuggaaacug

SEQ ID NO: 206952 - RNA, 22 nt, Human
caggugauuuuguuuucaaaug

SEQ ID NO: 206953 - RNA, 22 nt, Human
caggugcucugauauggggcug

SEQ ID NO: 206954 - RNA, 22 nt, Human
caggaaaauaauggugauggga

SEQ ID NO: 206955 - RNA, 22 nt, Human
caggaacagcaccaggagcuag

SEQ ID NO: 206956 - RNA, 22 nt, Human
cagcaugcaaguccagaugugg

SEQ ID NO: 206957 - RNA, 22 nt, Human
cagcauugagcacagaaggaaa

SEQ ID NO: 206958 - RNA, 22 nt, Human
cagcgguggcaaggugacugug

SEQ ID NO: 206959 - RNA, 22 nt, Human
caggacuuccucuaugguggcg

SEQ ID NO: 206960 - RNA, 22 nt, Human
caggacagaaauaaggaauaua

SEQ ID NO: 206961 - RNA, 22 nt, Human
caggacacagacacuaaauaua

SEQ ID NO: 206962 - RNA, 22 nt, Human
cagcccugagagaaccaucuau

SEQ ID NO: 206963 - RNA, 22 nt, Human
cagccgcucaugggcccggagc

SEQ ID NO: 206964 - RNA, 22 nt, Human
cagagccagcuguccuuggcau

SEQ ID NO: 206965 - RNA, 22 nt, Human
cagagcugucauuugccaguga

SEQ ID NO: 206966 - RNA, 22 nt, Human
cagagcugagucuucaagguug

SEQ ID NO: 206967 - RNA, 22 nt, Human
cagaggagcgaguuggacgcca

SEQ ID NO: 206968 - RNA, 20 nt, Human
cagcagucagcucuccaaug

SEQ ID NO: 206969 - RNA, 22 nt, Human
cagcuauuguucuguauaauga

SEQ ID NO: 206970 - RNA, 22 nt, Human
cagcuggggagagacauggcag

SEQ ID NO: 206971 - RNA, 22 nt, Human
cagcugcugguguaucgggucc

SEQ ID NO: 206972 - RNA, 22 nt, Human
cagcuucaaaggcccugauggu

SEQ ID NO: 206973 - RNA, 22 nt, Human
cagcuucacuuaaaacaugcaa

SEQ ID NO: 206974 - RNA, 22 nt, Human
cagcuucuccauucuucuggcu

SEQ ID NO: 206975 - RNA, 22 nt, Human
caggccgcccucuccuguuagc

SEQ ID NO: 206976 - RNA, 22 nt, Human
caggcgcugacgggaccgggcu

SEQ ID NO: 206977 - RNA, 22 nt, Human
caggauuuaauaagauaguguu

SEQ ID NO: 206978 - RNA, 22 nt, Human
caggcacaagaucggcuagaua

SEQ ID NO: 206979 - RNA, 22 nt, Human
caggaggaggccgggaggaagc

SEQ ID NO: 206980 - RNA, 22 nt, Human
cagcuacuaccuguagacaaag

SEQ ID NO: 206981 - RNA, 22 nt, Human
caggaggaaaguuccacucaac

SEQ ID NO: 206982 - RNA, 22 nt, Human
cagaaagaaguggggauagagg

SEQ ID NO: 206983 - RNA, 22 nt, Human
cagaaaguauguucuaguaguu

SEQ ID NO: 206984 - RNA, 22 nt, Human
cagaaacacuguauuuagggaa

SEQ ID NO: 206985 - RNA, 22 nt, Human
cagaaaacauuguguguauaag

SEQ ID NO: 206986 - RNA, 22 nt, Human
cagaaaaaaaugcagacuagca

SEQ ID NO: 206987 - RNA, 22 nt, Human
cacuucaguacuagaggaugaa

SEQ ID NO: 206988 - RNA, 22 nt, Human
cacuuauuuuuccuuugugauu

SEQ ID NO: 206989 - RNA, 22 nt, Human
cacagccaagacuuggccccau

SEQ ID NO: 206990 - RNA, 22 nt, Human
cacaguuuuaucuuauacugau

SEQ ID NO: 206991 - RNA, 22 nt, Human
cacagucugagcccagccuugu

SEQ ID NO: 206992 - RNA, 22 nt, Human
cacaggacuuggcuucucacag

SEQ ID NO: 206993 - RNA, 22 nt, Human
cagaaugugacaucaaaggcuc

SEQ ID NO: 206994 - RNA, 22 nt, Human
cagaaagugauuugcuauucca

SEQ ID NO: 206995 - RNA, 22 nt, Human
cagaaguugcuugagagagagc

SEQ ID NO: 206996 - RNA, 22 nt, Human
cagaacugaauaaagccaggau

SEQ ID NO: 206997 - RNA, 22 nt, Human
cacauuuuccagaagaaucaga

SEQ ID NO: 206998 - RNA, 22 nt, Human
cacaugugugugccuacaugca

SEQ ID NO: 206999 - RNA, 22 nt, Human
cacauuguuuggucagagcaua

SEQ ID NO: 207000 - RNA, 22 nt, Human
cacacagguaagccucuuucaa

SEQ ID NO: 207001 - RNA, 22 nt, Human
cacugcugaggcccguguuacu

SEQ ID NO: 207002 - RNA, 22 nt, Human
cacacguuucuacugcugccaa

SEQ ID NO: 207003 - RNA, 18 nt, Human
cacagcauccaaguuaug

SEQ ID NO: 207004 - RNA, 22 nt, Human
caaugaaaauuuaaguugcagc

SEQ ID NO: 207005 - RNA, 22 nt, Human
caauuaccaguaauugagguuu

SEQ ID NO: 207006 - RNA, 22 nt, Human
cacuauguacauaauagcugcu

SEQ ID NO: 207007 - RNA, 22 nt, Human
cacucuucucucauuuuccuuu

SEQ ID NO: 207008 - RNA, 22 nt, Human
caaaagcaaagaucuuugauug

SEQ ID NO: 207009 - RNA, 22 nt, Human
caaaacccaagugcuauugcaa

SEQ ID NO: 207010 - RNA, 22 nt, Human
caaugccaggaaccugggggaa

SEQ ID NO: 207011 - RNA, 22 nt, Human
caaugcacauggacaucaggcu

SEQ ID NO: 207012 - RNA, 22 nt, Human
caaagaaccuucgagacagggc

SEQ ID NO: 207013 - RNA, 22 nt, Human
caaaauuguugaugcugcuuug

SEQ ID NO: 207014 - RNA, 22 nt, Human
cacugugagugcaagcaggggu

SEQ ID NO: 207015 - RNA, 22 nt, Human
cacugcacuccagccugggcaa

SEQ ID NO: 207016 - RNA, 23 nt, Human
cacuggugggguuuaaaagaagc

SEQ ID NO: 207017 - RNA, 22 nt, Human
cacuauaaugugauuucgcccu

SEQ ID NO: 207018 - RNA, 20 nt, Human
cagagacaagagggaaggga

SEQ ID NO: 207019 - RNA, 22 nt, Human
cagagaggagcacaaagugaag

SEQ ID NO: 207020 - RNA, 23 nt, Human
cagagaaaauagaauaugcugug

SEQ ID NO: 207021 - RNA, 22 nt, Human
caccgaacuuugcaaaugcaau

SEQ ID NO: 207022 - RNA, 22 nt, Human
cagaccagaaggaagccgacaa

SEQ ID NO: 207023 - RNA, 22 nt, Human
cacgggcgacgugaucuaggac

SEQ ID NO: 207024 - RNA, 23 nt, Human
caccaugacaugccuauagggga

SEQ ID NO: 207025 - RNA, 22 nt, Human
caccccauccccucccaauucc

SEQ ID NO: 207026 - RNA, 22 nt, Human
cacccccaggcuccccuucugg

SEQ ID NO: 207027 - RNA, 22 nt, Human
cacccgacugaggacgccgccc

SEQ ID NO: 207028 - RNA, 22 nt, Human
cagccauucuaacacugccagu

SEQ ID NO: 207029 - RNA, 19 nt, Human
cacuguccuagucgaggcc

SEQ ID NO: 207030 - RNA, 22 nt, Human
cagcauucuacuuugugaacug

SEQ ID NO: 207031 - RNA, 22 nt, Human
cagcccuggccucuucgcuuuc

SEQ ID NO: 207032 - RNA, 22 nt, Human
cagcccuguugcgcuuccggcg

SEQ ID NO: 207033 - RNA, 22 nt, Human
cagagagcguccauccggugcc

SEQ ID NO: 207034 - RNA, 22 nt, Human
cagacgguuaaacgauuuugcu

SEQ ID NO: 207035 - RNA, 22 nt, Human
cagccccgcuggccucgccucc

SEQ ID NO: 207036 - RNA, 22 nt, Human
cacuguugagcaauguacagug

SEQ ID NO: 207037 - RNA, 22 nt, Human
cagcacaggugugaggccugau

SEQ ID NO: 207038 - RNA, 22 nt, Human
cagcacugcccuaccccuccac

SEQ ID NO: 207039 - RNA, 21 nt, Human
cagcagaugccagggucucug

SEQ ID NO: 207040 - RNA, 22 nt, Human
cagaaauuggcagagaagaccu

SEQ ID NO: 207041 - RNA, 22 nt, Human
cauugcugugggcauuugcugc

SEQ ID NO: 207042 - RNA, 20 nt, Human
ccagaagagaagaaaaggaa

SEQ ID NO: 207043 - RNA, 19 nt, Human
ccagaagggcaagcaaagg

SEQ ID NO: 207044 - RNA, 22 nt, Human
cauugcaaccccaaaaagaaca

SEQ ID NO: 207045 - RNA, 22 nt, Human
ccagaacgacgggcagaggcgc

SEQ ID NO: 207046 - RNA, 22 nt, Human
ccagaacguuugugcgaggcag

SEQ ID NO: 207047 - RNA, 20 nt, Human
cauuccugaggaauucaugu

SEQ ID NO: 207048 - RNA, 22 nt, Human
cauuccuucucagguacuggca

SEQ ID NO: 207049 - RNA, 22 nt, Human
ccagauaaacauuccuuggccu

SEQ ID NO: 207050 - RNA, 22 nt, Human
ccagagcaccgaaacgagcuuu

SEQ ID NO: 207051 - RNA, 22 nt, Human
cauuggcacauguauucugggc

SEQ ID NO: 207052 - RNA, 22 nt, Human
ccagacuggggauuuugccagg

SEQ ID NO: 207053 - RNA, 22 nt, Human
ccagcaagacucgcagugggau

SEQ ID NO: 207054 - RNA, 22 nt, Human
cauugguacaaaauguacuuug

SEQ ID NO: 207055 - RNA, 22 nt, Human
cauugggcggggaccucggcug

SEQ ID NO: 207056 - RNA, 22 nt, Human
cauuuaaccccuugguacugaa

SEQ ID NO: 207057 - RNA, 22 nt, Human
cauuuaucacuugcuaaacaua

SEQ ID NO: 207058 - RNA, 22 nt, Human
cauuucuugugagccgcauccu

SEQ ID NO: 207059 - RNA, 22 nt, Human
ccagcaaguaagucagugucag

SEQ ID NO: 207060 - RNA, 22 nt, Human
ccagcagaagcucccgcugggu

SEQ ID NO: 207061 - RNA, 22 nt, Human
ccaaagaagcaaugagaauagu

SEQ ID NO: 207062 - RNA, 22 nt, Human
ccaggaguccgugggucuugag

SEQ ID NO: 207063 - RNA, 22 nt, Human
ccaggacuuauuacaguauaac

SEQ ID NO: 207064 - RNA, 22 nt, Human
ccagcuuuucagaaucugccug

SEQ ID NO: 207065 - RNA, 22 nt, Human
ccagcugggucccugcuggggc

SEQ ID NO: 207066 - RNA, 22 nt, Human
ccagugagauagugguauaugc

SEQ ID NO: 207067 - RNA, 22 nt, Human
ccaaggcugcagccgugacgcg

SEQ ID NO: 207068 - RNA, 22 nt, Human
ccagugacaaagucggaagucc

SEQ ID NO: 207069 - RNA, 22 nt, Human
ccagucugccggcccggccccu

SEQ ID NO: 207070 - RNA, 22 nt, Human
ccagguuggccaccuucacggg

SEQ ID NO: 207071 - RNA, 22 nt, Human
ccaauuuuggaauuauuaggca

SEQ ID NO: 207072 - RNA, 21 nt, Human
ccacaauucuaguuacauaug

SEQ ID NO: 207073 - RNA, 22 nt, Human
ccaaucaacuguguggcuuucu

SEQ ID NO: 207074 - RNA, 22 nt, Human
ccaaggcuggagggcuuaugua

SEQ ID NO: 207075 - RNA, 22 nt, Human
ccaaagaauuuggaaaaucuga

SEQ ID NO: 207076 - RNA, 22 nt, Human
ccaaauuaccuucuuggauuca

SEQ ID NO: 207077 - RNA, 22 nt, Human
ccaagcguguuuaggaaaugcu

SEQ ID NO: 207078 - RNA, 22 nt, Human
ccaagagcuucccauagcuucu

SEQ ID NO: 207079 - RNA, 22 nt, Human
ccaggggagagucugagucguu

SEQ ID NO: 207080 - RNA, 22 nt, Human
ccagggacuauuaguuguguau

SEQ ID NO: 207081 - RNA, 22 nt, Human
ccagggcugcugccugggcugg

SEQ ID NO: 207082 - RNA, 22 nt, Human
ccagggaggucauagugcuggu

SEQ ID NO: 207083 - RNA, 22 nt, Human
ccacuuugagaagcugaugaaa

SEQ ID NO: 207084 - RNA, 20 nt, Human
ccacuucucugcucugccca

SEQ ID NO: 207085 - RNA, 22 nt, Human
ccacuuucuaaauuggcgauuu

SEQ ID NO: 207086 - RNA, 22 nt, Human
ccacucagaagaaacaagagag

SEQ ID NO: 207087 - RNA, 22 nt, Human
ccauggauacuaagguauguga

SEQ ID NO: 207088 - RNA, 22 nt, Human
ccauggaugcucagauguuagc

SEQ ID NO: 207089 - RNA, 22 nt, Human
ccaugggugucuggagcacccu

SEQ ID NO: 207090 - RNA, 22 nt, Human
cccaaccagaaauugacagaga

SEQ ID NO: 207091 - RNA, 22 nt, Human
cccacccuacugcuacccagga

SEQ ID NO: 207092 - RNA, 22 nt, Human
cccagaccagagugccuggacg

SEQ ID NO: 207093 - RNA, 22 nt, Human
ccaccacauuugccuagacuuu

SEQ ID NO: 207094 - RNA, 22 nt, Human
ccaguuuuuccagugcuuucug

SEQ ID NO: 207095 - RNA, 22 nt, Human
ccaguggugcauguuugagcaa

SEQ ID NO: 207096 - RNA, 22 nt, Human
ccauaaaagagaaucuaaauga

SEQ ID NO: 207097 - RNA, 22 nt, Human
ccaucuuugcucuuuuauugca

SEQ ID NO: 207098 - RNA, 22 nt, Human
ccaccacugaggcacaggagcc

SEQ ID NO: 207099 - RNA, 22 nt, Human
ccacccacuucucugcccucca

SEQ ID NO: 207100 - RNA, 22 nt, Human
ccacccugguuacugugccagg

SEQ ID NO: 207101 - RNA, 22 nt, Human
caucacggagcaugagaagaca

SEQ ID NO: 207102 - RNA, 22 nt, Human
caucaggcugggaacacagauc

SEQ ID NO: 207103 - RNA, 22 nt, Human
cagguggccggguaggaggugg

SEQ ID NO: 207104 - RNA, 22 nt, Human
cagguugaaaguggaggagcua

SEQ ID NO: 207105 - RNA, 22 nt, Human
cagguguugcaguugaagacug

SEQ ID NO: 207106 - RNA, 22 nt, Human
caugugguauugugagauccac

SEQ ID NO: 207107 - RNA, 22 nt, Human
cauguggaaaugcaugcuuuuu

SEQ ID NO: 207108 - RNA, 22 nt, Human
caugugacuuagguuuuaucac

SEQ ID NO: 207109 - RNA, 22 nt, Human
caucaacagucuacuuuuugcc

SEQ ID NO: 207110 - RNA, 22 nt, Human
caucaauagguauuugagagac

SEQ ID NO: 207111 - RNA, 22 nt, Human
cauuauacaugaagacucaccc

SEQ ID NO: 207112 - RNA, 22 nt, Human
cauuccuaccauaucugcucuu

SEQ ID NO: 207113 - RNA, 22 nt, Human
caucagucugaaagccagggag

SEQ ID NO: 207114 - RNA, 22 nt, Human
cauugcaaccauuccaaauggc

SEQ ID NO: 207115 - RNA, 22 nt, Human
cauugcugccaaggugagcugg

SEQ ID NO: 207116 - RNA, 22 nt, Human
cauccagcuccugggggccacc

SEQ ID NO: 207117 - RNA, 22 nt, Human
cauugcaucuuuuauggguaag

SEQ ID NO: 207118 - RNA, 22 nt, Human
cauugcuguuaauugucucuag

SEQ ID NO: 207119 - RNA, 22 nt, Human
caucucagguuuguucugagac

SEQ ID NO: 207120 - RNA, 22 nt, Human
caucugcagccucugcauuccc

SEQ ID NO: 207121 - RNA, 22 nt, Human
caucuccaagucuguaagcagu

SEQ ID NO: 207122 - RNA, 18 nt, Human
cauuguacaaugcuuuau

SEQ ID NO: 207123 - RNA, 22 nt, Human
cauuuacauaacaguaacgcug

SEQ ID NO: 207124 - RNA, 22 nt, Human
cauuuacguaacaguaacgcug

SEQ ID NO: 207125 - RNA, 22 nt, Human
cauuuucugcaagucugcucaa

SEQ ID NO: 207126 - RNA, 22 nt, Human
cauuuuccucugcugguguuca

SEQ ID NO: 207127 - RNA, 22 nt, Human
cauuuuaucagcacacgucacu

SEQ ID NO: 207128 - RNA, 22 nt, Human
cauuugcuuaucacucuucuuu

SEQ ID NO: 207129 - RNA, 23 nt, Human
cauuugauccucacaauaaaugg

SEQ ID NO: 207130 - RNA, 22 nt, Human
cauuugacaauugggauagauc

SEQ ID NO: 207131 - RNA, 22 nt, Human
cauuucuggccuggggagcggg

SEQ ID NO: 207132 - RNA, 22 nt, Human
caugaagugaaaagguuaauuu

SEQ ID NO: 207133 - RNA, 22 nt, Human
caugauaacacuucuguuuaau

SEQ ID NO: 207134 - RNA, 22 nt, Human
caugaccauuuggguuugugcg

SEQ ID NO: 207135 - RNA, 22 nt, Human
cauuuugguaauguucguuugc

SEQ ID NO: 207136 - RNA, 22 nt, Human
caugccugaucagcggccagca

SEQ ID NO: 207137 - RNA, 22 nt, Human
caugauucccacauugcgauca

SEQ ID NO: 207138 - RNA, 19 nt, Human
ccaacaguacugaagcacu

SEQ ID NO: 207139 - RNA, 22 nt, Human
cauuuuuuuuccccuccuggua

SEQ ID NO: 207140 - RNA, 22 nt, Human
cauuuuuccucaggcaauuuga

SEQ ID NO: 207141 - RNA, 22 nt, Human
cauggcacagaagaugucguuu

SEQ ID NO: 207142 - RNA, 22 nt, Human
caugcuucccacauuccgauuu

SEQ ID NO: 207143 - RNA, 22 nt, Human
cauggcaggugcagauucugug

SEQ ID NO: 207144 - RNA, 22 nt, Human
caugggcucuucuggacugcac

SEQ ID NO: 207145 - RNA, 22 nt, Human
ccaaccaguuucuuggcuuuag

SEQ ID NO: 207146 - RNA, 22 nt, Human
ccaaccaguuaucuccuaaggu

SEQ ID NO: 207147 - RNA, 22 nt, Human
caugcuggcacugaccagccua

SEQ ID NO: 207148 - RNA, 22 nt, Human
caugcuaacacguugcucaccg

SEQ ID NO: 207149 - RNA, 21 nt, Human
caugguaaguacaaagaugac

SEQ ID NO: 207150 - RNA, 22 nt, Human
caugguaaucggggccaucugu

SEQ ID NO: 207151 - RNA, 22 nt, Human
cauguauguuaguggcugcuuu

SEQ ID NO: 207152 - RNA, 22 nt, Human
caugugcaucagccaauuggag

SEQ ID NO: 207153 - RNA, 21 nt, Human
ccacaucaugucaccuccuag

SEQ ID NO: 207154 - RNA, 23 nt, Human
ccacaugugagcccaccgugccc

SEQ ID NO: 207155 - RNA, 22 nt, Human
cauguguuucuuaagccaggcc

SEQ ID NO: 207156 - RNA, 22 nt, Human
ccacagcauugaaaucuauaau

SEQ ID NO: 207157 - RNA, 22 nt, Human
ccaccuggcagcaggcucggca

SEQ ID NO: 207158 - RNA, 22 nt, Human
ccacguguugcucagacagggu

SEQ ID NO: 207159 - RNA, 22 nt, Human
cauucauagaaucaguuuggga

SEQ ID NO: 207160 - RNA, 22 nt, Human
cauuagugaggggcugccugcu

SEQ ID NO: 207161 - RNA, 22 nt, Human
cauucauaagacuuugcucuug

SEQ ID NO: 207162 - RNA, 22 nt, Human
cauuauucaggcuuuggaauuu

SEQ ID NO: 207163 - RNA, 22 nt, Human
cauuaccuggggagaggauacc

SEQ ID NO: 207164 - RNA, 22 nt, Human
cauguguauuauucuuguggaa

SEQ ID NO: 207165 - RNA, 22 nt, Human
ccacccuuccauucuuccucuu

SEQ ID NO: 207166 - RNA, 22 nt, Human
ccugugucaucagcuguggcua

SEQ ID NO: 207167 - RNA, 22 nt, Human
ccuuaauaguguucuaauguuu

SEQ ID NO: 207168 - RNA, 20 nt, Human
ccuguucacugcgcaguuuc

SEQ ID NO: 207169 - RNA, 22 nt, Human
ccuguguucguccucaccuugc

SEQ ID NO: 207170 - RNA, 22 nt, Human
ccugucugaaggcagggggaug

SEQ ID NO: 207171 - RNA, 22 nt, Human
ccuggggcucugcacagagcag

SEQ ID NO: 207172 - RNA, 22 nt, Human
ccugggcucgcgcacuucaccc

SEQ ID NO: 207173 - RNA, 22 nt, Human
ccuggcccagcuggaagcggga

SEQ ID NO: 207174 - RNA, 19 nt, Human
ccuggccaacgucaacauu

SEQ ID NO: 207175 - RNA, 22 nt, Human
ccgcggcugcgcggugccccuc

SEQ ID NO: 207176 - RNA, 22 nt, Human
ccuggccacagggcucugcauu

SEQ ID NO: 207177 - RNA, 22 nt, Human
ccgccucucgcucccagcuugc

SEQ ID NO: 207178 - RNA, 22 nt, Human
ccgcggauggggagucaccacc

SEQ ID NO: 207179 - RNA, 19 nt, Human
ccgagcagauugauguuuc

SEQ ID NO: 207180 - RNA, 22 nt, Human
ccuggcauuagaaauuccguca

SEQ ID NO: 207181 - RNA, 22 nt, Human
ccgagcagggcgcccugcccca

SEQ ID NO: 207182 - RNA, 22 nt, Human
ccagaauuugaacccacaaaug

SEQ ID NO: 207183 - RNA, 22 nt, Human
cccagagacuuuguccgacgac

SEQ ID NO: 207184 - RNA, 22 nt, Human
ccgaaccacacgacagugcuca

SEQ ID NO: 207185 - RNA, 21 nt, Human
ccuggagacaaagacagggug

SEQ ID NO: 207186 - RNA, 22 nt, Human
ccuuuuaucgcgaagaacucca

SEQ ID NO: 207187 - RNA, 22 nt, Human
ccgggcggcauccagccguucc

SEQ ID NO: 207188 - RNA, 22 nt, Human
ccggcugcugaggcggccccgg

SEQ ID NO: 207189 - RNA, 22 nt, Human
ccggcggguggagcaugcgcgg

SEQ ID NO: 207190 - RNA, 22 nt, Human
ccggaggaaauugcauugguug

SEQ ID NO: 207191 - RNA, 22 nt, Human
ccuuucucuuggauaccgauug

SEQ ID NO: 207192 - RNA, 22 nt, Human
ccgcuggaagcgaguggugggc

SEQ ID NO: 207193 - RNA, 22 nt, Human
ccuuggcuuaccuucugugugg

SEQ ID NO: 207194 - RNA, 22 nt, Human
ccuugugauugaucuaaguugc

SEQ ID NO: 207195 - RNA, 22 nt, Human
ccgcgggcagggcuucaccuuu

SEQ ID NO: 207196 - RNA, 22 nt, Human
ccuugcgaggaugcugugagcu

SEQ ID NO: 207197 - RNA, 21 nt, Human
ccuugcacucaucccaugccc

SEQ ID NO: 207198 - RNA, 22 nt, Human
ccuucuguaccaaggccucaug

SEQ ID NO: 207199 - RNA, 22 nt, Human
ccuguuuguucauguacuguga

SEQ ID NO: 207200 - RNA, 22 nt, Human
ccuucaguguuacuagaaagcg

SEQ ID NO: 207201 - RNA, 18 nt, Human
ccuucaucucugcuucuu

SEQ ID NO: 207202 - RNA, 22 nt, Human
ccuucgcuggcaucuccaggua

SEQ ID NO: 207203 - RNA, 22 nt, Human
ccugacgcugauauauaguuaa

SEQ ID NO: 207204 - RNA, 22 nt, Human
cgcugcagcggcugagucccgc

SEQ ID NO: 207205 - RNA, 22 nt, Human
cgcugggugguugauguacagc

SEQ ID NO: 207206 - RNA, 22 nt, Human
ccugagccgagcgcucuuucuc

SEQ ID NO: 207207 - RNA, 21 nt, Human
ccugagccuguuuauccagaa

SEQ ID NO: 207208 - RNA, 22 nt, Human
ccugaggcccuggcugugcuga

SEQ ID NO: 207209 - RNA, 22 nt, Human
cggcugcgguucaccuagggca

SEQ ID NO: 207210 - RNA, 22 nt, Human
cgggacaauagcagugcugaug

SEQ ID NO: 207211 - RNA, 22 nt, Human
cgggaaguaaacauuauuucag

SEQ ID NO: 207212 - RNA, 22 nt, Human
cgcuuugguaauagggcagccu

SEQ ID NO: 207213 - RNA, 22 nt, Human
cgcuggagagcaagugcgugca

SEQ ID NO: 207214 - RNA, 22 nt, Human
cgcuucauugugggggccccca

SEQ ID NO: 207215 - RNA, 22 nt, Human
cgcuuuccaggcacauccucuu

SEQ ID NO: 207216 - RNA, 22 nt, Human
cggagcgagaaggggaaagccc

SEQ ID NO: 207217 - RNA, 22 nt, Human
cggagcauacugccuggagaug

SEQ ID NO: 207218 - RNA, 22 nt, Human
ccguaugacuuuuuguuguugu

SEQ ID NO: 207219 - RNA, 22 nt, Human
ccggguccagugggcacugggc

SEQ ID NO: 207220 - RNA, 22 nt, Human
ccuaauuuuagacccacuccua

SEQ ID NO: 207221 - RNA, 22 nt, Human
ccuacccucaagggccuggggg

SEQ ID NO: 207222 - RNA, 22 nt, Human
ccuacguauuuugauauagaga

SEQ ID NO: 207223 - RNA, 22 nt, Human
ccuaacagauugggugacaaua

SEQ ID NO: 207224 - RNA, 22 nt, Human
ccgugggugggguacgggcugg

SEQ ID NO: 207225 - RNA, 21 nt, Human
ccguuauucuucccaccccca

SEQ ID NO: 207226 - RNA, 18 nt, Human
ccuccccuguggaggucc

SEQ ID NO: 207227 - RNA, 19 nt, Human
ccuccguguuaccuguccu

SEQ ID NO: 207228 - RNA, 22 nt, Human
ccucgcucauggauucugccug

SEQ ID NO: 207229 - RNA, 22 nt, Human
ccuccugggccuugcucuguga

SEQ ID NO: 207230 - RNA, 22 nt, Human
cgaagcuuuuguuggcgugucg

SEQ ID NO: 207231 - RNA, 20 nt, Human
ccucauucucgcguguguuu

SEQ ID NO: 207232 - RNA, 22 nt, Human
cgagguuuaugaguuuguguuc

SEQ ID NO: 207233 - RNA, 22 nt, Human
cgaggagguccaggagcaguag

SEQ ID NO: 207234 - RNA, 22 nt, Human
cgcccggcugagacgcucgccc

SEQ ID NO: 207235 - RNA, 18 nt, Human
cgauguguaugugauuug

SEQ ID NO: 207236 - RNA, 22 nt, Human
cgagugauuauucuggcugaga

SEQ ID NO: 207237 - RNA, 22 nt, Human
cuacaaggucuuuaucugcuuu

SEQ ID NO: 207238 - RNA, 22 nt, Human
cuaccagcacgccuuccucuac

SEQ ID NO: 207239 - RNA, 22 nt, Human
cgaggccgcuucauggcuggca

SEQ ID NO: 207240 - RNA, 22 nt, Human
cuaaauuuuuuagugaaauagg

SEQ ID NO: 207241 - RNA, 22 nt, Human
cuaaauucuauauccuugcuuc

SEQ ID NO: 207242 - RNA, 22 nt, Human
cuaaaacuuuuccaaauuaugu

SEQ ID NO: 207243 - RNA, 22 nt, Human
cgugucauggcggcgcaggugg

SEQ ID NO: 207244 - RNA, 22 nt, Human
cguggccacaguggagcugagc

SEQ ID NO: 207245 - RNA, 22 nt, Human
cuacugaugccccgcugugccu

SEQ ID NO: 207246 - RNA, 22 nt, Human
cgaguaauuggaaauuugcuau

SEQ ID NO: 207247 - RNA, 22 nt, Human
cuacuuucuucuucagaauugu

SEQ ID NO: 207248 - RNA, 22 nt, Human
cgcacuggagcuggaacgaguc

SEQ ID NO: 207249 - RNA, 22 nt, Human
cgcacaggcacagacacuggga

SEQ ID NO: 207250 - RNA, 22 nt, Human
ccuugauaugcuucagagaauu

SEQ ID NO: 207251 - RNA, 22 nt, Human
ccuuggaucugcauaucagcua

SEQ ID NO: 207252 - RNA, 22 nt, Human
cgggagaugaggagagcuucgg

SEQ ID NO: 207253 - RNA, 22 nt, Human
cgggcacucagggucgaggugg

SEQ ID NO: 207254 - RNA, 22 nt, Human
cgggcacagguugagguagaug

SEQ ID NO: 207255 - RNA, 22 nt, Human
cgucauguuauggcucauucua

SEQ ID NO: 207256 - RNA, 22 nt, Human
ccuuucuggucucugagagacu

SEQ ID NO: 207257 - RNA, 22 nt, Human
cgucauuuguaaaugaucaaga

SEQ ID NO: 207258 - RNA, 22 nt, Human
ccuuugcccugagaaauguucc

SEQ ID NO: 207259 - RNA, 17 nt, Human
ccuuucugaucaucuga

SEQ ID NO: 207260 - RNA, 22 nt, Human
ccuuuccucuucaugacuuucu

SEQ ID NO: 207261 - RNA, 22 nt, Human
ccuuuccuggaaaugguaaguu

SEQ ID NO: 207262 - RNA, 22 nt, Human
cgaaaaagaagugcaccauguu

SEQ ID NO: 207263 - RNA, 22 nt, Human
cgugccugguggagagcgaggg

SEQ ID NO: 207264 - RNA, 17 nt, Human
cgugaggaccaggcagc

SEQ ID NO: 207265 - RNA, 22 nt, Human
cgugaaaugcagaaaguugugg

SEQ ID NO: 207266 - RNA, 22 nt, Human
ccuuuuuagaugugcgaauguu

SEQ ID NO: 207267 - RNA, 22 nt, Human
cucaucagagcccuccucuggc

SEQ ID NO: 207268 - RNA, 22 nt, Human
cucaucuucuuccuucuuuucc

SEQ ID NO: 207269 - RNA, 22 nt, Human
cucauugacagagcagcucuac

SEQ ID NO: 207270 - RNA, 22 nt, Human
cgcugcugucaucgucuacggu

SEQ ID NO: 207271 - RNA, 20 nt, Human
cucauugcuuucauuuucuu

SEQ ID NO: 207272 - RNA, 22 nt, Human
cuccagcagaaagggcgagugg

SEQ ID NO: 207273 - RNA, 22 nt, Human
cuccggccuucugacuccccug

SEQ ID NO: 207274 - RNA, 22 nt, Human
cucccugagaugcaggagagag

SEQ ID NO: 207275 - RNA, 22 nt, Human
cuccggggacgcagucgccgcc

SEQ ID NO: 207276 - RNA, 22 nt, Human
cggaggagcugcgcggaggggg

SEQ ID NO: 207277 - RNA, 22 nt, Human
cucuaccugcacaugccugacu

SEQ ID NO: 207278 - RNA, 22 nt, Human
cucugagcucgugcaguacuuc

SEQ ID NO: 207279 - RNA, 22 nt, Human
cggcccggccucgcggcgcaug

SEQ ID NO: 207280 - RNA, 22 nt, Human
cggagggcccucaggacugggu

SEQ ID NO: 207281 - RNA, 22 nt, Human
cggccgcgggauggcgggcagc

SEQ ID NO: 207282 - RNA, 22 nt, Human
cgcccguacuuugccggcauga

SEQ ID NO: 207283 - RNA, 21 nt, Human
cgcccggccggaaaccccuuc

SEQ ID NO: 207284 - RNA, 22 nt, Human
cgccgccgccugcccgcgcccc

SEQ ID NO: 207285 - RNA, 22 nt, Human
cuaguuuuaagcuccuugaggu

SEQ ID NO: 207286 - RNA, 22 nt, Human
cgcauugcaauucaggggauaa

SEQ ID NO: 207287 - RNA, 22 nt, Human
cgcaucggguagaggagcugga

SEQ ID NO: 207288 - RNA, 22 nt, Human
cgcagcuucagggccaggaggg

SEQ ID NO: 207289 - RNA, 22 nt, Human
cuaggucagaggacacagcuua

SEQ ID NO: 207290 - RNA, 22 nt, Human
cgccgugucuggucuguacguc

SEQ ID NO: 207291 - RNA, 22 nt, Human
cuauuuucccauaugguugaca

SEQ ID NO: 207292 - RNA, 22 nt, Human
cgccgugcagucagcccagaag

SEQ ID NO: 207293 - RNA, 22 nt, Human
cucaaagcagacuuuucccuuu

SEQ ID NO: 207294 - RNA, 22 nt, Human
cgcgcuuugggcaguguggcug

SEQ ID NO: 207295 - RNA, 22 nt, Human
cucaguauugacgaaagagauu

SEQ ID NO: 207296 - RNA, 22 nt, Human
cucagcaauuaccugugucucu

SEQ ID NO: 207297 - RNA, 22 nt, Human
cucagcgggagucuggccgaac

SEQ ID NO: 207298 - RNA, 22 nt, Human
cucagcugauuaauuucauguu

SEQ ID NO: 207299 - RNA, 22 nt, Human
cucagcgagggaaagaggccgc

SEQ ID NO: 207300 - RNA, 23 nt, Human
cuggacauucgcaaaguucaucu

SEQ ID NO: 207301 - RNA, 22 nt, Human
cucacugugggcuaugaauggg

SEQ ID NO: 207302 - RNA, 22 nt, Human
cucagaagaacaaaggcucuac

SEQ ID NO: 207303 - RNA, 22 nt, Human
cucagcaacccacacacggucu

SEQ ID NO: 207304 - RNA, 22 nt, Human
cucagaauugucaccucaaaaa

SEQ ID NO: 207305 - RNA, 22 nt, Human
cuggcagcucugagucccuucu

SEQ ID NO: 207306 - RNA, 22 nt, Human
cucaugaauggcucuuugugcu

SEQ ID NO: 207307 - RNA, 22 nt, Human
cucaaaauccauaaaaucaggu

SEQ ID NO: 207308 - RNA, 22 nt, Human
cucaaauggguuuguagaauau

SEQ ID NO: 207309 - RNA, 22 nt, Human
cuauuauuauugucguuuuaca

SEQ ID NO: 207310 - RNA, 22 nt, Human
cucacugucagcugcagggcuu

SEQ ID NO: 207311 - RNA, 22 nt, Human
cucaccugccuccccgcccucc

SEQ ID NO: 207312 - RNA, 22 nt, Human
cucaauuuuuauugcuuuuuug

SEQ ID NO: 207313 - RNA, 22 nt, Human
cucacccaaacuauaucuuuaa

SEQ ID NO: 207314 - RNA, 22 nt, Human
cucaagugacucagccugguug

SEQ ID NO: 207315 - RNA, 22 nt, Human
cugcuuguguugcucagaguca

SEQ ID NO: 207316 - RNA, 22 nt, Human
cugcuugaugaggaaaggauug

SEQ ID NO: 207317 - RNA, 22 nt, Human
cugggguggugcaggccucaug

SEQ ID NO: 207318 - RNA, 22 nt, Human
cugggggacagagagaggcggu

SEQ ID NO: 207319 - RNA, 22 nt, Human
cuccuuuuuauaucuuucucug

SEQ ID NO: 207320 - RNA, 22 nt, Human
cugggaguugacgaggcuugua

SEQ ID NO: 207321 - RNA, 22 nt, Human
cugggaugagcuguuuccuggu

SEQ ID NO: 207322 - RNA, 22 nt, Human
cugggcucccucucccgccucg

SEQ ID NO: 207323 - RNA, 22 nt, Human
cugggugugugugaacagagau

SEQ ID NO: 207324 - RNA, 22 nt, Human
cuggguuuggcugugcuugaau

SEQ ID NO: 207325 - RNA, 22 nt, Human
cuggguaaauauguauuccuga

SEQ ID NO: 207326 - RNA, 22 nt, Human
cuggguaaggaaacuccuuugu

SEQ ID NO: 207327 - RNA, 22 nt, Human
cugggugagcuggccagagggu

SEQ ID NO: 207328 - RNA, 22 nt, Human
cuggguguggugggugcugccg

SEQ ID NO: 207329 - RNA, 22 nt, Human
cucucuuuuuuucccuuguuaa

SEQ ID NO: 207330 - RNA, 22 nt, Human
cuccaccucagugucaucuucu

SEQ ID NO: 207331 - RNA, 21 nt, Human
cuggcucgccaugguucuuuu

SEQ ID NO: 207332 - RNA, 22 nt, Human
cucccuucaggggaggacuagg

SEQ ID NO: 207333 - RNA, 22 nt, Human
cuggcggugaucccgauggugu

SEQ ID NO: 207334 - RNA, 22 nt, Human
cuguccugauggugccacuggu

SEQ ID NO: 207335 - RNA, 22 nt, Human
cugucacuguuuuaaccaacaa

SEQ ID NO: 207336 - RNA, 22 nt, Human
cuguccuguggccugcuccggu

SEQ ID NO: 207337 - RNA, 22 nt, Human
cugucagcaaaucagugucugg

SEQ ID NO: 207338 - RNA, 19 nt, Human
cuguccacacacucgcuuc

SEQ ID NO: 207339 - RNA, 22 nt, Human
cugguuuuccaauguuuugacu

SEQ ID NO: 207340 - RNA, 22 nt, Human
cucugugucugauucugggaag

SEQ ID NO: 207341 - RNA, 22 nt, Human
cuggugaagccuucggagaccc

SEQ ID NO: 207342 - RNA, 22 nt, Human
cuggugagaccgacuuccacuu

SEQ ID NO: 207343 - RNA, 22 nt, Human
cuguuaucaggaguuuucacgg

SEQ ID NO: 207344 - RNA, 22 nt, Human
cuguguuguuugaguagcuuga

SEQ ID NO: 207345 - RNA, 19 nt, Human
cugaaacacagagagggcu

SEQ ID NO: 207346 - RNA, 20 nt, Human
cucuuuaugagaccacuguc

SEQ ID NO: 207347 - RNA, 22 nt, Human
cugugccagucagggggcaagu

SEQ ID NO: 207348 - RNA, 22 nt, Human
cucuuuuuuugucuuaagaacc

SEQ ID NO: 207349 - RNA, 22 nt, Human
cuguuccuccaccucaacaaac

SEQ ID NO: 207350 - RNA, 22 nt, Human
cugaaagacagccaggcaaagc

SEQ ID NO: 207351 - RNA, 23 nt, Human
cugaaauucagaugcuaaagaua

SEQ ID NO: 207352 - RNA, 20 nt, Human
cugaaaggaaagaaauuuuu

SEQ ID NO: 207353 - RNA, 22 nt, Human
cugaaagacgaggggaagucgg

SEQ ID NO: 207354 - RNA, 22 nt, Human
cuguuguucacuuugcugguga

SEQ ID NO: 207355 - RNA, 22 nt, Human
cuguuucucugccugcacacau

SEQ ID NO: 207356 - RNA, 22 nt, Human
cuguuguguuauuugcagugca

SEQ ID NO: 207357 - RNA, 22 nt, Human
cuuaagacaggcucaaagauua

SEQ ID NO: 207358 - RNA, 22 nt, Human
cuuaggcgugugcgggugaggc

SEQ ID NO: 207359 - RNA, 22 nt, Human
cugagggagacagugcggacua

SEQ ID NO: 207360 - RNA, 22 nt, Human
cuuauucuucuggacuuggagu

SEQ ID NO: 207361 - RNA, 22 nt, Human
cuuauuugcccauguuucuuua

SEQ ID NO: 207362 - RNA, 22 nt, Human
cuguuuuugccugugacaaaaa

SEQ ID NO: 207363 - RNA, 20 nt, Human
cuguuugcuaucaugagcug

SEQ ID NO: 207364 - RNA, 19 nt, Human
cugagcagggaaaaacccu

SEQ ID NO: 207365 - RNA, 22 nt, Human
cugagaucaugggucagguggu

SEQ ID NO: 207366 - RNA, 22 nt, Human
cguuauagagcacucgaacuuu

SEQ ID NO: 207367 - RNA, 22 nt, Human
cgugugcguauguguuuguaug

SEQ ID NO: 207368 - RNA, 22 nt, Human
cgugggggcaacgaccccuccc

SEQ ID NO: 207369 - RNA, 21 nt, Human
cgucccggcgugagagagcug

SEQ ID NO: 207370 - RNA, 22 nt, Human
cguucccuccugccacgggagg

SEQ ID NO: 207371 - RNA, 22 nt, Human
cguugguggguguguggucgga

SEQ ID NO: 207372 - RNA, 22 nt, Human
cugaugugcauguggggggaug

SEQ ID NO: 207373 - RNA, 21 nt, Human
cugcacugugauuuaaaaugu

SEQ ID NO: 207374 - RNA, 22 nt, Human
cugcagagaccuaggucagguu

SEQ ID NO: 207375 - RNA, 22 nt, Human
cugauuguagccacugugauga

SEQ ID NO: 207376 - RNA, 22 nt, Human
cugauguuuaucucaagaguuc

SEQ ID NO: 207377 - RNA, 22 nt, Human
cugcaguguccgcuugcucagc

SEQ ID NO: 207378 - RNA, 22 nt, Human
cugcaguaacuauuuucaauaa

SEQ ID NO: 207379 - RNA, 22 nt, Human
cugcagauguagcugcuuuccu

SEQ ID NO: 207380 - RNA, 22 nt, Human
cugcaucacagcaggaggcaca

SEQ ID NO: 207381 - RNA, 22 nt, Human
cugccacuaccaugcuggauga

SEQ ID NO: 207382 - RNA, 22 nt, Human
cguuuugaguagauagccauau

SEQ ID NO: 207383 - RNA, 22 nt, Human
cuaaagacagcaagacaucauc

SEQ ID NO: 207384 - RNA, 22 nt, Human
cuaaaccaauauauuuucuucc

SEQ ID NO: 207385 - RNA, 22 nt, Human
cugagguagaggaaauguagcu

SEQ ID NO: 207386 - RNA, 22 nt, Human
cugaucccuuuucauuugcagg

SEQ ID NO: 207387 - RNA, 22 nt, Human
cugauccuauauugguaugagg

SEQ ID NO: 207388 - RNA, 22 nt, Human
cgugaagaaguaauagguggug

SEQ ID NO: 207389 - RNA, 22 nt, Human
cgugaucuguuauauagugagc

SEQ ID NO: 207390 - RNA, 22 nt, Human
cguggaggucgcauauuccucu

SEQ ID NO: 207391 - RNA, 22 nt, Human
cgugcaggagcuggagguccga

SEQ ID NO: 207392 - RNA, 22 nt, Human
cguggcaguagagcuggaacuu

SEQ ID NO: 207393 - RNA, 22 nt, Human
cugagcaucaaaugggcaauua

SEQ ID NO: 207394 - RNA, 22 nt, Human
cggugcuuuccauaucagcagc

SEQ ID NO: 207395 - RNA, 22 nt, Human
cgguuuuuaaaagucucuucua

SEQ ID NO: 207396 - RNA, 22 nt, Human
cguauauaaauguauauacaca

SEQ ID NO: 207397 - RNA, 22 nt, Human
cgucagccacagcugccccggg

SEQ ID NO: 207398 - RNA, 23 nt, Human
cugagggcuggucugaagucugc

SEQ ID NO: 207399 - RNA, 22 nt, Human
cugaggaguaguucuggaggac

SEQ ID NO: 207400 - RNA, 22 nt, Human
cugagcuauauauuaugcauag

SEQ ID NO: 207401 - RNA, 21 nt, Human
cugcugaaggaaccccaugga

SEQ ID NO: 207402 - RNA, 20 nt, Human
cugcuccauggcaucuuuag

SEQ ID NO: 207403 - RNA, 22 nt, Human
cugcucuucccaucccuuaaau

SEQ ID NO: 207404 - RNA, 22 nt, Human
cugcuauaacacuaacaucuaa

SEQ ID NO: 207405 - RNA, 18 nt, Human
cuaguuuguuuucuacau

SEQ ID NO: 207406 - RNA, 22 nt, Human
cuagcaggacucagcagauauu

SEQ ID NO: 207407 - RNA, 22 nt, Human
cugcguugaccagacuccuggg

SEQ ID NO: 207408 - RNA, 22 nt, Human
cugcgguucuguuuaguggcga

SEQ ID NO: 207409 - RNA, 22 nt, Human
cuaggcuuucugugugacuaga

SEQ ID NO: 207410 - RNA, 22 nt, Human
cugcuggugcugcccacacggu

SEQ ID NO: 207411 - RNA, 21 nt, Human
cuauaaaaaugguucuuugcg

SEQ ID NO: 207412 - RNA, 22 nt, Human
cuaugaaucaauuucugcaguu

SEQ ID NO: 207413 - RNA, 22 nt, Human
cugcugucuuuauuucacugcu

SEQ ID NO: 207414 - RNA, 22 nt, Human
cugcuguuuucugggcuucuua

SEQ ID NO: 207415 - RNA, 22 nt, Human
cuacugacugaccauaguuuca

SEQ ID NO: 207416 - RNA, 22 nt, Human
cugccaguaucuuuggggcugu

SEQ ID NO: 207417 - RNA, 22 nt, Human
cuacauaaauuuaucacagacu

SEQ ID NO: 207418 - RNA, 18 nt, Human
cuacauucauaggaaagg

SEQ ID NO: 207419 - RNA, 22 nt, Human
cuacauuuacacaguuaggcuu

SEQ ID NO: 207420 - RNA, 23 nt, Human
cuaagcuugaguauagcuuagga

SEQ ID NO: 207421 - RNA, 22 nt, Human
cuaaugaaaugauggcuccuac

SEQ ID NO: 207422 - RNA, 22 nt, Human
cuaauuguaagcuccuugaggg

SEQ ID NO: 207423 - RNA, 22 nt, Human
cugccucucaugccugcuugcu

SEQ ID NO: 207424 - RNA, 22 nt, Human
cugccuggggaaugugaggauu

SEQ ID NO: 207425 - RNA, 22 nt, Human
cugccugugcgccaagugcacg

SEQ ID NO: 207426 - RNA, 22 nt, Human
cugcgcagaucugcuguucucu

SEQ ID NO: 207427 - RNA, 22 nt, Human
cugcgcgagcacugccggcggg

SEQ ID NO: 207428 - RNA, 22 nt, Human
cugcggcaccaaccccuucaug

SEQ ID NO: 207429 - RNA, 22 nt, Human
cuggugcuguagccugauugag

SEQ ID NO: 207430 - RNA, 22 nt, Human
cuggugggucacgugugggugg

SEQ ID NO: 207431 - RNA, 22 nt, Human
cugguuacuucagaucaguagu

SEQ ID NO: 207432 - RNA, 22 nt, Human
cugguuuauuucauaguuuguu

SEQ ID NO: 207433 - RNA, 22 nt, Human
gaaaagcucuuuagaagagguu

SEQ ID NO: 207434 - RNA, 22 nt, Human
gaaaaggaggggaggcagaugg

SEQ ID NO: 207435 - RNA, 22 nt, Human
gaaaaguauuaugugaggguuc

SEQ ID NO: 207436 - RNA, 22 nt, Human
gaaaacccuguauguagcguuu

SEQ ID NO: 207437 - RNA, 22 nt, Human
gaaaagaaggcaggagcccaag

SEQ ID NO: 207438 - RNA, 22 nt, Human
cugguacuggaggaguucagag

SEQ ID NO: 207439 - RNA, 22 nt, Human
cuggucaauaaucauguaguac

SEQ ID NO: 207440 - RNA, 22 nt, Human
cuggguguuccuuucauuuuaa

SEQ ID NO: 207441 - RNA, 22 nt, Human
gaaaauaguucaucacaaugau

SEQ ID NO: 207442 - RNA, 22 nt, Human
cugucucugauaagcucgaggg

SEQ ID NO: 207443 - RNA, 22 nt, Human
cuguauggaggaggugcuagcc

SEQ ID NO: 207444 - RNA, 22 nt, Human
gaaacauuuguugaguacuugc

SEQ ID NO: 207445 - RNA, 22 nt, Human
gaaaccauggcaaccagguccu

SEQ ID NO: 207446 - RNA, 22 nt, Human
gaaaugaaacacacaugcagcu

SEQ ID NO: 207447 - RNA, 22 nt, Human
cugugggcucucaugggaccug

SEQ ID NO: 207448 - RNA, 22 nt, Human
cugugguuuuauuuauuugaag

SEQ ID NO: 207449 - RNA, 21 nt, Human
cugugggaaggccugaggucu

SEQ ID NO: 207450 - RNA, 20 nt, Human
gaacauaaauaacucuuuac

SEQ ID NO: 207451 - RNA, 22 nt, Human
gaagaggaagaggagccagagc

SEQ ID NO: 207452 - RNA, 22 nt, Human
gaacugaauguguaauguuggc

SEQ ID NO: 207453 - RNA, 22 nt, Human
gaacggccucguuccucggugu

SEQ ID NO: 207454 - RNA, 22 nt, Human
gaaccauuuaauggagaugcuc

SEQ ID NO: 207455 - RNA, 22 nt, Human
cuguuaauugugaauuuuacau

SEQ ID NO: 207456 - RNA, 22 nt, Human
cuguguugggauggugcgcgca

SEQ ID NO: 207457 - RNA, 22 nt, Human
gaacagauucaucuaguggcua

SEQ ID NO: 207458 - RNA, 22 nt, Human
gaacauuucugcagaugucuga

SEQ ID NO: 207459 - RNA, 22 nt, Human
cugggagggguagccaauccua

SEQ ID NO: 207460 - RNA, 22 nt, Human
cugggagaugacucagagcagg

SEQ ID NO: 207461 - RNA, 22 nt, Human
cugggacccagcccaagucuuu

SEQ ID NO: 207462 - RNA, 22 nt, Human
cugggagaggaaccucgagggu

SEQ ID NO: 207463 - RNA, 22 nt, Human
cugggacacguugugcuuuaac

SEQ ID NO: 207464 - RNA, 19 nt, Human
cugggacaaugaaagcauc

SEQ ID NO: 207465 - RNA, 22 nt, Human
cuuuuucuuaucuuuuucuaug

SEQ ID NO: 207466 - RNA, 22 nt, Human
cugggcaugggaacuucaaggc

SEQ ID NO: 207467 - RNA, 22 nt, Human
cugggguaucugccacaacucu

SEQ ID NO: 207468 - RNA, 22 nt, Human
cugggguaucuggugucuuggu

SEQ ID NO: 207469 - RNA, 22 nt, Human
cugggcuuucaggcccuaaggc

SEQ ID NO: 207470 - RNA, 22 nt, Human
cuuuuuuucuccauauuucugg

SEQ ID NO: 207471 - RNA, 22 nt, Human
cugggugggcacccagccuggg

SEQ ID NO: 207472 - RNA, 22 nt, Human
gaaaaauggguuguuugaagau

SEQ ID NO: 207473 - RNA, 22 nt, Human
gaaaaagucuuaaaguaaggca

SEQ ID NO: 207474 - RNA, 22 nt, Human
gaaaaacucagugggggucuuu

SEQ ID NO: 207475 - RNA, 22 nt, Human
gaaaaagagaaggaguucagua

SEQ ID NO: 207476 - RNA, 22 nt, Human
cuuuucaaacaggacagguccu

SEQ ID NO: 207477 - RNA, 21 nt, Human
cuuuucuagucccagccccgc

SEQ ID NO: 207478 - RNA, 22 nt, Human
cuggcgagcugggccuggggga

SEQ ID NO: 207479 - RNA, 22 nt, Human
cuggcuguguguuugugcaucu

SEQ ID NO: 207480 - RNA, 21 nt, Human
cugggaacccgaccaaggccu

SEQ ID NO: 207481 - RNA, 22 nt, Human
cuggcuaaugugcugauagcca

SEQ ID NO: 207482 - RNA, 22 nt, Human
cuggcgauugcgagagucgccu

SEQ ID NO: 207483 - RNA, 22 nt, Human
cuggcggcccgaggcagaggag

SEQ ID NO: 207484 - RNA, 22 nt, Human
cuggagucagcaaggacgaggc

SEQ ID NO: 207485 - RNA, 22 nt, Human
cuggagcucugggcaucucagg

SEQ ID NO: 207486 - RNA, 22 nt, Human
cuggauagaccccuuauugcau

SEQ ID NO: 207487 - RNA, 20 nt, Human
cuggaguguagcaguggcug

SEQ ID NO: 207488 - RNA, 22 nt, Human
cuucagagugacucagcaucuu

SEQ ID NO: 207489 - RNA, 22 nt, Human
cugaucuuaaguaacauuauuu

SEQ ID NO: 207490 - RNA, 22 nt, Human
cugaugcucuggauguagucaa

SEQ ID NO: 207491 - RNA, 20 nt, Human
cuuauuuuggagaacuuuuc

SEQ ID NO: 207492 - RNA, 22 nt, Human
gacagcguaucaauugaacaua

SEQ ID NO: 207493 - RNA, 22 nt, Human
cuuucuuuuugguuucccccca

SEQ ID NO: 207494 - RNA, 22 nt, Human
cuuugauuucucugguccaauc

SEQ ID NO: 207495 - RNA, 18 nt, Human
cuuucugcccccauuagc

SEQ ID NO: 207496 - RNA, 22 nt, Human
gacaggcagagaggaagagaga

SEQ ID NO: 207497 - RNA, 22 nt, Human
cuuucuccagagugaagauccu

SEQ ID NO: 207498 - RNA, 22 nt, Human
cuuucucucaaacacacauaca

SEQ ID NO: 207499 - RNA, 22 nt, Human
cuuuccaugucuucuuucucca

SEQ ID NO: 207500 - RNA, 22 nt, Human
gacagcaggaugugaggggaug

SEQ ID NO: 207501 - RNA, 22 nt, Human
gacacugccaagugccccgaga

SEQ ID NO: 207502 - RNA, 22 nt, Human
cuuuucuuuucuucucuuccca

SEQ ID NO: 207503 - RNA, 22 nt, Human
gaccugcucagcccuguguguu

SEQ ID NO: 207504 - RNA, 22 nt, Human
cuuuguaaucaauaagucuuuu

SEQ ID NO: 207505 - RNA, 22 nt, Human
cuuuggacaacugagugacguu

SEQ ID NO: 207506 - RNA, 21 nt, Human
cuuugccuccagcagccgcag

SEQ ID NO: 207507 - RNA, 22 nt, Human
cuuugcaaagagagaaaguggg

SEQ ID NO: 207508 - RNA, 22 nt, Human
gacuguuggcagauguuugagu

SEQ ID NO: 207509 - RNA, 22 nt, Human
cuuuuucaugggugaugagugg

SEQ ID NO: 207510 - RNA, 22 nt, Human
cuuuuggcaucagccucaggaa

SEQ ID NO: 207511 - RNA, 22 nt, Human
gacuuaaaugcuccccucaggg

SEQ ID NO: 207512 - RNA, 22 nt, Human
gacuggaaucucugcuuguuaa

SEQ ID NO: 207513 - RNA, 22 nt, Human
cuuuuuaaaguaaauggcuaga

SEQ ID NO: 207514 - RNA, 22 nt, Human
cuuuugcaauagugacacugau

SEQ ID NO: 207515 - RNA, 22 nt, Human
cuuuuugcccuugggcuuccug

SEQ ID NO: 207516 - RNA, 22 nt, Human
cuuuuugccuugaagugaccuc

SEQ ID NO: 207517 - RNA, 22 nt, Human
gagaacagauaugaugacuuca

SEQ ID NO: 207518 - RNA, 22 nt, Human
gagaacaaggaagagucggcag

SEQ ID NO: 207519 - RNA, 22 nt, Human
gagaaauagauucaugguagau

SEQ ID NO: 207520 - RNA, 22 nt, Human
gagaaaacauacuuaguguccu

SEQ ID NO: 207521 - RNA, 22 nt, Human
gagaaagggagaaaaagaucuu

SEQ ID NO: 207522 - RNA, 22 nt, Human
gagaaagauuguccuucagggg

SEQ ID NO: 207523 - RNA, 22 nt, Human
gagacagugucagccauugaaa

SEQ ID NO: 207524 - RNA, 22 nt, Human
gagagagacugggaaaucauca

SEQ ID NO: 207525 - RNA, 22 nt, Human
gagacugcguggcucugacaca

SEQ ID NO: 207526 - RNA, 22 nt, Human
gagacuguaagcuccuugagga

SEQ ID NO: 207527 - RNA, 22 nt, Human
cuugccaguguugcagaagcuc

SEQ ID NO: 207528 - RNA, 22 nt, Human
cuugccagggacucagucaggg

SEQ ID NO: 207529 - RNA, 22 nt, Human
cuugauucauuuaagguuggag

SEQ ID NO: 207530 - RNA, 22 nt, Human
cuugccucucccucuagggggu

SEQ ID NO: 207531 - RNA, 22 nt, Human
gaauguuaaugcacuucuagcu

SEQ ID NO: 207532 - RNA, 22 nt, Human
gaaugguuauaugauguuuaaa

SEQ ID NO: 207533 - RNA, 22 nt, Human
cuuggcuccuucacagggagau

SEQ ID NO: 207534 - RNA, 22 nt, Human
gaauuacuccaguguguggguu

SEQ ID NO: 207535 - RNA, 22 nt, Human
gaauuacagaguuguuaaguca

SEQ ID NO: 207536 - RNA, 22 nt, Human
gacaauuucucaauauagaaac

SEQ ID NO: 207537 - RNA, 22 nt, Human
gacacaacuauccaguauggga

SEQ ID NO: 207538 - RNA, 22 nt, Human
cuuuaguaaaacguauuuagga

SEQ ID NO: 207539 - RNA, 22 nt, Human
cuuucauuuuugggcaucugag

SEQ ID NO: 207540 - RNA, 22 nt, Human
cuuuauguuggggugucuuagu

SEQ ID NO: 207541 - RNA, 22 nt, Human
gacaagaugacaucauggcuuc

SEQ ID NO: 207542 - RNA, 22 nt, Human
gacaagaagaacggagguuuca

SEQ ID NO: 207543 - RNA, 19 nt, Human
cuuguggcuaugcagauac

SEQ ID NO: 207544 - RNA, 22 nt, Human
gaagcaagagggaucaggaucu

SEQ ID NO: 207545 - RNA, 22 nt, Human
gaagaugacaucggaucugucu

SEQ ID NO: 207546 - RNA, 22 nt, Human
gaagauuauuacucauugcagg

SEQ ID NO: 207547 - RNA, 22 nt, Human
gaaggggacuccauggaaugau

SEQ ID NO: 207548 - RNA, 22 nt, Human
gaagggccaggggcaggcugga

SEQ ID NO: 207549 - RNA, 22 nt, Human
gaaggugcugaaacagaaauuu

SEQ ID NO: 207550 - RNA, 22 nt, Human
cuuccugcaacaccuguguugc

SEQ ID NO: 207551 - RNA, 22 nt, Human
cuucuaauucuuauguaagcuu

SEQ ID NO: 207552 - RNA, 22 nt, Human
gaagucaggaaggagauugaag

SEQ ID NO: 207553 - RNA, 22 nt, Human
gaaguauuucugaguugcccag

SEQ ID NO: 207554 - RNA, 22 nt, Human
cuucucuuccuucucauccuca

SEQ ID NO: 207555 - RNA, 22 nt, Human
gaagggucagggcccaggggcc

SEQ ID NO: 207556 - RNA, 22 nt, Human
gaaggggccuggggcaaggcua

SEQ ID NO: 207557 - RNA, 22 nt, Human
gaaguaaaacaguaacuuuguu

SEQ ID NO: 207558 - RNA, 22 nt, Human
cuugcagagcccauggauguca

SEQ ID NO: 207559 - RNA, 22 nt, Human
cuugcagccuggagcucagccu

SEQ ID NO: 207560 - RNA, 22 nt, Human
gaaguucuuagucucauuugca

SEQ ID NO: 207561 - RNA, 22 nt, Human
gaauaagaauccacuucuggca

SEQ ID NO: 207562 - RNA, 22 nt, Human
gaggucaugcagcucugaguuc

SEQ ID NO: 207563 - RNA, 22 nt, Human
gacacucauauuaagccuauuu

SEQ ID NO: 207564 - RNA, 22 nt, Human
gacacucuuaauccuaucccug

SEQ ID NO: 207565 - RNA, 20 nt, Human
gacaagccacagcucccaga

SEQ ID NO: 207566 - RNA, 22 nt, Human
gagguuggagggcuggccugca

SEQ ID NO: 207567 - RNA, 22 nt, Human
gacaguggagccacguugggag

SEQ ID NO: 207568 - RNA, 22 nt, Human
gagguuuaguccauaguauuua

SEQ ID NO: 207569 - RNA, 22 nt, Human
gaggugcaggggcccgggcugg

SEQ ID NO: 207570 - RNA, 22 nt, Human
gaggugauuccucccauguaau

SEQ ID NO: 207571 - RNA, 22 nt, Human
gaggugggaggcgggccugcau

SEQ ID NO: 207572 - RNA, 22 nt, Human
gacaggaauuaucuaaaguaga

SEQ ID NO: 207573 - RNA, 22 nt, Human
gacagguagacaugaauauuaa

SEQ ID NO: 207574 - RNA, 22 nt, Human
gacagcguguuuugcaugaaca

SEQ ID NO: 207575 - RNA, 22 nt, Human
gacagaccucugcugacuggag

SEQ ID NO: 207576 - RNA, 22 nt, Human
gaggugaacccaggugcuucac

SEQ ID NO: 207577 - RNA, 22 nt, Human
gaccugguggccauugucccag

SEQ ID NO: 207578 - RNA, 22 nt, Human
gaccugaccucauuagcaaguu

SEQ ID NO: 207579 - RNA, 22 nt, Human
gagucaaugugcagugcagccc

SEQ ID NO: 207580 - RNA, 22 nt, Human
gacggaggacaucagcaguguc

SEQ ID NO: 207581 - RNA, 22 nt, Human
gacggggcagccagcugguggc

SEQ ID NO: 207582 - RNA, 22 nt, Human
gacccugaggauucccugcuga

SEQ ID NO: 207583 - RNA, 22 nt, Human
gaccgggcucugcugacggucu

SEQ ID NO: 207584 - RNA, 22 nt, Human
gacccggauguuguacucgagg

SEQ ID NO: 207585 - RNA, 22 nt, Human
gaguauuagaagaguaguuauu

SEQ ID NO: 207586 - RNA, 22 nt, Human
gacauugaauugaauccagauu

SEQ ID NO: 207587 - RNA, 22 nt, Human
gacagugucccucuggggugga

SEQ ID NO: 207588 - RNA, 22 nt, Human
gaguaaaagaugaggcaguaga

SEQ ID NO: 207589 - RNA, 22 nt, Human
gacucuucucucccaaaugccc

SEQ ID NO: 207590 - RNA, 22 nt, Human
gaguugauggccauugaguuga

SEQ ID NO: 207591 - RNA, 22 nt, Human
gacuggggcauuagaguagcuu

SEQ ID NO: 207592 - RNA, 18 nt, Human
gacugccuugaacuauug

SEQ ID NO: 207593 - RNA, 22 nt, Human
gacuccuuaauguggcugaugu

SEQ ID NO: 207594 - RNA, 22 nt, Human
gaguguuugcuguauaauugga

SEQ ID NO: 207595 - RNA, 22 nt, Human
gaguuauuuuuccuguuuuuua

SEQ ID NO: 207596 - RNA, 22 nt, Human
gauaaauaguguuuggggacau

SEQ ID NO: 207597 - RNA, 22 nt, Human
gauaauuauaggcuaagccacu

SEQ ID NO: 207598 - RNA, 22 nt, Human
gauacaugucacaaguugugca

SEQ ID NO: 207599 - RNA, 22 nt, Human
gauaaugcuuuggucagacaug

SEQ ID NO: 207600 - RNA, 22 nt, Human
gauaagugauucugauucacau

SEQ ID NO: 207601 - RNA, 22 nt, Human
gacuucaagaugaaucuuuggg

SEQ ID NO: 207602 - RNA, 22 nt, Human
gacuugaagcucucugguuuug

SEQ ID NO: 207603 - RNA, 22 nt, Human
gacuucaucagagcguacuguu

SEQ ID NO: 207604 - RNA, 22 nt, Human
gauacuugaggagaucaccaca

SEQ ID NO: 207605 - RNA, 22 nt, Human
gauagguacuguaagguccucu

SEQ ID NO: 207606 - RNA, 22 nt, Human
gauauggaaacuugauguugug

SEQ ID NO: 207607 - RNA, 22 nt, Human
gauauauuucaaauucuuuugc

SEQ ID NO: 207608 - RNA, 22 nt, Human
gauacuuuguggaauccuggau

SEQ ID NO: 207609 - RNA, 22 nt, Human
gagaaaaauuucuuugcugcac

SEQ ID NO: 207610 - RNA, 22 nt, Human
gagaagugggggucugggauga

SEQ ID NO: 207611 - RNA, 22 nt, Human
gagaagugaauaacgaagcagg

SEQ ID NO: 207612 - RNA, 22 nt, Human
gauauuuugugaaaaaacaacu

SEQ ID NO: 207613 - RNA, 22 nt, Human
gauauucauaggcagguauuua

SEQ ID NO: 207614 - RNA, 22 nt, Human
gaucccaguccuacccucauaa

SEQ ID NO: 207615 - RNA, 22 nt, Human
gaucauuuucauuaauguugca

SEQ ID NO: 207616 - RNA, 22 nt, Human
gaucacuuugauuagauguccu

SEQ ID NO: 207617 - RNA, 22 nt, Human
gaaaaugcacacauacacaccc

SEQ ID NO: 207618 - RNA, 21 nt, Human
gaaaaucuaaugugacaaugc

SEQ ID NO: 207619 - RNA, 22 nt, Human
gaagauucugacccugacucag

SEQ ID NO: 207620 - RNA, 22 nt, Human
gaaaaucaggauggaugugagg

SEQ ID NO: 207621 - RNA, 22 nt, Human
gaaaaucaugaaaguguguugu

SEQ ID NO: 207622 - RNA, 18 nt, Human
gaagcaacaguucugagu

SEQ ID NO: 207623 - RNA, 22 nt, Human
gaagcagguucuucaggaugaa

SEQ ID NO: 207624 - RNA, 22 nt, Human
gaagccaugauaaccagugugg

SEQ ID NO: 207625 - RNA, 22 nt, Human
gaagcccuggaggggcuggagg

SEQ ID NO: 207626 - RNA, 22 nt, Human
gagcgcgcaaucucuccagcug

SEQ ID NO: 207627 - RNA, 22 nt, Human
gagccuguuaggcaccuguguu

SEQ ID NO: 207628 - RNA, 22 nt, Human
gagccuuucuggagggcacuug

SEQ ID NO: 207629 - RNA, 22 nt, Human
gagacugugucugucaagcuag

SEQ ID NO: 207630 - RNA, 22 nt, Human
gagcguuucccugggggucugc

SEQ ID NO: 207631 - RNA, 22 nt, Human
gagcuaauagacagcaacauca

SEQ ID NO: 207632 - RNA, 22 nt, Human
gagcuaagcccuggagaggucg

SEQ ID NO: 207633 - RNA, 22 nt, Human
gagcucucgggcuggggcguug

SEQ ID NO: 207634 - RNA, 21 nt, Human
gaagcugcuaugaagggggac

SEQ ID NO: 207635 - RNA, 22 nt, Human
gaagcucaguugcuuagaucuc

SEQ ID NO: 207636 - RNA, 22 nt, Human
gaaggcaguaaauggcuguuuu

SEQ ID NO: 207637 - RNA, 22 nt, Human
gaaggagaggauugugaggcug

SEQ ID NO: 207638 - RNA, 22 nt, Human
gagcuuuagcugagaccugcuu

SEQ ID NO: 207639 - RNA, 22 nt, Human
gagcuuuguuccgugguggcac

SEQ ID NO: 207640 - RNA, 22 nt, Human
gaagcuucucaacugguggaau

SEQ ID NO: 207641 - RNA, 22 nt, Human
gaggacuucaggccuggccagg

SEQ ID NO: 207642 - RNA, 22 nt, Human
gaggagacaguggagccgcuac

SEQ ID NO: 207643 - RNA, 22 nt, Human
gaggaagucuuaucuggaugca

SEQ ID NO: 207644 - RNA, 22 nt, Human
gaggaggagaagcggcggcgga

SEQ ID NO: 207645 - RNA, 22 nt, Human
gaaguaaugugauugcucaggg

SEQ ID NO: 207646 - RNA, 22 nt, Human
gaggagggagcuggaagcucuu

SEQ ID NO: 207647 - RNA, 22 nt, Human
gaggauaaugaaucugaaucau

SEQ ID NO: 207648 - RNA, 22 nt, Human
gaggcaggaagggaggguugug

SEQ ID NO: 207649 - RNA, 22 nt, Human
gaggcaggcggggcccaggugg

SEQ ID NO: 207650 - RNA, 22 nt, Human
gaauggaacauagcaacaucuu

SEQ ID NO: 207651 - RNA, 22 nt, Human
gaggcuaugucuacgcucagcg

SEQ ID NO: 207652 - RNA, 22 nt, Human
gaggcugguucccuugaucuuu

SEQ ID NO: 207653 - RNA, 22 nt, Human
gaggcucagagggacuuucaag

SEQ ID NO: 207654 - RNA, 22 nt, Human
gaauauuuaucucagcugcaga

SEQ ID NO: 207655 - RNA, 22 nt, Human
gaggcagaggaaacagcucauu

SEQ ID NO: 207656 - RNA, 22 nt, Human
gaauacaaauaauaccaaggug

SEQ ID NO: 207657 - RNA, 22 nt, Human
gaauagauuagaaagaguaugu

SEQ ID NO: 207658 - RNA, 22 nt, Human
gaauaccauuuacauuugaaaa

SEQ ID NO: 207659 - RNA, 22 nt, Human
gaaguggggaggagaagacuga

SEQ ID NO: 207660 - RNA, 22 nt, Human
gaagucagaucuuuugacuccc

SEQ ID NO: 207661 - RNA, 21 nt, Human
gaaguagcucugagaaaagug

SEQ ID NO: 207662 - RNA, 22 nt, Human
gaggaucuuuagcgggacugcu

SEQ ID NO: 207663 - RNA, 22 nt, Human
gaggggacugucuggcuccgag

SEQ ID NO: 207664 - RNA, 20 nt, Human
gaauucugaagauaauuugg

SEQ ID NO: 207665 - RNA, 22 nt, Human
gaggggaaggguguucaauggg

SEQ ID NO: 207666 - RNA, 22 nt, Human
gaggggcucuugggcaugaagg

SEQ ID NO: 207667 - RNA, 22 nt, Human
gaggggcggggcgggaggagag

SEQ ID NO: 207668 - RNA, 22 nt, Human
gaauggcagaaugaagcagugu

SEQ ID NO: 207669 - RNA, 22 nt, Human
gagggcauugucuucuuaguuu

SEQ ID NO: 207670 - RNA, 19 nt, Human
gaauggguucuguagggag

SEQ ID NO: 207671 - RNA, 22 nt, Human
gaaugguuagugaacaaauuug

SEQ ID NO: 207672 - RNA, 22 nt, Human
gaaugggaauuauggugggacu

SEQ ID NO: 207673 - RNA, 22 nt, Human
gagggauuuuagugcagcaacu

SEQ ID NO: 207674 - RNA, 22 nt, Human
gagggagugggcccgugggcac

SEQ ID NO: 207675 - RNA, 22 nt, Human
gaggcuugccacuguccauggc

SEQ ID NO: 207676 - RNA, 22 nt, Human
gagggaaaggggccaugauugg

SEQ ID NO: 207677 - RNA, 22 nt, Human
gaggggaacaggcauucuuaag

SEQ ID NO: 207678 - RNA, 22 nt, Human
gaggggaagaacaauuuaauuu

SEQ ID NO: 207679 - RNA, 22 nt, Human
gagggcugccacguugggcgag

SEQ ID NO: 207680 - RNA, 17 nt, Human
uuugugauggcagaugc

SEQ ID NO: 207681 - RNA, 22 nt, Human
uuuguggugagcagggaacguc

SEQ ID NO: 207682 - RNA, 22 nt, Human
uuugugguuuugagagaguugc

SEQ ID NO: 207683 - RNA, 19 nt, Human
ggaacgcugggcuccccuc

SEQ ID NO: 207684 - RNA, 22 nt, Human
ggaagaagagggagcuguggga

SEQ ID NO: 207685 - RNA, 22 nt, Human
ggaagaggaagaugaggcagca

SEQ ID NO: 207686 - RNA, 22 nt, Human
ggaauauaaaucagaugcuccg

SEQ ID NO: 207687 - RNA, 22 nt, Human
gccugggauuggggauuuuuug

SEQ ID NO: 207688 - RNA, 22 nt, Human
ggaauccugguguuuucugccu

SEQ ID NO: 207689 - RNA, 22 nt, Human
ggaauguuuuccagaccuagau

SEQ ID NO: 207690 - RNA, 22 nt, Human
ggaauuauuuuaaauagacauu

SEQ ID NO: 207691 - RNA, 22 nt, Human
gccuggggaacuugauccuguc

SEQ ID NO: 207692 - RNA, 22 nt, Human
gccugggcuuccgggacccggg

SEQ ID NO: 207693 - RNA, 22 nt, Human
gccugggguuugcggggcugca

SEQ ID NO: 207694 - RNA, 22 nt, Human
ggacuggugaagccuucggaga

SEQ ID NO: 207695 - RNA, 22 nt, Human
ggacuugaaguaguuauggccu

SEQ ID NO: 207696 - RNA, 22 nt, Human
gccuuucuugguuugucaggca

SEQ ID NO: 207697 - RNA, 22 nt, Human
gccuuuugcaaugguguuggug

SEQ ID NO: 207698 - RNA, 18 nt, Human
ggagaagaacagaugugg

SEQ ID NO: 207699 - RNA, 22 nt, Human
ggacauggaaagugugugauuu

SEQ ID NO: 207700 - RNA, 22 nt, Human
ggacauuguuguuggauccuug

SEQ ID NO: 207701 - RNA, 22 nt, Human
ggacauugaagcuggaaaggga

SEQ ID NO: 207702 - RNA, 22 nt, Human
ggacagagcaacccuacgcagc

SEQ ID NO: 207703 - RNA, 22 nt, Human
ggacagggagcaaaaacguccc

SEQ ID NO: 207704 - RNA, 22 nt, Human
ggaauugagcaagggguggggc

SEQ ID NO: 207705 - RNA, 22 nt, Human
ggacauagaucuagacuuuaaa

SEQ ID NO: 207706 - RNA, 22 nt, Human
ggaggagggaguucaggaguau

SEQ ID NO: 207707 - RNA, 22 nt, Human
ggagcugaacccuuaacuggcu

SEQ ID NO: 207708 - RNA, 22 nt, Human
ggaggccgugcugugcugccag

SEQ ID NO: 207709 - RNA, 22 nt, Human
ggaggcacugaaaguccuacag

SEQ ID NO: 207710 - RNA, 22 nt, Human
ggaggccagagaagagccaggc

SEQ ID NO: 207711 - RNA, 22 nt, Human
ggaggggaguuugccucugggg

SEQ ID NO: 207712 - RNA, 22 nt, Human
ggagggagugcaggcaggcaga

SEQ ID NO: 207713 - RNA, 22 nt, Human
ggaggucagcuggaggggaggc

SEQ ID NO: 207714 - RNA, 22 nt, Human
ggagguaagaggcccugggccg

SEQ ID NO: 207715 - RNA, 22 nt, Human
ggagguggagcuggaaguucca

SEQ ID NO: 207716 - RNA, 22 nt, Human
gcgcgcucugcgaggacacgcu

SEQ ID NO: 207717 - RNA, 22 nt, Human
ggagagagggaucuuuguggag

SEQ ID NO: 207718 - RNA, 22 nt, Human
ggagacagugacuuagagacug

SEQ ID NO: 207719 - RNA, 22 nt, Human
ggagacagauggcgucucaguu

SEQ ID NO: 207720 - RNA, 23 nt, Human
ggagaaggaugucaucaaaagac

SEQ ID NO: 207721 - RNA, 22 nt, Human
gcggagcuaaagauuggcuccu

SEQ ID NO: 207722 - RNA, 22 nt, Human
gcggagaggcagagacuccgcg

SEQ ID NO: 207723 - RNA, 22 nt, Human
gcggacaauggaagaugucauu

SEQ ID NO: 207724 - RNA, 20 nt, Human
gcgcuucccuacgcucugcu

SEQ ID NO: 207725 - RNA, 19 nt, Human
ggaguugccaggagaagga

SEQ ID NO: 207726 - RNA, 22 nt, Human
ggaguucacagcaauggaacag

SEQ ID NO: 207727 - RNA, 22 nt, Human
ggagugauuugucuugucuggu

SEQ ID NO: 207728 - RNA, 22 nt, Human
ggagugaagacagagugaacuu

SEQ ID NO: 207729 - RNA, 22 nt, Human
ggcacagcgacuaccaucgaaa

SEQ ID NO: 207730 - RNA, 22 nt, Human
ggcacacugaaguuugagaacc

SEQ ID NO: 207731 - RNA, 22 nt, Human
ggcacuggguugcagagagaga

SEQ ID NO: 207732 - RNA, 22 nt, Human
ggcaccuuucaucccaucuaga

SEQ ID NO: 207733 - RNA, 21 nt, Human
ggcagccuggcaggggcacug

SEQ ID NO: 207734 - RNA, 20 nt, Human
ggcagcaaccauaugcuaca

SEQ ID NO: 207735 - RNA, 22 nt, Human
gcguagaagaaagcugcugcua

SEQ ID NO: 207736 - RNA, 22 nt, Human
gcgguuguucugugugcaugga

SEQ ID NO: 207737 - RNA, 22 nt, Human
gcgguuggacguucgccucggg

SEQ ID NO: 207738 - RNA, 22 nt, Human
ggcaguagucagaggguuuuac

SEQ ID NO: 207739 - RNA, 17 nt, Human
gcuaguuguuuccagua

SEQ ID NO: 207740 - RNA, 22 nt, Human
gcuaguucugccuccccuagug

SEQ ID NO: 207741 - RNA, 22 nt, Human
ggcagguggcacugcugcuccc

SEQ ID NO: 207742 - RNA, 22 nt, Human
ggcaaggaagaaagcagaaguu

SEQ ID NO: 207743 - RNA, 22 nt, Human
gcuagcugugcuuggaaguuug

SEQ ID NO: 207744 - RNA, 19 nt, Human
gcuccugcagcuagagugc

SEQ ID NO: 207745 - RNA, 22 nt, Human
gcuccggggguuccagaucauc

SEQ ID NO: 207746 - RNA, 22 nt, Human
gcucgauugucaguguuaggga

SEQ ID NO: 207747 - RNA, 22 nt, Human
gcuccuuaugguccugacccua

SEQ ID NO: 207748 - RNA, 22 nt, Human
gcucuccuugcuagagguucua

SEQ ID NO: 207749 - RNA, 22 nt, Human
gcucagagaugucugcugccuu

SEQ ID NO: 207750 - RNA, 21 nt, Human
ggcauguagccagcaaaggua

SEQ ID NO: 207751 - RNA, 22 nt, Human
ggcauggugggggaggacuugg

SEQ ID NO: 207752 - RNA, 22 nt, Human
gcugagcagaacaauuagaaau

SEQ ID NO: 207753 - RNA, 23 nt, Human
gcugagcaccagccauaucuuuu

SEQ ID NO: 207754 - RNA, 22 nt, Human
gcugagcaaugcacugccgcau

SEQ ID NO: 207755 - RNA, 22 nt, Human
gcugacuguagcugggggaaga

SEQ ID NO: 207756 - RNA, 22 nt, Human
gcucucucuucugcaggccuua

SEQ ID NO: 207757 - RNA, 22 nt, Human
gcugacuauaaggcugcucugu

SEQ ID NO: 207758 - RNA, 22 nt, Human
gcauucuugucaguggggucag

SEQ ID NO: 207759 - RNA, 22 nt, Human
gcauuccagaguugcuggaaaa

SEQ ID NO: 207760 - RNA, 22 nt, Human
gcccgaccgcgccggcccgcac

SEQ ID NO: 207761 - RNA, 22 nt, Human
gcccccgccuugcugggccagg

SEQ ID NO: 207762 - RNA, 22 nt, Human
gccccgcgcgcguagcgccgcu

SEQ ID NO: 207763 - RNA, 22 nt, Human
gcugacuuauuagaaaaggaca

SEQ ID NO: 207764 - RNA, 22 nt, Human
gcauuggaaacugcuuuaugcu

SEQ ID NO: 207765 - RNA, 22 nt, Human
gcauugcuauuucuguuagugu

SEQ ID NO: 207766 - RNA, 22 nt, Human
gcccugucagcucucauggaca

SEQ ID NO: 207767 - RNA, 22 nt, Human
gcugucccccaaagaugcuccu

SEQ ID NO: 207768 - RNA, 22 nt, Human
gcccuguuuucuggguuccuug

SEQ ID NO: 207769 - RNA, 22 nt, Human
gcccuggucguggagggcaaca

SEQ ID NO: 207770 - RNA, 22 nt, Human
gcugucauggacaugucuguuu

SEQ ID NO: 207771 - RNA, 22 nt, Human
gcugguuucucucauugucagu

SEQ ID NO: 207772 - RNA, 22 nt, Human
gcccguuuagcaaacgccuccu

SEQ ID NO: 207773 - RNA, 22 nt, Human
gcuuacuguuccuguuggugcu

SEQ ID NO: 207774 - RNA, 22 nt, Human
gcuguuucuuuggcaaacugau

SEQ ID NO: 207775 - RNA, 22 nt, Human
gcuguuuaaguggaauuuguuu

SEQ ID NO: 207776 - RNA, 22 nt, Human
gcuguuguugcacggaaggugg

SEQ ID NO: 207777 - RNA, 22 nt, Human
gcuguugugaggaucagcauau

SEQ ID NO: 207778 - RNA, 22 nt, Human
gcuguugagucagacaaguuuu

SEQ ID NO: 207779 - RNA, 22 nt, Human
gcuguguaugaugcaggcaccu

SEQ ID NO: 207780 - RNA, 22 nt, Human
gcugugacaagaggcugcuucu

SEQ ID NO: 207781 - RNA, 22 nt, Human
gcuguggagaagcugccuaugg

SEQ ID NO: 207782 - RNA, 20 nt, Human
gcugugccaugacccucgag

SEQ ID NO: 207783 - RNA, 22 nt, Human
gccgccgccgccuuuguugcgg

SEQ ID NO: 207784 - RNA, 22 nt, Human
gcuucuguuaggauguggcuua

SEQ ID NO: 207785 - RNA, 20 nt, Human
gcccuucccccuccgcgagc

SEQ ID NO: 207786 - RNA, 22 nt, Human
gcuucugugagugcagaugcug

SEQ ID NO: 207787 - RNA, 22 nt, Human
gcuuccgacagagaucacauug

SEQ ID NO: 207788 - RNA, 22 nt, Human
gcuucucacccuuacuaucucu

SEQ ID NO: 207789 - RNA, 22 nt, Human
gcuuaugauguuuacauaaaag

SEQ ID NO: 207790 - RNA, 22 nt, Human
gccugaaaugaaccagaggacu

SEQ ID NO: 207791 - RNA, 22 nt, Human
gccugagauuggacauuauuua

SEQ ID NO: 207792 - RNA, 22 nt, Human
ggaaaggacuggagcccagcgc

SEQ ID NO: 207793 - RNA, 22 nt, Human
ggaaaggaagggaaggagaugc

SEQ ID NO: 207794 - RNA, 22 nt, Human
ggaaagaggacaucuuacuucu

SEQ ID NO: 207795 - RNA, 22 nt, Human
gccugcaggaaggugugccugu

SEQ ID NO: 207796 - RNA, 22 nt, Human
gccggcugggggcggagggcag

SEQ ID NO: 207797 - RNA, 22 nt, Human
gccgggagaggcggcgcagggg

SEQ ID NO: 207798 - RNA, 22 nt, Human
gccgcguggcagucuuggugac

SEQ ID NO: 207799 - RNA, 20 nt, Human
gccggggcauaggggccguc

SEQ ID NO: 207800 - RNA, 22 nt, Human
gccucaaaaguguuguagaggg

SEQ ID NO: 207801 - RNA, 22 nt, Human
gcuucccagaccaggcucccuc

SEQ ID NO: 207802 - RNA, 22 nt, Human
gccuccggagucgcagugucuu

SEQ ID NO: 207803 - RNA, 20 nt, Human
gccuccuccaaguuucauca

SEQ ID NO: 207804 - RNA, 18 nt, Human
gccucuguugacagaguu

SEQ ID NO: 207805 - RNA, 22 nt, Human
gccuccuuccgaccucaguccu

SEQ ID NO: 207806 - RNA, 22 nt, Human
gccucucuggcaaagcggugau

SEQ ID NO: 207807 - RNA, 22 nt, Human
ggaaaaauggguggugauauga

SEQ ID NO: 207808 - RNA, 22 nt, Human
gcuuuuuaauuugcuucccugg

SEQ ID NO: 207809 - RNA, 22 nt, Human
gcuuuugcaaagcuggagaauu

SEQ ID NO: 207810 - RNA, 22 nt, Human
gcuuuugagaaaguguuuuccc

SEQ ID NO: 207811 - RNA, 22 nt, Human
gccggagagccaacaccacgga

SEQ ID NO: 207812 - RNA, 22 nt, Human
ggaaaaucaaaccauuuacagu

SEQ ID NO: 207813 - RNA, 22 nt, Human
ggaaaagaauuguuaguuagug

SEQ ID NO: 207814 - RNA, 22 nt, Human
gcuuuucaaguuacaauuagcu

SEQ ID NO: 207815 - RNA, 22 nt, Human
gcuuuucucccugcuuucuucc

SEQ ID NO: 207816 - RNA, 22 nt, Human
gcuuuguucauuuaguuuuuuu

SEQ ID NO: 207817 - RNA, 22 nt, Human
gcuuuuaaauuaucugacaaug

SEQ ID NO: 207818 - RNA, 20 nt, Human
gcuugcgugggaggaggggg

SEQ ID NO: 207819 - RNA, 22 nt, Human
gcuugcuuuguaaauaucugug

SEQ ID NO: 207820 - RNA, 22 nt, Human
gcuugcugaacaggaaccuggc

SEQ ID NO: 207821 - RNA, 22 nt, Human
gcccuuuuaucaacuccuagaa

SEQ ID NO: 207822 - RNA, 18 nt, Human
gccgccuugcucgugaac

SEQ ID NO: 207823 - RNA, 22 nt, Human
gcuuucauuauguuguguuuuu

SEQ ID NO: 207824 - RNA, 22 nt, Human
gcuuuccuggcccugucccugc

SEQ ID NO: 207825 - RNA, 22 nt, Human
gcuugggcugaaggccuggguc

SEQ ID NO: 207826 - RNA, 22 nt, Human
gcuuguuuagcauaggucacug

SEQ ID NO: 207827 - RNA, 22 nt, Human
gcagugucacuaguaauagucu

SEQ ID NO: 207828 - RNA, 22 nt, Human
gcuagaaacuguuuaaucucuu

SEQ ID NO: 207829 - RNA, 22 nt, Human
gcagugcugcgacagucgggug

SEQ ID NO: 207830 - RNA, 23 nt, Human
gcaguggagcgagaacuuccugu

SEQ ID NO: 207831 - RNA, 22 nt, Human
gcuagauugucacuugaguguc

SEQ ID NO: 207832 - RNA, 22 nt, Human
gcaucccagaagauucugauuu

SEQ ID NO: 207833 - RNA, 22 nt, Human
gcucagcuggagagggacgggu

SEQ ID NO: 207834 - RNA, 20 nt, Human
gcucaguggagaaaugcacc

SEQ ID NO: 207835 - RNA, 22 nt, Human
gcucaugggcccagagcagccc

SEQ ID NO: 207836 - RNA, 22 nt, Human
gcaugcgugcgugcgugcaugu

SEQ ID NO: 207837 - RNA, 21 nt, Human
gcauccucguacucuucaggu

SEQ ID NO: 207838 - RNA, 22 nt, Human
gcucggcuggcucaucucaugu

SEQ ID NO: 207839 - RNA, 22 nt, Human
gcucuagcuggcgcugaccugg

SEQ ID NO: 207840 - RNA, 22 nt, Human
gcaugcuguuuggaaacgauaa

SEQ ID NO: 207841 - RNA, 23 nt, Human
gcaugcccauauguguauauaua

SEQ ID NO: 207842 - RNA, 23 nt, Human
gcagugacugggauggaaguaga

SEQ ID NO: 207843 - RNA, 22 nt, Human
gcaguagauccagcagccugca

SEQ ID NO: 207844 - RNA, 22 nt, Human
gcaguaaggaggggaaggguuu

SEQ ID NO: 207845 - RNA, 22 nt, Human
gcagguccgagagggucgggua

SEQ ID NO: 207846 - RNA, 22 nt, Human
gcaguauuguguguggucaugg

SEQ ID NO: 207847 - RNA, 22 nt, Human
gcagguuguuuaaauuaggauu

SEQ ID NO: 207848 - RNA, 22 nt, Human
gcaguaaauugagagucauguu

SEQ ID NO: 207849 - RNA, 22 nt, Human
gcaggccgauuuguuagaaguc

SEQ ID NO: 207850 - RNA, 22 nt, Human
gcaggguaggugacagguaguc

SEQ ID NO: 207851 - RNA, 21 nt, Human
gcaggggugugugagcugggg

SEQ ID NO: 207852 - RNA, 22 nt, Human
gcagggcucuggagucaggcug

SEQ ID NO: 207853 - RNA, 22 nt, Human
gcgguuauggcagagauuacag

SEQ ID NO: 207854 - RNA, 23 nt, Human
gcgggcggagccgggaggcgggg

SEQ ID NO: 207855 - RNA, 22 nt, Human
gcagggcucagccgcucccacc

SEQ ID NO: 207856 - RNA, 22 nt, Human
gcaggcaggauucagagauaca

SEQ ID NO: 207857 - RNA, 22 nt, Human
gcaggagggggccuggagccca

SEQ ID NO: 207858 - RNA, 22 nt, Human
gcaggcagauccagaagcacua

SEQ ID NO: 207859 - RNA, 22 nt, Human
gcgcggcgcggguccucggccu

SEQ ID NO: 207860 - RNA, 22 nt, Human
gcgcgggugagucacgggcgga

SEQ ID NO: 207861 - RNA, 22 nt, Human
gcgcucuccugcagacagccuc

SEQ ID NO: 207862 - RNA, 22 nt, Human
gcgcugagcuuuucuuauugaa

SEQ ID NO: 207863 - RNA, 21 nt, Human
gcagcucaggauauagacuug

SEQ ID NO: 207864 - RNA, 22 nt, Human
gcagacuaacuuuugucagccu

SEQ ID NO: 207865 - RNA, 22 nt, Human
gcagagaaugucagauuuuguu

SEQ ID NO: 207866 - RNA, 22 nt, Human
gcagaaguauuguacgguggga

SEQ ID NO: 207867 - RNA, 21 nt, Human
gcagaacuaggacuugaacau

SEQ ID NO: 207868 - RNA, 21 nt, Human
gcagaaagugauuugcuauuc

SEQ ID NO: 207869 - RNA, 23 nt, Human
gcacuccgagggcacgugucucu

SEQ ID NO: 207870 - RNA, 22 nt, Human
gcgauugguuuggggccagagu

SEQ ID NO: 207871 - RNA, 22 nt, Human
gcagauaguaggagcuaaucuu

SEQ ID NO: 207872 - RNA, 22 nt, Human
gcagaggcugccgugggcagga

SEQ ID NO: 207873 - RNA, 22 nt, Human
gcagagcugucuaagucacuuc

SEQ ID NO: 207874 - RNA, 21 nt, Human
gcgcgcucgugcucgacgcgc

SEQ ID NO: 207875 - RNA, 22 nt, Human
gcgcgccugccucccgcggugc

SEQ ID NO: 207876 - RNA, 22 nt, Human
gcgcagugagguuaagaaugca

SEQ ID NO: 207877 - RNA, 20 nt, Human
gcgcaguuccgggcgcgucu

SEQ ID NO: 207878 - RNA, 22 nt, Human
gcagcagugugggcugaaccua

SEQ ID NO: 207879 - RNA, 22 nt, Human
gcagcaauaaaacugaaggugu

SEQ ID NO: 207880 - RNA, 22 nt, Human
gcagauuggguacauaaacagu

SEQ ID NO: 207881 - RNA, 22 nt, Human
gccugcagccagggaguucucu

SEQ ID NO: 207882 - RNA, 22 nt, Human
gccugcacucaaacacucucuu

SEQ ID NO: 207883 - RNA, 22 nt, Human
gcaauuggaaugaauucuauuu

SEQ ID NO: 207884 - RNA, 22 nt, Human
gcaauuguauugucaagacaug

SEQ ID NO: 207885 - RNA, 18 nt, Human
gccugccagccgagggac

SEQ ID NO: 207886 - RNA, 22 nt, Human
gccugccucugacuggggcuga

SEQ ID NO: 207887 - RNA, 22 nt, Human
gcacauauuuagaucuugaugu

SEQ ID NO: 207888 - RNA, 22 nt, Human
gauuuugcuuuagugaaggaag

SEQ ID NO: 207889 - RNA, 22 nt, Human
gauuuuuaaaaguaguuuugaa

SEQ ID NO: 207890 - RNA, 22 nt, Human
gcaaggaagcagaguugcuauc

SEQ ID NO: 207891 - RNA, 22 nt, Human
gauuuugaaccuuauuuggaaa

SEQ ID NO: 207892 - RNA, 22 nt, Human
gccucuuugcucuuugguuguu

SEQ ID NO: 207893 - RNA, 22 nt, Human
gauuccugcuauucacagggcu

SEQ ID NO: 207894 - RNA, 22 nt, Human
gauuaagaaagauagaugugga

SEQ ID NO: 207895 - RNA, 22 nt, Human
gauuaaaggucuugauuauaag

SEQ ID NO: 207896 - RNA, 22 nt, Human
gauuaagugaauuggagaaaag

SEQ ID NO: 207897 - RNA, 22 nt, Human
gcaggccuccccugcuggagcu

SEQ ID NO: 207898 - RNA, 22 nt, Human
gauccucagacccuccucuggu

SEQ ID NO: 207899 - RNA, 22 nt, Human
gcaggucacagcugauuggcca

SEQ ID NO: 207900 - RNA, 22 nt, Human
gaucugguuccaggacauugca

SEQ ID NO: 207901 - RNA, 22 nt, Human
gaucuuacucacuucagcuggc

SEQ ID NO: 207902 - RNA, 18 nt, Human
gaugaagaggaagaggag

SEQ ID NO: 207903 - RNA, 22 nt, Human
gaugaaguaguccacuggaagg

SEQ ID NO: 207904 - RNA, 22 nt, Human
gaguagccucagucugcaagug

SEQ ID NO: 207905 - RNA, 22 nt, Human
gaguaucagauuggaguccuca

SEQ ID NO: 207906 - RNA, 22 nt, Human
gaguaugugaggaaguaaagaa

SEQ ID NO: 207907 - RNA, 22 nt, Human
gcagguggaagcagcagacuca

SEQ ID NO: 207908 - RNA, 22 nt, Human
gcagucauggguagaacucaag

SEQ ID NO: 207909 - RNA, 22 nt, Human
gcagucuacuuaagaaucucag

SEQ ID NO: 207910 - RNA, 22 nt, Human
gcagugacagacaacuguuuga

SEQ ID NO: 207911 - RNA, 22 nt, Human
gcauagauauguaaugcaucau

SEQ ID NO: 207912 - RNA, 22 nt, Human
gcauauuuuaaaguguaaccug

SEQ ID NO: 207913 - RNA, 22 nt, Human
gcauagacaccuuagagcaaua

SEQ ID NO: 207914 - RNA, 22 nt, Human
gcaucacacgcacauacacaca

SEQ ID NO: 207915 - RNA, 22 nt, Human
gagucuuuuaagaugucuuacu

SEQ ID NO: 207916 - RNA, 22 nt, Human
gaguggccugccccagccaggc

SEQ ID NO: 207917 - RNA, 22 nt, Human
gaguggcaaagagaacaaagau

SEQ ID NO: 207918 - RNA, 22 nt, Human
gagucuacaugcaggcaauugu

SEQ ID NO: 207919 - RNA, 22 nt, Human
gaguggugagaauacaacggaa

SEQ ID NO: 207920 - RNA, 22 nt, Human
gagugguaaaguguacugaaua

SEQ ID NO: 207921 - RNA, 22 nt, Human
gaguuaaauagcuuaggauuca

SEQ ID NO: 207922 - RNA, 22 nt, Human
gcauccaaggagcagaagugau

SEQ ID NO: 207923 - RNA, 22 nt, Human
gcagugccauguggaggaucuc

SEQ ID NO: 207924 - RNA, 19 nt, Human
gcaguuccucuuaagagaa

SEQ ID NO: 207925 - RNA, 19 nt, Human
gcaguuauggcccacuucc

SEQ ID NO: 207926 - RNA, 22 nt, Human
gaguauuuaccacuaaaugguu

SEQ ID NO: 207927 - RNA, 22 nt, Human
gaguauuacuaaaauucgccua

SEQ ID NO: 207928 - RNA, 22 nt, Human
gagucaauucaccuuggugcuu

SEQ ID NO: 207929 - RNA, 22 nt, Human
gcaguuugugauguggcaguca

SEQ ID NO: 207930 - RNA, 22 nt, Human
gagucaucucuagaaugaugau

SEQ ID NO: 207931 - RNA, 22 nt, Human
gagucaggucaggcuuguagau

SEQ ID NO: 207932 - RNA, 22 nt, Human
gcaugaauggaacccccugagu

SEQ ID NO: 207933 - RNA, 22 nt, Human
gcauccugacuauggugguggu

SEQ ID NO: 207934 - RNA, 23 nt, Human
gcaucgcaggucuaagauuagcu

SEQ ID NO: 207935 - RNA, 21 nt, Human
gccacugcugcucauucucug

SEQ ID NO: 207936 - RNA, 23 nt, Human
gccaaacugcccguucucucugc

SEQ ID NO: 207937 - RNA, 22 nt, Human
gccaaucaggaggcuguacauc

SEQ ID NO: 207938 - RNA, 22 nt, Human
gccaggccuggguggagcgcuc

SEQ ID NO: 207939 - RNA, 22 nt, Human
gccaggcagcagcgaggauggu

SEQ ID NO: 207940 - RNA, 22 nt, Human
gccaggagaaaaggcgaaugau

SEQ ID NO: 207941 - RNA, 22 nt, Human
gccagccggugaguggaagcgg

SEQ ID NO: 207942 - RNA, 22 nt, Human
gaugaagaaacucaaccaagaa

SEQ ID NO: 207943 - RNA, 22 nt, Human
gaucuguccuggcaguuaacac

SEQ ID NO: 207944 - RNA, 22 nt, Human
gaucccagaggcggggauagga

SEQ ID NO: 207945 - RNA, 22 nt, Human
gauccagauauuugggcuggua

SEQ ID NO: 207946 - RNA, 22 nt, Human
gcccagcucucuggccugucuu

SEQ ID NO: 207947 - RNA, 23 nt, Human
gccaucugcugggugccccggcc

SEQ ID NO: 207948 - RNA, 22 nt, Human
gccaguggucagugggagggug

SEQ ID NO: 207949 - RNA, 22 nt, Human
gccagggcucgagcaggccagc

SEQ ID NO: 207950 - RNA, 22 nt, Human
gauggggaaaaaauggaucuuu

SEQ ID NO: 207951 - RNA, 22 nt, Human
gauggguugaguucauggagcc

SEQ ID NO: 207952 - RNA, 22 nt, Human
gaugggaggaugaauuggaccu

SEQ ID NO: 207953 - RNA, 22 nt, Human
gcccuguguguuugcacugauu

SEQ ID NO: 207954 - RNA, 22 nt, Human
gcccuguuauagucugaggccu

SEQ ID NO: 207955 - RNA, 22 nt, Human
gcccugccauugaucggcccag

SEQ ID NO: 207956 - RNA, 22 nt, Human
gauguuuugaaagaagaauaca

SEQ ID NO: 207957 - RNA, 22 nt, Human
gcccugaaggccuccaggacuc

SEQ ID NO: 207958 - RNA, 22 nt, Human
gcccuggagauggaaguucuga

SEQ ID NO: 207959 - RNA, 22 nt, Human
gcccuggcauuucuauucaugu

SEQ ID NO: 207960 - RNA, 22 nt, Human
gaugucauguuggcagacaguu

SEQ ID NO: 207961 - RNA, 22 nt, Human
gauguuaauauguuucaccaaa

SEQ ID NO: 207962 - RNA, 22 nt, Human
gaugugugugcccugggccugc

SEQ ID NO: 207963 - RNA, 22 nt, Human
gaugucccuggaggggacagga

SEQ ID NO: 207964 - RNA, 22 nt, Human
gaugucuauguccagggccauc

SEQ ID NO: 207965 - RNA, 22 nt, Human
ggcauuccucucuguucaugga

SEQ ID NO: 207966 - RNA, 22 nt, Human
gguggccuaacaaugguggcaa

SEQ ID NO: 207967 - RNA, 20 nt, Human
ggcaucugacaacuaguugc

SEQ ID NO: 207968 - RNA, 22 nt, Human
ggugcuuuucacaagcauggga

SEQ ID NO: 207969 - RNA, 22 nt, Human
gguggcauguaccucacagacu

SEQ ID NO: 207970 - RNA, 22 nt, Human
gguggcagaggaggcgggagag

SEQ ID NO: 207971 - RNA, 22 nt, Human
ggugaggggauccuguuaccau

SEQ ID NO: 207972 - RNA, 22 nt, Human
ggccacgggguuugcugaaacu

SEQ ID NO: 207973 - RNA, 22 nt, Human
ggccaccuaagguugugcauca

SEQ ID NO: 207974 - RNA, 20 nt, Human
ggcauuuuuuaguugagcuu

SEQ ID NO: 207975 - RNA, 22 nt, Human
gguuauuucugauuauaugaua

SEQ ID NO: 207976 - RNA, 22 nt, Human
gguguuccgguucugcucuggg

SEQ ID NO: 207977 - RNA, 22 nt, Human
ggcauugauggggucuugggga

SEQ ID NO: 207978 - RNA, 22 nt, Human
ggugucguuucacaugacccag

SEQ ID NO: 207979 - RNA, 22 nt, Human
gguguggcaguggaccugugaa

SEQ ID NO: 207980 - RNA, 22 nt, Human
gguguuaaccagcuaaaguuug

SEQ ID NO: 207981 - RNA, 22 nt, Human
ggcaauauuauaagggcauuua

SEQ ID NO: 207982 - RNA, 22 nt, Human
ggcaauuacguauuagucaugu

SEQ ID NO: 207983 - RNA, 22 nt, Human
ggcacccugcauuggcuugagu

SEQ ID NO: 207984 - RNA, 22 nt, Human
ggcacaggcugguaccaguuca

SEQ ID NO: 207985 - RNA, 21 nt, Human
ggcagagaagcuggaaguugg

SEQ ID NO: 207986 - RNA, 22 nt, Human
ggcagaggagcuggaaacaugg

SEQ ID NO: 207987 - RNA, 22 nt, Human
ggcagagcugugcgcccaccca

SEQ ID NO: 207988 - RNA, 22 nt, Human
ggcagauaaacaauguuguaua

SEQ ID NO: 207989 - RNA, 22 nt, Human
ggucauacaaggcacuggugau

SEQ ID NO: 207990 - RNA, 22 nt, Human
gguccgcgcgcagaggcccugg

SEQ ID NO: 207991 - RNA, 22 nt, Human
gguauccaaauaaagcagguaa

SEQ ID NO: 207992 - RNA, 22 nt, Human
gguaagcauuaagugagggaau

SEQ ID NO: 207993 - RNA, 22 nt, Human
gguaaucuccucauugacguua

SEQ ID NO: 207994 - RNA, 22 nt, Human
ggaugggcuuggggaggucuag

SEQ ID NO: 207995 - RNA, 22 nt, Human
ggauggaugugaucugccuccu

SEQ ID NO: 207996 - RNA, 22 nt, Human
ggaugcagcagagaccuggagu

SEQ ID NO: 207997 - RNA, 22 nt, Human
ggaugauuuucaguuguguggg

SEQ ID NO: 207998 - RNA, 22 nt, Human
ggaugcugcuccacaucccaca

SEQ ID NO: 207999 - RNA, 22 nt, Human
ggaggaaauccuuaguaaggca

SEQ ID NO: 208000 - RNA, 22 nt, Human
gggguuggaugccuuggaaauu

SEQ ID NO: 208001 - RNA, 22 nt, Human
ggagcauggcuucuuggggcug

SEQ ID NO: 208002 - RNA, 22 nt, Human
gggggcgcguggagggccgugg

SEQ ID NO: 208003 - RNA, 22 nt, Human
ggaggaugaggguggugguguu

SEQ ID NO: 208004 - RNA, 22 nt, Human
ggaggccccccaugcagcucca

SEQ ID NO: 208005 - RNA, 23 nt, Human
ggaggcccagaggucggccccac

SEQ ID NO: 208006 - RNA, 22 nt, Human
ggagcaguggaggggccagggu

SEQ ID NO: 208007 - RNA, 19 nt, Human
ggagcagauaaacauacuu

SEQ ID NO: 208008 - RNA, 22 nt, Human
ggggcuuggguagagcagaaac

SEQ ID NO: 208009 - RNA, 22 nt, Human
gggggaggcucggcgccgcggu

SEQ ID NO: 208010 - RNA, 22 nt, Human
gggggcagguuccaggccagcu

SEQ ID NO: 208011 - RNA, 22 nt, Human
gggggaaaguggagguucguga

SEQ ID NO: 208012 - RNA, 22 nt, Human
ggagcagaggaaagaguagcau

SEQ ID NO: 208013 - RNA, 18 nt, Human
gggcuuugggguucuauc

SEQ ID NO: 208014 - RNA, 18 nt, Human
gggcuuuacagaguggag

SEQ ID NO: 208015 - RNA, 22 nt, Human
gggcuuuuccauuccaggguuc

SEQ ID NO: 208016 - RNA, 22 nt, Human
ggagugaaugguggccguguuu

SEQ ID NO: 208017 - RNA, 22 nt, Human
ggagucugugucuugaagcagu

SEQ ID NO: 208018 - RNA, 22 nt, Human
ggagucguguuugggaucggag

SEQ ID NO: 208019 - RNA, 22 nt, Human
gggugggguaggugacucucgc

SEQ ID NO: 208020 - RNA, 22 nt, Human
ggguggcaagucuuucugcaac

SEQ ID NO: 208021 - RNA, 22 nt, Human
ggguucauuugccggguaguuu

SEQ ID NO: 208022 - RNA, 22 nt, Human
ggguggggcaugcucucuucug

SEQ ID NO: 208023 - RNA, 22 nt, Human
ggguuccuuggaacacuguuug

SEQ ID NO: 208024 - RNA, 22 nt, Human
ggguucugggaggacuagggga

SEQ ID NO: 208025 - RNA, 22 nt, Human
ggguuccugaagugguucagga

SEQ ID NO: 208026 - RNA, 22 nt, Human
ggaugaguuguauauaggauuc

SEQ ID NO: 208027 - RNA, 22 nt, Human
ggaucuaaagccagaauauaug

SEQ ID NO: 208028 - RNA, 23 nt, Human
ggauccugacauauaccaucacc

SEQ ID NO: 208029 - RNA, 22 nt, Human
ggguuguuuguauuucucugaa

SEQ ID NO: 208030 - RNA, 22 nt, Human
ggaucaccagguuuguuguugg

SEQ ID NO: 208031 - RNA, 22 nt, Human
ggguuguagagcuggaagggga

SEQ ID NO: 208032 - RNA, 22 nt, Human
ggguuuccugcucgcggguagc

SEQ ID NO: 208033 - RNA, 22 nt, Human
gguaacagaagagcacuuggca

SEQ ID NO: 208034 - RNA, 22 nt, Human
ggguuuugugauugccucugaa

SEQ ID NO: 208035 - RNA, 22 nt, Human
ggguuuuggggaggaagugagc

SEQ ID NO: 208036 - RNA, 22 nt, Human
ggguuuuaccagauguguggug

SEQ ID NO: 208037 - RNA, 22 nt, Human
ggguuuguuccuacuucuacuc

SEQ ID NO: 208038 - RNA, 22 nt, Human
gggauacuuuguuucccugcca

SEQ ID NO: 208039 - RNA, 20 nt, Human
gggaucgaguaccuccgggu

SEQ ID NO: 208040 - RNA, 22 nt, Human
gggagccagcagggcauggagc

SEQ ID NO: 208041 - RNA, 22 nt, Human
gggaugaaugccuggcuccccc

SEQ ID NO: 208042 - RNA, 22 nt, Human
gcuuuugaauacuacaggaguu

SEQ ID NO: 208043 - RNA, 19 nt, Human
gggagaaaaucuuuauccu

SEQ ID NO: 208044 - RNA, 22 nt, Human
gggacugguuguguguggugug

SEQ ID NO: 208045 - RNA, 22 nt, Human
gcugagaguguaggauguuuac

SEQ ID NO: 208046 - RNA, 22 nt, Human
gggagauuuguguaggaaaacu

SEQ ID NO: 208047 - RNA, 22 nt, Human
gcuuguuagcaaugcagaaucu

SEQ ID NO: 208048 - RNA, 22 nt, Human
gcuuucagggucacugucaaca

SEQ ID NO: 208049 - RNA, 22 nt, Human
gggcaggacccguuagaguggc

SEQ ID NO: 208050 - RNA, 22 nt, Human
gggcaggcuggguggugguccc

SEQ ID NO: 208051 - RNA, 22 nt, Human
gggcagagagcuggaacuccuu

SEQ ID NO: 208052 - RNA, 22 nt, Human
ggaaaggggaaaauacagagag

SEQ ID NO: 208053 - RNA, 22 nt, Human
ggaaauauaagcaguuugugug

SEQ ID NO: 208054 - RNA, 22 nt, Human
ggaaauguguguaagaaaguau

SEQ ID NO: 208055 - RNA, 22 nt, Human
ggaagauagaaguucaaaaguu

SEQ ID NO: 208056 - RNA, 22 nt, Human
gggccaggaugugguucauuuu

SEQ ID NO: 208057 - RNA, 22 nt, Human
gggccgcagccucuccggccug

SEQ ID NO: 208058 - RNA, 22 nt, Human
gggcccggguaggggaagagag

SEQ ID NO: 208059 - RNA, 20 nt, Human
gggccagguggaccaggggc

SEQ ID NO: 208060 - RNA, 21 nt, Human
ggaauagcuuaaagugagggg

SEQ ID NO: 208061 - RNA, 22 nt, Human
ggaaucuucagccaugccaaga

SEQ ID NO: 208062 - RNA, 22 nt, Human
gggccugcgcuggggggagccg

SEQ ID NO: 208063 - RNA, 22 nt, Human
gggccggagaagguagcugaag

SEQ ID NO: 208064 - RNA, 22 nt, Human
ggaagcugucugcccggcgcuc

SEQ ID NO: 208065 - RNA, 22 nt, Human
ggaagcucaauacuuuccucuu

SEQ ID NO: 208066 - RNA, 22 nt, Human
ggacccagggcuuauucauguu

SEQ ID NO: 208067 - RNA, 22 nt, Human
gggcuuaaccuggguaugaggg

SEQ ID NO: 208068 - RNA, 22 nt, Human
ggacggggagcuggaaagggga

SEQ ID NO: 208069 - RNA, 23 nt, Human
ggacuaggcaacagaugggacag

SEQ ID NO: 208070 - RNA, 19 nt, Human
gggcuuguuggcaaaugac

SEQ ID NO: 208071 - RNA, 22 nt, Human
ggaauuaagaggcuggacaggg

SEQ ID NO: 208072 - RNA, 22 nt, Human
ggaaugcuuggcaugagaaccu

SEQ ID NO: 208073 - RNA, 22 nt, Human
ggaccagagcuaaugcgcgccc

SEQ ID NO: 208074 - RNA, 22 nt, Human
gggaagaacugauuucacacca

SEQ ID NO: 208075 - RNA, 22 nt, Human
gggaacuguaguuuacgcugcc

SEQ ID NO: 208076 - RNA, 22 nt, Human
gcuucccacagcuggacugggg

SEQ ID NO: 208077 - RNA, 22 nt, Human
gcuuauugcuuauagauaggaa

SEQ ID NO: 208078 - RNA, 22 nt, Human
gcuuaggcgcuccuuuucacuc

SEQ ID NO: 208079 - RNA, 22 nt, Human
gcuuauuagguuauuucaagga

SEQ ID NO: 208080 - RNA, 22 nt, Human
gggacugcgagauucucaaggg

SEQ ID NO: 208081 - RNA, 22 nt, Human
gggacgggcuagcugccguggc

SEQ ID NO: 208082 - RNA, 20 nt, Human
gcuugcggacagguggcuca

SEQ ID NO: 208083 - RNA, 22 nt, Human
gcuugaggaacucagacuugag

SEQ ID NO: 208084 - RNA, 20 nt, Human
gcuugaauuugauggccaga

SEQ ID NO: 208085 - RNA, 22 nt, Human
gggaagugcaguuuucuuuugg

SEQ ID NO: 208086 - RNA, 20 nt, Human
gggaauggauggauugcucc

SEQ ID NO: 208087 - RNA, 19 nt, Human
ggccacacuauuaaaagau

SEQ ID NO: 208088 - RNA, 22 nt, Human
ggccaaagagcacaaugaauag

SEQ ID NO: 208089 - RNA, 21 nt, Human
ggccagauucucccauagcug

SEQ ID NO: 208090 - RNA, 22 nt, Human
gcugagcagcgaaggcacaugc

SEQ ID NO: 208091 - RNA, 22 nt, Human
ggcuuugggaggaugaggcggu

SEQ ID NO: 208092 - RNA, 22 nt, Human
gggaaaaaggaaccuuauuacu

SEQ ID NO: 208093 - RNA, 22 nt, Human
gcuguguucauccugcccaggu

SEQ ID NO: 208094 - RNA, 22 nt, Human
gcuguggguuccuccccugucc

SEQ ID NO: 208095 - RNA, 22 nt, Human
gcuguuggaggaguucagugcu

SEQ ID NO: 208096 - RNA, 22 nt, Human
ggcuuguccuucugguugucuu

SEQ ID NO: 208097 - RNA, 22 nt, Human
gcuguugcaaucaaggccaugg

SEQ ID NO: 208098 - RNA, 22 nt, Human
gggaaaaaggaguuagagauaa

SEQ ID NO: 208099 - RNA, 23 nt, Human
gggaaaucaaaagauauuucuuc

SEQ ID NO: 208100 - RNA, 22 nt, Human
gggaaauagagcuggaaccuug

SEQ ID NO: 208101 - RNA, 22 nt, Human
gggaaaauguuucugagacaaa

SEQ ID NO: 208102 - RNA, 22 nt, Human
gcuuagaugcugucauucacca

SEQ ID NO: 208103 - RNA, 22 nt, Human
gggaaaugugucuuggcauucu

SEQ ID NO: 208104 - RNA, 22 nt, Human
gggaacccaaauaggaaaauug

SEQ ID NO: 208105 - RNA, 22 nt, Human
gucuguuggcacagggggaggu

SEQ ID NO: 208106 - RNA, 22 nt, Human
gucuuucuuuuacauauuugug

SEQ ID NO: 208107 - RNA, 22 nt, Human
gucuucugacacuguuaggagg

SEQ ID NO: 208108 - RNA, 22 nt, Human
ggcuggggccuguugaagaugc

SEQ ID NO: 208109 - RNA, 18 nt, Human
ggcugggcugugccccuu

SEQ ID NO: 208110 - RNA, 22 nt, Human
gucuuugagccucaguuuccuc

SEQ ID NO: 208111 - RNA, 22 nt, Human
ggcuguggcagcuggaaguggu

SEQ ID NO: 208112 - RNA, 21 nt, Human
ggcuguuaauagugauuagaa

SEQ ID NO: 208113 - RNA, 22 nt, Human
ggcuuaguagggacagaugcac

SEQ ID NO: 208114 - RNA, 22 nt, Human
gugaagcaagggucaccugugg

SEQ ID NO: 208115 - RNA, 22 nt, Human
ggcuucucuuggccaugguccc

SEQ ID NO: 208116 - RNA, 22 nt, Human
ggcuucuuaacauuuggacacc

SEQ ID NO: 208117 - RNA, 22 nt, Human
ggcuuuuguuauaaucaggccu

SEQ ID NO: 208118 - RNA, 22 nt, Human
ggcuuguaggugauggagaacu

SEQ ID NO: 208119 - RNA, 19 nt, Human
ggcuuugcccuucgcuccg

SEQ ID NO: 208120 - RNA, 23 nt, Human
gugaacaaugcuccaggagauac

SEQ ID NO: 208121 - RNA, 22 nt, Human
gugaaaugaagugacuggauau

SEQ ID NO: 208122 - RNA, 22 nt, Human
gugaaauuguacacucaguacc

SEQ ID NO: 208123 - RNA, 22 nt, Human
ggcuuaugaucugacccaucga

SEQ ID NO: 208124 - RNA, 19 nt, Human
gugauauuuauuauuuauu

SEQ ID NO: 208125 - RNA, 22 nt, Human
gggaagaagaaaagagguggga

SEQ ID NO: 208126 - RNA, 21 nt, Human
gggaagagaagagaaaggagg

SEQ ID NO: 208127 - RNA, 22 nt, Human
gggaagagggagcuggaaugau

SEQ ID NO: 208128 - RNA, 22 nt, Human
gggaagccugggugauccuaaa

SEQ ID NO: 208129 - RNA, 18 nt, Human
gggaagaugccacaguga

SEQ ID NO: 208130 - RNA, 22 nt, Human
gggaagaaccucugcuaccaau

SEQ ID NO: 208131 - RNA, 22 nt, Human
gugaguuuucgugacacuauuu

SEQ ID NO: 208132 - RNA, 22 nt, Human
gugauauaacaauuuagggaau

SEQ ID NO: 208133 - RNA, 22 nt, Human
ggcuuuuucccuaggguaagag

SEQ ID NO: 208134 - RNA, 22 nt, Human
gugaaggggaagcagggagagg

SEQ ID NO: 208135 - RNA, 21 nt, Human
gugaccuguuaugcaaaggca

SEQ ID NO: 208136 - RNA, 22 nt, Human
gggaaaucugcuuccuagggcu

SEQ ID NO: 208137 - RNA, 22 nt, Human
gugacugagcuggcaaaguaug

SEQ ID NO: 208138 - RNA, 22 nt, Human
gugcugcaaggauggagaggca

SEQ ID NO: 208139 - RNA, 22 nt, Human
gggcaagaagcuggaagcauuc

SEQ ID NO: 208140 - RNA, 22 nt, Human
gggauuuaaugggaaaaauaug

SEQ ID NO: 208141 - RNA, 22 nt, Human
gugcucaagacauuaggaauau

SEQ ID NO: 208142 - RNA, 22 nt, Human
gugccgaugaggccuggcauuc

SEQ ID NO: 208143 - RNA, 22 nt, Human
gggagggaggagccccggccau

SEQ ID NO: 208144 - RNA, 22 nt, Human
gugccgcuggagcuggaauuga

SEQ ID NO: 208145 - RNA, 22 nt, Human
gggagguaaugggggugcaggg

SEQ ID NO: 208146 - RNA, 22 nt, Human
gggagggggauucuggcgagaa

SEQ ID NO: 208147 - RNA, 22 nt, Human
gggaguggagagugaagcuaau

SEQ ID NO: 208148 - RNA, 21 nt, Human
gggagugaguaaugauggggg

SEQ ID NO: 208149 - RNA, 22 nt, Human
gggagcucaccaugcucugcau

SEQ ID NO: 208150 - RNA, 22 nt, Human
gggagcccuggacgggcgguau

SEQ ID NO: 208151 - RNA, 21 nt, Human
gggagccucauuuucuucauc

SEQ ID NO: 208152 - RNA, 22 nt, Human
gggagcuggagcuggaagacuc

SEQ ID NO: 208153 - RNA, 22 nt, Human
gugccaaauagcuugauuaaga

SEQ ID NO: 208154 - RNA, 22 nt, Human
gugcagcugguggagucugggg

SEQ ID NO: 208155 - RNA, 22 nt, Human
gugauuucaaauauagagugag

SEQ ID NO: 208156 - RNA, 22 nt, Human
gugcaaugaguguggcaaagcc

SEQ ID NO: 208157 - RNA, 22 nt, Human
gugauucaucuggggccuuauu

SEQ ID NO: 208158 - RNA, 22 nt, Human
gggacaggacuccuggggccug

SEQ ID NO: 208159 - RNA, 22 nt, Human
gggacagcuggggguaaagcau

SEQ ID NO: 208160 - RNA, 19 nt, Human
gugaugaugccacuccaac

SEQ ID NO: 208161 - RNA, 22 nt, Human
gugauggggagagcgcagcuuu

SEQ ID NO: 208162 - RNA, 22 nt, Human
gugauggucgagcgcuuguugu

SEQ ID NO: 208163 - RNA, 22 nt, Human
guaugugucuuagaacuuggga

SEQ ID NO: 208164 - RNA, 22 nt, Human
ggcgccugguauucuuccucuc

SEQ ID NO: 208165 - RNA, 22 nt, Human
guaucaggugugagcauuuuaa

SEQ ID NO: 208166 - RNA, 22 nt, Human
guauauccaauaggugaugaaa

SEQ ID NO: 208167 - RNA, 22 nt, Human
guaucugaaaaagaauucugac

SEQ ID NO: 208168 - RNA, 22 nt, Human
guauauuuaugagcauuagccu

SEQ ID NO: 208169 - RNA, 22 nt, Human
ggcgcaguguucgcccucucgc

SEQ ID NO: 208170 - RNA, 22 nt, Human
guaucuuuauuuuaauuaagau

SEQ ID NO: 208171 - RNA, 22 nt, Human
ggcgaugaggucuuagaaucua

SEQ ID NO: 208172 - RNA, 22 nt, Human
gguuuucacgauccucccuuuu

SEQ ID NO: 208173 - RNA, 22 nt, Human
gguuugggaagaacuauucccu

SEQ ID NO: 208174 - RNA, 21 nt, Human
gguuucugcaaaccuuguaca

SEQ ID NO: 208175 - RNA, 22 nt, Human
gguuuauucccacaaaggaagu

SEQ ID NO: 208176 - RNA, 22 nt, Human
gguuuucagaaugcaguccugu

SEQ ID NO: 208177 - RNA, 22 nt, Human
ggccagcuuugagcugcaggaa

SEQ ID NO: 208178 - RNA, 22 nt, Human
ggccaguauacaaacuuccggu

SEQ ID NO: 208179 - RNA, 22 nt, Human
ggccagucaaggggauccugaa

SEQ ID NO: 208180 - RNA, 22 nt, Human
guauaaauaucuauauuguuac

SEQ ID NO: 208181 - RNA, 22 nt, Human
ggcggugcgaggaugcagggcu

SEQ ID NO: 208182 - RNA, 22 nt, Human
ggcggcugcuccuugcccucgg

SEQ ID NO: 208183 - RNA, 22 nt, Human
ggcggcccaggugcuccaggcg

SEQ ID NO: 208184 - RNA, 22 nt, Human
gucagugcuuuaguucaggaug

SEQ ID NO: 208185 - RNA, 19 nt, Human
gucagucuuaaguuucagc

SEQ ID NO: 208186 - RNA, 22 nt, Human
ggcggcaagggaauggagaaga

SEQ ID NO: 208187 - RNA, 20 nt, Human
gucagaggacccuagagcga

SEQ ID NO: 208188 - RNA, 22 nt, Human
gucagacucuggggccccaggc

SEQ ID NO: 208189 - RNA, 22 nt, Human
gucaggaugagggaugaggagu

SEQ ID NO: 208190 - RNA, 22 nt, Human
gucagauucuuucauuugcuga

SEQ ID NO: 208191 - RNA, 23 nt, Human
gucagcuugaccaguggagaguc

SEQ ID NO: 208192 - RNA, 22 nt, Human
guauuuggacugccuguucauu

SEQ ID NO: 208193 - RNA, 22 nt, Human
gucaaaggcggugcaggaggag

SEQ ID NO: 208194 - RNA, 22 nt, Human
guauuugacaccagugaauggu

SEQ ID NO: 208195 - RNA, 22 nt, Human
guauuaugaaugccgaggcggc

SEQ ID NO: 208196 - RNA, 22 nt, Human
guaugugugcauacauguacga

SEQ ID NO: 208197 - RNA, 22 nt, Human
ggcugcagggaacaggaugggu

SEQ ID NO: 208198 - RNA, 22 nt, Human
guccugauggccauuuuucacu

SEQ ID NO: 208199 - RNA, 22 nt, Human
guccuguccugcugagcuccug

SEQ ID NO: 208200 - RNA, 22 nt, Human
ggcugagguguggggaacuaua

SEQ ID NO: 208201 - RNA, 22 nt, Human
ggcgggucuagggcccuggagu

SEQ ID NO: 208202 - RNA, 22 nt, Human
ggcgucuugcgggcgguagcgc

SEQ ID NO: 208203 - RNA, 23 nt, Human
ggcgugcugggcugacccuuggc

SEQ ID NO: 208204 - RNA, 22 nt, Human
ggcuccagauguccccuggcaa

SEQ ID NO: 208205 - RNA, 22 nt, Human
ggcuauuguuuuaaaaaaugag

SEQ ID NO: 208206 - RNA, 22 nt, Human
gucaugaugauacagguggagg

SEQ ID NO: 208207 - RNA, 22 nt, Human
gucaucugagggacgagauuuc

SEQ ID NO: 208208 - RNA, 22 nt, Human
guccaugugcuaacagugcuua

SEQ ID NO: 208209 - RNA, 19 nt, Human
guccaaauggaaccccuug

SEQ ID NO: 208210 - RNA, 22 nt, Human
guccaggucauuuaaaaagucc

SEQ ID NO: 208211 - RNA, 22 nt, Human
guccagaguagucgaguauucu

SEQ ID NO: 208212 - RNA, 22 nt, Human
ggcuggaacuucuucuggcauu

SEQ ID NO: 208213 - RNA, 22 nt, Human
gucguucugcuauucuaugagg

SEQ ID NO: 208214 - RNA, 22 nt, Human
ggcugcuauuggucuggcuugg

SEQ ID NO: 208215 - RNA, 22 nt, Human
ggcugcuugggcuguuucuuuu

SEQ ID NO: 208216 - RNA, 17 nt, Human
ggcugccaggcaacaua

SEQ ID NO: 208217 - RNA, 22 nt, Human
gucgucgcucccaccuuccgcu

SEQ ID NO: 208218 - RNA, 22 nt, Human
gucgcuuuccugaggggucuca

SEQ ID NO: 208219 - RNA, 22 nt, Human
guccuuuuuuuauacccaggcc

SEQ ID NO: 208220 - RNA, 22 nt, Human
gucuggagccacugcugcugcu

SEQ ID NO: 208221 - RNA, 22 nt, Human
ggcugggaggcggaggcugaga

SEQ ID NO: 208222 - RNA, 22 nt, Human
ggcuggagcaggcugcacagug

SEQ ID NO: 208223 - RNA, 22 nt, Human
ggcuggacuuucugcugggcuc

SEQ ID NO: 208224 - RNA, 22 nt, Human
gucuccugcccacccugguccc

SEQ ID NO: 208225 - RNA, 22 nt, Human
gucuauuuauagacagauccua

SEQ ID NO: 208226 - RNA, 23 nt, Human
gucucacaaccaccugagaaaau

SEQ ID NO: 208227 - RNA, 22 nt, Human
gucugcagcacugugcacgguc

SEQ ID NO: 208228 - RNA, 22 nt, Human
gucucuuuugauuuuucacuca

SEQ ID NO: 208229 - RNA, 22 nt, Human
gucugaaauaucuuuugucuug

SEQ ID NO: 208230 - RNA, 22 nt, Human
ggugaaggaucccucuuggccu

SEQ ID NO: 208231 - RNA, 22 nt, Human
ggugagagaaaagaaacacugu

SEQ ID NO: 208232 - RNA, 18 nt, Human
ggugagggagcuggaagc

SEQ ID NO: 208233 - RNA, 23 nt, Human
ggugagccuuucuaguagucuug

SEQ ID NO: 208234 - RNA, 22 nt, Human
ggugaguagaaguaguuggcuu

SEQ ID NO: 208235 - RNA, 22 nt, Human
guuucucuuugguggguugaga

SEQ ID NO: 208236 - RNA, 22 nt, Human
guuucuguguugauugugcccu

SEQ ID NO: 208237 - RNA, 22 nt, Human
guuugaacagaaggguugauca

SEQ ID NO: 208238 - RNA, 22 nt, Human
guuugagcaaucccucuauccc

SEQ ID NO: 208239 - RNA, 19 nt, Human
ggucugcggggugaccgug

SEQ ID NO: 208240 - RNA, 22 nt, Human
ggucuuauaauuaauuuaggcu

SEQ ID NO: 208241 - RNA, 20 nt, Human
ggucuguuucuucuuuucau

SEQ ID NO: 208242 - RNA, 22 nt, Human
ggucucugggacguuggaucgc

SEQ ID NO: 208243 - RNA, 22 nt, Human
ggucugauaccugcagguuguc

SEQ ID NO: 208244 - RNA, 22 nt, Human
guuguugucauuagcuguuuaa

SEQ ID NO: 208245 - RNA, 22 nt, Human
guuguuuuuguuaaaacaguga

SEQ ID NO: 208246 - RNA, 22 nt, Human
ggucuucauucuaccagacuuu

SEQ ID NO: 208247 - RNA, 22 nt, Human
guuuaagcagauugcuguggug

SEQ ID NO: 208248 - RNA, 20 nt, Human
guugggagaagugucagcug

SEQ ID NO: 208249 - RNA, 22 nt, Human
guugggugccagaggcuucacg

SEQ ID NO: 208250 - RNA, 22 nt, Human
guugggguuucaguggcaguca

SEQ ID NO: 208251 - RNA, 22 nt, Human
guugggcugaagugugugcuua

SEQ ID NO: 208252 - RNA, 22 nt, Human
guugcuucuuggcuuuuccaac

SEQ ID NO: 208253 - RNA, 22 nt, Human
gugcuugaguaaaaauagucuu

SEQ ID NO: 208254 - RNA, 22 nt, Human
gugcugucguggaacugggcug

SEQ ID NO: 208255 - RNA, 22 nt, Human
gugcuguuagcgguuuauaaca

SEQ ID NO: 208256 - RNA, 22 nt, Human
gugcuggcaaagagaacaucuu

SEQ ID NO: 208257 - RNA, 22 nt, Human
guuguuuucagcccagcauuag

SEQ ID NO: 208258 - RNA, 22 nt, Human
ggucgguuggagagaucaugaa

SEQ ID NO: 208259 - RNA, 22 nt, Human
ggucggggcuggccggcguggu

SEQ ID NO: 208260 - RNA, 22 nt, Human
ggucgucuguccugucgccgcu

SEQ ID NO: 208261 - RNA, 19 nt, Human
gguccguuacaggcuuucc

SEQ ID NO: 208262 - RNA, 22 nt, Human
ggucgagcagcacccguucggc

SEQ ID NO: 208263 - RNA, 22 nt, Human
ggucaucacugagagcagaucc

SEQ ID NO: 208264 - RNA, 22 nt, Human
guugucguucccccugcuuaaa

SEQ ID NO: 208265 - RNA, 22 nt, Human
ggugcugcugcugaacccagcu

SEQ ID NO: 208266 - RNA, 22 nt, Human
guuuggguggcuagagaaagaa

SEQ ID NO: 208267 - RNA, 22 nt, Human
ggugcguggcccauccuccacc

SEQ ID NO: 208268 - RNA, 19 nt, Human
ggugaucugucccuugcuc

SEQ ID NO: 208269 - RNA, 22 nt, Human
ggugcaaagauggcaguugcaa

SEQ ID NO: 208270 - RNA, 22 nt, Human
ggugcaauaaaguuguagaacc

SEQ ID NO: 208271 - RNA, 22 nt, Human
ggugccugggcacggaaagcau

SEQ ID NO: 208272 - RNA, 22 nt, Human
gguguacgaagaggcgggaguc

SEQ ID NO: 208273 - RNA, 22 nt, Human
gguggggugagggggcgaggcc

SEQ ID NO: 208274 - RNA, 22 nt, Human
uaaaaauuagauauguauuuag

SEQ ID NO: 208275 - RNA, 22 nt, Human
ggugugugugugugugugugug

SEQ ID NO: 208276 - RNA, 22 nt, Human
uaaaacuaugcaaccuacuacc

SEQ ID NO: 208277 - RNA, 22 nt, Human
uaaaaccauucauugaccuaug

SEQ ID NO: 208278 - RNA, 22 nt, Human
gguugaagcuacuuucuggaug

SEQ ID NO: 208279 - RNA, 22 nt, Human
ggugugaauagagccuggagca

SEQ ID NO: 208280 - RNA, 22 nt, Human
ggugucucagauuguaaaaugu

SEQ ID NO: 208281 - RNA, 22 nt, Human
uaaaauaccacauauggugcuc

SEQ ID NO: 208282 - RNA, 22 nt, Human
gguuugccagugcuggaaugca

SEQ ID NO: 208283 - RNA, 22 nt, Human
gguuugauauguuugugauucu

SEQ ID NO: 208284 - RNA, 22 nt, Human
gguuucuuuccucucugugccu

SEQ ID NO: 208285 - RNA, 22 nt, Human
gguuuguggagcuggaaacacu

SEQ ID NO: 208286 - RNA, 22 nt, Human
guaagcagcaugacgguuggau

SEQ ID NO: 208287 - RNA, 22 nt, Human
uaaauaugcaugugguauucau

SEQ ID NO: 208288 - RNA, 22 nt, Human
gguuuucuuguucauuuuuuaa

SEQ ID NO: 208289 - RNA, 22 nt, Human
uaaaugaaaggguuuaauuuau

SEQ ID NO: 208290 - RNA, 20 nt, Human
gucguguauauagcuggggc

SEQ ID NO: 208291 - RNA, 22 nt, Human
gucgagcuggaggagcgaaugg

SEQ ID NO: 208292 - RNA, 22 nt, Human
uaauuucauuuugcaaugaucu

SEQ ID NO: 208293 - RNA, 22 nt, Human
gucgagaacauucauuaugcaa

SEQ ID NO: 208294 - RNA, 22 nt, Human
gucuggugguggguguagggca

SEQ ID NO: 208295 - RNA, 22 nt, Human
gucugcuuuuaucacaugucau

SEQ ID NO: 208296 - RNA, 22 nt, Human
gucugguggaguuguauauacu

SEQ ID NO: 208297 - RNA, 22 nt, Human
uaauuuugucacagugacaugc

SEQ ID NO: 208298 - RNA, 22 nt, Human
gucugcucauguuugguuugug

SEQ ID NO: 208299 - RNA, 22 nt, Human
gugaaaaauggccaucaggaca

SEQ ID NO: 208300 - RNA, 22 nt, Human
uacauuccagaaaguuucugua

SEQ ID NO: 208301 - RNA, 22 nt, Human
gucuugugaagacggcagaaag

SEQ ID NO: 208302 - RNA, 22 nt, Human
uacauagaauauauaaaugucg

SEQ ID NO: 208303 - RNA, 22 nt, Human
uacauaauucauuagcuccucu

SEQ ID NO: 208304 - RNA, 22 nt, Human
uacauaauagcaaggugcuguc

SEQ ID NO: 208305 - RNA, 22 nt, Human
uacagauaaaaaugcuguucuu

SEQ ID NO: 208306 - RNA, 22 nt, Human
uaccaauuaaauagccaaucua

SEQ ID NO: 208307 - RNA, 22 nt, Human
uacuucccacuggggucuacca

SEQ ID NO: 208308 - RNA, 22 nt, Human
uacuucauucaaguucgcuaua

SEQ ID NO: 208309 - RNA, 22 nt, Human
gugaaacuggaugugaaaacaa

SEQ ID NO: 208310 - RNA, 22 nt, Human
uacugguguauuucuucuuauu

SEQ ID NO: 208311 - RNA, 22 nt, Human
uacuggguguucugagaaaaua

SEQ ID NO: 208312 - RNA, 22 nt, Human
gugaaaauaguaaccuggcuag

SEQ ID NO: 208313 - RNA, 22 nt, Human
uaccugguuucuuaaacccaaa

SEQ ID NO: 208314 - RNA, 22 nt, Human
uaccuuuuuauucuuaaggccg

SEQ ID NO: 208315 - RNA, 22 nt, Human
uaccgcagagucauugugagga

SEQ ID NO: 208316 - RNA, 22 nt, Human
uacuuuaauugcaaaaauaaau

SEQ ID NO: 208317 - RNA, 22 nt, Human
uacuugaaaugggcaucaagag

SEQ ID NO: 208318 - RNA, 22 nt, Human
uacuugaacaucacuaagagaa

SEQ ID NO: 208319 - RNA, 22 nt, Human
uacuugcaaggcucuuggaaua

SEQ ID NO: 208320 - RNA, 22 nt, Human
uacuuuuuucacuucuagcccc

SEQ ID NO: 208321 - RNA, 22 nt, Human
gugaagguccugauuugugacc

SEQ ID NO: 208322 - RNA, 20 nt, Human
gugaaguuuucugaagacag

SEQ ID NO: 208323 - RNA, 22 nt, Human
gugaaggcaugugugcugugcu

SEQ ID NO: 208324 - RNA, 22 nt, Human
gugaccagacagagucuagccc

SEQ ID NO: 208325 - RNA, 22 nt, Human
uaauucuucaauccaguguuca

SEQ ID NO: 208326 - RNA, 22 nt, Human
uaauuuagugcauuuccuagua

SEQ ID NO: 208327 - RNA, 22 nt, Human
guccuguguaaguacuugcuca

SEQ ID NO: 208328 - RNA, 22 nt, Human
guccuuaaauacgaugaacaug

SEQ ID NO: 208329 - RNA, 22 nt, Human
guccuucgcggcugaggccauu

SEQ ID NO: 208330 - RNA, 22 nt, Human
guccuuuauuugaacaugacau

SEQ ID NO: 208331 - RNA, 22 nt, Human
guccuguccuguccuggagaca

SEQ ID NO: 208332 - RNA, 22 nt, Human
guccuggagcagcuggaagaug

SEQ ID NO: 208333 - RNA, 22 nt, Human
guccuggugccaccugcgggau

SEQ ID NO: 208334 - RNA, 22 nt, Human
guccugaaaaaaaucccugagu

SEQ ID NO: 208335 - RNA, 22 nt, Human
guccucgugucuuuuucucuaa

SEQ ID NO: 208336 - RNA, 23 nt, Human
gucauuacuguuaccuuauucuu

SEQ ID NO: 208337 - RNA, 22 nt, Human
guccaguaguguuugcaugugg

SEQ ID NO: 208338 - RNA, 22 nt, Human
guccaucuugcaaugagaccua

SEQ ID NO: 208339 - RNA, 22 nt, Human
uaaugaugaacacuuggaagaa

SEQ ID NO: 208340 - RNA, 22 nt, Human
uaauccaaaccaggaauucccu

SEQ ID NO: 208341 - RNA, 22 nt, Human
uaauccaaaacugaaucugugg

SEQ ID NO: 208342 - RNA, 22 nt, Human
guccguaauuuuugcuugcaga

SEQ ID NO: 208343 - RNA, 22 nt, Human
uaauauauuuuuuaagggaugu

SEQ ID NO: 208344 - RNA, 22 nt, Human
uaagugcuagaauuccagguuu

SEQ ID NO: 208345 - RNA, 22 nt, Human
gucacgucgggacagacugggg

SEQ ID NO: 208346 - RNA, 22 nt, Human
uaagucaagagcuagaaaaagc

SEQ ID NO: 208347 - RNA, 22 nt, Human
gucaggugcaccuccaccaaca

SEQ ID NO: 208348 - RNA, 20 nt, Human
gucaucucagggacugucug

SEQ ID NO: 208349 - RNA, 19 nt, Human
uaaguagaugacugaugcu

SEQ ID NO: 208350 - RNA, 22 nt, Human
uaaggcuuuggucaccauggag

SEQ ID NO: 208351 - RNA, 22 nt, Human
uaagcacuuuauaugcuuuauc

SEQ ID NO: 208352 - RNA, 22 nt, Human
uaaggagagaauuuagagguuu

SEQ ID NO: 208353 - RNA, 22 nt, Human
uaagauggaagaaaaggcggau

SEQ ID NO: 208354 - RNA, 22 nt, Human
uaagauuuuuacaaauagagug

SEQ ID NO: 208355 - RNA, 22 nt, Human
uaagauauugagugguaauuug

SEQ ID NO: 208356 - RNA, 22 nt, Human
guauuggcaguauacauagcac

SEQ ID NO: 208357 - RNA, 22 nt, Human
uaagaaaggggaaguuccucuu

SEQ ID NO: 208358 - RNA, 21 nt, Human
uaagaacauuaucuucuuccu

SEQ ID NO: 208359 - RNA, 22 nt, Human
guauucugugugaucaagugau

SEQ ID NO: 208360 - RNA, 22 nt, Human
guauugauuguuuuaaaagauu

SEQ ID NO: 208361 - RNA, 22 nt, Human
guaugaguggauagauguaucu

SEQ ID NO: 208362 - RNA, 22 nt, Human
guacuugauucauuauugcauu

SEQ ID NO: 208363 - RNA, 22 nt, Human
guagaacucuuuccugcguggg

SEQ ID NO: 208364 - RNA, 22 nt, Human
guagaaaauagauugucucuug

SEQ ID NO: 208365 - RNA, 22 nt, Human
gugguaaagugugccugugguc

SEQ ID NO: 208366 - RNA, 22 nt, Human
gugggugauacugccgugggag

SEQ ID NO: 208367 - RNA, 22 nt, Human
guggugaacauuugcaucugcu

SEQ ID NO: 208368 - RNA, 22 nt, Human
gugguggggaguuggauggaag

SEQ ID NO: 208369 - RNA, 22 nt, Human
uaucaguccaggguuuugugac

SEQ ID NO: 208370 - RNA, 22 nt, Human
gugguuugcugguguacguuua

SEQ ID NO: 208371 - RNA, 22 nt, Human
gugguuuagccuucauuaaccu

SEQ ID NO: 208372 - RNA, 22 nt, Human
gugguggugaggcaaggggugu

SEQ ID NO: 208373 - RNA, 22 nt, Human
uaucauuuuacugugacauuuu

SEQ ID NO: 208374 - RNA, 22 nt, Human
uaucauuaggagugcugcucgg

SEQ ID NO: 208375 - RNA, 22 nt, Human
uaugccaccagucuggaacucu

SEQ ID NO: 208376 - RNA, 22 nt, Human
uauggacagcuuucuuuguguu

SEQ ID NO: 208377 - RNA, 22 nt, Human
uaugcuguauucuguauguuag

SEQ ID NO: 208378 - RNA, 22 nt, Human
uaucuuugccuuggguuuuguu

SEQ ID NO: 208379 - RNA, 22 nt, Human
uauccaucuucuuugagaaugg

SEQ ID NO: 208380 - RNA, 22 nt, Human
uaugaaagguuuuuucuugaaa

SEQ ID NO: 208381 - RNA, 22 nt, Human
uaugaaggauacaccucugauu

SEQ ID NO: 208382 - RNA, 22 nt, Human
uauguggcaggugggagaucag

SEQ ID NO: 208383 - RNA, 22 nt, Human
uaugugguuugucauuuaauau

SEQ ID NO: 208384 - RNA, 22 nt, Human
guuaaaggaagccauauguucg

SEQ ID NO: 208385 - RNA, 22 nt, Human
guuaaaaugauuugugauuuau

SEQ ID NO: 208386 - RNA, 22 nt, Human
uaugugaguaccugucaugugc

SEQ ID NO: 208387 - RNA, 20 nt, Human
uaugugcaguuugguuuauc

SEQ ID NO: 208388 - RNA, 22 nt, Human
uauguuaauuaccagcacugau

SEQ ID NO: 208389 - RNA, 22 nt, Human
guuaucauccucagaggcaguu

SEQ ID NO: 208390 - RNA, 22 nt, Human
uauguuugcaguucuaggucuu

SEQ ID NO: 208391 - RNA, 22 nt, Human
guguuuauguuuuugcuaggga

SEQ ID NO: 208392 - RNA, 22 nt, Human
guguucuuuaugguuguagugu

SEQ ID NO: 208393 - RNA, 19 nt, Human
guguucuguuauacaguug

SEQ ID NO: 208394 - RNA, 22 nt, Human
uauucagugcugguucuuuuuc

SEQ ID NO: 208395 - RNA, 22 nt, Human
uauuaugguuguagguuaacaa

SEQ ID NO: 208396 - RNA, 22 nt, Human
uauuagggaacugcaagacuaa

SEQ ID NO: 208397 - RNA, 22 nt, Human
guuauuaaauauuuuggugauu

SEQ ID NO: 208398 - RNA, 22 nt, Human
guuccucugugguggaggaagg

SEQ ID NO: 208399 - RNA, 22 nt, Human
guuccucugaaggauuuucaga

SEQ ID NO: 208400 - RNA, 22 nt, Human
guuccugagcaguuccuggcca

SEQ ID NO: 208401 - RNA, 22 nt, Human
uauugguagauggagagagaca

SEQ ID NO: 208402 - RNA, 17 nt, Human
guucucaaacugacuga

SEQ ID NO: 208403 - RNA, 22 nt, Human
uauuuguuuuuaaugcugggug

SEQ ID NO: 208404 - RNA, 22 nt, Human
guucuucucuuguaauggaauc

SEQ ID NO: 208405 - RNA, 22 nt, Human
guucucuuaauccuaguuggua

SEQ ID NO: 208406 - RNA, 22 nt, Human
guucucuccugcuggugaugga

SEQ ID NO: 208407 - RNA, 22 nt, Human
guucuguucuucacagguuugu

SEQ ID NO: 208408 - RNA, 22 nt, Human
uauuuccugcguuucugugagc

SEQ ID NO: 208409 - RNA, 22 nt, Human
guugcggaguguagcgaugcuu

SEQ ID NO: 208410 - RNA, 22 nt, Human
guugcuaugaaauuaaaauuua

SEQ ID NO: 208411 - RNA, 22 nt, Human
guuggcgaaggaccuggaggag

SEQ ID NO: 208412 - RNA, 22 nt, Human
guuggaaauaucagucacguga

SEQ ID NO: 208413 - RNA, 22 nt, Human
guugccugguuucaaaaggaau

SEQ ID NO: 208414 - RNA, 22 nt, Human
uauuuuuuuaacauuuauugua

SEQ ID NO: 208415 - RNA, 22 nt, Human
uauuuuuguuuaccaguuaaca

SEQ ID NO: 208416 - RNA, 22 nt, Human
ucaaccagcuuaucugcaggau

SEQ ID NO: 208417 - RNA, 22 nt, Human
ucaacauguuuuuuaaaagaaa

SEQ ID NO: 208418 - RNA, 22 nt, Human
guugggauugaaggugccucua

SEQ ID NO: 208419 - RNA, 22 nt, Human
ucaaaggcuugugguucuggga

SEQ ID NO: 208420 - RNA, 22 nt, Human
ucaaauaugggccagaggaaau

SEQ ID NO: 208421 - RNA, 22 nt, Human
ucaaagaucuuugcuuuugggg

SEQ ID NO: 208422 - RNA, 22 nt, Human
ucaagaagauaaugucuagggu

SEQ ID NO: 208423 - RNA, 21 nt, Human
ucaaccagguguugaaggcac

SEQ ID NO: 208424 - RNA, 22 nt, Human
guuggugagaguuagggauuua

SEQ ID NO: 208425 - RNA, 22 nt, Human
guggcgucgaugauggugucau

SEQ ID NO: 208426 - RNA, 22 nt, Human
guggccuuccuguuccuuugaa

SEQ ID NO: 208427 - RNA, 22 nt, Human
guggccugacagaucggaacag

SEQ ID NO: 208428 - RNA, 22 nt, Human
guggcuugguauuaaggugcca

SEQ ID NO: 208429 - RNA, 22 nt, Human
guggcuuaauauuuauagcaga

SEQ ID NO: 208430 - RNA, 22 nt, Human
guggcuuucuaccauuaaauug

SEQ ID NO: 208431 - RNA, 22 nt, Human
uagguuuugugucagaguagaa

SEQ ID NO: 208432 - RNA, 22 nt, Human
uaggucuuggagguggggcugg

SEQ ID NO: 208433 - RNA, 22 nt, Human
uaguaauauuccuacauuaugu

SEQ ID NO: 208434 - RNA, 22 nt, Human
uaggcaauauuagacuuugucu

SEQ ID NO: 208435 - RNA, 22 nt, Human
uaggcagggauuaggguugauu

SEQ ID NO: 208436 - RNA, 22 nt, Human
guggcaguaaagcuggaaaagu

SEQ ID NO: 208437 - RNA, 22 nt, Human
guggcauggggagcagcuagaa

SEQ ID NO: 208438 - RNA, 22 nt, Human
guggcaaguuuucugacaagga

SEQ ID NO: 208439 - RNA, 22 nt, Human
guggcagagccuugcggcuuug

SEQ ID NO: 208440 - RNA, 22 nt, Human
uagugauuuaagaaaggugacu

SEQ ID NO: 208441 - RNA, 22 nt, Human
uagucucagaauauuugcugau

SEQ ID NO: 208442 - RNA, 22 nt, Human
uagucggcuaggagggccuucu

SEQ ID NO: 208443 - RNA, 22 nt, Human
uagucaauuagaaagaggccuu

SEQ ID NO: 208444 - RNA, 22 nt, Human
gugggugaguggggccgccuga

SEQ ID NO: 208445 - RNA, 22 nt, Human
uagugggguccacuuccuucac

SEQ ID NO: 208446 - RNA, 22 nt, Human
uagugggauuuugaacaaaacc

SEQ ID NO: 208447 - RNA, 22 nt, Human
uaguggaaccuucuaaaugacg

SEQ ID NO: 208448 - RNA, 22 nt, Human
uagugcuucauucuauugguuu

SEQ ID NO: 208449 - RNA, 22 nt, Human
gugggaguggagcucagcaugu

SEQ ID NO: 208450 - RNA, 22 nt, Human
gugggggcagaagcgagugcag

SEQ ID NO: 208451 - RNA, 22 nt, Human
gugggggugaggaauguucuau

SEQ ID NO: 208452 - RNA, 22 nt, Human
guggggguaggggguuuccugg

SEQ ID NO: 208453 - RNA, 22 nt, Human
uaguaugaaaauuagcgggagg

SEQ ID NO: 208454 - RNA, 22 nt, Human
uagcugucauuggaucagaagg

SEQ ID NO: 208455 - RNA, 20 nt, Human
uagcuucaccuagagauagc

SEQ ID NO: 208456 - RNA, 21 nt, Human
uaggaacuguucugagugguc

SEQ ID NO: 208457 - RNA, 22 nt, Human
gugcucaucuucuguaacuguu

SEQ ID NO: 208458 - RNA, 22 nt, Human
gugcucgagcugugcgcgcugc

SEQ ID NO: 208459 - RNA, 22 nt, Human
gugcucuagaaauugucagugg

SEQ ID NO: 208460 - RNA, 22 nt, Human
uagcguaugcugugugaugaau

SEQ ID NO: 208461 - RNA, 22 nt, Human
uagcgggucacccugcugugaa

SEQ ID NO: 208462 - RNA, 19 nt, Human
uagcuguucuugaguguga

SEQ ID NO: 208463 - RNA, 22 nt, Human
uagcucuuaccagugaaguuug

SEQ ID NO: 208464 - RNA, 22 nt, Human
uagcugacagcagaagaguauu

SEQ ID NO: 208465 - RNA, 22 nt, Human
gugagaggaggcagcuuuuaca

SEQ ID NO: 208466 - RNA, 22 nt, Human
gugagagugguuuauguccaug

SEQ ID NO: 208467 - RNA, 22 nt, Human
uagaagaugccuuaaaguugaa

SEQ ID NO: 208468 - RNA, 22 nt, Human
uagaagagcuuccaccuggggc

SEQ ID NO: 208469 - RNA, 22 nt, Human
uagcauuucacugaucuucacu

SEQ ID NO: 208470 - RNA, 22 nt, Human
uagccuguuuuuaugagaauuu

SEQ ID NO: 208471 - RNA, 22 nt, Human
uagccucauuauuuacucauga

SEQ ID NO: 208472 - RNA, 22 nt, Human
uaggcaaguggaccagagguuu

SEQ ID NO: 208473 - RNA, 22 nt, Human
uaggaagagauuuucacauggc

SEQ ID NO: 208474 - RNA, 22 nt, Human
guggaguggguuguacucaggg

SEQ ID NO: 208475 - RNA, 22 nt, Human
guggaggguuugcaaugugcag

SEQ ID NO: 208476 - RNA, 22 nt, Human
guggagaaauauguucagcuuc

SEQ ID NO: 208477 - RNA, 22 nt, Human
guggagaucuggugcccccugg

SEQ ID NO: 208478 - RNA, 22 nt, Human
guggaggaagaucuuugaugau

SEQ ID NO: 208479 - RNA, 22 nt, Human
gugcugcaugagcaucacguag

SEQ ID NO: 208480 - RNA, 22 nt, Human
gugcuuuaccuuauuggucucg

SEQ ID NO: 208481 - RNA, 22 nt, Human
gugcugggaggcccaggaugga

SEQ ID NO: 208482 - RNA, 22 nt, Human
gugcuuccuguauugauuccau

SEQ ID NO: 208483 - RNA, 22 nt, Human
guggaagauauuucugguccag

SEQ ID NO: 208484 - RNA, 22 nt, Human
guggaagggaaaccgcacuggc

SEQ ID NO: 208485 - RNA, 22 nt, Human
guggacuagaguaggaguugca

SEQ ID NO: 208486 - RNA, 22 nt, Human
guggagaaagcuggaaucugag

SEQ ID NO: 208487 - RNA, 22 nt, Human
uacguggcucguuaauuuccug

SEQ ID NO: 208488 - RNA, 22 nt, Human
uacguuuuauaucuuuuggaau

SEQ ID NO: 208489 - RNA, 22 nt, Human
uccagguccuacuggcccauag

SEQ ID NO: 208490 - RNA, 22 nt, Human
uaccuggauaaauguacaaccg

SEQ ID NO: 208491 - RNA, 22 nt, Human
uacguaauagcuuuauuuuggg

SEQ ID NO: 208492 - RNA, 22 nt, Human
uccaugcaguagaggcgcuggg

SEQ ID NO: 208493 - RNA, 22 nt, Human
uccauguauugcuaacaaauag

SEQ ID NO: 208494 - RNA, 22 nt, Human
uccauggucgauggcugcuggg

SEQ ID NO: 208495 - RNA, 22 nt, Human
uccaucauucagaaauuuuuga

SEQ ID NO: 208496 - RNA, 22 nt, Human
uacuaccugcaggaacaauuag

SEQ ID NO: 208497 - RNA, 22 nt, Human
uccaggacgccgacgugucggc

SEQ ID NO: 208498 - RNA, 22 nt, Human
uacagcuuccucuaugguggcc

SEQ ID NO: 208499 - RNA, 22 nt, Human
uccagcugugcuccaggaggug

SEQ ID NO: 208500 - RNA, 21 nt, Human
uccaggagcacgggacuagga

SEQ ID NO: 208501 - RNA, 22 nt, Human
uacagcgaaaauuuagcuugau

SEQ ID NO: 208502 - RNA, 22 nt, Human
uacaggaggaugugcagccagg

SEQ ID NO: 208503 - RNA, 22 nt, Human
uccaaggacucuugucagcugu

SEQ ID NO: 208504 - RNA, 22 nt, Human
uccccaugaacuuguggcugcu

SEQ ID NO: 208505 - RNA, 22 nt, Human
uccccgcuccguagagaaagag

SEQ ID NO: 208506 - RNA, 22 nt, Human
uccccggagucccuggccaggg

SEQ ID NO: 208507 - RNA, 22 nt, Human
uacugauggagauaggcuauca

SEQ ID NO: 208508 - RNA, 22 nt, Human
uacugcaguuccugcugucucc

SEQ ID NO: 208509 - RNA, 23 nt, Human
uccccagcugcccgugucccggg

SEQ ID NO: 208510 - RNA, 22 nt, Human
uccccaccuaagauacccaucu

SEQ ID NO: 208511 - RNA, 22 nt, Human
ucccugagagacuucuuuggcu

SEQ ID NO: 208512 - RNA, 22 nt, Human
ucccugccuuauuuucauaugc

SEQ ID NO: 208513 - RNA, 22 nt, Human
ucccugcgugagaaagcacuua

SEQ ID NO: 208514 - RNA, 22 nt, Human
ucccguuucacuccuugccagc

SEQ ID NO: 208515 - RNA, 22 nt, Human
ucccgcccugcguucucccaug

SEQ ID NO: 208516 - RNA, 22 nt, Human
uacuugucuuuauuuuaaugcu

SEQ ID NO: 208517 - RNA, 22 nt, Human
uacuuuggugaaauuggaaaua

SEQ ID NO: 208518 - RNA, 21 nt, Human
uccccugugccuggcauacag

SEQ ID NO: 208519 - RNA, 22 nt, Human
uccgugggucuugaagugucac

SEQ ID NO: 208520 - RNA, 22 nt, Human
uccgggcagcuccuggagcugu

SEQ ID NO: 208521 - RNA, 22 nt, Human
uccgaccuuuacuucuugucuc

SEQ ID NO: 208522 - RNA, 22 nt, Human
uccgcguugguuagagagggcu

SEQ ID NO: 208523 - RNA, 22 nt, Human
uagaguaagugugugcugagcu

SEQ ID NO: 208524 - RNA, 22 nt, Human
uagaggcuagugguuaugaccu

SEQ ID NO: 208525 - RNA, 22 nt, Human
ucccuuuuuaauugugucccug

SEQ ID NO: 208526 - RNA, 22 nt, Human
uccgacacacgugcucgcagcg

SEQ ID NO: 208527 - RNA, 22 nt, Human
uagaacuguaaauuaucucucc

SEQ ID NO: 208528 - RNA, 22 nt, Human
uagaacugcucucauacuugcu

SEQ ID NO: 208529 - RNA, 22 nt, Human
ucccuuaacucaaguggugcuc

SEQ ID NO: 208530 - RNA, 22 nt, Human
ucccuuuggagguguccagcac

SEQ ID NO: 208531 - RNA, 22 nt, Human
uagaacaaacagcauguuugau

SEQ ID NO: 208532 - RNA, 22 nt, Human
uagaaauaaacacugcuaccuu

SEQ ID NO: 208533 - RNA, 22 nt, Human
uagaagaacaugucaaacuaua

SEQ ID NO: 208534 - RNA, 22 nt, Human
ucccuucagcuccagcucugcu

SEQ ID NO: 208535 - RNA, 22 nt, Human
ucccuucccaccccugccuuuu

SEQ ID NO: 208536 - RNA, 23 nt, Human
uccuccccaccuuuguccccucc

SEQ ID NO: 208537 - RNA, 22 nt, Human
uccuccauguugugcacuugaa

SEQ ID NO: 208538 - RNA, 22 nt, Human
uccuccuuuccccgcuggagcc

SEQ ID NO: 208539 - RNA, 22 nt, Human
uccucccugcacucagugaagu

SEQ ID NO: 208540 - RNA, 22 nt, Human
uccucccgaaugaguagaaggg

SEQ ID NO: 208541 - RNA, 21 nt, Human
uccugccuggccuucugacua

SEQ ID NO: 208542 - RNA, 21 nt, Human
uccugccuuaguccagagcag

SEQ ID NO: 208543 - RNA, 22 nt, Human
uagcuggaggggcaggaugcug

SEQ ID NO: 208544 - RNA, 22 nt, Human
uagcguucuugcaugcuaaccu

SEQ ID NO: 208545 - RNA, 22 nt, Human
uccuucucagggagacuugaua

SEQ ID NO: 208546 - RNA, 22 nt, Human
uccuuccucuuucaaauuuguu

SEQ ID NO: 208547 - RNA, 22 nt, Human
uccuucagaggacggcagccag

SEQ ID NO: 208548 - RNA, 22 nt, Human
uccuggccucugagucaagaac

SEQ ID NO: 208549 - RNA, 22 nt, Human
uccuggccuuggggagagaagu

SEQ ID NO: 208550 - RNA, 22 nt, Human
uccugcuucaaucugcugcugg

SEQ ID NO: 208551 - RNA, 22 nt, Human
ucagguuuaagcuacuggaauc

SEQ ID NO: 208552 - RNA, 22 nt, Human
ucagguuuaagugacuggaauc

SEQ ID NO: 208553 - RNA, 22 nt, Human
ucagguuuuuaaggagcuagga

SEQ ID NO: 208554 - RNA, 22 nt, Human
uaaaugauaguauugaagguag

SEQ ID NO: 208555 - RNA, 22 nt, Human
uaaaguauucaaguagcuuucu

SEQ ID NO: 208556 - RNA, 22 nt, Human
uaaaggcaaacucuccaaggau

SEQ ID NO: 208557 - RNA, 22 nt, Human
uaaagugaaguucagaauggcu

SEQ ID NO: 208558 - RNA, 22 nt, Human
uaaaugagcaccucuaguuuug

SEQ ID NO: 208559 - RNA, 22 nt, Human
uaaaugaaaugaagugaaagcu

SEQ ID NO: 208560 - RNA, 21 nt, Human
ucaagcggcagagcaguuauu

SEQ ID NO: 208561 - RNA, 22 nt, Human
guuggguaauuaagcacagaaa

SEQ ID NO: 208562 - RNA, 22 nt, Human
guugguggaggcgagagaagaa

SEQ ID NO: 208563 - RNA, 22 nt, Human
uaaaggaguguauaauuguagu

SEQ ID NO: 208564 - RNA, 22 nt, Human
uaaagcauguuucaguaagguu

SEQ ID NO: 208565 - RNA, 18 nt, Human
ucagggaaacuuugccug

SEQ ID NO: 208566 - RNA, 22 nt, Human
ucagggaggagaggcaggggga

SEQ ID NO: 208567 - RNA, 19 nt, Human
ucaggaggucgaccuggca

SEQ ID NO: 208568 - RNA, 22 nt, Human
ucaggagaguguucaguggagg

SEQ ID NO: 208569 - RNA, 22 nt, Human
uaaauguugcuugugcugcuca

SEQ ID NO: 208570 - RNA, 22 nt, Human
uaaauuagauucccagcgcuau

SEQ ID NO: 208571 - RNA, 22 nt, Human
uaaauguacugaggcaacagga

SEQ ID NO: 208572 - RNA, 22 nt, Human
uaaaugcucuuuaaaagugcuu

SEQ ID NO: 208573 - RNA, 22 nt, Human
ucagucauguuuaccagacgua

SEQ ID NO: 208574 - RNA, 23 nt, Human
uaacacaguccuggucuuuggcc

SEQ ID NO: 208575 - RNA, 22 nt, Human
ucaguggaacacacagaguggg

SEQ ID NO: 208576 - RNA, 22 nt, Human
ucagugauccagauauuugagc

SEQ ID NO: 208577 - RNA, 22 nt, Human
ucagucugguggaugcucauug

SEQ ID NO: 208578 - RNA, 22 nt, Human
ucagucugcuauagguauuugu

SEQ ID NO: 208579 - RNA, 22 nt, Human
uaacacauagauauuuuaacuu

SEQ ID NO: 208580 - RNA, 22 nt, Human
uaacauuucggugacaguggga

SEQ ID NO: 208581 - RNA, 22 nt, Human
uaaccuugaagacugagcugac

SEQ ID NO: 208582 - RNA, 22 nt, Human
uaacccaaaggcaaugucucga

SEQ ID NO: 208583 - RNA, 20 nt, Human
ucaguggcauaguugcuaag

SEQ ID NO: 208584 - RNA, 19 nt, Human
ucagugggacauuugcuuu

SEQ ID NO: 208585 - RNA, 22 nt, Human
uaacuguuuugaauauuguggu

SEQ ID NO: 208586 - RNA, 22 nt, Human
uaauuugauuucucccuggaaa

SEQ ID NO: 208587 - RNA, 22 nt, Human
uaauugagauuucuggcugcuu

SEQ ID NO: 208588 - RNA, 22 nt, Human
uacaaaauucaaauaauguuug

SEQ ID NO: 208589 - RNA, 22 nt, Human
uaauauaacugccaguuaaggu

SEQ ID NO: 208590 - RNA, 22 nt, Human
uaauaguugaaggucaucacua

SEQ ID NO: 208591 - RNA, 22 nt, Human
uaauaucuuuacacauuuucaa

SEQ ID NO: 208592 - RNA, 22 nt, Human
ucauuauuuugauguauuuccu

SEQ ID NO: 208593 - RNA, 17 nt, Human
ucauuucaguaaaucca

SEQ ID NO: 208594 - RNA, 22 nt, Human
ucauuguuucugcuuuucauga

SEQ ID NO: 208595 - RNA, 22 nt, Human
ucauuuaucgcugccuuuuaaa

SEQ ID NO: 208596 - RNA, 17 nt, Human
ucauuuauccucuuugg

SEQ ID NO: 208597 - RNA, 22 nt, Human
uccaagcgcuucuggagcuccu

SEQ ID NO: 208598 - RNA, 23 nt, Human
uacagccaugucgcugauuuaac

SEQ ID NO: 208599 - RNA, 22 nt, Human
ucaugccugcgauugucccugg

SEQ ID NO: 208600 - RNA, 22 nt, Human
ucaugagcacaggugcagggac

SEQ ID NO: 208601 - RNA, 22 nt, Human
uaaggaaaugcaaauuuaagaa

SEQ ID NO: 208602 - RNA, 22 nt, Human
ucauggcucuaaagacauagau

SEQ ID NO: 208603 - RNA, 22 nt, Human
ucauguauucugggcaggagau

SEQ ID NO: 208604 - RNA, 22 nt, Human
ucauaaaaucaguguccauugu

SEQ ID NO: 208605 - RNA, 16 nt, Human
ucauaaacugcagcuu

SEQ ID NO: 208606 - RNA, 22 nt, Human
ucaguuuaauuggaucuuuuuc

SEQ ID NO: 208607 - RNA, 22 nt, Human
ucaguugagguggucuauugcg

SEQ ID NO: 208608 - RNA, 22 nt, Human
ucaucgauggggagcucuacaa

SEQ ID NO: 208609 - RNA, 22 nt, Human
ucauaaguuguugacuagcaaa

SEQ ID NO: 208610 - RNA, 22 nt, Human
ucaucuauaaguagcaucuggg

SEQ ID NO: 208611 - RNA, 21 nt, Human
ucuggggacaagguccaggaa

SEQ ID NO: 208612 - RNA, 22 nt, Human
ucugggucuaucccaugccuuu

SEQ ID NO: 208613 - RNA, 22 nt, Human
ucuggguaacugaggcuaauau

SEQ ID NO: 208614 - RNA, 22 nt, Human
ucugguuucccaguuccuccgu

SEQ ID NO: 208615 - RNA, 22 nt, Human
ucuggugcacucugauauuuga

SEQ ID NO: 208616 - RNA, 22 nt, Human
ucuguaauccacacagguggau

SEQ ID NO: 208617 - RNA, 22 nt, Human
ucuguagcuuuagaggacagga

SEQ ID NO: 208618 - RNA, 22 nt, Human
uauuaaaagagaaaaagccacc

SEQ ID NO: 208619 - RNA, 22 nt, Human
uauuaauugugguuauuguauu

SEQ ID NO: 208620 - RNA, 22 nt, Human
uauuacugccacaucauuaggu

SEQ ID NO: 208621 - RNA, 22 nt, Human
ucuguagucuuggagccgcaca

SEQ ID NO: 208622 - RNA, 22 nt, Human
ucugucaguguccucguguggu

SEQ ID NO: 208623 - RNA, 22 nt, Human
ucugucucugucaggcugcugc

SEQ ID NO: 208624 - RNA, 22 nt, Human
uauguucaauaccagguucuuu

SEQ ID NO: 208625 - RNA, 22 nt, Human
uauguugucuuguucagccaua

SEQ ID NO: 208626 - RNA, 22 nt, Human
ucugugugugcauguguguaua

SEQ ID NO: 208627 - RNA, 19 nt, Human
ucuguggccuucccugaug

SEQ ID NO: 208628 - RNA, 22 nt, Human
ucugugcuggacugauuucaua

SEQ ID NO: 208629 - RNA, 21 nt, Human
ucugugcuuuuuuggcuccua

SEQ ID NO: 208630 - RNA, 21 nt, Human
ucuguuguguguugaggacuu

SEQ ID NO: 208631 - RNA, 22 nt, Human
ucuguuguauggcugucuaauu

SEQ ID NO: 208632 - RNA, 22 nt, Human
ucuguuuacaugucagcagcaa

SEQ ID NO: 208633 - RNA, 22 nt, Human
ucuguucucuuguucugacggu

SEQ ID NO: 208634 - RNA, 19 nt, Human
ucuguugcuuuguguccuc

SEQ ID NO: 208635 - RNA, 22 nt, Human
uauuauggguuuuuguguaaau

SEQ ID NO: 208636 - RNA, 18 nt, Human
uauuccucuuccucuauc

SEQ ID NO: 208637 - RNA, 22 nt, Human
ucuguguguguggcuaaacaag

SEQ ID NO: 208638 - RNA, 22 nt, Human
ucuuagacagagaagacuauug

SEQ ID NO: 208639 - RNA, 22 nt, Human
ucuuaaucauucuucacuuccu

SEQ ID NO: 208640 - RNA, 20 nt, Human
ucuucagcuccaagucuggc

SEQ ID NO: 208641 - RNA, 22 nt, Human
ucugcuuaguuuucuugaacag

SEQ ID NO: 208642 - RNA, 22 nt, Human
uaugguuagugcuguagauuau

SEQ ID NO: 208643 - RNA, 22 nt, Human
uaugguuucuccugcagauuug

SEQ ID NO: 208644 - RNA, 20 nt, Human
ucugcuugucuucagguucc

SEQ ID NO: 208645 - RNA, 22 nt, Human
ucuggaaauggaaguaacuaug

SEQ ID NO: 208646 - RNA, 22 nt, Human
ucugcuuuucuuaaggggauca

SEQ ID NO: 208647 - RNA, 22 nt, Human
uaugggcaagagauaggugguc

SEQ ID NO: 208648 - RNA, 22 nt, Human
ucugcguggcgugguucugugc

SEQ ID NO: 208649 - RNA, 21 nt, Human
ucuggccuauaaaguagucgc

SEQ ID NO: 208650 - RNA, 22 nt, Human
ucuggcaguugccgcuucaguc

SEQ ID NO: 208651 - RNA, 22 nt, Human
uauguauaacuugauaggauga

SEQ ID NO: 208652 - RNA, 22 nt, Human
uauguauauccagguaagggcu

SEQ ID NO: 208653 - RNA, 22 nt, Human
uaugugaaauggaauauagaaa

SEQ ID NO: 208654 - RNA, 22 nt, Human
uauguauguauguauguauaug

SEQ ID NO: 208655 - RNA, 22 nt, Human
uauguguaauuaaauacuauag

SEQ ID NO: 208656 - RNA, 22 nt, Human
uaugugugugcguguguuuugc

SEQ ID NO: 208657 - RNA, 22 nt, Human
uaugugugaguauauaugcaca

SEQ ID NO: 208658 - RNA, 22 nt, Human
ucugauucucuuguugaccuag

SEQ ID NO: 208659 - RNA, 22 nt, Human
ucugaugaccacaugugggacu

SEQ ID NO: 208660 - RNA, 22 nt, Human
ucugcacagcucaccucccugg

SEQ ID NO: 208661 - RNA, 17 nt, Human
ucugcagaggcaaaccu

SEQ ID NO: 208662 - RNA, 22 nt, Human
ucugauucauucugguaaaugg

SEQ ID NO: 208663 - RNA, 22 nt, Human
ucugaucuuucauccuaaaugg

SEQ ID NO: 208664 - RNA, 22 nt, Human
ucugauaaggaaggauuaaaag

SEQ ID NO: 208665 - RNA, 22 nt, Human
ucugaguuaaaauuccagaggu

SEQ ID NO: 208666 - RNA, 22 nt, Human
ucugagugggaacucucaugac

SEQ ID NO: 208667 - RNA, 22 nt, Human
uaugacugcucagugaauggaa

SEQ ID NO: 208668 - RNA, 22 nt, Human
uaugaccuuaggaagcaagaag

SEQ ID NO: 208669 - RNA, 22 nt, Human
ucugagugacguccugacagga

SEQ ID NO: 208670 - RNA, 22 nt, Human
uaugaauauaccacaauuuagg

SEQ ID NO: 208671 - RNA, 22 nt, Human
ucugccuucaggagcagacucu

SEQ ID NO: 208672 - RNA, 23 nt, Human
ucugccuccuaauuguugguguc

SEQ ID NO: 208673 - RNA, 22 nt, Human
uaugcuagauggaaaaauauug

SEQ ID NO: 208674 - RNA, 22 nt, Human
uaugcgguccaucaggggcacu

SEQ ID NO: 208675 - RNA, 22 nt, Human
ucugcgggccuggcucccagcg

SEQ ID NO: 208676 - RNA, 22 nt, Human
ucugcggccuagcgcccggcgc

SEQ ID NO: 208677 - RNA, 22 nt, Human
uaugccaaaaauaaguuuuaug

SEQ ID NO: 208678 - RNA, 22 nt, Human
uaugcaucaguaugguuggaaa

SEQ ID NO: 208679 - RNA, 21 nt, Human
ucugccaguuucucuuacuuu

SEQ ID NO: 208680 - RNA, 22 nt, Human
uaugccuaccuccaaaauauau

SEQ ID NO: 208681 - RNA, 22 nt, Human
uaugauuuucaugguagaguua

SEQ ID NO: 208682 - RNA, 22 nt, Human
uauauauacauauagaauaugu

SEQ ID NO: 208683 - RNA, 22 nt, Human
uauauacuugaaaauugcugag

SEQ ID NO: 208684 - RNA, 20 nt, Human
ucucucacccuugcugugca

SEQ ID NO: 208685 - RNA, 21 nt, Human
ucucuaucguauaccagccgg

SEQ ID NO: 208686 - RNA, 22 nt, Human
ucucucucucuuccagcauguu

SEQ ID NO: 208687 - RNA, 22 nt, Human
ucucucgguacagcuggcugga

SEQ ID NO: 208688 - RNA, 22 nt, Human
ucucucugcuguccagcguuau

SEQ ID NO: 208689 - RNA, 22 nt, Human
ucucuggacggacauuuaaggu

SEQ ID NO: 208690 - RNA, 22 nt, Human
ucucugguggcuccaucaguag

SEQ ID NO: 208691 - RNA, 22 nt, Human
ucucuguaguugggcagcugcu

SEQ ID NO: 208692 - RNA, 22 nt, Human
uauccaaaggaacaaucacagc

SEQ ID NO: 208693 - RNA, 22 nt, Human
uauauuuguccuagcuccuagc

SEQ ID NO: 208694 - RNA, 22 nt, Human
uauauguagcucaaaaauuccc

SEQ ID NO: 208695 - RNA, 22 nt, Human
uauauuaaagugcuuugcagug

SEQ ID NO: 208696 - RNA, 22 nt, Human
ucugaaauuuuaguuauagaaa

SEQ ID NO: 208697 - RNA, 22 nt, Human
ucugaaaggagaguagggcaga

SEQ ID NO: 208698 - RNA, 22 nt, Human
ucugaauauguuuaucaucucu

SEQ ID NO: 208699 - RNA, 18 nt, Human
ucugaaggaaugauucca

SEQ ID NO: 208700 - RNA, 22 nt, Human
uaucugaugcaggcucccagga

SEQ ID NO: 208701 - RNA, 22 nt, Human
ucucugugaauggcgucaccug

SEQ ID NO: 208702 - RNA, 21 nt, Human
uaucauuuuuuccccugagau

SEQ ID NO: 208703 - RNA, 22 nt, Human
ucugagcaggaaagagcagaga

SEQ ID NO: 208704 - RNA, 22 nt, Human
ucugaguagaaucauucauaaa

SEQ ID NO: 208705 - RNA, 22 nt, Human
ucugagucgcucccuggaucca

SEQ ID NO: 208706 - RNA, 22 nt, Human
uaucuguagucucaugguuccu

SEQ ID NO: 208707 - RNA, 22 nt, Human
uaucuguauuguagaacuguug

SEQ ID NO: 208708 - RNA, 22 nt, Human
ucugacugucccguagaggaac

SEQ ID NO: 208709 - RNA, 22 nt, Human
ucugacguugguucugcccuuu

SEQ ID NO: 208710 - RNA, 22 nt, Human
uaucugcuggagguaauuacuc

SEQ ID NO: 208711 - RNA, 22 nt, Human
ucucugucucccguguguccgg

SEQ ID NO: 208712 - RNA, 22 nt, Human
uaguucugaauagcauugaaga

SEQ ID NO: 208713 - RNA, 20 nt, Human
ucuaggguuugguuaucauc

SEQ ID NO: 208714 - RNA, 23 nt, Human
ucucaccaggauaugacugucac

SEQ ID NO: 208715 - RNA, 22 nt, Human
ucucaggcuuccuggugcugug

SEQ ID NO: 208716 - RNA, 22 nt, Human
uagcuucacuuuuguugaugcg

SEQ ID NO: 208717 - RNA, 22 nt, Human
ucgaggagagucgccagcugcu

SEQ ID NO: 208718 - RNA, 23 nt, Human
uaguguuauuaauuaguaaggau

SEQ ID NO: 208719 - RNA, 22 nt, Human
uaggauaacaauuuguaguuuc

SEQ ID NO: 208720 - RNA, 22 nt, Human
uaguuacuuuugcucuucauua

SEQ ID NO: 208721 - RNA, 22 nt, Human
uaguuauuucugcacuuaauga

SEQ ID NO: 208722 - RNA, 22 nt, Human
uaguuaggauucccaggaaacc

SEQ ID NO: 208723 - RNA, 22 nt, Human
ucuccuuugaaaguuaggacug

SEQ ID NO: 208724 - RNA, 22 nt, Human
ucucccuuuggauuuguuuugg

SEQ ID NO: 208725 - RNA, 22 nt, Human
ucuccucuauuucuguauguau

SEQ ID NO: 208726 - RNA, 22 nt, Human
ucuccucucugaucuugcuccg

SEQ ID NO: 208727 - RNA, 22 nt, Human
uauagcaagagaaccauuacca

SEQ ID NO: 208728 - RNA, 22 nt, Human
uauagccuuacaagauauuaua

SEQ ID NO: 208729 - RNA, 22 nt, Human
uauacauauacaaaugcacaua

SEQ ID NO: 208730 - RNA, 22 nt, Human
ucuccaccccugggaggcagaa

SEQ ID NO: 208731 - RNA, 22 nt, Human
ucucauugugcuuuuuguacug

SEQ ID NO: 208732 - RNA, 20 nt, Human
ucucauuuugauuucgcauu

SEQ ID NO: 208733 - RNA, 22 nt, Human
ucucauaucuguacacccuugu

SEQ ID NO: 208734 - RNA, 22 nt, Human
uaguuuucaagugaguuggaag

SEQ ID NO: 208735 - RNA, 23 nt, Human
uggaagaaaaugguuuggcugug

SEQ ID NO: 208736 - RNA, 22 nt, Human
uggaagaaaacuuggaaggcau

SEQ ID NO: 208737 - RNA, 22 nt, Human
uggaagcuagggguuucuguug

SEQ ID NO: 208738 - RNA, 22 nt, Human
uggaagcuggcugaucugacuu

SEQ ID NO: 208739 - RNA, 22 nt, Human
ucugcuguugaucaugacuagc

SEQ ID NO: 208740 - RNA, 22 nt, Human
ucugcuggugucauuuuugcua

SEQ ID NO: 208741 - RNA, 22 nt, Human
ucugguuccugcauucauucaa

SEQ ID NO: 208742 - RNA, 22 nt, Human
ucugguuaggcuugugaggucc

SEQ ID NO: 208743 - RNA, 17 nt, Human
ucuggguuucugauuua

SEQ ID NO: 208744 - RNA, 22 nt, Human
ucugguagauuauuuagaguac

SEQ ID NO: 208745 - RNA, 22 nt, Human
ucuggucugccgagauccauuu

SEQ ID NO: 208746 - RNA, 22 nt, Human
ucuggcucaggagcuguguuca

SEQ ID NO: 208747 - RNA, 22 nt, Human
ucuggcuucaguaggguucacu

SEQ ID NO: 208748 - RNA, 22 nt, Human
ucuggcucuccagugcucuuag

SEQ ID NO: 208749 - RNA, 22 nt, Human
uggaagcccagaaggaagcaga

SEQ ID NO: 208750 - RNA, 22 nt, Human
ucuguuauaaaucacacugcau

SEQ ID NO: 208751 - RNA, 22 nt, Human
ucuguucacaauuacacacacu

SEQ ID NO: 208752 - RNA, 22 nt, Human
uggauaugaaacaaaacaagag

SEQ ID NO: 208753 - RNA, 22 nt, Human
ucuguuuuuaucuauucuguua

SEQ ID NO: 208754 - RNA, 20 nt, Human
uggaucaccauccuguugcu

SEQ ID NO: 208755 - RNA, 22 nt, Human
ucuguuuugugcuuuguuuucu

SEQ ID NO: 208756 - RNA, 22 nt, Human
ucuguuuuccaggaaucucaua

SEQ ID NO: 208757 - RNA, 22 nt, Human
ucuguuucaggggucuggaaug

SEQ ID NO: 208758 - RNA, 22 nt, Human
ucuguaccuuauguucagagug

SEQ ID NO: 208759 - RNA, 22 nt, Human
ucuguauuuuuuacacacaugc

SEQ ID NO: 208760 - RNA, 20 nt, Human
ucuguggcagguggcgcuug

SEQ ID NO: 208761 - RNA, 17 nt, Human
ucuguguccgcucaguc

SEQ ID NO: 208762 - RNA, 22 nt, Human
uggaguagaagggcuccuggaa

SEQ ID NO: 208763 - RNA, 22 nt, Human
uggagucagaaugcgacaggcc

SEQ ID NO: 208764 - RNA, 22 nt, Human
ucuguggcaaacacagugacca

SEQ ID NO: 208765 - RNA, 21 nt, Human
ucugucuaguuaccaccgccc

SEQ ID NO: 208766 - RNA, 22 nt, Human
uggccaaauuggccugauguau

SEQ ID NO: 208767 - RNA, 22 nt, Human
uggcauuugagcuggaaggaug

SEQ ID NO: 208768 - RNA, 22 nt, Human
uggccgaugagcaugcgcugau

SEQ ID NO: 208769 - RNA, 23 nt, Human
uggccguccccugacucucuggc

SEQ ID NO: 208770 - RNA, 21 nt, Human
uggcccgagccgggguuggcu

SEQ ID NO: 208771 - RNA, 22 nt, Human
uggcccugaaucaaggccagca

SEQ ID NO: 208772 - RNA, 21 nt, Human
uggcauacugcuaaaaagugu

SEQ ID NO: 208773 - RNA, 22 nt, Human
uggcaguugcaguaacuuguau

SEQ ID NO: 208774 - RNA, 22 nt, Human
ucuugcuggagucaaggcuaca

SEQ ID NO: 208775 - RNA, 22 nt, Human
uggcaucuggugauauggacua

SEQ ID NO: 208776 - RNA, 22 nt, Human
uggcgacuggaauuaaucuuuu

SEQ ID NO: 208777 - RNA, 22 nt, Human
uggcgcgcagccugcuggugcu

SEQ ID NO: 208778 - RNA, 22 nt, Human
ucuuuaucugugagcagucucc

SEQ ID NO: 208779 - RNA, 22 nt, Human
uggcgcucacccugcggcccug

SEQ ID NO: 208780 - RNA, 22 nt, Human
ucuuucucuccagccuggaccu

SEQ ID NO: 208781 - RNA, 22 nt, Human
ucuuugcagaauuuaacuuugc

SEQ ID NO: 208782 - RNA, 22 nt, Human
uggcuacauuuauacucucauu

SEQ ID NO: 208783 - RNA, 22 nt, Human
uggcucaggccuacgacgccuu

SEQ ID NO: 208784 - RNA, 18 nt, Human
uggcuagaagagcucuca

SEQ ID NO: 208785 - RNA, 21 nt, Human
ucuuccaacacugacaccaug

SEQ ID NO: 208786 - RNA, 19 nt, Human
ucuuccaucuauccuccuc

SEQ ID NO: 208787 - RNA, 22 nt, Human
uggcagugagauuucucuucug

SEQ ID NO: 208788 - RNA, 22 nt, Human
ucuuccagauacuuccugacuu

SEQ ID NO: 208789 - RNA, 22 nt, Human
ucuucaugaaauugauugcuua

SEQ ID NO: 208790 - RNA, 15 nt, Human
uggauuugccacaua

SEQ ID NO: 208791 - RNA, 22 nt, Human
ucuucaucucuaaaaugggaac

SEQ ID NO: 208792 - RNA, 22 nt, Human
ucuucuguguguagugguugug

SEQ ID NO: 208793 - RNA, 21 nt, Human
ucuucccaggccuuaaagggc

SEQ ID NO: 208794 - RNA, 22 nt, Human
ucuucccgggcaucucugcuca

SEQ ID NO: 208795 - RNA, 20 nt, Human
uggaucgaccucacuuccau

SEQ ID NO: 208796 - RNA, 22 nt, Human
uggaucaugcgaggccuccccu

SEQ ID NO: 208797 - RNA, 22 nt, Human
uggcaaaaccugcaauuacuuu

SEQ ID NO: 208798 - RNA, 22 nt, Human
ucuucacagaugcauauacuuc

SEQ ID NO: 208799 - RNA, 22 nt, Human
ucuuauuucuuucuuuuccugu

SEQ ID NO: 208800 - RNA, 23 nt, Human
uggcaaacgggaauaaaggaauu

SEQ ID NO: 208801 - RNA, 22 nt, Human
ucuucacugaagcuuugcaucu

SEQ ID NO: 208802 - RNA, 22 nt, Human
ucuucagacuguuguucuuuug

SEQ ID NO: 208803 - RNA, 22 nt, Human
ucucuggcuuuuuuuccauuuu

SEQ ID NO: 208804 - RNA, 19 nt, Human
ucucugguggcuccaucag

SEQ ID NO: 208805 - RNA, 22 nt, Human
ucucuguacauagugaagcccg

SEQ ID NO: 208806 - RNA, 22 nt, Human
ugcuugugcacacacauguuau

SEQ ID NO: 208807 - RNA, 22 nt, Human
ugcuugaggcuugucaucuaac

SEQ ID NO: 208808 - RNA, 22 nt, Human
ucucucggagcuaccggaaguu

SEQ ID NO: 208809 - RNA, 22 nt, Human
ugcuuaaccagccccuucccuu

SEQ ID NO: 208810 - RNA, 22 nt, Human
ucucuccuccacaccgggugcu

SEQ ID NO: 208811 - RNA, 22 nt, Human
ucucuacuuggcuuguguucac

SEQ ID NO: 208812 - RNA, 17 nt, Human
ucuccuggcucuaucag

SEQ ID NO: 208813 - RNA, 22 nt, Human
ucucgcuguuccugcuucaggu

SEQ ID NO: 208814 - RNA, 22 nt, Human
ucuccuuuggggccucaggguu

SEQ ID NO: 208815 - RNA, 22 nt, Human
ugcuuacauuuugcuggucucc

SEQ ID NO: 208816 - RNA, 22 nt, Human
ugcuuuuggcagcaguguuuau

SEQ ID NO: 208817 - RNA, 22 nt, Human
ucugaccaggcucuuguagccu

SEQ ID NO: 208818 - RNA, 22 nt, Human
uggaaaauuuagaaagauuuau

SEQ ID NO: 208819 - RNA, 17 nt, Human
ucugaccuuuacuccug

SEQ ID NO: 208820 - RNA, 22 nt, Human
uggaaaacgcaguuuaauuuuu

SEQ ID NO: 208821 - RNA, 22 nt, Human
ucugaggacagugcugugccug

SEQ ID NO: 208822 - RNA, 22 nt, Human
ucugaccccccuugccuccacu

SEQ ID NO: 208823 - RNA, 22 nt, Human
ucucuuuuuuuaaaacucuaug

SEQ ID NO: 208824 - RNA, 22 nt, Human
ucugaagagaacucuuaguguu

SEQ ID NO: 208825 - RNA, 22 nt, Human
ugcuuuauucgacaucugguag

SEQ ID NO: 208826 - RNA, 22 nt, Human
ucucuucggagagaccuuugga

SEQ ID NO: 208827 - RNA, 20 nt, Human
ucucuuuuucuucuuuucuc

SEQ ID NO: 208828 - RNA, 22 nt, Human
ugcugcuguuuccuacaucuca

SEQ ID NO: 208829 - RNA, 21 nt, Human
ucucauuuuaacacagaguug

SEQ ID NO: 208830 - RNA, 22 nt, Human
ucucauaauuguuucccagcua

SEQ ID NO: 208831 - RNA, 22 nt, Human
ucucauacguuuccagguguca

SEQ ID NO: 208832 - RNA, 22 nt, Human
ucuccaggaaagacacuggacu

SEQ ID NO: 208833 - RNA, 22 nt, Human
ugcuggagccauguuuucucua

SEQ ID NO: 208834 - RNA, 22 nt, Human
ugcuggaguggcacuguguggc

SEQ ID NO: 208835 - RNA, 20 nt, Human
ugcugugugucuacuguggg

SEQ ID NO: 208836 - RNA, 22 nt, Human
ugcugugagaccauuuguugag

SEQ ID NO: 208837 - RNA, 22 nt, Human
ucuccucuuaaugcacguuucc

SEQ ID NO: 208838 - RNA, 18 nt, Human
ucuccgaccccgcggucc

SEQ ID NO: 208839 - RNA, 22 nt, Human
ucucccgcuuccugcuggcugc

SEQ ID NO: 208840 - RNA, 22 nt, Human
ucgcuguguccuuuucacuuau

SEQ ID NO: 208841 - RNA, 22 nt, Human
ucgcuucugaguuggugacccc

SEQ ID NO: 208842 - RNA, 22 nt, Human
ucuaugaagucuuccuuuccuc

SEQ ID NO: 208843 - RNA, 21 nt, Human
ucuauccuggcuuuccacuug

SEQ ID NO: 208844 - RNA, 22 nt, Human
ugcgcgccgacggcuccgugac

SEQ ID NO: 208845 - RNA, 22 nt, Human
ucgccuccucccagaucaacaa

SEQ ID NO: 208846 - RNA, 22 nt, Human
ucgcgcgugccacgcgccgcgg

SEQ ID NO: 208847 - RNA, 22 nt, Human
ucgcuauuauuuuagguucuca

SEQ ID NO: 208848 - RNA, 22 nt, Human
ugcugcuguuaucauuuuacca

SEQ ID NO: 208849 - RNA, 21 nt, Human
ucucaagguaacauuuaagau

SEQ ID NO: 208850 - RNA, 22 nt, Human
ucuauuauauuuacacgagagu

SEQ ID NO: 208851 - RNA, 22 nt, Human
ucucaaagagcuacuggucuau

SEQ ID NO: 208852 - RNA, 22 nt, Human
uccucgccgucacgcagccucu

SEQ ID NO: 208853 - RNA, 22 nt, Human
uccuccucgccacgacucugcu

SEQ ID NO: 208854 - RNA, 22 nt, Human
uccucguccucauccgcgucau

SEQ ID NO: 208855 - RNA, 18 nt, Human
ugcccaccagaagaggga

SEQ ID NO: 208856 - RNA, 22 nt, Human
ugcccacuuugucuccaugcug

SEQ ID NO: 208857 - RNA, 22 nt, Human
ugcccacuucaaaaucuucauu

SEQ ID NO: 208858 - RNA, 22 nt, Human
ugcaucauuaagguacaguugg

SEQ ID NO: 208859 - RNA, 22 nt, Human
uccuacccccuucuccagcucc

SEQ ID NO: 208860 - RNA, 22 nt, Human
uccuagaccuacugaaucagac

SEQ ID NO: 208861 - RNA, 22 nt, Human
uccucagcaaacacuucacucu

SEQ ID NO: 208862 - RNA, 22 nt, Human
ugcauguuauuguggcaagaau

SEQ ID NO: 208863 - RNA, 22 nt, Human
ugcauuuugaaggaaaaaaaug

SEQ ID NO: 208864 - RNA, 22 nt, Human
ugcauuuucuaccacacccacu

SEQ ID NO: 208865 - RNA, 22 nt, Human
ugccaaagauagagguuugagu

SEQ ID NO: 208866 - RNA, 22 nt, Human
uccuggaagggaugguugagga

SEQ ID NO: 208867 - RNA, 22 nt, Human
uccuggcgugggcuggcugcag

SEQ ID NO: 208868 - RNA, 22 nt, Human
uccuugaccuccugacaguaac

SEQ ID NO: 208869 - RNA, 19 nt, Human
uccuugacuguauucagag

SEQ ID NO: 208870 - RNA, 22 nt, Human
ugccuaaaccauuccccuuccu

SEQ ID NO: 208871 - RNA, 22 nt, Human
ugccugaagccugccccugggu

SEQ ID NO: 208872 - RNA, 17 nt, Human
ugccuucgucuucaguu

SEQ ID NO: 208873 - RNA, 22 nt, Human
uccuuuauuuaugggcagugua

SEQ ID NO: 208874 - RNA, 22 nt, Human
uccuuguuggaauauccuuacc

SEQ ID NO: 208875 - RNA, 19 nt, Human
ugccuggcaccagcuccac

SEQ ID NO: 208876 - RNA, 22 nt, Human
ugccuuguagccaccgggucac

SEQ ID NO: 208877 - RNA, 22 nt, Human
ugcgcgcaccugcauauauaug

SEQ ID NO: 208878 - RNA, 22 nt, Human
ugcgccucugucacucagcauc

SEQ ID NO: 208879 - RNA, 22 nt, Human
ucgagauguuuguuguggugau

SEQ ID NO: 208880 - RNA, 22 nt, Human
ucccuguuuccugcgcuccuuc

SEQ ID NO: 208881 - RNA, 23 nt, Human
ucccuguuucagggccagaacug

SEQ ID NO: 208882 - RNA, 22 nt, Human
ucccugcugggcgaucuucucu

SEQ ID NO: 208883 - RNA, 22 nt, Human
ucccugagcuguguuuguuggu

SEQ ID NO: 208884 - RNA, 22 nt, Human
ucccugccuccuggcagugcca

SEQ ID NO: 208885 - RNA, 22 nt, Human
ucccugcaggcauguacucuga

SEQ ID NO: 208886 - RNA, 22 nt, Human
ugcagcuuuugguuucuagaug

SEQ ID NO: 208887 - RNA, 22 nt, Human
ucccucuuccuacccucccuuu

SEQ ID NO: 208888 - RNA, 22 nt, Human
ugcaggagcccaggaauacuau

SEQ ID NO: 208889 - RNA, 18 nt, Human
ugcaggggaggggugaua

SEQ ID NO: 208890 - RNA, 22 nt, Human
ugcaggaagcucagcggggccg

SEQ ID NO: 208891 - RNA, 22 nt, Human
uccggcgaccuccagauguucc

SEQ ID NO: 208892 - RNA, 22 nt, Human
uccgggagcccccggaggagga

SEQ ID NO: 208893 - RNA, 22 nt, Human
uccguccacacuuagagaguuu

SEQ ID NO: 208894 - RNA, 18 nt, Human
uccggaggucagaguaaa

SEQ ID NO: 208895 - RNA, 22 nt, Human
ugcaggucuggacccccacuuu

SEQ ID NO: 208896 - RNA, 22 nt, Human
ugcagguuuucagauguguguu

SEQ ID NO: 208897 - RNA, 22 nt, Human
ugcaguugcguuugcauuccau

SEQ ID NO: 208898 - RNA, 22 nt, Human
ugcauaaauauuguugggagua

SEQ ID NO: 208899 - RNA, 22 nt, Human
ucccagcaggcaccgcuucugc

SEQ ID NO: 208900 - RNA, 22 nt, Human
ucccauauuauggggaaaaacu

SEQ ID NO: 208901 - RNA, 22 nt, Human
ucccagccugacagugcaucaa

SEQ ID NO: 208902 - RNA, 19 nt, Human
ugcacucauggagggucug

SEQ ID NO: 208903 - RNA, 20 nt, Human
ugcacggcugugugugugca

SEQ ID NO: 208904 - RNA, 22 nt, Human
uccccugccccccauccucugg

SEQ ID NO: 208905 - RNA, 22 nt, Human
ucccucgccccggguucuuucu

SEQ ID NO: 208906 - RNA, 22 nt, Human
ugauuucauaugacagcuuuuu

SEQ ID NO: 208907 - RNA, 22 nt, Human
ugauugguauguauguuuguca

SEQ ID NO: 208908 - RNA, 22 nt, Human
uccagcuucugccugcugcugc

SEQ ID NO: 208909 - RNA, 22 nt, Human
uccaggaggacugagggggcug

SEQ ID NO: 208910 - RNA, 22 nt, Human
uccaggagucagacagauggug

SEQ ID NO: 208911 - RNA, 22 nt, Human
ucaguaagauugauauuucccc

SEQ ID NO: 208912 - RNA, 22 nt, Human
ucagucacugugaaaugaauuu

SEQ ID NO: 208913 - RNA, 22 nt, Human
ucaguauuagugcauuaucagg

SEQ ID NO: 208914 - RNA, 22 nt, Human
ugagagaauuacuaaagggcuu

SEQ ID NO: 208915 - RNA, 22 nt, Human
ugagagguagaacuuguagugu

SEQ ID NO: 208916 - RNA, 22 nt, Human
ugagaggaagggaaagaugauu

SEQ ID NO: 208917 - RNA, 22 nt, Human
ucagucacugucucagacagga

SEQ ID NO: 208918 - RNA, 22 nt, Human
ucagucauacuuuaugauugaa

SEQ ID NO: 208919 - RNA, 22 nt, Human
ucuucaggaaaaccaaaguugu

SEQ ID NO: 208920 - RNA, 22 nt, Human
ucaggcuagcccagugcuuggg

SEQ ID NO: 208921 - RNA, 22 nt, Human
ucaggguacuuguggccaaagu

SEQ ID NO: 208922 - RNA, 23 nt, Human
ucagggaucgucagaaaaugaaa

SEQ ID NO: 208923 - RNA, 22 nt, Human
ugagaacacuuuucucuuugcu

SEQ ID NO: 208924 - RNA, 22 nt, Human
ugagaauuuaacuugauuagga

SEQ ID NO: 208925 - RNA, 22 nt, Human
ugagaaauauacaccagacaca

SEQ ID NO: 208926 - RNA, 22 nt, Human
ucaggucacugauaaaguggaa

SEQ ID NO: 208927 - RNA, 22 nt, Human
ugagauguaauguaguacuuug

SEQ ID NO: 208928 - RNA, 22 nt, Human
ugagauucuguucagaaaaaug

SEQ ID NO: 208929 - RNA, 22 nt, Human
ucagucuucaggacuaugaaaa

SEQ ID NO: 208930 - RNA, 23 nt, Human
ucagugaaggaacaacuaaauag

SEQ ID NO: 208931 - RNA, 22 nt, Human
ugagcagagcacuugggaacga

SEQ ID NO: 208932 - RNA, 22 nt, Human
ugagccauguucaugaguucau

SEQ ID NO: 208933 - RNA, 21 nt, Human
ugagcccaaagcuguauuggu

SEQ ID NO: 208934 - RNA, 22 nt, Human
ugagcuauuucaccauauagau

SEQ ID NO: 208935 - RNA, 22 nt, Human
ugaggaggugcuaccagcgucu

SEQ ID NO: 208936 - RNA, 22 nt, Human
ugaggaacaugggagaaauguc

SEQ ID NO: 208937 - RNA, 22 nt, Human
ugaggaggugggcacacagagu

SEQ ID NO: 208938 - RNA, 22 nt, Human
ugaggaugagaaggaagagaag

SEQ ID NO: 208939 - RNA, 22 nt, Human
ucaguugauggcaguuaauguc

SEQ ID NO: 208940 - RNA, 17 nt, Human
ucaguugugcgagcagc

SEQ ID NO: 208941 - RNA, 22 nt, Human
ucaguuacucugauguccugug

SEQ ID NO: 208942 - RNA, 22 nt, Human
ucagugugacccuucuauuuuu

SEQ ID NO: 208943 - RNA, 20 nt, Human
ucagugggaaagugagagug

SEQ ID NO: 208944 - RNA, 22 nt, Human
ucaugcagauaagaauaaguaa

SEQ ID NO: 208945 - RNA, 22 nt, Human
ucaugggcaaacuuggggauca

SEQ ID NO: 208946 - RNA, 22 nt, Human
ucaucggcugucaucuucacgu

SEQ ID NO: 208947 - RNA, 22 nt, Human
ucaucuuucuuuauggaaauac

SEQ ID NO: 208948 - RNA, 20 nt, Human
ucaucuuucaaauuugugac

SEQ ID NO: 208949 - RNA, 20 nt, Human
ucaguuucccuauuagguug

SEQ ID NO: 208950 - RNA, 22 nt, Human
ucauaaaggugccacucaguuu

SEQ ID NO: 208951 - RNA, 22 nt, Human
ucauaagucucauauaugucca

SEQ ID NO: 208952 - RNA, 22 nt, Human
ugaggcaguucuuacuuguauu

SEQ ID NO: 208953 - RNA, 21 nt, Human
ugaggccugccagucucagaa

SEQ ID NO: 208954 - RNA, 22 nt, Human
ucauauugguagagauguguaa

SEQ ID NO: 208955 - RNA, 22 nt, Human
ucaucauccuuuuuugaagagu

SEQ ID NO: 208956 - RNA, 20 nt, Human
ugauaugcgguacagagagg

SEQ ID NO: 208957 - RNA, 22 nt, Human
ucaugucagugucugugugugg

SEQ ID NO: 208958 - RNA, 22 nt, Human
ugaucaacagggcuggaaagag

SEQ ID NO: 208959 - RNA, 22 nt, Human
ugaucaguacuguaugagggau

SEQ ID NO: 208960 - RNA, 22 nt, Human
ugauguaggacauuauuauuuc

SEQ ID NO: 208961 - RNA, 18 nt, Human
ugauggcuaagagccggg

SEQ ID NO: 208962 - RNA, 22 nt, Human
ucauuuuaucaggaauggaauc

SEQ ID NO: 208963 - RNA, 22 nt, Human
ucauuuguauucuacaaagcac

SEQ ID NO: 208964 - RNA, 22 nt, Human
ugaugaugccaaaauuuggcau

SEQ ID NO: 208965 - RNA, 22 nt, Human
ugaugugugaauucuuaaaugu

SEQ ID NO: 208966 - RNA, 22 nt, Human
ugauuagccguccuuuuauuaa

SEQ ID NO: 208967 - RNA, 22 nt, Human
ugauucacagacuucacaaggc

SEQ ID NO: 208968 - RNA, 22 nt, Human
ugauugauaaugaagacaguca

SEQ ID NO: 208969 - RNA, 22 nt, Human
ugauucaguacuuucucuaacu

SEQ ID NO: 208970 - RNA, 19 nt, Human
ugccccacccucuauccag

SEQ ID NO: 208971 - RNA, 22 nt, Human
ugcccagcagggagcuaccugg

SEQ ID NO: 208972 - RNA, 22 nt, Human
ugccccagcacauuuacuaucc

SEQ ID NO: 208973 - RNA, 22 nt, Human
ugccccuggaggagagcaaugg

SEQ ID NO: 208974 - RNA, 22 nt, Human
ugccagauuaugucuccagggc

SEQ ID NO: 208975 - RNA, 23 nt, Human
ugccaggaagaaugaccucugcu

SEQ ID NO: 208976 - RNA, 22 nt, Human
ugcauguuucuguauguuaaug

SEQ ID NO: 208977 - RNA, 22 nt, Human
ugcauguuuuaagugaagcuga

SEQ ID NO: 208978 - RNA, 22 nt, Human
ugccagcuccgaggagcugcag

SEQ ID NO: 208979 - RNA, 22 nt, Human
ugcauuacuuugauaagcgucu

SEQ ID NO: 208980 - RNA, 22 nt, Human
ugcccugcagacccugcagugu

SEQ ID NO: 208981 - RNA, 22 nt, Human
ugccccuugccaggccucugcc

SEQ ID NO: 208982 - RNA, 19 nt, Human
ugccccuucuucauccauc

SEQ ID NO: 208983 - RNA, 22 nt, Human
ugccgcuuucuggcccucaguc

SEQ ID NO: 208984 - RNA, 22 nt, Human
ugcccugucccuagguuugugg

SEQ ID NO: 208985 - RNA, 22 nt, Human
ugugugcacguacauacuguau

SEQ ID NO: 208986 - RNA, 22 nt, Human
uguguggaggugggugaugucu

SEQ ID NO: 208987 - RNA, 22 nt, Human
ugccgccgugggucccgacgcg

SEQ ID NO: 208988 - RNA, 22 nt, Human
uguguauguauguauguaugua

SEQ ID NO: 208989 - RNA, 17 nt, Human
uguguauucuccaggug

SEQ ID NO: 208990 - RNA, 22 nt, Human
ugcaggaacucgaaaacuauag

SEQ ID NO: 208991 - RNA, 19 nt, Human
ugcagcuguaugagcuuaa

SEQ ID NO: 208992 - RNA, 22 nt, Human
ugugauugucuucugaaaguca

SEQ ID NO: 208993 - RNA, 22 nt, Human
ugugauaauauuauuagagcuc

SEQ ID NO: 208994 - RNA, 22 nt, Human
ugugaugagaugaacuguagac

SEQ ID NO: 208995 - RNA, 22 nt, Human
ugcagccuuuguccuugggcua

SEQ ID NO: 208996 - RNA, 22 nt, Human
ugugauaaaggcccgcagaucc

SEQ ID NO: 208997 - RNA, 17 nt, Human
ugcaugcgucugugaua

SEQ ID NO: 208998 - RNA, 22 nt, Human
ugcaugaucucacuuacaggug

SEQ ID NO: 208999 - RNA, 22 nt, Human
ugcaugacaauugccgucaagu

SEQ ID NO: 209000 - RNA, 22 nt, Human
ugcaucugagcacuacggugga

SEQ ID NO: 209001 - RNA, 22 nt, Human
ugcagugaugcuucuggcucag

SEQ ID NO: 209002 - RNA, 22 nt, Human
ugcagugcagcuggaaguuggc

SEQ ID NO: 209003 - RNA, 22 nt, Human
ugcagugcagcuggaauaucuu

SEQ ID NO: 209004 - RNA, 22 nt, Human
ugugcugcagcgagagcuacga

SEQ ID NO: 209005 - RNA, 21 nt, Human
ugucaucucuaaaaagauugu

SEQ ID NO: 209006 - RNA, 22 nt, Human
ugucagccacggugugaccggc

SEQ ID NO: 209007 - RNA, 22 nt, Human
ugucaguuugucaaauacccca

SEQ ID NO: 209008 - RNA, 22 nt, Human
ugcaaauuuuuuuauuuuuccu

SEQ ID NO: 209009 - RNA, 21 nt, Human
ugucagaaagccugugacuuu

SEQ ID NO: 209010 - RNA, 22 nt, Human
ugucacuuaagguuggugucuc

SEQ ID NO: 209011 - RNA, 23 nt, Human
ugucacugcggaguggccugcag

SEQ ID NO: 209012 - RNA, 22 nt, Human
ugucacguaaaaacuagauuuc

SEQ ID NO: 209013 - RNA, 22 nt, Human
ugucguaaaagggccgcagugg

SEQ ID NO: 209014 - RNA, 22 nt, Human
uguccuuucagagcuccuuuug

SEQ ID NO: 209015 - RNA, 22 nt, Human
ugucauggacuggauuucugcu

SEQ ID NO: 209016 - RNA, 22 nt, Human
ugucauuggugaucugaugccu

SEQ ID NO: 209017 - RNA, 22 nt, Human
ugcaagugccauggauucaggu

SEQ ID NO: 209018 - RNA, 22 nt, Human
ugauggaguauaauaaaaugac

SEQ ID NO: 209019 - RNA, 22 nt, Human
ugauuugaaaccuuuggcaaga

SEQ ID NO: 209020 - RNA, 22 nt, Human
ugucacagugcacagcuaagaa

SEQ ID NO: 209021 - RNA, 22 nt, Human
ugugaagcgugugcaggggaca

SEQ ID NO: 209022 - RNA, 22 nt, Human
ugugaaggaaaguaggagggac

SEQ ID NO: 209023 - RNA, 22 nt, Human
ugugacugaaaaugauugagug

SEQ ID NO: 209024 - RNA, 22 nt, Human
ugugacaugauggcgucaugua

SEQ ID NO: 209025 - RNA, 22 nt, Human
ugcagcagaauauggcugcagg

SEQ ID NO: 209026 - RNA, 22 nt, Human
ugcagcaucuccuugugccaug

SEQ ID NO: 209027 - RNA, 22 nt, Human
ugcagaggagcuggaaggcugg

SEQ ID NO: 209028 - RNA, 22 nt, Human
ugcagacuguuucuugacugaa

SEQ ID NO: 209029 - RNA, 22 nt, Human
ugucuucuuuucccuuagcccu

SEQ ID NO: 209030 - RNA, 21 nt, Human
ugcaaugcauugacagcagca

SEQ ID NO: 209031 - RNA, 21 nt, Human
ugucugcaauuccagggaacc

SEQ ID NO: 209032 - RNA, 22 nt, Human
ugcaauggauaucugaacgugg

SEQ ID NO: 209033 - RNA, 22 nt, Human
ugucugaauuguaauguugcgu

SEQ ID NO: 209034 - RNA, 22 nt, Human
ugaggaugaggaagaagaagaa

SEQ ID NO: 209035 - RNA, 22 nt, Human
ugguggagucugggggaggcuu

SEQ ID NO: 209036 - RNA, 22 nt, Human
ugagggaggggaaugugugcag

SEQ ID NO: 209037 - RNA, 22 nt, Human
ugguuauauaaggauuaaauac

SEQ ID NO: 209038 - RNA, 22 nt, Human
ugguucacaagaauccagguag

SEQ ID NO: 209039 - RNA, 19 nt, Human
ugagauuguaugaggagau

SEQ ID NO: 209040 - RNA, 22 nt, Human
ugagcaaacacagauaggcuua

SEQ ID NO: 209041 - RNA, 22 nt, Human
ugagccauguucaugagguuca

SEQ ID NO: 209042 - RNA, 22 nt, Human
ugguccgagaacuguccugguu

SEQ ID NO: 209043 - RNA, 22 nt, Human
ugaggagggcuagagucuccug

SEQ ID NO: 209044 - RNA, 22 nt, Human
ugagcaccaggcaccacagcuc

SEQ ID NO: 209045 - RNA, 22 nt, Human
uggucggugguguggggaggca

SEQ ID NO: 209046 - RNA, 22 nt, Human
ugguuuucuuaauuagcaguca

SEQ ID NO: 209047 - RNA, 22 nt, Human
ugguuuuuuguaggauaaacau

SEQ ID NO: 209048 - RNA, 23 nt, Human
ugguuuucagaagaccuuguuag

SEQ ID NO: 209049 - RNA, 22 nt, Human
ugguuucagacagacucgaacu

SEQ ID NO: 209050 - RNA, 22 nt, Human
ugagucugaagagagaauaagg

SEQ ID NO: 209051 - RNA, 22 nt, Human
ugaguccagaugggccagcagg

SEQ ID NO: 209052 - RNA, 19 nt, Human
ugaguacuaaugagauuga

SEQ ID NO: 209053 - RNA, 22 nt, Human
ugagugacuguugucaagaugg

SEQ ID NO: 209054 - RNA, 22 nt, Human
ugagugccagugcuugcucuac

SEQ ID NO: 209055 - RNA, 22 nt, Human
ugagugcuuuucgguguaccgu

SEQ ID NO: 209056 - RNA, 22 nt, Human
ugagugugugcugcuuacauuc

SEQ ID NO: 209057 - RNA, 19 nt, Human
ugaucuccaguacagacau

SEQ ID NO: 209058 - RNA, 22 nt, Human
uguacuguuuucuaggcaaaaa

SEQ ID NO: 209059 - RNA, 22 nt, Human
uguagaaguuaauugaugagua

SEQ ID NO: 209060 - RNA, 20 nt, Human
ugauccacucucauugcucu

SEQ ID NO: 209061 - RNA, 22 nt, Human
ugauagcaugcucucaguaaaa

SEQ ID NO: 209062 - RNA, 22 nt, Human
ugauaugguaauaagauauucu

SEQ ID NO: 209063 - RNA, 22 nt, Human
ugauauaaaagauucuuauuga

SEQ ID NO: 209064 - RNA, 22 nt, Human
uguaagaagaaaaccguaugga

SEQ ID NO: 209065 - RNA, 22 nt, Human
uguaauguuagaaacaauugcu

SEQ ID NO: 209066 - RNA, 22 nt, Human
uggcucaguaaucgagucuccu

SEQ ID NO: 209067 - RNA, 22 nt, Human
ucuuuugugauuuucugaagca

SEQ ID NO: 209068 - RNA, 22 nt, Human
ugacgcauggccagcucugucu

SEQ ID NO: 209069 - RNA, 22 nt, Human
ugaccuuaguuuuuucaaugag

SEQ ID NO: 209070 - RNA, 22 nt, Human
ugaccuccuaagugacagaauu

SEQ ID NO: 209071 - RNA, 22 nt, Human
ugagaaaacaguuuguaauaau

SEQ ID NO: 209072 - RNA, 22 nt, Human
ugacuuauuaaaaguuuuuauu

SEQ ID NO: 209073 - RNA, 22 nt, Human
uggguuaaaguuugucacugac

SEQ ID NO: 209074 - RNA, 22 nt, Human
uggguuaaaaguugaaugaauu

SEQ ID NO: 209075 - RNA, 22 nt, Human
uggguggugaaauggaugggaa

SEQ ID NO: 209076 - RNA, 22 nt, Human
ugacucugaugcaguguguuua

SEQ ID NO: 209077 - RNA, 19 nt, Human
ugacuggguucuaggcagg

SEQ ID NO: 209078 - RNA, 23 nt, Human
ugagacacuggaaggcaagaaaa

SEQ ID NO: 209079 - RNA, 22 nt, Human
ugagagcuccacaccuugcccu

SEQ ID NO: 209080 - RNA, 22 nt, Human
ugagacuuggggggcugagggc

SEQ ID NO: 209081 - RNA, 22 nt, Human
ugguaugaaggaggccggcagc

SEQ ID NO: 209082 - RNA, 22 nt, Human
uggguuugcuuguucagguucu

SEQ ID NO: 209083 - RNA, 22 nt, Human
ugagaagucagucuauugugaa

SEQ ID NO: 209084 - RNA, 22 nt, Human
ugguaacgguuuccuugccauu

SEQ ID NO: 209085 - RNA, 22 nt, Human
ugguaauuuaacaaaauuguca

SEQ ID NO: 209086 - RNA, 22 nt, Human
uggguucugaucccaggacugc

SEQ ID NO: 209087 - RNA, 20 nt, Human
ugagaaacaagggcuggucu

SEQ ID NO: 209088 - RNA, 22 nt, Human
ugagaagaggucuuuugggaug

SEQ ID NO: 209089 - RNA, 22 nt, Human
ugagaacuguuuugguuugggu

SEQ ID NO: 209090 - RNA, 22 nt, Human
ugcucgauuauuucauuuugca

SEQ ID NO: 209091 - RNA, 22 nt, Human
uguugguuucaagcaggagccu

SEQ ID NO: 209092 - RNA, 22 nt, Human
uguuuaaauagaacauacugca

SEQ ID NO: 209093 - RNA, 22 nt, Human
uguuguucuuuuucuucuuguu

SEQ ID NO: 209094 - RNA, 22 nt, Human
uguugucaugcagucaguggua

SEQ ID NO: 209095 - RNA, 23 nt, Human
uguuggcucccagucucccccuc

SEQ ID NO: 209096 - RNA, 18 nt, Human
uguugguguucacucacu

SEQ ID NO: 209097 - RNA, 21 nt, Human
uguuggccuucauucucuguc

SEQ ID NO: 209098 - RNA, 22 nt, Human
uguuggaaucuucuagucuucc

SEQ ID NO: 209099 - RNA, 22 nt, Human
uguguguguguguaugugcgug

SEQ ID NO: 209100 - RNA, 22 nt, Human
uguguguguccucauuugcaga

SEQ ID NO: 209101 - RNA, 20 nt, Human
ugcuccaggaacacuggccg

SEQ ID NO: 209102 - RNA, 22 nt, Human
uguguguguguguguaauauau

SEQ ID NO: 209103 - RNA, 22 nt, Human
ugccugucuaucuuugucaucu

SEQ ID NO: 209104 - RNA, 22 nt, Human
ugccuggugcggagugaguggc

SEQ ID NO: 209105 - RNA, 22 nt, Human
ugccuguguauuuccggccugc

SEQ ID NO: 209106 - RNA, 22 nt, Human
ugcugcacucacaggaagaguu

SEQ ID NO: 209107 - RNA, 22 nt, Human
ugcugacuauacauuuagcauu

SEQ ID NO: 209108 - RNA, 19 nt, Human
ugcugcaggaauucucaag

SEQ ID NO: 209109 - RNA, 22 nt, Human
uguuuaucaguagacucaaguu

SEQ ID NO: 209110 - RNA, 22 nt, Human
uguuuaagugguuaaaggauuc

SEQ ID NO: 209111 - RNA, 22 nt, Human
uguuuagcucugacuaugugau

SEQ ID NO: 209112 - RNA, 22 nt, Human
uguuucaguaugauuuucccuc

SEQ ID NO: 209113 - RNA, 22 nt, Human
ugcucuuucaggcauagaccuu

SEQ ID NO: 209114 - RNA, 22 nt, Human
uguuuccuguaccacagguuuu

SEQ ID NO: 209115 - RNA, 22 nt, Human
uguuuguaugauggcacaucca

SEQ ID NO: 209116 - RNA, 21 nt, Human
uguuugcuuuuggagcaacug

SEQ ID NO: 209117 - RNA, 22 nt, Human
uguuugaugugcacgugugugu

SEQ ID NO: 209118 - RNA, 22 nt, Human
uguuuucuuuccccuucuuuuc

SEQ ID NO: 209119 - RNA, 22 nt, Human
uguuuuuuagagugauacuuuu

SEQ ID NO: 209120 - RNA, 22 nt, Human
ugcugcggauauacaggaucug

SEQ ID NO: 209121 - RNA, 22 nt, Human
ugcugccucugaauggagcagu

SEQ ID NO: 209122 - RNA, 22 nt, Human
uguuuuguuuagguuuguuuuu

SEQ ID NO: 209123 - RNA, 22 nt, Human
uuaaaauuguuaacuuugguga

SEQ ID NO: 209124 - RNA, 22 nt, Human
uuaaagaguuuauuacuuguaa

SEQ ID NO: 209125 - RNA, 22 nt, Human
ugcuggaaggguaguauuaacu

SEQ ID NO: 209126 - RNA, 22 nt, Human
uuaaaucaggcaucauuucagu

SEQ ID NO: 209127 - RNA, 22 nt, Human
ugcugcucaagcugcagcaaaa

SEQ ID NO: 209128 - RNA, 22 nt, Human
ugcugcucuucaccauggccuc

SEQ ID NO: 209129 - RNA, 23 nt, Human
ugcugcgggacccgagcgcgcgc

SEQ ID NO: 209130 - RNA, 22 nt, Human
ugcugcggcgcaggcacuccag

SEQ ID NO: 209131 - RNA, 23 nt, Human
ugcugcuggaguaucuacaaugc

SEQ ID NO: 209132 - RNA, 22 nt, Human
uuaaaagaauccuguuauccuc

SEQ ID NO: 209133 - RNA, 22 nt, Human
ugcuggagucucuugacccugg

SEQ ID NO: 209134 - RNA, 22 nt, Human
ugcugggagcugggccucgaca

SEQ ID NO: 209135 - RNA, 22 nt, Human
uuaacauuguccuuagcagauu

SEQ ID NO: 209136 - RNA, 22 nt, Human
uuaagggauugagauggaauga

SEQ ID NO: 209137 - RNA, 23 nt, Human
uuaaggugccguguaauucaugc

SEQ ID NO: 209138 - RNA, 22 nt, Human
ugcugguuucugaguaaccaca

SEQ ID NO: 209139 - RNA, 22 nt, Human
ugcuggugauuaaauccugaag

SEQ ID NO: 209140 - RNA, 20 nt, Human
ugcugggccaucuugcaugc

SEQ ID NO: 209141 - RNA, 22 nt, Human
ugcuguacaagacccucuguuu

SEQ ID NO: 209142 - RNA, 22 nt, Human
ugcuugcuaucuaaguguuuca

SEQ ID NO: 209143 - RNA, 22 nt, Human
ugcuugggucuguuuugcaaag

SEQ ID NO: 209144 - RNA, 22 nt, Human
ugcuugacucagcaucggcaau

SEQ ID NO: 209145 - RNA, 22 nt, Human
ugcuugaacccaggaaguggag

SEQ ID NO: 209146 - RNA, 22 nt, Human
uuaauucuugagcugucuuucc

SEQ ID NO: 209147 - RNA, 22 nt, Human
ugcuucuuugggggugaagaga

SEQ ID NO: 209148 - RNA, 22 nt, Human
ugcuucuuuaggauguaguuau

SEQ ID NO: 209149 - RNA, 20 nt, Human
ugcuguggguaagcuuuaua

SEQ ID NO: 209150 - RNA, 22 nt, Human
uuaaguauauccauuugacugg

SEQ ID NO: 209151 - RNA, 22 nt, Human
ugcugugcuggcggcagaggcc

SEQ ID NO: 209152 - RNA, 22 nt, Human
uuaauauuuauugguaaucacu

SEQ ID NO: 209153 - RNA, 22 nt, Human
uuaaguccuugguaauuuucuu

SEQ ID NO: 209154 - RNA, 22 nt, Human
uuaaugauuaauguggacccaa

SEQ ID NO: 209155 - RNA, 22 nt, Human
ugcuuaaagcauuucucuuuaa

SEQ ID NO: 209156 - RNA, 22 nt, Human
ugcuguugacuuuguuguucuu

SEQ ID NO: 209157 - RNA, 22 nt, Human
ugcuuacgcaaccuguguuugg

SEQ ID NO: 209158 - RNA, 22 nt, Human
ugcuucucucuaggaagacgcu

SEQ ID NO: 209159 - RNA, 22 nt, Human
ugcuuaucuccuuaguuuuugc

SEQ ID NO: 209160 - RNA, 22 nt, Human
uuaccugcagagacguggaggc

SEQ ID NO: 209161 - RNA, 23 nt, Human
uuacuaugaaaauuccagucacu

SEQ ID NO: 209162 - RNA, 22 nt, Human
ugcuuuggcccaacauugaugc

SEQ ID NO: 209163 - RNA, 22 nt, Human
uggaaaagaugucuuccugaau

SEQ ID NO: 209164 - RNA, 23 nt, Human
ugcuuugauuauuauucccaccu

SEQ ID NO: 209165 - RNA, 22 nt, Human
ugcuuuuguaucagaguauuca

SEQ ID NO: 209166 - RNA, 21 nt, Human
ugcuuuuguugucagcugcug

SEQ ID NO: 209167 - RNA, 22 nt, Human
uuacccuugaauuugugacaaa

SEQ ID NO: 209168 - RNA, 22 nt, Human
ugcuuuccuucccuauguugag

SEQ ID NO: 209169 - RNA, 22 nt, Human
ugcuuucagauaucuguuucaa

SEQ ID NO: 209170 - RNA, 21 nt, Human
ugcuuucugugcuuuuucugc

SEQ ID NO: 209171 - RNA, 22 nt, Human
ugcuuuaccuuccauuuaagga

SEQ ID NO: 209172 - RNA, 22 nt, Human
ugcuuucaaaacucagaggaau

SEQ ID NO: 209173 - RNA, 22 nt, Human
ugcuuucaaugaauuguauacu

SEQ ID NO: 209174 - RNA, 22 nt, Human
uuacaagaucuuugaaggcaag

SEQ ID NO: 209175 - RNA, 22 nt, Human
uuacacaugaagguccaauguu

SEQ ID NO: 209176 - RNA, 22 nt, Human
uuaccgagaacaugacuggaau

SEQ ID NO: 209177 - RNA, 19 nt, Human
uuacaugacauaugaagga

SEQ ID NO: 209178 - RNA, 22 nt, Human
uggaaagaagacugugguugag

SEQ ID NO: 209179 - RNA, 22 nt, Human
uggaaagcagcccugcucccca

SEQ ID NO: 209180 - RNA, 22 nt, Human
uuagaaaaaggcuguggucuua

SEQ ID NO: 209181 - RNA, 22 nt, Human
uuacuguaggugggugaauuug

SEQ ID NO: 209182 - RNA, 22 nt, Human
uuagaaauguccuacuaauaug

SEQ ID NO: 209183 - RNA, 22 nt, Human
uuagaauggaaucauuugcauu

SEQ ID NO: 209184 - RNA, 22 nt, Human
uggaaaugcuuagaggugaucu

SEQ ID NO: 209185 - RNA, 22 nt, Human
uggaacugguuugcuucagacu

SEQ ID NO: 209186 - RNA, 22 nt, Human
uuagagauuuuauguuaaugua

SEQ ID NO: 209187 - RNA, 22 nt, Human
uuagcagacagauggagagaga

SEQ ID NO: 209188 - RNA, 22 nt, Human
uuagaugaaaaucggaacaugu

SEQ ID NO: 209189 - RNA, 22 nt, Human
uuaggggcuuaggcagaguuug

SEQ ID NO: 209190 - RNA, 23 nt, Human
uuagcccaggcuggagguagccc

SEQ ID NO: 209191 - RNA, 22 nt, Human
uuagccuccaguuuucucauuu

SEQ ID NO: 209192 - RNA, 22 nt, Human
uggaagaagcuacaagcgguga

SEQ ID NO: 209193 - RNA, 22 nt, Human
uggaagaucugguguagcuccu

SEQ ID NO: 209194 - RNA, 22 nt, Human
uuagugucugacgcaggcgcca

SEQ ID NO: 209195 - RNA, 22 nt, Human
uuaguggguuccauuucuaugg

SEQ ID NO: 209196 - RNA, 22 nt, Human
uggaaguggcaggggagacgua

SEQ ID NO: 209197 - RNA, 22 nt, Human
uggaagggguuacgcagcagga

SEQ ID NO: 209198 - RNA, 22 nt, Human
uggaaggggccaggcgcggagu

SEQ ID NO: 209199 - RNA, 22 nt, Human
uggaagucuucucucccaugga

SEQ ID NO: 209200 - RNA, 21 nt, Human
uggaagggaagucuugguugu

SEQ ID NO: 209201 - RNA, 22 nt, Human
uggaagggagcuggaauuugga

SEQ ID NO: 209202 - RNA, 20 nt, Human
uggaaggaaagguguaucuu

SEQ ID NO: 209203 - RNA, 19 nt, Human
uuauccggacuuaauuuau

SEQ ID NO: 209204 - RNA, 22 nt, Human
uuaucugcccauuguagaauug

SEQ ID NO: 209205 - RNA, 19 nt, Human
uuauccacagggaauuuau

SEQ ID NO: 209206 - RNA, 22 nt, Human
uuaucuguuuuaaugaauaauu

SEQ ID NO: 209207 - RNA, 21 nt, Human
uggagcagggaggauuugggg

SEQ ID NO: 209208 - RNA, 22 nt, Human
uggagaugcacgagcaggugga

SEQ ID NO: 209209 - RNA, 22 nt, Human
uuaucaaaaaauaguacuuuga

SEQ ID NO: 209210 - RNA, 22 nt, Human
uuaucagggaguuguguguucu

SEQ ID NO: 209211 - RNA, 22 nt, Human
uuauauuuuauuuaauuaaaua

SEQ ID NO: 209212 - RNA, 22 nt, Human
uggagagaaguucuauaaauca

SEQ ID NO: 209213 - RNA, 22 nt, Human
uggagagcaaugaggggcaggc

SEQ ID NO: 209214 - RNA, 22 nt, Human
uggagagauagucauucuagag

SEQ ID NO: 209215 - RNA, 22 nt, Human
uuauaagugccucuuuauuuuc

SEQ ID NO: 209216 - RNA, 21 nt, Human
uggaauuggaaaccauucuau

SEQ ID NO: 209217 - RNA, 22 nt, Human
uggaaugccgggccaggcuccg

SEQ ID NO: 209218 - RNA, 22 nt, Human
uggaaugaaagaaaaauuguag

SEQ ID NO: 209219 - RNA, 23 nt, Human
uggaaguugagagucugcuuugu

SEQ ID NO: 209220 - RNA, 22 nt, Human
uggaagugucagcaggcugguu

SEQ ID NO: 209221 - RNA, 22 nt, Human
uggacagugguggggaggagga

SEQ ID NO: 209222 - RNA, 22 nt, Human
uggacacugguggauauggaau

SEQ ID NO: 209223 - RNA, 22 nt, Human
uggacagguacuucacauuauu

SEQ ID NO: 209224 - RNA, 22 nt, Human
uuauauuaaaaaucgcuaacag

SEQ ID NO: 209225 - RNA, 22 nt, Human
uuauacuucugccagaggacaa

SEQ ID NO: 209226 - RNA, 18 nt, Human
uuauacaauuuuuuuuca

SEQ ID NO: 209227 - RNA, 21 nt, Human
uucuauauugagaauuggcua

SEQ ID NO: 209228 - RNA, 22 nt, Human
uucuaguuacucuuaaaugcug

SEQ ID NO: 209229 - RNA, 22 nt, Human
uggggcgccuggcugaggcugc

SEQ ID NO: 209230 - RNA, 22 nt, Human
uggggcuggccaggaggagucu

SEQ ID NO: 209231 - RNA, 22 nt, Human
uggguagggagcuggaauccua

SEQ ID NO: 209232 - RNA, 22 nt, Human
uggguauauauguugcuacaga

SEQ ID NO: 209233 - RNA, 22 nt, Human
uucuccugcccuuggacuucca

SEQ ID NO: 209234 - RNA, 22 nt, Human
uggguguuccuggggugcaagg

SEQ ID NO: 209235 - RNA, 22 nt, Human
uggguguggaagcagcgugggg

SEQ ID NO: 209236 - RNA, 22 nt, Human
ugggugugcaccuacgaucucu

SEQ ID NO: 209237 - RNA, 22 nt, Human
uggguggauucgggaacuuguu

SEQ ID NO: 209238 - RNA, 22 nt, Human
ugggugaugagguccccagccc

SEQ ID NO: 209239 - RNA, 22 nt, Human
uggguguguccauauuuugacu

SEQ ID NO: 209240 - RNA, 22 nt, Human
uggguucaaauccugguuccac

SEQ ID NO: 209241 - RNA, 23 nt, Human
uggguuucagugccaaugcugcc

SEQ ID NO: 209242 - RNA, 22 nt, Human
uucugcuuuaaagcucauguuu

SEQ ID NO: 209243 - RNA, 21 nt, Human
uucugcuguucaccaccaccc

SEQ ID NO: 209244 - RNA, 20 nt, Human
uucugcucuagagucuagaa

SEQ ID NO: 209245 - RNA, 22 nt, Human
uucugcuagugguauauguuga

SEQ ID NO: 209246 - RNA, 18 nt, Human
uucugcggugacagauau

SEQ ID NO: 209247 - RNA, 22 nt, Human
ugguaaaguguacugaauauga

SEQ ID NO: 209248 - RNA, 22 nt, Human
ugguacaaaaaagauuuuggac

SEQ ID NO: 209249 - RNA, 22 nt, Human
ugguauaaaaauuugugaaugu

SEQ ID NO: 209250 - RNA, 22 nt, Human
uucuggagucuauuuugaaaag

SEQ ID NO: 209251 - RNA, 22 nt, Human
ugguccaaaccagugcuguggu

SEQ ID NO: 209252 - RNA, 22 nt, Human
uggucacgucgggguauugcca

SEQ ID NO: 209253 - RNA, 22 nt, Human
uggucacagauuuacaggaaug

SEQ ID NO: 209254 - RNA, 22 nt, Human
uggucacacugcauaacacgca

SEQ ID NO: 209255 - RNA, 22 nt, Human
uucuggucucucugaccuagga

SEQ ID NO: 209256 - RNA, 22 nt, Human
ugguauauuugaccauaugugu

SEQ ID NO: 209257 - RNA, 22 nt, Human
uucugucaguguugguggaaau

SEQ ID NO: 209258 - RNA, 22 nt, Human
uucuggugauuugccucuuuag

SEQ ID NO: 209259 - RNA, 22 nt, Human
uucugggguaagcacugaggau

SEQ ID NO: 209260 - RNA, 22 nt, Human
ugguauaaaaaaaugaguauaa

SEQ ID NO: 209261 - RNA, 22 nt, Human
uucuggaguuugaagaucaggu

SEQ ID NO: 209262 - RNA, 22 nt, Human
uucauuuuauauuagagcuguu

SEQ ID NO: 209263 - RNA, 22 nt, Human
uuccaugccuaagagccugaag

SEQ ID NO: 209264 - RNA, 22 nt, Human
uuccacaugaucauuguaauaa

SEQ ID NO: 209265 - RNA, 22 nt, Human
uuccaaggagagcucgaccuca

SEQ ID NO: 209266 - RNA, 22 nt, Human
uuccaacaugugcuuguguuga

SEQ ID NO: 209267 - RNA, 22 nt, Human
uuaugggguuaaauuucuccua

SEQ ID NO: 209268 - RNA, 22 nt, Human
uuauggauuagaguuugauucu

SEQ ID NO: 209269 - RNA, 22 nt, Human
uggagcuggcuuguggaaguug

SEQ ID NO: 209270 - RNA, 22 nt, Human
uggagcugaaguacucucacua

SEQ ID NO: 209271 - RNA, 22 nt, Human
ugggaagccaguaucagacuaa

SEQ ID NO: 209272 - RNA, 22 nt, Human
ugggaagcugagccucgaugug

SEQ ID NO: 209273 - RNA, 22 nt, Human
uggcuuuuuauuccuaugugau

SEQ ID NO: 209274 - RNA, 22 nt, Human
uggcuuauggguccucccucuu

SEQ ID NO: 209275 - RNA, 22 nt, Human
uggcugagugaacauguccauu

SEQ ID NO: 209276 - RNA, 18 nt, Human
uucgucauggggaucgua

SEQ ID NO: 209277 - RNA, 22 nt, Human
uucgucauuaugcagccuguga

SEQ ID NO: 209278 - RNA, 22 nt, Human
ugggauucugaaaauggauuac

SEQ ID NO: 209279 - RNA, 22 nt, Human
uuccuggaguggagggagguga

SEQ ID NO: 209280 - RNA, 22 nt, Human
uuccuguggggugucaucauag

SEQ ID NO: 209281 - RNA, 20 nt, Human
uuccuuaucuguaaagugga

SEQ ID NO: 209282 - RNA, 22 nt, Human
uuccugcuggucaaaguugccu

SEQ ID NO: 209283 - RNA, 22 nt, Human
uuccuuuaaccaagagcaguac

SEQ ID NO: 209284 - RNA, 22 nt, Human
uuccuucccccuucuuugccuu

SEQ ID NO: 209285 - RNA, 21 nt, Human
uucgaaugggucguugcugcc

SEQ ID NO: 209286 - RNA, 22 nt, Human
uggggcauacgugaaauaauuu

SEQ ID NO: 209287 - RNA, 22 nt, Human
uucccugggggggccgcuuucc

SEQ ID NO: 209288 - RNA, 22 nt, Human
uucccgcugcuggaguuggggc

SEQ ID NO: 209289 - RNA, 18 nt, Human
ugggacucugacuugguu

SEQ ID NO: 209290 - RNA, 22 nt, Human
uuccugacacuggcaggcuucu

SEQ ID NO: 209291 - RNA, 22 nt, Human
uuccucuugaaucugucugacu

SEQ ID NO: 209292 - RNA, 21 nt, Human
uuccuccucuggagaagaaga

SEQ ID NO: 209293 - RNA, 22 nt, Human
uugaaucauauguaauugacuu

SEQ ID NO: 209294 - RNA, 21 nt, Human
uugaaguggguagcuggcggg

SEQ ID NO: 209295 - RNA, 20 nt, Human
uugagccucauggauugucu

SEQ ID NO: 209296 - RNA, 22 nt, Human
uugacguccucgauggggaacu

SEQ ID NO: 209297 - RNA, 22 nt, Human
uguccagcuauauguguaugug

SEQ ID NO: 209298 - RNA, 22 nt, Human
uugaugacuaaagaaagcugcu

SEQ ID NO: 209299 - RNA, 22 nt, Human
uugaugacauuuagcauaauug

SEQ ID NO: 209300 - RNA, 22 nt, Human
uugauaacuuagcugggcugcu

SEQ ID NO: 209301 - RNA, 21 nt, Human
ugucagcaacaauacuuucuc

SEQ ID NO: 209302 - RNA, 20 nt, Human
uugaggagauauugaauacu

SEQ ID NO: 209303 - RNA, 22 nt, Human
uugaggaagggaggcaaaacug

SEQ ID NO: 209304 - RNA, 21 nt, Human
uugagcuuuuaguacagacag

SEQ ID NO: 209305 - RNA, 22 nt, Human
ugucugauccuucaggagcccc

SEQ ID NO: 209306 - RNA, 20 nt, Human
ugucugguaagacgcccauc

SEQ ID NO: 209307 - RNA, 22 nt, Human
ugucugggauguuggcagccac

SEQ ID NO: 209308 - RNA, 22 nt, Human
uugauuuggcguuuuccuccug

SEQ ID NO: 209309 - RNA, 22 nt, Human
ugucuuaaaauuuuagggcuau

SEQ ID NO: 209310 - RNA, 22 nt, Human
ugucuuaugcugcauagacuau

SEQ ID NO: 209311 - RNA, 22 nt, Human
uugccaggagacaucuggagcc

SEQ ID NO: 209312 - RNA, 22 nt, Human
ugugccuguugguguagacaua

SEQ ID NO: 209313 - RNA, 22 nt, Human
uugcccuaccccaggccuuuuu

SEQ ID NO: 209314 - RNA, 22 nt, Human
uugcaucaaauauguaccacag

SEQ ID NO: 209315 - RNA, 22 nt, Human
uugcaugauuuaagaauaucug

SEQ ID NO: 209316 - RNA, 22 nt, Human
ugucuucauuccccaugaaguc

SEQ ID NO: 209317 - RNA, 22 nt, Human
uucugugcugagaaauagagag

SEQ ID NO: 209318 - RNA, 22 nt, Human
uucugugacgcaaagcugggaa

SEQ ID NO: 209319 - RNA, 22 nt, Human
uggucuuuccuucauuguccag

SEQ ID NO: 209320 - RNA, 22 nt, Human
uggucuccucuuaauugccuac

SEQ ID NO: 209321 - RNA, 22 nt, Human
uggucugauggucccaccaccg

SEQ ID NO: 209322 - RNA, 22 nt, Human
ugguccuuuccauuggagacac

SEQ ID NO: 209323 - RNA, 20 nt, Human
uucuguggcccguuuaagug

SEQ ID NO: 209324 - RNA, 22 nt, Human
uggugcccguggaaagagggag

SEQ ID NO: 209325 - RNA, 22 nt, Human
uggugccuuccgagagcuguga

SEQ ID NO: 209326 - RNA, 19 nt, Human
uggugcgcuguuccugagc

SEQ ID NO: 209327 - RNA, 22 nt, Human
ugguucuagaugagaugaugag

SEQ ID NO: 209328 - RNA, 20 nt, Human
ugguuaaagugggugagcgg

SEQ ID NO: 209329 - RNA, 22 nt, Human
ugguuauggaacuggcuauggc

SEQ ID NO: 209330 - RNA, 22 nt, Human
ugguuacagaugaagaucggcc

SEQ ID NO: 209331 - RNA, 22 nt, Human
uucuugcuuccggugcuccagg

SEQ ID NO: 209332 - RNA, 20 nt, Human
ugguguccuaugcuugugcu

SEQ ID NO: 209333 - RNA, 22 nt, Human
uggugcuuuuguggaugcuaac

SEQ ID NO: 209334 - RNA, 22 nt, Human
uucuucuguuggcagagcauac

SEQ ID NO: 209335 - RNA, 22 nt, Human
uucuugagaacaaauuccugga

SEQ ID NO: 209336 - RNA, 22 nt, Human
uucuuuguccuagcauucuaca

SEQ ID NO: 209337 - RNA, 22 nt, Human
uucuuuuaauagagauccugug

SEQ ID NO: 209338 - RNA, 22 nt, Human
uguaaagugguauuuaauuuua

SEQ ID NO: 209339 - RNA, 22 nt, Human
uucuuuuaauuucugucugcag

SEQ ID NO: 209340 - RNA, 22 nt, Human
ugguugagguugacucuauaua

SEQ ID NO: 209341 - RNA, 17 nt, Human
ugguucuuuuccugacc

SEQ ID NO: 209342 - RNA, 22 nt, Human
ugguucugucugugcugggggg

SEQ ID NO: 209343 - RNA, 22 nt, Human
ugguucugccacuuuccccuug

SEQ ID NO: 209344 - RNA, 22 nt, Human
uguaaaguuuccuauugcccua

SEQ ID NO: 209345 - RNA, 22 nt, Human
uugaaaaaugcccagcagacaa

SEQ ID NO: 209346 - RNA, 22 nt, Human
uguacauuuacaaaagcuuuau

SEQ ID NO: 209347 - RNA, 17 nt, Human
uguaccgaguguguaua

SEQ ID NO: 209348 - RNA, 22 nt, Human
uugaagaagucaaaagcugcag

SEQ ID NO: 209349 - RNA, 22 nt, Human
uugaagccaccacuguaaguca

SEQ ID NO: 209350 - RNA, 22 nt, Human
uguauaaaauggaaugucagaa

SEQ ID NO: 209351 - RNA, 22 nt, Human
uugaaagucuaagaauagguau

SEQ ID NO: 209352 - RNA, 22 nt, Human
uguaggcacauguauauauccc

SEQ ID NO: 209353 - RNA, 22 nt, Human
uguagucucagggagcugcuuc

SEQ ID NO: 209354 - RNA, 22 nt, Human
uuuauaaacacaagaugggcuc

SEQ ID NO: 209355 - RNA, 22 nt, Human
uuuagugaagcuuugcauuuca

SEQ ID NO: 209356 - RNA, 22 nt, Human
uuaggcugcuuuggaaaacugu

SEQ ID NO: 209357 - RNA, 22 nt, Human
uuagaugcugugauuuuucaaa

SEQ ID NO: 209358 - RNA, 22 nt, Human
uuaggcuaauagagauggaaug

SEQ ID NO: 209359 - RNA, 22 nt, Human
uuaguccuaaauuuagauuuuc

SEQ ID NO: 209360 - RNA, 22 nt, Human
uuuaugguacaggaaugcuguu

SEQ ID NO: 209361 - RNA, 22 nt, Human
uuaguauuuuuugaaugaugaa

SEQ ID NO: 209362 - RNA, 22 nt, Human
uuaguauuuucaccauaugagg

SEQ ID NO: 209363 - RNA, 22 nt, Human
uuagguuuaugaggucugcauu

SEQ ID NO: 209364 - RNA, 22 nt, Human
uuacuuuuuucccccuuagaug

SEQ ID NO: 209365 - RNA, 17 nt, Human
uuagagcuacauguuga

SEQ ID NO: 209366 - RNA, 22 nt, Human
uuuaguauaguaugugcucaaa

SEQ ID NO: 209367 - RNA, 22 nt, Human
uuagaguucaagcuuuaggaaa

SEQ ID NO: 209368 - RNA, 22 nt, Human
uuuaaugaugucuaugccuguu

SEQ ID NO: 209369 - RNA, 22 nt, Human
uuacaucacuuuacuuaauaau

SEQ ID NO: 209370 - RNA, 22 nt, Human
uuacaguuuacauaagaauugu

SEQ ID NO: 209371 - RNA, 22 nt, Human
uuaauuguuagauagauuauag

SEQ ID NO: 209372 - RNA, 18 nt, Human
uuuaauaagccuguuaug

SEQ ID NO: 209373 - RNA, 22 nt, Human
uuuaacccaaauaaccacagga

SEQ ID NO: 209374 - RNA, 21 nt, Human
uuaauugagggauggggguga

SEQ ID NO: 209375 - RNA, 22 nt, Human
uuuaccugucuguagaacauaa

SEQ ID NO: 209376 - RNA, 22 nt, Human
uuuaccucguuguguccuuguu

SEQ ID NO: 209377 - RNA, 22 nt, Human
uuuaaugguuuauggucuaaga

SEQ ID NO: 209378 - RNA, 22 nt, Human
uuuacuuuugguaaggucauuu

SEQ ID NO: 209379 - RNA, 22 nt, Human
uuuacuuguuuugcucuuuucc

SEQ ID NO: 209380 - RNA, 22 nt, Human
uuuacuauuaguauuucauuuu

SEQ ID NO: 209381 - RNA, 22 nt, Human
uuacuguguguaaaauaucuuu

SEQ ID NO: 209382 - RNA, 22 nt, Human
uuaacggugagacgccccaaau

SEQ ID NO: 209383 - RNA, 22 nt, Human
uuaacgaauugugcauaauucc

SEQ ID NO: 209384 - RNA, 22 nt, Human
uuaaggcuguggggauuacugc

SEQ ID NO: 209385 - RNA, 22 nt, Human
uuaaagguacuccuaagcgggg

SEQ ID NO: 209386 - RNA, 22 nt, Human
uuguuauaggaucagugucacu

SEQ ID NO: 209387 - RNA, 22 nt, Human
uuguguuuaaucuguuccacua

SEQ ID NO: 209388 - RNA, 22 nt, Human
uuguuccuaguuguccaucaca

SEQ ID NO: 209389 - RNA, 22 nt, Human
uuguugcaagccuggaaucugg

SEQ ID NO: 209390 - RNA, 22 nt, Human
uuguuuggcaaaugugugugug

SEQ ID NO: 209391 - RNA, 22 nt, Human
uuguuugcacuuuagagacugu

SEQ ID NO: 209392 - RNA, 22 nt, Human
uuuaaauaguugguuuuuuugc

SEQ ID NO: 209393 - RNA, 22 nt, Human
uuuaaacuaacaguacacguug

SEQ ID NO: 209394 - RNA, 22 nt, Human
uuuaaagucaggcuguaguggu

SEQ ID NO: 209395 - RNA, 23 nt, Human
uuuaaacaauguggucguggugg

SEQ ID NO: 209396 - RNA, 22 nt, Human
uuaauguugacacacuagcaca

SEQ ID NO: 209397 - RNA, 22 nt, Human
uuaauguuuuagaaugagagug

SEQ ID NO: 209398 - RNA, 22 nt, Human
uuuaaaccuuggaagccacaua

SEQ ID NO: 209399 - RNA, 21 nt, Human
uuaaugcuaugcagaaaaucu

SEQ ID NO: 209400 - RNA, 22 nt, Human
uuaauguggaagaguuuggcua

SEQ ID NO: 209401 - RNA, 22 nt, Human
uuaaugcauguaaaugugcaaa

SEQ ID NO: 209402 - RNA, 22 nt, Human
uuaaugcagguacuguuacaau

SEQ ID NO: 209403 - RNA, 22 nt, Human
uuguuuuaaaaagaauaacuac

SEQ ID NO: 209404 - RNA, 22 nt, Human
uuaauaaggaccugugacaugc

SEQ ID NO: 209405 - RNA, 22 nt, Human
uuaauacugugucuuuuuuaau

SEQ ID NO: 209406 - RNA, 22 nt, Human
uuaaucagacauucucaaguuu

SEQ ID NO: 209407 - RNA, 22 nt, Human
uuaauauuaagauauugagugg

SEQ ID NO: 209408 - RNA, 22 nt, Human
uuguuuuucucuagggaaggcu

SEQ ID NO: 209409 - RNA, 22 nt, Human
uuuaaaacagcauuuaaaaggu

SEQ ID NO: 209410 - RNA, 22 nt, Human
uuguuuucuugaugaaauuauu

SEQ ID NO: 209411 - RNA, 22 nt, Human
uuguuuucuaguguuuugaaua

SEQ ID NO: 209412 - RNA, 22 nt, Human
uuguuuuaguagaaguuacaug

SEQ ID NO: 209413 - RNA, 22 nt, Human
uguguguguauacauguauaua

SEQ ID NO: 209414 - RNA, 22 nt, Human
uguguguaugagcauuuguaug

SEQ ID NO: 209415 - RNA, 22 nt, Human
ugugucuuuggcgaugucugga

SEQ ID NO: 209416 - RNA, 22 nt, Human
ugugucgccaacaauugugucu

SEQ ID NO: 209417 - RNA, 22 nt, Human
ugugucuccacugugcuauuuu

SEQ ID NO: 209418 - RNA, 19 nt, Human
uguguguguuuuguuugaa

SEQ ID NO: 209419 - RNA, 22 nt, Human
uguguguguuguaugaaauuuu

SEQ ID NO: 209420 - RNA, 22 nt, Human
uguguuacaauaauggcaagua

SEQ ID NO: 209421 - RNA, 22 nt, Human
uuggaaauguagaaaagcagau

SEQ ID NO: 209422 - RNA, 22 nt, Human
uugcguaucuacauugccugua

SEQ ID NO: 209423 - RNA, 22 nt, Human
uugcuaagguuuaacuauugga

SEQ ID NO: 209424 - RNA, 22 nt, Human
uugcguaauuugagauuguaaa

SEQ ID NO: 209425 - RNA, 22 nt, Human
uugcggaucuucauggccucag

SEQ ID NO: 209426 - RNA, 20 nt, Human
uugcggccuaacagccccuu

SEQ ID NO: 209427 - RNA, 21 nt, Human
uguguaccuucuuccgagcuc

SEQ ID NO: 209428 - RNA, 22 nt, Human
uuggacugguuuacauuucaag

SEQ ID NO: 209429 - RNA, 22 nt, Human
uuggacugggauggccgaggcu

SEQ ID NO: 209430 - RNA, 22 nt, Human
uuggaauuugagaccaagaaaa

SEQ ID NO: 209431 - RNA, 23 nt, Human
uguuaucacauguuccuuuaaau

SEQ ID NO: 209432 - RNA, 22 nt, Human
uguuauugccucaugagacucc

SEQ ID NO: 209433 - RNA, 21 nt, Human
uuggcuacugcuucagaggga

SEQ ID NO: 209434 - RNA, 22 nt, Human
uuggcguuuccuguucugggug

SEQ ID NO: 209435 - RNA, 22 nt, Human
uguuccuggggaccugccuucc

SEQ ID NO: 209436 - RNA, 22 nt, Human
uuggggaggaagauagggugaa

SEQ ID NO: 209437 - RNA, 20 nt, Human
uuggggacaggagugugaug

SEQ ID NO: 209438 - RNA, 22 nt, Human
uuggcaaaaauacuguaggccu

SEQ ID NO: 209439 - RNA, 22 nt, Human
uuggcagagaacagaaugauuu

SEQ ID NO: 209440 - RNA, 22 nt, Human
uguguucagaagaggcugccgg

SEQ ID NO: 209441 - RNA, 19 nt, Human
uguguuccauccaccaccc

SEQ ID NO: 209442 - RNA, 22 nt, Human
uuggcauuccagaugcuuuucu

SEQ ID NO: 209443 - RNA, 21 nt, Human
uguguuuauauguguuuauau

SEQ ID NO: 209444 - RNA, 22 nt, Human
uguguuguuggggauguuuuca

SEQ ID NO: 209445 - RNA, 21 nt, Human
uugugaaaguccaggaacaac

SEQ ID NO: 209446 - RNA, 22 nt, Human
uugugacaauacagcauggaga

SEQ ID NO: 209447 - RNA, 22 nt, Human
uugucuguacuggcugcaucga

SEQ ID NO: 209448 - RNA, 21 nt, Human
uguuuuguaauagauacuaug

SEQ ID NO: 209449 - RNA, 22 nt, Human
uguuuucuauuaccugagauug

SEQ ID NO: 209450 - RNA, 22 nt, Human
uguuuguuuuguauuuuuaauu

SEQ ID NO: 209451 - RNA, 22 nt, Human
uguuuucaucucucacccagaa

SEQ ID NO: 209452 - RNA, 22 nt, Human
uguuuuucaagcauuuauuaau

SEQ ID NO: 209453 - RNA, 22 nt, Human
uguuuuuucccccccuucuaaa

SEQ ID NO: 209454 - RNA, 22 nt, Human
uuguggcaggauggacagcaga

SEQ ID NO: 209455 - RNA, 22 nt, Human
uugugauuaauaacuuuucucu

SEQ ID NO: 209456 - RNA, 22 nt, Human
uugugcauuuuguuuuacuuau

SEQ ID NO: 209457 - RNA, 22 nt, Human
uugugcauuugcuaugggccau

SEQ ID NO: 209458 - RNA, 22 nt, Human
uugugcacauuucauugaccug

SEQ ID NO: 209459 - RNA, 22 nt, Human
uugugccuuaauauaggcgcug

SEQ ID NO: 209460 - RNA, 22 nt, Human
uguuuuuauucuuaauguuuca

SEQ ID NO: 209461 - RNA, 22 nt, Human
uguuuuuagcuguuuuuuggau

SEQ ID NO: 209462 - RNA, 22 nt, Human
uguuguuguuguuguuguuguu

SEQ ID NO: 209463 - RNA, 22 nt, Human
uugucaggaacuaugauuaugc

SEQ ID NO: 209464 - RNA, 22 nt, Human
uuguaaguuuuagguguuucaa

SEQ ID NO: 209465 - RNA, 22 nt, Human
uuguauuaauacacuccuuuuc

SEQ ID NO: 209466 - RNA, 22 nt, Human
uugguauucaguuggauuugga

SEQ ID NO: 209467 - RNA, 22 nt, Human
uugguuuacucuggggauaucu

SEQ ID NO: 209468 - RNA, 22 nt, Human
uugguugcugaugagcuuugag

SEQ ID NO: 209469 - RNA, 22 nt, Human
uugguuuuauucguauuuguau

SEQ ID NO: 209470 - RNA, 19 nt, Human
uguugugggccacuaacua

SEQ ID NO: 209471 - RNA, 22 nt, Human
uuggguaacuucccagaggguc

SEQ ID NO: 209472 - RNA, 22 nt, Human
uuggggaugccccuacgggcua

SEQ ID NO: 209473 - RNA, 22 nt, Human
uugggugcugcacccuucaaca

SEQ ID NO: 209474 - RNA, 22 nt, Human
uugguaccaagcaaacuuucug

SEQ ID NO: 209475 - RNA, 22 nt, Human
uucacccaaaucaagcuggccu

SEQ ID NO: 209476 - RNA, 22 nt, Human
uucacguuguugaagaaaauac

SEQ ID NO: 209477 - RNA, 22 nt, Human
uucacugacaguauugaggagg

SEQ ID NO: 209478 - RNA, 22 nt, Human
uucacugugauugggguggauu

SEQ ID NO: 209479 - RNA, 22 nt, Human
uucagaauuaucauaauuuuga

SEQ ID NO: 209480 - RNA, 22 nt, Human
uucacuuuuucucugcuugaga

SEQ ID NO: 209481 - RNA, 22 nt, Human
uuugauuuuuugagcaguguau

SEQ ID NO: 209482 - RNA, 22 nt, Human
uucacaauuuuaaaaaguggaa

SEQ ID NO: 209483 - RNA, 22 nt, Human
uuaguuacuugacucaagaccc

SEQ ID NO: 209484 - RNA, 22 nt, Human
uuuauguugagcaaaauaccac

SEQ ID NO: 209485 - RNA, 22 nt, Human
uuuauuugggauuucucaucug

SEQ ID NO: 209486 - RNA, 22 nt, Human
uuuauuuggugguguuacuguu

SEQ ID NO: 209487 - RNA, 22 nt, Human
uuaguuaccacugcagaucuuu

SEQ ID NO: 209488 - RNA, 22 nt, Human
uucagauuuguuuuuguuucug

SEQ ID NO: 209489 - RNA, 22 nt, Human
uucagcacuggacagcgagucu

SEQ ID NO: 209490 - RNA, 22 nt, Human
uucagcauggcuguuuucccuu

SEQ ID NO: 209491 - RNA, 22 nt, Human
uuugcuguccaauauucagggu

SEQ ID NO: 209492 - RNA, 22 nt, Human
uucagcugcuugccugaaguca

SEQ ID NO: 209493 - RNA, 23 nt, Human
uuugccuaaugaagacuauguca

SEQ ID NO: 209494 - RNA, 19 nt, Human
uuugccugugguucagaag

SEQ ID NO: 209495 - RNA, 22 nt, Human
uuugcugggaagccuucacucu

SEQ ID NO: 209496 - RNA, 22 nt, Human
uucaggacacauuauuuaugaa

SEQ ID NO: 209497 - RNA, 22 nt, Human
uuuggcuccccaggaucugaaa

SEQ ID NO: 209498 - RNA, 22 nt, Human
uuuggcugucauuugaaaaugu

SEQ ID NO: 209499 - RNA, 22 nt, Human
uucagguuuuaugguaaugcuu

SEQ ID NO: 209500 - RNA, 22 nt, Human
uucauccucuaguacugaagug

SEQ ID NO: 209501 - RNA, 22 nt, Human
uucauauuguggucuugcauuc

SEQ ID NO: 209502 - RNA, 19 nt, Human
uuuguuguaucagagcuuu

SEQ ID NO: 209503 - RNA, 22 nt, Human
uuuguugguugcacuggugggu

SEQ ID NO: 209504 - RNA, 22 nt, Human
uucccggccgccccccgcucgg

SEQ ID NO: 209505 - RNA, 22 nt, Human
uuuguucaguuuguugugggug

SEQ ID NO: 209506 - RNA, 22 nt, Human
uuccccgagccuggggaagcug

SEQ ID NO: 209507 - RNA, 22 nt, Human
uuuguguuacaguccuagaacu

SEQ ID NO: 209508 - RNA, 22 nt, Human
uuccauggggcuguugcgcaga

SEQ ID NO: 209509 - RNA, 22 nt, Human
uuccauuacuaaugccugcaau

SEQ ID NO: 209510 - RNA, 22 nt, Human
uucaugcgcuuuucaggagugu

SEQ ID NO: 209511 - RNA, 20 nt, Human
uucaugcagugguugcugug

SEQ ID NO: 209512 - RNA, 22 nt, Human
uucauuauuaauaauagcagcu

SEQ ID NO: 209513 - RNA, 22 nt, Human
uucaugucuuugauucugauaa

SEQ ID NO: 209514 - RNA, 22 nt, Human
uucauuagcguaggauguguac

SEQ ID NO: 209515 - RNA, 22 nt, Human
uuuggguuuuuccuuagggacu

SEQ ID NO: 209516 - RNA, 22 nt, Human
uucauggauuugugaaauuuag

SEQ ID NO: 209517 - RNA, 19 nt, Human
uuccacugcuuagcauugc

SEQ ID NO: 209518 - RNA, 22 nt, Human
uuccaggacuggguguuugaag

SEQ ID NO: 209519 - RNA, 22 nt, Human
uuccugaucuuuucccagaguu

SEQ ID NO: 209520 - RNA, 22 nt, Human
uuccucauucuggggcauguug

SEQ ID NO: 209521 - RNA, 22 nt, Human
uuccucauuuggcacaucugag

SEQ ID NO: 209522 - RNA, 20 nt, Human
uuccucaaaagucugaugcu

SEQ ID NO: 209523 - RNA, 22 nt, Human
uuuguuugcugagugaauucaa

SEQ ID NO: 209524 - RNA, 17 nt, Human
uuuguuucauacuucau

SEQ ID NO: 209525 - RNA, 22 nt, Human
uuuguuuccagccuuuugucuu

SEQ ID NO: 209526 - RNA, 21 nt, Human
uuccuggaggcagaaacguga

SEQ ID NO: 209527 - RNA, 22 nt, Human
uuuuaaaguaauugaagcuugu

SEQ ID NO: 209528 - RNA, 22 nt, Human
uuccuuuucuucuaccacaugu

SEQ ID NO: 209529 - RNA, 22 nt, Human
uuuuaacuuuggguucucuuua

SEQ ID NO: 209530 - RNA, 22 nt, Human
uuuuaacuuuaccauuucuuca

SEQ ID NO: 209531 - RNA, 22 nt, Human
uucgcggccaggcggggaggcc

SEQ ID NO: 209532 - RNA, 22 nt, Human
uucuauaagagaugaauacagu

SEQ ID NO: 209533 - RNA, 22 nt, Human
uuuuauaauacccuugacuaau

SEQ ID NO: 209534 - RNA, 22 nt, Human
uuuucaguuccaucucugcucu

SEQ ID NO: 209535 - RNA, 22 nt, Human
uuuuaucagagcuugcagugug

SEQ ID NO: 209536 - RNA, 22 nt, Human
uuuucauagccagaaacugaaa

SEQ ID NO: 209537 - RNA, 22 nt, Human
uuuuccuuccugucucuuuauu

SEQ ID NO: 209538 - RNA, 22 nt, Human
uucucucaguuaaacuuuguga

SEQ ID NO: 209539 - RNA, 22 nt, Human
uucucugaagagccagcccuua

SEQ ID NO: 209540 - RNA, 22 nt, Human
uuuuaaucagguauuugaguau

SEQ ID NO: 209541 - RNA, 22 nt, Human
uuuuaauucaacauuugcuuuu

SEQ ID NO: 209542 - RNA, 22 nt, Human
uucggcagaaagucauuugucu

SEQ ID NO: 209543 - RNA, 22 nt, Human
uucgcucuucacacagugcuga

SEQ ID NO: 209544 - RNA, 22 nt, Human
uucggugagcugcgggcgagga

SEQ ID NO: 209545 - RNA, 22 nt, Human
uucgucaauaugcagccuguga

SEQ ID NO: 209546 - RNA, 23 nt, Human
uuuuacaagagugcauuugucuc

SEQ ID NO: 209547 - RNA, 22 nt, Human
uuuuacaaugcaaauucuugcu

SEQ ID NO: 209548 - RNA, 22 nt, Human
uuuuacuuuucccacuuacagc

SEQ ID NO: 209549 - RNA, 22 nt, Human
uuuucuuggaguggcuguccuu

SEQ ID NO: 209550 - RNA, 22 nt, Human
uuuugaauaauucagaaacagc

SEQ ID NO: 209551 - RNA, 22 nt, Human
uuuugccuauuguaucaucgua

SEQ ID NO: 209552 - RNA, 22 nt, Human
uucugugacuccucagagauuu

SEQ ID NO: 209553 - RNA, 22 nt, Human
uucuguuuuuauucuaucucug

SEQ ID NO: 209554 - RNA, 22 nt, Human
uuuugggugcaaauuguuuguu

SEQ ID NO: 209555 - RNA, 22 nt, Human
uuuucuacaaucacucuggaag

SEQ ID NO: 209556 - RNA, 22 nt, Human
uuuucucacugagagccuugau

SEQ ID NO: 209557 - RNA, 22 nt, Human
uuuucuacaaaucuggacuuuu

SEQ ID NO: 209558 - RNA, 22 nt, Human
uuuuccuugagucggggcacag

SEQ ID NO: 209559 - RNA, 22 nt, Human
uuuucuucggugcuggguugau

SEQ ID NO: 209560 - RNA, 22 nt, Human
uuuucugauccuucuaacuuga

SEQ ID NO: 209561 - RNA, 22 nt, Human
uuuucuucucauucugaccuca

SEQ ID NO: 209562 - RNA, 22 nt, Human
uuuucucaguuuuuuucaaaag

SEQ ID NO: 209563 - RNA, 22 nt, Human
uuuucucucacuucacauauuu

SEQ ID NO: 209564 - RNA, 22 nt, Human
uucuugugugaauauaauuaca

SEQ ID NO: 209565 - RNA, 22 nt, Human
uuuuuaaaauuaggacggcacg

SEQ ID NO: 209566 - RNA, 22 nt, Human
uucuuguccacagaagagcuca

SEQ ID NO: 209567 - RNA, 22 nt, Human
uucuugcuucucugucugccuc

SEQ ID NO: 209568 - RNA, 22 nt, Human
uuuugucuguggaaagcugcua

SEQ ID NO: 209569 - RNA, 22 nt, Human
uucuugcgaaagaaugagcuga

SEQ ID NO: 209570 - RNA, 20 nt, Human
uuuuguccaccugcaggaag

SEQ ID NO: 209571 - RNA, 22 nt, Human
uuuugguaguccagaguuuagu

SEQ ID NO: 209572 - RNA, 22 nt, Human
uugaaaaaaucugaggaggacc

SEQ ID NO: 209573 - RNA, 22 nt, Human
uucuuugcccauguuuccuaag

SEQ ID NO: 209574 - RNA, 22 nt, Human
uucuuugcucaccugccgcucc

SEQ ID NO: 209575 - RNA, 22 nt, Human
uuuuucuuugcuuuccacuggc

SEQ ID NO: 209576 - RNA, 22 nt, Human
uuuuucugacugcuaacaaaaa

SEQ ID NO: 209577 - RNA, 22 nt, Human
uuuuucuuugguaacucuuccu

SEQ ID NO: 209578 - RNA, 22 nt, Human
uugaaggugggaggauuuauau

SEQ ID NO: 209579 - RNA, 22 nt, Human
uuuuuguaaaugaaguuuuauu

SEQ ID NO: 209580 - RNA, 22 nt, Human
uugaaaucuucccuccugucug

SEQ ID NO: 209581 - RNA, 22 nt, Human
uugaacaguuuugucagguuca

SEQ ID NO: 209582 - RNA, 22 nt, Human
uuuuuuccugguuacagauugu

SEQ ID NO: 209583 - RNA, 22 nt, Human
uugaauuuagguuuaugugaaa

SEQ ID NO: 209584 - RNA, 22 nt, Human
uugaauaaggcauaaagauacu

SEQ ID NO: 209585 - RNA, 22 nt, Human
uugaugagucacuuucuguaaa

SEQ ID NO: 209586 - RNA, 22 nt, Human
uugauagauuuuagaggcaggc

SEQ ID NO: 209587 - RNA, 22 nt, Human
uuuuuuuccaguuauucauuuu

SEQ ID NO: 209588 - RNA, 22 nt, Human
uugaccauguggcccaggccaa

SEQ ID NO: 209589 - RNA, 22 nt, Human
uugagaugacuuaaaucacugu

SEQ ID NO: 209590 - RNA, 22 nt, Human
uugagcagccauuagcuggggu

SEQ ID NO: 209591 - RNA, 22 nt, Human
uugagauuuggagguaauuccc

SEQ ID NO: 209592 - RNA, 22 nt, Human
uugauuugcagaagguguagag

SEQ ID NO: 209593 - RNA, 22 nt, Human
uugauuuccauuguccagcauu

SEQ ID NO: 209594 - RNA, 22 nt, Human
uugauuggguauaaugacagga

SEQ ID NO: 209595 - RNA, 20 nt, Human
uugauucacaaaaagcuuag

SEQ ID NO: 209596 - RNA, 22 nt, Human
uugauggaggaaaaguuggaau

SEQ ID NO: 209597 - RNA, 23 nt, Human
uugaucuggaaaauacuuguuug

SEQ ID NO: 209598 - RNA, 22 nt, Human
uugauuaauugaugaaccucuc

SEQ ID NO: 209599 - RNA, 22 nt, Human
uuggaggcagagucuugcugag

SEQ ID NO: 209600 - RNA, 19 nt, Human
uuggagcaucccaaaggcu

SEQ ID NO: 209601 - RNA, 22 nt, Human
uuggauugugaaaguauucucu

SEQ ID NO: 209602 - RNA, 22 nt, Human
uuggauguggggauggaguggg

SEQ ID NO: 209603 - RNA, 22 nt, Human
uuggcgcuauuauuaccacauu

SEQ ID NO: 209604 - RNA, 22 nt, Human
uuggccguuucacugggcaguu

SEQ ID NO: 209605 - RNA, 22 nt, Human
uuggccuaggcacaggcaggug

SEQ ID NO: 209606 - RNA, 22 nt, Human
uugggagaaaguuaacuuucua

SEQ ID NO: 209607 - RNA, 22 nt, Human
uugggcuagaaacaacgugggu

SEQ ID NO: 209608 - RNA, 22 nt, Human
uugggauuggugggguggguuu

SEQ ID NO: 209609 - RNA, 22 nt, Human
uuggggaauuuggggccguccg

SEQ ID NO: 209610 - RNA, 22 nt, Human
uugggcauuucuuauguauuuu

SEQ ID NO: 209611 - RNA, 19 nt, Human
uugguuuguugcuuaggug

SEQ ID NO: 209612 - RNA, 22 nt, Human
uugguuuuuugguguaucuuau

SEQ ID NO: 209613 - RNA, 22 nt, Human
uuguaagacuguagaaugcaaa

SEQ ID NO: 209614 - RNA, 22 nt, Human
uuggugauguagcagcaauugu

SEQ ID NO: 209615 - RNA, 22 nt, Human
uuggggagaagagcuggucagg

SEQ ID NO: 209616 - RNA, 22 nt, Human
uugugacuauuuuucauugaag

SEQ ID NO: 209617 - RNA, 22 nt, Human
uugugcucaguuguggucuauu

SEQ ID NO: 209618 - RNA, 23 nt, Human
uugugcggugcuuuggguuuaca

SEQ ID NO: 209619 - RNA, 22 nt, Human
uuguauguuucugugcacauga

SEQ ID NO: 209620 - RNA, 22 nt, Human
uuguauuguuugcgucuguguu

SEQ ID NO: 209621 - RNA, 22 nt, Human
uugguugaaauguguucaugcu

SEQ ID NO: 209622 - RNA, 22 nt, Human
uugucaugauccuucuguuagg

SEQ ID NO: 209623 - RNA, 22 nt, Human
uugucagcuagugaugcuguuc

SEQ ID NO: 209624 - RNA, 22 nt, Human
uuucacauacaguguauaguag

SEQ ID NO: 209625 - RNA, 22 nt, Human
uuucagaaauggcacugaaauc

SEQ ID NO: 209626 - RNA, 22 nt, Human
uuucacuucgaucagaguuuuu

SEQ ID NO: 209627 - RNA, 22 nt, Human
uuuauugcuaugucuugauugu

SEQ ID NO: 209628 - RNA, 22 nt, Human
uuuauuuacuuucgguucugcu

SEQ ID NO: 209629 - RNA, 22 nt, Human
uuuauugaccugaguaucagca

SEQ ID NO: 209630 - RNA, 22 nt, Human
uuuauucuuugcuagguuccau

SEQ ID NO: 209631 - RNA, 19 nt, Human
uuuauuugagacaugccuu

SEQ ID NO: 209632 - RNA, 22 nt, Human
uuuaucaucuucugaauuugga

SEQ ID NO: 209633 - RNA, 22 nt, Human
uuuauucacuuaucaggaacga

SEQ ID NO: 209634 - RNA, 22 nt, Human
uuuauguuuguuuuugaaauaa

SEQ ID NO: 209635 - RNA, 22 nt, Human
uuuaguugcuuuaguugagcug

SEQ ID NO: 209636 - RNA, 22 nt, Human
uuuauaauuguuauguuaccca

SEQ ID NO: 209637 - RNA, 22 nt, Human
uuuauaauuacguaaaauauuu

SEQ ID NO: 209638 - RNA, 22 nt, Human
uuuaggugucugcucauugaag

SEQ ID NO: 209639 - RNA, 22 nt, Human
uuuagguuguguucuggcaugu

SEQ ID NO: 209640 - RNA, 22 nt, Human
uuuaccuuauguaaauaagagu

SEQ ID NO: 209641 - RNA, 18 nt, Human
uuuacgaacucacuugag

SEQ ID NO: 209642 - RNA, 22 nt, Human
uuguguugaagugguuagggcg

SEQ ID NO: 209643 - RNA, 22 nt, Human
uuguuauuauuauuuucguucu

SEQ ID NO: 209644 - RNA, 22 nt, Human
uuguucacuaugaagagguugg

SEQ ID NO: 209645 - RNA, 22 nt, Human
uuguuccuuucuucuguagucg

SEQ ID NO: 209646 - RNA, 22 nt, Human
uuguuuaaagaacuucugacuu

SEQ ID NO: 209647 - RNA, 22 nt, Human
uuguuguuguuguuauuuaguu

SEQ ID NO: 209648 - RNA, 22 nt, Human
uuguugcuguugaacccugcug

SEQ ID NO: 209649 - RNA, 22 nt, Human
uuguuccuucuuuuuguaucag

SEQ ID NO: 209650 - RNA, 22 nt, Human
uuuaauuauaucugggcaguua

SEQ ID NO: 209651 - RNA, 22 nt, Human
uuugaugauuuucuagagugua

SEQ ID NO: 209652 - RNA, 22 nt, Human
uuugagugcccauguuucccag

SEQ ID NO: 209653 - RNA, 22 nt, Human
uuugagaaugucaaucacaaga

SEQ ID NO: 209654 - RNA, 22 nt, Human
uuugaauauacuucaaacaaag

SEQ ID NO: 209655 - RNA, 22 nt, Human
uuugaagaccuuaucucuaaau

SEQ ID NO: 209656 - RNA, 23 nt, Human
uuugaaucauuguggggcuuuug

SEQ ID NO: 209657 - RNA, 22 nt, Human
uuugaauauuaugucccacuuu

SEQ ID NO: 209658 - RNA, 22 nt, Human
uuugcuguaaugcaugucagag

SEQ ID NO: 209659 - RNA, 22 nt, Human
uuugcuccucuucauuuguauc

SEQ ID NO: 209660 - RNA, 22 nt, Human
uuugccccacaggcagcuuugg

SEQ ID NO: 209661 - RNA, 22 nt, Human
uuugcugaaaaaccacuugagu

SEQ ID NO: 209662 - RNA, 22 nt, Human
uuugccggaucugucuccagcu

SEQ ID NO: 209663 - RNA, 22 nt, Human
uuugccaucagaugugguaggu

SEQ ID NO: 209664 - RNA, 22 nt, Human
uuugcaggaaauguacugaaug

SEQ ID NO: 209665 - RNA, 20 nt, Human
uuugauugccccucugacuu

SEQ ID NO: 209666 - RNA, 22 nt, Human
uuuggucuggaaucuucagggu

SEQ ID NO: 209667 - RNA, 20 nt, Human
uuugugaggccagagaacag

SEQ ID NO: 209668 - RNA, 22 nt, Human
uuuguccuguuggcaugaaaau

SEQ ID NO: 209669 - RNA, 22 nt, Human
uuugucauuuagcccauggugg

SEQ ID NO: 209670 - RNA, 20 nt, Human
uuugucaacugcauccagca

SEQ ID NO: 209671 - RNA, 22 nt, Human
uuugucaggaauugaaaaguuu

SEQ ID NO: 209672 - RNA, 22 nt, Human
uuugggcauuuuuaaggaucuu

SEQ ID NO: 209673 - RNA, 22 nt, Human
uuuggcuuugauccuaggauuc

SEQ ID NO: 209674 - RNA, 22 nt, Human
uuuggccauuuguaugcaugau

SEQ ID NO: 209675 - RNA, 22 nt, Human
uuuggcuacucuucauugguga

SEQ ID NO: 209676 - RNA, 22 nt, Human
uuuggcgucucucaggagcuca

SEQ ID NO: 209677 - RNA, 22 nt, Human
uuuggcaagcagaugaagguag

SEQ ID NO: 209678 - RNA, 22 nt, Human
uuugcuuugacuuugggaguau

SEQ ID NO: 209679 - RNA, 22 nt, Human
uuucagauuauguucauggguu

SEQ ID NO: 209680 - RNA, 22 nt, Human
uuuccccugggaacauugauuc

SEQ ID NO: 209681 - RNA, 22 nt, Human
uuucccuugcgcuugcucuccg

SEQ ID NO: 209682 - RNA, 22 nt, Human
uuuccacacucacugcacucau

SEQ ID NO: 209683 - RNA, 22 nt, Human
uuucguugcacucauaugguug

SEQ ID NO: 209684 - RNA, 22 nt, Human
uuuccuguuuugguuuggagag

SEQ ID NO: 209685 - RNA, 22 nt, Human
uuuccuguccugguacuuggca

SEQ ID NO: 209686 - RNA, 22 nt, Human
uuucgggauuucaaagagcaaa

SEQ ID NO: 209687 - RNA, 22 nt, Human
uuuccuuuguuuugguauaugu

SEQ ID NO: 209688 - RNA, 22 nt, Human
uuucugagccacauauaauuug

SEQ ID NO: 209689 - RNA, 22 nt, Human
uuucucugggugaugagguggc

SEQ ID NO: 209690 - RNA, 22 nt, Human
uuucucuuguauuugaaucacu

SEQ ID NO: 209691 - RNA, 22 nt, Human
uuucucagccuccuugcuggag

SEQ ID NO: 209692 - RNA, 22 nt, Human
uuucucagcauauugccuuuga

SEQ ID NO: 209693 - RNA, 22 nt, Human
uuucugcauuuguauuggaaaa

SEQ ID NO: 209694 - RNA, 22 nt, Human
uuucugaugaaguagaaagacc

SEQ ID NO: 209695 - RNA, 22 nt, Human
uuucugcuuucuaguugguguu

SEQ ID NO: 209696 - RNA, 22 nt, Human
uuugaaaggagcuuuauccaga

SEQ ID NO: 209697 - RNA, 18 nt, Human
uuucuuuuauuccagguc

SEQ ID NO: 209698 - RNA, 22 nt, Human
uuucuuugcugguuggcucucc

SEQ ID NO: 209699 - RNA, 19 nt, Human
uuucuggguucaccucuug

SEQ ID NO: 209700 - RNA, 22 nt, Human
uuucucuuuuugggguggggug

SEQ ID NO: 209701 - RNA, 22 nt, Human
uuucugguuuuauucugggguu

SEQ ID NO: 209702 - RNA, 22 nt, Human
uuucuguuuguaacuccagcaa

SEQ ID NO: 209703 - RNA, 22 nt, Human
uuucuuccaucuggcuuuauuu

SEQ ID NO: 209704 - RNA, 22 nt, Human
gccuuuauauuacauuuggaag

SEQ ID NO: 209705 - RNA, 22 nt, Human
cugucagcaaaucagugucugg

SEQ ID NO: 209706 - RNA, 22 nt, Human
gcaguaaggaggggaaggguuu

SEQ ID NO: 209707 - RNA, 22 nt, Human
gggggagcuacaggucccuugg

SEQ ID NO: 209708 - RNA, 22 nt, Human
uacagugaggcgagauucacca

SEQ ID NO: 209709 - RNA, 19 nt, Human
aguauuggcagguccugua

SEQ ID NO: 209710 - RNA, 22 nt, Human
aucuccagcagugcuuuugagc

SEQ ID NO: 209711 - RNA, 22 nt, Human
gcuaggagccucgacucuggag

SEQ ID NO: 209712 - RNA, 19 nt, Human
uguugcagcuugaucggua

SEQ ID NO: 209713 - RNA, 20 nt, Human
guggcagugguggcagcagu

SEQ ID NO: 209714 - RNA, 19 nt, Human
uuccuuucuauccugggua

SEQ ID NO: 209715 - RNA, 22 nt, Human
cggggaggagccagcggaggau

SEQ ID NO: 209716 - RNA, 22 nt, Human
uauauauaugcaccacaugugu

SEQ ID NO: 209717 - RNA, 22 nt, Human
auauaaugugugcuuuauugaa

SEQ ID NO: 209718 - RNA, 22 nt, Human
ucaguagcauuuaauguucagu

SEQ ID NO: 209719 - RNA, 22 nt, Human
gaggcucagagggacuuucaag

SEQ ID NO: 209720 - RNA, 21 nt, Human
ugucagcaacaauacuuucuc

SEQ ID NO: 209721 - RNA, 22 nt, Human
gagcacugagcuggaauuggag

SEQ ID NO: 209722 - RNA, 22 nt, Human
agcuuccaaagaccaggauuga

SEQ ID NO: 209723 - RNA, 22 nt, Human
ccaaggugcagcccauggugaa

SEQ ID NO: 209724 - RNA, 22 nt, Human
cuggagaacagagcuguuuaga

SEQ ID NO: 209725 - RNA, 22 nt, Human
uuggugaugcccaccuuuucau

SEQ ID NO: 209726 - RNA, 22 nt, Human
gcggagcuaaagauuggcuccu

SEQ ID NO: 209727 - RNA, 22 nt, Human
cuucuuucuuuucuucuucucu

SEQ ID NO: 209728 - RNA, 22 nt, Human
aaugcuaaagaagaaggaguag

SEQ ID NO: 209729 - RNA, 22 nt, Human
cugugggcucucaugggaccug

SEQ ID NO: 209730 - RNA, 22 nt, Human
aggcuguagaucuagacaugua

SEQ ID NO: 209731 - RNA, 22 nt, Human
acaggaaugaagaugagagagu

SEQ ID NO: 209732 - RNA, 21 nt, Human
cugugggaaggccugaggucu

SEQ ID NO: 209733 - RNA, 22 nt, Human
caugagaguaaccuagagaaga

SEQ ID NO: 209734 - RNA, 22 nt, Human
auuccccagcaggccuuuuguu

SEQ ID NO: 209735 - RNA, 22 nt, Human
aaauucuuccaggaggaaauac

SEQ ID NO: 209736 - RNA, 22 nt, Human
ucauuguuucugcuuuucauga

SEQ ID NO: 209737 - RNA, 22 nt, Human
uccaggcagcugcuugaugaua

SEQ ID NO: 209738 - RNA, 22 nt, Human
ccaaauuguuguuguuguuguu

SEQ ID NO: 209739 - RNA, 22 nt, Human
ucccuucccaccccugccuuuu

SEQ ID NO: 209740 - RNA, 22 nt, Human
ucagucugguggaugcucauug

SEQ ID NO: 209741 - RNA, 22 nt, Human
uacaaaugaucaucucuuugaa

SEQ ID NO: 209742 - RNA, 22 nt, Human
ggccaccuaagguugugcauca

SEQ ID NO: 209743 - RNA, 22 nt, Human
ugagucugaagagagaauaagg

SEQ ID NO: 209744 - RNA, 20 nt, Human
auucucaccaugugacaugg

SEQ ID NO: 209745 - RNA, 22 nt, Human
aagaugcaagcauuuugaacug

SEQ ID NO: 209746 - RNA, 22 nt, Human
augaaggauagggcaaaauuuu

SEQ ID NO: 209747 - RNA, 22 nt, Human
cagaaacacuguauuuagggaa

SEQ ID NO: 209748 - RNA, 23 nt, Human
uuuuaauaguaugacaugagcug

SEQ ID NO: 209749 - RNA, 21 nt, Human
uagaccagcugugcuccucgg

SEQ ID NO: 209750 - RNA, 22 nt, Human
ggcagggagagcaugcugauaa

SEQ ID NO: 209751 - RNA, 22 nt, Human
cuuuuaaucuaauuuuuauauu

SEQ ID NO: 209752 - RNA, 22 nt, Human
auuuccacaaauuaagauugca

SEQ ID NO: 209753 - RNA, 22 nt, Human
uggaaggggccaggcgcggagu

SEQ ID NO: 209754 - RNA, 22 nt, Human
auuacagauuauaaauuugagc

SEQ ID NO: 209755 - RNA, 20 nt, Human
ugccagagagcucauacccu

SEQ ID NO: 209756 - RNA, 21 nt, Human
agcaucugaggcaguuuccua

SEQ ID NO: 209757 - RNA, 21 nt, Human
uugaaguggguagcuggcggg

SEQ ID NO: 209758 - RNA, 22 nt, Human
ggcugcuggaguugggucucuc

SEQ ID NO: 209759 - RNA, 22 nt, Human
auuaagacugcccauguuuuua

SEQ ID NO: 209760 - RNA, 22 nt, Human
caaagaagagauuuacagagcu

SEQ ID NO: 209761 - RNA, 22 nt, Human
uguggugcagcgggaacagcuu

SEQ ID NO: 209762 - RNA, 22 nt, Human
cuugauucauuuaagguuggag

SEQ ID NO: 209763 - RNA, 22 nt, Human
uuuggucuggaaucuucagggu

SEQ ID NO: 209764 - RNA, 22 nt, Human
ugaaauuuuuuggagauaauuu

SEQ ID NO: 209765 - RNA, 22 nt, Human
cucugaguuuacaguauguuuu

SEQ ID NO: 209766 - RNA, 22 nt, Human
auuuaaagaguaauacaaucca

SEQ ID NO: 209767 - RNA, 22 nt, Human
auucaagauaagggucugggag

SEQ ID NO: 209768 - RNA, 22 nt, Human
ucugaauauguuuaucaucucu

SEQ ID NO: 209769 - RNA, 22 nt, Human
uugguuuuuugguguaucuuau

SEQ ID NO: 209770 - RNA, 22 nt, Human
gaaaaguuuaaccuuguacauu

SEQ ID NO: 209771 - RNA, 22 nt, Human
auuaaaaaaagauaaugaguua

SEQ ID NO: 209772 - RNA, 18 nt, Human
auucauuugcguuuggcu

SEQ ID NO: 209773 - RNA, 18 nt, Human
aaacauggcuuaaaggcu

SEQ ID NO: 209774 - RNA, 22 nt, Human
cauuucaaacaguuacagcugc

SEQ ID NO: 209775 - RNA, 22 nt, Human
cagguuuggaagucacgaagcu

SEQ ID NO: 209776 - RNA, 22 nt, Human
ucccaagugcuccucuggcccc

SEQ ID NO: 209777 - RNA, 21 nt, Human
agaaugaagaagaggucuuug

SEQ ID NO: 209778 - RNA, 22 nt, Human
aaaucauagccaugaacauuug

SEQ ID NO: 209779 - RNA, 22 nt, Human
gcacagaguguaaaaguuucau

SEQ ID NO: 209780 - RNA, 22 nt, Human
aaagacagccuguuggcuuucu

SEQ ID NO: 209781 - RNA, 22 nt, Human
guaguuuucaugguuagaaaua

SEQ ID NO: 209782 - RNA, 22 nt, Human
ccacucucucccucuguagggg

SEQ ID NO: 209783 - RNA, 22 nt, Human
auuucagcagcccauguuugga

SEQ ID NO: 209784 - RNA, 22 nt, Human
uucacugugauguuuaagagaa

SEQ ID NO: 209785 - RNA, 22 nt, Human
ggcugagguguggggaacuaua

SEQ ID NO: 209786 - RNA, 23 nt, Human
aguauuguucaucuucaagacag

SEQ ID NO: 209787 - RNA, 22 nt, Human
ggagggcuggacguacuagggc

SEQ ID NO: 209788 - RNA, 22 nt, Human
gucacuuugcuugcgaugcucc

SEQ ID NO: 209789 - RNA, 22 nt, Human
aaagggcugaaguagucucugu

SEQ ID NO: 209790 - RNA, 19 nt, Human
uagauuagagcauaggguu

SEQ ID NO: 209791 - RNA, 22 nt, Human
aauuagaagcuguuagcaaaau

SEQ ID NO: 209792 - RNA, 22 nt, Human
gcaccgagaaggaagcaugccu

SEQ ID NO: 209793 - RNA, 22 nt, Human
cgggagagacagaggaggcgcc

SEQ ID NO: 209794 - RNA, 22 nt, Human
ugucacagugcacagcuaagaa

SEQ ID NO: 209795 - RNA, 22 nt, Human
caaauguuugguggcauuuugu

SEQ ID NO: 209796 - RNA, 22 nt, Human
cuuggggucuuacuuguacccu

SEQ ID NO: 209797 - RNA, 22 nt, Human
gaaacauuuguugaguacuugc

SEQ ID NO: 209798 - RNA, 22 nt, Human
agaauuuguaucuacggugugc

SEQ ID NO: 209799 - RNA, 22 nt, Human
aaugaaugaaugaaugauuaug

SEQ ID NO: 209800 - RNA, 22 nt, Human
acugauuuuauauauuaccccg

SEQ ID NO: 209801 - RNA, 22 nt, Human
gccuucccuccucugcucucag

SEQ ID NO: 209802 - RNA, 22 nt, Human
aacaguaugugagauuuacaca

SEQ ID NO: 209803 - RNA, 22 nt, Human
ucuccucuauuucuguauguau

SEQ ID NO: 209804 - RNA, 22 nt, Human
aguauaucugcuucuggguccc

SEQ ID NO: 209805 - RNA, 22 nt, Human
gaauacaagccugccaccugga

SEQ ID NO: 209806 - RNA, 22 nt, Human
aagaaaggagauauucuuuuag

SEQ ID NO: 209807 - RNA, 22 nt, Human
aaacccaggguuuugucuuccc

SEQ ID NO: 209808 - RNA, 22 nt, Human
gccaucugcuuagauugcuggg

SEQ ID NO: 209809 - RNA, 22 nt, Human
auugaaauuaauuucugcuuuc

SEQ ID NO: 209810 - RNA, 22 nt, Human
aaucaugguacaaguaagcacg

SEQ ID NO: 209811 - RNA, 22 nt, Human
ucuguuuuucagaccuuuuugg

SEQ ID NO: 209812 - RNA, 22 nt, Human
ccuaggcuggcugucuucaggu

SEQ ID NO: 209813 - RNA, 22 nt, Human
aaacccacauuccugcuuaggc

SEQ ID NO: 209814 - RNA, 22 nt, Human
guggacagacauaauccuaauu

SEQ ID NO: 209815 - RNA, 22 nt, Human
ggaguucacagcaauggaacag

SEQ ID NO: 209816 - RNA, 23 nt, Human
cauuugauccucacaauaaaugg

SEQ ID NO: 209817 - RNA, 19 nt, Human
uagacagauuuguguuacu

SEQ ID NO: 209818 - RNA, 22 nt, Human
uuaucaaaaaauaguacuuuga

SEQ ID NO: 209819 - RNA, 22 nt, Human
uuuuuagcauaugucaaaucag

SEQ ID NO: 209820 - RNA, 22 nt, Human
ucuuggucccugagcucuuuca

SEQ ID NO: 209821 - RNA, 22 nt, Human
gugaggugauugcugguguuug

SEQ ID NO: 209822 - RNA, 22 nt, Human
uagcauuuagaacaccuugaga

SEQ ID NO: 209823 - RNA, 22 nt, Human
cagggcagaguuaagaugcugg

SEQ ID NO: 209824 - RNA, 22 nt, Human
augaaaacggaccagagcuauu

SEQ ID NO: 209825 - RNA, 22 nt, Human
gagcagcugagcuggaaugaga

SEQ ID NO: 209826 - RNA, 22 nt, Human
aaguccaaaacauuucucugcu

SEQ ID NO: 209827 - RNA, 21 nt, Human
gcagcaugagaaagccccaaa

SEQ ID NO: 209828 - RNA, 22 nt, Human
uggcaucucggugcugguucuu

SEQ ID NO: 209829 - RNA, 22 nt, Human
uuguuauuauuauuuucguucu

SEQ ID NO: 209830 - RNA, 22 nt, Human
uuuuuagcuguuauuguggaag

SEQ ID NO: 209831 - RNA, 22 nt, Human
auggugaaaugauuugauguca

SEQ ID NO: 209832 - RNA, 22 nt, Human
cagacuccugcuccucuggggc

SEQ ID NO: 209833 - RNA, 22 nt, Human
cuaaauucuauauccuugcuuc

SEQ ID NO: 209834 - RNA, 22 nt, Human
uucauuuuauauuagagcuguu

SEQ ID NO: 209835 - RNA, 22 nt, Human
cagcagaugacuauuggagcug

SEQ ID NO: 209836 - RNA, 22 nt, Human
ccucuccucugugcagacugcc

SEQ ID NO: 209837 - RNA, 22 nt, Human
aagaaauagauagaggaauacu

SEQ ID NO: 209838 - RNA, 22 nt, Human
agaagggaagcaggagaggcau

SEQ ID NO: 209839 - RNA, 22 nt, Human
ggcagggaauucagagggaagg

SEQ ID NO: 209840 - RNA, 22 nt, Human
ggggaggguuuggaugagaguc

SEQ ID NO: 209841 - RNA, 22 nt, Human
ugucuuuuaaaaauguguaaaa

SEQ ID NO: 209842 - RNA, 20 nt, Human
agugaguuaucagcuacagu

SEQ ID NO: 209843 - RNA, 22 nt, Human
agguaguggaaccaaggcauca

SEQ ID NO: 209844 - RNA, 22 nt, Human
ggauaauguauuuuaaaauggg

SEQ ID NO: 209845 - RNA, 22 nt, Human
gugucccaaagauuagaaauca

SEQ ID NO: 209846 - RNA, 22 nt, Human
uuuguucaccuagcaaacuuuu

SEQ ID NO: 209847 - RNA, 22 nt, Human
ucccuguuuccugcgcuccuuc

SEQ ID NO: 209848 - RNA, 22 nt, Human
ccagagcaccgaaacgagcuuu

SEQ ID NO: 209849 - RNA, 22 nt, Human
cagcuccagcccaggcagcucc

SEQ ID NO: 209850 - RNA, 22 nt, Human
ugggcccaucauugcugugggc

SEQ ID NO: 209851 - RNA, 22 nt, Human
cuccagggcuaccagguuuuag

SEQ ID NO: 209852 - RNA, 22 nt, Human
uuucucuccucgaaauucuuau

SEQ ID NO: 209853 - RNA, 22 nt, Human
ggccaagagaggauggagggau

SEQ ID NO: 209854 - RNA, 20 nt, Human
gggaauggauggauugcucc

SEQ ID NO: 209855 - RNA, 22 nt, Human
ucaugcagaguagaaagggcaa

SEQ ID NO: 209856 - RNA, 23 nt, Human
uccugcagauaagcugguugaca

SEQ ID NO: 209857 - RNA, 22 nt, Human
ucccuuuggagguguccagcac

SEQ ID NO: 209858 - RNA, 22 nt, Human
cucaucagagcccuccucuggc

SEQ ID NO: 209859 - RNA, 22 nt, Human
aucaagacaaaggaaaggcuaa

SEQ ID NO: 209860 - RNA, 20 nt, Human
aguacauauuugugauuuuu

SEQ ID NO: 209861 - RNA, 22 nt, Human
cucccaucacaauucagggccu

SEQ ID NO: 209862 - RNA, 20 nt, Human
aagcuguguucaagauggga

SEQ ID NO: 209863 - RNA, 22 nt, Human
agauaaaucauuuauuaagcgg

SEQ ID NO: 209864 - RNA, 22 nt, Human
ucagucuucaggacuaugaaaa

SEQ ID NO: 209865 - RNA, 22 nt, Human
uguguauguauguauguaugua

SEQ ID NO: 209866 - RNA, 22 nt, Human
gcauccaaggagcagaagugau

SEQ ID NO: 209867 - RNA, 22 nt, Human
cuugucuaguuccuggugaugu

SEQ ID NO: 209868 - RNA, 18 nt, Human
ggugagggagcuggaagc

SEQ ID NO: 209869 - RNA, 22 nt, Human
agauagaaggauugugacacau

SEQ ID NO: 209870 - RNA, 22 nt, Human
auuauggacuuucuuguuuggg

SEQ ID NO: 209871 - RNA, 22 nt, Human
cucaugagucugucagagucau

SEQ ID NO: 209872 - RNA, 22 nt, Human
uguauugugggugucagagugc

SEQ ID NO: 209873 - RNA, 22 nt, Human
guucaaucucucaugcauuuuc

SEQ ID NO: 209874 - RNA, 22 nt, Human
acugagcaaaacugauccuguu

SEQ ID NO: 209875 - RNA, 22 nt, Human
uccacagugguggaauuguuca

SEQ ID NO: 209876 - RNA, 22 nt, Human
ggugcuggggaaauuaggguag

SEQ ID NO: 209877 - RNA, 22 nt, Human
gggcagucagauucgggggccu

SEQ ID NO: 209878 - RNA, 19 nt, Human
ucuugaggaaaguaaggca

SEQ ID NO: 209879 - RNA, 22 nt, Human
ucuguggcaaacacagugacca

SEQ ID NO: 209880 - RNA, 22 nt, Human
acacagaguauuuagaaggggu

SEQ ID NO: 209881 - RNA, 23 nt, Human
ucugccuccuaauuguugguguc

SEQ ID NO: 209882 - RNA, 22 nt, Human
ggagcuaagagaauggacaagg

SEQ ID NO: 209883 - RNA, 20 nt, Human
uuggggacaggagugugaug

SEQ ID NO: 209884 - RNA, 22 nt, Human
uaaaugcucuuuaaaagugcuu

SEQ ID NO: 209885 - RNA, 22 nt, Human
acuugcauuguguaguguuuuu

SEQ ID NO: 209886 - RNA, 22 nt, Human
aggggagggcuggccuuuggau

SEQ ID NO: 209887 - RNA, 22 nt, Human
ccucccuucccggcauggcucu

SEQ ID NO: 209888 - RNA, 22 nt, Human
cucagcugauuaauuucauguu

SEQ ID NO: 209889 - RNA, 22 nt, Human
cugggaggagacaggggauggg

SEQ ID NO: 209890 - RNA, 22 nt, Human
uagcugucauuggaucagaagg

SEQ ID NO: 209891 - RNA, 22 nt, Human
cuucuagucaaaauggauaagc

SEQ ID NO: 209892 - RNA, 22 nt, Human
uaagggaagucuucaggagaca

SEQ ID NO: 209893 - RNA, 22 nt, Human
uauacauauacaaaugcacaua

SEQ ID NO: 209894 - RNA, 22 nt, Human
aguuuuguuuguuuguuuguua

SEQ ID NO: 209895 - RNA, 22 nt, Human
aucaaaauguguagucuugauc

SEQ ID NO: 209896 - RNA, 22 nt, Human
gugagaggaggcagcuuuuaca

SEQ ID NO: 209897 - RNA, 22 nt, Human
ucccugcaggcauguacucuga

SEQ ID NO: 209898 - RNA, 22 nt, Human
gcagaguauaaguguggagcug

SEQ ID NO: 209899 - RNA, 22 nt, Human
aggcaggagcugugguggugag

SEQ ID NO: 209900 - RNA, 23 nt, Human
gucucacaaccaccugagaaaau

SEQ ID NO: 209901 - RNA, 22 nt, Human
cugugugugcacacguguaugg

SEQ ID NO: 209902 - RNA, 22 nt, Human
guggggguaggggguuuucugg

SEQ ID NO: 209903 - RNA, 22 nt, Human
uuuaaauuucugaaucuugagg

SEQ ID NO: 209904 - RNA, 22 nt, Human
uuucugagccacauauaauuug

SEQ ID NO: 209905 - RNA, 22 nt, Human
augaauuugaacaccagguugg

SEQ ID NO: 209906 - RNA, 22 nt, Human
aaggacaaaacagcuguucuaa

SEQ ID NO: 209907 - RNA, 19 nt, Human
uagcuguucuugaguguga

SEQ ID NO: 209908 - RNA, 22 nt, Human
ccugagacucuccugugcagcc

SEQ ID NO: 209909 - RNA, 20 nt, Human
cccuggaaugagaugcauau

SEQ ID NO: 209910 - RNA, 22 nt, Human
cucuugugucaccauggauaaa

SEQ ID NO: 209911 - RNA, 22 nt, Human
ugagaagaggucuuuugggaug

SEQ ID NO: 209912 - RNA, 22 nt, Human
agauuuucuuuuccaucuuugu

SEQ ID NO: 209913 - RNA, 22 nt, Human
aggcuaagugauuagugacaua

SEQ ID NO: 209914 - RNA, 22 nt, Human
guccaucuugcaaugagaccua

SEQ ID NO: 209915 - RNA, 22 nt, Human
uuccaaggcugcuauuuguuuc

SEQ ID NO: 209916 - RNA, 22 nt, Human
cagcuacuaccuguagacaaag

SEQ ID NO: 209917 - RNA, 22 nt, Human
uguuuucaucucucacccagaa

SEQ ID NO: 209918 - RNA, 22 nt, Human
uuuaggaagaucugaaggaaga

SEQ ID NO: 209919 - RNA, 22 nt, Human
uuugagaaugucaaucacaaga

SEQ ID NO: 209920 - RNA, 22 nt, Human
uucaucauuuuccauuccucuu

SEQ ID NO: 209921 - RNA, 22 nt, Human
uacugggugagcugggcuggga

SEQ ID NO: 209922 - RNA, 22 nt, Human
cuguggcugcgcccugggggag

SEQ ID NO: 209923 - RNA, 22 nt, Human
uguauugaggauucauuuuugu

SEQ ID NO: 209924 - RNA, 22 nt, Human
ucucucugcuguccagcguuau

SEQ ID NO: 209925 - RNA, 22 nt, Human
gguggcauguaccucacagacu

SEQ ID NO: 209926 - RNA, 20 nt, Human
ugcuccaggaacacuggccg

SEQ ID NO: 209927 - RNA, 22 nt, Human
ccaugugaccugugucaguugc

SEQ ID NO: 209928 - RNA, 22 nt, Human
uccagcacacagguggcucuca

SEQ ID NO: 209929 - RNA, 22 nt, Human
cagaaauuggcagagaagaccu

SEQ ID NO: 209930 - RNA, 22 nt, Human
ugcucugcuaggagaagaauga

SEQ ID NO: 209931 - RNA, 22 nt, Human
aggcugaagcacacucaugcag

SEQ ID NO: 209932 - RNA, 22 nt, Human
agauuaagcauuauaauuauaa

SEQ ID NO: 209933 - RNA, 19 nt, Human
uggaggcggguggcccaga

SEQ ID NO: 209934 - RNA, 22 nt, Human
ugcucugguccucccucggcgc

SEQ ID NO: 209935 - RNA, 22 nt, Human
augcagauguagauucugaaau

SEQ ID NO: 209936 - RNA, 22 nt, Human
guaaaucccucucuuuguagau

SEQ ID NO: 209937 - RNA, 19 nt, Human
agggagagucccaagagaa

SEQ ID NO: 209938 - RNA, 22 nt, Human
ucugugugugugcauaugcaug

SEQ ID NO: 209939 - RNA, 22 nt, Human
uggggcggaaggaggagaggug

SEQ ID NO: 209940 - RNA, 22 nt, Human
auguauauauacauguauugua

SEQ ID NO: 209941 - RNA, 22 nt, Human
ccagccugccaagcccagcccu

SEQ ID NO: 209942 - RNA, 22 nt, Human
aucuguggguaaggauaagcau

SEQ ID NO: 209943 - RNA, 22 nt, Human
uuuuaacuuuaccauuucuuca

SEQ ID NO: 209944 - RNA, 22 nt, Human
uagcauuuauugggcuagcaaa

SEQ ID NO: 209945 - RNA, 23 nt, Human
uuuuccaaaucgacucucuaguu

SEQ ID NO: 209946 - RNA, 22 nt, Human
gcccugucagcucucauggaca

SEQ ID NO: 209947 - RNA, 22 nt, Human
agggucgucuggguccgugggg

SEQ ID NO: 209948 - RNA, 22 nt, Human
agagacugauggaucaccaaau

SEQ ID NO: 209949 - RNA, 22 nt, Human
gagggauuuuagugcagcaacu

SEQ ID NO: 209950 - RNA, 18 nt, Human
uguauuguucacuucugu

SEQ ID NO: 209951 - RNA, 20 nt, Human
ggcagagcuaugucuguugc

SEQ ID NO: 209952 - RNA, 22 nt, Human
aucauguauauuuuugcuauua

SEQ ID NO: 209953 - RNA, 16 nt, Human
aggauauauucucuuc

SEQ ID NO: 209954 - RNA, 22 nt, Human
gaugguggaggaaucgcugaag

SEQ ID NO: 209955 - RNA, 22 nt, Human
uacacacacaugcauguacgug

SEQ ID NO: 209956 - RNA, 22 nt, Human
uuaugucauuugaauuaauuuu

SEQ ID NO: 209957 - RNA, 22 nt, Human
ucugagugacguccugacagga

SEQ ID NO: 209958 - RNA, 22 nt, Human
aacuuucagaauccuaugcauu

SEQ ID NO: 209959 - RNA, 22 nt, Human
agcaauucugaaauuacuugac

SEQ ID NO: 209960 - RNA, 22 nt, Human
aauuuuagcuaaagauccaugg

SEQ ID NO: 209961 - RNA, 22 nt, Human
agccuguuacuguccugugcca

SEQ ID NO: 209962 - RNA, 22 nt, Human
aauaagagaauaaaaucuguua

SEQ ID NO: 209963 - RNA, 22 nt, Human
auuuuucuuucacauuuucuua

SEQ ID NO: 209964 - RNA, 22 nt, Human
cacccugacuggcccugcagga

SEQ ID NO: 209965 - RNA, 22 nt, Human
cagaaguugcuugagagagagc

SEQ ID NO: 209966 - RNA, 20 nt, Human
aguacugacaauauucugug

SEQ ID NO: 209967 - RNA, 22 nt, Human
gaggcuugccacuguccauggc

SEQ ID NO: 209968 - RNA, 22 nt, Human
uuuauaaacacaagaugggcuc

SEQ ID NO: 209969 - RNA, 19 nt, Human
cuuguggcuaugcagauac

SEQ ID NO: 209970 - RNA, 22 nt, Human
acauuagaugacucuuucuuuc

SEQ ID NO: 209971 - RNA, 22 nt, Human
guucacauccuugugaggauuu

SEQ ID NO: 209972 - RNA, 23 nt, Human
ugugugugugugugugugugugu

SEQ ID NO: 209973 - RNA, 22 nt, Human
ggcguccuccucgucugaggcg

SEQ ID NO: 209974 - RNA, 17 nt, Human
auucuuauacucuguga

SEQ ID NO: 209975 - RNA, 22 nt, Human
cuuuuucuuaucuuuuucuaug

SEQ ID NO: 209976 - RNA, 20 nt, Human
ugguguacauuuccauaguu

SEQ ID NO: 209977 - RNA, 22 nt, Human
uucugaaacauugcuauuuucc

SEQ ID NO: 209978 - RNA, 22 nt, Human
auuaaauagcagaagaaagaug

SEQ ID NO: 209979 - RNA, 22 nt, Human
cuggguaaauauguauuccuga

SEQ ID NO: 209980 - RNA, 22 nt, Human
cucucacucccuccuucccucu

SEQ ID NO: 209981 - RNA, 22 nt, Human
acccuucugugaccugccuguc

SEQ ID NO: 209982 - RNA, 22 nt, Human
cuguauggaggaggugcuagcc

SEQ ID NO: 209983 - RNA, 22 nt, Human
gacuggcucuaucaggauaaau

SEQ ID NO: 209984 - RNA, 22 nt, Human
ucuucaucucuaaaaugggaac

SEQ ID NO: 209985 - RNA, 22 nt, Human
uuuuuuguuccuugguuuuugu

SEQ ID NO: 209986 - RNA, 22 nt, Human
aagugcuggccuacucaaucga

SEQ ID NO: 209987 - RNA, 22 nt, Human
gauaauuauaggcuaagccacu

SEQ ID NO: 209988 - RNA, 22 nt, Human
acguugaaaugggcauuuuccg

SEQ ID NO: 209989 - RNA, 22 nt, Human
uuuuuuguggcuggaagaaaaa

SEQ ID NO: 209990 - RNA, 22 nt, Human
uuuauguugagcaaaauaccac

SEQ ID NO: 209991 - RNA, 20 nt, Human
gacaugagggagcaaagagc

SEQ ID NO: 209992 - RNA, 22 nt, Human
uagaagaacaugucaaacuaua

SEQ ID NO: 209993 - RNA, 22 nt, Human
uguggacaccuauuaccaguga

SEQ ID NO: 209994 - RNA, 22 nt, Human
guguucuucacuguuagaaggu

SEQ ID NO: 209995 - RNA, 22 nt, Human
caugucaagacugaagauccag

SEQ ID NO: 209996 - RNA, 22 nt, Human
uuagugaagaagcaucuuuagu

SEQ ID NO: 209997 - RNA, 22 nt, Human
uggguggauucgggaacuuguu

SEQ ID NO: 209998 - RNA, 22 nt, Human
ugggugaagaggcuaugcuacu

SEQ ID NO: 209999 - RNA, 22 nt, Human
ugauuguauuuauccucuguuc

SEQ ID NO: 210000 - RNA, 22 nt, Human
auccuggcuuuccugauuuacu

SEQ ID NO: 210001 - RNA, 22 nt, Human
uaauuccacacucccgcaagcg

SEQ ID NO: 210002 - RNA, 22 nt, Human
uuuuucuccauuccaggugccu

SEQ ID NO: 210003 - RNA, 22 nt, Human
ugucuuugaccuuaagaaguuu

SEQ ID NO: 210004 - RNA, 22 nt, Human
agagauggugaugaggaaaaau

SEQ ID NO: 210005 - RNA, 22 nt, Human
ugccuucugccaaggacggugc

SEQ ID NO: 210006 - RNA, 22 nt, Human
caaggaaaacagaugaucaaca

SEQ ID NO: 210007 - RNA, 22 nt, Human
auuucauaaaaacuuuaccuga

SEQ ID NO: 210008 - RNA, 22 nt, Human
acauuuccaaagaugccaguca

SEQ ID NO: 210009 - RNA, 22 nt, Human
gaauagauuagaaagaguaugu

SEQ ID NO: 210010 - RNA, 22 nt, Human
gcuggggaucgaaggcagagcc

SEQ ID NO: 210011 - RNA, 22 nt, Human
uuuaaagucaggcuguaguggu

SEQ ID NO: 210012 - RNA, 22 nt, Human
cagccuggccucuggauauuug

SEQ ID NO: 210013 - RNA, 22 nt, Human
uccaaauucccaugacagaagu

SEQ ID NO: 210014 - RNA, 22 nt, Human
cccuuuucuaauuuagccuguu

SEQ ID NO: 210015 - RNA, 22 nt, Human
aggaaaaugaaggaagugggaa

SEQ ID NO: 210016 - RNA, 22 nt, Human
guagagccaccaccaccauagc

SEQ ID NO: 210017 - RNA, 22 nt, Human
guucuacaacuucgcuugcaga

SEQ ID NO: 210018 - RNA, 22 nt, Human
ugcuuuuguaucagaguauuca

SEQ ID NO: 210019 - RNA, 22 nt, Human
uuuuaaaguaauugaagcuugu

SEQ ID NO: 210020 - RNA, 22 nt, Human
caucucagguuuguucugagac

SEQ ID NO: 210021 - RNA, 22 nt, Human
uaugaauauaccacaauuuagg

SEQ ID NO: 210022 - RNA, 22 nt, Human
ugcacccacuuagcugaaguuc

SEQ ID NO: 210023 - RNA, 22 nt, Human
ugucauuuauucucuuauucua

SEQ ID NO: 210024 - RNA, 22 nt, Human
uguuugagaauuugcugauguu

SEQ ID NO: 210025 - RNA, 22 nt, Human
cuuggugagcuccuggcgcagc

SEQ ID NO: 210026 - RNA, 22 nt, Human
guacuugauucauuauugcauu

SEQ ID NO: 210027 - RNA, 22 nt, Human
aauuuuauuagacaggcauaau

SEQ ID NO: 210028 - RNA, 22 nt, Human
cuggaugagcuucgugcgcacg

SEQ ID NO: 210029 - RNA, 22 nt, Human
agggaaauaggagaagaaagga

SEQ ID NO: 210030 - RNA, 20 nt, Human
cacagcugacgaguauccaa

SEQ ID NO: 210031 - RNA, 22 nt, Human
uaacauuagcuuugcucaugca

SEQ ID NO: 210032 - RNA, 22 nt, Human
ucuuuauuucccuaacuugcua

SEQ ID NO: 210033 - RNA, 22 nt, Human
gcucagcuggagagggacgggu

SEQ ID NO: 210034 - RNA, 22 nt, Human
cuggagcuucaggguucucggg

SEQ ID NO: 210035 - RNA, 22 nt, Human
aucucccaaauuagccucuuga

SEQ ID NO: 210036 - RNA, 22 nt, Human
ggaaaaugcugaagcaucugaa

SEQ ID NO: 210037 - RNA, 19 nt, Human
auagcagaagucauuuuca

SEQ ID NO: 210038 - RNA, 22 nt, Human
aggcugcuggcaggcguggacg

SEQ ID NO: 210039 - RNA, 20 nt, Human
aaacucuuuucuuacauuuu

SEQ ID NO: 210040 - RNA, 19 nt, Human
cugaaacacagagagggcu

SEQ ID NO: 210041 - RNA, 23 nt, Human
uuucugaguuuuuuaaaagucca

SEQ ID NO: 210042 - RNA, 22 nt, Human
auuuuugugcuuuauuggggua

SEQ ID NO: 210043 - RNA, 22 nt, Human
cuucuuagugauuuaacaugua

SEQ ID NO: 210044 - RNA, 22 nt, Human
uucauggauuugugaaauuuag

SEQ ID NO: 210045 - RNA, 22 nt, Human
ggcucagaggagcuggaacggu

SEQ ID NO: 210046 - RNA, 22 nt, Human
agcucugcuucuugggaagaug

SEQ ID NO: 210047 - RNA, 22 nt, Human
ugcaugcagcuggucgggcgcc

SEQ ID NO: 210048 - RNA, 19 nt, Human
acugggaugggcagugcca

SEQ ID NO: 210049 - RNA, 22 nt, Human
agauuauuuaagacaggaacca

SEQ ID NO: 210050 - RNA, 20 nt, Human
uguuucccaacaccccaaag

SEQ ID NO: 210051 - RNA, 18 nt, Human
cucuggacagcaggcauc

SEQ ID NO: 210052 - RNA, 22 nt, Human
ggagaggaaguuuaaagaauug

SEQ ID NO: 210053 - RNA, 22 nt, Human
cugggagaggaaccucgagggu

SEQ ID NO: 210054 - RNA, 22 nt, Human
agugagcuuuuaaaauuuacca

SEQ ID NO: 210055 - RNA, 22 nt, Human
uugauuuccauuguccagcauu

SEQ ID NO: 210056 - RNA, 21 nt, Human
acaguaugaucaaaugugcca

SEQ ID NO: 210057 - RNA, 22 nt, Human
uuuccaguuguucuagaaagcu

SEQ ID NO: 210058 - RNA, 22 nt, Human
ggaaaaauggguggugauauga

SEQ ID NO: 210059 - RNA, 22 nt, Human
caucuaaaauaagccuuauaau

SEQ ID NO: 210060 - RNA, 22 nt, Human
aauguaaauaauuguaaaauuu

SEQ ID NO: 210061 - RNA, 22 nt, Human
augcuacauuuugguuuauaaa

SEQ ID NO: 210062 - RNA, 22 nt, Human
uuccucauuuuguuaauuuuac

SEQ ID NO: 210063 - RNA, 22 nt, Human
gaaagugaauguaacauguuau

SEQ ID NO: 210064 - RNA, 20 nt, Human
gccugggagaagaucaggga

SEQ ID NO: 210065 - RNA, 19 nt, Human
uagaggagaauggcaaaga

SEQ ID NO: 210066 - RNA, 22 nt, Human
gaaaagaaggcaggagcccaag

SEQ ID NO: 210067 - RNA, 22 nt, Human
caaggcuaagcuuuggcuuucu

SEQ ID NO: 210068 - RNA, 22 nt, Human
ugaaauguggagaugguaagua

SEQ ID NO: 210069 - RNA, 22 nt, Human
aucguuaugauagagaaagaga

SEQ ID NO: 210070 - RNA, 21 nt, Human
caguuugcuauuuuaguauga

SEQ ID NO: 210071 - RNA, 22 nt, Human
auucuuuagaguccuucaaaua

SEQ ID NO: 210072 - RNA, 22 nt, Human
uauuagggaacugcaagacuaa

SEQ ID NO: 210073 - RNA, 22 nt, Human
uuugaagaccuuaucucuaaau

SEQ ID NO: 210074 - RNA, 22 nt, Human
gguguacuucacucuuaccuag

SEQ ID NO: 210075 - RNA, 22 nt, Human
uacaccaugcuccagcaggaca

SEQ ID NO: 210076 - RNA, 22 nt, Human
aaauagauuugacuacuuggug

SEQ ID NO: 210077 - RNA, 22 nt, Human
ugaauuauaugguauugaacau

SEQ ID NO: 210078 - RNA, 22 nt, Human
aagagaaagggaaaaugguaaa

SEQ ID NO: 210079 - RNA, 22 nt, Human
ucuccagcugaggccuucuucc

SEQ ID NO: 210080 - RNA, 22 nt, Human
ugcucuuucaggcauagaccuu

SEQ ID NO: 210081 - RNA, 22 nt, Human
cucugcccacaguccccgagga

SEQ ID NO: 210082 - RNA, 22 nt, Human
ccaccacugaggcacaggagcc

SEQ ID NO: 210083 - RNA, 22 nt, Human
ccacuuucuaaauuggcgauuu

SEQ ID NO: 210084 - RNA, 22 nt, Human
uuuaagguacagcuagcagcau

SEQ ID NO: 210085 - RNA, 22 nt, Human
cccuucauguagcugugugucc

SEQ ID NO: 210086 - RNA, 22 nt, Human
aggguggcuggaguggucuggu

SEQ ID NO: 210087 - RNA, 22 nt, Human
ugcuuaucuccuuaguuuuugc

SEQ ID NO: 210088 - RNA, 22 nt, Human
ugguccuuuccauuggagacac

SEQ ID NO: 210089 - RNA, 22 nt, Human
guggaaggaauuaacagacuag

SEQ ID NO: 210090 - RNA, 22 nt, Human
uaauuucauuuugcaaugaucu

SEQ ID NO: 210091 - RNA, 22 nt, Human
auacuacaucacagccaagaag

SEQ ID NO: 210092 - RNA, 22 nt, Human
guuuucuuguuaauuuugaacg

SEQ ID NO: 210093 - RNA, 22 nt, Human
aaggaggaugaauugucugcaa

SEQ ID NO: 210094 - RNA, 22 nt, Human
ggcuccaggguaccccuggaug

SEQ ID NO: 210095 - RNA, 22 nt, Human
aaacauguagugcaugaggauc

SEQ ID NO: 210096 - RNA, 22 nt, Human
cugguuuauuucauaguuuguu

SEQ ID NO: 210097 - RNA, 22 nt, Human
uuggcuguguugaaaacgugga

SEQ ID NO: 210098 - RNA, 22 nt, Human
cucccucauaugguugcuuauc

SEQ ID NO: 210099 - RNA, 22 nt, Human
cgggaggcggagcuccgcgggg

SEQ ID NO: 210100 - RNA, 22 nt, Human
aacuuucuuugcaucuaaguuu

SEQ ID NO: 210101 - RNA, 22 nt, Human
cauuauucaggcuuuggaauuu

SEQ ID NO: 210102 - RNA, 22 nt, Human
cagaaaguauguucuaguaguu

SEQ ID NO: 210103 - RNA, 21 nt, Human
ugaagcccugugaggugcuua

SEQ ID NO: 210104 - RNA, 22 nt, Human
uauuuugaggugaaagaguuug

SEQ ID NO: 210105 - RNA, 22 nt, Human
uauaugcacucagguguaugug

SEQ ID NO: 210106 - RNA, 22 nt, Human
gaaggugcugaaacagaaauuu

SEQ ID NO: 210107 - RNA, 22 nt, Human
uuaauuguuagauagauuauag

SEQ ID NO: 210108 - RNA, 22 nt, Human
uugcaagauaguguauuuuuca

SEQ ID NO: 210109 - RNA, 22 nt, Human
aaguuuaagguagugaugauga

SEQ ID NO: 210110 - RNA, 22 nt, Human
ccccauggaaaacccaccuagg

SEQ ID NO: 210111 - RNA, 22 nt, Human
agaguguguggggcugagguca

SEQ ID NO: 210112 - RNA, 22 nt, Human
acaaauuuaaauguugucuguu

SEQ ID NO: 210113 - RNA, 22 nt, Human
uaucuagguacacaucuccucu

SEQ ID NO: 210114 - RNA, 22 nt, Human
uggugcaggauuuauuuaacua

SEQ ID NO: 210115 - RNA, 22 nt, Human
caaaucuguuaauuucaaguug

SEQ ID NO: 210116 - RNA, 22 nt, Human
agguggcuaugaggaugcaguc

SEQ ID NO: 210117 - RNA, 22 nt, Human
uuccgcuuucaauggcuuggcu

SEQ ID NO: 210118 - RNA, 22 nt, Human
aaaaggauauuuggugcaaagc

SEQ ID NO: 210119 - RNA, 22 nt, Human
uucagaauuaucauaauuuuga

SEQ ID NO: 210120 - RNA, 22 nt, Human
guaggaaaugaauaagguaccu

SEQ ID NO: 210121 - RNA, 22 nt, Human
uuguaagacuguagaaugcaaa

SEQ ID NO: 210122 - RNA, 22 nt, Human
ucuugugguggaucccucauuu

SEQ ID NO: 210123 - RNA, 22 nt, Human
uggagcugguucuggggaagcu

SEQ ID NO: 210124 - RNA, 22 nt, Human
uucucucaguuaaacuuuguga

SEQ ID NO: 210125 - RNA, 22 nt, Human
acuaaacauaucacugcuuuac

SEQ ID NO: 210126 - RNA, 22 nt, Human
uucaaacaguguagaauauaug

SEQ ID NO: 210127 - RNA, 22 nt, Human
auuucacucuuaauugcuuccu

SEQ ID NO: 210128 - RNA, 22 nt, Human
uuuccacacucacugcacucau

SEQ ID NO: 210129 - RNA, 22 nt, Human
aagaggcuacagcccugugucu

SEQ ID NO: 210130 - RNA, 22 nt, Human
auuuuugguuucaccugcacgc

SEQ ID NO: 210131 - RNA, 22 nt, Human
uuuuuaauuuuaagcuauuugu

SEQ ID NO: 210132 - RNA, 22 nt, Human
uuguuuaaagaacuucugacuu

SEQ ID NO: 210133 - RNA, 22 nt, Human
ucccacugucuucucgugcucg

SEQ ID NO: 210134 - RNA, 22 nt, Human
gcuucccacagcuggacugggg

SEQ ID NO: 210135 - RNA, 22 nt, Human
gcucuggcuacuguggcuaccg

SEQ ID NO: 210136 - RNA, 22 nt, Human
auugacagagguguaguugaga

SEQ ID NO: 210137 - RNA, 22 nt, Human
acagucuuggauuccaggaguc

SEQ ID NO: 210138 - RNA, 22 nt, Human
uggaagugggcaucaccaucca

SEQ ID NO: 210139 - RNA, 22 nt, Human
ccaaggcuguggggcugugcag

SEQ ID NO: 210140 - RNA, 22 nt, Human
uuuauuuacuuucgguucugcu

SEQ ID NO: 210141 - RNA, 22 nt, Human
ggggaagagagaagaaugaucu

SEQ ID NO: 210142 - RNA, 22 nt, Human
gucacaaaugauuuagcaauca

SEQ ID NO: 210143 - RNA, 22 nt, Human
auccucucugugacagggaacg

SEQ ID NO: 210144 - RNA, 22 nt, Human
auggggaggcggauggagugcu

SEQ ID NO: 210145 - RNA, 22 nt, Human
agaggcuuuccuaagauugguu

SEQ ID NO: 210146 - RNA, 22 nt, Human
caggacagaaauaaggaauaua

SEQ ID NO: 210147 - RNA, 22 nt, Human
uauuuuuaccuaauuuaugaga

SEQ ID NO: 210148 - RNA, 22 nt, Human
cuccaugagccaggagggcuac

SEQ ID NO: 210149 - RNA, 22 nt, Human
caaugggagaugcagaacagcu

SEQ ID NO: 210150 - RNA, 22 nt, Human
uggaaaugcuuagaggugaucu

SEQ ID NO: 210151 - RNA, 22 nt, Human
uuggggaugccccuacgggcua

SEQ ID NO: 210152 - RNA, 22 nt, Human
uccuggcgugggcuggcugcag

SEQ ID NO: 210153 - RNA, 22 nt, Human
gaaggcugaauuauuuguuccu

SEQ ID NO: 210154 - RNA, 22 nt, Human
acuguggcugcuacccuggcuc

SEQ ID NO: 210155 - RNA, 22 nt, Human
uguuuguuuuguauuuuuaauu

SEQ ID NO: 210156 - RNA, 22 nt, Human
aaaagacaaggaucuggaguga

SEQ ID NO: 210157 - RNA, 22 nt, Human
uccuaguucugaccucgcucac

SEQ ID NO: 210158 - RNA, 21 nt, Human
acaaugaguuugaggcaucag

SEQ ID NO: 210159 - RNA, 22 nt, Human
ccccugcucagggaggagaccg

SEQ ID NO: 210160 - RNA, 22 nt, Human
cuggguguggugggugcugccg

SEQ ID NO: 210161 - RNA, 22 nt, Human
uuuuaaaacaugucaaaaugug

SEQ ID NO: 210162 - RNA, 22 nt, Human
ucccugagcuguguuuguuggu

SEQ ID NO: 210163 - RNA, 22 nt, Human
uuacuuucugggauaucaaaug

SEQ ID NO: 210164 - RNA, 22 nt, Human
aagccgagggaggugauggaga

SEQ ID NO: 210165 - RNA, 22 nt, Human
guccugaaaaaaaucccugagu

SEQ ID NO: 210166 - RNA, 22 nt, Human
agaaugcaagguauuuggaggg

SEQ ID NO: 210167 - RNA, 23 nt, Human
ccagucgagucccaaccuucacc

SEQ ID NO: 210168 - RNA, 22 nt, Human
gcucagagaaaacuggggcuug

SEQ ID NO: 210169 - RNA, 22 nt, Human
caaaauuguugaugcugcuuug

SEQ ID NO: 210170 - RNA, 22 nt, Human
uuuuccuucuuccugccuugcc

SEQ ID NO: 210171 - RNA, 20 nt, Human
gcuaggggacuggagggagg

SEQ ID NO: 210172 - RNA, 22 nt, Human
ccauuuuccuguauggacucga

SEQ ID NO: 210173 - RNA, 22 nt, Human
guuagaauggacaaagcugaaa

SEQ ID NO: 210174 - RNA, 21 nt, Human
auuggcagaucucuggauugu

SEQ ID NO: 210175 - RNA, 22 nt, Human
gaggagcaggcaggaucugguc

SEQ ID NO: 210176 - RNA, 22 nt, Human
gcucuccuugcuagagguucua

SEQ ID NO: 210177 - RNA, 22 nt, Human
aaucccaguugacagaacuguu

SEQ ID NO: 210178 - RNA, 22 nt, Human
ugaagacuucuuuuggucacca

SEQ ID NO: 210179 - RNA, 22 nt, Human
ugcuuucagauaucuguuucaa

SEQ ID NO: 210180 - RNA, 22 nt, Human
guggcagguguacagcucagcu

SEQ ID NO: 210181 - RNA, 22 nt, Human
aauggagaaaagacaauguuga

SEQ ID NO: 210182 - RNA, 21 nt, Human
ccgaggagugcggggagcccc

SEQ ID NO: 210183 - RNA, 22 nt, Human
gagcaacacauugaaugaggau

SEQ ID NO: 210184 - RNA, 22 nt, Human
gcaacuccuaggcgaggccuuc

SEQ ID NO: 210185 - RNA, 19 nt, Human
uaugaaguugauaaaaguu

SEQ ID NO: 210186 - RNA, 22 nt, Human
agaggugcuuaugcucaugguu

SEQ ID NO: 210187 - RNA, 22 nt, Human
gaauggaugcuggucaguuugg

SEQ ID NO: 210188 - RNA, 22 nt, Human
agagcuccaggguuuuguagug

SEQ ID NO: 210189 - RNA, 22 nt, Human
uuucuaaaaccagaguuuauaa

SEQ ID NO: 210190 - RNA, 22 nt, Human
gugccucuaguuuucuccuaaa

SEQ ID NO: 210191 - RNA, 22 nt, Human
ugugcaguauugaaauauaugu

SEQ ID NO: 210192 - RNA, 22 nt, Human
uuagaaauguccuacuaauaug

SEQ ID NO: 210193 - RNA, 22 nt, Human
uuuauuuagguaaacaugaguu

SEQ ID NO: 210194 - RNA, 23 nt, Human
acgggaggcggggcagggcugag

SEQ ID NO: 210195 - RNA, 22 nt, Human
caaccucuaucggucaggaagc

SEQ ID NO: 210196 - RNA, 22 nt, Human
uaauaaaaauuuaauucacauu

SEQ ID NO: 210197 - RNA, 22 nt, Human
uggcucaggccuacgacgccuu

SEQ ID NO: 210198 - RNA, 22 nt, Human
guuaaaaugauuugugauuuau

SEQ ID NO: 210199 - RNA, 22 nt, Human
uuuuguuuacauuaaauuuuga

SEQ ID NO: 210200 - RNA, 22 nt, Human
auggugaugaugaugaugauaa

SEQ ID NO: 210201 - RNA, 22 nt, Human
augaagguggacagauuuuuuu

SEQ ID NO: 210202 - RNA, 22 nt, Human
cauuacaagaaauagcauaaug

SEQ ID NO: 210203 - RNA, 22 nt, Human
gccucucuggcaaagcggugau

SEQ ID NO: 210204 - RNA, 19 nt, Human
ugaggauugagguccagua

SEQ ID NO: 210205 - RNA, 21 nt, Human
uguauacacacauuguaccaa

SEQ ID NO: 210206 - RNA, 22 nt, Human
uuccaugccccucuuuggguac

SEQ ID NO: 210207 - RNA, 22 nt, Human
cuucauuucaggcugaagaaua

SEQ ID NO: 210208 - RNA, 21 nt, Human
aaguccaauaccuaaggcucc

SEQ ID NO: 210209 - RNA, 22 nt, Human
gaggguaagcugggacuccucg

SEQ ID NO: 210210 - RNA, 22 nt, Human
aaaaacuuaccccagggcaagg

SEQ ID NO: 210211 - RNA, 22 nt, Human
ggagagaacguaaucuaguauu

SEQ ID NO: 210212 - RNA, 22 nt, Human
uuucacuucgaucagaguuuuu

SEQ ID NO: 210213 - RNA, 22 nt, Human
agggaagcaggaaguaugggaa

SEQ ID NO: 210214 - RNA, 22 nt, Human
ggcagaggaagcuggaaguggg

SEQ ID NO: 210215 - RNA, 22 nt, Human
gaguagcaguucauccacaagc

SEQ ID NO: 210216 - RNA, 22 nt, Human
acaguuuuccuugguauagaac

SEQ ID NO: 210217 - RNA, 22 nt, Human
gggauggggagcuggaaagggg

SEQ ID NO: 210218 - RNA, 22 nt, Human
ugucuucauuccccaugaaguc

SEQ ID NO: 210219 - RNA, 22 nt, Human
auuuuacuaugauaguugagaa

SEQ ID NO: 210220 - RNA, 23 nt, Human
uccuccccaccuuuguccccucc

SEQ ID NO: 210221 - RNA, 22 nt, Human
cuggugagaccgacuuccacuu

SEQ ID NO: 210222 - RNA, 22 nt, Human
ugggaaaauagcuauuuugaaa

SEQ ID NO: 210223 - RNA, 22 nt, Human
gagcagggagaggcagagaggc

SEQ ID NO: 210224 - RNA, 22 nt, Human
uuccugcuggucaaaguugccu

SEQ ID NO: 210225 - RNA, 22 nt, Human
agugucugcgggcagaggagcg

SEQ ID NO: 210226 - RNA, 22 nt, Human
aggagcugccggauggggcaug

SEQ ID NO: 210227 - RNA, 22 nt, Human
agguuuuacuuuuuuuggaggu

SEQ ID NO: 210228 - RNA, 22 nt, Human
agauauucugccuaacagguuu

SEQ ID NO: 210229 - RNA, 22 nt, Human
agagaagaauccccugguggag

SEQ ID NO: 210230 - RNA, 22 nt, Human
uuaaugcagguacuguuacaau

SEQ ID NO: 210231 - RNA, 22 nt, Human
gaacauauuuagcaccuaauau

SEQ ID NO: 210232 - RNA, 22 nt, Human
gggcaggcuggguggugguccc

SEQ ID NO: 210233 - RNA, 19 nt, Human
uuuguuguaucagagcuuu

SEQ ID NO: 210234 - RNA, 22 nt, Human
uuugauuuuguuuauagugccg

SEQ ID NO: 210235 - RNA, 20 nt, Human
aaggaggcuuaaaguuagaa

SEQ ID NO: 210236 - RNA, 22 nt, Human
uagcagcacuauuuguuguagu

SEQ ID NO: 210237 - RNA, 21 nt, Human
aauucccagaaacagcacaag

SEQ ID NO: 210238 - RNA, 22 nt, Human
gagcacuucagcauaaaucaca

SEQ ID NO: 210239 - RNA, 22 nt, Human
aaauauuaaugaugaagguagu

SEQ ID NO: 210240 - RNA, 22 nt, Human
aggagggcggggcuaaaaggga

SEQ ID NO: 210241 - RNA, 19 nt, Human
cuuuuagagggagaggacu

SEQ ID NO: 210242 - RNA, 21 nt, Human
aucucaguccugggaaugauu

SEQ ID NO: 210243 - RNA, 22 nt, Human
aagaaaagcaucuuuguaguag

SEQ ID NO: 210244 - RNA, 22 nt, Human
cuuggagauacagaggacauuu

SEQ ID NO: 210245 - RNA, 22 nt, Human
ugagggaggggaaugugugcag

SEQ ID NO: 210246 - RNA, 22 nt, Human
ucccagguugaggccuugccug

SEQ ID NO: 210247 - RNA, 22 nt, Human
cuggcccugucagcacagaauc

SEQ ID NO: 210248 - RNA, 22 nt, Human
aacucugacgcugucaaauaca

SEQ ID NO: 210249 - RNA, 22 nt, Human
aaggggaggccugcgcuuucgg

SEQ ID NO: 210250 - RNA, 22 nt, Human
guucuguauauauccuagcaaa

SEQ ID NO: 210251 - RNA, 22 nt, Human
uccaaggcuggaucuuuucuuu

SEQ ID NO: 210252 - RNA, 22 nt, Human
uuuuucuccucucucuuucauu

SEQ ID NO: 210253 - RNA, 20 nt, Human
agucuucaggugugaggauu

SEQ ID NO: 210254 - RNA, 22 nt, Human
ugccuuccuucuccccuccuuc

SEQ ID NO: 210255 - RNA, 22 nt, Human
gcccuguuauagucugaggccu

SEQ ID NO: 210256 - RNA, 22 nt, Human
ggaagccugggcgcaggcaggg

SEQ ID NO: 210257 - RNA, 22 nt, Human
gcuagagaccagaggccuugaa

SEQ ID NO: 210258 - RNA, 22 nt, Human
ugggcagggauuuggggaaacu

SEQ ID NO: 210259 - RNA, 22 nt, Human
aaagaagugucuuacucccucu

SEQ ID NO: 210260 - RNA, 22 nt, Human
uccaggaggacugagggggcug

SEQ ID NO: 210261 - RNA, 21 nt, Human
uggcaggcagcuggaagcuug

SEQ ID NO: 210262 - RNA, 22 nt, Human
aauaauacaugugaugagaauu

SEQ ID NO: 210263 - RNA, 22 nt, Human
acagaauugggguucuugggga

SEQ ID NO: 210264 - RNA, 22 nt, Human
ugaauucaaacuuuuuaacaag

SEQ ID NO: 210265 - RNA, 22 nt, Human
aauaucuugaguuauaaauuca

SEQ ID NO: 210266 - RNA, 22 nt, Human
ggcagaggagcuggaaacaugg

SEQ ID NO: 210267 - RNA, 17 nt, Human
ucuuuuacuuucucucc

SEQ ID NO: 210268 - RNA, 22 nt, Human
ucuaaaaauuagaaauuagguc

SEQ ID NO: 210269 - RNA, 22 nt, Human
agcuaguucacugaagccuaug

SEQ ID NO: 210270 - RNA, 22 nt, Human
cccagcuggcaaaggcguccuu

SEQ ID NO: 210271 - RNA, 22 nt, Human
gucuuucuuuuacauauuugug

SEQ ID NO: 210272 - RNA, 22 nt, Human
auggagggguuguugcuugagu

SEQ ID NO: 210273 - RNA, 22 nt, Human
aaacuuuaucaaguacucuuca

SEQ ID NO: 210274 - RNA, 22 nt, Human
guacaaagucaaggugaaaaua

SEQ ID NO: 210275 - RNA, 22 nt, Human
agcaauguuggccuauauaccu

SEQ ID NO: 210276 - RNA, 22 nt, Human
aguaggaauucaaagagacaaa

SEQ ID NO: 210277 - RNA, 22 nt, Human
uaggguuucaugcugguuucca

SEQ ID NO: 210278 - RNA, 22 nt, Human
uuccauuccauaucagguacag

SEQ ID NO: 210279 - RNA, 22 nt, Human
gcagccagggaccuuugacuau

SEQ ID NO: 210280 - RNA, 23 nt, Human
uuuuacaagagugcauuugucuc

SEQ ID NO: 210281 - RNA, 22 nt, Human
accuggcccugggucuccugac

SEQ ID NO: 210282 - RNA, 19 nt, Human
ccacacacuggucucuggg

SEQ ID NO: 210283 - RNA, 22 nt, Human
gaggggacugucuggcuccgag

SEQ ID NO: 210284 - RNA, 20 nt, Human
aucugugaugagaacgguuu

SEQ ID NO: 210285 - RNA, 22 nt, Human
auauuucuacaggcugauuuua

SEQ ID NO: 210286 - RNA, 22 nt, Human
ucuggcacuugccaguuucuau

SEQ ID NO: 210287 - RNA, 19 nt, Human
ugguggaggugcaccugac

SEQ ID NO: 210288 - RNA, 22 nt, Human
ugcagagagccagcucucucgg

SEQ ID NO: 210289 - RNA, 22 nt, Human
caggaaaauaauggugauggga

SEQ ID NO: 210290 - RNA, 22 nt, Human
aaggucuucgaaccuuauguua

SEQ ID NO: 210291 - RNA, 22 nt, Human
cugcccgcaugcaggaaugcug

SEQ ID NO: 210292 - RNA, 23 nt, Human
aacugcaagguugcugggaagua

SEQ ID NO: 210293 - RNA, 21 nt, Human
uacaucaguuuucuuggcuca

SEQ ID NO: 210294 - RNA, 22 nt, Human
gaggagcugggucagggagaca

SEQ ID NO: 210295 - RNA, 22 nt, Human
cuguuuggcuuccacugcuucu

SEQ ID NO: 210296 - RNA, 22 nt, Human
ccacucagaagaaacaagagag

SEQ ID NO: 210297 - RNA, 22 nt, Human
ucagaagguacugaagacaugg

SEQ ID NO: 210298 - RNA, 22 nt, Human
uuggaaaugcauuuguuauuau

SEQ ID NO: 210299 - RNA, 22 nt, Human
cugcagauguagcugcuuuccu

SEQ ID NO: 210300 - RNA, 22 nt, Human
uggagagcaaugaggggcaggc

SEQ ID NO: 210301 - RNA, 22 nt, Human
uuucacugaguaggagagcacu

SEQ ID NO: 210302 - RNA, 22 nt, Human
aggcaggauuugcgaugugguu

SEQ ID NO: 210303 - RNA, 22 nt, Human
ccacagugauucacuuuugaag

SEQ ID NO: 210304 - RNA, 22 nt, Human
ugugaagcgugugcaggggaca

SEQ ID NO: 210305 - RNA, 22 nt, Human
agguugggagaggucacccuga

SEQ ID NO: 210306 - RNA, 22 nt, Human
uaauauaacugccaguuaaggu

SEQ ID NO: 210307 - RNA, 22 nt, Human
uuaauauuaagauauugagugg

SEQ ID NO: 210308 - RNA, 22 nt, Human
ugcagcagaauauggcugcagg

SEQ ID NO: 210309 - RNA, 22 nt, Human
uuuuaucagagcuugcagugug

SEQ ID NO: 210310 - RNA, 22 nt, Human
ccuccugggccuugcucuguga

SEQ ID NO: 210311 - RNA, 21 nt, Human
aaauuucauauggccaaccua

SEQ ID NO: 210312 - RNA, 22 nt, Human
uccccaugaacuuguggcugcu

SEQ ID NO: 210313 - RNA, 23 nt, Human
agagggaagagcuuagaugggga

SEQ ID NO: 210314 - RNA, 22 nt, Human
aaagacaauaauucucucuagc

SEQ ID NO: 210315 - RNA, 18 nt, Human
uucaggcucuugcaugaa

SEQ ID NO: 210316 - RNA, 22 nt, Human
ugugugcuaguuuugucaguau

SEQ ID NO: 210317 - RNA, 22 nt, Human
gaagaggaagaggagccagagc

SEQ ID NO: 210318 - RNA, 22 nt, Human
gggcaagagaggaagagauggc

SEQ ID NO: 210319 - RNA, 22 nt, Human
gccugggguuugcggggcugca

SEQ ID NO: 210320 - RNA, 23 nt, Human
uccaagagagauuuuaaauuucu

SEQ ID NO: 210321 - RNA, 18 nt, Human
cccagaggaaugccugga

SEQ ID NO: 210322 - RNA, 22 nt, Human
gugaucagaagaaccugccgaa

SEQ ID NO: 210323 - RNA, 22 nt, Human
cucaucuucuuccuucuuuucc

SEQ ID NO: 210324 - RNA, 22 nt, Human
uuacucucugaggcacucaaaa

SEQ ID NO: 210325 - RNA, 22 nt, Human
cagagaggagcacaaagugaag

SEQ ID NO: 210326 - RNA, 22 nt, Human
aaauauuagacauaccuggaga

SEQ ID NO: 210327 - RNA, 22 nt, Human
agggcaguuaugaaugucucca

SEQ ID NO: 210328 - RNA, 22 nt, Human
ugcaucuaaguggcuaacaacc

SEQ ID NO: 210329 - RNA, 17 nt, Human
ccacuagauagguugug

SEQ ID NO: 210330 - RNA, 22 nt, Human
cccuguccugcuaggcccuggu

SEQ ID NO: 210331 - RNA, 22 nt, Human
uguugaagcaccucugucuuuc

SEQ ID NO: 210332 - RNA, 22 nt, Human
ugagguugggaggacugccuaa

SEQ ID NO: 210333 - RNA, 22 nt, Human
uauagcaagagaaccauuacca

SEQ ID NO: 210334 - RNA, 22 nt, Human
auuuucuucauuuugauuguau

SEQ ID NO: 210335 - RNA, 22 nt, Human
uacuugaaaugggcaucaagag

SEQ ID NO: 210336 - RNA, 22 nt, Human
gggagauuuguguaggaaaacu

SEQ ID NO: 210337 - RNA, 20 nt, Human
aauaaauauaacccauaauu

SEQ ID NO: 210338 - RNA, 22 nt, Human
ucucagcuggcugggagcccug

SEQ ID NO: 210339 - RNA, 22 nt, Human
ucccagcaggcaccgcuucugc

SEQ ID NO: 210340 - RNA, 22 nt, Human
cacuaggauccuucuucuucuu

SEQ ID NO: 210341 - RNA, 22 nt, Human
uuuuaaaagguugcuguuauaa

SEQ ID NO: 210342 - RNA, 22 nt, Human
ugcuuggauuuccaaaugguuu

SEQ ID NO: 210343 - RNA, 21 nt, Human
ggggccucaucagaaauguua

SEQ ID NO: 210344 - RNA, 22 nt, Human
ucagggaggagaggcaggggga

SEQ ID NO: 210345 - RNA, 22 nt, Human
ugguggcaauuuuuggggucaa

SEQ ID NO: 210346 - RNA, 22 nt, Human
uaggaagagauuuucacauggc

SEQ ID NO: 210347 - RNA, 22 nt, Human
cagcucuggcuauugaggacca

SEQ ID NO: 210348 - RNA, 22 nt, Human
uggcagccugcgugaaggagcu

SEQ ID NO: 210349 - RNA, 22 nt, Human
uccagggaggggcggcaggggu

SEQ ID NO: 210350 - RNA, 22 nt, Human
ccuccuggaguuacuuccaaaa

SEQ ID NO: 210351 - RNA, 22 nt, Human
ucgagcucagcagggaggugcg

SEQ ID NO: 210352 - RNA, 22 nt, Human
uagcauuucacugaucuucacu

SEQ ID NO: 210353 - RNA, 22 nt, Human
gcuacaacugugucuguggggc

SEQ ID NO: 210354 - RNA, 22 nt, Human
caggguuuuaguugcagguuau

SEQ ID NO: 210355 - RNA, 20 nt, Human
ugggggugcccaucuccccu

SEQ ID NO: 210356 - RNA, 22 nt, Human
aggcaguguggagggcuguugc

SEQ ID NO: 210357 - RNA, 22 nt, Human
ggaaauguguguaagaaaguau

SEQ ID NO: 210358 - RNA, 22 nt, Human
aguguuuuaagaaaguaauuuu

SEQ ID NO: 210359 - RNA, 22 nt, Human
gggggcugugugcccgcucccc

SEQ ID NO: 210360 - RNA, 20 nt, Human
ggagcgggcauuuguguucc

SEQ ID NO: 210361 - RNA, 22 nt, Human
gggaagaaccucugcuaccaau

SEQ ID NO: 210362 - RNA, 22 nt, Human
gaaaagcucuuuagaagagguu

SEQ ID NO: 210363 - RNA, 22 nt, Human
ucauuuaucgcugccuuuuaaa

SEQ ID NO: 210364 - RNA, 22 nt, Human
uucagaugcuugauuauggcaa

SEQ ID NO: 210365 - RNA, 22 nt, Human
aggguguacauuuguuggugaa

SEQ ID NO: 210366 - RNA, 22 nt, Human
aaauguaaacuguauuuauaaa

SEQ ID NO: 210367 - RNA, 22 nt, Human
uuuucauuguuaguuucuccuu

SEQ ID NO: 210368 - RNA, 22 nt, Human
cuacauuuacacaguuaggcuu

SEQ ID NO: 210369 - RNA, 22 nt, Human
aacugcauaagcuucgggaccu

SEQ ID NO: 210370 - RNA, 22 nt, Human
acagcagguuauuguuauggca

SEQ ID NO: 210371 - RNA, 22 nt, Human
guaagaauauacccaggaguca

SEQ ID NO: 210372 - RNA, 22 nt, Human
acugcaggucccaucaccugcg

SEQ ID NO: 210373 - RNA, 22 nt, Human
agacacagcaauaacuacuguu

SEQ ID NO: 210374 - RNA, 22 nt, Human
agggcaugugaaguaaccuagg

SEQ ID NO: 210375 - RNA, 22 nt, Human
ucaccauguuuucauaggaaca

SEQ ID NO: 210376 - RNA, 22 nt, Human
aucacacaccuguuaaauugug

SEQ ID NO: 210377 - RNA, 22 nt, Human
cagacagaaggcuccuugaggu

SEQ ID NO: 210378 - RNA, 21 nt, Human
agaugaggauacugaggccua

SEQ ID NO: 210379 - RNA, 22 nt, Human
guuuucuccugcuauacagugc

SEQ ID NO: 210380 - RNA, 22 nt, Human
aucaugugacuagguuuggcca

SEQ ID NO: 210381 - RNA, 22 nt, Human
gugcuuuaccuuauuggucucg

SEQ ID NO: 210382 - RNA, 22 nt, Human
uguggguggucagcgugugaug

SEQ ID NO: 210383 - RNA, 22 nt, Human
agcuugaugaaagugggugcuc

SEQ ID NO: 210384 - RNA, 22 nt, Human
ccccaaauuugugcuuucauag

SEQ ID NO: 210385 - RNA, 22 nt, Human
gggccaaggggagcuggaaggg

SEQ ID NO: 210386 - RNA, 22 nt, Human
cagggacgugagccaugucagu

SEQ ID NO: 210387 - RNA, 22 nt, Human
cuugccuuugaaagcauuucuc

SEQ ID NO: 210388 - RNA, 22 nt, Human
gcuggccugcgagggcaggcug

SEQ ID NO: 210389 - RNA, 22 nt, Human
aacaucaaaggaagaaugauau

SEQ ID NO: 210390 - RNA, 22 nt, Human
aaaauauguugagauacugaaa

SEQ ID NO: 210391 - RNA, 22 nt, Human
aagggaaguuugacacuuuuua

SEQ ID NO: 210392 - RNA, 22 nt, Human
cugccuggggaaugugaggauu

SEQ ID NO: 210393 - RNA, 22 nt, Human
uuuucucucacuucacauauuu

SEQ ID NO: 210394 - RNA, 22 nt, Human
gggugcuucauaggugaugcug

SEQ ID NO: 210395 - RNA, 17 nt, Human
uuagagcuacauguuga

SEQ ID NO: 210396 - RNA, 22 nt, Human
cuauuuucccauaugguugaca

SEQ ID NO: 210397 - RNA, 22 nt, Human
augaaaacgugugugugugugu

SEQ ID NO: 210398 - RNA, 22 nt, Human
gugugugucuacuuucaucucu

SEQ ID NO: 210399 - RNA, 18 nt, Human
uuuuuuguucuguuuugu

SEQ ID NO: 210400 - RNA, 22 nt, Human
uuuguuugcugagugaauucaa

SEQ ID NO: 210401 - RNA, 22 nt, Human
cugaaggacacgugaggagcca

SEQ ID NO: 210402 - RNA, 22 nt, Human
accugagauuuuuacucaguaa

SEQ ID NO: 210403 - RNA, 22 nt, Human
uuaggcuuuauugaaaacaaua

SEQ ID NO: 210404 - RNA, 22 nt, Human
gguguagagaaaauaguuguau

SEQ ID NO: 210405 - RNA, 22 nt, Human
cgcacuggagcuggaacgaguc

SEQ ID NO: 210406 - RNA, 22 nt, Human
caaaaaauccauagaaagaggu

SEQ ID NO: 210407 - RNA, 22 nt, Human
ucugugugugcauguguguaua

SEQ ID NO: 210408 - RNA, 22 nt, Human
aguaauuucuuacggagaccuu

SEQ ID NO: 210409 - RNA, 22 nt, Human
ccugaagaugguugauccccuu

SEQ ID NO: 210410 - RNA, 22 nt, Human
cauuccccaacucaacagggcu

SEQ ID NO: 210411 - RNA, 22 nt, Human
ugggucagauacaguguuuggu

SEQ ID NO: 210412 - RNA, 20 nt, Human
aauagcacagcucaaacauu

SEQ ID NO: 210413 - RNA, 22 nt, Human
uguccuuuauauguuuuuuagu

SEQ ID NO: 210414 - RNA, 22 nt, Human
uuuuuuccuguuugucuuuggg

SEQ ID NO: 210415 - RNA, 22 nt, Human
caguugcuauugagagaacaca

SEQ ID NO: 210416 - RNA, 22 nt, Human
ucauaaaggugccacucaguuu

SEQ ID NO: 210417 - RNA, 23 nt, Human
aaggugaagccaccaggugagga

SEQ ID NO: 210418 - RNA, 22 nt, Human
ccccaggcagcccuccaggagc

SEQ ID NO: 210419 - RNA, 22 nt, Human
ggaacuaagcacauuaucugau

SEQ ID NO: 210420 - RNA, 22 nt, Human
agcggaggaggcggagcaggga

SEQ ID NO: 210421 - RNA, 22 nt, Human
gucuguacugccguuauucaga

SEQ ID NO: 210422 - RNA, 22 nt, Human
uuauuuaaguauuuauugaagu

SEQ ID NO: 210423 - RNA, 22 nt, Human
aagugauuuagagagcucuuag

SEQ ID NO: 210424 - RNA, 23 nt, Human
uguauacacccugugcaucuggg

SEQ ID NO: 210425 - RNA, 22 nt, Human
agaagaaugguuugaaagauuu

SEQ ID NO: 210426 - RNA, 20 nt, Human
auccuggucuuuggaagcuu

SEQ ID NO: 210427 - RNA, 22 nt, Human
aaaagggucugacacugcuuga

SEQ ID NO: 210428 - RNA, 22 nt, Human
aauauuuaccuaccugucaucu

SEQ ID NO: 210429 - RNA, 22 nt, Human
uacuauuuugacaugaaauuga

SEQ ID NO: 210430 - RNA, 22 nt, Human
uuuuccuucugauacuccauuu

SEQ ID NO: 210431 - RNA, 22 nt, Human
agaggcagagcugggguuugac

SEQ ID NO: 210432 - RNA, 20 nt, Human
ucucuuuuucuucuuuucuc

SEQ ID NO: 210433 - RNA, 22 nt, Human
ugggugccgcaucuugcuguuc

SEQ ID NO: 210434 - RNA, 22 nt, Human
ccaguuuuuccagugcuuucug

SEQ ID NO: 210435 - RNA, 22 nt, Human
ggcauggugggggaggacuugg

SEQ ID NO: 210436 - RNA, 22 nt, Human
ucccagaacggguucuucccag

SEQ ID NO: 210437 - RNA, 22 nt, Human
ucuccucucugaucuugcuccg

SEQ ID NO: 210438 - RNA, 21 nt, Human
uccaggagcacgggacuagga

SEQ ID NO: 210439 - RNA, 22 nt, Human
agggaagaggaccagagucucu

SEQ ID NO: 210440 - RNA, 22 nt, Human
caacuucugcuuucuuccuugc

SEQ ID NO: 210441 - RNA, 22 nt, Human
ugucuucagguuccucaccacu

SEQ ID NO: 210442 - RNA, 22 nt, Human
ugcuaguuuuugauacuuuugc

SEQ ID NO: 210443 - RNA, 22 nt, Human
ucauccugaagaaccugcuucc

SEQ ID NO: 210444 - RNA, 20 nt, Human
gagguugcucagaguggggu

SEQ ID NO: 210445 - RNA, 20 nt, Human
uuccuuucuuucuuuuuuuu

SEQ ID NO: 210446 - RNA, 20 nt, Human
augaaugcuccccacguuuc

SEQ ID NO: 210447 - RNA, 22 nt, Human
ccuucccagacggcucagcugu

SEQ ID NO: 210448 - RNA, 23 nt, Human
auguagcugcucccgaugcccuc

SEQ ID NO: 210449 - RNA, 22 nt, Human
aggugagaacguggaggggcgg

SEQ ID NO: 210450 - RNA, 22 nt, Human
uggaguagaagggcuccuggaa

SEQ ID NO: 210451 - RNA, 22 nt, Human
ggggcuccuguggcuauaugua

SEQ ID NO: 210452 - RNA, 22 nt, Human
caccaucugaauauucuccaag

SEQ ID NO: 210453 - RNA, 22 nt, Human
ugugggaggaugggccccuaga

SEQ ID NO: 210454 - RNA, 22 nt, Human
aagagaaaugcuuuaacuuuau

SEQ ID NO: 210455 - RNA, 22 nt, Human
aggggaggcugcgggcugccgu

SEQ ID NO: 210456 - RNA, 22 nt, Human
aaaugcacaauaaaguaaaggc

SEQ ID NO: 210457 - RNA, 22 nt, Human
cuucuucaucuuuuggaggaac

SEQ ID NO: 210458 - RNA, 22 nt, Human
ucugaggaauaagaugucuaaa

SEQ ID NO: 210459 - RNA, 22 nt, Human
uggaaaauuuagaaagauuuau

SEQ ID NO: 210460 - RNA, 22 nt, Human
acaagaaaggucugggaacaau

SEQ ID NO: 210461 - RNA, 22 nt, Human
cacugguugccucuuucuguuc

SEQ ID NO: 210462 - RNA, 22 nt, Human
aaagaggacgugcuauuuuuua

SEQ ID NO: 210463 - RNA, 22 nt, Human
gagcaggcuggcagggccaggg

SEQ ID NO: 210464 - RNA, 22 nt, Human
ccuacccaccccuccucaucac

SEQ ID NO: 210465 - RNA, 22 nt, Human
aagaaggaaggcaagagauggg

SEQ ID NO: 210466 - RNA, 22 nt, Human
acuggggaggucuggauggauc

SEQ ID NO: 210467 - RNA, 22 nt, Human
gagcagccugaggauucugcuc

SEQ ID NO: 210468 - RNA, 22 nt, Human
augcacuccucagcuguucugg

SEQ ID NO: 210469 - RNA, 23 nt, Human
aauguugaggguggguuuuuaac

SEQ ID NO: 210470 - RNA, 22 nt, Human
uuaccauaguacuaucaguuua

SEQ ID NO: 210471 - RNA, 17 nt, Human
agcagcuggguugaucu

SEQ ID NO: 210472 - RNA, 22 nt, Human
auaucuuguuuuugauuucuug

SEQ ID NO: 210473 - RNA, 22 nt, Human
caaaugcaguggucgugcugga

SEQ ID NO: 210474 - RNA, 22 nt, Human
cugggcucccucucccgccucg

SEQ ID NO: 210475 - RNA, 22 nt, Human
cucaaauggguuuguagaauau

SEQ ID NO: 210476 - RNA, 22 nt, Human
uuaucuuuuaaaaacacuugug

SEQ ID NO: 210477 - RNA, 22 nt, Human
gagaaugagucagagcuggcug

SEQ ID NO: 210478 - RNA, 22 nt, Human
gagacucagccccugcucucaa

SEQ ID NO: 210479 - RNA, 22 nt, Human
ugagcagccagucauucaaaaa

SEQ ID NO: 210480 - RNA, 22 nt, Human
ucuguuuuccaggaaucucaua

SEQ ID NO: 210481 - RNA, 19 nt, Human
ccaguuuuuuaauauucaa

SEQ ID NO: 210482 - RNA, 22 nt, Human
gccugcaggaaggugugccugu

SEQ ID NO: 210483 - RNA, 22 nt, Human
agggcuugggggccuugaaggc

SEQ ID NO: 210484 - RNA, 17 nt, Human
ucccacuucauuuucca

SEQ ID NO: 210485 - RNA, 22 nt, Human
uaagagauuuauugaggacuuc

SEQ ID NO: 210486 - RNA, 22 nt, Human
gaagaagagauaauggggagca

SEQ ID NO: 210487 - RNA, 22 nt, Human
cauacauguuagcaguagccuu

SEQ ID NO: 210488 - RNA, 20 nt, Human
uucuccacaggguggaggag

SEQ ID NO: 210489 - RNA, 22 nt, Human
agcaagggucucucauggcuug

SEQ ID NO: 210490 - RNA, 22 nt, Human
ugcauuuugaaggaaaaaaaug

SEQ ID NO: 210491 - RNA, 22 nt, Human
gggagggucugagagcugcacc

SEQ ID NO: 210492 - RNA, 22 nt, Human
gccugcuugaaagcacuuucug

SEQ ID NO: 210493 - RNA, 22 nt, Human
cuaguuuuaagcuccuugaggu

SEQ ID NO: 210494 - RNA, 22 nt, Human
gaaaaauggguuguuugaagau

SEQ ID NO: 210495 - RNA, 22 nt, Human
ggccuggccuccugcuuuucca

SEQ ID NO: 210496 - RNA, 22 nt, Human
cacacgagcccuggagccagca

SEQ ID NO: 210497 - RNA, 22 nt, Human
ucagcaguuaagcuucccugcc

SEQ ID NO: 210498 - RNA, 22 nt, Human
uuaggggcuuaggcagaguuug

SEQ ID NO: 210499 - RNA, 22 nt, Human
gcagggcucuggagucaggcug

SEQ ID NO: 210500 - RNA, 22 nt, Human
acaaaaauauuguagaagugcu

SEQ ID NO: 210501 - RNA, 22 nt, Human
gauuuuaaaagauguauaaggu

SEQ ID NO: 210502 - RNA, 22 nt, Human
uggcaggggaaaagggguggga

SEQ ID NO: 210503 - RNA, 22 nt, Human
cagauaagcuauaaguaguacc

SEQ ID NO: 210504 - RNA, 22 nt, Human
ucaaaaauaagauauucuggac

SEQ ID NO: 210505 - RNA, 22 nt, Human
ggcucacuguaccugccgccgc

SEQ ID NO: 210506 - RNA, 18 nt, Human
agguugcaucugugcaga

SEQ ID NO: 210507 - RNA, 22 nt, Human
ggcuagggaucuagaccaggac

SEQ ID NO: 210508 - RNA, 22 nt, Human
cuauauucuggaauguccauuu

SEQ ID NO: 210509 - RNA, 22 nt, Human
aauuauuauguggaagacgacg

SEQ ID NO: 210510 - RNA, 22 nt, Human
auucuuauaaaaaguguugacu

SEQ ID NO: 210511 - RNA, 22 nt, Human
cuggaagcgucggaggaagggc

SEQ ID NO: 210512 - RNA, 22 nt, Human
uguuuucuuuccccuucuuuuc

SEQ ID NO: 210513 - RNA, 21 nt, Human
uccccugugccuggcauacag

SEQ ID NO: 210514 - RNA, 22 nt, Human
uagaggccguagguggcugguu

SEQ ID NO: 210515 - RNA, 22 nt, Human
cucagaauugucaccucaaaaa

SEQ ID NO: 210516 - RNA, 22 nt, Human
gugggagaaugggaggaguaau

SEQ ID NO: 210517 - RNA, 22 nt, Human
agucugugguccucuguaucuc

SEQ ID NO: 210518 - RNA, 22 nt, Human
cauuuuuuuuccccuccuggua

SEQ ID NO: 210519 - RNA, 22 nt, Human
agcuuugcccaaugaguuaugu

SEQ ID NO: 210520 - RNA, 22 nt, Human
gcauaauauugagaaauuauua

SEQ ID NO: 210521 - RNA, 22 nt, Human
uuggcgcuauuauuaccacauu

SEQ ID NO: 210522 - RNA, 22 nt, Human
agucaaaaaaccuagaaacacc

SEQ ID NO: 210523 - RNA, 22 nt, Human
augcacuaugaugagcuagucu

SEQ ID NO: 210524 - RNA, 22 nt, Human
cuuucauuuuugggcaucugag

SEQ ID NO: 210525 - RNA, 22 nt, Human
agcaguuuauccucauaaugga

SEQ ID NO: 210526 - RNA, 22 nt, Human
agcugugccuauucguggcaag

SEQ ID NO: 210527 - RNA, 22 nt, Human
ggcucuggcgagcuuuaguaca

SEQ ID NO: 210528 - RNA, 22 nt, Human
uaaaaucaugacagauugacau

SEQ ID NO: 210529 - RNA, 22 nt, Human
ucaugagcacaggugcagggac

SEQ ID NO: 210530 - RNA, 22 nt, Human
gggccuuggaggagaaggacuu

SEQ ID NO: 210531 - RNA, 22 nt, Human
aucuggaacuucucugcauuga

SEQ ID NO: 210532 - RNA, 19 nt, Human
ggaggguguccucaguguc

SEQ ID NO: 210533 - RNA, 19 nt, Human
uaugacaaguacuaguucu

SEQ ID NO: 210534 - RNA, 22 nt, Human
uuaauauuuauugguaaucacu

SEQ ID NO: 210535 - RNA, 22 nt, Human
agcucugugcaggcagaggcau

SEQ ID NO: 210536 - RNA, 20 nt, Human
gggucuggcaucucucucug

SEQ ID NO: 210537 - RNA, 21 nt, Human
ugucaucucuaaaaagauugu

SEQ ID NO: 210538 - RNA, 22 nt, Human
uuuucacugacuuggucuggaa

SEQ ID NO: 210539 - RNA, 22 nt, Human
aaggaguggugaagucagaugu

SEQ ID NO: 210540 - RNA, 21 nt, Human
acauccaggguccucacugcc

SEQ ID NO: 210541 - RNA, 20 nt, Human
uucacagaggacucagguca

SEQ ID NO: 210542 - RNA, 22 nt, Human
uguauuuuuucccugaaauaaa

SEQ ID NO: 210543 - RNA, 21 nt, Human
aacaaaagggaagaacagcug

SEQ ID NO: 210544 - RNA, 22 nt, Human
cuucccuacuucagugcucccu

SEQ ID NO: 210545 - RNA, 22 nt, Human
uaaacgaagcuucaugcuugaa

SEQ ID NO: 210546 - RNA, 19 nt, Human
uuuuucccccucuccucag

SEQ ID NO: 210547 - RNA, 22 nt, Human
uuaaaucaggcaucauuucagu

SEQ ID NO: 210548 - RNA, 22 nt, Human
ugccgggcugagcaagugcugc

SEQ ID NO: 210549 - RNA, 21 nt, Human
cuauaaaaaugguucuuugcg

SEQ ID NO: 210550 - RNA, 22 nt, Human
aggggcagaggaugauggaaga

SEQ ID NO: 210551 - RNA, 22 nt, Human
uacuuacacugaagcaaagaua

SEQ ID NO: 210552 - RNA, 22 nt, Human
ugaggaacaugggagaaauguc

SEQ ID NO: 210553 - RNA, 22 nt, Human
cucagaugcacacaggugaggg

SEQ ID NO: 210554 - RNA, 22 nt, Human
aagccagccaguuccagcagcu

SEQ ID NO: 210555 - RNA, 22 nt, Human
uaguuuuaagcugacauuguuc

SEQ ID NO: 210556 - RNA, 22 nt, Human
aacccugaacuuaguucuagga

SEQ ID NO: 210557 - RNA, 22 nt, Human
caaggaaaugucagaaaggcaa

SEQ ID NO: 210558 - RNA, 22 nt, Human
ggcgggggagccaggaacccag

SEQ ID NO: 210559 - RNA, 22 nt, Human
ggaauuauuuuaaauagacauu

SEQ ID NO: 210560 - RNA, 22 nt, Human
uauuuucucugccacacuucca

SEQ ID NO: 210561 - RNA, 22 nt, Human
gacagggacacagccagugagg

SEQ ID NO: 210562 - RNA, 22 nt, Human
aggccaggcgccggcgcgagac

SEQ ID NO: 210563 - RNA, 22 nt, Human
uuuuuuuccaguuauucauuuu

SEQ ID NO: 210564 - RNA, 19 nt, Human
acuugcuuucauuuaagau

SEQ ID NO: 210565 - RNA, 22 nt, Human
acauuuguuucucuagaguagg

SEQ ID NO: 210566 - RNA, 22 nt, Human
ggagguggagcuggaaguucca

SEQ ID NO: 210567 - RNA, 22 nt, Human
acuggggcaggaaaguaugcug

SEQ ID NO: 210568 - RNA, 22 nt, Human
aaucaaagccugcaaguugacu

SEQ ID NO: 210569 - RNA, 22 nt, Human
agccauggaggaugugcagcau

SEQ ID NO: 210570 - RNA, 22 nt, Human
cucugagcucgugcaguacuuc

SEQ ID NO: 210571 - RNA, 22 nt, Human
gacugggacucaacccaccauu

SEQ ID NO: 210572 - RNA, 22 nt, Human
ugcaggagaaaguacggagcgu

SEQ ID NO: 210573 - RNA, 22 nt, Human
uggugaggacccagauuuuccu

SEQ ID NO: 210574 - RNA, 22 nt, Human
gaaguucuuagucucauuugca

SEQ ID NO: 210575 - RNA, 22 nt, Human
cacauuaagcccaagcauagaa

SEQ ID NO: 210576 - RNA, 22 nt, Human
ucaccaggauugggcuguaggc

SEQ ID NO: 210577 - RNA, 22 nt, Human
gcucagagaugucugcugccuu

SEQ ID NO: 210578 - RNA, 22 nt, Human
aaggcaggagaguaggaggugg

SEQ ID NO: 210579 - RNA, 22 nt, Human
gcugcgccgggagccggggccg

SEQ ID NO: 210580 - RNA, 21 nt, Human
ugguguacauuuccauaguuu

SEQ ID NO: 210581 - RNA, 22 nt, Human
ugcuugcuaucuaaguguuuca

SEQ ID NO: 210582 - RNA, 22 nt, Human
agcagcaggcugggaugagucu

SEQ ID NO: 210583 - RNA, 22 nt, Human
ggagggagugcaggcaggcaga

SEQ ID NO: 210584 - RNA, 22 nt, Human
gcugggccucuuacuucuuacg

SEQ ID NO: 210585 - RNA, 22 nt, Human
aaucaaauuucuugugguuguu

SEQ ID NO: 210586 - RNA, 21 nt, Human
acaaaaccuaacuuggcugcu

SEQ ID NO: 210587 - RNA, 22 nt, Human
ggaaagagaaacaugaacuaga

SEQ ID NO: 210588 - RNA, 22 nt, Human
aucuucaaagcacaucguuugu

SEQ ID NO: 210589 - RNA, 22 nt, Human
uaacauuuaguuuuaagauggu

SEQ ID NO: 210590 - RNA, 22 nt, Human
gagccuggagcuggaacgaagc

SEQ ID NO: 210591 - RNA, 22 nt, Human
acagugguggagggcuguccug

SEQ ID NO: 210592 - RNA, 22 nt, Human
uaggggugaaggaucuaggaug

SEQ ID NO: 210593 - RNA, 22 nt, Human
aaaaaaacuaauuuuaaaugug

SEQ ID NO: 210594 - RNA, 22 nt, Human
ggagaagaggagcuggaagccu

SEQ ID NO: 210595 - RNA, 22 nt, Human
uuacuuuuuucccccuuagaug

SEQ ID NO: 210596 - RNA, 22 nt, Human
ccauuucacaucccugacaugu

SEQ ID NO: 210597 - RNA, 22 nt, Human
ugugaggggcguucacucucgu

SEQ ID NO: 210598 - RNA, 22 nt, Human
caccucagagcuccuucuucuc

SEQ ID NO: 210599 - RNA, 21 nt, Human
ugucagaaagccugugacuuu

SEQ ID NO: 210600 - RNA, 21 nt, Human
agaguuuucuccauuucaggc

SEQ ID NO: 210601 - RNA, 22 nt, Human
ugcugcacuuauggcucugagg

SEQ ID NO: 210602 - RNA, 22 nt, Human
acaaggaagaaaacauuacuuu

SEQ ID NO: 210603 - RNA, 20 nt, Human
aggggcuguaguuagaugac

SEQ ID NO: 210604 - RNA, 20 nt, Human
uuguacuuaugugagaagga

SEQ ID NO: 210605 - RNA, 20 nt, Human
cugaaaggaaagaaauuuuu

SEQ ID NO: 210606 - RNA, 22 nt, Human
gaaggggacuccauggaaugau

SEQ ID NO: 210607 - RNA, 22 nt, Human
cccagaagaguauguguuugcu

SEQ ID NO: 210608 - RNA, 22 nt, Human
uagcacauaguaggcacaggcu

SEQ ID NO: 210609 - RNA, 20 nt, Human
uggaaggaaagguguaucuu

SEQ ID NO: 210610 - RNA, 22 nt, Human
ugagucaccucucagaagccac

SEQ ID NO: 210611 - RNA, 22 nt, Human
guucuuagcacuucugcccauu

SEQ ID NO: 210612 - RNA, 22 nt, Human
caggagagucucugucuguacu

SEQ ID NO: 210613 - RNA, 22 nt, Human
gccccaggggaggugcccugca

SEQ ID NO: 210614 - RNA, 19 nt, Human
uuuauuugagacaugccuu

SEQ ID NO: 210615 - RNA, 22 nt, Human
uuuaacauaugaaagaauauuu

SEQ ID NO: 210616 - RNA, 22 nt, Human
cucccaauaauaacaagcaggu

SEQ ID NO: 210617 - RNA, 22 nt, Human
cacagucugagcccagccuugu

SEQ ID NO: 210618 - RNA, 22 nt, Human
aaucuuuuugaaggaggagaga

SEQ ID NO: 210619 - RNA, 22 nt, Human
aggguauguuuuuaucuacugu

SEQ ID NO: 210620 - RNA, 20 nt, Human
agcuggcccccgguggccug

SEQ ID NO: 210621 - RNA, 22 nt, Human
ugaguucugacugagcaugggg

SEQ ID NO: 210622 - RNA, 21 nt, Human
uggaagggaagucuugguugu

SEQ ID NO: 210623 - RNA, 22 nt, Human
cugcaucacagcaggaggcaca

SEQ ID NO: 210624 - RNA, 22 nt, Human
uucucuugccuucucuuuuauc

SEQ ID NO: 210625 - RNA, 22 nt, Human
auagagcuggggaagaagcugg

SEQ ID NO: 210626 - RNA, 22 nt, Human
acacacagaaggaagccccacu

SEQ ID NO: 210627 - RNA, 22 nt, Human
guucuuuacuucgcaucugcua

SEQ ID NO: 210628 - RNA, 19 nt, Human
aguauauaucuuuaccuca

SEQ ID NO: 210629 - RNA, 22 nt, Human
cgggagcagcucuggggcuggg

SEQ ID NO: 210630 - RNA, 18 nt, Human
gggcuuuacagaguggag

SEQ ID NO: 210631 - RNA, 22 nt, Human
gaggaggagaagcggcggcgga

SEQ ID NO: 210632 - RNA, 22 nt, Human
cuuggggauuuuaaagaccucu

SEQ ID NO: 210633 - RNA, 22 nt, Human
ccagcaggagacuagcaacaua

SEQ ID NO: 210634 - RNA, 22 nt, Human
gccugagucaagauguggcacc

SEQ ID NO: 210635 - RNA, 22 nt, Human
aggcaguguguagcuggaagag

SEQ ID NO: 210636 - RNA, 22 nt, Human
aggggcagccucacaauccucu

SEQ ID NO: 210637 - RNA, 22 nt, Human
aauguucucuaaucuuucucuu

SEQ ID NO: 210638 - RNA, 22 nt, Human
acuucccacugcagugacugag

SEQ ID NO: 210639 - RNA, 22 nt, Human
uuuguuuccagccuuuugucuu

SEQ ID NO: 210640 - RNA, 22 nt, Human
ggcagguggcacugcugcuccc

SEQ ID NO: 210641 - RNA, 21 nt, Human
ccugagccuguuuauccagaa

SEQ ID NO: 210642 - RNA, 22 nt, Human
ugaaugaguucaccgcucaguu

SEQ ID NO: 210643 - RNA, 22 nt, Human
ucuuuaaggggccuuuguguca

SEQ ID NO: 210644 - RNA, 22 nt, Human
caggcgcugacgggaccgggcu

SEQ ID NO: 210645 - RNA, 22 nt, Human
uugcuuuuugggguuuacuggg

SEQ ID NO: 210646 - RNA, 22 nt, Human
cauaaauuuuaccuuguaagug

SEQ ID NO: 210647 - RNA, 22 nt, Human
aguaggagugacaagcagguca

SEQ ID NO: 210648 - RNA, 22 nt, Human
aguggugccuaagcgcggaggc

SEQ ID NO: 210649 - RNA, 22 nt, Human
agagacaggguuuugucguguu

SEQ ID NO: 210650 - RNA, 22 nt, Human
uagcuggaggggcaggaugcug

SEQ ID NO: 210651 - RNA, 18 nt, Human
auccccagucccuggaau

SEQ ID NO: 210652 - RNA, 22 nt, Human
uuauauuuuauuuaauuaaaua

SEQ ID NO: 210653 - RNA, 22 nt, Human
cucaugcugcaaauggcuguuu

SEQ ID NO: 210654 - RNA, 22 nt, Human
aguauuuaguauucuauauuag

SEQ ID NO: 210655 - RNA, 22 nt, Human
agcggccucgcugccugcucag

SEQ ID NO: 210656 - RNA, 20 nt, Human
ggagagggaaaggcuguacu

SEQ ID NO: 210657 - RNA, 22 nt, Human
uucuuuuaauagagauccugug

SEQ ID NO: 210658 - RNA, 21 nt, Human
uaaaagaugacaagacagcuc

SEQ ID NO: 210659 - RNA, 22 nt, Human
uccauuuacuauucucauaucg

SEQ ID NO: 210660 - RNA, 22 nt, Human
acuugaagcaugaaaauaagcc

SEQ ID NO: 210661 - RNA, 22 nt, Human
ucuuauuucuuucuuuuccugu

SEQ ID NO: 210662 - RNA, 20 nt, Human
aggaaggagaaucugagcaa

SEQ ID NO: 210663 - RNA, 22 nt, Human
augcaguuagguaauagucuca

SEQ ID NO: 210664 - RNA, 22 nt, Human
cccagcaccauaacucaggccu

SEQ ID NO: 210665 - RNA, 22 nt, Human
ggaagauagaaguucaaaaguu

SEQ ID NO: 210666 - RNA, 22 nt, Human
guuuaagcagauugcuguggug

SEQ ID NO: 210667 - RNA, 22 nt, Human
uggcugggagcuggaacugggc

SEQ ID NO: 210668 - RNA, 22 nt, Human
aaucccaguccuccugggggau

SEQ ID NO: 210669 - RNA, 22 nt, Human
aagagcuuguuaugcugcucuu

SEQ ID NO: 210670 - RNA, 22 nt, Human
agcauuagguguguuucagagg

SEQ ID NO: 210671 - RNA, 22 nt, Human
gcccuguuuucuggguuccuug

SEQ ID NO: 210672 - RNA, 22 nt, Human
uggcuucagacuucugcuacgu

SEQ ID NO: 210673 - RNA, 22 nt, Human
gucacgucgggacagacugggg

SEQ ID NO: 210674 - RNA, 22 nt, Human
uggccagucuuagcugugccug

SEQ ID NO: 210675 - RNA, 22 nt, Human
uugucucuacagagaguaguag

SEQ ID NO: 210676 - RNA, 22 nt, Human
aucuccaguuagcaguacugau

SEQ ID NO: 210677 - RNA, 22 nt, Human
guauuugacaccagugaauggu

SEQ ID NO: 210678 - RNA, 18 nt, Human
acuguccucaggacguug

SEQ ID NO: 210679 - RNA, 22 nt, Human
auucuucauguugaagcuguca

SEQ ID NO: 210680 - RNA, 22 nt, Human
acucuuauuuugaaguaauaau

SEQ ID NO: 210681 - RNA, 22 nt, Human
ccucuggacuugggacagugag

SEQ ID NO: 210682 - RNA, 22 nt, Human
uuuaugucaaaaguaaaaugaa

SEQ ID NO: 210683 - RNA, 22 nt, Human
gagggugguggcggccggcacc

SEQ ID NO: 210684 - RNA, 22 nt, Human
uaaagcacucaaaauuguagcu

SEQ ID NO: 210685 - RNA, 22 nt, Human
acugccuugcaccauggcuuuu

SEQ ID NO: 210686 - RNA, 20 nt, Human
gaauucugaagauaauuugg

SEQ ID NO: 210687 - RNA, 22 nt, Human
agucaggggaucuagacuugaa

SEQ ID NO: 210688 - RNA, 22 nt, Human
cuccaucccccugugugucaau

SEQ ID NO: 210689 - RNA, 22 nt, Human
cuuucuuucaaguucugcuuua

SEQ ID NO: 210690 - RNA, 22 nt, Human
acugaaauggggacaguccuua

SEQ ID NO: 210691 - RNA, 21 nt, Human
gggagccucauuuucuucauc

SEQ ID NO: 210692 - RNA, 19 nt, Human
cagagacuguaacacuuuu

SEQ ID NO: 210693 - RNA, 22 nt, Human
cagcccuguugcgcuuccggcg

SEQ ID NO: 210694 - RNA, 22 nt, Human
uugggaaauuugaaaauaaaag

SEQ ID NO: 210695 - RNA, 22 nt, Human
uguuuuuucccccccuucuaaa

SEQ ID NO: 210696 - RNA, 22 nt, Human
gggaggucgaggcugggccgca

SEQ ID NO: 210697 - RNA, 22 nt, Human
ggcuuugggaggaugaggcggu

SEQ ID NO: 210698 - RNA, 23 nt, Human
auuauuucaggguuuugacuugc

SEQ ID NO: 210699 - RNA, 22 nt, Human
cauauuaugcauguuguucuuu

SEQ ID NO: 210700 - RNA, 22 nt, Human
guuuccuuuugugguuuuucua

SEQ ID NO: 210701 - RNA, 22 nt, Human
auauuuguuuggcagaguucag

SEQ ID NO: 210702 - RNA, 22 nt, Human
aauuugcuccaaugucaguucu

SEQ ID NO: 210703 - RNA, 22 nt, Human
gagggaaaggggccaugauugg

SEQ ID NO: 210704 - RNA, 22 nt, Human
guuuaaaagcaaccaacaggcu

SEQ ID NO: 210705 - RNA, 22 nt, Human
acugcacuccagcccgagcaac

SEQ ID NO: 210706 - RNA, 22 nt, Human
ccagugcaguacaaaccuuagu

SEQ ID NO: 210707 - RNA, 22 nt, Human
uucauaugaauuggguuuuuuu

SEQ ID NO: 210708 - RNA, 22 nt, Human
ggagacagauggcgucucaguu

SEQ ID NO: 210709 - RNA, 22 nt, Human
aaucugugugugagaaauggca

SEQ ID NO: 210710 - RNA, 19 nt, Human
aggugaugugacucuagaa

SEQ ID NO: 210711 - RNA, 20 nt, Human
gacaagccacagcucccaga

SEQ ID NO: 210712 - RNA, 22 nt, Human
cugcacagucauuuccucucaa

SEQ ID NO: 210713 - RNA, 22 nt, Human
cgaaggaaucacuuaacacuuu

SEQ ID NO: 210714 - RNA, 22 nt, Human
agaggcaggcagcagagaagau

SEQ ID NO: 210715 - RNA, 22 nt, Human
aggaaagacgcauuucuguagg

SEQ ID NO: 210716 - RNA, 23 nt, Human
uucagcucuccugaagcaucugu

SEQ ID NO: 210717 - RNA, 22 nt, Human
guccccugcguguucauccugg

SEQ ID NO: 210718 - RNA, 22 nt, Human
uauucauuuuuauuugugacug

SEQ ID NO: 210719 - RNA, 22 nt, Human
uuuuuauaagauuuaaaaugua

SEQ ID NO: 210720 - RNA, 22 nt, Human
agagagggaugguguccagaga

SEQ ID NO: 210721 - RNA, 22 nt, Human
cauggcggcgcucucccugccu

SEQ ID NO: 210722 - RNA, 22 nt, Human
gaagcaccuggacggugccugg

SEQ ID NO: 210723 - RNA, 22 nt, Human
uugauagauuuuagaggcaggc

SEQ ID NO: 210724 - RNA, 22 nt, Human
cugauguuuaucucaagaguuc

SEQ ID NO: 210725 - RNA, 22 nt, Human
cugcguugaccagacuccuggg

SEQ ID NO: 210726 - RNA, 22 nt, Human
aggcaguggcuuuuguuguguu

SEQ ID NO: 210727 - RNA, 22 nt, Human
ccugggugaugugcugcccucg

SEQ ID NO: 210728 - RNA, 22 nt, Human
augugccuuaauauaggcgcug

SEQ ID NO: 210729 - RNA, 22 nt, Human
ggagccaguuuagaccucaguu

SEQ ID NO: 210730 - RNA, 22 nt, Human
gccugcagccagggaguucucu

SEQ ID NO: 210731 - RNA, 22 nt, Human
agauggaguccugaagccagaa

SEQ ID NO: 210732 - RNA, 22 nt, Human
gcagccugaguuuagcucgucg

SEQ ID NO: 210733 - RNA, 22 nt, Human
uuuugaauaauucagaaacagc

SEQ ID NO: 210734 - RNA, 22 nt, Human
uuauaucagaaggugagauuga

SEQ ID NO: 210735 - RNA, 22 nt, Human
ucuuuuaucuguuguguaacaa

SEQ ID NO: 210736 - RNA, 22 nt, Human
cauuuuaucagcacacgucacu

SEQ ID NO: 210737 - RNA, 22 nt, Human
uuuaccuuauguaaauaagagu

SEQ ID NO: 210738 - RNA, 22 nt, Human
cuuuucaaacaggacagguccu

SEQ ID NO: 210739 - RNA, 22 nt, Human
ugaggaagugguuguaugguuu

SEQ ID NO: 210740 - RNA, 18 nt, Human
uuauacaauuuuuuuuca

SEQ ID NO: 210741 - RNA, 22 nt, Human
ugacauuugagagagauauaca

SEQ ID NO: 210742 - RNA, 22 nt, Human
aguuauuuuucacuauuaggcu

SEQ ID NO: 210743 - RNA, 22 nt, Human
ggcugggaggcggaggcugaga

SEQ ID NO: 210744 - RNA, 22 nt, Human
ugauaugguaauaagauauucu

SEQ ID NO: 210745 - RNA, 22 nt, Human
auuugccaguuacucacaccac

SEQ ID NO: 210746 - RNA, 20 nt, Human
uagcacuguauccucuucau

SEQ ID NO: 210747 - RNA, 23 nt, Human
aggcaagaacggguuguucaccc

SEQ ID NO: 210748 - RNA, 22 nt, Human
uuauuugcccauguuuagcaga

SEQ ID NO: 210749 - RNA, 22 nt, Human
uggguauauauguugcuacaga

SEQ ID NO: 210750 - RNA, 22 nt, Human
uccuggcuguuagagaggcaag

SEQ ID NO: 210751 - RNA, 22 nt, Human
uuagcagacagauggagagaga

SEQ ID NO: 210752 - RNA, 22 nt, Human
aaagcaaauaguugcuuaauau

SEQ ID NO: 210753 - RNA, 22 nt, Human
agcacagugccugacauauaug

SEQ ID NO: 210754 - RNA, 22 nt, Human
aaggcuuugugcugaguugucg

SEQ ID NO: 210755 - RNA, 19 nt, Human
gaauggguucuguagggag

SEQ ID NO: 210756 - RNA, 22 nt, Human
cacauuuuccagaagaaucaga

SEQ ID NO: 210757 - RNA, 22 nt, Human
uauuucuagggcaugaaaauaa

SEQ ID NO: 210758 - RNA, 20 nt, Human
aaaaauguguuuauggagau

SEQ ID NO: 210759 - RNA, 22 nt, Human
gaggaaaauggaguguaauuaa

SEQ ID NO: 210760 - RNA, 22 nt, Human
uguacauacauagauauacaca

SEQ ID NO: 210761 - RNA, 21 nt, Human
auucaaagaagaggaaggccc

SEQ ID NO: 210762 - RNA, 22 nt, Human
uccacaaagucuaugagaguug

SEQ ID NO: 210763 - RNA, 22 nt, Human
uuuaaauaguugguuuuuuugc

SEQ ID NO: 210764 - RNA, 22 nt, Human
auuucagaaugaaaggaaaaau

SEQ ID NO: 210765 - RNA, 22 nt, Human
agcauugguggcauuugcagcu

SEQ ID NO: 210766 - RNA, 22 nt, Human
auaaucuuugaguagaguugag

SEQ ID NO: 210767 - RNA, 22 nt, Human
ggagagcuagugagcuggaggu

SEQ ID NO: 210768 - RNA, 22 nt, Human
cugauggagagugugauuuggg

SEQ ID NO: 210769 - RNA, 22 nt, Human
aguuaaagggggcuacagugug

SEQ ID NO: 210770 - RNA, 22 nt, Human
agauaagaacauuaguaagccg

SEQ ID NO: 210771 - RNA, 22 nt, Human
uagggaggguuugggguggagg

SEQ ID NO: 210772 - RNA, 23 nt, Human
caggggacaggugaccugggcuc

SEQ ID NO: 210773 - RNA, 21 nt, Human
gcagcucaggauauagacuug

SEQ ID NO: 210774 - RNA, 22 nt, Human
ucuguuuugugcuuuguuuucu

SEQ ID NO: 210775 - RNA, 22 nt, Human
gggaaaaaggaguuagagauaa

SEQ ID NO: 210776 - RNA, 22 nt, Human
cugggugagcuggccagagggu

SEQ ID NO: 210777 - RNA, 22 nt, Human
gguggcagaggaggcgggagag

SEQ ID NO: 210778 - RNA, 18 nt, Human
acucugaagcuaagucac

SEQ ID NO: 210779 - RNA, 22 nt, Human
uauaagaaaagucauuaucaaa

SEQ ID NO: 210780 - RNA, 22 nt, Human
uacauuugauuuuugcuucuuu

SEQ ID NO: 210781 - RNA, 22 nt, Human
ggcucccccauggcugacagac

SEQ ID NO: 210782 - RNA, 22 nt, Human
uuucacauacaguguauaguag

SEQ ID NO: 210783 - RNA, 22 nt, Human
ugcuguugacuuuguuguucuu

SEQ ID NO: 210784 - RNA, 20 nt, Human
ugcugugugucuacuguggg

SEQ ID NO: 210785 - RNA, 22 nt, Human
cagcagccuccccggccgaccu

SEQ ID NO: 210786 - RNA, 22 nt, Human
gaaauguacuuauagggagguu

SEQ ID NO: 210787 - RNA, 22 nt, Human
uucuccacguucuucucggccu

SEQ ID NO: 210788 - RNA, 22 nt, Human
cuggaaauggcagaguugcauu

SEQ ID NO: 210789 - RNA, 22 nt, Human
uucuuuuaauuucugucugcag

SEQ ID NO: 210790 - RNA, 22 nt, Human
cuccuugguuccggcguuggag

SEQ ID NO: 210791 - RNA, 22 nt, Human
cuguguguauaauguuugauaa

SEQ ID NO: 210792 - RNA, 22 nt, Human
ucaucuuucuuuauggaaauac

SEQ ID NO: 210793 - RNA, 22 nt, Human
ugcagugcagcuggaaguuggc

SEQ ID NO: 210794 - RNA, 22 nt, Human
ggggaggaagcuggaacacggg

SEQ ID NO: 210795 - RNA, 22 nt, Human
guugagaaucucuagcuuagga

SEQ ID NO: 210796 - RNA, 17 nt, Human
ucuguguccgcucaguc

SEQ ID NO: 210797 - RNA, 22 nt, Human
aggcugggaaguguguccugag

SEQ ID NO: 210798 - RNA, 22 nt, Human
acucacuguuuugaaauugaac

SEQ ID NO: 210799 - RNA, 22 nt, Human
agccauggagauguggguuggg

SEQ ID NO: 210800 - RNA, 22 nt, Human
guuuccaggcuuugguaugguu

SEQ ID NO: 210801 - RNA, 22 nt, Human
guuuggguggcuagagaaagaa

SEQ ID NO: 210802 - RNA, 22 nt, Human
ucugggccacccgccuccaggg

SEQ ID NO: 210803 - RNA, 22 nt, Human
uuuacuguuuacagcuaaugca

SEQ ID NO: 210804 - RNA, 22 nt, Human
uggccccauuuuucuggagccu

SEQ ID NO: 210805 - RNA, 22 nt, Human
uggggcauacgugaaauaauuu

SEQ ID NO: 210806 - RNA, 22 nt, Human
agcugcuaagcugcauaacuua

SEQ ID NO: 210807 - RNA, 22 nt, Human
ccuuucucuuggauaccgauug

SEQ ID NO: 210808 - RNA, 22 nt, Human
ugaaguuuagaaaaagugccuu

SEQ ID NO: 210809 - RNA, 22 nt, Human
ccaggaguccgugggucuugag

SEQ ID NO: 210810 - RNA, 22 nt, Human
ucagccuugguuuugguguugg

SEQ ID NO: 210811 - RNA, 22 nt, Human
cucacugucagcugcagggcuu

SEQ ID NO: 210812 - RNA, 22 nt, Human
uggucucaaagcaaggaaggaa

SEQ ID NO: 210813 - RNA, 22 nt, Human
uccauguauugcuaacaaauag

SEQ ID NO: 210814 - RNA, 22 nt, Human
acuucauuugaaaugguugaau

SEQ ID NO: 210815 - RNA, 22 nt, Human
ccauagucacuuguccucuuuu

SEQ ID NO: 210816 - RNA, 22 nt, Human
ggggaaauauuucugaccugug

SEQ ID NO: 210817 - RNA, 22 nt, Human
agagcagcaaucuuugaaauua

SEQ ID NO: 210818 - RNA, 22 nt, Human
uuguaaguuuuagguguuucaa

SEQ ID NO: 210819 - RNA, 22 nt, Human
uucuucgacuguauaaaaguau

SEQ ID NO: 210820 - RNA, 19 nt, Human
agcgccucuacugcaugga

SEQ ID NO: 210821 - RNA, 22 nt, Human
uguguguguguguguguuugug

SEQ ID NO: 210822 - RNA, 22 nt, Human
acucauuuggauuuuggaguuu

SEQ ID NO: 210823 - RNA, 22 nt, Human
ggcagagguagcuggaaccagg

SEQ ID NO: 210824 - RNA, 22 nt, Human
auuugcuuguucaccaguacuu

SEQ ID NO: 210825 - RNA, 23 nt, Human
gugagaccagagccuauucucag

SEQ ID NO: 210826 - RNA, 22 nt, Human
uauauguagcucaaaaauuccc

SEQ ID NO: 210827 - RNA, 22 nt, Human
gcauugcuauuucuguuagugu

SEQ ID NO: 210828 - RNA, 22 nt, Human
ggggacggcuggccggggcccc

SEQ ID NO: 210829 - RNA, 21 nt, Human
uaagcuaaacauucaguuaac

SEQ ID NO: 210830 - RNA, 22 nt, Human
ucagguagugguuaaguucugu

SEQ ID NO: 210831 - RNA, 22 nt, Human
guuuugauggaguguguuaaau

SEQ ID NO: 210832 - RNA, 22 nt, Human
uucacccuucucuggcuuucag

SEQ ID NO: 210833 - RNA, 22 nt, Human
ucuuuccagaccagccccagcu

SEQ ID NO: 210834 - RNA, 22 nt, Human
uaugcauaauuggauaaguaga

SEQ ID NO: 210835 - RNA, 22 nt, Human
uggguguguccauauuuugacu

SEQ ID NO: 210836 - RNA, 22 nt, Human
uugaagaagucaaaagcugcag

SEQ ID NO: 210837 - RNA, 22 nt, Human
aauguguauguguauauauaug

SEQ ID NO: 210838 - RNA, 23 nt, Human
auuuccuaaaagauaaucauuac

SEQ ID NO: 210839 - RNA, 22 nt, Human
gggagggggauucuggcgagaa

SEQ ID NO: 210840 - RNA, 22 nt, Human
uaugugaaauggaauauagaaa

SEQ ID NO: 210841 - RNA, 22 nt, Human
cacaacaaaaaauaaguaugag

SEQ ID NO: 210842 - RNA, 22 nt, Human
guacauauggcacaugcuauuu

SEQ ID NO: 210843 - RNA, 22 nt, Human
uucaaaaugcagaauaguuugg

SEQ ID NO: 210844 - RNA, 22 nt, Human
uccagguaggagaccaggcugu

SEQ ID NO: 210845 - RNA, 22 nt, Human
aaugaauaaauuuuaaagacag

SEQ ID NO: 210846 - RNA, 22 nt, Human
aggaugagugaagagguaaauu

SEQ ID NO: 210847 - RNA, 20 nt, Human
uuuagcacauuguacaaaac

SEQ ID NO: 210848 - RNA, 22 nt, Human
uuuccccugggaacauugauuc

SEQ ID NO: 210849 - RNA, 22 nt, Human
ugucucuuccuccucuugguac

SEQ ID NO: 210850 - RNA, 22 nt, Human
cuuuggggcugaggaggagguu

SEQ ID NO: 210851 - RNA, 22 nt, Human
cuagagaaaaagcuuagguacg

SEQ ID NO: 210852 - RNA, 18 nt, Human
ccuccccuguggaggucc

SEQ ID NO: 210853 - RNA, 22 nt, Human
aggaaauaggaccagacaaagc

SEQ ID NO: 210854 - RNA, 19 nt, Human
uccuacaugagacagagag

SEQ ID NO: 210855 - RNA, 22 nt, Human
caucaauagguauuugagagac

SEQ ID NO: 210856 - RNA, 19 nt, Human
auuuugguucuuuccauuc

SEQ ID NO: 210857 - RNA, 22 nt, Human
agcuuucuauauaugaguugcu

SEQ ID NO: 210858 - RNA, 22 nt, Human
uggugccuuccgagagcuguga

SEQ ID NO: 210859 - RNA, 22 nt, Human
aagcucugggacugaggcuccu

SEQ ID NO: 210860 - RNA, 20 nt, Human
acauccacugagugggauga

SEQ ID NO: 210861 - RNA, 22 nt, Human
aauagcuuuuuguuugguguau

SEQ ID NO: 210862 - RNA, 22 nt, Human
ugugagucuugcaggucgcuca

SEQ ID NO: 210863 - RNA, 22 nt, Human
uccaaggacuaaauucuagauu

SEQ ID NO: 210864 - RNA, 22 nt, Human
gggaagaagaaaagagguggga

SEQ ID NO: 210865 - RNA, 22 nt, Human
ucuuccauuccccuccuacgcc

SEQ ID NO: 210866 - RNA, 22 nt, Human
aucuugaaacauauaugcauuu

SEQ ID NO: 210867 - RNA, 22 nt, Human
uuuccuaggaaaugauugaagu

SEQ ID NO: 210868 - RNA, 22 nt, Human
gcuguuggaggaguucagugcu

SEQ ID NO: 210869 - RNA, 17 nt, Human
guucucaaacugacuga

SEQ ID NO: 210870 - RNA, 22 nt, Human
uggaggaggagaacuuggcacu

SEQ ID NO: 210871 - RNA, 22 nt, Human
auaaaucaagggcaguauuucc

SEQ ID NO: 210872 - RNA, 22 nt, Human
uggucuuuccuucauuguccag

SEQ ID NO: 210873 - RNA, 22 nt, Human
uucugagguagccacucacugg

SEQ ID NO: 210874 - RNA, 22 nt, Human
gacuugaagcucucugguuuug

SEQ ID NO: 210875 - RNA, 22 nt, Human
agauucucccuccuggcgcugu

SEQ ID NO: 210876 - RNA, 22 nt, Human
agggaugugcagggcuugccau

SEQ ID NO: 210877 - RNA, 19 nt, Human
ugugaagaccucagugcgg

SEQ ID NO: 210878 - RNA, 22 nt, Human
cuguacuuguuuuaggaugaug

SEQ ID NO: 210879 - RNA, 22 nt, Human
ugagaauuuaacuugauuagga

SEQ ID NO: 210880 - RNA, 22 nt, Human
ggcaggaaguaaggaugcuaca

SEQ ID NO: 210881 - RNA, 22 nt, Human
gagguucacgcagggaggggac

SEQ ID NO: 210882 - RNA, 22 nt, Human
gggagguaaugggggugcaggg

SEQ ID NO: 210883 - RNA, 17 nt, Human
ugaggcugucucccugg

SEQ ID NO: 210884 - RNA, 22 nt, Human
uaggauugguguauguagguuu

SEQ ID NO: 210885 - RNA, 22 nt, Human
ucagcucacaauguugagaaag

SEQ ID NO: 210886 - RNA, 22 nt, Human
gagaggacaggauccggagggc

SEQ ID NO: 210887 - RNA, 22 nt, Human
cauuccuucucagguacuggca

SEQ ID NO: 210888 - RNA, 22 nt, Human
auuuuagagaaacaaacguagg

SEQ ID NO: 210889 - RNA, 22 nt, Human
uacugcaguuccugcugucucc

SEQ ID NO: 210890 - RNA, 22 nt, Human
guuuauucuuuuauuugugaga

SEQ ID NO: 210891 - RNA, 22 nt, Human
cagccccucuucucuccucgga

SEQ ID NO: 210892 - RNA, 22 nt, Human
gaguuaaauagcuuaggauuca

SEQ ID NO: 210893 - RNA, 22 nt, Human
caaaagcaaagaucuuugauug

SEQ ID NO: 210894 - RNA, 22 nt, Human
cuccuggagcagcaggcgcagg

SEQ ID NO: 210895 - RNA, 22 nt, Human
uggguuugcuuguucagguucu

SEQ ID NO: 210896 - RNA, 22 nt, Human
uucaucuucaaaccccagugcc

SEQ ID NO: 210897 - RNA, 19 nt, Human
gaguaaaacuagagagaaa

SEQ ID NO: 210898 - RNA, 22 nt, Human
ggacagagcaacccuacgcagc

SEQ ID NO: 210899 - RNA, 22 nt, Human
cgcuuugacuuuagaaggccaa

SEQ ID NO: 210900 - RNA, 22 nt, Human
agccagugcagcuggaaauuca

SEQ ID NO: 210901 - RNA, 22 nt, Human
aaaaaauugcuggcagagcugu

SEQ ID NO: 210902 - RNA, 22 nt, Human
ugcuagggcaggaggugaggag

SEQ ID NO: 210903 - RNA, 22 nt, Human
uuuuccuuagaaauacauugau

SEQ ID NO: 210904 - RNA, 22 nt, Human
uacuuaaaacacauuuagcauu

SEQ ID NO: 210905 - RNA, 22 nt, Human
aaguuccuaaagucagggguca

SEQ ID NO: 210906 - RNA, 22 nt, Human
agcaacauggaguuugugcgca

SEQ ID NO: 210907 - RNA, 22 nt, Human
uggaugacaaccauuggaagag

SEQ ID NO: 210908 - RNA, 22 nt, Human
agacgggacagacuuuugagug

SEQ ID NO: 210909 - RNA, 22 nt, Human
aaauguuucauucuauuuuuag

SEQ ID NO: 210910 - RNA, 22 nt, Human
auucccucaagagacccacagc

SEQ ID NO: 210911 - RNA, 21 nt, Human
uugauuuagcagaucuagcug

SEQ ID NO: 210912 - RNA, 22 nt, Human
agggcgugguggugcuggagca

SEQ ID NO: 210913 - RNA, 20 nt, Human
cagagacaagagggaaggga

SEQ ID NO: 210914 - RNA, 22 nt, Human
ccuccacgaggggucuucucuu

SEQ ID NO: 210915 - RNA, 22 nt, Human
cagaguccugcaccagcuccag

SEQ ID NO: 210916 - RNA, 22 nt, Human
uuauuuuuaggaauguagaggu

SEQ ID NO: 210917 - RNA, 22 nt, Human
aagacagugacagucacaauug

SEQ ID NO: 210918 - RNA, 22 nt, Human
ggaucccaucgagcuggcuguc

SEQ ID NO: 210919 - RNA, 22 nt, Human
ccuuggaucugcauaucagcua

SEQ ID NO: 210920 - RNA, 21 nt, Human
uccauucuuggugguucugca

SEQ ID NO: 210921 - RNA, 22 nt, Human
aggcaacagacaggcuugguuc

SEQ ID NO: 210922 - RNA, 22 nt, Human
aggaggcucucagguccucccc

SEQ ID NO: 210923 - RNA, 22 nt, Human
acauuuuaaaaacaguaccugg

SEQ ID NO: 210924 - RNA, 22 nt, Human
agggcucuuucauuguuaagaa

SEQ ID NO: 210925 - RNA, 22 nt, Human
caucuccaagucuguaagcagu

SEQ ID NO: 210926 - RNA, 22 nt, Human
ccagccuucugaugggacccuc

SEQ ID NO: 210927 - RNA, 22 nt, Human
uauuuguauugucuuaucacuu

SEQ ID NO: 210928 - RNA, 22 nt, Human
acaguuuucugagaaucacagg

SEQ ID NO: 210929 - RNA, 22 nt, Human
cauuuucugcaagucugcucaa

SEQ ID NO: 210930 - RNA, 22 nt, Human
aaaaaggagaaagagagggaga

SEQ ID NO: 210931 - RNA, 22 nt, Human
ugccucucuggaucugcuguga

SEQ ID NO: 210932 - RNA, 22 nt, Human
uggcucaguaaucgagucuccu

SEQ ID NO: 210933 - RNA, 22 nt, Human
acaugcuuucuagguccuucug

SEQ ID NO: 210934 - RNA, 22 nt, Human
gaaagggggcuuggacacuggc

SEQ ID NO: 210935 - RNA, 22 nt, Human
gaggaaagcugguuuaaaguau

SEQ ID NO: 210936 - RNA, 22 nt, Human
ggagcagaggaaagaguagcau

SEQ ID NO: 210937 - RNA, 22 nt, Human
acuuuaaauaucauuugguagg

SEQ ID NO: 210938 - RNA, 22 nt, Human
gugccugcucauucucaauauu

SEQ ID NO: 210939 - RNA, 22 nt, Human
aaugaaaaucugucaguucaag

SEQ ID NO: 210940 - RNA, 22 nt, Human
uacaacuuacuugaauggcuuu

SEQ ID NO: 210941 - RNA, 22 nt, Human
aggcaagauuaggaccagaaga

SEQ ID NO: 210942 - RNA, 23 nt, Human
uaaauuuuauucugauaacacag

SEQ ID NO: 210943 - RNA, 17 nt, Human
auucaugaacauguccu

SEQ ID NO: 210944 - RNA, 22 nt, Human
gcccuguguguuugcacugauu

SEQ ID NO: 210945 - RNA, 22 nt, Human
uuucuuugggcccuggcagucu

SEQ ID NO: 210946 - RNA, 22 nt, Human
ucccagaaccuuuuagcuucac

SEQ ID NO: 210947 - RNA, 22 nt, Human
auaaaguaaugcauauaaugug

SEQ ID NO: 210948 - RNA, 22 nt, Human
ugcuuuaccuuccauuuaagga

SEQ ID NO: 210949 - RNA, 22 nt, Human
uaugucuauugacuuaggauuu

SEQ ID NO: 210950 - RNA, 22 nt, Human
gcuguggguuccuccccugucc

SEQ ID NO: 210951 - RNA, 22 nt, Human
uauguauguauguauguauaug

SEQ ID NO: 210952 - RNA, 22 nt, Human
aaugcugugggauagggcuccu

SEQ ID NO: 210953 - RNA, 22 nt, Human
caaguauuuauugaggcccugu

SEQ ID NO: 210954 - RNA, 22 nt, Human
gggggaggcucggcgccgcggu

SEQ ID NO: 210955 - RNA, 22 nt, Human
uaaauuugugaauuagcuauca

SEQ ID NO: 210956 - RNA, 22 nt, Human
cccaggccguguaaucagcagc

SEQ ID NO: 210957 - RNA, 22 nt, Human
auuuuuuuggucauaugagaua

SEQ ID NO: 210958 - RNA, 19 nt, Human
agcaucuccacagaaaaag

SEQ ID NO: 210959 - RNA, 22 nt, Human
cuuucucucaaacacacauaca

SEQ ID NO: 210960 - RNA, 21 nt, Human
caguucuaagugucaucuuuu

SEQ ID NO: 210961 - RNA, 22 nt, Human
uaguuucuucaacugucccagc

SEQ ID NO: 210962 - RNA, 22 nt, Human
aggcguggcuucugcuggguug

SEQ ID NO: 210963 - RNA, 22 nt, Human
gcccauggagaccucaggcugg

SEQ ID NO: 210964 - RNA, 22 nt, Human
aguaauaaacaacucauuuugg

SEQ ID NO: 210965 - RNA, 22 nt, Human
uuuucucuuugcuucucuaaaa

SEQ ID NO: 210966 - RNA, 22 nt, Human
augcauaugugugcaagugugu

SEQ ID NO: 210967 - RNA, 22 nt, Human
ucuguuuuuaucuauucuguua

SEQ ID NO: 210968 - RNA, 22 nt, Human
caggcagggagcuggaaaggau

SEQ ID NO: 210969 - RNA, 22 nt, Human
ucaagggaccaagcauucauua

SEQ ID NO: 210970 - RNA, 20 nt, Human
uucguuucaguguuggauca

SEQ ID NO: 210971 - RNA, 22 nt, Human
cuaaaccaauauauuuucuucc

SEQ ID NO: 210972 - RNA, 22 nt, Human
caguuuuauacacugcagcucc

SEQ ID NO: 210973 - RNA, 22 nt, Human
uucaugucuuugauucugauaa

SEQ ID NO: 210974 - RNA, 22 nt, Human
ugguugggguaacaaaaaggaa

SEQ ID NO: 210975 - RNA, 22 nt, Human
acagcauagaggaaauguggaa

SEQ ID NO: 210976 - RNA, 22 nt, Human
gaaagagaugucguuugucuuc

SEQ ID NO: 210977 - RNA, 20 nt, Human
agucuuaucugcauuuagaa

SEQ ID NO: 210978 - RNA, 22 nt, Human
auuugcauguuuauuucuuaga

SEQ ID NO: 210979 - RNA, 22 nt, Human
ugaagaauuccauggcuuccau

SEQ ID NO: 210980 - RNA, 22 nt, Human
aaaucaaaagugguuauuuuau

SEQ ID NO: 210981 - RNA, 21 nt, Human
uuccuggaggcagaaacguga

SEQ ID NO: 210982 - RNA, 22 nt, Human
guucuucagauuccauuucagu

SEQ ID NO: 210983 - RNA, 22 nt, Human
aggguguuugggagcagaggau

SEQ ID NO: 210984 - RNA, 22 nt, Human
cugcugucuuuauuucacugcu

SEQ ID NO: 210985 - RNA, 19 nt, Human
aagaacaguucuaauuuca

SEQ ID NO: 210986 - RNA, 22 nt, Human
caccacauguccgaaauucagc

SEQ ID NO: 210987 - RNA, 22 nt, Human
cacagaauuaagggagaaauau

SEQ ID NO: 210988 - RNA, 22 nt, Human
uggcccugaaucaaggccagca

SEQ ID NO: 210989 - RNA, 22 nt, Human
caaacauuuguuggaaccccug

SEQ ID NO: 210990 - RNA, 22 nt, Human
uauauuaaagugcuuugcagug

SEQ ID NO: 210991 - RNA, 22 nt, Human
gucugaaauaucuuuugucuug

SEQ ID NO: 210992 - RNA, 21 nt, Human
acuccagccacugacugucuc

SEQ ID NO: 210993 - RNA, 19 nt, Human
uguguguguuuuguuugaa

SEQ ID NO: 210994 - RNA, 22 nt, Human
gaguggccugccccagccaggc

SEQ ID NO: 210995 - RNA, 22 nt, Human
gccuccagaggggacaaaaauu

SEQ ID NO: 210996 - RNA, 22 nt, Human
guggaagauauuucugguccag

SEQ ID NO: 210997 - RNA, 22 nt, Human
uccuggccuuggggagagaagu

SEQ ID NO: 210998 - RNA, 22 nt, Human
ugacaagagaccccuccgcagg

SEQ ID NO: 210999 - RNA, 22 nt, Human
acgugugugugcacguguguau

SEQ ID NO: 211000 - RNA, 22 nt, Human
agaaaagaggcuuucuaagcau

SEQ ID NO: 211001 - RNA, 22 nt, Human
ccaggcucaccuggagccccug

SEQ ID NO: 211002 - RNA, 22 nt, Human
cugcagagaccuaggucagguu

SEQ ID NO: 211003 - RNA, 22 nt, Human
acugcagauccucugagaaacc

SEQ ID NO: 211004 - RNA, 22 nt, Human
auugaaauuugcuuccucacug

SEQ ID NO: 211005 - RNA, 22 nt, Human
acucaugugacuaaaacauuaa

SEQ ID NO: 211006 - RNA, 22 nt, Human
auuuuucacauuuugggggaca

SEQ ID NO: 211007 - RNA, 22 nt, Human
gagaggaagugccugcucccag

SEQ ID NO: 211008 - RNA, 22 nt, Human
gguuuauucccacaaaggaagu

SEQ ID NO: 211009 - RNA, 20 nt, Human
auucuuguuccauuucccag

SEQ ID NO: 211010 - RNA, 22 nt, Human
guugggauugaaggugccucua

SEQ ID NO: 211011 - RNA, 22 nt, Human
uuugcauuaguuuagauuucaa

SEQ ID NO: 211012 - RNA, 22 nt, Human
uauguggcaggugggagaucag

SEQ ID NO: 211013 - RNA, 22 nt, Human
guuuggguugcucauucuacau

SEQ ID NO: 211014 - RNA, 22 nt, Human
aauuauguugaaauaugagaac

SEQ ID NO: 211015 - RNA, 22 nt, Human
agaugaugugugucuucagcua

SEQ ID NO: 211016 - RNA, 22 nt, Human
uugcacuccagcccgagcaaca

SEQ ID NO: 211017 - RNA, 22 nt, Human
uggaggcccagcugggggccgg

SEQ ID NO: 211018 - RNA, 22 nt, Human
gaagccaacacgugggagggag

SEQ ID NO: 211019 - RNA, 22 nt, Human
ggaagguauuucuccuugagug

SEQ ID NO: 211020 - RNA, 22 nt, Human
uuuugcuagaaaucaccaauac

SEQ ID NO: 211021 - RNA, 22 nt, Human
ugcccacaggaagacaccagcg

SEQ ID NO: 211022 - RNA, 22 nt, Human
gcugguggcagagcuccgcggc

SEQ ID NO: 211023 - RNA, 22 nt, Human
gcuugaggaacucagacuugag

SEQ ID NO: 211024 - RNA, 22 nt, Human
caguacugucuuccugauggca

SEQ ID NO: 211025 - RNA, 22 nt, Human
uuagggacagcucuguagguga

SEQ ID NO: 211026 - RNA, 22 nt, Human
cuccacagccccuccaguggca

SEQ ID NO: 211027 - RNA, 22 nt, Human
gggcagaaaggaaggcuggggg

SEQ ID NO: 211028 - RNA, 22 nt, Human
agcaaaauuccaaaaugcuaau

SEQ ID NO: 211029 - RNA, 22 nt, Human
aggguggcacucugggggcucc

SEQ ID NO: 211030 - RNA, 22 nt, Human
agcugcugcaaguggugcuaac

SEQ ID NO: 211031 - RNA, 22 nt, Human
uaaccaggaaaaagauaugcau

SEQ ID NO: 211032 - RNA, 22 nt, Human
aggaagccuggaguccugccca

SEQ ID NO: 211033 - RNA, 22 nt, Human
gaggaggagacggaggccuggg

SEQ ID NO: 211034 - RNA, 21 nt, Human
aaacaugcagccugccaauuc

SEQ ID NO: 211035 - RNA, 22 nt, Human
uggggcuggccaggaggagucu

SEQ ID NO: 211036 - RNA, 22 nt, Human
aguauggaauuuuuaaugacag

SEQ ID NO: 211037 - RNA, 22 nt, Human
ugcagaggagcuggaaggcugg

SEQ ID NO: 211038 - RNA, 22 nt, Human
cuuacaauuuucuuggacuuuu

SEQ ID NO: 211039 - RNA, 22 nt, Human
uacuugaacaucacuaagagaa

SEQ ID NO: 211040 - RNA, 22 nt, Human
agaguguggaaauguucagagu

SEQ ID NO: 211041 - RNA, 22 nt, Human
ugcaugguuauauacuacuagu

SEQ ID NO: 211042 - RNA, 22 nt, Human
guucuucagcccucagguccua

SEQ ID NO: 211043 - RNA, 22 nt, Human
aucauuuuuauuagcugggguu

SEQ ID NO: 211044 - RNA, 22 nt, Human
cugaagcugggcacuuccuuuu

SEQ ID NO: 211045 - RNA, 22 nt, Human
aguggagguuacagcuguacau

SEQ ID NO: 211046 - RNA, 22 nt, Human
acucugcaguaaggaauuguuu

SEQ ID NO: 211047 - RNA, 22 nt, Human
aggaagucucucaaaacuggaa

SEQ ID NO: 211048 - RNA, 22 nt, Human
aguaacagguguacagacuauc

SEQ ID NO: 211049 - RNA, 22 nt, Human
gauuaaaggucuugauuauaag

SEQ ID NO: 211050 - RNA, 22 nt, Human
aaaucuuccugaaauuuguuca

SEQ ID NO: 211051 - RNA, 22 nt, Human
uagugggauuuugaacaaaacc

SEQ ID NO: 211052 - RNA, 22 nt, Human
aucccacaccccuacaacauau

SEQ ID NO: 211053 - RNA, 20 nt, Human
acugcaagagacagaugaaa

SEQ ID NO: 211054 - RNA, 22 nt, Human
aagcucuuuccacuaaaccacu

SEQ ID NO: 211055 - RNA, 22 nt, Human
guugagaagaccauuuuguuca

SEQ ID NO: 211056 - RNA, 22 nt, Human
ggcagggacugggauauggaga

SEQ ID NO: 211057 - RNA, 22 nt, Human
agacucuggcaugcuaacuagu

SEQ ID NO: 211058 - RNA, 22 nt, Human
ccuuucuaacagauuguggauc

SEQ ID NO: 211059 - RNA, 22 nt, Human
gcacaaguccuccgacagcacg

SEQ ID NO: 211060 - RNA, 22 nt, Human
agcugaugucucaccuguuaga

SEQ ID NO: 211061 - RNA, 22 nt, Human
uuuuucuuugcuuuccacuggc

SEQ ID NO: 211062 - RNA, 22 nt, Human
ugggauggacuuuagagaaucg

SEQ ID NO: 211063 - RNA, 22 nt, Human
aagggaaggaugggcauuuaca

SEQ ID NO: 211064 - RNA, 22 nt, Human
aaaugguguucuuuagaugaaa

SEQ ID NO: 211065 - RNA, 22 nt, Human
guaaauaucucacgaaugauuc

SEQ ID NO: 211066 - RNA, 22 nt, Human
guuccugagcaguuccuggcca

SEQ ID NO: 211067 - RNA, 22 nt, Human
aaaucuuucacauauuuuuuau

SEQ ID NO: 211068 - RNA, 22 nt, Human
aguccagggcuuagucagcggg

SEQ ID NO: 211069 - RNA, 22 nt, Human
aaaauaauauuauaccacugcu

SEQ ID NO: 211070 - RNA, 21 nt, Human
ccaucuugaaccaugcccacu

SEQ ID NO: 211071 - RNA, 22 nt, Human
aaaaugggaaaauuuuagauua

SEQ ID NO: 211072 - RNA, 22 nt, Human
uucuggagacccagcaacaggg

SEQ ID NO: 211073 - RNA, 22 nt, Human
auuaaaaaugagaguagggauu

SEQ ID NO: 211074 - RNA, 20 nt, Human
aaauugaacaagccaggcug

SEQ ID NO: 211075 - RNA, 22 nt, Human
ugauuucauaugacagcuuuuu

SEQ ID NO: 211076 - RNA, 22 nt, Human
cuucauccguaccacggccaca

SEQ ID NO: 211077 - RNA, 21 nt, Human
acucaucuuuuuggagaccag

SEQ ID NO: 211078 - RNA, 22 nt, Human
aaucacuuagaacccaggaagu

SEQ ID NO: 211079 - RNA, 22 nt, Human
ggagggaggggugggagaugga

SEQ ID NO: 211080 - RNA, 22 nt, Human
cauuuuuccucaggcaauuuga

SEQ ID NO: 211081 - RNA, 23 nt, Human
gugaacaaugcuccaggagauac

SEQ ID NO: 211082 - RNA, 22 nt, Human
gagggaaauauggguuugguua

SEQ ID NO: 211083 - RNA, 22 nt, Human
gugggggcuaaauugaggggug

SEQ ID NO: 211084 - RNA, 22 nt, Human
gggcuagggucagggggccacu

SEQ ID NO: 211085 - RNA, 22 nt, Human
aagaugaguuacaaaggaguaa

SEQ ID NO: 211086 - RNA, 22 nt, Human
auaaaaauguuuuuguguggua

SEQ ID NO: 211087 - RNA, 22 nt, Human
cgagcccacacuccuguccucu

SEQ ID NO: 211088 - RNA, 22 nt, Human
acauuuuuggguugaugucuga

SEQ ID NO: 211089 - RNA, 22 nt, Human
auuuaagacuguggugcaguuu

SEQ ID NO: 211090 - RNA, 22 nt, Human
cauugcaucuuuuauggguaag

SEQ ID NO: 211091 - RNA, 22 nt, Human
ugcugggagcugggccucgaca

SEQ ID NO: 211092 - RNA, 22 nt, Human
auggagugggaggacaugaagg

SEQ ID NO: 211093 - RNA, 23 nt, Human
ggacuaggcaacagaugggacag

SEQ ID NO: 211094 - RNA, 22 nt, Human
cuugguuugaaacauacucuac

SEQ ID NO: 211095 - RNA, 22 nt, Human
aaaguagaugagaauuuuguug

SEQ ID NO: 211096 - RNA, 22 nt, Human
uguagucucagggagcugcuuc

SEQ ID NO: 211097 - RNA, 22 nt, Human
uccugggcuugcucuuuccauu

SEQ ID NO: 211098 - RNA, 22 nt, Human
ugcugcuguuuccuacaucuca

SEQ ID NO: 211099 - RNA, 22 nt, Human
ggcaugcaaaugugggugaccu

SEQ ID NO: 211100 - RNA, 22 nt, Human
aaaucaagucagcugaauucca

SEQ ID NO: 211101 - RNA, 22 nt, Human
cccagccgcuguggucuagggu

SEQ ID NO: 211102 - RNA, 22 nt, Human
cucagugacuuccugcucaauu

SEQ ID NO: 211103 - RNA, 22 nt, Human
cgcuucauugugggggccccca

SEQ ID NO: 211104 - RNA, 22 nt, Human
uuuaaucaguugguaauauuga

SEQ ID NO: 211105 - RNA, 20 nt, Human
accccuccccacuccucgcc

SEQ ID NO: 211106 - RNA, 22 nt, Human
uuggggaauuuggggccguccg

SEQ ID NO: 211107 - RNA, 22 nt, Human
uucugggguaagcacugaggau

SEQ ID NO: 211108 - RNA, 22 nt, Human
ccauggaaaagacgggcaggcc

SEQ ID NO: 211109 - RNA, 22 nt, Human
ccuggccacagggcucugcauu

SEQ ID NO: 211110 - RNA, 22 nt, Human
ucaguacaagauuuucuaaauc

SEQ ID NO: 211111 - RNA, 22 nt, Human
uuguuuuaaaaagaauaacuac

SEQ ID NO: 211112 - RNA, 22 nt, Human
gggggacagugugccuggugug

SEQ ID NO: 211113 - RNA, 22 nt, Human
uguggccaccagagcugcuauu

SEQ ID NO: 211114 - RNA, 22 nt, Human
uuuuuuuguagguguaugaaaa

SEQ ID NO: 211115 - RNA, 20 nt, Human
uccuaugagcuguuaaauug

SEQ ID NO: 211116 - RNA, 22 nt, Human
uaaagacaauuucgagcuguag

SEQ ID NO: 211117 - RNA, 22 nt, Human
aagaaaccauauuaguuccugg

SEQ ID NO: 211118 - RNA, 22 nt, Human
uaauaauuaacagugauggguc

SEQ ID NO: 211119 - RNA, 22 nt, Human
auugauuuugugcuuuccuacg

SEQ ID NO: 211120 - RNA, 22 nt, Human
cugagaucaugggucagguggu

SEQ ID NO: 211121 - RNA, 22 nt, Human
acugagaacuuggggacagagg

SEQ ID NO: 211122 - RNA, 22 nt, Human
acauugcagcuccuaccuuguc

SEQ ID NO: 211123 - RNA, 22 nt, Human
aucucacuucugucauguggca

SEQ ID NO: 211124 - RNA, 22 nt, Human
gggagcugagcuggaagagaau

SEQ ID NO: 211125 - RNA, 22 nt, Human
ugguggcuuuucguagguucac

SEQ ID NO: 211126 - RNA, 22 nt, Human
ccugcuggagucuaguuggucu

SEQ ID NO: 211127 - RNA, 22 nt, Human
gugacugagcuggcaaaguaug

SEQ ID NO: 211128 - RNA, 21 nt, Human
auuuuucagaaggaugugaua

SEQ ID NO: 211129 - RNA, 22 nt, Human
aaugagaauguaagugaagaga

SEQ ID NO: 211130 - RNA, 22 nt, Human
auccuucaaaaggaauagcagg

SEQ ID NO: 211131 - RNA, 22 nt, Human
accuuguuguagguacaaaaga

SEQ ID NO: 211132 - RNA, 22 nt, Human
ugauugcucagcuagccucuuu

SEQ ID NO: 211133 - RNA, 22 nt, Human
uuguuuucuaguguuuugaaua

SEQ ID NO: 211134 - RNA, 22 nt, Human
augggagggugaggaggcagcu

SEQ ID NO: 211135 - RNA, 22 nt, Human
uuccacaugaucauuguaauaa

SEQ ID NO: 211136 - RNA, 22 nt, Human
cugugcauguucucuagcugau

SEQ ID NO: 211137 - RNA, 22 nt, Human
acugucuuguuguaugugagcu

SEQ ID NO: 211138 - RNA, 22 nt, Human
ugcuggugauuaaauccugaag

SEQ ID NO: 211139 - RNA, 22 nt, Human
uucauagaagggaguuuuuccu

SEQ ID NO: 211140 - RNA, 22 nt, Human
uggaaaggcccauaaaaggaua

SEQ ID NO: 211141 - RNA, 22 nt, Human
cuguguggccuaaguggagaca

SEQ ID NO: 211142 - RNA, 22 nt, Human
gauuccugcuauucacagggcu

SEQ ID NO: 211143 - RNA, 22 nt, Human
gcuggguaguucuuguuuggga

SEQ ID NO: 211144 - RNA, 22 nt, Human
cugcuguugagguuccaggcca

SEQ ID NO: 211145 - RNA, 22 nt, Human
ugggcacacugaaucugcuauu

SEQ ID NO: 211146 - RNA, 22 nt, Human
cagcucugcugggaggaugcag

SEQ ID NO: 211147 - RNA, 22 nt, Human
agcacuuuagaauuuagaguug

SEQ ID NO: 211148 - RNA, 22 nt, Human
ggaagacuuagaguagcaucag

SEQ ID NO: 211149 - RNA, 23 nt, Human
uaagccugugccugcuaccugcu

SEQ ID NO: 211150 - RNA, 22 nt, Human
aaccuggguguacauuaugguc

SEQ ID NO: 211151 - RNA, 22 nt, Human
caggcagggcugccuucugcuu

SEQ ID NO: 211152 - RNA, 22 nt, Human
ggaggaugaggguggugguguu

SEQ ID NO: 211153 - RNA, 22 nt, Human
gcacccagggcaggaagugagg

SEQ ID NO: 211154 - RNA, 22 nt, Human
cagggagguuggauuggggccu

SEQ ID NO: 211155 - RNA, 21 nt, Human
acaguacuugagaucuuuuga

SEQ ID NO: 211156 - RNA, 22 nt, Human
auugguuucuuguggguuaucc

SEQ ID NO: 211157 - RNA, 22 nt, Human
ccagggcuggaccagugcuugg

SEQ ID NO: 211158 - RNA, 22 nt, Human
ugauggugagaugucccguguu

SEQ ID NO: 211159 - RNA, 22 nt, Human
agggagcagcuagagggggucc

SEQ ID NO: 211160 - RNA, 22 nt, Human
aggagaaagaccagccugccga

SEQ ID NO: 211161 - RNA, 22 nt, Human
cugggguggugcaggccucaug

SEQ ID NO: 211162 - RNA, 22 nt, Human
auaccaguagaggacugcccaa

SEQ ID NO: 211163 - RNA, 22 nt, Human
uuguuauaggaucagugucacu

SEQ ID NO: 211164 - RNA, 22 nt, Human
aagugaggagaccucuucuuca

SEQ ID NO: 211165 - RNA, 22 nt, Human
gggcuuaaccuggguaugaggg

SEQ ID NO: 211166 - RNA, 22 nt, Human
gaauggaacauagcaacaucuu

SEQ ID NO: 211167 - RNA, 22 nt, Human
ggccgggcaugcgagcugagcg

SEQ ID NO: 211168 - RNA, 21 nt, Human
cagagcuuuggagacggagga

SEQ ID NO: 211169 - RNA, 22 nt, Human
uauuugauggaacucuugcuuu

SEQ ID NO: 211170 - RNA, 22 nt, Human
ucuauauucuauguucuucuuu

SEQ ID NO: 211171 - RNA, 22 nt, Human
aaauauuugaaugguguaagau

SEQ ID NO: 211172 - RNA, 22 nt, Human
auauguuaugccauuuucaagg

SEQ ID NO: 211173 - RNA, 22 nt, Human
cugcuucacccugccugagaac

SEQ ID NO: 211174 - RNA, 22 nt, Human
auugagaaaauucgagcaaguu

SEQ ID NO: 211175 - RNA, 19 nt, Human
auuuccuggcauauaucac

SEQ ID NO: 211176 - RNA, 22 nt, Human
ucgcuugaacccaggaagugga

SEQ ID NO: 211177 - RNA, 19 nt, Human
ucuuccaucuauccuccuc

SEQ ID NO: 211178 - RNA, 22 nt, Human
uguguguuguuuugccagaaua

SEQ ID NO: 211179 - RNA, 22 nt, Human
ucauuagaccucucugguucag

SEQ ID NO: 211180 - RNA, 22 nt, Human
ggcugugguggacgcgggaaac

SEQ ID NO: 211181 - RNA, 22 nt, Human
gaaggcagucuggggagcagcc

SEQ ID NO: 211182 - RNA, 22 nt, Human
aguuuaaauuguucuaucagaa

SEQ ID NO: 211183 - RNA, 22 nt, Human
aagauucaguugguuuuggaaa

SEQ ID NO: 211184 - RNA, 22 nt, Human
gugcuuccuguauugauuccau

SEQ ID NO: 211185 - RNA, 19 nt, Human
gagugaggagcaucguuua

SEQ ID NO: 211186 - RNA, 22 nt, Human
auggaggaugugcagcaugggc

SEQ ID NO: 211187 - RNA, 22 nt, Human
aggcauauaguguuuaaaaaaa

SEQ ID NO: 211188 - RNA, 22 nt, Human
uuguuccuuucuucuguagucg

SEQ ID NO: 211189 - RNA, 21 nt, Human
auucugaguugucagucuuca

SEQ ID NO: 211190 - RNA, 22 nt, Human
gcagguuguuuaaauuaggauu

SEQ ID NO: 211191 - RNA, 22 nt, Human
acacagugaccuacauuccaaa

SEQ ID NO: 211192 - RNA, 22 nt, Human
ccagggaagaaagaugaagugc

SEQ ID NO: 211193 - RNA, 22 nt, Human
augcuagaaaauuucauauuau

SEQ ID NO: 211194 - RNA, 22 nt, Human
uauaugcagauuuucaucaucg

SEQ ID NO: 211195 - RNA, 22 nt, Human
acaaucuuauuaguaguauaga

SEQ ID NO: 211196 - RNA, 20 nt, Human
cuccuccccucggccccacc

SEQ ID NO: 211197 - RNA, 22 nt, Human
cucuggggaagugcacucgcug

SEQ ID NO: 211198 - RNA, 22 nt, Human
cacacaccagaaagccugggac

SEQ ID NO: 211199 - RNA, 22 nt, Human
gggacaggacuccuggggccug

SEQ ID NO: 211200 - RNA, 19 nt, Human
agaaacaacauucuggaga

SEQ ID NO: 211201 - RNA, 22 nt, Human
aggaagagcuggaccagaggac

SEQ ID NO: 211202 - RNA, 22 nt, Human
gaguaaaagaugaggcaguaga

SEQ ID NO: 211203 - RNA, 21 nt, Human
ugcuuucugugcuuuuucugc

SEQ ID NO: 211204 - RNA, 22 nt, Human
uuccaugccuaagagccugaag

SEQ ID NO: 211205 - RNA, 22 nt, Human
aagccuccgugcugcuggaucu

SEQ ID NO: 211206 - RNA, 22 nt, Human
aggaggaggacucgccaggcca

SEQ ID NO: 211207 - RNA, 22 nt, Human
cagaugccauagguauaguaua

SEQ ID NO: 211208 - RNA, 22 nt, Human
auguguuuccaacagagaggga

SEQ ID NO: 211209 - RNA, 19 nt, Human
caggucuucuuggaggacu

SEQ ID NO: 211210 - RNA, 22 nt, Human
gagagaguaucugcugguucac

SEQ ID NO: 211211 - RNA, 22 nt, Human
gaugguagauauagaaagggga

SEQ ID NO: 211212 - RNA, 22 nt, Human
aauucuuuguuccucugccaag

SEQ ID NO: 211213 - RNA, 22 nt, Human
auguaugagagauucuuuuauu

SEQ ID NO: 211214 - RNA, 22 nt, Human
guggauggagcuggaagccauu

SEQ ID NO: 211215 - RNA, 22 nt, Human
gagaugugguucaaggguguuu

SEQ ID NO: 211216 - RNA, 22 nt, Human
auuuaaaaacugguacaacagg

SEQ ID NO: 211217 - RNA, 22 nt, Human
cuuuuggcaucagccucaggaa

SEQ ID NO: 211218 - RNA, 22 nt, Human
gagcagacugcacaguucuugc

SEQ ID NO: 211219 - RNA, 22 nt, Human
ggaggccagagaagagccaggc

SEQ ID NO: 211220 - RNA, 22 nt, Human
gacacaacuauccaguauggga

SEQ ID NO: 211221 - RNA, 22 nt, Human
ucugcccaggaggucccauggg

SEQ ID NO: 211222 - RNA, 22 nt, Human
auguuuaauuugaaauuuuauu

SEQ ID NO: 211223 - RNA, 22 nt, Human
auuuuugugucacaucuaggaa

SEQ ID NO: 211224 - RNA, 22 nt, Human
aaugacagccuauacugucugc

SEQ ID NO: 211225 - RNA, 22 nt, Human
guuuuaaucuccuuauuccuaa

SEQ ID NO: 211226 - RNA, 22 nt, Human
aagaaagaucugaaagaagcga

SEQ ID NO: 211227 - RNA, 22 nt, Human
uucugugacgcaaagcugggaa

SEQ ID NO: 211228 - RNA, 22 nt, Human
ggcaaggaagaaagcagaaguu

SEQ ID NO: 211229 - RNA, 22 nt, Human
gagcuuuagcugagaccugcuu

SEQ ID NO: 211230 - RNA, 22 nt, Human
gcucucuggccugggaggagga

SEQ ID NO: 211231 - RNA, 22 nt, Human
ucccugccuuauuuucauaugc

SEQ ID NO: 211232 - RNA, 22 nt, Human
agcagagggucaguuuuuuagu

SEQ ID NO: 211233 - RNA, 22 nt, Human
cugggaguugacgaggcuugua

SEQ ID NO: 211234 - RNA, 22 nt, Human
ggagcaagagugagcaagcaga

SEQ ID NO: 211235 - RNA, 22 nt, Human
ugcugcacucacaggaagaguu

SEQ ID NO: 211236 - RNA, 22 nt, Human
cauugcugugggcauuugcugc

SEQ ID NO: 211237 - RNA, 22 nt, Human
ugugucuuuggcgaugucugga

SEQ ID NO: 211238 - RNA, 22 nt, Human
ugugggaucguaaauuugggac

SEQ ID NO: 211239 - RNA, 22 nt, Human
ccuugguuuagcaauuuuucuu

SEQ ID NO: 211240 - RNA, 22 nt, Human
cggggcucugcacaggccagga

SEQ ID NO: 211241 - RNA, 22 nt, Human
aaacaccaagagcuagcuauua

SEQ ID NO: 211242 - RNA, 18 nt, Human
ugcaggggaggggugaua

SEQ ID NO: 211243 - RNA, 22 nt, Human
acauugguauuaguguggcuga

SEQ ID NO: 211244 - RNA, 22 nt, Human
augugagcuggaugaauuuaua

SEQ ID NO: 211245 - RNA, 22 nt, Human
ucaaguccuuggcauaggauaa

SEQ ID NO: 211246 - RNA, 22 nt, Human
caggccagcuggaggggcagcu

SEQ ID NO: 211247 - RNA, 19 nt, Human
acuggggcaggcugggcuu

SEQ ID NO: 211248 - RNA, 22 nt, Human
agguaguacuuuuuagagugca

SEQ ID NO: 211249 - RNA, 22 nt, Human
auguuuuuugaaaauguauuuu

SEQ ID NO: 211250 - RNA, 22 nt, Human
guuuuguagucuggagacuguc

SEQ ID NO: 211251 - RNA, 22 nt, Human
uggaggaugacagagaugggcu

SEQ ID NO: 211252 - RNA, 22 nt, Human
gguaugaggaugaggguggcau

SEQ ID NO: 211253 - RNA, 22 nt, Human
cccaucugugaaauggggcugc

SEQ ID NO: 211254 - RNA, 22 nt, Human
uugcaagcccugaagggcugga

SEQ ID NO: 211255 - RNA, 22 nt, Human
ggagacagugacuuagagacug

SEQ ID NO: 211256 - RNA, 23 nt, Human
aaacuacauuuauaguuuuucuc

SEQ ID NO: 211257 - RNA, 22 nt, Human
gggccgcagccucuccggccug

SEQ ID NO: 211258 - RNA, 22 nt, Human
cucucugcugucuuucgggaaa

SEQ ID NO: 211259 - RNA, 21 nt, Human
gcagaaagugauuugcuauuc

SEQ ID NO: 211260 - RNA, 22 nt, Human
gugcugcaugagcaucacguag

SEQ ID NO: 211261 - RNA, 22 nt, Human
auuuuuauuugccuaugauaua

SEQ ID NO: 211262 - RNA, 22 nt, Human
uauuuuuuuaacauuuauugua

SEQ ID NO: 211263 - RNA, 21 nt, Human
ugcaacugaaaggaauauggu

SEQ ID NO: 211264 - RNA, 22 nt, Human
uuuucucaguuuuuuucaaaag

SEQ ID NO: 211265 - RNA, 22 nt, Human
cugaccucuaaguaacagagaa

SEQ ID NO: 211266 - RNA, 22 nt, Human
ugucacagggauaccauggggc

SEQ ID NO: 211267 - RNA, 22 nt, Human
uuuauuugugguaguguaaucu

SEQ ID NO: 211268 - RNA, 22 nt, Human
gagccuguuaggcaccuguguu

SEQ ID NO: 211269 - RNA, 22 nt, Human
uuucuuaguuaaguagguaggc

SEQ ID NO: 211270 - RNA, 22 nt, Human
agagcccagaucccacccugga

SEQ ID NO: 211271 - RNA, 22 nt, Human
uuccacauucggaauuuucuga

SEQ ID NO: 211272 - RNA, 22 nt, Human
uggguagcucaauagagccaca

SEQ ID NO: 211273 - RNA, 22 nt, Human
uuuuuugucuugaagaaauggu

SEQ ID NO: 211274 - RNA, 22 nt, Human
gcuucuguuaggauguggcuua

SEQ ID NO: 211275 - RNA, 22 nt, Human
uauguaacaccauuuacaaagu

SEQ ID NO: 211276 - RNA, 22 nt, Human
ccauuuggccauucaguuguuc

SEQ ID NO: 211277 - RNA, 22 nt, Human
ggcagcagaacuggcccuguau

SEQ ID NO: 211278 - RNA, 22 nt, Human
gugaaaugaagugacuggauau

SEQ ID NO: 211279 - RNA, 22 nt, Human
uuuuuguauaugcuucgaggau

SEQ ID NO: 211280 - RNA, 22 nt, Human
uaaaaauuagauauguauuuag

SEQ ID NO: 211281 - RNA, 22 nt, Human
cugucucugauaagcucgaggg

SEQ ID NO: 211282 - RNA, 22 nt, Human
uccucccagguucuaucuccuc

SEQ ID NO: 211283 - RNA, 22 nt, Human
aagguauaaauaacucgggagg

SEQ ID NO: 211284 - RNA, 21 nt, Human
uaggguacacuggcagagagc

SEQ ID NO: 211285 - RNA, 20 nt, Human
caacacugcccauuguuugc

SEQ ID NO: 211286 - RNA, 22 nt, Human
uggaagaucugguguagcuccu

SEQ ID NO: 211287 - RNA, 19 nt, Human
uuuagcuacugugguauua

SEQ ID NO: 211288 - RNA, 22 nt, Human
uacuuuaauugcaaaaauaaau

SEQ ID NO: 211289 - RNA, 22 nt, Human
uacucuggaguugagaugcgag

SEQ ID NO: 211290 - RNA, 22 nt, Human
uggcugaugucuguucuguuau

SEQ ID NO: 211291 - RNA, 21 nt, Human
uucuuugaagacccauuugag

SEQ ID NO: 211292 - RNA, 22 nt, Human
uuaaucagacauucucaaguuu

SEQ ID NO: 211293 - RNA, 22 nt, Human
gaggggaacaggcauucuuaag

SEQ ID NO: 211294 - RNA, 22 nt, Human
cacaucucagggcuacaggcag

SEQ ID NO: 211295 - RNA, 22 nt, Human
gacacugccaagugccccgaga

SEQ ID NO: 211296 - RNA, 22 nt, Human
ugucaucuuucuaaagcugguc

SEQ ID NO: 211297 - RNA, 22 nt, Human
cauugcaaccccaaaaagaaca

SEQ ID NO: 211298 - RNA, 22 nt, Human
uggcacagcuugucauaaacuc

SEQ ID NO: 211299 - RNA, 22 nt, Human
guauaaauaucuauauuguuac

SEQ ID NO: 211300 - RNA, 22 nt, Human
agcacucacuagaguuagaacc

SEQ ID NO: 211301 - RNA, 22 nt, Human
uauauauacauauagaauaugu

SEQ ID NO: 211302 - RNA, 22 nt, Human
gaggccauguggcccgggcugc

SEQ ID NO: 211303 - RNA, 20 nt, Human
acagagauccucucuuuauc

SEQ ID NO: 211304 - RNA, 22 nt, Human
auuuuuuuaggcugucagccgc

SEQ ID NO: 211305 - RNA, 22 nt, Human
uagagaaauauuuguagugcug

SEQ ID NO: 211306 - RNA, 22 nt, Human
cuuggugcgaagagucagggga

SEQ ID NO: 211307 - RNA, 22 nt, Human
ucagucucuggggcuucuguuu

SEQ ID NO: 211308 - RNA, 22 nt, Human
agcagcugagccccagcuguga

SEQ ID NO: 211309 - RNA, 22 nt, Human
uggaugccuugggggaggagga

SEQ ID NO: 211310 - RNA, 21 nt, Human
aaguuucucccuaauuguugc

SEQ ID NO: 211311 - RNA, 22 nt, Human
gguggggacuuggggucagcgg

SEQ ID NO: 211312 - RNA, 22 nt, Human
uaaaugagcaccucuaguuuug

SEQ ID NO: 211313 - RNA, 22 nt, Human
uuuagugagugugaaucaaaug

SEQ ID NO: 211314 - RNA, 22 nt, Human
gguagaggaugaggagguugga

SEQ ID NO: 211315 - RNA, 22 nt, Human
cagcccugagagaaccaucuau

SEQ ID NO: 211316 - RNA, 22 nt, Human
gggggggcagguuggaugucag

SEQ ID NO: 211317 - RNA, 22 nt, Human
agccugugacucugugaaacca

SEQ ID NO: 211318 - RNA, 22 nt, Human
ugagugggaggugggaagggua

SEQ ID NO: 211319 - RNA, 22 nt, Human
guguauuucuagaagaaaugaa

SEQ ID NO: 211320 - RNA, 22 nt, Human
uguguguaugagcauuuguaug

SEQ ID NO: 211321 - RNA, 19 nt, Human
ugcacucauggagggucug

SEQ ID NO: 211322 - RNA, 22 nt, Human
uucccugugcaguauguuccaa

SEQ ID NO: 211323 - RNA, 22 nt, Human
uggcaugugaauuguuacauug

SEQ ID NO: 211324 - RNA, 22 nt, Human
uuuaaugucuuggaaaaagacu

SEQ ID NO: 211325 - RNA, 22 nt, Human
aguaaaugaaagcaauuuuaga

SEQ ID NO: 211326 - RNA, 22 nt, Human
gauguuaauauguuucaccaaa

SEQ ID NO: 211327 - RNA, 22 nt, Human
agugcucagggaaugccacuga

SEQ ID NO: 211328 - RNA, 22 nt, Human
gggcaagaggguuugacaugag

SEQ ID NO: 211329 - RNA, 22 nt, Human
cgcuagggagcacuuggcagug

SEQ ID NO: 211330 - RNA, 22 nt, Human
auguauuuauguauguguuaua

SEQ ID NO: 211331 - RNA, 17 nt, Human
ucauuuauccucuuugg

SEQ ID NO: 211332 - RNA, 22 nt, Human
ggaaaggacuggagcccagcgc

SEQ ID NO: 211333 - RNA, 22 nt, Human
ugggaaaauugugauucuuucu

SEQ ID NO: 211334 - RNA, 22 nt, Human
auacaucuuaacgcgcucuugg

SEQ ID NO: 211335 - RNA, 22 nt, Human
auuguuuugugaaacauaguga

SEQ ID NO: 211336 - RNA, 22 nt, Human
uuauuucaggcauuuguaaaug

SEQ ID NO: 211337 - RNA, 22 nt, Human
gaaaucuggugauuuucuguug

SEQ ID NO: 211338 - RNA, 22 nt, Human
cugugucucccaaggaggguca

SEQ ID NO: 211339 - RNA, 20 nt, Human
uucacagaucucuaacugag

SEQ ID NO: 211340 - RNA, 22 nt, Human
uguuauugccucaugagacucc

SEQ ID NO: 211341 - RNA, 22 nt, Human
agcgcucauuuuccuccugcuc

SEQ ID NO: 211342 - RNA, 22 nt, Human
aaacuuuaggcacauggaucua

SEQ ID NO: 211343 - RNA, 22 nt, Human
caaggaagguugguugaaggua

SEQ ID NO: 211344 - RNA, 22 nt, Human
gaggaucuuuagcgggacugcu

SEQ ID NO: 211345 - RNA, 21 nt, Human
aucagaggacaucucagggcc

SEQ ID NO: 211346 - RNA, 22 nt, Human
cccacccuacugcuacccagga

SEQ ID NO: 211347 - RNA, 22 nt, Human
caacaagcgcucagagcaaagc

SEQ ID NO: 211348 - RNA, 22 nt, Human
cagcagaggagguggcagcacc

SEQ ID NO: 211349 - RNA, 22 nt, Human
ucauuguuuacugucuuuuuuc

SEQ ID NO: 211350 - RNA, 22 nt, Human
cagaaugugacaucaaaggcuc

SEQ ID NO: 211351 - RNA, 22 nt, Human
caugcuggcacugaccagccua

SEQ ID NO: 211352 - RNA, 22 nt, Human
accccacucccuuucuuuugcu

SEQ ID NO: 211353 - RNA, 22 nt, Human
augugugugcgagcgugugugu

SEQ ID NO: 211354 - RNA, 22 nt, Human
gggggcagguuccaggccagcu

SEQ ID NO: 211355 - RNA, 22 nt, Human
cugagggagcugcuggccuugg

SEQ ID NO: 211356 - RNA, 22 nt, Human
cagagagcguccauccggugcc

SEQ ID NO: 211357 - RNA, 22 nt, Human
gaaaaggaggggaggcagaugg

SEQ ID NO: 211358 - RNA, 22 nt, Human
uguguguguguguguaauauau

SEQ ID NO: 211359 - RNA, 23 nt, Human
ucagugaaggaacaacuaaauag

SEQ ID NO: 211360 - RNA, 22 nt, Human
cggggcuggcguuagggaggca

SEQ ID NO: 211361 - RNA, 22 nt, Human
ugccuggugcggagugaguggc

SEQ ID NO: 211362 - RNA, 22 nt, Human
guuuuucuuugauuuagaacca

SEQ ID NO: 211363 - RNA, 22 nt, Human
uacauccuuuugaaaucccaga

SEQ ID NO: 211364 - RNA, 22 nt, Human
uccuccauguugugcacuugaa

SEQ ID NO: 211365 - RNA, 22 nt, Human
cccuuuuccugaggcccccugc

SEQ ID NO: 211366 - RNA, 22 nt, Human
gggagccucccacugggggaag

SEQ ID NO: 211367 - RNA, 22 nt, Human
caguucuguaccaggagaagcu

SEQ ID NO: 211368 - RNA, 20 nt, Human
aagugcuguuagcugccuga

SEQ ID NO: 211369 - RNA, 22 nt, Human
uuuuuguuauuuagguguagag

SEQ ID NO: 211370 - RNA, 22 nt, Human
gagaaagauuguccuucagggg

SEQ ID NO: 211371 - RNA, 22 nt, Human
auacaugugugugcauacaugu

SEQ ID NO: 211372 - RNA, 22 nt, Human
ucuuuugaacauccaggauguc

SEQ ID NO: 211373 - RNA, 22 nt, Human
ggcuggagcaggcugcacagug

SEQ ID NO: 211374 - RNA, 22 nt, Human
guuuugaugugauuucucaugu

SEQ ID NO: 211375 - RNA, 22 nt, Human
gcuguggagaagcugccuaugg

SEQ ID NO: 211376 - RNA, 22 nt, Human
caggcacagcuaagacuggcca

SEQ ID NO: 211377 - RNA, 22 nt, Human
aguguauuugccuauaaaaaug

SEQ ID NO: 211378 - RNA, 23 nt, Human
uucuuuccuuaucccauuuacuu

SEQ ID NO: 211379 - RNA, 22 nt, Human
agguguaauuacucuugcaguu

SEQ ID NO: 211380 - RNA, 22 nt, Human
agugccuggcugauggguccug

SEQ ID NO: 211381 - RNA, 22 nt, Human
cgggguguggggcgguagugug

SEQ ID NO: 211382 - RNA, 22 nt, Human
ucagcucucucuuggugaucuc

SEQ ID NO: 211383 - RNA, 22 nt, Human
aaauucagcagguuucaaaagc

SEQ ID NO: 211384 - RNA, 22 nt, Human
ugauucacgcuucucuuuaaac

SEQ ID NO: 211385 - RNA, 22 nt, Human
caggcagagagggcagugugga

SEQ ID NO: 211386 - RNA, 22 nt, Human
augcaccugucuuuuaaggaua

SEQ ID NO: 211387 - RNA, 22 nt, Human
agguuuuagagagccaggaugu

SEQ ID NO: 211388 - RNA, 22 nt, Human
uuugggccugucugccugcuuu

SEQ ID NO: 211389 - RNA, 22 nt, Human
uuaaaauuguuaacuuugguga

SEQ ID NO: 211390 - RNA, 22 nt, Human
ccagccacugacugauuuaaaa

SEQ ID NO: 211391 - RNA, 22 nt, Human
uauuaaaagagaaaaagccacc

SEQ ID NO: 211392 - RNA, 23 nt, Human
aguggaggucgggguggggagac

SEQ ID NO: 211393 - RNA, 22 nt, Human
ucucuucacuuguaugcuauca

SEQ ID NO: 211394 - RNA, 22 nt, Human
uguuuuguuuagguuuguuuuu

SEQ ID NO: 211395 - RNA, 22 nt, Human
ugccaacaggcuugccugaugu

SEQ ID NO: 211396 - RNA, 22 nt, Human
aagugucucugggaggcccgga

SEQ ID NO: 211397 - RNA, 22 nt, Human
gagagcugucagcguagcaccg

SEQ ID NO: 211398 - RNA, 22 nt, Human
gucuugugaagacggcagaaag

SEQ ID NO: 211399 - RNA, 22 nt, Human
uggacagguacuucacauuauu

SEQ ID NO: 211400 - RNA, 22 nt, Human
ugggcagagggugaggaaggcg

SEQ ID NO: 211401 - RNA, 22 nt, Human
gcagaggcugccgugggcagga

SEQ ID NO: 211402 - RNA, 22 nt, Human
cgguuuuuaaaagucucuucua

SEQ ID NO: 211403 - RNA, 19 nt, Human
uagagcagcuucagauucc

SEQ ID NO: 211404 - RNA, 22 nt, Human
ucugcaugccucaggaggccug

SEQ ID NO: 211405 - RNA, 22 nt, Human
uuaugccuguuaggcagcaucu

SEQ ID NO: 211406 - RNA, 22 nt, Human
uguuuuucaagcauuuauuaau

SEQ ID NO: 211407 - RNA, 22 nt, Human
gcugcaggaggugguagggucu

SEQ ID NO: 211408 - RNA, 22 nt, Human
gucaagaugcuacauaauggga

SEQ ID NO: 211409 - RNA, 22 nt, Human
gccugccucugacuggggcuga

SEQ ID NO: 211410 - RNA, 22 nt, Human
uggguguggaagcagcgugggg

SEQ ID NO: 211411 - RNA, 22 nt, Human
aguugaggguuaguaaauagcu

SEQ ID NO: 211412 - RNA, 22 nt, Human
ggggagggcugagcacgguuga

SEQ ID NO: 211413 - RNA, 22 nt, Human
cagagcugucauuugccaguga

SEQ ID NO: 211414 - RNA, 22 nt, Human
gcuguggaaaaugggucuccaa

SEQ ID NO: 211415 - RNA, 21 nt, Human
accuggugaugaaugggaggc

SEQ ID NO: 211416 - RNA, 22 nt, Human
ccagcaucagcucuuggcuggc

SEQ ID NO: 211417 - RNA, 22 nt, Human
auguaaugucaaucuucagugg

SEQ ID NO: 211418 - RNA, 22 nt, Human
ccugcacuaccuggggcugcug

SEQ ID NO: 211419 - RNA, 22 nt, Human
gggaaauagagcuggaaccuug

SEQ ID NO: 211420 - RNA, 22 nt, Human
uaggcagggauuaggguugauu

SEQ ID NO: 211421 - RNA, 22 nt, Human
ugaaugaacugaugaacuuaac

SEQ ID NO: 211422 - RNA, 22 nt, Human
ggaaagaggacaucuuacuucu

SEQ ID NO: 211423 - RNA, 22 nt, Human
cuucccaucaagcuggaggaug

SEQ ID NO: 211424 - RNA, 22 nt, Human
aauugcauucauuuguauauuu

SEQ ID NO: 211425 - RNA, 22 nt, Human
uucauuuccauuuuauagauaa

SEQ ID NO: 211426 - RNA, 22 nt, Human
ggcuggggccuguugaagaugc

SEQ ID NO: 211427 - RNA, 22 nt, Human
cuugcugggagagcuuuagaga

SEQ ID NO: 211428 - RNA, 22 nt, Human
ucuuuaaauucuuaugagugaa

SEQ ID NO: 211429 - RNA, 22 nt, Human
cuggaugucugggaggcuuccc

SEQ ID NO: 211430 - RNA, 20 nt, Human
gaacauaaauaacucuuuac

SEQ ID NO: 211431 - RNA, 22 nt, Human
cuguuaauugugaauuuuacau

SEQ ID NO: 211432 - RNA, 22 nt, Human
aagcagcauaugacagcaucca

SEQ ID NO: 211433 - RNA, 22 nt, Human
uugccaggggacaucuggagcc

SEQ ID NO: 211434 - RNA, 22 nt, Human
ugaguguuguaaccauaugauu

SEQ ID NO: 211435 - RNA, 22 nt, Human
ucccagccugacagugcaucaa

SEQ ID NO: 211436 - RNA, 22 nt, Human
gguuuguggagcuggaaacacu

SEQ ID NO: 211437 - RNA, 18 nt, Human
ucagaggagauaccuaaa

SEQ ID NO: 211438 - RNA, 22 nt, Human
uggaagugucagcaggcugguu

SEQ ID NO: 211439 - RNA, 21 nt, Human
uaagaacauuaucuucuuccu

SEQ ID NO: 211440 - RNA, 22 nt, Human
gcaaggaggguaaccacauuuc

SEQ ID NO: 211441 - RNA, 22 nt, Human
ugguugauuaauuuugccaagc

SEQ ID NO: 211442 - RNA, 22 nt, Human
ggccacauuccagagggcugaa

SEQ ID NO: 211443 - RNA, 22 nt, Human
gggcagagggcgagcugggaga

SEQ ID NO: 211444 - RNA, 22 nt, Human
aggggcugagaguuugaugugg

SEQ ID NO: 211445 - RNA, 22 nt, Human
ugaccucaagcaugcggagggc

SEQ ID NO: 211446 - RNA, 22 nt, Human
cagcccaucaaggggauccuga

SEQ ID NO: 211447 - RNA, 22 nt, Human
aggucccauguccucccugacc

SEQ ID NO: 211448 - RNA, 22 nt, Human
aauacaaucagauuaugguagu

SEQ ID NO: 211449 - RNA, 22 nt, Human
ugcuuguuuguuuucuuccauu

SEQ ID NO: 211450 - RNA, 22 nt, Human
aggggcugugucauuuguccua

SEQ ID NO: 211451 - RNA, 22 nt, Human
cacaugugggcacagggcugca

SEQ ID NO: 211452 - RNA, 18 nt, Human
agggggaagccaggagga

SEQ ID NO: 211453 - RNA, 22 nt, Human
acucagaguuugcguuccauac

SEQ ID NO: 211454 - RNA, 22 nt, Human
aggacaaaggaccagaucugga

SEQ ID NO: 211455 - RNA, 22 nt, Human
aauuucuccuuuucaguuagau

SEQ ID NO: 211456 - RNA, 22 nt, Human
aaaauauucuauaucaaagaua

SEQ ID NO: 211457 - RNA, 22 nt, Human
uaccuggauaaauguacaaccg

SEQ ID NO: 211458 - RNA, 22 nt, Human
acucugaggauuucaguuuuac

SEQ ID NO: 211459 - RNA, 18 nt, Human
augggggaggaggaaagg

SEQ ID NO: 211460 - RNA, 22 nt, Human
gcauuucuguuuuuuuaaauga

SEQ ID NO: 211461 - RNA, 22 nt, Human
agaagcaaagcaaacacauucu

SEQ ID NO: 211462 - RNA, 22 nt, Human
guuguuuucagcccagcauuag

SEQ ID NO: 211463 - RNA, 22 nt, Human
uggaagggagcuggaauuugga

SEQ ID NO: 211464 - RNA, 22 nt, Human
ggagaucucauugauacugaua

SEQ ID NO: 211465 - RNA, 19 nt, Human
agggaggcaagagaaaugu

SEQ ID NO: 211466 - RNA, 22 nt, Human
aucuucuuucaucagccccuca

SEQ ID NO: 211467 - RNA, 22 nt, Human
ggcugugaaguacguugaaggu

SEQ ID NO: 211468 - RNA, 22 nt, Human
cuccuuuuuuuaaagauggauu

SEQ ID NO: 211469 - RNA, 22 nt, Human
ucuguaauccacacagguggau

SEQ ID NO: 211470 - RNA, 22 nt, Human
uuauuuaaaauguagguuggga

SEQ ID NO: 211471 - RNA, 22 nt, Human
gggagggcuuggacccagaugu

SEQ ID NO: 211472 - RNA, 22 nt, Human
aauccaaacaggauuaccuauc

SEQ ID NO: 211473 - RNA, 23 nt, Human
uugcuugagcccaggaaguggag

SEQ ID NO: 211474 - RNA, 19 nt, Human
cgguaugaauguacuaugg

SEQ ID NO: 211475 - RNA, 22 nt, Human
guugcuucuuggcuuuuccaac

SEQ ID NO: 211476 - RNA, 22 nt, Human
ugaggucaggcagggguuuggc

SEQ ID NO: 211477 - RNA, 23 nt, Human
ucauugcucaagauaaugguuga

SEQ ID NO: 211478 - RNA, 22 nt, Human
gcauuagacuaguacacggcag

SEQ ID NO: 211479 - RNA, 22 nt, Human
ccagcugggucccugcuggggc

SEQ ID NO: 211480 - RNA, 22 nt, Human
aaugaacuuucaguucagagag

SEQ ID NO: 211481 - RNA, 22 nt, Human
ugcuuguuuuguggcuucagcu

SEQ ID NO: 211482 - RNA, 22 nt, Human
ugauugauaaugaagacaguca

SEQ ID NO: 211483 - RNA, 22 nt, Human
uccucagcaagacgcuggcagc

SEQ ID NO: 211484 - RNA, 22 nt, Human
auucaagauagaaggauuuuca

SEQ ID NO: 211485 - RNA, 20 nt, Human
uuggagaucacguguccagg

SEQ ID NO: 211486 - RNA, 20 nt, Human
gccaaggaggagaaacaggc

SEQ ID NO: 211487 - RNA, 22 nt, Human
ggcugggagguggcgaggaggc

SEQ ID NO: 211488 - RNA, 22 nt, Human
auuagugguguauuuggcacua

SEQ ID NO: 211489 - RNA, 22 nt, Human
cagccuuuucuuaaaaugcaag

SEQ ID NO: 211490 - RNA, 22 nt, Human
auuuccagcagcauauuugucu

SEQ ID NO: 211491 - RNA, 22 nt, Human
cugccucucaugccugcuugcu

SEQ ID NO: 211492 - RNA, 22 nt, Human
gcugucauggacaugucuguuu

SEQ ID NO: 211493 - RNA, 22 nt, Human
auaguuuuagauacugagaaaa

SEQ ID NO: 211494 - RNA, 22 nt, Human
ucucagaagaaacaucugcugg

SEQ ID NO: 211495 - RNA, 22 nt, Human
gaauucuaguucuguaucucug

SEQ ID NO: 211496 - RNA, 22 nt, Human
gcuguggcuccaauggugagcc

SEQ ID NO: 211497 - RNA, 22 nt, Human
gaaugggaauuauggugggacu

SEQ ID NO: 211498 - RNA, 22 nt, Human
uuucagagaaagcccaaagacu

SEQ ID NO: 211499 - RNA, 22 nt, Human
uacaauguucgcauucucucug

SEQ ID NO: 211500 - RNA, 22 nt, Human
ccacguguugcucagacagggu

SEQ ID NO: 211501 - RNA, 22 nt, Human
aauacagauggcaugugaagau

SEQ ID NO: 211502 - RNA, 21 nt, Human
uuccauggacccugucagugu

SEQ ID NO: 211503 - RNA, 22 nt, Human
agucacuguucugucaugucaa

SEQ ID NO: 211504 - RNA, 22 nt, Human
cccagaggcugaguugggagca

SEQ ID NO: 211505 - RNA, 22 nt, Human
ucuggguaacugaggcuaauau

SEQ ID NO: 211506 - RNA, 22 nt, Human
uuuaaguuaguauggguuaggu

SEQ ID NO: 211507 - RNA, 22 nt, Human
uuggaaauguagaaaagcagau

SEQ ID NO: 211508 - RNA, 22 nt, Human
gcaguuugugauguggcaguca

SEQ ID NO: 211509 - RNA, 22 nt, Human
gaaggcuguggcuggucucagu

SEQ ID NO: 211510 - RNA, 19 nt, Human
gggcucucugaauuuuuuu

SEQ ID NO: 211511 - RNA, 22 nt, Human
auacauauaugcacauuaauau

SEQ ID NO: 211512 - RNA, 22 nt, Human
agccugggucgagagacgagaa

SEQ ID NO: 211513 - RNA, 22 nt, Human
gcggggcucuacuuggccugga

SEQ ID NO: 211514 - RNA, 22 nt, Human
aaaggagugaaaugagaggaaa

SEQ ID NO: 211515 - RNA, 22 nt, Human
aacacuaaaggucaguuagaag

SEQ ID NO: 211516 - RNA, 22 nt, Human
uugcagagaacuaaagggagua

SEQ ID NO: 211517 - RNA, 22 nt, Human
uugaauaaggcauaaagauacu

SEQ ID NO: 211518 - RNA, 22 nt, Human
uguacagauaucaggagugagg

SEQ ID NO: 211519 - RNA, 22 nt, Human
cuggugggucacgugugggugg

SEQ ID NO: 211520 - RNA, 22 nt, Human
aucuacuuugggaguuucucuu

SEQ ID NO: 211521 - RNA, 22 nt, Human
ugagggauuucuggccuuaacu

SEQ ID NO: 211522 - RNA, 22 nt, Human
ugggaaggggagcuggaaagga

SEQ ID NO: 211523 - RNA, 22 nt, Human
uggguucaaauccugguuccac

SEQ ID NO: 211524 - RNA, 22 nt, Human
uucuugugugaauauaauuaca

SEQ ID NO: 211525 - RNA, 22 nt, Human
cacaugugugugccuacaugca

SEQ ID NO: 211526 - RNA, 22 nt, Human
ggaagcuguugugagugcagca

SEQ ID NO: 211527 - RNA, 22 nt, Human
ccagcaaguaagucagugucag

SEQ ID NO: 211528 - RNA, 22 nt, Human
ccucuccuugcuccccuuccuu

SEQ ID NO: 211529 - RNA, 22 nt, Human
uuuaggauaacuccaguuuucc

SEQ ID NO: 211530 - RNA, 22 nt, Human
uaaaugauaguauugaagguag

SEQ ID NO: 211531 - RNA, 22 nt, Human
uagccucuggaauccuuucucu

SEQ ID NO: 211532 - RNA, 22 nt, Human
cuggcgagcugggccuggggga

SEQ ID NO: 211533 - RNA, 22 nt, Human
gcuggaaauaacuuguguagaa

SEQ ID NO: 211534 - RNA, 22 nt, Human
aaucauaacaaaagcaauuaua

SEQ ID NO: 211535 - RNA, 22 nt, Human
guuuuaucuauguaauuauaaa

SEQ ID NO: 211536 - RNA, 22 nt, Human
gacauuuauuggauuuuacgag

SEQ ID NO: 211537 - RNA, 22 nt, Human
augcacuugacucuauuccaca

SEQ ID NO: 211538 - RNA, 22 nt, Human
acuuuuccuggguagcuccugg

SEQ ID NO: 211539 - RNA, 22 nt, Human
uuuugccuauuguaucaucgua

SEQ ID NO: 211540 - RNA, 22 nt, Human
cggguccuucugucuucucugg

SEQ ID NO: 211541 - RNA, 22 nt, Human
gggcgcuguguuaggugcugua

SEQ ID NO: 211542 - RNA, 22 nt, Human
ugugauugucuucugaaaguca

SEQ ID NO: 211543 - RNA, 22 nt, Human
augugcacuggugugugcguuc

SEQ ID NO: 211544 - RNA, 22 nt, Human
uggcuucuggccaggcacagga

SEQ ID NO: 211545 - RNA, 22 nt, Human
uggagaugcacgagcaggugga

SEQ ID NO: 211546 - RNA, 21 nt, Human
acugggcuagccugacuucug

SEQ ID NO: 211547 - RNA, 22 nt, Human
uuccucauuuggcacaucugag

SEQ ID NO: 211548 - RNA, 22 nt, Human
uccucagcaaacacuucacucu

SEQ ID NO: 211549 - RNA, 22 nt, Human
aauggaaaggagccugacuaua

SEQ ID NO: 211550 - RNA, 22 nt, Human
gaucccaguccuacccucauaa

SEQ ID NO: 211551 - RNA, 22 nt, Human
uuguacaaauaggaaccucuga

SEQ ID NO: 211552 - RNA, 22 nt, Human
ggaggucagcuggaggggaggc

SEQ ID NO: 211553 - RNA, 22 nt, Human
ucucucagauuguuuccauuuu

SEQ ID NO: 211554 - RNA, 22 nt, Human
aucuaaaacuacgaauacuacc

SEQ ID NO: 211555 - RNA, 22 nt, Human
agggaguagggagccaugggug

SEQ ID NO: 211556 - RNA, 22 nt, Human
auaaggaaagugagugcuuaaa

SEQ ID NO: 211557 - RNA, 22 nt, Human
auuuuuuuuccugucucuuuca

SEQ ID NO: 211558 - RNA, 22 nt, Human
uccauucccugacagccucuuu

SEQ ID NO: 211559 - RNA, 22 nt, Human
caggaacagcaccaggagcuag

SEQ ID NO: 211560 - RNA, 22 nt, Human
ggaggcggaaguccaagcaggu

SEQ ID NO: 211561 - RNA, 22 nt, Human
cuuccuuucagaggaaggccug

SEQ ID NO: 211562 - RNA, 22 nt, Human
uggugguaggggugguuucuga

SEQ ID NO: 211563 - RNA, 22 nt, Human
cagaaaaaaaugcagacuagca

SEQ ID NO: 211564 - RNA, 20 nt, Human
ccugggcuccaggagccccg

SEQ ID NO: 211565 - RNA, 22 nt, Human
uucaaguucccucagggagccc

SEQ ID NO: 211566 - RNA, 22 nt, Human
acacacaugccuuuccuaagua

SEQ ID NO: 211567 - RNA, 22 nt, Human
aucuguuccccuaugcucucua

SEQ ID NO: 211568 - RNA, 22 nt, Human
acuggagcccguggaggcgcag

SEQ ID NO: 211569 - RNA, 22 nt, Human
cuguccugauggugccacuggu

SEQ ID NO: 211570 - RNA, 22 nt, Human
auggaguguggccaggcaguaa

SEQ ID NO: 211571 - RNA, 22 nt, Human
gaaugcauuuuuuaaaagcaua

SEQ ID NO: 211572 - RNA, 20 nt, Human
uggagggaggaggggcccaa

SEQ ID NO: 211573 - RNA, 22 nt, Human
gcugcuggcggagcuggcgcug

SEQ ID NO: 211574 - RNA, 22 nt, Human
augcacaagguagauuauuauu

SEQ ID NO: 211575 - RNA, 23 nt, Human
ucagaccaaccucuugcuggaac

SEQ ID NO: 211576 - RNA, 22 nt, Human
uccugcuucaaucugcugcugg

SEQ ID NO: 211577 - RNA, 22 nt, Human
auuuagagaaguagcaaggucc

SEQ ID NO: 211578 - RNA, 20 nt, Human
ucugugugccaucaccuaac

SEQ ID NO: 211579 - RNA, 22 nt, Human
uaagacuuuaccaggcucaaau

SEQ ID NO: 211580 - RNA, 22 nt, Human
uuccagaacaauguggacguau

SEQ ID NO: 211581 - RNA, 22 nt, Human
gugcacagaaacauacaaugug

SEQ ID NO: 211582 - RNA, 22 nt, Human
ggccaaagagcacaaugaauag

SEQ ID NO: 211583 - RNA, 22 nt, Human
ggcugcagugcaacucuuucua

SEQ ID NO: 211584 - RNA, 22 nt, Human
agcugaggccccgcagcagggu

SEQ ID NO: 211585 - RNA, 22 nt, Human
auuggaagacgcuggaggcacu

SEQ ID NO: 211586 - RNA, 22 nt, Human
cugaggcuaauagaauuuucug

SEQ ID NO: 211587 - RNA, 22 nt, Human
uguaguguuuagucuagugucg

SEQ ID NO: 211588 - RNA, 22 nt, Human
auauuguagcaucacugucuug

SEQ ID NO: 211589 - RNA, 22 nt, Human
gcaaagaauugauucauuuugc

SEQ ID NO: 211590 - RNA, 22 nt, Human
uggcagaaugaagacuggggcc

SEQ ID NO: 211591 - RNA, 22 nt, Human
gaucauauccagucaccacuau

SEQ ID NO: 211592 - RNA, 19 nt, Human
ugcagcuguaugagcuuaa

SEQ ID NO: 211593 - RNA, 22 nt, Human
ugauucacagacuucacaaggc

SEQ ID NO: 211594 - RNA, 22 nt, Human
uggugacaucuaccuagguaaa

SEQ ID NO: 211595 - RNA, 21 nt, Human
ggcugcucgugaugaacuuca

SEQ ID NO: 211596 - RNA, 22 nt, Human
uucuuagauuuuauuucuucug

SEQ ID NO: 211597 - RNA, 22 nt, Human
acaugggggugggacggcagag

SEQ ID NO: 211598 - RNA, 22 nt, Human
ucugaccaggcucuuguagccu

SEQ ID NO: 211599 - RNA, 22 nt, Human
gcagcccucuuggucacuaggc

SEQ ID NO: 211600 - RNA, 20 nt, Human
ucugcuugucuucagguucc

SEQ ID NO: 211601 - RNA, 22 nt, Human
gcagggcucagccgcucccacc

SEQ ID NO: 211602 - RNA, 22 nt, Human
uuauuguagcacuuuggcagug

SEQ ID NO: 211603 - RNA, 22 nt, Human
acuuuauacuagugauaguuug

SEQ ID NO: 211604 - RNA, 22 nt, Human
ggaaauauaagcaguuugugug

SEQ ID NO: 211605 - RNA, 22 nt, Human
ccagccugagcuugcugcccuc

SEQ ID NO: 211606 - RNA, 23 nt, Human
gaugauggcaacuacauccggug

SEQ ID NO: 211607 - RNA, 22 nt, Human
uaaccuugaagacugagcugac

SEQ ID NO: 211608 - RNA, 22 nt, Human
acuuuugaguuacauaccugaa

SEQ ID NO: 211609 - RNA, 22 nt, Human
agacuucucuuggcuauauuau

SEQ ID NO: 211610 - RNA, 22 nt, Human
cuucuuuuggggaugaaaaugg

SEQ ID NO: 211611 - RNA, 22 nt, Human
aggaaauaguuuagucccaaaa

SEQ ID NO: 211612 - RNA, 18 nt, Human
uuuccucauuugcagacu

SEQ ID NO: 211613 - RNA, 22 nt, Human
acacuuuugcgagagcaugcag

SEQ ID NO: 211614 - RNA, 22 nt, Human
agccacagucuguagccagcuu

SEQ ID NO: 211615 - RNA, 22 nt, Human
auccuccuggggcagucuuccc

SEQ ID NO: 211616 - RNA, 22 nt, Human
auauaguacauguauauauaua

SEQ ID NO: 211617 - RNA, 22 nt, Human
auggggaucugcaguguugauc

SEQ ID NO: 211618 - RNA, 22 nt, Human
aagugugugugcgcaugugcau

SEQ ID NO: 211619 - RNA, 20 nt, Human
ucuucagcuccaagucuggc

SEQ ID NO: 211620 - RNA, 22 nt, Human
uguggugcucagggaggauggg

SEQ ID NO: 211621 - RNA, 22 nt, Human
uacauguggagauaacugaagc

SEQ ID NO: 211622 - RNA, 22 nt, Human
uggagccuugugagaccacaau

SEQ ID NO: 211623 - RNA, 22 nt, Human
guugauuuaggguuuugguuuu

SEQ ID NO: 211624 - RNA, 23 nt, Human
ugaagugaaauuucacaagggac

SEQ ID NO: 211625 - RNA, 22 nt, Human
caggguaguaauuuaauacaag

SEQ ID NO: 211626 - RNA, 22 nt, Human
gaggcaggaagggaggguugug

SEQ ID NO: 211627 - RNA, 22 nt, Human
ugagagggagacagcucuagca

SEQ ID NO: 211628 - RNA, 22 nt, Human
augaccuucuuuccuuaaauuu

SEQ ID NO: 211629 - RNA, 22 nt, Human
ggguuguagagcuggaagggga

SEQ ID NO: 211630 - RNA, 22 nt, Human
gugcugggaggcccaggaugga

SEQ ID NO: 211631 - RNA, 22 nt, Human
aaacacacaacauauuuuggaa

SEQ ID NO: 211632 - RNA, 22 nt, Human
aucuuaguuauuuggagaaacc

SEQ ID NO: 211633 - RNA, 22 nt, Human
cugggugggcacccagccuggg

SEQ ID NO: 211634 - RNA, 18 nt, Human
uuuacgaacucacuugag

SEQ ID NO: 211635 - RNA, 22 nt, Human
ucagcuucaucuugagcccaca

SEQ ID NO: 211636 - RNA, 22 nt, Human
uugcaucagcaggcauaauugg

SEQ ID NO: 211637 - RNA, 22 nt, Human
gacaagaugacaucauggcuuc

SEQ ID NO: 211638 - RNA, 21 nt, Human
uguggccauuugaaaacaggg

SEQ ID NO: 211639 - RNA, 22 nt, Human
cacacagcuagugacaggagaa

SEQ ID NO: 211640 - RNA, 22 nt, Human
ucuguuucaggggucuggaaug

SEQ ID NO: 211641 - RNA, 22 nt, Human
gcuguggacacagcucucuuca

SEQ ID NO: 211642 - RNA, 22 nt, Human
ucacagauguuauccugaggau

SEQ ID NO: 211643 - RNA, 22 nt, Human
uauuuuuacuguuugaugauuc

SEQ ID NO: 211644 - RNA, 22 nt, Human
ucuuuaucugugagcagucucc

SEQ ID NO: 211645 - RNA, 22 nt, Human
ugcacacaguucucaggaaaga

SEQ ID NO: 211646 - RNA, 22 nt, Human
ugcaggagcaccagcucacccu

SEQ ID NO: 211647 - RNA, 22 nt, Human
aagaaaggcacaagaaagaaaa

SEQ ID NO: 211648 - RNA, 22 nt, Human
cucugauuuuucuaauacuuca

SEQ ID NO: 211649 - RNA, 21 nt, Human
ucuggccuauaaaguagucgc

SEQ ID NO: 211650 - RNA, 22 nt, Human
ccugggcucgcgcacuucaccc

SEQ ID NO: 211651 - RNA, 22 nt, Human
ggucccacgauguaccugucug

SEQ ID NO: 211652 - RNA, 22 nt, Human
ucccugagagacuucuuuggcu

SEQ ID NO: 211653 - RNA, 18 nt, Human
gaugaagaggaagaggag

SEQ ID NO: 211654 - RNA, 22 nt, Human
uccuuucaaauuuauuugacau

SEQ ID NO: 211655 - RNA, 22 nt, Human
cucggggcguggcaguagcaug

SEQ ID NO: 211656 - RNA, 22 nt, Human
ugcucacugcuuguguucaguu

SEQ ID NO: 211657 - RNA, 23 nt, Human
uguuccugaugccucguccuguc

SEQ ID NO: 211658 - RNA, 22 nt, Human
aagugguuuauuguaugguuuu

SEQ ID NO: 211659 - RNA, 22 nt, Human
uaggguagugggaaacuggacg

SEQ ID NO: 211660 - RNA, 22 nt, Human
uggaaggaaauguguaucauaa

SEQ ID NO: 211661 - RNA, 19 nt, Human
uuacaugacauaugaagga

SEQ ID NO: 211662 - RNA, 22 nt, Human
uauuuuaaaagcauuaauucuu

SEQ ID NO: 211663 - RNA, 22 nt, Human
cgaggagguccaggagcaguag

SEQ ID NO: 211664 - RNA, 22 nt, Human
ugcaggagcccaggaauacuau

SEQ ID NO: 211665 - RNA, 22 nt, Human
agcccugugugcuuguguuccu

SEQ ID NO: 211666 - RNA, 22 nt, Human
ggggaaggaaggggagggcacg

SEQ ID NO: 211667 - RNA, 22 nt, Human
gagauggauuuuuuugccaguc

SEQ ID NO: 211668 - RNA, 22 nt, Human
gaaaugucaagauauguuugga

SEQ ID NO: 211669 - RNA, 22 nt, Human
gugcuggcaaagagaacaucuu

SEQ ID NO: 211670 - RNA, 22 nt, Human
uagugcauaccuaacauuuuug

SEQ ID NO: 211671 - RNA, 22 nt, Human
cugagaaauacccaagucuggu

SEQ ID NO: 211672 - RNA, 22 nt, Human
uggaaaacgcaguuuaauuuuu

SEQ ID NO: 211673 - RNA, 22 nt, Human
gagcagcucgagaaggaagcag

SEQ ID NO: 211674 - RNA, 22 nt, Human
aaaaguauaagugucuccugau

SEQ ID NO: 211675 - RNA, 22 nt, Human
caaaggaauuacauguuucgga

SEQ ID NO: 211676 - RNA, 22 nt, Human
ggaggguggaggagggaauuga

SEQ ID NO: 211677 - RNA, 22 nt, Human
aaauauauauaauauauauauu

SEQ ID NO: 211678 - RNA, 21 nt, Human
agugagauuuaugccugguuc

SEQ ID NO: 211679 - RNA, 22 nt, Human
ccugaggcccuggcugugcuga

SEQ ID NO: 211680 - RNA, 22 nt, Human
gagcagcacagaccaaacagaa

SEQ ID NO: 211681 - RNA, 22 nt, Human
gagcagguuauuagaaauggaa

SEQ ID NO: 211682 - RNA, 22 nt, Human
gcucugcuccaucuguuuccuc

SEQ ID NO: 211683 - RNA, 22 nt, Human
ugcagcaucuccuugugccaug

SEQ ID NO: 211684 - RNA, 22 nt, Human
gaaggaagcugucuggaugugu

SEQ ID NO: 211685 - RNA, 19 nt, Human
acaggaaggaaaauuucaa

SEQ ID NO: 211686 - RNA, 22 nt, Human
ggaugcagcagagaccuggagu

SEQ ID NO: 211687 - RNA, 22 nt, Human
ccugccugggcucacuugccag

SEQ ID NO: 211688 - RNA, 22 nt, Human
caggcacaagaucggcuagaua

SEQ ID NO: 211689 - RNA, 18 nt, Human
cauuguacaaugcuuuau

SEQ ID NO: 211690 - RNA, 22 nt, Human
aaauagucagaaaucaacgugc

SEQ ID NO: 211691 - RNA, 22 nt, Human
gaaaaucaggauggaugugagg

SEQ ID NO: 211692 - RNA, 22 nt, Human
augggaggguagagugaacaga

SEQ ID NO: 211693 - RNA, 22 nt, Human
auauucaaugaggucauauaag

SEQ ID NO: 211694 - RNA, 22 nt, Human
augguugggggaugucagcagg

SEQ ID NO: 211695 - RNA, 22 nt, Human
uuggcguuuccuguucugggug

SEQ ID NO: 211696 - RNA, 22 nt, Human
caacuucuauucagucugcagu

SEQ ID NO: 211697 - RNA, 22 nt, Human
ggcuccagauguccccuggcaa

SEQ ID NO: 211698 - RNA, 22 nt, Human
ugguugguuaaugugcccauuu

SEQ ID NO: 211699 - RNA, 22 nt, Human
ugcacagagggaggcauaaaau

SEQ ID NO: 211700 - RNA, 22 nt, Human
ugugacaugauggcgucaugua

SEQ ID NO: 211701 - RNA, 22 nt, Human
auauaagauaauaacuuuuuua

SEQ ID NO: 211702 - RNA, 22 nt, Human
aaaacuuucagggauacagaaa

SEQ ID NO: 211703 - RNA, 22 nt, Human
aaaguugcauccuaugaccuca

SEQ ID NO: 211704 - RNA, 22 nt, Human
uguaaauucuauacacuuaaaa

SEQ ID NO: 211705 - RNA, 22 nt, Human
aaaauauaaaggauguggguuu

SEQ ID NO: 211706 - RNA, 22 nt, Human
guuaguucccaccccuguaaga

SEQ ID NO: 211707 - RNA, 22 nt, Human
auuuuauuuugggaucuuuuua

SEQ ID NO: 211708 - RNA, 22 nt, Human
cagcuuguucugaccugugauu

SEQ ID NO: 211709 - RNA, 22 nt, Human
gagggggcggccccugugggca

SEQ ID NO: 211710 - RNA, 22 nt, Human
uagccaaguguuuuucaugacc

SEQ ID NO: 211711 - RNA, 22 nt, Human
uugugugugcccaccuguggcc

SEQ ID NO: 211712 - RNA, 22 nt, Human
agcccagguggagugugugggg

SEQ ID NO: 211713 - RNA, 22 nt, Human
ugcaggaacucgaaaacuauag

SEQ ID NO: 211714 - RNA, 22 nt, Human
gggcagagagcuggaacuccuu

SEQ ID NO: 211715 - RNA, 22 nt, Human
uuuaucaucuucugaauuugga

SEQ ID NO: 211716 - RNA, 22 nt, Human
uuuucuacaaaucuggacuuuu

SEQ ID NO: 211717 - RNA, 22 nt, Human
uuuaguugcuuuaguugagcug

SEQ ID NO: 211718 - RNA, 22 nt, Human
uuucuacauuuguaaccagauu

SEQ ID NO: 211719 - RNA, 22 nt, Human
aucauuaacagugcagggguag

SEQ ID NO: 211720 - RNA, 22 nt, Human
aaauuaaaguuuuauuuagagc

SEQ ID NO: 211721 - RNA, 22 nt, Human
ccuucugcuggucaucccagug

SEQ ID NO: 211722 - RNA, 22 nt, Human
aagaugaucagagggcaagagg

SEQ ID NO: 211723 - RNA, 22 nt, Human
ggagcucacuacgaaauaagcu

SEQ ID NO: 211724 - RNA, 22 nt, Human
gagagucuuaaguuacagaacu

SEQ ID NO: 211725 - RNA, 22 nt, Human
aaagggagauaaaguaauuuua

SEQ ID NO: 211726 - RNA, 23 nt, Human
uugcuuuugccccaaaagaguua

SEQ ID NO: 211727 - RNA, 21 nt, Human
uccugccuggccuucugacua

SEQ ID NO: 211728 - RNA, 22 nt, Human
ggcugguggcgggcagcacaga

SEQ ID NO: 211729 - RNA, 22 nt, Human
cucuccaguuauagcugauuug

SEQ ID NO: 211730 - RNA, 22 nt, Human
aacaaaacauuuuacgaauaua

SEQ ID NO: 211731 - RNA, 20 nt, Human
uuuuuuaaauagagcuguug

SEQ ID NO: 211732 - RNA, 22 nt, Human
agugaggggagaaugaggugga

SEQ ID NO: 211733 - RNA, 22 nt, Human
ugcagacuguuucuugacugaa

SEQ ID NO: 211734 - RNA, 22 nt, Human
guguguauguagguauauaugu

SEQ ID NO: 211735 - RNA, 22 nt, Human
aucuuuuuucacaauuuauuuu

SEQ ID NO: 211736 - RNA, 23 nt, Human
auuaugaagaagacucgccuguu

SEQ ID NO: 211737 - RNA, 22 nt, Human
agauggggccugaggacacugu

SEQ ID NO: 211738 - RNA, 22 nt, Human
ugaauaaauaaacuuuuacuac

SEQ ID NO: 211739 - RNA, 22 nt, Human
ccuacccucaagggccuggggg

SEQ ID NO: 211740 - RNA, 22 nt, Human
aauguuuaagcuuuuauuuaca

SEQ ID NO: 211741 - RNA, 22 nt, Human
aggagguagggugugaaacagc

SEQ ID NO: 211742 - RNA, 22 nt, Human
ccagugagauagugguauaugc

SEQ ID NO: 211743 - RNA, 22 nt, Human
agcagcaggugaccucgaugcc

SEQ ID NO: 211744 - RNA, 22 nt, Human
aacuuagagcucuccuaaauga

SEQ ID NO: 211745 - RNA, 22 nt, Human
cgguccugcucuuccucccguu

SEQ ID NO: 211746 - RNA, 22 nt, Human
uguguuucggauagcagauucu

SEQ ID NO: 211747 - RNA, 22 nt, Human
uccucuucucuagagccggaau

SEQ ID NO: 211748 - RNA, 22 nt, Human
auccugugggguauugcugcau

SEQ ID NO: 211749 - RNA, 22 nt, Human
gcaggaagauugcagaaggcug

SEQ ID NO: 211750 - RNA, 22 nt, Human
ugaguuuuggaagauguuacag

SEQ ID NO: 211751 - RNA, 22 nt, Human
auucauuuuuacaucaccaaua

SEQ ID NO: 211752 - RNA, 22 nt, Human
uguaauuugguuagauuucuuu

SEQ ID NO: 211753 - RNA, 22 nt, Human
ucugaaauuuuaguuauagaaa

SEQ ID NO: 211754 - RNA, 22 nt, Human
auacagccuaguuugaguccca

SEQ ID NO: 211755 - RNA, 22 nt, Human
uguugaaacagcuauugacuuu

SEQ ID NO: 211756 - RNA, 22 nt, Human
caggaggaaaguuccacucaac

SEQ ID NO: 211757 - RNA, 22 nt, Human
uuucagaaauggcacugaaauc

SEQ ID NO: 211758 - RNA, 22 nt, Human
aggcaguggagcuggaauaggc

SEQ ID NO: 211759 - RNA, 22 nt, Human
uuuuuaaaauuaggacggcacg

SEQ ID NO: 211760 - RNA, 22 nt, Human
ccagugcagacgcggaacuggc

SEQ ID NO: 211761 - RNA, 22 nt, Human
guagccacugaaguaaggccac

SEQ ID NO: 211762 - RNA, 23 nt, Human
aaauaauaauuucucuguuggga

SEQ ID NO: 211763 - RNA, 22 nt, Human
cuugcuuuaucugguuucucau

SEQ ID NO: 211764 - RNA, 22 nt, Human
uccagagcuguccuacugugag

SEQ ID NO: 211765 - RNA, 22 nt, Human
auggauggaagcagccugaacu

SEQ ID NO: 211766 - RNA, 22 nt, Human
uuggggaggaagauagggugaa

SEQ ID NO: 211767 - RNA, 17 nt, Human
cccugcauugauccuca

SEQ ID NO: 211768 - RNA, 22 nt, Human
cuucuuaaaguugucacagcug

SEQ ID NO: 211769 - RNA, 22 nt, Human
uucauauuguggucuugcauuc

SEQ ID NO: 211770 - RNA, 22 nt, Human
gauuuuuaaaaguaguuuugaa

SEQ ID NO: 211771 - RNA, 22 nt, Human
auaguaaauguuaacagcaaca

SEQ ID NO: 211772 - RNA, 22 nt, Human
cuuuuucaugggugaugagugg

SEQ ID NO: 211773 - RNA, 22 nt, Human
cagaggagcgaguuggacgcca

SEQ ID NO: 211774 - RNA, 22 nt, Human
aauuauguuugcuuuagaugga

SEQ ID NO: 211775 - RNA, 22 nt, Human
gagggggaaaagggcagcagag

SEQ ID NO: 211776 - RNA, 19 nt, Human
ucuguggccuucccugaug

SEQ ID NO: 211777 - RNA, 22 nt, Human
uaaguuguagaacguuuucuua

SEQ ID NO: 211778 - RNA, 22 nt, Human
uggucccugaagagagaccuug

SEQ ID NO: 211779 - RNA, 22 nt, Human
aaguagccuguuauguaguuca

SEQ ID NO: 211780 - RNA, 20 nt, Human
ugauuauuccaacaagaaug

SEQ ID NO: 211781 - RNA, 22 nt, Human
ugccccagcacauuuacuaucc

SEQ ID NO: 211782 - RNA, 22 nt, Human
cggggugugacggugcgggccu

SEQ ID NO: 211783 - RNA, 22 nt, Human
uuucucuuucaaucugcaguac

SEQ ID NO: 211784 - RNA, 18 nt, Human
uuugggauccucuuuucu

SEQ ID NO: 211785 - RNA, 22 nt, Human
acuucuuuugcaugauucuuua

SEQ ID NO: 211786 - RNA, 20 nt, Human
acuuucacaugaacauuuaa

SEQ ID NO: 211787 - RNA, 22 nt, Human
cuggccagccucccagguaccc

SEQ ID NO: 211788 - RNA, 22 nt, Human
ccuuuuaucgcgaagaacucca

SEQ ID NO: 211789 - RNA, 21 nt, Human
uccugcagggcagcagagugg

SEQ ID NO: 211790 - RNA, 22 nt, Human
cuguuaucaggaguuuucacgg

SEQ ID NO: 211791 - RNA, 22 nt, Human
uccacagcagagcacgguaccu

SEQ ID NO: 211792 - RNA, 22 nt, Human
uugucaggaacuaugauuaugc

SEQ ID NO: 211793 - RNA, 22 nt, Human
ucuggcuucaguaggguucacu

SEQ ID NO: 211794 - RNA, 22 nt, Human
gaguucaaagaucuaggaagag

SEQ ID NO: 211795 - RNA, 22 nt, Human
aagaaaagguaaccgcuuaucu

SEQ ID NO: 211796 - RNA, 22 nt, Human
uguacauuuacaaaagcuuuau

SEQ ID NO: 211797 - RNA, 22 nt, Human
gagggcucaacuacuacuaggc

SEQ ID NO: 211798 - RNA, 23 nt, Human
uccccagcugcccgugucccggg

SEQ ID NO: 211799 - RNA, 22 nt, Human
acugaggaagccugucaucauc

SEQ ID NO: 211800 - RNA, 22 nt, Human
uugcuuuuuuggguuuacuggg

SEQ ID NO: 211801 - RNA, 22 nt, Human
aagccucaugccagauccaggu

SEQ ID NO: 211802 - RNA, 22 nt, Human
ugagcaccaggcaccacagcuc

SEQ ID NO: 211803 - RNA, 22 nt, Human
uuuuccuuaacagagggagaaa

SEQ ID NO: 211804 - RNA, 20 nt, Human
acuagaaagucacugggggg

SEQ ID NO: 211805 - RNA, 22 nt, Human
augcccugggagugcuguacca

SEQ ID NO: 211806 - RNA, 22 nt, Human
gccuucauuggaaucuagcuuc

SEQ ID NO: 211807 - RNA, 22 nt, Human
ucuaggcugugugugggcaggg

SEQ ID NO: 211808 - RNA, 22 nt, Human
accaggaguuuugaccaggggc

SEQ ID NO: 211809 - RNA, 22 nt, Human
aguagggugaggaggggaguga

SEQ ID NO: 211810 - RNA, 22 nt, Human
gguauccaaauaaagcagguaa

SEQ ID NO: 211811 - RNA, 22 nt, Human
uugaaaaaaucugaggaggacc

SEQ ID NO: 211812 - RNA, 22 nt, Human
uuuacaaggcaguuauuuuccu

SEQ ID NO: 211813 - RNA, 22 nt, Human
auuuucauauggguuauuugua

SEQ ID NO: 211814 - RNA, 22 nt, Human
cugggggacagagagaggcggu

SEQ ID NO: 211815 - RNA, 22 nt, Human
ccauaaaguaggaaacacuaca

SEQ ID NO: 211816 - RNA, 19 nt, Human
accaaacaguggacggagc

SEQ ID NO: 211817 - RNA, 22 nt, Human
agagaaauguacuagucuaacu

SEQ ID NO: 211818 - RNA, 22 nt, Human
ucagugagauuuuuagcaguag

SEQ ID NO: 211819 - RNA, 22 nt, Human
uccucccugcacucagugaagu

SEQ ID NO: 211820 - RNA, 22 nt, Human
cuagcagaagcuccuugagggu

SEQ ID NO: 211821 - RNA, 22 nt, Human
accucuuucuauggauuuuuug

SEQ ID NO: 211822 - RNA, 22 nt, Human
guuuaucagagagcagaggugg

SEQ ID NO: 211823 - RNA, 22 nt, Human
uggagagcaggugaaggaaaga

SEQ ID NO: 211824 - RNA, 19 nt, Human
acagccuguugguggggcu

SEQ ID NO: 211825 - RNA, 22 nt, Human
guaaauacuaugagauaaugaa

SEQ ID NO: 211826 - RNA, 22 nt, Human
uauuucaugagugaauaucuag

SEQ ID NO: 211827 - RNA, 22 nt, Human
gugucacuuucaggagcucuaa

SEQ ID NO: 211828 - RNA, 22 nt, Human
uuuccuuaauuguaaaauggag

SEQ ID NO: 211829 - RNA, 22 nt, Human
gauacugugggcacucauaaua

SEQ ID NO: 211830 - RNA, 22 nt, Human
aaagcugaaacgaaaugacaac

SEQ ID NO: 211831 - RNA, 22 nt, Human
acuacccugaccaaguauuuua

SEQ ID NO: 211832 - RNA, 22 nt, Human
cagaggauggaaaugagaacaa

SEQ ID NO: 211833 - RNA, 19 nt, Human
acacaccagugccugugac

SEQ ID NO: 211834 - RNA, 22 nt, Human
guggcauggggagcagcuagaa

SEQ ID NO: 211835 - RNA, 22 nt, Human
uuugcuuugacuuugggaguau

SEQ ID NO: 211836 - RNA, 22 nt, Human
aaaauuuccuuggaccauuuuu

SEQ ID NO: 211837 - RNA, 22 nt, Human
uagucuuuguggucuuuagcua

SEQ ID NO: 211838 - RNA, 22 nt, Human
ugucuuaaaauuuuagggcuau

SEQ ID NO: 211839 - RNA, 22 nt, Human
augcacuacuagaugcaaaagu

SEQ ID NO: 211840 - RNA, 22 nt, Human
ucacaugcucaccuaagccaca

SEQ ID NO: 211841 - RNA, 22 nt, Human
uaguauuuguaauuaucaaagc

SEQ ID NO: 211842 - RNA, 22 nt, Human
uugccaggagacaucuggagcc

SEQ ID NO: 211843 - RNA, 22 nt, Human
augcuuucucuucuauuucuca

SEQ ID NO: 211844 - RNA, 22 nt, Human
cuggauagaggaugguaggcac

SEQ ID NO: 211845 - RNA, 22 nt, Human
cccuguccuucccuccaucuga

SEQ ID NO: 211846 - RNA, 22 nt, Human
auggcaucuucgguuggacugc

SEQ ID NO: 211847 - RNA, 22 nt, Human
gaugccuccaggaaagaggacg

SEQ ID NO: 211848 - RNA, 22 nt, Human
aucagagcuaguacuugcaggu

SEQ ID NO: 211849 - RNA, 22 nt, Human
uggaaggugauucucugguuaa

SEQ ID NO: 211850 - RNA, 22 nt, Human
cacaauuuccauugagcagcag

SEQ ID NO: 211851 - RNA, 22 nt, Human
cuguggaguccuggggaaugga

SEQ ID NO: 211852 - RNA, 20 nt, Human
agugauuuguuaguacauug

SEQ ID NO: 211853 - RNA, 22 nt, Human
gcccagccucagggcaucagcu

SEQ ID NO: 211854 - RNA, 22 nt, Human
uuucacagcgucuuucucuugc

SEQ ID NO: 211855 - RNA, 22 nt, Human
gagaggguugggaggcagcaga

SEQ ID NO: 211856 - RNA, 22 nt, Human
acaugcuucauauuauaaccaa

SEQ ID NO: 211857 - RNA, 17 nt, Human
uagccagcuugugauuu

SEQ ID NO: 211858 - RNA, 22 nt, Human
uccacuguguagucucccaagu

SEQ ID NO: 211859 - RNA, 22 nt, Human
uuaagagaagaguaucuagaac

SEQ ID NO: 211860 - RNA, 22 nt, Human
ccagggacuauuaguuguguau

SEQ ID NO: 211861 - RNA, 22 nt, Human
ucccaaguguuuggcgaggaga

SEQ ID NO: 211862 - RNA, 22 nt, Human
ugcauguuucuguauguuaaug

SEQ ID NO: 211863 - RNA, 22 nt, Human
gcuuucagggucacugucaaca

SEQ ID NO: 211864 - RNA, 22 nt, Human
ccacccugguuacugugccagg

SEQ ID NO: 211865 - RNA, 22 nt, Human
aagagaggaaagggugugaggu

SEQ ID NO: 211866 - RNA, 22 nt, Human
uuauuguuuggguauaauuuga

SEQ ID NO: 211867 - RNA, 22 nt, Human
ucccucacacagcugggagaac

SEQ ID NO: 211868 - RNA, 22 nt, Human
uguguuguuggggauguuuuca

SEQ ID NO: 211869 - RNA, 22 nt, Human
ucagaaggagagacagcgugga

SEQ ID NO: 211870 - RNA, 22 nt, Human
cggaggcugcuuucuguugcua

SEQ ID NO: 211871 - RNA, 22 nt, Human
uggaaaagaugucuuccugaau

SEQ ID NO: 211872 - RNA, 22 nt, Human
uggcucacaggaggcagaggug

SEQ ID NO: 211873 - RNA, 22 nt, Human
gccauauucaugcaggugcuaa

SEQ ID NO: 211874 - RNA, 22 nt, Human
acagccaacgucuuucuuacuu

SEQ ID NO: 211875 - RNA, 22 nt, Human
aggccacucagggggccaagau

SEQ ID NO: 211876 - RNA, 22 nt, Human
gcagcauuaccaagacauggca

SEQ ID NO: 211877 - RNA, 22 nt, Human
uggaaggggagcuggaaagggg

SEQ ID NO: 211878 - RNA, 19 nt, Human
cuacaguguuuuucuuucc

SEQ ID NO: 211879 - RNA, 22 nt, Human
uuugauuuuuugagcaguguau

SEQ ID NO: 211880 - RNA, 22 nt, Human
guagaaaauagauugucucuug

SEQ ID NO: 211881 - RNA, 22 nt, Human
gugggugaguggggccgccuga

SEQ ID NO: 211882 - RNA, 18 nt, Human
aguuuuuuuggcaaaagg

SEQ ID NO: 211883 - RNA, 22 nt, Human
agcugugaccuucaagagcuac

SEQ ID NO: 211884 - RNA, 22 nt, Human
ucuuuuucccugguuccuuuuu

SEQ ID NO: 211885 - RNA, 19 nt, Human
agugaacuccauaucaggu

SEQ ID NO: 211886 - RNA, 22 nt, Human
accccagcucugagccacacca

SEQ ID NO: 211887 - RNA, 22 nt, Human
cagaggcugggugggguggggg

SEQ ID NO: 211888 - RNA, 22 nt, Human
uuuaaugucuuuggccuuuaau

SEQ ID NO: 211889 - RNA, 22 nt, Human
ccuugcuucuagcauucccaug

SEQ ID NO: 211890 - RNA, 22 nt, Human
gugcugcaaggauggagaggca

SEQ ID NO: 211891 - RNA, 22 nt, Human
cuuuacauuaauuucuacugau

SEQ ID NO: 211892 - RNA, 22 nt, Human
ugccagcuccgaggagcugcag

SEQ ID NO: 211893 - RNA, 22 nt, Human
aaggaaaaccugacugaagaac

SEQ ID NO: 211894 - RNA, 22 nt, Human
gagaagguggaccugaaggagc

SEQ ID NO: 211895 - RNA, 22 nt, Human
cucagaugaugucuucagggaa

SEQ ID NO: 211896 - RNA, 22 nt, Human
gagcccuguagcaagucauguc

SEQ ID NO: 211897 - RNA, 23 nt, Human
uagacugcaggcuccuugagggc

SEQ ID NO: 211898 - RNA, 22 nt, Human
gccuggcagggagauuguaaga

SEQ ID NO: 211899 - RNA, 22 nt, Human
ucucugguagcucugugcucug

SEQ ID NO: 211900 - RNA, 22 nt, Human
uuuuagaagcauuuaugagauu

SEQ ID NO: 211901 - RNA, 22 nt, Human
ugaggaugagaaggaagagaag

SEQ ID NO: 211902 - RNA, 22 nt, Human
cugggagaugacucagagcagg

SEQ ID NO: 211903 - RNA, 18 nt, Human
uuccauuuuucagucuuc

SEQ ID NO: 211904 - RNA, 22 nt, Human
cuucuuuccauguguuuugguu

SEQ ID NO: 211905 - RNA, 22 nt, Human
aggggagaguuaaugugaaugu

SEQ ID NO: 211906 - RNA, 22 nt, Human
cagcuauggaauuggcccagau

SEQ ID NO: 211907 - RNA, 22 nt, Human
cuggcuaaugugcugauagcca

SEQ ID NO: 211908 - RNA, 22 nt, Human
augugacaagugugggcagggc

SEQ ID NO: 211909 - RNA, 22 nt, Human
gggaaaauguuucugagacaaa

SEQ ID NO: 211910 - RNA, 22 nt, Human
gaaugguuagugaacaaauuug

SEQ ID NO: 211911 - RNA, 22 nt, Human
guacauauccuuuacguuuugu

SEQ ID NO: 211912 - RNA, 22 nt, Human
cagaaagaaguggggauagagg

SEQ ID NO: 211913 - RNA, 22 nt, Human
uggaaguggcaggggagacgua

SEQ ID NO: 211914 - RNA, 23 nt, Human
cacucgcaggcccagcucucagg

SEQ ID NO: 211915 - RNA, 22 nt, Human
uccaugaguuuuuuaguuucac

SEQ ID NO: 211916 - RNA, 22 nt, Human
ucaauuuauguggcuauucauu

SEQ ID NO: 211917 - RNA, 22 nt, Human
agaguacagaagcauuucagau

SEQ ID NO: 211918 - RNA, 22 nt, Human
aaagagugugcauguaccugug

SEQ ID NO: 211919 - RNA, 22 nt, Human
ggagcugaacccuuaacuggcu

SEQ ID NO: 211920 - RNA, 22 nt, Human
cuaauaauuuacugagugcuac

SEQ ID NO: 211921 - RNA, 22 nt, Human
cagucaaauuugaaaacuuuga

SEQ ID NO: 211922 - RNA, 20 nt, Human
cuuauuuuggagaacuuuuc

SEQ ID NO: 211923 - RNA, 22 nt, Human
ucugagagcuguagaagccuau

SEQ ID NO: 211924 - RNA, 20 nt, Human
cagagccaggguuuuguuuu

SEQ ID NO: 211925 - RNA, 22 nt, Human
cuccuuugagcaaaucuuugau

SEQ ID NO: 211926 - RNA, 22 nt, Human
aagccugguuauuugaggaugu

SEQ ID NO: 211927 - RNA, 20 nt, Human
ccccagcauccuuuucaucu

SEQ ID NO: 211928 - RNA, 22 nt, Human
auuaugaauuguguuacgaaga

SEQ ID NO: 211929 - RNA, 22 nt, Human
cuccaggcccagggccaagagc

SEQ ID NO: 211930 - RNA, 22 nt, Human
gaguguuugcuguauaauugga

SEQ ID NO: 211931 - RNA, 22 nt, Human
guguucccauccacaccaagcc

SEQ ID NO: 211932 - RNA, 22 nt, Human
agugugaguuacaaagugugaa

SEQ ID NO: 211933 - RNA, 22 nt, Human
gcaugcaggaagggcuugggga

SEQ ID NO: 211934 - RNA, 22 nt, Human
uuuuuauaagagcagcagaguu

SEQ ID NO: 211935 - RNA, 22 nt, Human
ggccugcuaccagcugugaccu

SEQ ID NO: 211936 - RNA, 22 nt, Human
aaucaugagguguuucuuugca

SEQ ID NO: 211937 - RNA, 22 nt, Human
uuuguacuuucuaauguauuua

SEQ ID NO: 211938 - RNA, 22 nt, Human
cuucccuaagggacuggcauag

SEQ ID NO: 211939 - RNA, 22 nt, Human
uacagucauaagguuucucucc

SEQ ID NO: 211940 - RNA, 22 nt, Human
auauuuuacagcucucguugaa

SEQ ID NO: 211941 - RNA, 20 nt, Human
uggguucaguuguuucuggc

SEQ ID NO: 211942 - RNA, 22 nt, Human
aaaucauguuaaagagggaguu

SEQ ID NO: 211943 - RNA, 22 nt, Human
ugggguuuuagagcaggcagag

SEQ ID NO: 211944 - RNA, 17 nt, Human
ugguucuuuuccugacc

SEQ ID NO: 211945 - RNA, 22 nt, Human
agccaugcuguuuugccuggga

SEQ ID NO: 211946 - RNA, 22 nt, Human
acucugagaugugucuugauuc

SEQ ID NO: 211947 - RNA, 22 nt, Human
ccaccccagaaagggaaggcca

SEQ ID NO: 211948 - RNA, 21 nt, Human
ucaaguccuggcuuugcucuu

SEQ ID NO: 211949 - RNA, 22 nt, Human
uucacccaaaucaagcuggccu

SEQ ID NO: 211950 - RNA, 22 nt, Human
uuauuucauguaaaauuuaugu

SEQ ID NO: 211951 - RNA, 22 nt, Human
gggcuggggcucuggggcuagg

SEQ ID NO: 211952 - RNA, 22 nt, Human
cugcccauggcuccuggcugug

SEQ ID NO: 211953 - RNA, 22 nt, Human
cuccagcucgcgagcucugcuc

SEQ ID NO: 211954 - RNA, 22 nt, Human
aggggaggggaguaucaggauu

SEQ ID NO: 211955 - RNA, 22 nt, Human
caagaaaaaacaugaugagugu

SEQ ID NO: 211956 - RNA, 22 nt, Human
ugagcagagcacuugggaacga

SEQ ID NO: 211957 - RNA, 22 nt, Human
cagaggcugagcugcgggauga

SEQ ID NO: 211958 - RNA, 22 nt, Human
uguucuuaacuuuuguguauau

SEQ ID NO: 211959 - RNA, 22 nt, Human
aguuuguagguuaggaucagca

SEQ ID NO: 211960 - RNA, 22 nt, Human
gggauguauguuuguguggaga

SEQ ID NO: 211961 - RNA, 19 nt, Human
ggccacacuauuaaaagau

SEQ ID NO: 211962 - RNA, 22 nt, Human
uuuuagccagaguuuaucacag

SEQ ID NO: 211963 - RNA, 22 nt, Human
auagauagaagggacguggugc

SEQ ID NO: 211964 - RNA, 22 nt, Human
aaaguaaagccuauuuaauaau

SEQ ID NO: 211965 - RNA, 22 nt, Human
gcagcagugugggcugaaccua

SEQ ID NO: 211966 - RNA, 22 nt, Human
cacauaguuuaucuucauuuuc

SEQ ID NO: 211967 - RNA, 22 nt, Human
ucuagcccucauggcugaaggc

SEQ ID NO: 211968 - RNA, 22 nt, Human
gcuagagaagagcccacaccgg

SEQ ID NO: 211969 - RNA, 23 nt, Human
aggcagcaugcaacaggccauuu

SEQ ID NO: 211970 - RNA, 22 nt, Human
uagaccuccagcggaggagauu

SEQ ID NO: 211971 - RNA, 23 nt, Human
ucccaacuuugaaauauuccaca

SEQ ID NO: 211972 - RNA, 22 nt, Human
ccaaagaauuuggaaaaucuga

SEQ ID NO: 211973 - RNA, 22 nt, Human
uggcugagugaacauguccauu

SEQ ID NO: 211974 - RNA, 22 nt, Human
uggaagaagcuacaagcgguga

SEQ ID NO: 211975 - RNA, 23 nt, Human
cugaaauucagaugcuaaagaua

SEQ ID NO: 211976 - RNA, 22 nt, Human
agucuauacuucccaguugaca

SEQ ID NO: 211977 - RNA, 21 nt, Human
uuuguucaggggcaaaguuaa

SEQ ID NO: 211978 - RNA, 22 nt, Human
uuggggcugcguauuuccaugu

SEQ ID NO: 211979 - RNA, 22 nt, Human
gggaaaugugucuuggcauucu

SEQ ID NO: 211980 - RNA, 22 nt, Human
agagggcugugcuaaauuucag

SEQ ID NO: 211981 - RNA, 22 nt, Human
ugggagagauaggcuucuggac

SEQ ID NO: 211982 - RNA, 22 nt, Human
uaagauauugagugguaauuug

SEQ ID NO: 211983 - RNA, 22 nt, Human
ucauccugucucuguucggaau

SEQ ID NO: 211984 - RNA, 20 nt, Human
ucagugggaaagugagagug

SEQ ID NO: 211985 - RNA, 22 nt, Human
gcugucccccaaagaugcuccu

SEQ ID NO: 211986 - RNA, 22 nt, Human
aagaggaauaauaaaaauugca

SEQ ID NO: 211987 - RNA, 21 nt, Human
guucucacagcugaggugguu

SEQ ID NO: 211988 - RNA, 22 nt, Human
uaguaauauuccuacauuaugu

SEQ ID NO: 211989 - RNA, 22 nt, Human
ggacagggagcaaaaacguccc

SEQ ID NO: 211990 - RNA, 22 nt, Human
gaauaccauuuacauuugaaaa

SEQ ID NO: 211991 - RNA, 22 nt, Human
uauauauaauguguacagguga

SEQ ID NO: 211992 - RNA, 22 nt, Human
aacaaagaaaagcuugagguuu

SEQ ID NO: 211993 - RNA, 22 nt, Human
augcuuuauuggagacagucau

SEQ ID NO: 211994 - RNA, 22 nt, Human
agagcugggacuuggacucaau

SEQ ID NO: 211995 - RNA, 22 nt, Human
uguguguguguguaugugcgug

SEQ ID NO: 211996 - RNA, 19 nt, Human
agcagugaaaucuggugag

SEQ ID NO: 211997 - RNA, 22 nt, Human
uaugaaggauacaccucugauu

SEQ ID NO: 211998 - RNA, 22 nt, Human
aaaucugaaggaaacagcuuca

SEQ ID NO: 211999 - RNA, 23 nt, Human
cacuggugggguuuaaaagaagc

SEQ ID NO: 212000 - RNA, 22 nt, Human
ggugucuuugauguugggcuga

SEQ ID NO: 212001 - RNA, 21 nt, Human
gggagaguagcgguagggagg

SEQ ID NO: 212002 - RNA, 20 nt, Human
gccuccuccaaguuucauca

SEQ ID NO: 212003 - RNA, 22 nt, Human
agggaagccggagcgacggggg

SEQ ID NO: 212004 - RNA, 22 nt, Human
uuuucuugagucacuccaguga

SEQ ID NO: 212005 - RNA, 22 nt, Human
uugaacguguaggaagcugguu

SEQ ID NO: 212006 - RNA, 22 nt, Human
ucccacgugccaucugcucugu

SEQ ID NO: 212007 - RNA, 22 nt, Human
uaugggcaagagauaggugguc

SEQ ID NO: 212008 - RNA, 22 nt, Human
caaagaaccuucgagacagggc

SEQ ID NO: 212009 - RNA, 22 nt, Human
cgugcaggagcuggagguccga

SEQ ID NO: 212010 - RNA, 22 nt, Human
cucaaaauccauaaaaucaggu

SEQ ID NO: 212011 - RNA, 22 nt, Human
uaaauuagauucccagcgcuau

SEQ ID NO: 212012 - RNA, 22 nt, Human
cgagcccaacccucccguccuc

SEQ ID NO: 212013 - RNA, 22 nt, Human
gggccucccggagcugcuccca

SEQ ID NO: 212014 - RNA, 21 nt, Human
aguuguacuguauagcagaug

SEQ ID NO: 212015 - RNA, 22 nt, Human
caguguuuagcacagugcuugg

SEQ ID NO: 212016 - RNA, 22 nt, Human
agauuuuacggaguauuagggu

SEQ ID NO: 212017 - RNA, 22 nt, Human
ccugucuuuucugaucauacua

SEQ ID NO: 212018 - RNA, 22 nt, Human
gaggaugacaaagaaggcagac

SEQ ID NO: 212019 - RNA, 22 nt, Human
agauacaaaagauaagauuuag

SEQ ID NO: 212020 - RNA, 22 nt, Human
guggaaauuuuaggaucaucuu

SEQ ID NO: 212021 - RNA, 22 nt, Human
agagggagagaccuccgugccu

SEQ ID NO: 212022 - RNA, 22 nt, Human
cggugcuuuccauaucagcagc

SEQ ID NO: 212023 - RNA, 22 nt, Human
agggccaagaaagaguggcuuu

SEQ ID NO: 212024 - RNA, 22 nt, Human
uucuuaaugcauccuguguuca

SEQ ID NO: 212025 - RNA, 22 nt, Human
gcccugaagagguagagaauuu

SEQ ID NO: 212026 - RNA, 22 nt, Human
ccaguguguuuuucucugacuc

SEQ ID NO: 212027 - RNA, 22 nt, Human
agugaaauaugcccauugcugu

SEQ ID NO: 212028 - RNA, 22 nt, Human
auuuuuagucuugcugcaauca

SEQ ID NO: 212029 - RNA, 22 nt, Human
uggggcuuucgcggagcgucgg

SEQ ID NO: 212030 - RNA, 22 nt, Human
ugcagguggcagcggggcacca

SEQ ID NO: 212031 - RNA, 22 nt, Human
acuaugugucuguaucuggugc

SEQ ID NO: 212032 - RNA, 22 nt, Human
agauaucuuguuggcauaaaug

SEQ ID NO: 212033 - RNA, 22 nt, Human
guguugaugugucuguauucua

SEQ ID NO: 212034 - RNA, 22 nt, Human
uagaugcugagcuuaagagaau

SEQ ID NO: 212035 - RNA, 19 nt, Human
agauggcaaaaugcaaaga

SEQ ID NO: 212036 - RNA, 22 nt, Human
agagcagaggcauggccguggg

SEQ ID NO: 212037 - RNA, 22 nt, Human
uaguuucuaauguugaaauuau

SEQ ID NO: 212038 - RNA, 22 nt, Human
aagggaggguaggaagagggag

SEQ ID NO: 212039 - RNA, 22 nt, Human
cugccaguaucuuuggggcugu

SEQ ID NO: 212040 - RNA, 22 nt, Human
ugagauucuguucagaaaaaug

SEQ ID NO: 212041 - RNA, 23 nt, Human
uggugcagcgcaggccggguggc

SEQ ID NO: 212042 - RNA, 22 nt, Human
auuucauuuuagaaauaagugu

SEQ ID NO: 212043 - RNA, 22 nt, Human
uuugcaggaaauguacugaaug

SEQ ID NO: 212044 - RNA, 22 nt, Human
ugugacugaaaaugauugagug

SEQ ID NO: 212045 - RNA, 22 nt, Human
aagcaggaaaugaaaugcuugc

SEQ ID NO: 212046 - RNA, 22 nt, Human
uuccaaggagagcucgaccuca

SEQ ID NO: 212047 - RNA, 22 nt, Human
ugugugggcgaagacagccuuu

SEQ ID NO: 212048 - RNA, 22 nt, Human
guggcaguaaagcuggaaaagu

SEQ ID NO: 212049 - RNA, 22 nt, Human
gcagcaauaaaacugaaggugu

SEQ ID NO: 212050 - RNA, 22 nt, Human
aaggcugaccaguuuacacuuu

SEQ ID NO: 212051 - RNA, 22 nt, Human
aauauuuugggacugaggaauu

SEQ ID NO: 212052 - RNA, 22 nt, Human
aagggaauagagcagcaaaaau

SEQ ID NO: 212053 - RNA, 22 nt, Human
uuggguguugguuccugggagg

SEQ ID NO: 212054 - RNA, 22 nt, Human
uauguuaaauguuugauguuua

SEQ ID NO: 212055 - RNA, 22 nt, Human
uuggggauugggugcaagggac

SEQ ID NO: 212056 - RNA, 20 nt, Human
ucuguggcagguggcgcuug

SEQ ID NO: 212057 - RNA, 23 nt, Human
gcagugacugggauggaaguaga

SEQ ID NO: 212058 - RNA, 22 nt, Human
ucauuauuuugauguauuuccu

SEQ ID NO: 212059 - RNA, 22 nt, Human
acugugacugugucuucugggc

SEQ ID NO: 212060 - RNA, 22 nt, Human
auuuuuucaugugugguugaga

SEQ ID NO: 212061 - RNA, 22 nt, Human
cagugcucauagcuguuccucc

SEQ ID NO: 212062 - RNA, 22 nt, Human
gcuucucacccuuacuaucucu

SEQ ID NO: 212063 - RNA, 22 nt, Human
guugggaauucggagagaaaua

SEQ ID NO: 212064 - RNA, 22 nt, Human
agauggaggaaagcaguuagaa

SEQ ID NO: 212065 - RNA, 22 nt, Human
uggaaagauuuaaaauaacgag

SEQ ID NO: 212066 - RNA, 22 nt, Human
gggcaugcagcaauucuguggu

SEQ ID NO: 212067 - RNA, 18 nt, Human
gagaggcauuuagcugau

SEQ ID NO: 212068 - RNA, 22 nt, Human
ggcagggagagcgccgccaugc

SEQ ID NO: 212069 - RNA, 22 nt, Human
ggaguguaagugacucaccugg

SEQ ID NO: 212070 - RNA, 22 nt, Human
caggccccagggacugggcgcu

SEQ ID NO: 212071 - RNA, 22 nt, Human
agucccugauggacuggaugag

SEQ ID NO: 212072 - RNA, 22 nt, Human
uuucuuugcugguuggcucucc

SEQ ID NO: 212073 - RNA, 20 nt, Human
acacagccuagaguuuggcu

SEQ ID NO: 212074 - RNA, 22 nt, Human
aauggaaaaagaacuguuuaaa

SEQ ID NO: 212075 - RNA, 22 nt, Human
aagacacuuucuaaauagaagu

SEQ ID NO: 212076 - RNA, 22 nt, Human
uaaggaaaugcaaauuuaagaa

SEQ ID NO: 212077 - RNA, 22 nt, Human
gcacugagacuuuagauuggag

SEQ ID NO: 212078 - RNA, 22 nt, Human
agcugcuggcggauguuggacu

SEQ ID NO: 212079 - RNA, 22 nt, Human
ugaaagccuacagcucacuguu

SEQ ID NO: 212080 - RNA, 22 nt, Human
gcuuacagauaaugaggagacu

SEQ ID NO: 212081 - RNA, 20 nt, Human
ggcagcaaccauaugcuaca

SEQ ID NO: 212082 - RNA, 17 nt, Human
ucugcagaggcaaaccu

SEQ ID NO: 212083 - RNA, 22 nt, Human
auuaucugacugaguagucugu

SEQ ID NO: 212084 - RNA, 22 nt, Human
aacucugagaaacuugcaguug

SEQ ID NO: 212085 - RNA, 22 nt, Human
uccuuuucuuugaggaaggugu

SEQ ID NO: 212086 - RNA, 22 nt, Human
uccaggagucagacagauggug

SEQ ID NO: 212087 - RNA, 22 nt, Human
agggaggagggacagaaagagg

SEQ ID NO: 212088 - RNA, 19 nt, Human
aggggccugcuuggccuug

SEQ ID NO: 212089 - RNA, 22 nt, Human
ucucucucucuuccagcauguu

SEQ ID NO: 212090 - RNA, 22 nt, Human
gagggagugggcccgugggcac

SEQ ID NO: 212091 - RNA, 22 nt, Human
gagccucaggguuuuguugaca

SEQ ID NO: 212092 - RNA, 22 nt, Human
ggcugaugacgccugagucuga

SEQ ID NO: 212093 - RNA, 22 nt, Human
ggaaaagccauauuauaggcaa

SEQ ID NO: 212094 - RNA, 22 nt, Human
ggaggaagagaccagggggcuu

SEQ ID NO: 212095 - RNA, 22 nt, Human
uuuaaucaauaaccuccugggu

SEQ ID NO: 212096 - RNA, 23 nt, Human
agcccagcagagaaccuaggucc

SEQ ID NO: 212097 - RNA, 22 nt, Human
uacaagcucuuguagggggaaa

SEQ ID NO: 212098 - RNA, 19 nt, Human
aacaaaauaguucuaguua

SEQ ID NO: 212099 - RNA, 22 nt, Human
cuuuuuaaaguaaauggcuaga

SEQ ID NO: 212100 - RNA, 22 nt, Human
uaggauaacaauuuguaguuuc

SEQ ID NO: 212101 - RNA, 22 nt, Human
ccagcaugcucagucuaaauug

SEQ ID NO: 212102 - RNA, 22 nt, Human
aaauuaacuaucacuuuuguga

SEQ ID NO: 212103 - RNA, 22 nt, Human
aauaauuuuuuugugauuaugu

SEQ ID NO: 212104 - RNA, 22 nt, Human
uuuuaaauggcuuuuacuuuuc

SEQ ID NO: 212105 - RNA, 22 nt, Human
gcuuuucaaguuacaauuagcu

SEQ ID NO: 212106 - RNA, 22 nt, Human
caggaggaggccgggaggaagc

SEQ ID NO: 212107 - RNA, 22 nt, Human
auuuauuugaagagccauugca

SEQ ID NO: 212108 - RNA, 22 nt, Human
auggccuguuuccucugaaaga

SEQ ID NO: 212109 - RNA, 22 nt, Human
uuccccaccagagacagagcug

SEQ ID NO: 212110 - RNA, 22 nt, Human
caguagcuuuuugcagacaaga

SEQ ID NO: 212111 - RNA, 22 nt, Human
cguggccacaguggagcugagc

SEQ ID NO: 212112 - RNA, 22 nt, Human
cuauguuucagauauauauaua

SEQ ID NO: 212113 - RNA, 22 nt, Human
auugaguucaccucuuucagaa

SEQ ID NO: 212114 - RNA, 22 nt, Human
gcacacaagagauuguuauugc

SEQ ID NO: 212115 - RNA, 16 nt, Human
aggagcagaaagcagu

SEQ ID NO: 212116 - RNA, 22 nt, Human
ugcauucugaacguaaauguga

SEQ ID NO: 212117 - RNA, 22 nt, Human
cagacagagcucacaagucuuu

SEQ ID NO: 212118 - RNA, 23 nt, Human
ucucacucauucuccucugucca

SEQ ID NO: 212119 - RNA, 22 nt, Human
aagcauuuuagauaaagcauca

SEQ ID NO: 212120 - RNA, 22 nt, Human
cuuacauuuguuuaguguuucc

SEQ ID NO: 212121 - RNA, 22 nt, Human
uguguuguuuggggauguccau

SEQ ID NO: 212122 - RNA, 22 nt, Human
ucccuuaacucaaguggugcuc

SEQ ID NO: 212123 - RNA, 22 nt, Human
ucuugcuguggcagaucuggag

SEQ ID NO: 212124 - RNA, 22 nt, Human
ugagaaaacaguuuguaauaau

SEQ ID NO: 212125 - RNA, 22 nt, Human
uucuccaccugcuccucccacc

SEQ ID NO: 212126 - RNA, 22 nt, Human
uugucauuuucuuaauguuccu

SEQ ID NO: 212127 - RNA, 22 nt, Human
agucaguguagaaagcccaggc

SEQ ID NO: 212128 - RNA, 22 nt, Human
uggcauuuuguagcuguguauc

SEQ ID NO: 212129 - RNA, 22 nt, Human
aagcuuugggcagaagaggauu

SEQ ID NO: 212130 - RNA, 22 nt, Human
aaggauguuuaaacuacuuucc

SEQ ID NO: 212131 - RNA, 21 nt, Human
acuuccacaucacugaguaga

SEQ ID NO: 212132 - RNA, 22 nt, Human
uugcacagaugcacaugguugc

SEQ ID NO: 212133 - RNA, 22 nt, Human
gugaaaaauggccaucaggaca

SEQ ID NO: 212134 - RNA, 22 nt, Human
uagggggagugugcugaagcca

SEQ ID NO: 212135 - RNA, 23 nt, Human
agauaaggaagcauuugagccag

SEQ ID NO: 212136 - RNA, 22 nt, Human
auagauguauucauuguuuggc

SEQ ID NO: 212137 - RNA, 22 nt, Human
aaaucccacucacgaguuuugc

SEQ ID NO: 212138 - RNA, 22 nt, Human
agucugaguaucucugagccag

SEQ ID NO: 212139 - RNA, 22 nt, Human
uggcaguugcaguaacuuguau

SEQ ID NO: 212140 - RNA, 22 nt, Human
aaaucugaauuaaaaucugguu

SEQ ID NO: 212141 - RNA, 22 nt, Human
cagugcaacguugugcauucaa

SEQ ID NO: 212142 - RNA, 22 nt, Human
aauugccaagaauuagugauac

SEQ ID NO: 212143 - RNA, 22 nt, Human
gcagcaaucuucacagugucau

SEQ ID NO: 212144 - RNA, 19 nt, Human
ccaacaguacugaagcacu

SEQ ID NO: 212145 - RNA, 22 nt, Human
ucuuucugaugggaagggucaa

SEQ ID NO: 212146 - RNA, 22 nt, Human
guuuauuucuuaucaucacuau

SEQ ID NO: 212147 - RNA, 22 nt, Human
aagagaaaaaucuuaaucuagu

SEQ ID NO: 212148 - RNA, 22 nt, Human
uucacuguucuuagagaagacc

SEQ ID NO: 212149 - RNA, 22 nt, Human
acagagcucccagccaucuccu

SEQ ID NO: 212150 - RNA, 22 nt, Human
gaggccagcacccagaugcaug

SEQ ID NO: 212151 - RNA, 22 nt, Human
ggcuuguccuucugguugucuu

SEQ ID NO: 212152 - RNA, 22 nt, Human
uccauacuggccucuuucccag

SEQ ID NO: 212153 - RNA, 22 nt, Human
aagacccuaccccuggagagga

SEQ ID NO: 212154 - RNA, 19 nt, Human
augcacgugaaaugcauuu

SEQ ID NO: 212155 - RNA, 22 nt, Human
cagagcugagucuucaagguug

SEQ ID NO: 212156 - RNA, 22 nt, Human
gagcagcaggccagguugcagg

SEQ ID NO: 212157 - RNA, 22 nt, Human
gaggugggaggcgggccugcau

SEQ ID NO: 212158 - RNA, 22 nt, Human
agguagaaggaccagaauuuau

SEQ ID NO: 212159 - RNA, 22 nt, Human
gcucccaauuccuuuuacaauu

SEQ ID NO: 212160 - RNA, 23 nt, Human
aggaagucugacacuacagcguu

SEQ ID NO: 212161 - RNA, 22 nt, Human
cucugugucugauucugggaag

SEQ ID NO: 212162 - RNA, 22 nt, Human
caaaggaaagagaaaaagucuu

SEQ ID NO: 212163 - RNA, 20 nt, Human
auggaaacacgcagccccaa

SEQ ID NO: 212164 - RNA, 22 nt, Human
ccagucuuggugucuguagcac

SEQ ID NO: 212165 - RNA, 22 nt, Human
acuguugagggaagcagaugaa

SEQ ID NO: 212166 - RNA, 22 nt, Human
agugaaaacugaaucaccuucc

SEQ ID NO: 212167 - RNA, 22 nt, Human
acauaaaccccccuuccccagg

SEQ ID NO: 212168 - RNA, 22 nt, Human
aagaguggagcuggaaaguggg

SEQ ID NO: 212169 - RNA, 22 nt, Human
uuuauugaccugaguaucagca

SEQ ID NO: 212170 - RNA, 22 nt, Human
ccagugcuuccaggaauacggu

SEQ ID NO: 212171 - RNA, 22 nt, Human
aaaaguuguaauauuuccuuua

SEQ ID NO: 212172 - RNA, 21 nt, Human
aucagaaucucuagauuugga

SEQ ID NO: 212173 - RNA, 22 nt, Human
aauggaaaaauccacagggaac

SEQ ID NO: 212174 - RNA, 21 nt, Human
uggagcagggaggauuugggg

SEQ ID NO: 212175 - RNA, 22 nt, Human
auaaaaaguggcugcuauugga

SEQ ID NO: 212176 - RNA, 22 nt, Human
aagcugcagacccccugucuca

SEQ ID NO: 212177 - RNA, 22 nt, Human
aaggugggacugagaggggaca

SEQ ID NO: 212178 - RNA, 22 nt, Human
cuucacaaaauauuucauuaua

SEQ ID NO: 212179 - RNA, 22 nt, Human
uguuuuuauucuuaauguuuca

SEQ ID NO: 212180 - RNA, 17 nt, Human
auuguuuuuaauuugca

SEQ ID NO: 212181 - RNA, 22 nt, Human
aauucugaggccauuuauuucc

SEQ ID NO: 212182 - RNA, 22 nt, Human
auagauuuuaucagauuuuauc

SEQ ID NO: 212183 - RNA, 22 nt, Human
uuaaaagaauccuguuauccuc

SEQ ID NO: 212184 - RNA, 22 nt, Human
gcacaaaagguacuucauguag

SEQ ID NO: 212185 - RNA, 22 nt, Human
aagggaaacagccaggcccugu

SEQ ID NO: 212186 - RNA, 22 nt, Human
uuuuacaaugcaaauucuugcu

SEQ ID NO: 212187 - RNA, 22 nt, Human
cuucucugcugccugccucuuu

SEQ ID NO: 212188 - RNA, 19 nt, Human
aaggcuuucugagugaaaa

SEQ ID NO: 212189 - RNA, 22 nt, Human
aacucaggagagaguaacaggg

SEQ ID NO: 212190 - RNA, 22 nt, Human
acacccuuuagcaauucuucaa

SEQ ID NO: 212191 - RNA, 22 nt, Human
caggggaagccagcugccaugu

SEQ ID NO: 212192 - RNA, 22 nt, Human
ggcugcuauuggucuggcuugg

SEQ ID NO: 212193 - RNA, 22 nt, Human
acuaggaaguaaauaugucauc

SEQ ID NO: 212194 - RNA, 22 nt, Human
cugagcuuuucucugcuucuua

SEQ ID NO: 212195 - RNA, 22 nt, Human
aggugagaaggacuguugcauu

SEQ ID NO: 212196 - RNA, 22 nt, Human
agguuguugagaucaucuggcu

SEQ ID NO: 212197 - RNA, 22 nt, Human
caguucaagauuguugcuuucu

SEQ ID NO: 212198 - RNA, 22 nt, Human
ggaaaggggaaaauacagagag

SEQ ID NO: 212199 - RNA, 22 nt, Human
ugagaaauauacaccagacaca

SEQ ID NO: 212200 - RNA, 22 nt, Human
agggggaauccugcuuauggau

SEQ ID NO: 212201 - RNA, 22 nt, Human
guggcgucgaugauggugucau

SEQ ID NO: 212202 - RNA, 22 nt, Human
aaaaaguaccacuuggacacuu

SEQ ID NO: 212203 - RNA, 22 nt, Human
ucugcagggcccuuggcuccug

SEQ ID NO: 212204 - RNA, 22 nt, Human
uaaaugaaaugaagugaaagcu

SEQ ID NO: 212205 - RNA, 21 nt, Human
ccuggagacaaagacagggug

SEQ ID NO: 212206 - RNA, 22 nt, Human
cugagcugcucccgcugcagcg

SEQ ID NO: 212207 - RNA, 22 nt, Human
acauucucuuuuagaaagcugu

SEQ ID NO: 212208 - RNA, 22 nt, Human
cagcuguggagauggggugcau

SEQ ID NO: 212209 - RNA, 22 nt, Human
ugggcagggagcuggaaccaca

SEQ ID NO: 212210 - RNA, 22 nt, Human
cagaccucucaggcuguucuug

SEQ ID NO: 212211 - RNA, 22 nt, Human
aaaguguuaacacuggcuacuu

SEQ ID NO: 212212 - RNA, 22 nt, Human
ucccuugacauuacuugggagg

SEQ ID NO: 212213 - RNA, 22 nt, Human
uguauaaaauggaaugucagaa

SEQ ID NO: 212214 - RNA, 22 nt, Human
ucugggguucuuaauuuggaag

SEQ ID NO: 212215 - RNA, 22 nt, Human
auggagggcagccccacuaaag

SEQ ID NO: 212216 - RNA, 22 nt, Human
ugcuccucugcaugucugcggc

SEQ ID NO: 212217 - RNA, 22 nt, Human
ugggggagggagaguugauggg

SEQ ID NO: 212218 - RNA, 22 nt, Human
aaggaaaaaauggcuugugaua

SEQ ID NO: 212219 - RNA, 22 nt, Human
gggacugguuguguguggugug

SEQ ID NO: 212220 - RNA, 22 nt, Human
cagccccaguuuucauaagacu

SEQ ID NO: 212221 - RNA, 22 nt, Human
uacugucuuuuccuaaaugggu

SEQ ID NO: 212222 - RNA, 22 nt, Human
agacaaggggauuuuugauggu

SEQ ID NO: 212223 - RNA, 22 nt, Human
ucuaagcuugaucacuugcuuu

SEQ ID NO: 212224 - RNA, 22 nt, Human
uauuuccugcguuucugugagc

SEQ ID NO: 212225 - RNA, 22 nt, Human
gauuuucauuauagcuaguuuc

SEQ ID NO: 212226 - RNA, 22 nt, Human
ucucuccauguuuucuguccag

SEQ ID NO: 212227 - RNA, 22 nt, Human
ugggguguuacacaacauugag

SEQ ID NO: 212228 - RNA, 22 nt, Human
auggcucugcugggcaaagcaa

SEQ ID NO: 212229 - RNA, 21 nt, Human
caugguaaguacaaagaugac

SEQ ID NO: 212230 - RNA, 21 nt, Human
aagcagcugcagaauuucagu

SEQ ID NO: 212231 - RNA, 22 nt, Human
ucgcccagguuggagugcagug

SEQ ID NO: 212232 - RNA, 22 nt, Human
agccuugcaugauuucauucau

SEQ ID NO: 212233 - RNA, 22 nt, Human
auauauguauauaugugugugu

SEQ ID NO: 212234 - RNA, 22 nt, Human
acaugugugucugugugugugu

SEQ ID NO: 212235 - RNA, 22 nt, Human
agccccaauuacagcugugcug

SEQ ID NO: 212236 - RNA, 22 nt, Human
aggcagaugggagcuggaaguu

SEQ ID NO: 212237 - RNA, 21 nt, Human
ucuucccaggccuuaaagggc

SEQ ID NO: 212238 - RNA, 22 nt, Human
uuuuacuuuucccacuuacagc

SEQ ID NO: 212239 - RNA, 22 nt, Human
aggauggaaguaacuggauaau

SEQ ID NO: 212240 - RNA, 22 nt, Human
agguggucccaauggcugggca

SEQ ID NO: 212241 - RNA, 23 nt, Human
uucugaggucacgguggaccugg

SEQ ID NO: 212242 - RNA, 22 nt, Human
caaggucagacagccaggacag

SEQ ID NO: 212243 - RNA, 22 nt, Human
ugagacagaccuuggaccaugu

SEQ ID NO: 212244 - RNA, 22 nt, Human
gugaugugugaaggucugcagg

SEQ ID NO: 212245 - RNA, 22 nt, Human
aacagaaaucauuuagggcucu

SEQ ID NO: 212246 - RNA, 22 nt, Human
agaaacaagcccuagaaguccu

SEQ ID NO: 212247 - RNA, 22 nt, Human
cucuucauguuggugcagaagc

SEQ ID NO: 212248 - RNA, 22 nt, Human
uuucuugugauuuugaugaacu

SEQ ID NO: 212249 - RNA, 22 nt, Human
ucacuuccuugcagcuguagaa

SEQ ID NO: 212250 - RNA, 22 nt, Human
gaauacaaauaauaccaaggug

SEQ ID NO: 212251 - RNA, 22 nt, Human
ucaguggaacacacagaguggg

SEQ ID NO: 212252 - RNA, 22 nt, Human
gugaaauuguacacucaguacc

SEQ ID NO: 212253 - RNA, 19 nt, Human
ugccuggcaccagcuccac

SEQ ID NO: 212254 - RNA, 22 nt, Human
aagaaugaaaugaaagaacuaa

SEQ ID NO: 212255 - RNA, 20 nt, Human
cugaccagcagccugucucc

SEQ ID NO: 212256 - RNA, 22 nt, Human
ugguggaggugggggguauuuu

SEQ ID NO: 212257 - RNA, 19 nt, Human
uuucacaaagagagcguga

SEQ ID NO: 212258 - RNA, 22 nt, Human
ugcuugaacccaggaaguggag

SEQ ID NO: 212259 - RNA, 23 nt, Human
aaguggugacugugcuacugaga

SEQ ID NO: 212260 - RNA, 23 nt, Human
aggcugccacucagggugaggcu

SEQ ID NO: 212261 - RNA, 19 nt, Human
ccuggccaacgucaacauu

SEQ ID NO: 212262 - RNA, 22 nt, Human
aggcucagcaucugauucauau

SEQ ID NO: 212263 - RNA, 22 nt, Human
uguguggaggugggugaugucu

SEQ ID NO: 212264 - RNA, 22 nt, Human
aggcuuagaugaguucccacau

SEQ ID NO: 212265 - RNA, 22 nt, Human
ggcagucuuucccuugagcucu

SEQ ID NO: 212266 - RNA, 22 nt, Human
uuucucugggugaugagguggc

SEQ ID NO: 212267 - RNA, 22 nt, Human
cagcacuuccuccgugagcccc

SEQ ID NO: 212268 - RNA, 20 nt, Human
gggcucugcauccaucagcc

SEQ ID NO: 212269 - RNA, 22 nt, Human
gcugggagucgcgucuguggcc

SEQ ID NO: 212270 - RNA, 22 nt, Human
ccuauauuacaggcuugcucua

SEQ ID NO: 212271 - RNA, 21 nt, Human
aggcuuggaucuagacaggcc

SEQ ID NO: 212272 - RNA, 22 nt, Human
gaaugguuauaugauguuuaaa

SEQ ID NO: 212273 - RNA, 22 nt, Human
agccauggagaacagacuugaa

SEQ ID NO: 212274 - RNA, 22 nt, Human
uccuuaggaccuagagguagua

SEQ ID NO: 212275 - RNA, 22 nt, Human
auuuuuaucuaaaauccacuuu

SEQ ID NO: 212276 - RNA, 22 nt, Human
uucauuagcacauuuccuuggu

SEQ ID NO: 212277 - RNA, 22 nt, Human
acaugacagugacuuuauaaga

SEQ ID NO: 212278 - RNA, 22 nt, Human
uggcucacuuccguggagaggu

SEQ ID NO: 212279 - RNA, 22 nt, Human
ugugggcugcuguuuccuugua

SEQ ID NO: 212280 - RNA, 23 nt, Human
uuugggaaauagccuauaggcac

SEQ ID NO: 212281 - RNA, 22 nt, Human
cucuuucauucuguccuuguuu

SEQ ID NO: 212282 - RNA, 22 nt, Human
guacugggaauggagccugggc

SEQ ID NO: 212283 - RNA, 22 nt, Human
uuugaugauuuucuagagugua

SEQ ID NO: 212284 - RNA, 22 nt, Human
auaaauuugccagcauauguuc

SEQ ID NO: 212285 - RNA, 22 nt, Human
ggggcucauuugcaggggggag

SEQ ID NO: 212286 - RNA, 20 nt, Human
aggaacuggaagggaggaaa

SEQ ID NO: 212287 - RNA, 22 nt, Human
gaggagcuucagaggaaucuua

SEQ ID NO: 212288 - RNA, 20 nt, Human
ggccugagcauggcuggcag

SEQ ID NO: 212289 - RNA, 22 nt, Human
ugagacucuccugugcagccuc

SEQ ID NO: 212290 - RNA, 22 nt, Human
aguacuuuuuguucaauugugc

SEQ ID NO: 212291 - RNA, 22 nt, Human
ugagugccagugcuugcucuac

SEQ ID NO: 212292 - RNA, 22 nt, Human
ugcggagggagcagucggcugu

SEQ ID NO: 212293 - RNA, 22 nt, Human
ggacuggugaagccuucggaga

SEQ ID NO: 212294 - RNA, 22 nt, Human
agcaucuaucuucaaugugugu

SEQ ID NO: 212295 - RNA, 22 nt, Human
uccagguaaggguaaguaggcu

SEQ ID NO: 212296 - RNA, 22 nt, Human
ucuggggaugagugaugucgua

SEQ ID NO: 212297 - RNA, 18 nt, Human
uucuaaauucuguuuuua

SEQ ID NO: 212298 - RNA, 22 nt, Human
aaauguuugguggauaaaagga

SEQ ID NO: 212299 - RNA, 22 nt, Human
aggacagagggaccagagccca

SEQ ID NO: 212300 - RNA, 22 nt, Human
uuuaauauucucuuugaaggaa

SEQ ID NO: 212301 - RNA, 22 nt, Human
uggcaucuggugauauggacua

SEQ ID NO: 212302 - RNA, 22 nt, Human
gaaaauaguucaucacaaugau

SEQ ID NO: 212303 - RNA, 22 nt, Human
aauaacuuacucuaugcuuagu

SEQ ID NO: 212304 - RNA, 22 nt, Human
ucgaggagagucgccagcugcu

SEQ ID NO: 212305 - RNA, 22 nt, Human
cauguggaaaugcaugcuuuuu

SEQ ID NO: 212306 - RNA, 22 nt, Human
uuugagaagauaggggaauacu

SEQ ID NO: 212307 - RNA, 19 nt, Human
agcuccucaccucucgcgg

SEQ ID NO: 212308 - RNA, 22 nt, Human
ugaagacaguuuuacucaugag

SEQ ID NO: 212309 - RNA, 23 nt, Human
caccaugacaugccuauagggga

SEQ ID NO: 212310 - RNA, 22 nt, Human
cccagccuuugcuuccugguuc

SEQ ID NO: 212311 - RNA, 22 nt, Human
guuauuuugucuuguucaugaa

SEQ ID NO: 212312 - RNA, 22 nt, Human
gcagugcugcgacagucgggug

SEQ ID NO: 212313 - RNA, 22 nt, Human
ugcaucugagcacuacggugga

SEQ ID NO: 212314 - RNA, 22 nt, Human
aggcucucccacauucauuaca

SEQ ID NO: 212315 - RNA, 22 nt, Human
gagaaagggagaaaaagaucuu

SEQ ID NO: 212316 - RNA, 22 nt, Human
gaguggugagaauacaacggaa

SEQ ID NO: 212317 - RNA, 22 nt, Human
ccugggccuaaacaaacaagag

SEQ ID NO: 212318 - RNA, 21 nt, Human
ggccagauucucccauagcug

SEQ ID NO: 212319 - RNA, 22 nt, Human
ugugccuguugguguagacaua

SEQ ID NO: 212320 - RNA, 22 nt, Human
ugcccugucccuagguuugugg

SEQ ID NO: 212321 - RNA, 22 nt, Human
aagaaggcggaccagaagggag

SEQ ID NO: 212322 - RNA, 22 nt, Human
cuuuccaugucuucuuucucca

SEQ ID NO: 212323 - RNA, 22 nt, Human
gggaagccugggugauccuaaa

SEQ ID NO: 212324 - RNA, 22 nt, Human
gggcugcuccgcccgcugcgcc

SEQ ID NO: 212325 - RNA, 22 nt, Human
uuaguuaauaaauauugagugu

SEQ ID NO: 212326 - RNA, 22 nt, Human
gccaggcggcccaggagauggc

SEQ ID NO: 212327 - RNA, 22 nt, Human
gcugcuacagagcuggaggggg

SEQ ID NO: 212328 - RNA, 22 nt, Human
ucacaucugugugauugucauu

SEQ ID NO: 212329 - RNA, 22 nt, Human
uuuauguuuguuuuugaaauaa

SEQ ID NO: 212330 - RNA, 22 nt, Human
agauuucaauggauauugcaag

SEQ ID NO: 212331 - RNA, 22 nt, Human
acaaucauuuuuccccuucagu

SEQ ID NO: 212332 - RNA, 22 nt, Human
uggggucuggcauaugguagau

SEQ ID NO: 212333 - RNA, 22 nt, Human
ugaaccaugaauuacaggagca

SEQ ID NO: 212334 - RNA, 22 nt, Human
gaggggaauguuccugagcugg

SEQ ID NO: 212335 - RNA, 22 nt, Human
ugaugccauaguaaaauuugcu

SEQ ID NO: 212336 - RNA, 22 nt, Human
uguagggaggaaggguuggaaa

SEQ ID NO: 212337 - RNA, 22 nt, Human
cagcccuugcgacacccuggcu

SEQ ID NO: 212338 - RNA, 22 nt, Human
uucuggggccgugacgaggggc

SEQ ID NO: 212339 - RNA, 21 nt, Human
gggagugaguaaugauggggg

SEQ ID NO: 212340 - RNA, 22 nt, Human
gagggaggugacaaggacauag

SEQ ID NO: 212341 - RNA, 22 nt, Human
uguguguguauacauguauaua

SEQ ID NO: 212342 - RNA, 22 nt, Human
accaagaguccaagugagguug

SEQ ID NO: 212343 - RNA, 22 nt, Human
gaaaaacucagugggggucuuu

SEQ ID NO: 212344 - RNA, 22 nt, Human
auucuuuauuuucuguacuugc

SEQ ID NO: 212345 - RNA, 23 nt, Human
gccaucugcugggugccccggcc

SEQ ID NO: 212346 - RNA, 22 nt, Human
aggcugccuaugaaggcagaag

SEQ ID NO: 212347 - RNA, 22 nt, Human
aagggggacaagcauuggcuua

SEQ ID NO: 212348 - RNA, 22 nt, Human
uaucacauaaaugaggaauauu

SEQ ID NO: 212349 - RNA, 22 nt, Human
uucacuuuuucucugcuugaga

SEQ ID NO: 212350 - RNA, 22 nt, Human
ucuuauugguaaugauggcauu

SEQ ID NO: 212351 - RNA, 22 nt, Human
auaucuaggcugaauguaaaau

SEQ ID NO: 212352 - RNA, 22 nt, Human
ugguugcaguggugcuuauaca

SEQ ID NO: 212353 - RNA, 22 nt, Human
uggugcagacaggagccccgcu

SEQ ID NO: 212354 - RNA, 22 nt, Human
agauauuauuuucuauuuauca

SEQ ID NO: 212355 - RNA, 22 nt, Human
cucuaagcuuugguguuucacu

SEQ ID NO: 212356 - RNA, 22 nt, Human
uguuggaaucuucuagucuucc

SEQ ID NO: 212357 - RNA, 22 nt, Human
uucuuauuuuucguaaauccug

SEQ ID NO: 212358 - RNA, 22 nt, Human
guguucuuuguagaggaucuug

SEQ ID NO: 212359 - RNA, 22 nt, Human
uaacacauagauauuuuaacuu

SEQ ID NO: 212360 - RNA, 22 nt, Human
guguuaggugcauuaaacgugg

SEQ ID NO: 212361 - RNA, 22 nt, Human
cuucuuuucuacuggccuagaa

SEQ ID NO: 212362 - RNA, 22 nt, Human
uuaacauuguccuuagcagauu

SEQ ID NO: 212363 - RNA, 22 nt, Human
auagcacuuaauaugaaacagu

SEQ ID NO: 212364 - RNA, 22 nt, Human
cagcccuggccucuucgcuuuc

SEQ ID NO: 212365 - RNA, 22 nt, Human
agcuaaaaugagguuuuuggau

SEQ ID NO: 212366 - RNA, 20 nt, Human
uccaguuuuggagacauucu

SEQ ID NO: 212367 - RNA, 22 nt, Human
agcugugaccaguuacgaaauu

SEQ ID NO: 212368 - RNA, 22 nt, Human
gggcuguaggagcuggaauggg

SEQ ID NO: 212369 - RNA, 22 nt, Human
aggagggucauguugaagugua

SEQ ID NO: 212370 - RNA, 22 nt, Human
caaugaaaauuuaaguugcagc

SEQ ID NO: 212371 - RNA, 21 nt, Human
acacagcuggagcaucccggu

SEQ ID NO: 212372 - RNA, 22 nt, Human
augcuugcccauguuucugaag

SEQ ID NO: 212373 - RNA, 22 nt, Human
uaauuauuaauuuuagguugcu

SEQ ID NO: 212374 - RNA, 22 nt, Human
gaaaugaaacacacaugcagcu

SEQ ID NO: 212375 - RNA, 22 nt, Human
cguuuugaguagauagccauau

SEQ ID NO: 212376 - RNA, 22 nt, Human
ucuuccuuacucuggauguuau

SEQ ID NO: 212377 - RNA, 22 nt, Human
uauaaagaccuuauccuucaua

SEQ ID NO: 212378 - RNA, 22 nt, Human
uacagaccaguaguucucagcg

SEQ ID NO: 212379 - RNA, 22 nt, Human
ugaauuuguaggaauucuccau

SEQ ID NO: 212380 - RNA, 22 nt, Human
uuugagugcccauguuucccag

SEQ ID NO: 212381 - RNA, 22 nt, Human
ugucacagagcgugcaacagaa

SEQ ID NO: 212382 - RNA, 22 nt, Human
ucuggaggucucagggcgggaa

SEQ ID NO: 212383 - RNA, 22 nt, Human
gauagaaagagaaucagaacuu

SEQ ID NO: 212384 - RNA, 22 nt, Human
gaaguaaaacaguaacuuuguu

SEQ ID NO: 212385 - RNA, 22 nt, Human
uucucugaagagccagcccuua

SEQ ID NO: 212386 - RNA, 22 nt, Human
ucaaauaugggccagaggaaau

SEQ ID NO: 212387 - RNA, 22 nt, Human
cauuuuccucugcugguguuca

SEQ ID NO: 212388 - RNA, 22 nt, Human
uucuaagaaauggaaaacgauu

SEQ ID NO: 212389 - RNA, 22 nt, Human
uaaaaaccuuguauuuaacucu

SEQ ID NO: 212390 - RNA, 22 nt, Human
uggcucagcgcggccuggucuu

SEQ ID NO: 212391 - RNA, 22 nt, Human
ugucacguaaaaacuagauuuc

SEQ ID NO: 212392 - RNA, 22 nt, Human
cuuggguacaguaaagggaggu

SEQ ID NO: 212393 - RNA, 22 nt, Human
uaaaacuaugcaaccuacuacc

SEQ ID NO: 212394 - RNA, 22 nt, Human
uuuauaauuacguaaaauauuu

SEQ ID NO: 212395 - RNA, 22 nt, Human
aucacaaauggaaucaccuccc

SEQ ID NO: 212396 - RNA, 22 nt, Human
gaaaugggggcaugcguuacau

SEQ ID NO: 212397 - RNA, 22 nt, Human
aagaaaagaaacauggguaugc

SEQ ID NO: 212398 - RNA, 19 nt, Human
gugaugaugccacuccaac

SEQ ID NO: 212399 - RNA, 22 nt, Human
gcucuccuugaugcccucuguu

SEQ ID NO: 212400 - RNA, 22 nt, Human
aauaagaguuaagaaguauauu

SEQ ID NO: 212401 - RNA, 22 nt, Human
ugucaucuuggugcugugagag

SEQ ID NO: 212402 - RNA, 20 nt, Human
gagaggguuaggauauuugc

SEQ ID NO: 212403 - RNA, 22 nt, Human
uacuggguguucugagaaaaua

SEQ ID NO: 212404 - RNA, 22 nt, Human
aaguuaaaaaagcuggguaaaa

SEQ ID NO: 212405 - RNA, 22 nt, Human
uuggggagaagagcuggucagg

SEQ ID NO: 212406 - RNA, 22 nt, Human
ccagggcuggguuugucggugu

SEQ ID NO: 212407 - RNA, 22 nt, Human
uguuuagcucugacuaugugau

SEQ ID NO: 212408 - RNA, 22 nt, Human
ugggggguuuagaaucugcccu

SEQ ID NO: 212409 - RNA, 22 nt, Human
ugaagguggcuugcagcuaguc

SEQ ID NO: 212410 - RNA, 22 nt, Human
gcuuuugaauacuacaggaguu

SEQ ID NO: 212411 - RNA, 22 nt, Human
aaagaugucauacacauuaaga

SEQ ID NO: 212412 - RNA, 22 nt, Human
augcggcugugggggaauggga

SEQ ID NO: 212413 - RNA, 22 nt, Human
ugagagaggugaaaugacuuuc

SEQ ID NO: 212414 - RNA, 22 nt, Human
agugucuuuagucgcugagcaa

SEQ ID NO: 212415 - RNA, 22 nt, Human
auuuuguugaaacccuuguugu

SEQ ID NO: 212416 - RNA, 22 nt, Human
cugguacuggaggaguucagag

SEQ ID NO: 212417 - RNA, 22 nt, Human
uaugaguauagugcaccauggu

SEQ ID NO: 212418 - RNA, 22 nt, Human
aggggcaaacuuguucuagggu

SEQ ID NO: 212419 - RNA, 22 nt, Human
aauuaaauguuugguuugagcu

SEQ ID NO: 212420 - RNA, 22 nt, Human
uuuugaugaccauucuucuuuu

SEQ ID NO: 212421 - RNA, 22 nt, Human
acucauucgccuugcccaaggc

SEQ ID NO: 212422 - RNA, 22 nt, Human
uggaagaaaacuuggaaggcau

SEQ ID NO: 212423 - RNA, 22 nt, Human
gaggggcucuugggcaugaagg

SEQ ID NO: 212424 - RNA, 22 nt, Human
agcagucagaucguggggaaaa

SEQ ID NO: 212425 - RNA, 22 nt, Human
uugaaaaaugcccagcagacaa

SEQ ID NO: 212426 - RNA, 22 nt, Human
gugcagcugggcgcugaccuuc

SEQ ID NO: 212427 - RNA, 22 nt, Human
acuucaggagcagucucuggaa

SEQ ID NO: 212428 - RNA, 22 nt, Human
augcugugccuggaaagcggcu

SEQ ID NO: 212429 - RNA, 22 nt, Human
uuauaaaccgcuaacagcacuu

SEQ ID NO: 212430 - RNA, 22 nt, Human
cagagggagcuaaccagcagcc

SEQ ID NO: 212431 - RNA, 22 nt, Human
gcugcagggagcuggaaggcuc

SEQ ID NO: 212432 - RNA, 22 nt, Human
gcaucuguuagagugugcaugc

SEQ ID NO: 212433 - RNA, 18 nt, Human
acuguggcucagaguugc

SEQ ID NO: 212434 - RNA, 22 nt, Human
aaauauauccuucuguccugcc

SEQ ID NO: 212435 - RNA, 22 nt, Human
ugcagcuuuugguuucuagaug

SEQ ID NO: 212436 - RNA, 22 nt, Human
uagcuaggugagcggcuccggc

SEQ ID NO: 212437 - RNA, 22 nt, Human
uugcuuucuuuguagguuuucc

SEQ ID NO: 212438 - RNA, 22 nt, Human
uuaugugcuacacauaauuugu

SEQ ID NO: 212439 - RNA, 22 nt, Human
aucacuagaguuacauugccag

SEQ ID NO: 212440 - RNA, 22 nt, Human
uuagauaaaucagcccugagua

SEQ ID NO: 212441 - RNA, 22 nt, Human
cuugggguuugggggcuugacc

SEQ ID NO: 212442 - RNA, 22 nt, Human
uucagguuuuuaaguucugccu

SEQ ID NO: 212443 - RNA, 22 nt, Human
ucaacauguuuuuuaaaagaaa

SEQ ID NO: 212444 - RNA, 22 nt, Human
gaggcauaaguagaagagauug

SEQ ID NO: 212445 - RNA, 22 nt, Human
acacucagaaaggcagagguuc

SEQ ID NO: 212446 - RNA, 22 nt, Human
agucacuguuuaaucuagcuaa

SEQ ID NO: 212447 - RNA, 22 nt, Human
gaggaggucaccuggugagcaa

SEQ ID NO: 212448 - RNA, 22 nt, Human
cuaguucugccauucaguguca

SEQ ID NO: 212449 - RNA, 22 nt, Human
cagggagcggggagaucucggg

SEQ ID NO: 212450 - RNA, 22 nt, Human
agacuuugaaugaugacagcgu

SEQ ID NO: 212451 - RNA, 22 nt, Human
gaguggucacuaauuuccuuaa

SEQ ID NO: 212452 - RNA, 22 nt, Human
ucugggccaacccuuccauggg

SEQ ID NO: 212453 - RNA, 22 nt, Human
gcagugcauggaagggggugug

SEQ ID NO: 212454 - RNA, 22 nt, Human
uaaauuggaauaaugagaagug

SEQ ID NO: 212455 - RNA, 22 nt, Human
ugaaggaggugaauccaugcau

SEQ ID NO: 212456 - RNA, 22 nt, Human
ccagccacagcuuccagcuccu

SEQ ID NO: 212457 - RNA, 22 nt, Human
uauagccuuacaagauauuaua

SEQ ID NO: 212458 - RNA, 22 nt, Human
aaaaggaacaauaugguauuuu

SEQ ID NO: 212459 - RNA, 22 nt, Human
aaggcuuguugucacgcucuug

SEQ ID NO: 212460 - RNA, 22 nt, Human
gucucacuucauuuucuuagcc

SEQ ID NO: 212461 - RNA, 22 nt, Human
gagagaggggaagagaagcucu

SEQ ID NO: 212462 - RNA, 22 nt, Human
gguugccuguggcucccuguua

SEQ ID NO: 212463 - RNA, 22 nt, Human
agggcugcugcuccgggcccag

SEQ ID NO: 212464 - RNA, 22 nt, Human
cuaaaacuuuuccaaauuaugu

SEQ ID NO: 212465 - RNA, 22 nt, Human
agugcuuuauguuguugugcaa

SEQ ID NO: 212466 - RNA, 22 nt, Human
gcuuuguugauggugagucugu

SEQ ID NO: 212467 - RNA, 19 nt, Human
aggucuaaucauaagacaa

SEQ ID NO: 212468 - RNA, 22 nt, Human
uccccugccccccauccucugg

SEQ ID NO: 212469 - RNA, 22 nt, Human
auuacagaagauaugcucaaca

SEQ ID NO: 212470 - RNA, 18 nt, Human
gccagcccuccaaccucc

SEQ ID NO: 212471 - RNA, 22 nt, Human
cauuuugguaauguucguuugc

SEQ ID NO: 212472 - RNA, 22 nt, Human
guggcagagagcaagugucuga

SEQ ID NO: 212473 - RNA, 22 nt, Human
uggaguuuuaaucuguacagaa

SEQ ID NO: 212474 - RNA, 22 nt, Human
aacaggcuaaauuguccauuuc

SEQ ID NO: 212475 - RNA, 22 nt, Human
aaaugcuuuaauugaguucaug

SEQ ID NO: 212476 - RNA, 22 nt, Human
ugacagaggagcuggaaugauu

SEQ ID NO: 212477 - RNA, 22 nt, Human
ccagcuuuucagaaucugccug

SEQ ID NO: 212478 - RNA, 19 nt, Human
agacugaagggcccgaguc

SEQ ID NO: 212479 - RNA, 22 nt, Human
ggggaggugugcaggacaccuc

SEQ ID NO: 212480 - RNA, 22 nt, Human
uuugaagauaaauauggagaaa

SEQ ID NO: 212481 - RNA, 22 nt, Human
agggagucuggccgucggcugg

SEQ ID NO: 212482 - RNA, 22 nt, Human
uggauuuuggaauguuucagua

SEQ ID NO: 212483 - RNA, 22 nt, Human
uggcugagcugcagcguggcuu

SEQ ID NO: 212484 - RNA, 22 nt, Human
uuuuccuuccugucucuuuauu

SEQ ID NO: 212485 - RNA, 22 nt, Human
acauuucuccuacuuguuauuu

SEQ ID NO: 212486 - RNA, 22 nt, Human
agaauaagucuaauauauuggu

SEQ ID NO: 212487 - RNA, 22 nt, Human
cucaagugacucagccugguug

SEQ ID NO: 212488 - RNA, 22 nt, Human
ggucuuccuugggggacuugaa

SEQ ID NO: 212489 - RNA, 23 nt, Human
ccagcugugccuggcccaggagc

SEQ ID NO: 212490 - RNA, 22 nt, Human
guaaauuaugucugggucaguu

SEQ ID NO: 212491 - RNA, 22 nt, Human
guccuggugccaccugcgggau

SEQ ID NO: 212492 - RNA, 22 nt, Human
uuucuaguauauaacuagaucu

SEQ ID NO: 212493 - RNA, 22 nt, Human
ggaggaaauccuuaguaaggca

SEQ ID NO: 212494 - RNA, 22 nt, Human
auaaaagcacaauagaguuaug

SEQ ID NO: 212495 - RNA, 23 nt, Human
ugcaaugcagcuagauguaaaau

SEQ ID NO: 212496 - RNA, 22 nt, Human
aacauuuauguuuugaccaagu

SEQ ID NO: 212497 - RNA, 22 nt, Human
ucccacagcuuccuagccacag

SEQ ID NO: 212498 - RNA, 22 nt, Human
agcaggggcaggguuuugugcu

SEQ ID NO: 212499 - RNA, 22 nt, Human
aauauuuaaauagaauuacauc

SEQ ID NO: 212500 - RNA, 20 nt, Human
agguuugcuguauaucaugg

SEQ ID NO: 212501 - RNA, 22 nt, Human
guugggguuucaguggcaguca

SEQ ID NO: 212502 - RNA, 22 nt, Human
caggacuuccucuaugguggcg

SEQ ID NO: 212503 - RNA, 22 nt, Human
uagcuucccagcuaaccauguc

SEQ ID NO: 212504 - RNA, 22 nt, Human
auguuccaugacuaugcaugaa

SEQ ID NO: 212505 - RNA, 22 nt, Human
gccucucagcuagaaggcaggu

SEQ ID NO: 212506 - RNA, 22 nt, Human
aacgagcugggggggccggggg

SEQ ID NO: 212507 - RNA, 22 nt, Human
uuggaggucucugugguggugg

SEQ ID NO: 212508 - RNA, 22 nt, Human
aacagaauaucaaaagauuaug

SEQ ID NO: 212509 - RNA, 22 nt, Human
cucuggacaucugcggugcuuc

SEQ ID NO: 212510 - RNA, 22 nt, Human
gcuuucacugcaauagaugaau

SEQ ID NO: 212511 - RNA, 22 nt, Human
acccauggcucucugggaugcu

SEQ ID NO: 212512 - RNA, 22 nt, Human
aggaaaguugcuuguagugcug

SEQ ID NO: 212513 - RNA, 22 nt, Human
gaggugauuccucccauguaau

SEQ ID NO: 212514 - RNA, 21 nt, Human
gccacugcugcucauucucug

SEQ ID NO: 212515 - RNA, 22 nt, Human
gugaaacuggaugugaaaacaa

SEQ ID NO: 212516 - RNA, 22 nt, Human
gggagggaggagccccggccau

SEQ ID NO: 212517 - RNA, 22 nt, Human
aggacaagacaaggaccagaga

SEQ ID NO: 212518 - RNA, 22 nt, Human
cacagauaaggcuuugucccca

SEQ ID NO: 212519 - RNA, 20 nt, Human
cauuccaugcaucuuggucc

SEQ ID NO: 212520 - RNA, 22 nt, Human
uaaaggaccuguacuagguuua

SEQ ID NO: 212521 - RNA, 22 nt, Human
aaagguguagacucaguuaugc

SEQ ID NO: 212522 - RNA, 22 nt, Human
gugguggggaguuggauggaag

SEQ ID NO: 212523 - RNA, 22 nt, Human
uuccccagaaaaguaaacaagg

SEQ ID NO: 212524 - RNA, 22 nt, Human
ucuugccuuuucuagcuucuag

SEQ ID NO: 212525 - RNA, 22 nt, Human
uugggagaggcagcagagucau

SEQ ID NO: 212526 - RNA, 22 nt, Human
gguguacgaagaggcgggaguc

SEQ ID NO: 212527 - RNA, 22 nt, Human
aagacagaaaagcagagagagg

SEQ ID NO: 212528 - RNA, 22 nt, Human
cuggguuuggcugugcuugaau

SEQ ID NO: 212529 - RNA, 22 nt, Human
ucgggaggaggcggagcucguu

SEQ ID NO: 212530 - RNA, 22 nt, Human
ucccuuuuuccugaucugugaa

SEQ ID NO: 212531 - RNA, 22 nt, Human
uuuuccuugagucggggcacag

SEQ ID NO: 212532 - RNA, 22 nt, Human
cuucaacuucuguuuuaaggaa

SEQ ID NO: 212533 - RNA, 22 nt, Human
uaguugaauuuaucaguagcau

SEQ ID NO: 212534 - RNA, 23 nt, Human
gucauuacuguuaccuuauucuu

SEQ ID NO: 212535 - RNA, 22 nt, Human
cuaccagcacgccuuccucuac

SEQ ID NO: 212536 - RNA, 22 nt, Human
agcuugauggauugcugaggca

SEQ ID NO: 212537 - RNA, 20 nt, Human
cucugggaggcuugucaccu

SEQ ID NO: 212538 - RNA, 22 nt, Human
uuguuuuaguagaaguuacaug

SEQ ID NO: 212539 - RNA, 22 nt, Human
aacagagauucuucccuucuuu

SEQ ID NO: 212540 - RNA, 22 nt, Human
cgagggcuggaggggagacaga

SEQ ID NO: 212541 - RNA, 22 nt, Human
gcugagcagcgaaggcacaugc

SEQ ID NO: 212542 - RNA, 22 nt, Human
caggcaggagaaaaggcgcggg

SEQ ID NO: 212543 - RNA, 22 nt, Human
cagaggaugucuacaccuugag

SEQ ID NO: 212544 - RNA, 22 nt, Human
agagauacugcaggccauaaau

SEQ ID NO: 212545 - RNA, 22 nt, Human
caugcuaacacguugcucaccg

SEQ ID NO: 212546 - RNA, 21 nt, Human
gggaagagaagagaaaggagg

SEQ ID NO: 212547 - RNA, 22 nt, Human
ggacuuucuccugcacaaagug

SEQ ID NO: 212548 - RNA, 22 nt, Human
uuuacaagucuguugaucccaa

SEQ ID NO: 212549 - RNA, 21 nt, Human
auuauagugacuaaauugaua

SEQ ID NO: 212550 - RNA, 18 nt, Human
guucaagcauuuugcucu

SEQ ID NO: 212551 - RNA, 22 nt, Human
guggagaaagcuggaaucugag

SEQ ID NO: 212552 - RNA, 22 nt, Human
ucccacacucaacacacaugua

SEQ ID NO: 212553 - RNA, 22 nt, Human
aaaauaaccuucauuugcauug

SEQ ID NO: 212554 - RNA, 23 nt, Human
aagcaacagacuucaucagauau

SEQ ID NO: 212555 - RNA, 19 nt, Human
agcucaggcccaucguccc

SEQ ID NO: 212556 - RNA, 22 nt, Human
acauauaugugcauacaacuau

SEQ ID NO: 212557 - RNA, 16 nt, Human
gaauuccauugcucug

SEQ ID NO: 212558 - RNA, 22 nt, Human
guauuauauaaccauugguucu

SEQ ID NO: 212559 - RNA, 22 nt, Human
ggaugcugcuccacaucccaca

SEQ ID NO: 212560 - RNA, 22 nt, Human
aguugcuucccuauucuuagca

SEQ ID NO: 212561 - RNA, 22 nt, Human
cgugccugguggagagcgaggg

SEQ ID NO: 212562 - RNA, 22 nt, Human
gcugggagaggcagcuuucgga

SEQ ID NO: 212563 - RNA, 22 nt, Human
cugcaguguccgcuugcucagc

SEQ ID NO: 212564 - RNA, 22 nt, Human
acuugauggaguuucacuguau

SEQ ID NO: 212565 - RNA, 22 nt, Human
ggaggagggaguucaggaguau

SEQ ID NO: 212566 - RNA, 22 nt, Human
ggaauuaagaggcuggacaggg

SEQ ID NO: 212567 - RNA, 22 nt, Human
ucuggcaguugccgcuucaguc

SEQ ID NO: 212568 - RNA, 22 nt, Human
ugguccaaaccagugcuguggu

SEQ ID NO: 212569 - RNA, 22 nt, Human
gacacaacuucccucccacauu

SEQ ID NO: 212570 - RNA, 22 nt, Human
ggaauauaaaucagaugcuccg

SEQ ID NO: 212571 - RNA, 22 nt, Human
gaggggaaggauuucuucagaa

SEQ ID NO: 212572 - RNA, 23 nt, Human
agaugaugaauaaagagugagga

SEQ ID NO: 212573 - RNA, 22 nt, Human
gaguacagaagauaaaggcaca

SEQ ID NO: 212574 - RNA, 22 nt, Human
acugaauguucucaaaggggag

SEQ ID NO: 212575 - RNA, 22 nt, Human
auaugagaggaggagcaucagu

SEQ ID NO: 212576 - RNA, 20 nt, Human
cuggaguguagcaguggcug

SEQ ID NO: 212577 - RNA, 22 nt, Human
gaggggaaggguguucaauggg

SEQ ID NO: 212578 - RNA, 22 nt, Human
aagcccuuugaaaauguguguc

SEQ ID NO: 212579 - RNA, 22 nt, Human
uucucagagaaagcuccucaug

SEQ ID NO: 212580 - RNA, 22 nt, Human
ugacaucuagauaaaugggaca

SEQ ID NO: 212581 - RNA, 22 nt, Human
aaugauuuucugcaaacaguga

SEQ ID NO: 212582 - RNA, 23 nt, Human
aaucacuggauuugagcaugagg

SEQ ID NO: 212583 - RNA, 22 nt, Human
uagugauuuaagaaaggugacu

SEQ ID NO: 212584 - RNA, 18 nt, Human
ccccucuuccagacagag

SEQ ID NO: 212585 - RNA, 22 nt, Human
aauguuuaguuuuauuuuagua

SEQ ID NO: 212586 - RNA, 20 nt, Human
ucuugucuggcagccuggag

SEQ ID NO: 212587 - RNA, 22 nt, Human
uuuuacauuuuauucguuuauu

SEQ ID NO: 212588 - RNA, 22 nt, Human
uuggacugguuuacauuucaag

SEQ ID NO: 212589 - RNA, 22 nt, Human
uugucagcuagugaugcuguuc

SEQ ID NO: 212590 - RNA, 22 nt, Human
agcccuuucuuguuuaacugca

SEQ ID NO: 212591 - RNA, 22 nt, Human
gucugcagcacugugcacgguc

SEQ ID NO: 212592 - RNA, 22 nt, Human
auauuauuaaaauagauggaua

SEQ ID NO: 212593 - RNA, 22 nt, Human
uuuuuuuuacuccggacagcuc

SEQ ID NO: 212594 - RNA, 22 nt, Human
ugucccaucacagaggagacua

SEQ ID NO: 212595 - RNA, 22 nt, Human
ucacucuuuaucuuuuaugucu

SEQ ID NO: 212596 - RNA, 22 nt, Human
ucacccagacugucugacucuu

SEQ ID NO: 212597 - RNA, 22 nt, Human
acaaccaugucaguucaaacca

SEQ ID NO: 212598 - RNA, 22 nt, Human
auacaaaaaguggugaguguau

SEQ ID NO: 212599 - RNA, 22 nt, Human
auguuuuaaaaaacaggcuacc

SEQ ID NO: 212600 - RNA, 17 nt, Human
uccuacaggugugcuga

SEQ ID NO: 212601 - RNA, 21 nt, Human
ucuggggacaagguccaggaa

SEQ ID NO: 212602 - RNA, 22 nt, Human
uuucugugguggguaguucaga

SEQ ID NO: 212603 - RNA, 22 nt, Human
gugggagggaguccugggagca

SEQ ID NO: 212604 - RNA, 22 nt, Human
uggaaagaagacugugguugag

SEQ ID NO: 212605 - RNA, 22 nt, Human
uugcguaucuacauugccugua

SEQ ID NO: 212606 - RNA, 18 nt, Human
aggcuggggaucacaggg

SEQ ID NO: 212607 - RNA, 22 nt, Human
uucacugugauugggguggauu

SEQ ID NO: 212608 - RNA, 22 nt, Human
agagggagagauuggcaaucag

SEQ ID NO: 212609 - RNA, 22 nt, Human
accuccauggcccacaucuagu

SEQ ID NO: 212610 - RNA, 22 nt, Human
uuauguugauaggaaucugauu

SEQ ID NO: 212611 - RNA, 22 nt, Human
aauaugcaaagcguguuaucug

SEQ ID NO: 212612 - RNA, 23 nt, Human
cuuauauaaucauuagaaaccau

SEQ ID NO: 212613 - RNA, 22 nt, Human
uuaaacauuuccacuugccagu

SEQ ID NO: 212614 - RNA, 22 nt, Human
gaggggcugggguugacuccaa

SEQ ID NO: 212615 - RNA, 22 nt, Human
aaaagguuauagcuuugccuug

SEQ ID NO: 212616 - RNA, 22 nt, Human
auuagaagagcuuuuuacucuu

SEQ ID NO: 212617 - RNA, 22 nt, Human
uaaagugaaguucagaauggcu

SEQ ID NO: 212618 - RNA, 22 nt, Human
ccagggaggucauagugcuggu

SEQ ID NO: 212619 - RNA, 22 nt, Human
ucacuuuacaucuguaaaagga

SEQ ID NO: 212620 - RNA, 22 nt, Human
ucucuagaggaauuguucuagg

SEQ ID NO: 212621 - RNA, 22 nt, Human
cacagcuggggaagcugaggcc

SEQ ID NO: 212622 - RNA, 22 nt, Human
aggcaggcucaaugcccagucu

SEQ ID NO: 212623 - RNA, 22 nt, Human
ggaagaggaagaugaggcagca

SEQ ID NO: 212624 - RNA, 22 nt, Human
agcugacagugcauggagggac

SEQ ID NO: 212625 - RNA, 22 nt, Human
agugacauuauuuuguguacua

SEQ ID NO: 212626 - RNA, 22 nt, Human
uggggagcucagcaccaucagu

SEQ ID NO: 212627 - RNA, 22 nt, Human
cugggagggguagccaauccua

SEQ ID NO: 212628 - RNA, 22 nt, Human
acagacuuuuagacuuaugagu

SEQ ID NO: 212629 - RNA, 20 nt, Human
ccuuguggaugucuuuuuug

SEQ ID NO: 212630 - RNA, 18 nt, Human
ugcccaccagaagaggga

SEQ ID NO: 212631 - RNA, 22 nt, Human
cugaaagacagccaggcaaagc

SEQ ID NO: 212632 - RNA, 22 nt, Human
gcagcguguggcuaauggcucu

SEQ ID NO: 212633 - RNA, 22 nt, Human
cagccgcucaugggcccggagc

SEQ ID NO: 212634 - RNA, 22 nt, Human
gggcuguggggccugcagaagg

SEQ ID NO: 212635 - RNA, 21 nt, Human
agucaagcugccugcuuggca

SEQ ID NO: 212636 - RNA, 22 nt, Human
gccaggcagcagcgaggauggu

SEQ ID NO: 212637 - RNA, 22 nt, Human
uuucucagcauauugccuuuga

SEQ ID NO: 212638 - RNA, 22 nt, Human
aaggaaaguuaagguaaacucu

SEQ ID NO: 212639 - RNA, 22 nt, Human
gacuggggcauuagaguagcuu

SEQ ID NO: 212640 - RNA, 22 nt, Human
aagaacaacugcuuuaaaagca

SEQ ID NO: 212641 - RNA, 22 nt, Human
agggcugggcuuggcaggcugg

SEQ ID NO: 212642 - RNA, 22 nt, Human
uagccacagaauucugaguaga

SEQ ID NO: 212643 - RNA, 22 nt, Human
auaaaaucugaagcaagaauaa

SEQ ID NO: 212644 - RNA, 22 nt, Human
uauauuuguccuagcuccuagc

SEQ ID NO: 212645 - RNA, 22 nt, Human
gucaucugagggacgagauuuc

SEQ ID NO: 212646 - RNA, 22 nt, Human
uaagggagcagaagcugugaaa

SEQ ID NO: 212647 - RNA, 22 nt, Human
uuuuauaaaaccuguuugaccu

SEQ ID NO: 212648 - RNA, 22 nt, Human
aagcucagcugguggugauugc

SEQ ID NO: 212649 - RNA, 22 nt, Human
guggguauauauaugugugcug

SEQ ID NO: 212650 - RNA, 22 nt, Human
caguggggcuuccagacgcuga

SEQ ID NO: 212651 - RNA, 22 nt, Human
gugucuuauugauguuggcacu

SEQ ID NO: 212652 - RNA, 22 nt, Human
aggccagggacaaugaggcaga

SEQ ID NO: 212653 - RNA, 22 nt, Human
aggcuccucugggggccccgga

SEQ ID NO: 212654 - RNA, 22 nt, Human
gaucccagaggcggggauagga

SEQ ID NO: 212655 - RNA, 22 nt, Human
cauaggcucuucagagaacuga

SEQ ID NO: 212656 - RNA, 22 nt, Human
gcaguagauccagcagccugca

SEQ ID NO: 212657 - RNA, 22 nt, Human
auggcagcggagcuggaaauga

SEQ ID NO: 212658 - RNA, 22 nt, Human
ugugagcugccacuucuaaucu

SEQ ID NO: 212659 - RNA, 22 nt, Human
auauuuguacagcuugugaguu

SEQ ID NO: 212660 - RNA, 22 nt, Human
auggagcagagcugaugggccu

SEQ ID NO: 212661 - RNA, 22 nt, Human
uagaggguccaggagggcaaga

SEQ ID NO: 212662 - RNA, 17 nt, Human
ucuccuggcucuaucag

SEQ ID NO: 212663 - RNA, 18 nt, Human
aguaaauguuaaauauug

SEQ ID NO: 212664 - RNA, 22 nt, Human
ggaaguggauucagggcugcua

SEQ ID NO: 212665 - RNA, 22 nt, Human
auggggaauugaccguggaucu

SEQ ID NO: 212666 - RNA, 22 nt, Human
cucuucauuauucacgcccugu

SEQ ID NO: 212667 - RNA, 22 nt, Human
ggcugugggguccuguggugug

SEQ ID NO: 212668 - RNA, 22 nt, Human
ggcuuuuucccuaggguaagag

SEQ ID NO: 212669 - RNA, 22 nt, Human
ggauggugauguacccagucau

SEQ ID NO: 212670 - RNA, 22 nt, Human
uucuauaagagaugaauacagu

SEQ ID NO: 212671 - RNA, 22 nt, Human
uacaaagugauuuuggaauuga

SEQ ID NO: 212672 - RNA, 22 nt, Human
ugaguuuaggccaggauauggu

SEQ ID NO: 212673 - RNA, 22 nt, Human
cuguaaguggugaaauuaguuu

SEQ ID NO: 212674 - RNA, 22 nt, Human
aaauguauuagccuaugugaga

SEQ ID NO: 212675 - RNA, 22 nt, Human
cagaccagaaggaagccgacaa

SEQ ID NO: 212676 - RNA, 22 nt, Human
gagaaaaauuucuuugcugcac

SEQ ID NO: 212677 - RNA, 23 nt, Human
ucccuguuucagggccagaacug

SEQ ID NO: 212678 - RNA, 22 nt, Human
ugaaccugagggcaaagggaca

SEQ ID NO: 212679 - RNA, 22 nt, Human
gugccgggcugcggcaaggugu

SEQ ID NO: 212680 - RNA, 22 nt, Human
gcuuauugcuuauagauaggaa

SEQ ID NO: 212681 - RNA, 22 nt, Human
agagacuguaaugagagguaca

SEQ ID NO: 212682 - RNA, 22 nt, Human
aaggcacauauuuuagagucac

SEQ ID NO: 212683 - RNA, 22 nt, Human
uucugugacuccucagagauuu

SEQ ID NO: 212684 - RNA, 22 nt, Human
augggugggagugaaggggcuc

SEQ ID NO: 212685 - RNA, 22 nt, Human
uauuuuauuuagguuuaguugu

SEQ ID NO: 212686 - RNA, 19 nt, Human
ucuguggagcucagaguag

SEQ ID NO: 212687 - RNA, 23 nt, Human
acucucuguuuggaggcacuggu

SEQ ID NO: 212688 - RNA, 22 nt, Human
aauugauauuagauuugucuca

SEQ ID NO: 212689 - RNA, 22 nt, Human
guucuacaugacacucaacauu

SEQ ID NO: 212690 - RNA, 22 nt, Human
ugcagugaugcuucuggcucag

SEQ ID NO: 212691 - RNA, 22 nt, Human
auucucuguacagaagguaccg

SEQ ID NO: 212692 - RNA, 22 nt, Human
uacaaucacccaaagagccaga

SEQ ID NO: 212693 - RNA, 22 nt, Human
uuucuaaaauuacugcagucgg

SEQ ID NO: 212694 - RNA, 22 nt, Human
guugcaaaugggaagaugguua

SEQ ID NO: 212695 - RNA, 22 nt, Human
caaauggggaauagaugauggg

SEQ ID NO: 212696 - RNA, 22 nt, Human
auauuuuugcagaauuuuucgu

SEQ ID NO: 212697 - RNA, 22 nt, Human
uuuaaaacagcauuuaaaaggu

SEQ ID NO: 212698 - RNA, 22 nt, Human
aggagagaacaagaguauccug

SEQ ID NO: 212699 - RNA, 22 nt, Human
ugggccacguggagucuguagg

SEQ ID NO: 212700 - RNA, 22 nt, Human
guuguuuuuguuaaaacaguga

SEQ ID NO: 212701 - RNA, 20 nt, Human
agcauucaacuuucuauguu

SEQ ID NO: 212702 - RNA, 22 nt, Human
guauggaguuuuguugcacuuc

SEQ ID NO: 212703 - RNA, 22 nt, Human
guaauucugugugaaucuauua

SEQ ID NO: 212704 - RNA, 22 nt, Human
uuuugcuucuaguauauuuuuu

SEQ ID NO: 212705 - RNA, 22 nt, Human
uggggagucccaacgguggaag

SEQ ID NO: 212706 - RNA, 21 nt, Human
uaaggaagagcauuuuagguc

SEQ ID NO: 212707 - RNA, 22 nt, Human
ugagggaagguugauaauguuc

SEQ ID NO: 212708 - RNA, 22 nt, Human
caauggagccaagaggaggaaa

SEQ ID NO: 212709 - RNA, 22 nt, Human
aggugcagcugguggagucugg

SEQ ID NO: 212710 - RNA, 19 nt, Human
cucuggcuccugggcugcc

SEQ ID NO: 212711 - RNA, 22 nt, Human
ugcaucccaaacaugguuuccu

SEQ ID NO: 212712 - RNA, 22 nt, Human
uacauagaauauauaaaugucg

SEQ ID NO: 212713 - RNA, 22 nt, Human
aagagggguggucugugaggau

SEQ ID NO: 212714 - RNA, 22 nt, Human
uuggucaagacugauaucaaga

SEQ ID NO: 212715 - RNA, 22 nt, Human
aagaggcagcuugguaggcauc

SEQ ID NO: 212716 - RNA, 22 nt, Human
cucuggagggaggcugagcugg

SEQ ID NO: 212717 - RNA, 22 nt, Human
uguguggaaaugcuguauaugu

SEQ ID NO: 212718 - RNA, 22 nt, Human
aaacaaauccaauaauaaaauu

SEQ ID NO: 212719 - RNA, 22 nt, Human
acaauaauguuuuuagguuauu

SEQ ID NO: 212720 - RNA, 22 nt, Human
uuuacuuuugguaaggucauuu

SEQ ID NO: 212721 - RNA, 22 nt, Human
uguguguauauauauguaucau

SEQ ID NO: 212722 - RNA, 22 nt, Human
uucuggagucuauuuugaaaag

SEQ ID NO: 212723 - RNA, 18 nt, Human
agucugagugaaauguag

SEQ ID NO: 212724 - RNA, 22 nt, Human
ucauuagauuccugugguggau

SEQ ID NO: 212725 - RNA, 22 nt, Human
aaauuuauaacuuaaagugaau

SEQ ID NO: 212726 - RNA, 22 nt, Human
gaaaagaaaggaugguaugugu

SEQ ID NO: 212727 - RNA, 22 nt, Human
aauugcuuucacaaguguuaua

SEQ ID NO: 212728 - RNA, 21 nt, Human
aggugaaggcgagggggacag

SEQ ID NO: 212729 - RNA, 22 nt, Human
cuguuucucugccugcacacau

SEQ ID NO: 212730 - RNA, 22 nt, Human
ccucaggaauuuauucuucugu

SEQ ID NO: 212731 - RNA, 22 nt, Human
aggaacaacagccuuuauaucc

SEQ ID NO: 212732 - RNA, 22 nt, Human
gauaaauaguguuuggggacau

SEQ ID NO: 212733 - RNA, 22 nt, Human
ggagagagggaucuuuguggag

SEQ ID NO: 212734 - RNA, 20 nt, Human
uacaaggauguucaucagag

SEQ ID NO: 212735 - RNA, 22 nt, Human
cugaucuuaaguaacauuauuu

SEQ ID NO: 212736 - RNA, 22 nt, Human
gcuguguaugaugcaggcaccu

SEQ ID NO: 212737 - RNA, 22 nt, Human
acaugguguggcacuaggggcu

SEQ ID NO: 212738 - RNA, 22 nt, Human
caucaacagucuacuuuuugcc

SEQ ID NO: 212739 - RNA, 22 nt, Human
uuugggguuuuuuggugaaauc

SEQ ID NO: 212740 - RNA, 22 nt, Human
ucugaguuaaaauuccagaggu

SEQ ID NO: 212741 - RNA, 22 nt, Human
ucagugugacccuucuauuuuu

SEQ ID NO: 212742 - RNA, 22 nt, Human
uccaaauagcuggaugauggug

SEQ ID NO: 212743 - RNA, 22 nt, Human
agaaaaggaagcuuagacugua

SEQ ID NO: 212744 - RNA, 22 nt, Human
aaaaauuucuggugaaaugccu

SEQ ID NO: 212745 - RNA, 22 nt, Human
cauccagcuccugggggccacc

SEQ ID NO: 212746 - RNA, 22 nt, Human
cugcuuguguugcucagaguca

SEQ ID NO: 212747 - RNA, 22 nt, Human
ggugcuucgauagguguccaua

SEQ ID NO: 212748 - RNA, 22 nt, Human
accucccugaaaaagacagugc

SEQ ID NO: 212749 - RNA, 22 nt, Human
agccugagucugcacauagaac

SEQ ID NO: 212750 - RNA, 22 nt, Human
gcagccauggcuggccgggcau

SEQ ID NO: 212751 - RNA, 22 nt, Human
caggggcuccaggugagccugg

SEQ ID NO: 212752 - RNA, 22 nt, Human
ccaaaauauuagugcuuaagua

SEQ ID NO: 212753 - RNA, 22 nt, Human
cacugugagugcaagcaggggu

SEQ ID NO: 212754 - RNA, 22 nt, Human
uaaagaagaaaaggcuucaggc

SEQ ID NO: 212755 - RNA, 22 nt, Human
auucauucugaccucaagagaa

SEQ ID NO: 212756 - RNA, 23 nt, Human
gcucugauaccagcuacaucuag

SEQ ID NO: 212757 - RNA, 22 nt, Human
cuguccuguggccugcuccggu

SEQ ID NO: 212758 - RNA, 22 nt, Human
uaauaucuuuacacauuuucaa

SEQ ID NO: 212759 - RNA, 22 nt, Human
caaggggagcugguauggaugg

SEQ ID NO: 212760 - RNA, 22 nt, Human
cuccaggacugaggacagagcu

SEQ ID NO: 212761 - RNA, 22 nt, Human
uuuucuucucauucugaccuca

SEQ ID NO: 212762 - RNA, 23 nt, Human
acagcaagaggaccagaugugag

SEQ ID NO: 212763 - RNA, 22 nt, Human
ccauguaagcuggacuccuggg

SEQ ID NO: 212764 - RNA, 22 nt, Human
cuaguauuaagugugaguaaaa

SEQ ID NO: 212765 - RNA, 22 nt, Human
agagauugagcucagaagaccu

SEQ ID NO: 212766 - RNA, 22 nt, Human
uccagcugugcuccaggaggug

SEQ ID NO: 212767 - RNA, 22 nt, Human
gaaauagagacaguaagugucu

SEQ ID NO: 212768 - RNA, 22 nt, Human
uacaaucaggcucuagcuucuc

SEQ ID NO: 212769 - RNA, 22 nt, Human
augagaaauaauuguguacuga

SEQ ID NO: 212770 - RNA, 22 nt, Human
aggcaggggagcuggaagggua

SEQ ID NO: 212771 - RNA, 22 nt, Human
ccagcaagacucgcagugggau

SEQ ID NO: 212772 - RNA, 22 nt, Human
cagguauaugugugucuaauac

SEQ ID NO: 212773 - RNA, 22 nt, Human
ccagagcacaccguuugccuuc

SEQ ID NO: 212774 - RNA, 20 nt, Human
aggcagacaaggagucuguu

SEQ ID NO: 212775 - RNA, 22 nt, Human
acaaguuucauuguuuagaacc

SEQ ID NO: 212776 - RNA, 22 nt, Human
cuccagagagaaaggaggccgc

SEQ ID NO: 212777 - RNA, 22 nt, Human
gcaggcaggauucagagauaca

SEQ ID NO: 212778 - RNA, 21 nt, Human
cagcagaugccagggucucug

SEQ ID NO: 212779 - RNA, 22 nt, Human
guuuuauaacuauagugagaau

SEQ ID NO: 212780 - RNA, 22 nt, Human
cuccucccagcccaggcgccac

SEQ ID NO: 212781 - RNA, 23 nt, Human
uauuuuccccuguaauauguauu

SEQ ID NO: 212782 - RNA, 22 nt, Human
auguucucagguuguauuuauu

SEQ ID NO: 212783 - RNA, 22 nt, Human
auaaaacagaucaggagaauga

SEQ ID NO: 212784 - RNA, 22 nt, Human
aauuucuuucagcugcuuuaag

SEQ ID NO: 212785 - RNA, 22 nt, Human
ggcagcagaaccaacuguggcu

SEQ ID NO: 212786 - RNA, 22 nt, Human
uggggcugguaccguaauauau

SEQ ID NO: 212787 - RNA, 18 nt, Human
gccucuguugacagaguu

SEQ ID NO: 212788 - RNA, 18 nt, Human
aaacccacguauucaggc

SEQ ID NO: 212789 - RNA, 22 nt, Human
aaggccuaggaguugacauggg

SEQ ID NO: 212790 - RNA, 22 nt, Human
ugucuuuagagugaacagaaga

SEQ ID NO: 212791 - RNA, 22 nt, Human
gugaaggggaagcagggagagg

SEQ ID NO: 212792 - RNA, 22 nt, Human
ggaggaggggcggggaggggag

SEQ ID NO: 212793 - RNA, 22 nt, Human
ucugcuggugucauuuuugcua

SEQ ID NO: 212794 - RNA, 22 nt, Human
cuuggcaaaguggcaaaauuag

SEQ ID NO: 212795 - RNA, 22 nt, Human
auuaugugagggacuuaaucau

SEQ ID NO: 212796 - RNA, 22 nt, Human
cguucccuccugccacgggagg

SEQ ID NO: 212797 - RNA, 22 nt, Human
ccagggcggacaaggucuuuga

SEQ ID NO: 212798 - RNA, 22 nt, Human
agaaaagagacaauguuuuugg

SEQ ID NO: 212799 - RNA, 22 nt, Human
uggagggaagcaaacacuagau

SEQ ID NO: 212800 - RNA, 22 nt, Human
ccaaggcuggagggcuuaugua

SEQ ID NO: 212801 - RNA, 22 nt, Human
cuuuucauuucauggaauacaa

SEQ ID NO: 212802 - RNA, 22 nt, Human
ugcuuucaaaacucagaggaau

SEQ ID NO: 212803 - RNA, 22 nt, Human
uauaagaaacaaggcaaauuuu

SEQ ID NO: 212804 - RNA, 22 nt, Human
agcuccugcgcacggugcacac

SEQ ID NO: 212805 - RNA, 22 nt, Human
aaccuggaggaccuuaugcuaa

SEQ ID NO: 212806 - RNA, 22 nt, Human
auuuauuuucccucaaguaccu

SEQ ID NO: 212807 - RNA, 22 nt, Human
acaggggauaggcaggaaggca

SEQ ID NO: 212808 - RNA, 22 nt, Human
cggggcgggcgugggaggugga

SEQ ID NO: 212809 - RNA, 22 nt, Human
cuggccuuaucacaaagcuaga

SEQ ID NO: 212810 - RNA, 22 nt, Human
auaacgaaagcaauuauuuuca

SEQ ID NO: 212811 - RNA, 22 nt, Human
ggcgccugguauucuuccucuc

SEQ ID NO: 212812 - RNA, 22 nt, Human
uggagagaaguucuauaaauca

SEQ ID NO: 212813 - RNA, 22 nt, Human
aaauuuuguugaaaaauauuuu

SEQ ID NO: 212814 - RNA, 20 nt, Human
cccuggcuggcaucuggacu

SEQ ID NO: 212815 - RNA, 22 nt, Human
caugcagcagaauaaugacuau

SEQ ID NO: 212816 - RNA, 22 nt, Human
auaaucuuuccagucaguuucc

SEQ ID NO: 212817 - RNA, 21 nt, Human
gggccugggccagggccgggu

SEQ ID NO: 212818 - RNA, 21 nt, Human
uuccuaaaaugcuuuugugcc

SEQ ID NO: 212819 - RNA, 22 nt, Human
gggagcucaccaugcucugcau

SEQ ID NO: 212820 - RNA, 22 nt, Human
gcuguugugaggaucagcauau

SEQ ID NO: 212821 - RNA, 22 nt, Human
aguucaugcuuagaucucauuu

SEQ ID NO: 212822 - RNA, 22 nt, Human
agagggagcuccaagaucaagg

SEQ ID NO: 212823 - RNA, 22 nt, Human
aaaggaaacuaugaaucucugg

SEQ ID NO: 212824 - RNA, 22 nt, Human
aagugaaaaaagucaguacuga

SEQ ID NO: 212825 - RNA, 22 nt, Human
ccucccaccguaucucaguggc

SEQ ID NO: 212826 - RNA, 22 nt, Human
agagcaucgguggaguccccac

SEQ ID NO: 212827 - RNA, 18 nt, Human
ggcugggcugugccccuu

SEQ ID NO: 212828 - RNA, 22 nt, Human
uagaggauucuaaaggaagcug

SEQ ID NO: 212829 - RNA, 22 nt, Human
cauaucuuaaacaucaucucug

SEQ ID NO: 212830 - RNA, 22 nt, Human
cagggccagggcuauggugaag

SEQ ID NO: 212831 - RNA, 22 nt, Human
gagggugugguauggauguguu

SEQ ID NO: 212832 - RNA, 22 nt, Human
ggcugcagggaacaggaugggu

SEQ ID NO: 212833 - RNA, 22 nt, Human
uccuuuauuuaugggcagugua

SEQ ID NO: 212834 - RNA, 22 nt, Human
augcucuuaauugcuagauaag

SEQ ID NO: 212835 - RNA, 22 nt, Human
gauaaugcuuuggucagacaug

SEQ ID NO: 212836 - RNA, 20 nt, Human
ucacuguaauugccuacauu

SEQ ID NO: 212837 - RNA, 22 nt, Human
uuacaagaucuuugaaggcaag

SEQ ID NO: 212838 - RNA, 22 nt, Human
cuguuguguuauuugcagugca

SEQ ID NO: 212839 - RNA, 22 nt, Human
cauuccaagaaguaguucugca

SEQ ID NO: 212840 - RNA, 22 nt, Human
aagugauuuucccaccaucuac

SEQ ID NO: 212841 - RNA, 22 nt, Human
acauuuuaccaucuguggauga

SEQ ID NO: 212842 - RNA, 22 nt, Human
guguccuguagaaacuguucca

SEQ ID NO: 212843 - RNA, 22 nt, Human
gggcugagagcuggaaucugag

SEQ ID NO: 212844 - RNA, 22 nt, Human
cauggcaggugcagauucugug

SEQ ID NO: 212845 - RNA, 22 nt, Human
ucagagaaguaggcuaauggug

SEQ ID NO: 212846 - RNA, 22 nt, Human
uuuucauagccagaaacugaaa

SEQ ID NO: 212847 - RNA, 22 nt, Human
aagcugccugggaggaagggcu

SEQ ID NO: 212848 - RNA, 22 nt, Human
gucacucuuuuucagcuagcuc

SEQ ID NO: 212849 - RNA, 22 nt, Human
cagguuuuuauuacaacuuuga

SEQ ID NO: 212850 - RNA, 22 nt, Human
agcucugauccuuuaaaggaga

SEQ ID NO: 212851 - RNA, 22 nt, Human
aggcagagauggcugcagggcc

SEQ ID NO: 212852 - RNA, 22 nt, Human
caaauacaaauacgggcagcuu

SEQ ID NO: 212853 - RNA, 22 nt, Human
auaugcagaaaauaaaggaauu

SEQ ID NO: 212854 - RNA, 22 nt, Human
gacaggaauuaucuaaaguaga

SEQ ID NO: 212855 - RNA, 22 nt, Human
ccagaggcuuaugcagcugcug

SEQ ID NO: 212856 - RNA, 22 nt, Human
cagggacugcaggaggacaggu

SEQ ID NO: 212857 - RNA, 22 nt, Human
aggcgaagggaccagacgguag

SEQ ID NO: 212858 - RNA, 22 nt, Human
ggcucuccacuauggaugagaa

SEQ ID NO: 212859 - RNA, 22 nt, Human
cucuguggucugaagccuguga

SEQ ID NO: 212860 - RNA, 22 nt, Human
guguccaugugggugcucuccu

SEQ ID NO: 212861 - RNA, 22 nt, Human
cagggggcccagcugggagggg

SEQ ID NO: 212862 - RNA, 22 nt, Human
augaaacucuagcuuucagcac

SEQ ID NO: 212863 - RNA, 22 nt, Human
uuuuucuuugguaacucuuccu

SEQ ID NO: 212864 - RNA, 19 nt, Human
ugcgggcugcggucagggc

SEQ ID NO: 212865 - RNA, 22 nt, Human
gcucuggcugccuuaguuuugu

SEQ ID NO: 212866 - RNA, 22 nt, Human
ggggcaucguugauugcauggu

SEQ ID NO: 212867 - RNA, 22 nt, Human
ccaucccugagucacaggaggg

SEQ ID NO: 212868 - RNA, 21 nt, Human
gcaggggugugugagcugggg

SEQ ID NO: 212869 - RNA, 22 nt, Human
aaacauaugccuucuuuuguaa

SEQ ID NO: 212870 - RNA, 22 nt, Human
uggggggacagauggagaggac

SEQ ID NO: 212871 - RNA, 22 nt, Human
gagguuuaguccauaguauuua

SEQ ID NO: 212872 - RNA, 22 nt, Human
uaacaguauacuacaucauauu

SEQ ID NO: 212873 - RNA, 22 nt, Human
uauauaauacacaaauauguac

SEQ ID NO: 212874 - RNA, 22 nt, Human
gagaggcugagcaguccggguu

SEQ ID NO: 212875 - RNA, 22 nt, Human
cucugcuuguaucacauuugcu

SEQ ID NO: 212876 - RNA, 22 nt, Human
ggucugauaccugcagguuguc

SEQ ID NO: 212877 - RNA, 22 nt, Human
aggggaagagugagguuuuggu

SEQ ID NO: 212878 - RNA, 22 nt, Human
cccuaguuuauuugccuucuuu

SEQ ID NO: 212879 - RNA, 22 nt, Human
gggugcuuaagcuuguuuguaa

SEQ ID NO: 212880 - RNA, 22 nt, Human
ucucagaaaugacaggagguac

SEQ ID NO: 212881 - RNA, 18 nt, Human
acaaaaauagugcuuugg

SEQ ID NO: 212882 - RNA, 23 nt, Human
uggcucugagcuuccugguggcc

SEQ ID NO: 212883 - RNA, 22 nt, Human
gaaccauuuaauggagaugcuc

SEQ ID NO: 212884 - RNA, 22 nt, Human
caaaacauucagagagcucacu

SEQ ID NO: 212885 - RNA, 22 nt, Human
uugguuuacucuggggauaucu

SEQ ID NO: 212886 - RNA, 22 nt, Human
agcauuuuaaaacuaguuacca

SEQ ID NO: 212887 - RNA, 22 nt, Human
cugagggagacagugcggacua

SEQ ID NO: 212888 - RNA, 22 nt, Human
uacaaaauucaaauaauguuug

SEQ ID NO: 212889 - RNA, 18 nt, Human
cagcauuagcagcuucca

SEQ ID NO: 212890 - RNA, 22 nt, Human
uaguggaaacagacugagcccg

SEQ ID NO: 212891 - RNA, 22 nt, Human
guguuggugagcucauuuccac

SEQ ID NO: 212892 - RNA, 21 nt, Human
gaaaaucuaaugugacaaugc

SEQ ID NO: 212893 - RNA, 22 nt, Human
uaugaaagguuuuuucuugaaa

SEQ ID NO: 212894 - RNA, 22 nt, Human
uguuuaucaguagacucaaguu

SEQ ID NO: 212895 - RNA, 22 nt, Human
gaacaugaguuuuaugguauuu

SEQ ID NO: 212896 - RNA, 22 nt, Human
agagaaacauuaauugaugagg

SEQ ID NO: 212897 - RNA, 22 nt, Human
uagacugugagcuccuugaggg

SEQ ID NO: 212898 - RNA, 22 nt, Human
agcucuccuacucucuuucuag

SEQ ID NO: 212899 - RNA, 19 nt, Human
auguuuccauuucuggaua

SEQ ID NO: 212900 - RNA, 22 nt, Human
aguauuuuaaaauacauuaucc

SEQ ID NO: 212901 - RNA, 22 nt, Human
gagcagucuuugaaaggcacca

SEQ ID NO: 212902 - RNA, 22 nt, Human
aauuauugucuuuuuuaaaagc

SEQ ID NO: 212903 - RNA, 22 nt, Human
aagcaaaugguauugguauuau

SEQ ID NO: 212904 - RNA, 20 nt, Human
ugucccuggagagcugcaga

SEQ ID NO: 212905 - RNA, 22 nt, Human
uuccucuugaaucugucugacu

SEQ ID NO: 212906 - RNA, 22 nt, Human
gaggaggcuggagaggccagga

SEQ ID NO: 212907 - RNA, 22 nt, Human
uguuaaaaagucccuguuuugu

SEQ ID NO: 212908 - RNA, 22 nt, Human
uuugaugagaaaugacuuaagu

SEQ ID NO: 212909 - RNA, 23 nt, Human
aggcugcagaagaauagggucau

SEQ ID NO: 212910 - RNA, 22 nt, Human
uuuauauauauguaggagcaca

SEQ ID NO: 212911 - RNA, 22 nt, Human
ccagggcuggaggaggucagga

SEQ ID NO: 212912 - RNA, 22 nt, Human
cuagcacagugcuuggcacaca

SEQ ID NO: 212913 - RNA, 22 nt, Human
cuguggcuaggaagcuguggga

SEQ ID NO: 212914 - RNA, 21 nt, Human
agaggacuuuuuugauguuuu

SEQ ID NO: 212915 - RNA, 22 nt, Human
ucauuuaauuuggaacucagag

SEQ ID NO: 212916 - RNA, 19 nt, Human
uguguuccauccaccaccc

SEQ ID NO: 212917 - RNA, 22 nt, Human
gaauuccaggugagagaaggua

SEQ ID NO: 212918 - RNA, 22 nt, Human
aagguccuguagccacagagcc

SEQ ID NO: 212919 - RNA, 22 nt, Human
gauguuggugcauucacuucug

SEQ ID NO: 212920 - RNA, 22 nt, Human
gaaaaagucuuaaaguaaggca

SEQ ID NO: 212921 - RNA, 22 nt, Human
uuuaggaauuugcugggcauga

SEQ ID NO: 212922 - RNA, 22 nt, Human
ugcuuucaaugaauuguauacu

SEQ ID NO: 212923 - RNA, 22 nt, Human
gcagaggcaaagucuggaugac

SEQ ID NO: 212924 - RNA, 22 nt, Human
agagaacaggcagcuggugccg

SEQ ID NO: 212925 - RNA, 22 nt, Human
acuugggaaaugaaaauacaga

SEQ ID NO: 212926 - RNA, 22 nt, Human
aggucagacagggugucuuucu

SEQ ID NO: 212927 - RNA, 22 nt, Human
acugcucugugguuggaagccu

SEQ ID NO: 212928 - RNA, 22 nt, Human
uggagucuugcuuugggagugc

SEQ ID NO: 212929 - RNA, 22 nt, Human
gaaggagaggauugugaggcug

SEQ ID NO: 212930 - RNA, 22 nt, Human
ucucugagggugaucaugagaa

SEQ ID NO: 212931 - RNA, 22 nt, Human
agaguggcaccuuaccugagac

SEQ ID NO: 212932 - RNA, 22 nt, Human
cuuuucuuuucuucucuuccca

SEQ ID NO: 212933 - RNA, 20 nt, Human
ucucauuuugauuucgcauu

SEQ ID NO: 212934 - RNA, 22 nt, Human
uuuaaaauguuuuauuuauuua

SEQ ID NO: 212935 - RNA, 22 nt, Human
gcaggccuccccugcuggagcu

SEQ ID NO: 212936 - RNA, 22 nt, Human
cuggagaacucugugcuucacu

SEQ ID NO: 212937 - RNA, 20 nt, Human
gcccacccgcacucccgccg

SEQ ID NO: 212938 - RNA, 22 nt, Human
uaaaaugcucagauaaauauau

SEQ ID NO: 212939 - RNA, 22 nt, Human
uacccauuuugguucuugaugc

SEQ ID NO: 212940 - RNA, 22 nt, Human
uuucuggacuaaagggagagau

SEQ ID NO: 212941 - RNA, 17 nt, Human
ugucuuuuuccuccucc

SEQ ID NO: 212942 - RNA, 22 nt, Human
uuccaagcaccaugaaggccuc

SEQ ID NO: 212943 - RNA, 22 nt, Human
gguggcauucaguaaguauaua

SEQ ID NO: 212944 - RNA, 23 nt, Human
acuuugaggagaagaaugucagu

SEQ ID NO: 212945 - RNA, 22 nt, Human
guauuaagaaaugccugugaaa

SEQ ID NO: 212946 - RNA, 17 nt, Human
gugagcugagucaggac

SEQ ID NO: 212947 - RNA, 22 nt, Human
guuuucuaaaacacauauaagu

SEQ ID NO: 212948 - RNA, 22 nt, Human
guuauuguuauugcguugucga

SEQ ID NO: 212949 - RNA, 22 nt, Human
gcagcucagcacgcacagguaa

SEQ ID NO: 212950 - RNA, 22 nt, Human
ucacauugcauuuucucauuug

SEQ ID NO: 212951 - RNA, 22 nt, Human
ugugccuagauuccaugcacuc

SEQ ID NO: 212952 - RNA, 22 nt, Human
acaaugugcuuaugaaggcagu

SEQ ID NO: 212953 - RNA, 20 nt, Human
agaaaggaguaaagaagaga

SEQ ID NO: 212954 - RNA, 22 nt, Human
guacuaguuaaaaauagaauua

SEQ ID NO: 212955 - RNA, 22 nt, Human
gccuccggagucgcagugucuu

SEQ ID NO: 212956 - RNA, 22 nt, Human
cagaccuggaaaacaggcuugc

SEQ ID NO: 212957 - RNA, 22 nt, Human
aggaaauaagggcacuucagau

SEQ ID NO: 212958 - RNA, 22 nt, Human
uguuuccuaagugucucugaag

SEQ ID NO: 212959 - RNA, 22 nt, Human
agacuugguaacuagugaagaa

SEQ ID NO: 212960 - RNA, 17 nt, Human
ggaagaaaaggaucauc

SEQ ID NO: 212961 - RNA, 22 nt, Human
uggggagacauggaguaaaaga

SEQ ID NO: 212962 - RNA, 22 nt, Human
gugauucaucuggggccuuauu

SEQ ID NO: 212963 - RNA, 20 nt, Human
ugagucagcugcaugggugg

SEQ ID NO: 212964 - RNA, 22 nt, Human
ggcgucuugcgggcgguagcgc

SEQ ID NO: 212965 - RNA, 22 nt, Human
uauuguauuagcucuuggagau

SEQ ID NO: 212966 - RNA, 22 nt, Human
uuccucauuuauaggaaagaga

SEQ ID NO: 212967 - RNA, 22 nt, Human
agcuugagauaauucaagcuga

SEQ ID NO: 212968 - RNA, 22 nt, Human
agcaggagaaagaguaugggcu

SEQ ID NO: 212969 - RNA, 22 nt, Human
uuccugaucuuuucccagaguu

SEQ ID NO: 212970 - RNA, 22 nt, Human
uaagaaaggggaaguuccucuu

SEQ ID NO: 212971 - RNA, 22 nt, Human
agagauuagagaagaugauaaa

SEQ ID NO: 212972 - RNA, 22 nt, Human
ugagagcuccacaccuugcccu

SEQ ID NO: 212973 - RNA, 22 nt, Human
gucugaggagaggcagcauaac

SEQ ID NO: 212974 - RNA, 22 nt, Human
ggccuugggauguggcugcagc

SEQ ID NO: 212975 - RNA, 22 nt, Human
auuuccugugaacuuuucugau

SEQ ID NO: 212976 - RNA, 22 nt, Human
ccagggagggccacagggccau

SEQ ID NO: 212977 - RNA, 22 nt, Human
auccaggggucugaauggauau

SEQ ID NO: 212978 - RNA, 22 nt, Human
aggaacaguuucaaagagugaa

SEQ ID NO: 212979 - RNA, 22 nt, Human
aaugcagaugugucuuuaauuu

SEQ ID NO: 212980 - RNA, 22 nt, Human
agugagaguauuaaugugaacu

SEQ ID NO: 212981 - RNA, 21 nt, Human
caucaagaucaauggagggcu

SEQ ID NO: 212982 - RNA, 22 nt, Human
uucuuccagugaaacgugcauc

SEQ ID NO: 212983 - RNA, 22 nt, Human
uuuuucacacuccuuuccaguu

SEQ ID NO: 212984 - RNA, 22 nt, Human
guuacagagcugcuaugugugc

SEQ ID NO: 212985 - RNA, 22 nt, Human
cccagccugaucucggccagcu

SEQ ID NO: 212986 - RNA, 22 nt, Human
gugguaaagugugccugugguc

SEQ ID NO: 212987 - RNA, 22 nt, Human
gagaacagauaugaugacuuca

SEQ ID NO: 212988 - RNA, 19 nt, Human
gggccucacccacaccucc

SEQ ID NO: 212989 - RNA, 22 nt, Human
aggcccagcaccagcggucuuc

SEQ ID NO: 212990 - RNA, 22 nt, Human
uguucuuacuaaguaccugaaa

SEQ ID NO: 212991 - RNA, 22 nt, Human
agacaagagcugaggacauauu

SEQ ID NO: 212992 - RNA, 19 nt, Human
aacucugccgaggcaagcc

SEQ ID NO: 212993 - RNA, 19 nt, Human
ucaggaggucgaccuggca

SEQ ID NO: 212994 - RNA, 22 nt, Human
uggaugagugaauggauaaauc

SEQ ID NO: 212995 - RNA, 18 nt, Human
auugagcaugacagaccu

SEQ ID NO: 212996 - RNA, 22 nt, Human
guucucuuaauccuaguuggua

SEQ ID NO: 212997 - RNA, 20 nt, Human
uucucugcagcaggcggccc

SEQ ID NO: 212998 - RNA, 22 nt, Human
acauggguuaaagaagauggaa

SEQ ID NO: 212999 - RNA, 22 nt, Human
auuuacugagguaaauaaacug

SEQ ID NO: 213000 - RNA, 22 nt, Human
augccucuugagagccagugcu

SEQ ID NO: 213001 - RNA, 22 nt, Human
uucuuguccacagaagagcuca

SEQ ID NO: 213002 - RNA, 22 nt, Human
aggggaggcugggcuggggggc

SEQ ID NO: 213003 - RNA, 22 nt, Human
cagagcagaaaccugggugauu

SEQ ID NO: 213004 - RNA, 22 nt, Human
uggagccugauggauaggaacg

SEQ ID NO: 213005 - RNA, 22 nt, Human
cauuagugaggggcugccugcu

SEQ ID NO: 213006 - RNA, 22 nt, Human
gcaggacugauggagcauaugu

SEQ ID NO: 213007 - RNA, 22 nt, Human
cauagcauguguuuauuuucuu

SEQ ID NO: 213008 - RNA, 21 nt, Human
cuuggagacucuuggccacau

SEQ ID NO: 213009 - RNA, 22 nt, Human
agucagaaggugucagaucuug

SEQ ID NO: 213010 - RNA, 22 nt, Human
gaaaggagacugcacuggagcc

SEQ ID NO: 213011 - RNA, 22 nt, Human
ucuucaugaaauugauugcuua

SEQ ID NO: 213012 - RNA, 22 nt, Human
agggcuucugcugcagagaccu

SEQ ID NO: 213013 - RNA, 17 nt, Human
agggaaguagggugggc

SEQ ID NO: 213014 - RNA, 22 nt, Human
uuugaagaaacagucuuaagag

SEQ ID NO: 213015 - RNA, 22 nt, Human
uggaggaggaugcauuuguugu

SEQ ID NO: 213016 - RNA, 22 nt, Human
gcuacauuagcuucaauggcua

SEQ ID NO: 213017 - RNA, 22 nt, Human
cuauaucuguggauaguguaug

SEQ ID NO: 213018 - RNA, 21 nt, Human
ugagcccaaagcuguauuggu

SEQ ID NO: 213019 - RNA, 22 nt, Human
auucaagagcccauguuuccug

SEQ ID NO: 213020 - RNA, 22 nt, Human
aggguggaggacaggccaguga

SEQ ID NO: 213021 - RNA, 22 nt, Human
aggacuguauacucuaggugaa

SEQ ID NO: 213022 - RNA, 23 nt, Human
cagagaaaauagaauaugcugug

SEQ ID NO: 213023 - RNA, 22 nt, Human
gucagacucuggggccccaggc

SEQ ID NO: 213024 - RNA, 22 nt, Human
gauggggaaaaaauggaucuuu

SEQ ID NO: 213025 - RNA, 19 nt, Human
uucuuuccccaccccuacc

SEQ ID NO: 213026 - RNA, 22 nt, Human
gucagacugaguuccuggguac

SEQ ID NO: 213027 - RNA, 22 nt, Human
augccugcugucaggaacucuu

SEQ ID NO: 213028 - RNA, 22 nt, Human
uguaauucuaauccagagcugg

SEQ ID NO: 213029 - RNA, 22 nt, Human
cggggcuccgaagagcucgguu

SEQ ID NO: 213030 - RNA, 22 nt, Human
ccagaugggggcugugggaggg

SEQ ID NO: 213031 - RNA, 22 nt, Human
cuuuuuuucuccauauuucugg

SEQ ID NO: 213032 - RNA, 22 nt, Human
auuaaagcaugaauaauaugua

SEQ ID NO: 213033 - RNA, 22 nt, Human
ccugacucugauuucgcugcau

SEQ ID NO: 213034 - RNA, 22 nt, Human
acuucucuuuucauuaauuuug

SEQ ID NO: 213035 - RNA, 22 nt, Human
aggauagacuucagaaggcaua

SEQ ID NO: 213036 - RNA, 20 nt, Human
uacaauauucccacuuugcu

SEQ ID NO: 213037 - RNA, 22 nt, Human
aauguuugaacuuugcauauuu

SEQ ID NO: 213038 - RNA, 22 nt, Human
gauuucuucauuuaaaaauauu

SEQ ID NO: 213039 - RNA, 22 nt, Human
gaaguaaugugauugcucaggg

SEQ ID NO: 213040 - RNA, 22 nt, Human
gcacaggcugcacgaccccagc

SEQ ID NO: 213041 - RNA, 22 nt, Human
aagugauuuuccuacuugcuaa

SEQ ID NO: 213042 - RNA, 22 nt, Human
gaggggcacaguggggccuggg

SEQ ID NO: 213043 - RNA, 22 nt, Human
cagagccagcuguccuuggcau

SEQ ID NO: 213044 - RNA, 22 nt, Human
cucuguguguuugugugugugu

SEQ ID NO: 213045 - RNA, 22 nt, Human
uuggccaaggaccuuuuuggag

SEQ ID NO: 213046 - RNA, 22 nt, Human
ugcuuggagaaucagucccagc

SEQ ID NO: 213047 - RNA, 22 nt, Human
gacccugaggauucccugcuga

SEQ ID NO: 213048 - RNA, 22 nt, Human
uggacacugguggauauggaau

SEQ ID NO: 213049 - RNA, 22 nt, Human
uaugcagauaguuugccauuca

SEQ ID NO: 213050 - RNA, 22 nt, Human
cagggaaguauuacauguuucc

SEQ ID NO: 213051 - RNA, 22 nt, Human
cugcuguuuuccccaccaucuc

SEQ ID NO: 213052 - RNA, 21 nt, Human
aacuauuaauaccauuagcaa

SEQ ID NO: 213053 - RNA, 22 nt, Human
gauuaagaaagauagaugugga

SEQ ID NO: 213054 - RNA, 22 nt, Human
aggccugaggaccagauaaaug

SEQ ID NO: 213055 - RNA, 22 nt, Human
ccagggcugcugccugggcugg

SEQ ID NO: 213056 - RNA, 22 nt, Human
aguggcuguuccaggugaggac

SEQ ID NO: 213057 - RNA, 22 nt, Human
acucugaaaggcuacaaaugcu

SEQ ID NO: 213058 - RNA, 22 nt, Human
gauuuugaaccuuauuuggaaa

SEQ ID NO: 213059 - RNA, 22 nt, Human
guuggugagaguuagggauuua

SEQ ID NO: 213060 - RNA, 22 nt, Human
aaaauacuaggaaaauaaauca

SEQ ID NO: 213061 - RNA, 22 nt, Human
ugcagggucuccuguacuuggg

SEQ ID NO: 213062 - RNA, 23 nt, Human
ugcugcuggaguaucuacaaugc

SEQ ID NO: 213063 - RNA, 22 nt, Human
uagaagaugccuuaaaguugaa

SEQ ID NO: 213064 - RNA, 22 nt, Human
uauuuaaagucagcaacuuuuc

SEQ ID NO: 213065 - RNA, 22 nt, Human
gcucagccuuuuguucuauuca

SEQ ID NO: 213066 - RNA, 22 nt, Human
gaggagggagcuggaagcucuu

SEQ ID NO: 213067 - RNA, 22 nt, Human
cugaacuaagcccaaagacacu

SEQ ID NO: 213068 - RNA, 22 nt, Human
gggaagagggagcuggaaugau

SEQ ID NO: 213069 - RNA, 22 nt, Human
auuccagggaaauggggaugga

SEQ ID NO: 213070 - RNA, 22 nt, Human
uauauacacgcacauauacaua

SEQ ID NO: 213071 - RNA, 22 nt, Human
ucaugcagauaagaauaaguaa

SEQ ID NO: 213072 - RNA, 20 nt, Human
aaauccuugggaguggugca

SEQ ID NO: 213073 - RNA, 22 nt, Human
ccuccuuuccuguuuuccugag

SEQ ID NO: 213074 - RNA, 22 nt, Human
uuggggaaaaagaccuaaugac

SEQ ID NO: 213075 - RNA, 22 nt, Human
gaguucuagauguauuauuaau

SEQ ID NO: 213076 - RNA, 22 nt, Human
aagucccaucugccuccaugua

SEQ ID NO: 213077 - RNA, 22 nt, Human
guggagaaauauguucagcuuc

SEQ ID NO: 213078 - RNA, 22 nt, Human
cagccccagcacuuagcugagu

SEQ ID NO: 213079 - RNA, 22 nt, Human
acuggggauugguucuucaaca

SEQ ID NO: 213080 - RNA, 22 nt, Human
uuuagagauaaaugcucuccca

SEQ ID NO: 213081 - RNA, 22 nt, Human
aguuuggaggagaaagugcggg

SEQ ID NO: 213082 - RNA, 22 nt, Human
cagccccgcuggccucgccucc

SEQ ID NO: 213083 - RNA, 22 nt, Human
ucacaagaagaaauuaaacugu

SEQ ID NO: 213084 - RNA, 22 nt, Human
ugugaagaauuaaugugaauca

SEQ ID NO: 213085 - RNA, 22 nt, Human
uugguugaaauguguucaugcu

SEQ ID NO: 213086 - RNA, 22 nt, Human
uuggggcugcguguuuccaugu

SEQ ID NO: 213087 - RNA, 22 nt, Human
caguggagaccugccugcugga

SEQ ID NO: 213088 - RNA, 22 nt, Human
aguaggauguuuagcccuucuu

SEQ ID NO: 213089 - RNA, 22 nt, Human
cugcuguuuucugggcuucuua

SEQ ID NO: 213090 - RNA, 22 nt, Human
ugagggaugccucuccuuccgg

SEQ ID NO: 213091 - RNA, 20 nt, Human
ugccuuccgccccgggcacc

SEQ ID NO: 213092 - RNA, 22 nt, Human
ggagcauggcuucuuggggcug

SEQ ID NO: 213093 - RNA, 22 nt, Human
cucaugaauggcucuuugugcu

SEQ ID NO: 213094 - RNA, 18 nt, Human
ggccucagccuggccgga

SEQ ID NO: 213095 - RNA, 22 nt, Human
uaugugaguaccugucaugugc

SEQ ID NO: 213096 - RNA, 22 nt, Human
guggagaugagauauaccccuu

SEQ ID NO: 213097 - RNA, 22 nt, Human
caggacccaaccucccugcucu

SEQ ID NO: 213098 - RNA, 22 nt, Human
agagcagcuuuucggaaccacu

SEQ ID NO: 213099 - RNA, 22 nt, Human
acuauauaaugcacacaguaua

SEQ ID NO: 213100 - RNA, 22 nt, Human
uaguggaaccuucuaaaugacg

SEQ ID NO: 213101 - RNA, 22 nt, Human
uucuaauauuaugauuucuaag

SEQ ID NO: 213102 - RNA, 21 nt, Human
guucuuaguuauauucucaau

SEQ ID NO: 213103 - RNA, 22 nt, Human
ucuuccuuguaagggcuuuaga

SEQ ID NO: 213104 - RNA, 22 nt, Human
uuaauacugugucuuuuuuaau

SEQ ID NO: 213105 - RNA, 22 nt, Human
ccccccaaauguuacagugacc

SEQ ID NO: 213106 - RNA, 22 nt, Human
gugugucucaguugcuccgaag

SEQ ID NO: 213107 - RNA, 22 nt, Human
aaacaauaauaauuaggaagga

SEQ ID NO: 213108 - RNA, 22 nt, Human
guggaggguuugcaaugugcag

SEQ ID NO: 213109 - RNA, 22 nt, Human
augggagggagcagugaguguu

SEQ ID NO: 213110 - RNA, 22 nt, Human
cugaggaguaguucuggaggac

SEQ ID NO: 213111 - RNA, 20 nt, Human
uaguggaccuugaaggccuc

SEQ ID NO: 213112 - RNA, 22 nt, Human
cccaaccagaaauugacagaga

SEQ ID NO: 213113 - RNA, 22 nt, Human
ugcccacuucaaaaucuucauu

SEQ ID NO: 213114 - RNA, 22 nt, Human
agaacaagaaacccgaaaagug

SEQ ID NO: 213115 - RNA, 22 nt, Human
caauccccaggucccagaacag

SEQ ID NO: 213116 - RNA, 22 nt, Human
agcaggagagacuggcccaaaa

SEQ ID NO: 213117 - RNA, 22 nt, Human
agugccaucuuuaacuguccca

SEQ ID NO: 213118 - RNA, 22 nt, Human
cgguugcaggaugugcgggcag

SEQ ID NO: 213119 - RNA, 20 nt, Human
cucuuucugcuuuaugccuc

SEQ ID NO: 213120 - RNA, 22 nt, Human
uucucugcgcuccggcccaguu

SEQ ID NO: 213121 - RNA, 22 nt, Human
gcccucugccacaggacgccag

SEQ ID NO: 213122 - RNA, 17 nt, Human
ucuggguuucugauuua

SEQ ID NO: 213123 - RNA, 22 nt, Human
aaggucucucgggcuuugcuga

SEQ ID NO: 213124 - RNA, 22 nt, Human
gggagccagcagggcauggagc

SEQ ID NO: 213125 - RNA, 19 nt, Human
gauauugagcugagaauuc

SEQ ID NO: 213126 - RNA, 22 nt, Human
caugaggauccuccaggggaaa

SEQ ID NO: 213127 - RNA, 22 nt, Human
ugggagagaagcugaggcaggg

SEQ ID NO: 213128 - RNA, 22 nt, Human
uugcccuaccccaggccuuuuu

SEQ ID NO: 213129 - RNA, 22 nt, Human
uacaggaggaugugcagccagg

SEQ ID NO: 213130 - RNA, 22 nt, Human
uggcaagcuguuggcagauagc

SEQ ID NO: 213131 - RNA, 22 nt, Human
uuaaugcauguaaaugugcaaa

SEQ ID NO: 213132 - RNA, 22 nt, Human
uacaguauuuuuuaagaaaaaa

SEQ ID NO: 213133 - RNA, 22 nt, Human
ccagggucggcaucagcguggg

SEQ ID NO: 213134 - RNA, 22 nt, Human
caggguuuuauuuggcuuuaaa

SEQ ID NO: 213135 - RNA, 22 nt, Human
uuggagagggugggcuuugaag

SEQ ID NO: 213136 - RNA, 22 nt, Human
ucuccaggaaagacacuggacu

SEQ ID NO: 213137 - RNA, 22 nt, Human
caugaauaauucuuuuucuugg

SEQ ID NO: 213138 - RNA, 22 nt, Human
auuucagaguagaucguuauuu

SEQ ID NO: 213139 - RNA, 22 nt, Human
cagucucuugcuucauuaguug

SEQ ID NO: 213140 - RNA, 22 nt, Human
uucacaauuuuaaaaaguggaa

SEQ ID NO: 213141 - RNA, 22 nt, Human
uauggcuaguguguuuguaaca

SEQ ID NO: 213142 - RNA, 22 nt, Human
auucucauguuuuaaaaaaguu

SEQ ID NO: 213143 - RNA, 22 nt, Human
gaggcaggcggggcccaggugg

SEQ ID NO: 213144 - RNA, 22 nt, Human
auggaggugagccccccauccu

SEQ ID NO: 213145 - RNA, 22 nt, Human
uucuggaguuugaagaucaggu

SEQ ID NO: 213146 - RNA, 22 nt, Human
gugcuguuagcgguuuauaaca

SEQ ID NO: 213147 - RNA, 22 nt, Human
uaaaaccauucauugaccuaug

SEQ ID NO: 213148 - RNA, 22 nt, Human
uuggugauguagcagcaauugu

SEQ ID NO: 213149 - RNA, 22 nt, Human
ucuuugcagaauuuaacuuugc

SEQ ID NO: 213150 - RNA, 23 nt, Human
uggaaguugagagucugcuuugu

SEQ ID NO: 213151 - RNA, 22 nt, Human
uccaaggacucuugucagcugu

SEQ ID NO: 213152 - RNA, 22 nt, Human
ggaaaagaauuguuaguuagug

SEQ ID NO: 213153 - RNA, 22 nt, Human
gagcgcgcaaucucuccagcug

SEQ ID NO: 213154 - RNA, 22 nt, Human
uucccaggugugagugagguga

SEQ ID NO: 213155 - RNA, 22 nt, Human
agugagcauuagugcuuauauu

SEQ ID NO: 213156 - RNA, 22 nt, Human
uaaccuuuuuuaaaguuuccug

SEQ ID NO: 213157 - RNA, 21 nt, Human
ccugcacuucccuccucaagu

SEQ ID NO: 213158 - RNA, 22 nt, Human
gaggcagaggaugggacuguau

SEQ ID NO: 213159 - RNA, 22 nt, Human
aaaaggaagaguuuucagagac

SEQ ID NO: 213160 - RNA, 19 nt, Human
agagucuccacuccacuug

SEQ ID NO: 213161 - RNA, 22 nt, Human
gccagggcucgagcaggccagc

SEQ ID NO: 213162 - RNA, 22 nt, Human
cagcauggagacaaagugggca

SEQ ID NO: 213163 - RNA, 22 nt, Human
gauggugcaauuaucgugcaug

SEQ ID NO: 213164 - RNA, 22 nt, Human
auguguguaugacugaaucuau

SEQ ID NO: 213165 - RNA, 22 nt, Human
ggaaggggagcuggaaagggua

SEQ ID NO: 213166 - RNA, 22 nt, Human
cagcuggggagagacauggcag

SEQ ID NO: 213167 - RNA, 22 nt, Human
auacaugacucacacauucugc

SEQ ID NO: 213168 - RNA, 22 nt, Human
guggguuggguuuuugaaggga

SEQ ID NO: 213169 - RNA, 22 nt, Human
aucaaaauuuucagauacuaca

SEQ ID NO: 213170 - RNA, 20 nt, Human
acuaccaugcaauuccgcuu

SEQ ID NO: 213171 - RNA, 22 nt, Human
cucugucuggggaggggagagg

SEQ ID NO: 213172 - RNA, 22 nt, Human
ggcagagcugugcgcccaccca

SEQ ID NO: 213173 - RNA, 22 nt, Human
agggaguuccgaucugugcacc

SEQ ID NO: 213174 - RNA, 21 nt, Human
ugccuggccuuugcuuuuccu

SEQ ID NO: 213175 - RNA, 22 nt, Human
uggguuuauuguauuucccuua

SEQ ID NO: 213176 - RNA, 22 nt, Human
uuguggagaggaagcaaggagg

SEQ ID NO: 213177 - RNA, 22 nt, Human
cacugcaaccuccaccucccgg

SEQ ID NO: 213178 - RNA, 22 nt, Human
cagguggauggcgagcccugca

SEQ ID NO: 213179 - RNA, 22 nt, Human
agucuauguuuuuguucuuauu

SEQ ID NO: 213180 - RNA, 22 nt, Human
uaacuuuuuauccuguuaaaug

SEQ ID NO: 213181 - RNA, 22 nt, Human
guccuguguaaguacuugcuca

SEQ ID NO: 213182 - RNA, 22 nt, Human
aucuucuauguguaggcauuuu

SEQ ID NO: 213183 - RNA, 22 nt, Human
aggccccacaaacucgccuuug

SEQ ID NO: 213184 - RNA, 22 nt, Human
ugacacacagggggauggaguu

SEQ ID NO: 213185 - RNA, 22 nt, Human
auuauacauuaggagauugauu

SEQ ID NO: 213186 - RNA, 22 nt, Human
uggaagaaaugguugagccaug

SEQ ID NO: 213187 - RNA, 22 nt, Human
aaagaacguuucugggaaucag

SEQ ID NO: 213188 - RNA, 22 nt, Human
aaugcuuuuugcgaaaugugca

SEQ ID NO: 213189 - RNA, 23 nt, Human
acagaggcaucagagcagcaggc

SEQ ID NO: 213190 - RNA, 22 nt, Human
ucagugauccagauauuugagc

SEQ ID NO: 213191 - RNA, 22 nt, Human
aaauauagugacacuuauaguc

SEQ ID NO: 213192 - RNA, 22 nt, Human
cagauacaacagcaggaaugaa

SEQ ID NO: 213193 - RNA, 22 nt, Human
cacugcacuccagccugggcaa

SEQ ID NO: 213194 - RNA, 22 nt, Human
agcaaggguugguuuucugaca

SEQ ID NO: 213195 - RNA, 22 nt, Human
gcugcuggcuuccugcuguuuu

SEQ ID NO: 213196 - RNA, 22 nt, Human
gaagaaggaagaucaugcuuga

SEQ ID NO: 213197 - RNA, 22 nt, Human
uucuuuucuucccuguuuauua

SEQ ID NO: 213198 - RNA, 22 nt, Human
augaggaacagcaagaauauuu

SEQ ID NO: 213199 - RNA, 22 nt, Human
cuugcaaugaaggcacacuuau

SEQ ID NO: 213200 - RNA, 22 nt, Human
uggagagauagucauucuagag

SEQ ID NO: 213201 - RNA, 22 nt, Human
uuuaucaggccaucuuaugucu

SEQ ID NO: 213202 - RNA, 22 nt, Human
aaaauauuuaucuagcucuuaa

SEQ ID NO: 213203 - RNA, 22 nt, Human
uugauuaauugaugaaccucuc

SEQ ID NO: 213204 - RNA, 22 nt, Human
ucuggguuuccuucacaagcac

SEQ ID NO: 213205 - RNA, 22 nt, Human
cuguccauuuucgugccuccuu

SEQ ID NO: 213206 - RNA, 22 nt, Human
uugcagugucaucuagacgugg

SEQ ID NO: 213207 - RNA, 15 nt, Human
gccccaggaaucaaa

SEQ ID NO: 213208 - RNA, 22 nt, Human
uaggcaaguggaccagagguuu

SEQ ID NO: 213209 - RNA, 22 nt, Human
agaguucuauccagacucaugu

SEQ ID NO: 213210 - RNA, 19 nt, Human
augaaauagcauuuucuga

SEQ ID NO: 213211 - RNA, 22 nt, Human
auguguuuugaccccugcuaaa

SEQ ID NO: 213212 - RNA, 18 nt, Human
uucucucuggauaguagu

SEQ ID NO: 213213 - RNA, 22 nt, Human
gcaggcagauccagaagcacua

SEQ ID NO: 213214 - RNA, 23 nt, Human
ucccacauuucacagcacuuucc

SEQ ID NO: 213215 - RNA, 22 nt, Human
auuccauccuggcuuuuuccug

SEQ ID NO: 213216 - RNA, 19 nt, Human
cccagaggaaugccuggaa

SEQ ID NO: 213217 - RNA, 22 nt, Human
uuccuaagugcugguaugaggc

SEQ ID NO: 213218 - RNA, 22 nt, Human
agcacauguuucuuuugcaauu

SEQ ID NO: 213219 - RNA, 22 nt, Human
aggaggcaaaugagagggcuca

SEQ ID NO: 213220 - RNA, 22 nt, Human
ggagugaguauguucugaugca

SEQ ID NO: 213221 - RNA, 22 nt, Human
uuccccaugugaugcuauugcu

SEQ ID NO: 213222 - RNA, 22 nt, Human
cucugcuagaaggucaaucucu

SEQ ID NO: 213223 - RNA, 17 nt, Human
uuuguuucauacuucau

SEQ ID NO: 213224 - RNA, 22 nt, Human
agggcaguuuuacugaaaggug

SEQ ID NO: 213225 - RNA, 22 nt, Human
aagaggauuuuaguuugccaga

SEQ ID NO: 213226 - RNA, 22 nt, Human
ggagaggaggugagaggaagua

SEQ ID NO: 213227 - RNA, 22 nt, Human
uuugaauauacuucaaacaaag

SEQ ID NO: 213228 - RNA, 22 nt, Human
ggcuccugggcgucuucgaaca

SEQ ID NO: 213229 - RNA, 22 nt, Human
uguuuuuagcuguuuuuuggau

SEQ ID NO: 213230 - RNA, 22 nt, Human
uuuuuucuucucuaucuuaaua

SEQ ID NO: 213231 - RNA, 22 nt, Human
gggacagcuggggguaaagcau

SEQ ID NO: 213232 - RNA, 22 nt, Human
uuagaaaaaggcuguggucuua

SEQ ID NO: 213233 - RNA, 22 nt, Human
uggaaauagauguaggaaauug

SEQ ID NO: 213234 - RNA, 22 nt, Human
uuauuucuucucgaagcuuggg

SEQ ID NO: 213235 - RNA, 22 nt, Human
ugauuugaaaccuuuggcaaga

SEQ ID NO: 213236 - RNA, 22 nt, Human
cccuggcucaggcagcuuuguu

SEQ ID NO: 213237 - RNA, 22 nt, Human
caagugaguauguauuguguag

SEQ ID NO: 213238 - RNA, 22 nt, Human
gguguaaucacaagcuggaauu

SEQ ID NO: 213239 - RNA, 22 nt, Human
ucuucaaauacagucauauuga

SEQ ID NO: 213240 - RNA, 22 nt, Human
agggcaggguuggugcuggugc

SEQ ID NO: 213241 - RNA, 22 nt, Human
agaucugucaccauccuggagc

SEQ ID NO: 213242 - RNA, 21 nt, Human
cuuuucuagucccagccccgc

SEQ ID NO: 213243 - RNA, 22 nt, Human
uuauuuuuguuuguuaagccua

SEQ ID NO: 213244 - RNA, 22 nt, Human
agagaauuugggaauauaaauc

SEQ ID NO: 213245 - RNA, 22 nt, Human
gaaauaggcccuuacauggaaa

SEQ ID NO: 213246 - RNA, 22 nt, Human
cugccaggagaggccagggccc

SEQ ID NO: 213247 - RNA, 22 nt, Human
aguuauuaagaaaauuuugcca

SEQ ID NO: 213248 - RNA, 22 nt, Human
aacuuauacccagggcagaaau

SEQ ID NO: 213249 - RNA, 22 nt, Human
cugucucugucucuguuuaucc

SEQ ID NO: 213250 - RNA, 22 nt, Human
aaacuuuugaaggaggaaaaag

SEQ ID NO: 213251 - RNA, 22 nt, Human
caguaaccaguaguuuuggaaa

SEQ ID NO: 213252 - RNA, 22 nt, Human
uuauuuuauaaagagaagacuu

SEQ ID NO: 213253 - RNA, 22 nt, Human
ccuuugcccugagaaauguucc

SEQ ID NO: 213254 - RNA, 22 nt, Human
uucaguguuagaauuccaagaa

SEQ ID NO: 213255 - RNA, 22 nt, Human
uccagguggcuuuccuggggga

SEQ ID NO: 213256 - RNA, 22 nt, Human
uaggggguuuuucuagagauug

SEQ ID NO: 213257 - RNA, 22 nt, Human
uacaaauuguuuugccacaaag

SEQ ID NO: 213258 - RNA, 22 nt, Human
gugggccaguuccucacaggua

SEQ ID NO: 213259 - RNA, 22 nt, Human
aauggcaauagugcauuaugua

SEQ ID NO: 213260 - RNA, 22 nt, Human
acauaaauagcacugugaauuu

SEQ ID NO: 213261 - RNA, 22 nt, Human
ucucugaccuccaccccaggag

SEQ ID NO: 213262 - RNA, 22 nt, Human
uucuuuguccuagcauucuaca

SEQ ID NO: 213263 - RNA, 22 nt, Human
gccaucuucggcagccgccugg

SEQ ID NO: 213264 - RNA, 22 nt, Human
ugggggaggaggagacagacug

SEQ ID NO: 213265 - RNA, 22 nt, Human
aaguggugagacccugcugaaa

SEQ ID NO: 213266 - RNA, 22 nt, Human
auggcuguguuguuccucugaa

SEQ ID NO: 213267 - RNA, 22 nt, Human
cagcuccaucuugcuuauacca

SEQ ID NO: 213268 - RNA, 22 nt, Human
gugugcacaaucuggcaugugc

SEQ ID NO: 213269 - RNA, 22 nt, Human
ggugugaauagagccuggagca

SEQ ID NO: 213270 - RNA, 22 nt, Human
auggagguuugucugguuuugu

SEQ ID NO: 213271 - RNA, 19 nt, Human
ugcagcacuaaaaacuuuc

SEQ ID NO: 213272 - RNA, 20 nt, Human
caucaacaccuugucagccu

SEQ ID NO: 213273 - RNA, 22 nt, Human
gcauccugacuauggugguggu

SEQ ID NO: 213274 - RNA, 22 nt, Human
cagcaugguggagcugcucuuu

SEQ ID NO: 213275 - RNA, 22 nt, Human
cucagcgagggaaagaggccgc

SEQ ID NO: 213276 - RNA, 22 nt, Human
ugaguccagaugggccagcagg

SEQ ID NO: 213277 - RNA, 22 nt, Human
cacacacacacacacucucaca

SEQ ID NO: 213278 - RNA, 22 nt, Human
agacagaacauaauuaguacug

SEQ ID NO: 213279 - RNA, 22 nt, Human
aggcugcucucgccggcggugu

SEQ ID NO: 213280 - RNA, 22 nt, Human
gcuuauuagguuauuucaagga

SEQ ID NO: 213281 - RNA, 22 nt, Human
gugguuuagccuucauuaaccu

SEQ ID NO: 213282 - RNA, 22 nt, Human
acuaaguagaggagugaugauu

SEQ ID NO: 213283 - RNA, 22 nt, Human
gcagguggaagcagcagacuca

SEQ ID NO: 213284 - RNA, 22 nt, Human
uuucuggauaagcagggucucu

SEQ ID NO: 213285 - RNA, 22 nt, Human
cgaaaaagaagugcaccauguu

SEQ ID NO: 213286 - RNA, 22 nt, Human
auuuuucucucaugugcaacua

SEQ ID NO: 213287 - RNA, 18 nt, Human
uguugguguucacucacu

SEQ ID NO: 213288 - RNA, 22 nt, Human
uuuugagucuggcaguuuuguu

SEQ ID NO: 213289 - RNA, 22 nt, Human
gcugacucugcuuuuagccucc

SEQ ID NO: 213290 - RNA, 22 nt, Human
aaggggaauaguaggaccuggg

SEQ ID NO: 213291 - RNA, 22 nt, Human
aacuuuuaugaaggaaaucaua

SEQ ID NO: 213292 - RNA, 22 nt, Human
gaauggagaacccuggacacug

SEQ ID NO: 213293 - RNA, 22 nt, Human
ucccaaaacuugaagcaagccu

SEQ ID NO: 213294 - RNA, 22 nt, Human
guguaucagaggcuguguuaua

SEQ ID NO: 213295 - RNA, 22 nt, Human
aguuuccacuggagacacugug

SEQ ID NO: 213296 - RNA, 22 nt, Human
cuccccacucaacucccagacc

SEQ ID NO: 213297 - RNA, 22 nt, Human
acagguuucuccccugguuauu

SEQ ID NO: 213298 - RNA, 22 nt, Human
uuucucuuguauuugaaucacu

SEQ ID NO: 213299 - RNA, 19 nt, Human
cucuucauuggaggguuga

SEQ ID NO: 213300 - RNA, 22 nt, Human
ucccugcugggcgaucuucucu

SEQ ID NO: 213301 - RNA, 18 nt, Human
aaggaggaaugaauagca

SEQ ID NO: 213302 - RNA, 22 nt, Human
aggcagagaggucuuccuggaa

SEQ ID NO: 213303 - RNA, 22 nt, Human
uggaaauacaagaaguauguca

SEQ ID NO: 213304 - RNA, 22 nt, Human
aagcccucagagccucuuugac

SEQ ID NO: 213305 - RNA, 22 nt, Human
cugcugugcagacagacucucu

SEQ ID NO: 213306 - RNA, 22 nt, Human
ugcuggaguggcacuguguggc

SEQ ID NO: 213307 - RNA, 20 nt, Human
uagcuucaccuagagauagc

SEQ ID NO: 213308 - RNA, 22 nt, Human
gaucacuuugauuagauguccu

SEQ ID NO: 213309 - RNA, 22 nt, Human
aaggcuguuugagcacuggagc

SEQ ID NO: 213310 - RNA, 22 nt, Human
ggccuccaucuuaucuuacucu

SEQ ID NO: 213311 - RNA, 22 nt, Human
ugagguauuuggauuuauauuu

SEQ ID NO: 213312 - RNA, 22 nt, Human
uccauuagagaugcuaaaggac

SEQ ID NO: 213313 - RNA, 22 nt, Human
aagcuguuauuucacagguuca

SEQ ID NO: 213314 - RNA, 22 nt, Human
uucuuucgaacaagagaaguuc

SEQ ID NO: 213315 - RNA, 22 nt, Human
uaguuccucuucucagggccau

SEQ ID NO: 213316 - RNA, 22 nt, Human
gguagacugagcuccuugagga

SEQ ID NO: 213317 - RNA, 22 nt, Human
gaccugcucagcccuguguguu

SEQ ID NO: 213318 - RNA, 22 nt, Human
agggaaguucuagggagucugg

SEQ ID NO: 213319 - RNA, 22 nt, Human
ugugguuuguaagcaaagcaaa

SEQ ID NO: 213320 - RNA, 20 nt, Human
guugggagaagugucagcug

SEQ ID NO: 213321 - RNA, 22 nt, Human
gcagagaaugucagauuuuguu

SEQ ID NO: 213322 - RNA, 22 nt, Human
uaugaggagaacauuccugaac

SEQ ID NO: 213323 - RNA, 22 nt, Human
uauccaaaggaacaaucacagc

SEQ ID NO: 213324 - RNA, 22 nt, Human
ccucaucagaaagcagaaagca

SEQ ID NO: 213325 - RNA, 22 nt, Human
ugcauuauaacaauaaggcuua

SEQ ID NO: 213326 - RNA, 22 nt, Human
ggcuguggcagcuggaaguggu

SEQ ID NO: 213327 - RNA, 22 nt, Human
ucauacuuuuuugacccuugug

SEQ ID NO: 213328 - RNA, 22 nt, Human
acucaucauuuuacggagcagc

SEQ ID NO: 213329 - RNA, 22 nt, Human
augcaaaaucuuauuuuuucua

SEQ ID NO: 213330 - RNA, 22 nt, Human
aguuugauuugucuaucuucau

SEQ ID NO: 213331 - RNA, 22 nt, Human
gacaauuucucaauauagaaac

SEQ ID NO: 213332 - RNA, 22 nt, Human
ggaggccgugcugugcugccag

SEQ ID NO: 213333 - RNA, 22 nt, Human
ugcauugccucuauucauuaua

SEQ ID NO: 213334 - RNA, 22 nt, Human
ugcuuuauucgacaucugguag

SEQ ID NO: 213335 - RNA, 21 nt, Human
aaguacccuuuugcuacucag

SEQ ID NO: 213336 - RNA, 22 nt, Human
cacuguugagcaauguacagug

SEQ ID NO: 213337 - RNA, 20 nt, Human
acacaccugcucagacugag

SEQ ID NO: 213338 - RNA, 22 nt, Human
uaaaguauucaaguagcuuucu

SEQ ID NO: 213339 - RNA, 22 nt, Human
aaacaagagcuuacauggcugc

SEQ ID NO: 213340 - RNA, 20 nt, Human
aaaaacaguaaugcugaaga

SEQ ID NO: 213341 - RNA, 22 nt, Human
ugcaaggcacccacucugcuuu

SEQ ID NO: 213342 - RNA, 22 nt, Human
ugaaaaauauuuuuagaaauaa

SEQ ID NO: 213343 - RNA, 22 nt, Human
agcuguugaccuucccuuucag

SEQ ID NO: 213344 - RNA, 23 nt, Human
ugggagcuauguuuggaaugggg

SEQ ID NO: 213345 - RNA, 22 nt, Human
uccagcuccugaguucacugcu

SEQ ID NO: 213346 - RNA, 22 nt, Human
uaauugaacguucauuuuuaau

SEQ ID NO: 213347 - RNA, 22 nt, Human
ucucuacuuggcuuguguucac

SEQ ID NO: 213348 - RNA, 22 nt, Human
gaugguggggggcagcugggag

SEQ ID NO: 213349 - RNA, 22 nt, Human
gaggaggacauuggaaagaacu

SEQ ID NO: 213350 - RNA, 22 nt, Human
aggauggauagcaaggaagccg

SEQ ID NO: 213351 - RNA, 22 nt, Human
uuaaggcauagcuuguguugac

SEQ ID NO: 213352 - RNA, 22 nt, Human
guugauuuaaccucaccuuuga

SEQ ID NO: 213353 - RNA, 22 nt, Human
aacucugcaaugaaaucauguu

SEQ ID NO: 213354 - RNA, 18 nt, Human
acucuuccuuauguucuu

SEQ ID NO: 213355 - RNA, 21 nt, Human
uccaaaggagacugagugugu

SEQ ID NO: 213356 - RNA, 22 nt, Human
uuucauggaggccaggacagag

SEQ ID NO: 213357 - RNA, 22 nt, Human
uuuuuaagguuuguuuauauau

SEQ ID NO: 213358 - RNA, 22 nt, Human
uuuuuuuaaguuuugauuuuag

SEQ ID NO: 213359 - RNA, 22 nt, Human
agagcuuuggaguaaguuuuga

SEQ ID NO: 213360 - RNA, 22 nt, Human
acacuuacugcauuuuucuaua

SEQ ID NO: 213361 - RNA, 22 nt, Human
agauaggccauuaagaaggaua

SEQ ID NO: 213362 - RNA, 22 nt, Human
uaaaggcaaacucuccaaggau

SEQ ID NO: 213363 - RNA, 22 nt, Human
uuaccuuuucuuguuuacaagu

SEQ ID NO: 213364 - RNA, 19 nt, Human
aggcagccccaacuugcau

SEQ ID NO: 213365 - RNA, 21 nt, Human
uccuaaaggaaauacucaauu

SEQ ID NO: 213366 - RNA, 22 nt, Human
ucccuugagcccugaggucccu

SEQ ID NO: 213367 - RNA, 22 nt, Human
caguuuuucaaaauuacaugau

SEQ ID NO: 213368 - RNA, 20 nt, Human
ucucucacccuugcugugca

SEQ ID NO: 213369 - RNA, 22 nt, Human
guuuuggagauguccauuuucc

SEQ ID NO: 213370 - RNA, 22 nt, Human
gcuuuucucccugcuuucuucc

SEQ ID NO: 213371 - RNA, 22 nt, Human
agcagggagacagugcagcauu

SEQ ID NO: 213372 - RNA, 22 nt, Human
ucugucucugucaggcugcugc

SEQ ID NO: 213373 - RNA, 22 nt, Human
augauuauuugaaugaagagga

SEQ ID NO: 213374 - RNA, 21 nt, Human
ccuccagccagagggucugga

SEQ ID NO: 213375 - RNA, 22 nt, Human
uauuuuagccaacagaaugaug

SEQ ID NO: 213376 - RNA, 22 nt, Human
gaggggaaggagcgaaggcggg

SEQ ID NO: 213377 - RNA, 22 nt, Human
aauucuguugguuagaguugga

SEQ ID NO: 213378 - RNA, 22 nt, Human
ggaaaggaagggaaggagaugc

SEQ ID NO: 213379 - RNA, 18 nt, Human
uggcuagaagagcucuca

SEQ ID NO: 213380 - RNA, 22 nt, Human
aaauaggaguagugauguauua

SEQ ID NO: 213381 - RNA, 22 nt, Human
ugggaagaguuagagacagcug

SEQ ID NO: 213382 - RNA, 22 nt, Human
cagcuguacgugaucuacaugg

SEQ ID NO: 213383 - RNA, 22 nt, Human
uuuccuuacuuauaaaaugggg

SEQ ID NO: 213384 - RNA, 22 nt, Human
cuuuaaaaauguauuuuugugg

SEQ ID NO: 213385 - RNA, 22 nt, Human
gcacagauaaucugccuuacca

SEQ ID NO: 213386 - RNA, 22 nt, Human
uuauuuuuguaacacuguauag

SEQ ID NO: 213387 - RNA, 20 nt, Human
gggcuuugagcucagggcuu

SEQ ID NO: 213388 - RNA, 22 nt, Human
aauguugaaccuuuuuggccug

SEQ ID NO: 213389 - RNA, 22 nt, Human
auguaaauauuuauauaugcau

SEQ ID NO: 213390 - RNA, 22 nt, Human
aagcugaguaggaaugguaggu

SEQ ID NO: 213391 - RNA, 22 nt, Human
gugauggucgagcgcuuguugu

SEQ ID NO: 213392 - RNA, 22 nt, Human
ggagcaguggaggggccagggu

SEQ ID NO: 213393 - RNA, 22 nt, Human
ugcaagagcccaaacuauauac

SEQ ID NO: 213394 - RNA, 22 nt, Human
auuuuuagagugaaagaauuaa

SEQ ID NO: 213395 - RNA, 22 nt, Human
gugcaucuguaauuacaauggu

SEQ ID NO: 213396 - RNA, 22 nt, Human
gguuuucacgauccucccuuuu

SEQ ID NO: 213397 - RNA, 22 nt, Human
auggaaggggagguagggagga

SEQ ID NO: 213398 - RNA, 22 nt, Human
cugaugucaaauuuaucaaagc

SEQ ID NO: 213399 - RNA, 22 nt, Human
ugagagacggagccccggcucg

SEQ ID NO: 213400 - RNA, 22 nt, Human
uguuuaaauagaacauacugca

SEQ ID NO: 213401 - RNA, 22 nt, Human
aagggaaaagcugaaugagaug

SEQ ID NO: 213402 - RNA, 22 nt, Human
auuagaaaugacaugugggaau

SEQ ID NO: 213403 - RNA, 22 nt, Human
aaucaauuauccauuuguuagu

SEQ ID NO: 213404 - RNA, 21 nt, Human
agugaguagagcacugaguca

SEQ ID NO: 213405 - RNA, 22 nt, Human
auacugagauguuaauagggug

SEQ ID NO: 213406 - RNA, 22 nt, Human
ggagccucuaaacaguuaucaa

SEQ ID NO: 213407 - RNA, 19 nt, Human
gagccgcucccgcagccgg

SEQ ID NO: 213408 - RNA, 22 nt, Human
ucuuauugugaugaugaagaac

SEQ ID NO: 213409 - RNA, 22 nt, Human
cccugcuuccucuucuguuugu

SEQ ID NO: 213410 - RNA, 22 nt, Human
aaucacuucuuugucuucuuca

SEQ ID NO: 213411 - RNA, 22 nt, Human
auguuugugauugcugaaaaga

SEQ ID NO: 213412 - RNA, 22 nt, Human
ggaaaaucaaaccauuuacagu

SEQ ID NO: 213413 - RNA, 22 nt, Human
uuauuuucgugugugugugugu

SEQ ID NO: 213414 - RNA, 22 nt, Human
gggaaaaaggaaccuuauuacu

SEQ ID NO: 213415 - RNA, 21 nt, Human
ggcagagaagcuggaaguugg

SEQ ID NO: 213416 - RNA, 22 nt, Human
gccaggccuggguggagcgcuc

SEQ ID NO: 213417 - RNA, 22 nt, Human
aacaaagaacuuucuuccuuug

SEQ ID NO: 213418 - RNA, 22 nt, Human
aauguugacguuggccagggcc

SEQ ID NO: 213419 - RNA, 22 nt, Human
cugcacuggguacauagaaaca

SEQ ID NO: 213420 - RNA, 22 nt, Human
uucuucuucuuccucauccuca

SEQ ID NO: 213421 - RNA, 22 nt, Human
auuaauaucaauauauuauaug

SEQ ID NO: 213422 - RNA, 22 nt, Human
uuaccuuggaccggguaucaga

SEQ ID NO: 213423 - RNA, 22 nt, Human
cuacuucucccuagaucagaaa

SEQ ID NO: 213424 - RNA, 22 nt, Human
aggaaaaagaagaaaagaauca

SEQ ID NO: 213425 - RNA, 19 nt, Human
gaacuaaggggagcucugg

SEQ ID NO: 213426 - RNA, 22 nt, Human
uggaagcccagaaggaagcaga

SEQ ID NO: 213427 - RNA, 17 nt, Human
aucagaggauaggacaa

SEQ ID NO: 213428 - RNA, 22 nt, Human
ggcugaggccucuggggaggga

SEQ ID NO: 213429 - RNA, 22 nt, Human
gaggucagugugggggcaaggg

SEQ ID NO: 213430 - RNA, 22 nt, Human
gccuggccaaucgccgucuagg

SEQ ID NO: 213431 - RNA, 22 nt, Human
uuauuuaagaucuuaauauaua

SEQ ID NO: 213432 - RNA, 22 nt, Human
cauguaaguucacagucgaugu

SEQ ID NO: 213433 - RNA, 22 nt, Human
ugaggcaguucuuacuuguauu

SEQ ID NO: 213434 - RNA, 22 nt, Human
gugggaggaguguugaguaagu

SEQ ID NO: 213435 - RNA, 22 nt, Human
gcuaguucugccuccccuagug

SEQ ID NO: 213436 - RNA, 22 nt, Human
uggcugaggcuuuucuuaaaga

SEQ ID NO: 213437 - RNA, 22 nt, Human
agcuggauuaaucacagugacu

SEQ ID NO: 213438 - RNA, 22 nt, Human
cacaguccugcauuuacugccu

SEQ ID NO: 213439 - RNA, 22 nt, Human
ggagauggucacagguaaacau

SEQ ID NO: 213440 - RNA, 22 nt, Human
cuccugcuuuuucuucuuccga

SEQ ID NO: 213441 - RNA, 22 nt, Human
guaguucuuucucaauguucaa

SEQ ID NO: 213442 - RNA, 22 nt, Human
uauuguuuuaagguguauuaau

SEQ ID NO: 213443 - RNA, 22 nt, Human
ucagagccagacacacagcaga

SEQ ID NO: 213444 - RNA, 22 nt, Human
aaagcagguugcaauuacagug

SEQ ID NO: 213445 - RNA, 22 nt, Human
ugaggagggcuagagucuccug

SEQ ID NO: 213446 - RNA, 22 nt, Human
gggagcuggagcuggaagacuc

SEQ ID NO: 213447 - RNA, 22 nt, Human
gccuccuuccgaccucaguccu

SEQ ID NO: 213448 - RNA, 23 nt, Human
gugugccuuuaucuucuguacuc

SEQ ID NO: 213449 - RNA, 22 nt, Human
cugaucccuuuucauuugcagg

SEQ ID NO: 213450 - RNA, 23 nt, Human
auccacauucuaguccuuuaugc

SEQ ID NO: 213451 - RNA, 22 nt, Human
ucccuguggauuaaggagaugu

SEQ ID NO: 213452 - RNA, 22 nt, Human
uuuucuguuuaugaaauugugu

SEQ ID NO: 213453 - RNA, 22 nt, Human
agauaaacaacucuuagcuguu

SEQ ID NO: 213454 - RNA, 22 nt, Human
ugaauuucuuuuuaaaauauua

SEQ ID NO: 213455 - RNA, 22 nt, Human
ucucugaggacagaaaguuugu

SEQ ID NO: 213456 - RNA, 22 nt, Human
guggaaauaugggcaacaaaga

SEQ ID NO: 213457 - RNA, 22 nt, Human
aaugaaacuaguagaaucuuug

SEQ ID NO: 213458 - RNA, 20 nt, Human
cucuuuaugagaccacuguc

SEQ ID NO: 213459 - RNA, 22 nt, Human
agggggaaaauguggauuaugg

SEQ ID NO: 213460 - RNA, 20 nt, Human
auucuguguaaauguccugu

SEQ ID NO: 213461 - RNA, 22 nt, Human
cggagggcccucaggacugggu

SEQ ID NO: 213462 - RNA, 22 nt, Human
gguguggcaguggaccugugaa

SEQ ID NO: 213463 - RNA, 22 nt, Human
agucucuagagucugucccucu

SEQ ID NO: 213464 - RNA, 22 nt, Human
aauguuuuucaaguguggagca

SEQ ID NO: 213465 - RNA, 22 nt, Human
agaugaguaaauggagucuucc

SEQ ID NO: 213466 - RNA, 22 nt, Human
gccaguggucagugggagggug

SEQ ID NO: 213467 - RNA, 22 nt, Human
gaaggcaguaaauggcuguuuu

SEQ ID NO: 213468 - RNA, 22 nt, Human
ccuuggcuuaccuucugugugg

SEQ ID NO: 213469 - RNA, 22 nt, Human
cagguugaaaguggaggagcua

SEQ ID NO: 213470 - RNA, 22 nt, Human
acagacaucaucaacaucuucc

SEQ ID NO: 213471 - RNA, 22 nt, Human
ucacuguuucaccgucugaagg

SEQ ID NO: 213472 - RNA, 21 nt, Human
uuucauuaguacaucaauuug

SEQ ID NO: 213473 - RNA, 22 nt, Human
cuuuuucuugugguuaauaucu

SEQ ID NO: 213474 - RNA, 22 nt, Human
cccagagggcugaggauaugaa

SEQ ID NO: 213475 - RNA, 22 nt, Human
uucuugucuuuguuauguagga

SEQ ID NO: 213476 - RNA, 22 nt, Human
ugugguuggggucagauaggga

SEQ ID NO: 213477 - RNA, 22 nt, Human
ggcucccgugggaugguggagc

SEQ ID NO: 213478 - RNA, 22 nt, Human
caagggcagaggcagggccccg

SEQ ID NO: 213479 - RNA, 22 nt, Human
ggaggcccagaaggaagcccag

SEQ ID NO: 213480 - RNA, 22 nt, Human
guuuuucuagaaaucuccuccu

SEQ ID NO: 213481 - RNA, 22 nt, Human
ucugaggacagugcugugccug

SEQ ID NO: 213482 - RNA, 22 nt, Human
gucuggagccacugcugcugcu

SEQ ID NO: 213483 - RNA, 21 nt, Human
auauuguugggguuuucuuuu

SEQ ID NO: 213484 - RNA, 21 nt, Human
uuuuucuccagaguuuccacu

SEQ ID NO: 213485 - RNA, 18 nt, Human
ggagaagaacagaugugg

SEQ ID NO: 213486 - RNA, 22 nt, Human
ugugguagagcuuaaaugaggu

SEQ ID NO: 213487 - RNA, 22 nt, Human
uuuuuuaaucaaguaggaaaca

SEQ ID NO: 213488 - RNA, 22 nt, Human
uucuagcucauggugacagauc

SEQ ID NO: 213489 - RNA, 22 nt, Human
guugguggaggcgagagaagaa

SEQ ID NO: 213490 - RNA, 22 nt, Human
gagagagacugggaaaucauca

SEQ ID NO: 213491 - RNA, 22 nt, Human
ggcugcugcccaccccugcaug

SEQ ID NO: 213492 - RNA, 22 nt, Human
aauaagacugucauggaguaaa

SEQ ID NO: 213493 - RNA, 22 nt, Human
ccagcugcugcaccgugcaugg

SEQ ID NO: 213494 - RNA, 22 nt, Human
cuggcaguguccagcucgugau

SEQ ID NO: 213495 - RNA, 22 nt, Human
guucauuucaagucuaauccau

SEQ ID NO: 213496 - RNA, 22 nt, Human
gcuagaaacuguuuaaucucuu

SEQ ID NO: 213497 - RNA, 22 nt, Human
ugggagccuuccacugggggaa

SEQ ID NO: 213498 - RNA, 22 nt, Human
gagggcugccacguugggcgag

SEQ ID NO: 213499 - RNA, 22 nt, Human
uaaaugaaaggguuuaauuuau

SEQ ID NO: 213500 - RNA, 22 nt, Human
aucaugcugacacaguuuaucu

SEQ ID NO: 213501 - RNA, 22 nt, Human
uugcaugugugaaaugcacaga

SEQ ID NO: 213502 - RNA, 22 nt, Human
ucucuggacggacauuuaaggu

SEQ ID NO: 213503 - RNA, 22 nt, Human
cuccccuuauuccucaacauga

SEQ ID NO: 213504 - RNA, 22 nt, Human
aaauggauaaucaagauaauca

SEQ ID NO: 213505 - RNA, 22 nt, Human
acugcauuaucaccaagaugua

SEQ ID NO: 213506 - RNA, 22 nt, Human
gggcaggggcagugguggcauu

SEQ ID NO: 213507 - RNA, 22 nt, Human
acaacagaacuccugggauuuu

SEQ ID NO: 213508 - RNA, 22 nt, Human
gaaaaagagaaggaguucagua

SEQ ID NO: 213509 - RNA, 22 nt, Human
acauuguuuuugugacuucuau

SEQ ID NO: 213510 - RNA, 22 nt, Human
gauagcacacuuguugcuucug

SEQ ID NO: 213511 - RNA, 22 nt, Human
uguuuuuuagagugauacuuuu

SEQ ID NO: 213512 - RNA, 22 nt, Human
uguuuaagugguuaaaggauuc

SEQ ID NO: 213513 - RNA, 22 nt, Human
gugaugaaggccugcaccuggu

SEQ ID NO: 213514 - RNA, 22 nt, Human
uaagaaacauuuuuaugacagu

SEQ ID NO: 213515 - RNA, 22 nt, Human
cacauguguaccugccucucug

SEQ ID NO: 213516 - RNA, 22 nt, Human
uuucuguucuguuggauucuuu

SEQ ID NO: 213517 - RNA, 22 nt, Human
ugcugcacccuucauuuuccca

SEQ ID NO: 213518 - RNA, 22 nt, Human
agacugugagaagauggcugcg

SEQ ID NO: 213519 - RNA, 23 nt, Human
agggcacugaagcuggaauuggg

SEQ ID NO: 213520 - RNA, 22 nt, Human
agaagcaauuggaaaguacagg

SEQ ID NO: 213521 - RNA, 22 nt, Human
uggcaaggccacaggugcaguu

SEQ ID NO: 213522 - RNA, 22 nt, Human
ucauaaaaucaguguccauugu

SEQ ID NO: 213523 - RNA, 22 nt, Human
agcagauaaagguugcauuucu

SEQ ID NO: 213524 - RNA, 22 nt, Human
gaauuagguaauagaacuagua

SEQ ID NO: 213525 - RNA, 22 nt, Human
aagggagagggagaagguggga

SEQ ID NO: 213526 - RNA, 22 nt, Human
ggccagcuuugagcugcaggaa

SEQ ID NO: 213527 - RNA, 22 nt, Human
uugcucuuaccauuauguguga

SEQ ID NO: 213528 - RNA, 22 nt, Human
uuguuucagcuuccuccuccau

SEQ ID NO: 213529 - RNA, 22 nt, Human
auagaagguaaugccccaaggg

SEQ ID NO: 213530 - RNA, 22 nt, Human
aagauuuaccacuuuauucaag

SEQ ID NO: 213531 - RNA, 22 nt, Human
agcuccauauggcacaccauuu

SEQ ID NO: 213532 - RNA, 22 nt, Human
uucucuggggacugucucuauu

SEQ ID NO: 213533 - RNA, 22 nt, Human
ggguggggcaugcucucuucug

SEQ ID NO: 213534 - RNA, 22 nt, Human
gcaggggguaaggggcagggcu

SEQ ID NO: 213535 - RNA, 21 nt, Human
ucauccagguccugcuucuuc

SEQ ID NO: 213536 - RNA, 22 nt, Human
agacuccuucuaagaccucauu

SEQ ID NO: 213537 - RNA, 22 nt, Human
ugaguuucuuacucaggagcug

SEQ ID NO: 213538 - RNA, 19 nt, Human
caagagcaaagucuuauga

SEQ ID NO: 213539 - RNA, 22 nt, Human
cccagcccaucauuccugcaaa

SEQ ID NO: 213540 - RNA, 22 nt, Human
cucagaagaacaaaggcucuac

SEQ ID NO: 213541 - RNA, 22 nt, Human
agggaagagaaacaaagauuca

SEQ ID NO: 213542 - RNA, 22 nt, Human
uucacauucauuucuuauguuu

SEQ ID NO: 213543 - RNA, 22 nt, Human
cucuccagucauauucucaguc

SEQ ID NO: 213544 - RNA, 22 nt, Human
ucuucacagaugcauauacuuc

SEQ ID NO: 213545 - RNA, 22 nt, Human
uugugcauuugcuaugggccau

SEQ ID NO: 213546 - RNA, 21 nt, Human
ccacaauucuaguuacauaug

SEQ ID NO: 213547 - RNA, 22 nt, Human
uucugcuuuaaagcucauguuu

SEQ ID NO: 213548 - RNA, 22 nt, Human
gcuuucccaaccuucuugguau

SEQ ID NO: 213549 - RNA, 22 nt, Human
agggcuuaggcacacugugacu

SEQ ID NO: 213550 - RNA, 19 nt, Human
ucagcagauuuugcaaaca

SEQ ID NO: 213551 - RNA, 22 nt, Human
guuggggccuggagucucuugg

SEQ ID NO: 213552 - RNA, 22 nt, Human
acauuccugaagguaaugagaa

SEQ ID NO: 213553 - RNA, 22 nt, Human
auaaggcauagugagucaucau

SEQ ID NO: 213554 - RNA, 22 nt, Human
uaauauauuuuuuaagggaugu

SEQ ID NO: 213555 - RNA, 22 nt, Human
agacccugauucugcuggcggu

SEQ ID NO: 213556 - RNA, 22 nt, Human
gauacuuuguggaauccuggau

SEQ ID NO: 213557 - RNA, 22 nt, Human
caaagaugccaaaaggaagaca

SEQ ID NO: 213558 - RNA, 22 nt, Human
cuaaaaauguucuaguaguuca

SEQ ID NO: 213559 - RNA, 22 nt, Human
agcagggugugggugugagugu

SEQ ID NO: 213560 - RNA, 22 nt, Human
augguguaggugaagagaacau

SEQ ID NO: 213561 - RNA, 22 nt, Human
uaaauguacugaggcaacagga

SEQ ID NO: 213562 - RNA, 22 nt, Human
gaggcugguucccuugaucuuu

SEQ ID NO: 213563 - RNA, 22 nt, Human
uguauauuuucuguauaaaaua

SEQ ID NO: 213564 - RNA, 22 nt, Human
agggcucacuacaacccuggga

SEQ ID NO: 213565 - RNA, 22 nt, Human
gaaaaucaugaaaguguguugu

SEQ ID NO: 213566 - RNA, 22 nt, Human
gaguaaggaaguguuggccaca

SEQ ID NO: 213567 - RNA, 22 nt, Human
ccugcccaucccaccccagcau

SEQ ID NO: 213568 - RNA, 22 nt, Human
aucagaagaaauggaugugacu

SEQ ID NO: 213569 - RNA, 22 nt, Human
aaaguguuuaacaaauugcuuu

SEQ ID NO: 213570 - RNA, 19 nt, Human
cggugcugauuggugcagu

SEQ ID NO: 213571 - RNA, 22 nt, Human
uuucagacugcccauguuugcc

SEQ ID NO: 213572 - RNA, 22 nt, Human
ugagauguaauguaguacuuug

SEQ ID NO: 213573 - RNA, 22 nt, Human
gcaggaaugguacauaccuguu

SEQ ID NO: 213574 - RNA, 22 nt, Human
gauauauuucaaauucuuuugc

SEQ ID NO: 213575 - RNA, 22 nt, Human
ggaguguuaggaaguuguguuu

SEQ ID NO: 213576 - RNA, 22 nt, Human
uuucuuaaaagcuuuuaaaguu

SEQ ID NO: 213577 - RNA, 22 nt, Human
caugugcaucagccaauuggag

SEQ ID NO: 213578 - RNA, 22 nt, Human
agagcacaggguuuugugccgg

SEQ ID NO: 213579 - RNA, 22 nt, Human
uuuuaaauaaacuacacugauu

SEQ ID NO: 213580 - RNA, 22 nt, Human
uccucuucaaaauagcucugaa

SEQ ID NO: 213581 - RNA, 22 nt, Human
ugguucuagaugagaugaugag

SEQ ID NO: 213582 - RNA, 22 nt, Human
gucuuuguaguuuuaauuugag

SEQ ID NO: 213583 - RNA, 22 nt, Human
auuaaacuaaauuaugaauugg

SEQ ID NO: 213584 - RNA, 22 nt, Human
auaaauuugacagcucuucaug

SEQ ID NO: 213585 - RNA, 22 nt, Human
gccaggagaaaaggcgaaugau

SEQ ID NO: 213586 - RNA, 22 nt, Human
ugaaaaaugcuuuaaugcaugu

SEQ ID NO: 213587 - RNA, 22 nt, Human
uuuucuacaaucacucuggaag

SEQ ID NO: 213588 - RNA, 22 nt, Human
gaaggaaaagacgugcuaagua

SEQ ID NO: 213589 - RNA, 22 nt, Human
agcaggaaggcuagaagcagga

SEQ ID NO: 213590 - RNA, 22 nt, Human
ccaggcuccccaggaggcccuu

SEQ ID NO: 213591 - RNA, 22 nt, Human
cccauggaaggguuggcccaga

SEQ ID NO: 213592 - RNA, 22 nt, Human
gcuucccagaccaggcucccuc

SEQ ID NO: 213593 - RNA, 22 nt, Human
uuucuacacuucgugguguuuu

SEQ ID NO: 213594 - RNA, 22 nt, Human
agcuccucagauuuggguggcg

SEQ ID NO: 213595 - RNA, 22 nt, Human
aguguuaggaauuaauguaggg

SEQ ID NO: 213596 - RNA, 22 nt, Human
gaggguuucagugggacggguu

SEQ ID NO: 213597 - RNA, 22 nt, Human
caggaggugugucccaccgggu

SEQ ID NO: 213598 - RNA, 22 nt, Human
agucaccuacagcucaugcuuc

SEQ ID NO: 213599 - RNA, 22 nt, Human
aagcaugagguggugagugaca

SEQ ID NO: 213600 - RNA, 18 nt, Human
ggcagggcucagcugcuc

SEQ ID NO: 213601 - RNA, 22 nt, Human
ugaauaaucuuggguauuaaua

SEQ ID NO: 213602 - RNA, 22 nt, Human
uaucauuaggagugcugcucgg

SEQ ID NO: 213603 - RNA, 22 nt, Human
uauguauaacuugauaggauga

SEQ ID NO: 213604 - RNA, 22 nt, Human
ugcauguuuuaagugaagcuga

SEQ ID NO: 213605 - RNA, 22 nt, Human
aagagaggcccaaguggcuggc

SEQ ID NO: 213606 - RNA, 22 nt, Human
ugguggagucugggggaggcuu

SEQ ID NO: 213607 - RNA, 22 nt, Human
caguggacacuuccucuacaau

SEQ ID NO: 213608 - RNA, 22 nt, Human
ucccugagcucacauggcagga

SEQ ID NO: 213609 - RNA, 22 nt, Human
ugguaauuuaacaaaauuguca

SEQ ID NO: 213610 - RNA, 22 nt, Human
auucuagaguuucaauccaagg

SEQ ID NO: 213611 - RNA, 22 nt, Human
ugccuccucccuccuccuaggu

SEQ ID NO: 213612 - RNA, 17 nt, Human
uguguaaguugcauaga

SEQ ID NO: 213613 - RNA, 22 nt, Human
uggaagggguuacgcagcagga

SEQ ID NO: 213614 - RNA, 22 nt, Human
cagaacugaauaaagccaggau

SEQ ID NO: 213615 - RNA, 22 nt, Human
ugccagucggcacuuuaucugg

SEQ ID NO: 213616 - RNA, 22 nt, Human
aauaugaugccaaauugcuaca

SEQ ID NO: 213617 - RNA, 22 nt, Human
aaaacauuuaggguuuuuuuua

SEQ ID NO: 213618 - RNA, 22 nt, Human
accugcagguguuuccacacuu

SEQ ID NO: 213619 - RNA, 19 nt, Human
agcugcugauugguggagg

SEQ ID NO: 213620 - RNA, 23 nt, Human
gggggagcuggacuccuagaucc

SEQ ID NO: 213621 - RNA, 23 nt, Human
ggagaaggaugucaucaaaagac

SEQ ID NO: 213622 - RNA, 22 nt, Human
ucaggcuagcccagugcuuggg

SEQ ID NO: 213623 - RNA, 22 nt, Human
uagaacaaacagcauguuugau

SEQ ID NO: 213624 - RNA, 22 nt, Human
aaagagggaaggaaggagugaa

SEQ ID NO: 213625 - RNA, 22 nt, Human
aggaaaauggaccagaguuguu

SEQ ID NO: 213626 - RNA, 22 nt, Human
uuucauguuggauacuguuuca

SEQ ID NO: 213627 - RNA, 22 nt, Human
uggggcuccuccuggcaggagg

SEQ ID NO: 213628 - RNA, 22 nt, Human
cagggggacuuguuagguuuua

SEQ ID NO: 213629 - RNA, 22 nt, Human
gggcaagaagcuggaagcauuc

SEQ ID NO: 213630 - RNA, 22 nt, Human
gacuugcucaaaucagauuuua

SEQ ID NO: 213631 - RNA, 22 nt, Human
uuuuauuuguauguugaaugua

SEQ ID NO: 213632 - RNA, 22 nt, Human
gaugauuuuguaacuggggaca

SEQ ID NO: 213633 - RNA, 22 nt, Human
acccccacuccgcaguagaacu

SEQ ID NO: 213634 - RNA, 22 nt, Human
caaaaauacuugccuguaucug

SEQ ID NO: 213635 - RNA, 22 nt, Human
uagugucuuccaggacauggua

SEQ ID NO: 213636 - RNA, 22 nt, Human
uggucccuagugugggagcuug

SEQ ID NO: 213637 - RNA, 22 nt, Human
gaggggcuccagguguugagga

SEQ ID NO: 213638 - RNA, 22 nt, Human
ugggccucuguuuccucaucug

SEQ ID NO: 213639 - RNA, 22 nt, Human
cggcugcagcggagcaggcugg

SEQ ID NO: 213640 - RNA, 22 nt, Human
aagaggaggcuggaauccuaaa

SEQ ID NO: 213641 - RNA, 22 nt, Human
auagggaggcggagggagcugg

SEQ ID NO: 213642 - RNA, 22 nt, Human
ccaggacuuauuacaguauaac

SEQ ID NO: 213643 - RNA, 22 nt, Human
gggaggcagacgcuggagccca

SEQ ID NO: 213644 - RNA, 22 nt, Human
guauauuuaugagcauuagccu

SEQ ID NO: 213645 - RNA, 22 nt, Human
cacagaggaugcccaagcgauc

SEQ ID NO: 213646 - RNA, 22 nt, Human
acaggcugcccgcuccccaccu

SEQ ID NO: 213647 - RNA, 22 nt, Human
ugggaggcugugggaauggguc

SEQ ID NO: 213648 - RNA, 22 nt, Human
gaggcagaggaaacagcucauu

SEQ ID NO: 213649 - RNA, 22 nt, Human
gaauauuuaucucagcugcaga

SEQ ID NO: 213650 - RNA, 22 nt, Human
ugugggaggauuuaggugaauc

SEQ ID NO: 213651 - RNA, 22 nt, Human
ggacggggagcuggaaagggga

SEQ ID NO: 213652 - RNA, 22 nt, Human
agaguucaccccacugaugagu

SEQ ID NO: 213653 - RNA, 22 nt, Human
auuguauugcguuugcgaaugu

SEQ ID NO: 213654 - RNA, 22 nt, Human
ucucugucucccguguguccgg

SEQ ID NO: 213655 - RNA, 22 nt, Human
uugggagagaaaccuaaugccu

SEQ ID NO: 213656 - RNA, 22 nt, Human
uucagcauaggcugcucuucaa

SEQ ID NO: 213657 - RNA, 22 nt, Human
uugucuuucguauggaacacua

SEQ ID NO: 213658 - RNA, 21 nt, Human
auucugauguuucuauuguuu

SEQ ID NO: 213659 - RNA, 22 nt, Human
cccuucuguaucuucugaguuu

SEQ ID NO: 213660 - RNA, 18 nt, Human
ugauggcuaagagccggg

SEQ ID NO: 213661 - RNA, 20 nt, Human
aaagauacuuuuuguaaugg

SEQ ID NO: 213662 - RNA, 22 nt, Human
caauaccucuuggugauugggc

SEQ ID NO: 213663 - RNA, 22 nt, Human
ccugccagaaaagagggaguuc

SEQ ID NO: 213664 - RNA, 22 nt, Human
uaucaguagaacaauggacauu

SEQ ID NO: 213665 - RNA, 22 nt, Human
auguguguaugugugcauguau

SEQ ID NO: 213666 - RNA, 22 nt, Human
acuacucagcaaacauuugcug

SEQ ID NO: 213667 - RNA, 22 nt, Human
cuacuguaguuaaaguuuugua

SEQ ID NO: 213668 - RNA, 19 nt, Human
aggaaggggauaaguaaca

SEQ ID NO: 213669 - RNA, 22 nt, Human
aauagagacaguuuaacaauau

SEQ ID NO: 213670 - RNA, 22 nt, Human
ccauaaaagagaaucuaaauga

SEQ ID NO: 213671 - RNA, 22 nt, Human
auguacugacuguacuuuuaaa

SEQ ID NO: 213672 - RNA, 21 nt, Human
aaagaagagcucagagguaga

SEQ ID NO: 213673 - RNA, 22 nt, Human
gagaggcagcucaggaggucag

SEQ ID NO: 213674 - RNA, 22 nt, Human
ggcuagggagacagagggcaug

SEQ ID NO: 213675 - RNA, 22 nt, Human
uuuuguagauagggaaacagag

SEQ ID NO: 213676 - RNA, 22 nt, Human
ucucuggcuuuuuuuccauuuu

SEQ ID NO: 213677 - RNA, 22 nt, Human
agggaggcccagcagacuggcg

SEQ ID NO: 213678 - RNA, 22 nt, Human
ccagguggacggcgaguacagg

SEQ ID NO: 213679 - RNA, 22 nt, Human
uguggucuccucucugucuucc

SEQ ID NO: 213680 - RNA, 22 nt, Human
uugaaaauuaauagguguacaa

SEQ ID NO: 213681 - RNA, 22 nt, Human
uuuuuaaaagaugauuuaauga

SEQ ID NO: 213682 - RNA, 22 nt, Human
ugaggaugaggaagaagaagaa

SEQ ID NO: 213683 - RNA, 21 nt, Human
cuuugccuccagcagccgcag

SEQ ID NO: 213684 - RNA, 22 nt, Human
auguuccuuaaugugcuuguag

SEQ ID NO: 213685 - RNA, 20 nt, Human
uugauucacaaaaagcuuag

SEQ ID NO: 213686 - RNA, 22 nt, Human
aggcagugguguuugcuggugg

SEQ ID NO: 213687 - RNA, 22 nt, Human
gacuggguaaagcuuauccaaa

SEQ ID NO: 213688 - RNA, 22 nt, Human
aagaggacagucaaauggccgg

SEQ ID NO: 213689 - RNA, 22 nt, Human
uacuucccacuggggucuacca

SEQ ID NO: 213690 - RNA, 22 nt, Human
aaggagaggagucauugggaua

SEQ ID NO: 213691 - RNA, 23 nt, Human
ccuggcugaccugaagguguagu

SEQ ID NO: 213692 - RNA, 22 nt, Human
ggccugcucuggcuguggucag

SEQ ID NO: 213693 - RNA, 22 nt, Human
cuauaauuguacuuguuuuuua

SEQ ID NO: 213694 - RNA, 22 nt, Human
agaguguaauuaguauuuauau

SEQ ID NO: 213695 - RNA, 22 nt, Human
agaagaagacccuaaggaaagg

SEQ ID NO: 213696 - RNA, 22 nt, Human
aacuggguuuaucuaaugugua

SEQ ID NO: 213697 - RNA, 22 nt, Human
uuacaucacuuuacuuaauaau

SEQ ID NO: 213698 - RNA, 22 nt, Human
ugcugugagaccauuuguugag

SEQ ID NO: 213699 - RNA, 22 nt, Human
accuuaagugauuaugacauau

SEQ ID NO: 213700 - RNA, 22 nt, Human
cccugggccccgaacugcugag

SEQ ID NO: 213701 - RNA, 22 nt, Human
caaggaguuuggggaccaagga

SEQ ID NO: 213702 - RNA, 22 nt, Human
uuguauuaauacacuccuuuuc

SEQ ID NO: 213703 - RNA, 19 nt, Human
auccucucuagaaguggga

SEQ ID NO: 213704 - RNA, 22 nt, Human
aaagaauuucaagauucccaca

SEQ ID NO: 213705 - RNA, 22 nt, Human
gcagagcugucuaagucacuuc

SEQ ID NO: 213706 - RNA, 22 nt, Human
auuuucuugucucuguuguagg

SEQ ID NO: 213707 - RNA, 22 nt, Human
uuuuauaauacccuugacuaau

SEQ ID NO: 213708 - RNA, 22 nt, Human
ggacauaguugcuauggagagu

SEQ ID NO: 213709 - RNA, 23 nt, Human
uuagcccaggcuggagguagccc

SEQ ID NO: 213710 - RNA, 22 nt, Human
ugagggaguguggauacaguag

SEQ ID NO: 213711 - RNA, 22 nt, Human
uuccuaauugccaugaaguuau

SEQ ID NO: 213712 - RNA, 22 nt, Human
ugaaagcuggcucugcagagug

SEQ ID NO: 213713 - RNA, 22 nt, Human
aaaagauguaaacauauauuaa

SEQ ID NO: 213714 - RNA, 22 nt, Human
aacugggugauucaggcuguuu

SEQ ID NO: 213715 - RNA, 22 nt, Human
cagauuuaauaaaaaaugcauc

SEQ ID NO: 213716 - RNA, 22 nt, Human
uuucuauauucaguuucauaaa

SEQ ID NO: 213717 - RNA, 22 nt, Human
uuuuugaauaagugcaucauca

SEQ ID NO: 213718 - RNA, 22 nt, Human
agcugagccagacagguaagca

SEQ ID NO: 213719 - RNA, 22 nt, Human
uuuucaauuuucauuugcaaga

SEQ ID NO: 213720 - RNA, 19 nt, Human
auugguuugcucgggaaug

SEQ ID NO: 213721 - RNA, 20 nt, Human
agaaggagagaugaggcaaa

SEQ ID NO: 213722 - RNA, 22 nt, Human
ccucccagccuggagaggagcc

SEQ ID NO: 213723 - RNA, 22 nt, Human
auagaaauagacaaugcaaaga

SEQ ID NO: 213724 - RNA, 22 nt, Human
uucuucuuuccuauaauuaauu

SEQ ID NO: 213725 - RNA, 22 nt, Human
auuauucaaggugaggguaaaa

SEQ ID NO: 213726 - RNA, 22 nt, Human
uuccucauucuggggcauguug

SEQ ID NO: 213727 - RNA, 22 nt, Human
gaaagaggcugucagggaaugg

SEQ ID NO: 213728 - RNA, 22 nt, Human
ggugaguagaaguaguuggcuu

SEQ ID NO: 213729 - RNA, 19 nt, Human
accauggguguguuaagaa

SEQ ID NO: 213730 - RNA, 22 nt, Human
uccagugccagcuguuaaaguu

SEQ ID NO: 213731 - RNA, 22 nt, Human
uguguucuuugcuuaauuaaag

SEQ ID NO: 213732 - RNA, 22 nt, Human
uccuggccucugagucaagaac

SEQ ID NO: 213733 - RNA, 22 nt, Human
uguguggccuccauaggguacu

SEQ ID NO: 213734 - RNA, 22 nt, Human
agggaaauuaaugugagcaaug

SEQ ID NO: 213735 - RNA, 22 nt, Human
aguuuucugccucuggaugcgu

SEQ ID NO: 213736 - RNA, 22 nt, Human
aaacgcaauuucuugcauguca

SEQ ID NO: 213737 - RNA, 22 nt, Human
gaagcccuggaggggcuggagg

SEQ ID NO: 213738 - RNA, 22 nt, Human
gcaguaaauugagagucauguu

SEQ ID NO: 213739 - RNA, 22 nt, Human
uuuauuuuccaugucucuaggu

SEQ ID NO: 213740 - RNA, 22 nt, Human
auucuuuucucuaaaugaugaa

SEQ ID NO: 213741 - RNA, 22 nt, Human
auauaugcaacaagaaagcaua

SEQ ID NO: 213742 - RNA, 22 nt, Human
ucucuacugcuucugugaguga

SEQ ID NO: 213743 - RNA, 22 nt, Human
cugagaggcacaaggcauuucg

SEQ ID NO: 213744 - RNA, 22 nt, Human
gcucucucuucugcaggccuua

SEQ ID NO: 213745 - RNA, 22 nt, Human
uuaccuaagaaacucauuucgu

SEQ ID NO: 213746 - RNA, 22 nt, Salmonella typhimurium LT2
cugcgcuuaccaggccuacacg

SEQ ID NO: 213747 - RNA, 22 nt, Salmonella typhimurium LT2
gaucagaaugcuguugcuggag

SEQ ID NO: 213748 - RNA, 22 nt, Salmonella typhimurium LT2
ggcuuuaccguguuccccgcgc

SEQ ID NO: 213749 - RNA, 22 nt, Salmonella typhimurium LT2
gccguccaccguggcgguggac

SEQ ID NO: 213750 - RNA, 22 nt, Salmonella typhimurium LT2
uagcgccgcucucauaaccaga

SEQ ID NO: 213751 - RNA, 22 nt, Salmonella typhimurium LT2
ugggcaccagguacugauuagu

SEQ ID NO: 213752 - RNA, 22 nt, Salmonella typhimurium LT2
ugacggagaucguccgcggcgc

SEQ ID NO: 213753 - RNA, 22 nt, Salmonella typhimurium LT2
caggaguugcagauuuaccggu

SEQ ID NO: 213754 - RNA, 22 nt, Salmonella typhimurium LT2
acggucuguacagcguaccgcc

SEQ ID NO: 213755 - RNA, 22 nt, Salmonella typhimurium LT2
ccggauaaggcagcaaugugcg

SEQ ID NO: 213756 - RNA, 22 nt, Salmonella typhimurium LT2
uccggacgacaaacgccaggcg

SEQ ID NO: 213757 - RNA, 22 nt, Salmonella typhimurium LT2
guggcggaggugauucaacgcu

SEQ ID NO: 213758 - RNA, 22 nt, Salmonella typhimurium LT2
accaugaucaccaucuucacau

SEQ ID NO: 213759 - RNA, 18 nt, Salmonella typhimurium LT2
cguucgucugcaacgcau

SEQ ID NO: 213760 - RNA, 22 nt, Salmonella typhimurium LT2
cgugaugcaacguuggaucgcc

SEQ ID NO: 213761 - RNA, 22 nt, Salmonella typhimurium LT2
aaagcuggguggcgcgcguugc

SEQ ID NO: 213762 - RNA, 22 nt, Salmonella typhimurium LT2
accugugcacugccgaguuuga

SEQ ID NO: 213763 - RNA, 22 nt, Salmonella typhimurium LT2
ugcugaauccgauaaauggguu

SEQ ID NO: 213764 - RNA, 22 nt, Salmonella typhimurium LT2
uuaugauguucacuuuacuggc

SEQ ID NO: 213765 - RNA, 22 nt, Salmonella typhimurium LT2
caucgccuuaauuuuauccagc

SEQ ID NO: 213766 - RNA, 22 nt, Salmonella typhimurium LT2
uagccaucaccaucuucuggca

SEQ ID NO: 213767 - RNA, 22 nt, Salmonella typhimurium LT2
uugccgacaacaaucagcguca

SEQ ID NO: 213768 - RNA, 22 nt, Salmonella typhimurium LT2
auugaugacaucgaccugaacc

SEQ ID NO: 213769 - RNA, 22 nt, Salmonella typhimurium LT2
ugcagccgggacaauacgccgc

SEQ ID NO: 213770 - RNA, 22 nt, Salmonella typhimurium LT2
cgagauggguggcgaugauuuc

SEQ ID NO: 213771 - RNA, 22 nt, Salmonella typhimurium LT2
uggcgcaaggccugguuuuccg

SEQ ID NO: 213772 - RNA, 22 nt, Salmonella typhimurium LT2
auuucccgcuggucaacaaaga

SEQ ID NO: 213773 - RNA, 22 nt, Salmonella typhimurium LT2
uggcugauaucuggcccagguc

SEQ ID NO: 213774 - RNA, 22 nt, Salmonella typhimurium LT2
cgcauauucucgaaguggcccc

SEQ ID NO: 213775 - RNA, 22 nt, Salmonella typhimurium LT2
guauggacagcaagcuuuccgg

SEQ ID NO: 213776 - RNA, 22 nt, Salmonella typhimurium LT2
caucuucaaaacgcugcaugag

SEQ ID NO: 213777 - RNA, 22 nt, Salmonella typhimurium LT2
uaguccuuaugacaaugucaaa

SEQ ID NO: 213778 - RNA, 18 nt, Salmonella typhimurium LT2
agauugcuguaucguagu

SEQ ID NO: 213779 - RNA, 20 nt, Salmonella typhimurium LT2
ugaucgauguacguuugcag

SEQ ID NO: 213780 - RNA, 22 nt, Salmonella typhimurium LT2
acgucggccuuuaaaccggaca

SEQ ID NO: 213781 - RNA, 22 nt, Salmonella typhimurium LT2
ggcguccagaucgcccucaucg

SEQ ID NO: 213782 - RNA, 21 nt, Salmonella typhimurium LT2
cugcuuggcgauauuacuauc

SEQ ID NO: 213783 - RNA, 22 nt, Salmonella typhimurium LT2
auauuggugaagacgcaccugu

SEQ ID NO: 213784 - RNA, 22 nt, Salmonella typhimurium LT2
aagucgauuuccgcuuccugcg

SEQ ID NO: 213785 - RNA, 22 nt, Salmonella typhimurium LT2
uuagcgcgauguagcgcgguuu

SEQ ID NO: 213786 - RNA, 22 nt, Salmonella typhimurium LT2
gccagcguaaauagcccggauc

SEQ ID NO: 213787 - RNA, 22 nt, Salmonella typhimurium LT2
uaggccggauaagcguuagcgc

SEQ ID NO: 213788 - RNA, 22 nt, Salmonella typhimurium LT2
aaugaacaugauggaaggcacg

SEQ ID NO: 213789 - RNA, 22 nt, Salmonella typhimurium LT2
cuggaggccgcuaaucugaguc

SEQ ID NO: 213790 - RNA, 22 nt, Salmonella typhimurium LT2
acgcaugacuaucugcgcuggu

SEQ ID NO: 213791 - RNA, 22 nt, Salmonella typhimurium LT2
uauaucagcgaccaucuggcgg

SEQ ID NO: 213792 - RNA, 22 nt, Salmonella typhimurium LT2
auccggguaauguaaaaaaucu

SEQ ID NO: 213793 - RNA, 22 nt, Salmonella typhimurium LT2
cggacgaacuggugccgcuucc

SEQ ID NO: 213794 - RNA, 20 nt, Salmonella typhimurium LT2
auugccgauggugguauaca

SEQ ID NO: 213795 - RNA, 22 nt, Salmonella typhimurium LT2
uagaucaucgggaagugcuggc

SEQ ID NO: 213796 - RNA, 22 nt, Salmonella typhimurium LT2
ugagcaagugacagacuuauug

SEQ ID NO: 213797 - RNA, 22 nt, Salmonella typhimurium LT2
cuggauuaagcgggcugcgugu

SEQ ID NO: 213798 - RNA, 22 nt, Salmonella typhimurium LT2
guaucguacaggcgguggccgg

SEQ ID NO: 213799 - RNA, 22 nt, Salmonella typhimurium LT2
ccuguugguuuacguuauggcu

SEQ ID NO: 213800 - RNA, 22 nt, Salmonella typhimurium LT2
uguccguagugcgauuuuaaaa

SEQ ID NO: 213801 - RNA, 22 nt, Salmonella typhimurium LT2
gccgucagcggugcgcgcuucc

SEQ ID NO: 213802 - RNA, 22 nt, Salmonella typhimurium LT2
aggauauguccgaucugccgaa

SEQ ID NO: 213803 - RNA, 22 nt, Salmonella typhimurium LT2
gauguaggccugauaagcguag

SEQ ID NO: 213804 - RNA, 22 nt, Salmonella typhimurium LT2
gucaacggccaguagauccuga

SEQ ID NO: 213805 - RNA, 20 nt, Salmonella typhimurium LT2
cguuggcuuaauacgcugug

SEQ ID NO: 213806 - RNA, 22 nt, Salmonella typhimurium LT2
ucaggaaaaccaacaugaugua

SEQ ID NO: 213807 - RNA, 22 nt, Salmonella typhimurium LT2
auugacgauaucggcauugacg

SEQ ID NO: 213808 - RNA, 22 nt, Salmonella typhimurium LT2
cacguggagauggcggcggcgu

SEQ ID NO: 213809 - RNA, 22 nt, Salmonella typhimurium LT2
ucugccgguuaugauggcggcg

SEQ ID NO: 213810 - RNA, 21 nt, Salmonella typhimurium LT2
uucuggacgcguaucgcgcug

SEQ ID NO: 213811 - RNA, 22 nt, Salmonella typhimurium LT2
uggaccugcguacuuucucgcu

SEQ ID NO: 213812 - RNA, 22 nt, Salmonella typhimurium LT2
uggcgcuuauuuuugugcuacu

SEQ ID NO: 213813 - RNA, 22 nt, Salmonella typhimurium LT2
uugcgggacagcuugucgauau

SEQ ID NO: 213814 - RNA, 19 nt, Salmonella typhimurium LT2
ggucagcgaacuggcguua

SEQ ID NO: 213815 - RNA, 22 nt, Salmonella typhimurium LT2
cuuccgcguuugucggcgcugu

SEQ ID NO: 213816 - RNA, 22 nt, Salmonella typhimurium LT2
accgucggugauaucgaaucgc

SEQ ID NO: 213817 - RNA, 22 nt, Salmonella typhimurium LT2
ccuuugaaggucggcagcaggg

SEQ ID NO: 213818 - RNA, 22 nt, Salmonella typhimurium LT2
acggucguugcgucagcuucga

SEQ ID NO: 213819 - RNA, 22 nt, Salmonella typhimurium LT2
gugagggcgucgauggcccggc

SEQ ID NO: 213820 - RNA, 22 nt, Salmonella typhimurium LT2
uccgggcucauauuaucaaggu

SEQ ID NO: 213821 - RNA, 22 nt, Salmonella typhimurium LT2
gucggcgauaaaggcuguuucc

SEQ ID NO: 213822 - RNA, 22 nt, Salmonella typhimurium LT2
ucagcgccugggugucaaucug

SEQ ID NO: 213823 - RNA, 20 nt, Salmonella typhimurium LT2
ucuuccagcaaaugauggcg

SEQ ID NO: 213824 - RNA, 22 nt, Salmonella typhimurium LT2
uugacuuugggucugcgcgucg

SEQ ID NO: 213825 - RNA, 22 nt, Salmonella typhimurium LT2
aaugccguguaggcucauuaaa

SEQ ID NO: 213826 - RNA, 23 nt, Salmonella typhimurium LT2
ucagaucgguaucgccggugaug

SEQ ID NO: 213827 - RNA, 22 nt, Salmonella typhimurium LT2
ugaccgggcagcacggcgugau

SEQ ID NO: 213828 - RNA, 22 nt, Salmonella typhimurium LT2
cugaugauggaaaacgcgcuga

SEQ ID NO: 213829 - RNA, 22 nt, Salmonella typhimurium LT2
guagcgugaaauaauuagcgcu

SEQ ID NO: 213830 - RNA, 22 nt, Salmonella typhimurium LT2
ccugauucagggaucggggacg

SEQ ID NO: 213831 - RNA, 22 nt, Salmonella typhimurium LT2
ggcgcugaggaaaucgucaucc

SEQ ID NO: 213832 - RNA, 22 nt, Salmonella typhimurium LT2
aacgugaacuauagcgugcaga

SEQ ID NO: 213833 - RNA, 22 nt, Salmonella typhimurium LT2
ccggauaagcccuuagcgucgc

SEQ ID NO: 213834 - RNA, 22 nt, Salmonella typhimurium LT2
cgccgguugagauggagaacgg

SEQ ID NO: 213835 - RNA, 22 nt, Salmonella typhimurium LT2
ccugaaguuacagauucagggg

SEQ ID NO: 213836 - RNA, 22 nt, Salmonella typhimurium LT2
gugcgccugcuuccagcaguaa

SEQ ID NO: 213837 - RNA, 22 nt, Salmonella typhimurium LT2
cgcaccaucggauagcgaauac

SEQ ID NO: 213838 - RNA, 20 nt, Salmonella typhimurium LT2
uuguccagccgcugguagcc

SEQ ID NO: 213839 - RNA, 22 nt, Salmonella typhimurium LT2
aagacuuugcacauuuugcuaa

SEQ ID NO: 213840 - RNA, 22 nt, Salmonella typhimurium LT2
gcugaugaccgauaagcugcaa

SEQ ID NO: 213841 - RNA, 22 nt, Salmonella typhimurium LT2
cgauggucgacguuauuggcug

SEQ ID NO: 213842 - RNA, 22 nt, Salmonella typhimurium LT2
ucgucauucauggcgcgcgccg

SEQ ID NO: 213843 - RNA, 22 nt, Salmonella typhimurium LT2
gugcuggaaaaacagggcucca

SEQ ID NO: 213844 - RNA, 22 nt, Salmonella typhimurium LT2
gguaauggucuggucaagggga

SEQ ID NO: 213845 - RNA, 22 nt, Salmonella typhimurium LT2
cagcccgucaaagcuuacuggc

SEQ ID NO: 213846 - RNA, 22 nt, Salmonella typhimurium LT2
cuggcuggagucucagggcgca

SEQ ID NO: 213847 - RNA, 22 nt, Salmonella typhimurium LT2
gauugagcguuuacuggagucg

SEQ ID NO: 213848 - RNA, 19 nt, Salmonella typhimurium LT2
ugguguacguugauucgcg

SEQ ID NO: 213849 - RNA, 22 nt, Salmonella typhimurium LT2
aaagucaggguacguuuguacu

SEQ ID NO: 213850 - RNA, 22 nt, Salmonella typhimurium LT2
cgaacgcauucgcgccaccauu

SEQ ID NO: 213851 - RNA, 22 nt, Salmonella typhimurium LT2
aggauauugaguauuaugacua

SEQ ID NO: 213852 - RNA, 22 nt, Salmonella typhimurium LT2
accggagccagugucugucacg

SEQ ID NO: 213853 - RNA, 22 nt, Salmonella typhimurium LT2
ugcgccguggcgcgaucggucu

SEQ ID NO: 213854 - RNA, 22 nt, Salmonella typhimurium LT2
aagaccagauacguuauuacau

SEQ ID NO: 213855 - RNA, 22 nt, Salmonella typhimurium LT2
cggauggcgcuacgcuuauccg

SEQ ID NO: 213856 - RNA, 22 nt, Salmonella typhimurium LT2
ccuggguguauuuccccugggu

SEQ ID NO: 213857 - RNA, 22 nt, Salmonella typhimurium LT2
ugcguuauaguguuuucaucau

SEQ ID NO: 213858 - RNA, 22 nt, Salmonella typhimurium LT2
cgauccaguugcguaucaaaga

SEQ ID NO: 213859 - RNA, 22 nt, Salmonella typhimurium LT2
auauucccggcucaagcgcucg

SEQ ID NO: 213860 - RNA, 22 nt, Salmonella typhimurium LT2
gucgcccugaugccggacagua

SEQ ID NO: 213861 - RNA, 22 nt, Salmonella typhimurium LT2
gugaagaucagcagagcgggga

SEQ ID NO: 213862 - RNA, 23 nt, Salmonella typhimurium LT2
ugacugggacaggggccuguguc

SEQ ID NO: 213863 - RNA, 22 nt, Salmonella typhimurium LT2
uugccaguugcugauagcgcgc

SEQ ID NO: 213864 - RNA, 20 nt, Salmonella typhimurium LT2
ggcgaucguugaguugggca

SEQ ID NO: 213865 - RNA, 22 nt, Salmonella typhimurium LT2
uggugccgaacaugguagccac

SEQ ID NO: 213866 - RNA, 21 nt, Salmonella typhimurium LT2
agguuuaccgugauggagcgu

SEQ ID NO: 213867 - RNA, 21 nt, Salmonella typhimurium LT2
uauggcgaccaccugcuggac

SEQ ID NO: 213868 - RNA, 22 nt, Salmonella typhimurium LT2
ugggcaaagaagauaagcuggu

SEQ ID NO: 213869 - RNA, 22 nt, Salmonella typhimurium LT2
guuugcaacgguuccgguagua

SEQ ID NO: 213870 - RNA, 22 nt, Salmonella typhimurium LT2
cgcuggaagagcaggccagccg

SEQ ID NO: 213871 - RNA, 22 nt, Salmonella typhimurium LT2
uuugucauuuccgguuugacga

SEQ ID NO: 213872 - RNA, 22 nt, Salmonella typhimurium LT2
auaagacugauauccaucggag

SEQ ID NO: 213873 - RNA, 22 nt, Salmonella typhimurium LT2
ccguuagcguuagagauugaaa

SEQ ID NO: 213874 - RNA, 22 nt, Salmonella typhimurium LT2
cugcgacgaucuguugccggaa

SEQ ID NO: 213875 - RNA, 22 nt, Salmonella typhimurium LT2
cguaaagcuguugugucccggu

SEQ ID NO: 213876 - RNA, 22 nt, Salmonella typhimurium LT2
gaggaucauauugucgcgguac

SEQ ID NO: 213877 - RNA, 22 nt, Salmonella typhimurium LT2
ugcgcgaguauuucgaucugcu

SEQ ID NO: 213878 - RNA, 22 nt, Salmonella typhimurium LT2
aaacucagugcgcauuaauucg

SEQ ID NO: 213879 - RNA, 22 nt, Salmonella typhimurium LT2
agacggcgaaggcguuagguau

SEQ ID NO: 213880 - RNA, 22 nt, Salmonella typhimurium LT2
uugcggauacgaauuaccguuu

SEQ ID NO: 213881 - RNA, 22 nt, Salmonella typhimurium LT2
ugucugucccucggccuugaua

SEQ ID NO: 213882 - RNA, 18 nt, Salmonella typhimurium LT2
cagaccaguaaauuaagu

SEQ ID NO: 213883 - RNA, 22 nt, Salmonella typhimurium LT2
uacugugcgcgcugucggucuu

SEQ ID NO: 213884 - RNA, 22 nt, Salmonella typhimurium LT2
caucggcuggcggagcgucuuc

SEQ ID NO: 213885 - RNA, 22 nt, Salmonella typhimurium LT2
gccuguuuuugcguaaagaggg

SEQ ID NO: 213886 - RNA, 22 nt, Salmonella typhimurium LT2
aaauguuggcgaccugaugcag

SEQ ID NO: 213887 - RNA, 22 nt, Salmonella typhimurium LT2
cauucgcauuugcccuuaaccc

SEQ ID NO: 213888 - RNA, 22 nt, Salmonella typhimurium LT2
aacgcgucuuauccggccuaca

SEQ ID NO: 213889 - RNA, 22 nt, Salmonella typhimurium LT2
guuacccaaacaacgaucguca

SEQ ID NO: 213890 - RNA, 22 nt, Salmonella typhimurium LT2
uaucugcaauaaagguugcccg

SEQ ID NO: 213891 - RNA, 22 nt, Salmonella typhimurium LT2
gucagggcugccgaugucgcca

SEQ ID NO: 213892 - RNA, 22 nt, Salmonella typhimurium LT2
gucgaagaugacggcuuugccg

SEQ ID NO: 213893 - RNA, 22 nt, Salmonella typhimurium LT2
cguguaggccggauuaggcguu

SEQ ID NO: 213894 - RNA, 22 nt, Salmonella typhimurium LT2
acggcgcuggacuauuucagcc

SEQ ID NO: 213895 - RNA, 22 nt, Salmonella typhimurium LT2
uuauccgcaagcugaacgcgcc

SEQ ID NO: 213896 - RNA, 18 nt, Salmonella typhimurium LT2
gucugccugauuaucagg

SEQ ID NO: 213897 - RNA, 22 nt, Salmonella typhimurium LT2
gacgaugcuuacgcugauagau

SEQ ID NO: 213898 - RNA, 22 nt, Salmonella typhimurium LT2
uugcaaauuagcuucguccauu

SEQ ID NO: 213899 - RNA, 22 nt, Salmonella typhimurium LT2
cgcgcuuucuaccaggcagcca

SEQ ID NO: 213900 - RNA, 22 nt, Salmonella typhimurium LT2
gcauguguucuuuucucuugcu

SEQ ID NO: 213901 - RNA, 20 nt, Salmonella typhimurium LT2
cgaucgcucugcgagacgcu

SEQ ID NO: 213902 - RNA, 22 nt, Salmonella typhimurium LT2
aucaguuucaggaugaagaccg

SEQ ID NO: 213903 - RNA, 22 nt, Salmonella typhimurium LT2
ucgcaauuuuccgggccugcgc

SEQ ID NO: 213904 - RNA, 21 nt, Salmonella typhimurium LT2
acggacgauuuccguuuuugc

SEQ ID NO: 213905 - RNA, 22 nt, Salmonella typhimurium LT2
uguaaagcaaaugcuauacaag

SEQ ID NO: 213906 - RNA, 22 nt, Salmonella typhimurium LT2
uaccuguuguggcguucggcag

SEQ ID NO: 213907 - RNA, 22 nt, Salmonella typhimurium LT2
ugcgucuuauccggccuacgga

SEQ ID NO: 213908 - RNA, 21 nt, Salmonella typhimurium LT2
aaaugguuucgccgugggaga

SEQ ID NO: 213909 - RNA, 22 nt, Salmonella typhimurium LT2
uuguucaaagugugguaacguu

SEQ ID NO: 213910 - RNA, 22 nt, Salmonella typhimurium LT2
ugccggagaugaccgauguuca

SEQ ID NO: 213911 - RNA, 22 nt, Salmonella typhimurium LT2
agcuacgcuuaucgggccuacg

SEQ ID NO: 213912 - RNA, 22 nt, Salmonella typhimurium LT2
gauauugaugccgaugugguga

SEQ ID NO: 213913 - RNA, 22 nt, Salmonella typhimurium LT2
uacggccuuuaucgauaaaaau

SEQ ID NO: 213914 - RNA, 22 nt, Salmonella typhimurium LT2
aaugccgcaggcggacgaguag

SEQ ID NO: 213915 - RNA, 22 nt, Salmonella typhimurium LT2
augccgcgucgcuuagugauua

SEQ ID NO: 213916 - RNA, 22 nt, Salmonella typhimurium LT2
agacugcauuucaauggcuucc

SEQ ID NO: 213917 - RNA, 22 nt, Salmonella typhimurium LT2
cugcgcuuaucaggccuacgua

SEQ ID NO: 213918 - RNA, 22 nt, Salmonella typhimurium LT2
ucuggcgguggcuggcgccgug

SEQ ID NO: 213919 - RNA, 22 nt, Salmonella typhimurium LT2
aacgccuuauccggccuacucu

SEQ ID NO: 213920 - RNA, 22 nt, Salmonella typhimurium LT2
auggcgacaggaaucuguguga

SEQ ID NO: 213921 - RNA, 22 nt, Salmonella typhimurium LT2
uccagucugaauguugaacacg

SEQ ID NO: 213922 - RNA, 22 nt, Salmonella typhimurium LT2
aaaccgucgguaacaccauccg

SEQ ID NO: 213923 - RNA, 22 nt, Salmonella typhimurium LT2
cugcauaagcugauggaugaag

SEQ ID NO: 213924 - RNA, 22 nt, Salmonella typhimurium LT2
guccauauagguuucgauuucg

SEQ ID NO: 213925 - RNA, 22 nt, Salmonella typhimurium LT2
ugcugccggcgcuggcgaucgg

SEQ ID NO: 213926 - RNA, 22 nt, Salmonella typhimurium LT2
cgcgaaguaaugccagaagaua

SEQ ID NO: 213927 - RNA, 22 nt, Salmonella typhimurium LT2
acguaggccugauaagcgcagc

SEQ ID NO: 213928 - RNA, 22 nt, Salmonella typhimurium LT2
agcagaccauuuucugcggcgu

SEQ ID NO: 213929 - RNA, 22 nt, Salmonella typhimurium LT2
guguggaacggcagaucggaaa

SEQ ID NO: 213930 - RNA, 22 nt, Salmonella typhimurium LT2
auucgccagggacacugugagg

SEQ ID NO: 213931 - RNA, 22 nt, Salmonella typhimurium LT2
uacaucgauuguugcgaauauu

SEQ ID NO: 213932 - RNA, 22 nt, Salmonella typhimurium LT2
gaugucgaauuuaauauggaug

SEQ ID NO: 213933 - RNA, 22 nt, Salmonella typhimurium LT2
ugucgcuggaaaaguaucgcga

SEQ ID NO: 213934 - RNA, 22 nt, Salmonella typhimurium LT2
ccuguaggccggauaagcauua

SEQ ID NO: 213935 - RNA, 20 nt, Salmonella typhimurium LT2
aagugccugcgccuugcuua

SEQ ID NO: 213936 - RNA, 22 nt, Salmonella typhimurium LT2
aaaucgcuauagaugauuucgg

SEQ ID NO: 213937 - RNA, 23 nt, Salmonella typhimurium LT2
aauggcaauauagucuuucaccc

SEQ ID NO: 213938 - RNA, 22 nt, Salmonella typhimurium LT2
gaugauuaacgcauaagcgaug

SEQ ID NO: 213939 - RNA, 22 nt, Salmonella typhimurium LT2
uguaggcuggauaaggcguaag

SEQ ID NO: 213940 - RNA, 22 nt, Salmonella typhimurium LT2
uuugaacccgcaucacugccga

SEQ ID NO: 213941 - RNA, 22 nt, Salmonella typhimurium LT2
gcgcagaaaggguauuaguauu

SEQ ID NO: 213942 - RNA, 22 nt, Salmonella typhimurium LT2
ugaccgugcuggcauuagccgu

SEQ ID NO: 213943 - RNA, 22 nt, Salmonella typhimurium LT2
ggugaaacgcugaaugucuccc

SEQ ID NO: 213944 - RNA, 22 nt, Salmonella typhimurium LT2
gacugcuguuccugaagcgcua

SEQ ID NO: 213945 - RNA, 22 nt, Salmonella typhimurium LT2
cauaccgcaacgggagucagcg

SEQ ID NO: 213946 - RNA, 22 nt, Salmonella typhimurium LT2
gcacgcuaugguacggcguguu

SEQ ID NO: 213947 - RNA, 22 nt, Salmonella typhimurium LT2
aguggcguacaugguggaaggu

SEQ ID NO: 213948 - RNA, 22 nt, Salmonella typhimurium LT2
guuauucagcccgcguuucugu

SEQ ID NO: 213949 - RNA, 22 nt, Salmonella typhimurium LT2
ggccuacaagaauuuaucgcaa

SEQ ID NO: 213950 - RNA, 22 nt, Salmonella typhimurium LT2
caugaauuucagcaucaaaauc

SEQ ID NO: 213951 - RNA, 22 nt, Salmonella typhimurium LT2
gaacgugauaagcgcccgugag

SEQ ID NO: 213952 - RNA, 22 nt, Salmonella typhimurium LT2
uuucgcgcuggauuuguugaug

SEQ ID NO: 213953 - RNA, 22 nt, Salmonella typhimurium LT2
auggcuggagauaggcgcgcuu

SEQ ID NO: 213954 - RNA, 21 nt, Salmonella typhimurium LT2
agcuggguggcggugucgccg

SEQ ID NO: 213955 - RNA, 22 nt, Salmonella typhimurium LT2
gugaauaagcgguagaguaaac

SEQ ID NO: 213956 - RNA, 22 nt, Salmonella typhimurium LT2
uuaacccggauacgggcauagu

SEQ ID NO: 213957 - RNA, 22 nt, Salmonella typhimurium LT2
ucauucgccaucagccggcaau

SEQ ID NO: 213958 - RNA, 22 nt, Salmonella typhimurium LT2
gaaaucgcagguaucguuuccu

SEQ ID NO: 213959 - RNA, 22 nt, Salmonella typhimurium LT2
ugcuggauagagaaaacccccg

SEQ ID NO: 213960 - RNA, 22 nt, Salmonella typhimurium LT2
cugauuuauuugaagcuccagg

SEQ ID NO: 213961 - RNA, 22 nt, Salmonella typhimurium LT2
auugccuuucagcgccagacug

SEQ ID NO: 213962 - RNA, 17 nt, Salmonella typhimurium LT2
ucaugguggauuccggg

SEQ ID NO: 213963 - RNA, 22 nt, Salmonella typhimurium LT2
aggccggauaagcguagcgcca

SEQ ID NO: 213964 - RNA, 22 nt, Salmonella typhimurium LT2
cgccagagucgucauauuaucc

SEQ ID NO: 213965 - RNA, 22 nt, Salmonella typhimurium LT2
cggcguucuggcagccgugauu

SEQ ID NO: 213966 - RNA, 22 nt, Salmonella typhimurium LT2
cgucaagguaaaacgcagguga

SEQ ID NO: 213967 - RNA, 22 nt, Salmonella typhimurium LT2
uccaccgcaaaugcaucgugac

SEQ ID NO: 213968 - RNA, 22 nt, Salmonella typhimurium LT2
cgaugcaaaugagcgagagccg

SEQ ID NO: 213969 - RNA, 22 nt, Salmonella typhimurium LT2
gauguugcuccagaaucgcgac

SEQ ID NO: 213970 - RNA, 22 nt, Salmonella typhimurium LT2
ggaaacuucggucgcguagucg

SEQ ID NO: 213971 - RNA, 21 nt, Salmonella typhimurium LT2
ggaauguuacugcauuggcaa

SEQ ID NO: 213972 - RNA, 22 nt, Salmonella typhimurium LT2
guauuaccaggaagagcucaau

SEQ ID NO: 213973 - RNA, 22 nt, Salmonella typhimurium LT2
uucugcaacaccagcggcgcau

SEQ ID NO: 213974 - RNA, 22 nt, Salmonella typhimurium LT2
cgaguacggaaaaaggguccgc

SEQ ID NO: 213975 - RNA, 22 nt, Salmonella typhimurium LT2
acaguugguauuuuucucuaga

SEQ ID NO: 213976 - RNA, 22 nt, Salmonella typhimurium LT2
accugucaucuuccuuaugcuu

SEQ ID NO: 213977 - RNA, 22 nt, Salmonella typhimurium LT2
uucuggcgucuggagauggaua

SEQ ID NO: 213978 - RNA, 22 nt, Salmonella typhimurium LT2
ugaugcagacgacgacaugcgc

SEQ ID NO: 213979 - RNA, 22 nt, Salmonella typhimurium LT2
gcgauugacgccgacgcuaaag

SEQ ID NO: 213980 - RNA, 22 nt, Salmonella typhimurium LT2
uuucgcauguucgaccguggcg

SEQ ID NO: 213981 - RNA, 18 nt, Salmonella typhimurium LT2
uuugacgauugcuuuacc

SEQ ID NO: 213982 - RNA, 22 nt, Salmonella typhimurium LT2
ggcgauauucacggcuguuuuu

SEQ ID NO: 213983 - RNA, 22 nt, Salmonella typhimurium LT2
gcgaugcgguucaucaacguua

SEQ ID NO: 213984 - RNA, 22 nt, Salmonella typhimurium LT2
uuccggcgagagaaacuuguua

SEQ ID NO: 213985 - RNA, 22 nt, Salmonella typhimurium LT2
agguaccgcguaacacugcgcc

SEQ ID NO: 213986 - RNA, 20 nt, Salmonella typhimurium LT2
augugccaugauugauuuac

SEQ ID NO: 213987 - RNA, 22 nt, Salmonella typhimurium LT2
guucagauccagcguacgcacc

SEQ ID NO: 213988 - RNA, 22 nt, Salmonella typhimurium LT2
ucuguaggccggguaaggcguu

SEQ ID NO: 213989 - RNA, 22 nt, Salmonella typhimurium LT2
ugaccucaauuuucugcucaau

SEQ ID NO: 213990 - RNA, 22 nt, Salmonella typhimurium LT2
cgacgcaaagaguacuggaugu

SEQ ID NO: 213991 - RNA, 22 nt, Salmonella typhimurium LT2
gcgcuggaaagcggcaggugau

SEQ ID NO: 213992 - RNA, 22 nt, Salmonella typhimurium LT2
acggcuuuagcgcggauaaugu

SEQ ID NO: 213993 - RNA, 20 nt, Salmonella typhimurium LT2
ucuuggcgcgcuaauugguc

SEQ ID NO: 213994 - RNA, 22 nt, Salmonella typhimurium LT2
ugcgucugccugagcuggugca

SEQ ID NO: 213995 - RNA, 22 nt, Salmonella typhimurium LT2
augcggcggauggugcgugauu

SEQ ID NO: 213996 - RNA, 22 nt, Salmonella typhimurium LT2
cggguccuuuuuuggcgaauaa

SEQ ID NO: 213997 - RNA, 22 nt, Salmonella typhimurium LT2
caugccgacaauccugcggaaa

SEQ ID NO: 213998 - RNA, 22 nt, Salmonella typhimurium LT2
ggauuucaugucgacgcaaggg

SEQ ID NO: 213999 - RNA, 22 nt, Salmonella typhimurium LT2
ucggcagcgaaaaauucacugc

SEQ ID NO: 214000 - RNA, 22 nt, Salmonella typhimurium LT2
aucauucugaacgcgauuugcg

SEQ ID NO: 214001 - RNA, 22 nt, Salmonella typhimurium LT2
gauagggcgaucgccgguuuug

SEQ ID NO: 214002 - RNA, 21 nt, Salmonella typhimurium LT2
ucgauucagaagcgacuuuuu

SEQ ID NO: 214003 - RNA, 22 nt, Salmonella typhimurium LT2
agacgguacguugacuacgccg

SEQ ID NO: 214004 - RNA, 22 nt, Salmonella typhimurium LT2
cggcgaauguacugcuggaggu

SEQ ID NO: 214005 - RNA, 22 nt, Salmonella typhimurium LT2
gugggcaacaauauuccgacuc

SEQ ID NO: 214006 - RNA, 22 nt, Salmonella typhimurium LT2
gcuguagcgacucuucgccggu

SEQ ID NO: 214007 - RNA, 22 nt, Salmonella typhimurium LT2
uagcggaaaauugggcuauagc

SEQ ID NO: 214008 - RNA, 22 nt, Salmonella typhimurium LT2
gcuguuaacgcauuuccgcgac

SEQ ID NO: 214009 - RNA, 22 nt, Salmonella typhimurium LT2
cacguugaugugaacuauucug

SEQ ID NO: 214010 - RNA, 22 nt, Salmonella typhimurium LT2
cgguuggccggaaacccgcgcg

SEQ ID NO: 214011 - RNA, 22 nt, Salmonella typhimurium LT2
auauggcugucgcccgugccgg

SEQ ID NO: 214012 - RNA, 21 nt, Salmonella typhimurium LT2
ggccaugacaucuauccuauc

SEQ ID NO: 214013 - RNA, 22 nt, Salmonella typhimurium LT2
ugucauggagauagguaugcca

SEQ ID NO: 214014 - RNA, 22 nt, Salmonella typhimurium LT2
aucuugauugcagccagaguuu

SEQ ID NO: 214015 - RNA, 22 nt, Salmonella typhimurium LT2
ugccucgcugauucaggcgugu

SEQ ID NO: 214016 - RNA, 22 nt, Salmonella typhimurium LT2
cgguagaaaacuuucuagcgca

SEQ ID NO: 214017 - RNA, 22 nt, Salmonella typhimurium LT2
uaaagcaauauucgguuuaacu

SEQ ID NO: 214018 - RNA, 22 nt, Salmonella typhimurium LT2
cugggcauuuuccugucgccgc

SEQ ID NO: 214019 - RNA, 22 nt, Salmonella typhimurium LT2
aauguuugccggauaaagauga

SEQ ID NO: 214020 - RNA, 22 nt, Salmonella typhimurium LT2
uaucuccauaucaucguggguc

SEQ ID NO: 214021 - RNA, 22 nt, Salmonella typhimurium LT2
cgauggugaguacaaaauacua

SEQ ID NO: 214022 - RNA, 22 nt, Salmonella typhimurium LT2
uggcugacgaauauuauuaaaa

SEQ ID NO: 214023 - RNA, 22 nt, Salmonella typhimurium LT2
cuuguaggucggauaaggcgca

SEQ ID NO: 214024 - RNA, 22 nt, Salmonella typhimurium LT2
gcguuguauuuaucuucgugau

SEQ ID NO: 214025 - RNA, 22 nt, Salmonella typhimurium LT2
uggccgugguggucgacgauca

SEQ ID NO: 214026 - RNA, 22 nt, Salmonella typhimurium LT2
cuacgguacugcccaccuucgc

SEQ ID NO: 214027 - RNA, 22 nt, Salmonella typhimurium LT2
gaucgcuaaaacguuuuuaugu

SEQ ID NO: 214028 - RNA, 22 nt, Salmonella typhimurium LT2
augucgcuaaagcccggcacca

SEQ ID NO: 214029 - RNA, 20 nt, Salmonella typhimurium LT2
accagcagcgcggcgaccgc

SEQ ID NO: 214030 - RNA, 22 nt, Salmonella typhimurium LT2
aguggaaucagccaggagucgg

SEQ ID NO: 214031 - RNA, 22 nt, Salmonella typhimurium LT2
cugggagcaggcucgauuuaug

SEQ ID NO: 214032 - RNA, 22 nt, Salmonella typhimurium LT2
gcucacgguaacucauugcgug

SEQ ID NO: 214033 - RNA, 22 nt, Salmonella typhimurium LT2
gugccggauggcggcgccugca

SEQ ID NO: 214034 - RNA, 22 nt, Salmonella typhimurium LT2
ucuggaaaccguugaucauuuu

SEQ ID NO: 214035 - RNA, 22 nt, Salmonella typhimurium LT2
ggcagguuugccggauaucagc

SEQ ID NO: 214036 - RNA, 22 nt, Salmonella typhimurium LT2
gaaggcuuucauaugagcauca

SEQ ID NO: 214037 - RNA, 22 nt, Salmonella typhimurium LT2
ggccugacacgcacagcgccau

SEQ ID NO: 214038 - RNA, 22 nt, Salmonella typhimurium LT2
acgcuacagcgguucaucaauu

SEQ ID NO: 214039 - RNA, 22 nt, Salmonella typhimurium LT2
acggaucguuuuauuuugccgu

SEQ ID NO: 214040 - RNA, 21 nt, Salmonella typhimurium LT2
uaugcggcaaugauuucaacg

SEQ ID NO: 214041 - RNA, 22 nt, Salmonella typhimurium LT2
ugauaagguuggugaccauauu

SEQ ID NO: 214042 - RNA, 22 nt, Salmonella typhimurium LT2
cgccguaguuaucuggauaaaa

SEQ ID NO: 214043 - RNA, 22 nt, Salmonella typhimurium LT2
ggcgucuuccaguggcacgccg

SEQ ID NO: 214044 - RNA, 22 nt, Salmonella typhimurium LT2
ucgcgcguggcaaaaaccggaa

SEQ ID NO: 214045 - RNA, 22 nt, Salmonella typhimurium LT2
gcgauugauaucuggaacguga

SEQ ID NO: 214046 - RNA, 22 nt, Salmonella typhimurium LT2
uucgcaaagcggguuccagcga

SEQ ID NO: 214047 - RNA, 22 nt, Salmonella typhimurium LT2
caagcgucaugugcuuauacuc

SEQ ID NO: 214048 - RNA, 22 nt, Salmonella typhimurium LT2
aucgccauacggcagacgcgcg

SEQ ID NO: 214049 - RNA, 22 nt, Salmonella typhimurium LT2
aggcccuguuugauggcguaca

SEQ ID NO: 214050 - RNA, 22 nt, Salmonella typhimurium LT2
augcgucucugaacaggcggcc

SEQ ID NO: 214051 - RNA, 22 nt, Salmonella typhimurium LT2
cuaucggcaaucgagcgugaag

SEQ ID NO: 214052 - RNA, 22 nt, Salmonella typhimurium LT2
aggccaucacuuuccggauguc

SEQ ID NO: 214053 - RNA, 22 nt, Salmonella typhimurium LT2
gaauugcaagccacgguuggug

SEQ ID NO: 214054 - RNA, 22 nt, Salmonella typhimurium LT2
aauucgcuccguuaagccuaug

SEQ ID NO: 214055 - RNA, 22 nt, Salmonella typhimurium LT2
ugcauauccgguagcugcgggg

SEQ ID NO: 214056 - RNA, 19 nt, Salmonella typhimurium LT2
ugugccuguuaagccggau

SEQ ID NO: 214057 - RNA, 22 nt, Salmonella typhimurium LT2
aggaaucacaggcggcuuaucu

SEQ ID NO: 214058 - RNA, 20 nt, Salmonella typhimurium LT2
gucugcggcgacuggcggcg

SEQ ID NO: 214059 - RNA, 22 nt, Salmonella typhimurium LT2
aaaucaucuuccacuucggcgu

SEQ ID NO: 214060 - RNA, 22 nt, Salmonella typhimurium LT2
auucaguagcagauagaugcgc

SEQ ID NO: 214061 - RNA, 22 nt, Salmonella typhimurium LT2
ggacuguuuaucgcuauuauua

SEQ ID NO: 214062 - RNA, 22 nt, Salmonella typhimurium LT2
cgacgccugcuacagcccugua

SEQ ID NO: 214063 - RNA, 22 nt, Salmonella typhimurium LT2
ucacugaugagccagguucugg

SEQ ID NO: 214064 - RNA, 22 nt, Salmonella typhimurium LT2
uccaacaguugcguaaucugau

SEQ ID NO: 214065 - RNA, 22 nt, Salmonella typhimurium LT2
uugcuggagcgauuucaggagg

SEQ ID NO: 214066 - RNA, 22 nt, Salmonella typhimurium LT2
ugccuggcaaucuauuuauggu

SEQ ID NO: 214067 - RNA, 23 nt, Salmonella typhimurium LT2
ugaccguugccagaauaucugcg

SEQ ID NO: 214068 - RNA, 22 nt, Salmonella typhimurium LT2
uugcccgucuggcaggaaacgc

SEQ ID NO: 214069 - RNA, 22 nt, Salmonella typhimurium LT2
cauccguggugauuucaucaau

SEQ ID NO: 214070 - RNA, 22 nt, Salmonella typhimurium LT2
gaucaggucgguaaucaauagc

SEQ ID NO: 214071 - RNA, 22 nt, Salmonella typhimurium LT2
guagauuccagccguuugaaug

SEQ ID NO: 214072 - RNA, 21 nt, Salmonella typhimurium LT2
uucaggucgaugucaucaaug

SEQ ID NO: 214073 - RNA, 22 nt, Salmonella typhimurium LT2
cgcguugucauccagcgacugg

SEQ ID NO: 214074 - RNA, 22 nt, Salmonella typhimurium LT2
aauuacgagcaguaaugguauc

SEQ ID NO: 214075 - RNA, 22 nt, Salmonella typhimurium LT2
ucagcacgauacuguaaugcca

SEQ ID NO: 214076 - RNA, 22 nt, Salmonella typhimurium LT2
agcgaccuguuuguugccgggu

SEQ ID NO: 214077 - RNA, 22 nt, Salmonella typhimurium LT2
gcuacgcgcagauaggcugcgu

SEQ ID NO: 214078 - RNA, 22 nt, Salmonella typhimurium LT2
auuauggauguccagggcagcg

SEQ ID NO: 214079 - RNA, 22 nt, Salmonella typhimurium LT2
ugcaaaguaauaggguuuucuu

SEQ ID NO: 214080 - RNA, 22 nt, Salmonella typhimurium LT2
gugacgcguuuugguaaauuca

SEQ ID NO: 214081 - RNA, 22 nt, Salmonella typhimurium LT2
cgcuggacgaacgcgugcugaa

SEQ ID NO: 214082 - RNA, 22 nt, Salmonella typhimurium LT2
acggaaauauuauugcuaucgg

SEQ ID NO: 214083 - RNA, 22 nt, Salmonella typhimurium LT2
uggccugcuauuuauguggcug

SEQ ID NO: 214084 - RNA, 22 nt, Salmonella typhimurium LT2
ggucgcagauacgauuuugcuc

SEQ ID NO: 214085 - RNA, 22 nt, Salmonella typhimurium LT2
cgcagauaguguuuaucgagca

SEQ ID NO: 214086 - RNA, 22 nt, Salmonella typhimurium LT2
ugacgccggaauauucagguug

SEQ ID NO: 214087 - RNA, 22 nt, Salmonella typhimurium LT2
auauagugucaaacagucucga

SEQ ID NO: 214088 - RNA, 22 nt, Salmonella typhimurium LT2
auucacuacaugauugccgccg

SEQ ID NO: 214089 - RNA, 22 nt, Salmonella typhimurium LT2
augaugaugcugacguuacugc

SEQ ID NO: 214090 - RNA, 19 nt, Salmonella typhimurium LT2
cuggcauaguaagaaguau

SEQ ID NO: 214091 - RNA, 22 nt, Salmonella typhimurium LT2
agugccgguacaguaugggggc

SEQ ID NO: 214092 - RNA, 22 nt, Salmonella typhimurium LT2
gcggauuguucagguacaggua

SEQ ID NO: 214093 - RNA, 22 nt, Salmonella typhimurium LT2
cacggcgauuacgugaacgaca

SEQ ID NO: 214094 - RNA, 21 nt, Salmonella typhimurium LT2
agcgucaauugccaggagcga

SEQ ID NO: 214095 - RNA, 22 nt, Salmonella typhimurium LT2
accugccguugauugucgaugc

SEQ ID NO: 214096 - RNA, 22 nt, Salmonella typhimurium LT2
uggauaagugaaacgccauccg

SEQ ID NO: 214097 - RNA, 22 nt, Salmonella typhimurium LT2
uguucgauuuuaugggcaaauc

SEQ ID NO: 214098 - RNA, 22 nt, Salmonella typhimurium LT2
auguucucccgcauaagguacu

SEQ ID NO: 214099 - RNA, 22 nt, Salmonella typhimurium LT2
ugccggugguaaaggcacugcg

SEQ ID NO: 214100 - RNA, 22 nt, Salmonella typhimurium LT2
cauuucauuaugaccaaacugg

SEQ ID NO: 214101 - RNA, 22 nt, Salmonella typhimurium LT2
cuguucaagcucuauccguggg

SEQ ID NO: 214102 - RNA, 22 nt, Salmonella typhimurium LT2
aacgccugugaacuguugcaaa

SEQ ID NO: 214103 - RNA, 22 nt, Salmonella typhimurium LT2
ucggcauugauguugguuuaaa

SEQ ID NO: 214104 - RNA, 22 nt, Salmonella typhimurium LT2
gcguucgaguuaggcgaucaug

SEQ ID NO: 214105 - RNA, 22 nt, Salmonella typhimurium LT2
uagauaucgguaaacgucaucg

SEQ ID NO: 214106 - RNA, 22 nt, Salmonella typhimurium LT2
ucgcccgucagcacguugagca

SEQ ID NO: 214107 - RNA, 22 nt, Salmonella typhimurium LT2
ggaauucuguucaguggcguag

SEQ ID NO: 214108 - RNA, 22 nt, Salmonella typhimurium LT2
ccagcagcaggaugccgaaagc

SEQ ID NO: 214109 - RNA, 20 nt, Salmonella typhimurium LT2
caagaaauuuuaagcccggg

SEQ ID NO: 214110 - RNA, 19 nt, Salmonella typhimurium LT2
aucguugcuguccguggcc

SEQ ID NO: 214111 - RNA, 22 nt, Salmonella typhimurium LT2
auguguccugggauggccgggu

SEQ ID NO: 214112 - RNA, 19 nt, Salmonella typhimurium LT2
auccaugaugguuuccggg

SEQ ID NO: 214113 - RNA, 22 nt, Salmonella typhimurium LT2
acauugugaugccugaugacga

SEQ ID NO: 214114 - RNA, 20 nt, Salmonella typhimurium LT2
gcugucucgccagacgcagc

SEQ ID NO: 214115 - RNA, 22 nt, Salmonella typhimurium LT2
ggcuggaugugugacgugcugg

SEQ ID NO: 214116 - RNA, 22 nt, Salmonella typhimurium LT2
aguguugacugccguuuuaguu

SEQ ID NO: 214117 - RNA, 22 nt, Salmonella typhimurium LT2
cuucagguuuccccagacggcg

SEQ ID NO: 214118 - RNA, 22 nt, Salmonella typhimurium LT2
gucaggcuuguggcugauaucg

SEQ ID NO: 214119 - RNA, 22 nt, Salmonella typhimurium LT2
acuggcgaauacguugagcaau

SEQ ID NO: 214120 - RNA, 22 nt, Salmonella typhimurium LT2
ucaucagaccgauguugccuuc

SEQ ID NO: 214121 - RNA, 22 nt, Salmonella typhimurium LT2
gcuauuucuggugguucaguau

SEQ ID NO: 214122 - RNA, 22 nt, Salmonella typhimurium LT2
agucugcagugcuaccaccguc

SEQ ID NO: 214123 - RNA, 22 nt, Salmonella typhimurium LT2
ugaguggcaugaagauuucaua

SEQ ID NO: 214124 - RNA, 22 nt, Salmonella typhimurium LT2
uguaggucagguaagcgcuagc

SEQ ID NO: 214125 - RNA, 22 nt, Salmonella typhimurium LT2
uggcaugugguauugauccuga

SEQ ID NO: 214126 - RNA, 22 nt, Salmonella typhimurium LT2
ugagagauaucggauuuuacuu

SEQ ID NO: 214127 - RNA, 22 nt, Salmonella typhimurium LT2
ugaaugccuuacccgguuugua

SEQ ID NO: 214128 - RNA, 22 nt, Salmonella typhimurium LT2
uuacgccaucucuucuggcggc

SEQ ID NO: 214129 - RNA, 22 nt, Salmonella typhimurium LT2
acgcgugacggcgacuauuuua

SEQ ID NO: 214130 - RNA, 22 nt, Salmonella typhimurium LT2
cggauaagcauagcgccauccg

SEQ ID NO: 214131 - RNA, 22 nt, Salmonella typhimurium LT2
uugcugauuugcucuguggugg

SEQ ID NO: 214132 - RNA, 22 nt, Salmonella typhimurium LT2
acgcuggcuucuggcuguucgg

SEQ ID NO: 214133 - RNA, 22 nt, Salmonella typhimurium LT2
cugccguauaucgcgcugggua

SEQ ID NO: 214134 - RNA, 22 nt, Salmonella typhimurium LT2
uugagcaauagccguaucaaac

SEQ ID NO: 214135 - RNA, 22 nt, Salmonella typhimurium LT2
ucaggguauugccaacgccguc

SEQ ID NO: 214136 - RNA, 22 nt, Salmonella typhimurium LT2
auggcaugggugacgccggaug

SEQ ID NO: 214137 - RNA, 22 nt, Salmonella typhimurium LT2
ucgccguggcugcuggcgcugg

SEQ ID NO: 214138 - RNA, 22 nt, Salmonella typhimurium LT2
augcccgucugggagccgcugc

SEQ ID NO: 214139 - RNA, 22 nt, Salmonella typhimurium LT2
aucaggcuauccggcuuuuaac

SEQ ID NO: 214140 - RNA, 22 nt, Salmonella typhimurium LT2
auucaaucaaauuaagaucaca

SEQ ID NO: 214141 - RNA, 22 nt, Salmonella typhimurium LT2
ugucgcgcugcuaagccggggg

SEQ ID NO: 214142 - RNA, 22 nt, Salmonella typhimurium LT2
guuugacgccgcgcggcagaau

SEQ ID NO: 214143 - RNA, 22 nt, Salmonella typhimurium LT2
ugggcacguuguacguagaacu

SEQ ID NO: 214144 - RNA, 22 nt, Salmonella typhimurium LT2
gcaguauguaccuucgcugagu

SEQ ID NO: 214145 - RNA, 22 nt, Salmonella typhimurium LT2
ccggaaagcuugcuguccauac

SEQ ID NO: 214146 - RNA, 22 nt, Salmonella typhimurium LT2
caugaagcuuuggauaaauuug

SEQ ID NO: 214147 - RNA, 22 nt, Salmonella typhimurium LT2
aauccagaguauuaauuuucgu

SEQ ID NO: 214148 - RNA, 22 nt, Salmonella typhimurium LT2
aaaguguaauguucuaacaggu

SEQ ID NO: 214149 - RNA, 22 nt, Salmonella typhimurium LT2
uaccggaagugguggugacggc

SEQ ID NO: 214150 - RNA, 22 nt, Salmonella typhimurium LT2
cgccugagcuguaacggcagag

SEQ ID NO: 214151 - RNA, 22 nt, Salmonella typhimurium LT2
uggcgcuacgcuuauccgcccu

SEQ ID NO: 214152 - RNA, 22 nt, Salmonella typhimurium LT2
gcagcccaucaagcugagcgug

SEQ ID NO: 214153 - RNA, 22 nt, Salmonella typhimurium LT2
ggcgauagccgucgucauagcc

SEQ ID NO: 214154 - RNA, 22 nt, Salmonella typhimurium LT2
uuaaugugaguaaguugcgcga

SEQ ID NO: 214155 - RNA, 22 nt, Salmonella typhimurium LT2
uaaucguauccuggaugagcua

SEQ ID NO: 214156 - RNA, 22 nt, Salmonella typhimurium LT2
agaagugccgguuggcuucaaa

SEQ ID NO: 214157 - RNA, 22 nt, Salmonella typhimurium LT2
guugaucugguaguuauugcga

SEQ ID NO: 214158 - RNA, 22 nt, Salmonella typhimurium LT2
ugcaggucacucuccagcgccc

SEQ ID NO: 214159 - RNA, 22 nt, Salmonella typhimurium LT2
uucgguaaacucggcuauaacu

SEQ ID NO: 214160 - RNA, 22 nt, Salmonella typhimurium LT2
gucgccuuuaaugaccuugagg

SEQ ID NO: 214161 - RNA, 22 nt, Salmonella typhimurium LT2
ggacagcguugcgugguguuuu

SEQ ID NO: 214162 - RNA, 22 nt, Salmonella typhimurium LT2
acagcgcuucccugcugguggc

SEQ ID NO: 214163 - RNA, 22 nt, Salmonella typhimurium LT2
ugcugccgcugacgcuggccau

SEQ ID NO: 214164 - RNA, 19 nt, Salmonella typhimurium LT2
gcgccauaacgauuuuuca

SEQ ID NO: 214165 - RNA, 22 nt, Salmonella typhimurium LT2
cgcuuucgagcgauacaucauc

SEQ ID NO: 214166 - RNA, 22 nt, Salmonella typhimurium LT2
augcaguggauuaugguacacc

SEQ ID NO: 214167 - RNA, 21 nt, Salmonella typhimurium LT2
gacgcguguugccggaccagc

SEQ ID NO: 214168 - RNA, 22 nt, Salmonella typhimurium LT2
uggcugagguguuugccuaugc

SEQ ID NO: 214169 - RNA, 20 nt, Salmonella typhimurium LT2
uuaacggcaaguacgacaug

SEQ ID NO: 214170 - RNA, 22 nt, Salmonella typhimurium LT2
acaguuugaucgcaagggcaug

SEQ ID NO: 214171 - RNA, 22 nt, Salmonella typhimurium LT2
gcgcaguagacgugccuccaga

SEQ ID NO: 214172 - RNA, 22 nt, Salmonella typhimurium LT2
gcgugaauaauguugcucucua

SEQ ID NO: 214173 - RNA, 22 nt, Salmonella typhimurium LT2
cgugcgaaugcgguacugagac

SEQ ID NO: 214174 - RNA, 22 nt, Salmonella typhimurium LT2
guuguaucuuuaaugcuauucg

SEQ ID NO: 214175 - RNA, 22 nt, Salmonella typhimurium LT2
ggccuuugaccacuauuucggu

SEQ ID NO: 214176 - RNA, 22 nt, Salmonella typhimurium LT2
guuggauaguggcuucuuccag

SEQ ID NO: 214177 - RNA, 22 nt, Salmonella typhimurium LT2
cugcuguacauggcugccgcug

SEQ ID NO: 214178 - RNA, 22 nt, Salmonella typhimurium LT2
auccugaucccguuuaucgugg

SEQ ID NO: 214179 - RNA, 22 nt, Salmonella typhimurium LT2
ggugcauguucgggacuugcug

SEQ ID NO: 214180 - RNA, 21 nt, Salmonella typhimurium LT2
cggcaacuuaagcggcaaucc

SEQ ID NO: 214181 - RNA, 22 nt, Salmonella typhimurium LT2
ugauuguacgguagguaaucgc

SEQ ID NO: 214182 - RNA, 22 nt, Salmonella typhimurium LT2
ucgccuguacuugaugucuggc

SEQ ID NO: 214183 - RNA, 22 nt, Salmonella typhimurium LT2
gcguuauucugcgcgcgcucua

SEQ ID NO: 214184 - RNA, 22 nt, Salmonella typhimurium LT2
ggcgcugugcgugucaggccua

SEQ ID NO: 214185 - RNA, 22 nt, Salmonella typhimurium LT2
gucggaucgucaggaaaauucu

SEQ ID NO: 214186 - RNA, 22 nt, Salmonella typhimurium LT2
auuucugucaccuguugcuguu

SEQ ID NO: 214187 - RNA, 22 nt, Salmonella typhimurium LT2
ucgcucaagcuggaugacaauc

SEQ ID NO: 214188 - RNA, 22 nt, Salmonella typhimurium LT2
cgucgagcagauaaaaacgauu

SEQ ID NO: 214189 - RNA, 22 nt, Salmonella typhimurium LT2
uaacagccccagcccuggcgua

SEQ ID NO: 214190 - RNA, 22 nt, Salmonella typhimurium LT2
uccagcaaaaaucuuucuuuag

SEQ ID NO: 214191 - RNA, 22 nt, Salmonella typhimurium LT2
uuugcgccuguggggcaaccgu

SEQ ID NO: 214192 - RNA, 22 nt, Salmonella typhimurium LT2
cguagaaacgagcgguaacugg

SEQ ID NO: 214193 - RNA, 18 nt, Salmonella typhimurium LT2
gggcuaucaccccuucgc

SEQ ID NO: 214194 - RNA, 21 nt, Salmonella typhimurium LT2
ugauaacggguuaacaggcgu

SEQ ID NO: 214195 - RNA, 22 nt, Salmonella typhimurium LT2
gcuaccagacgcggcucaaugc

SEQ ID NO: 214196 - RNA, 22 nt, Salmonella typhimurium LT2
ucagauagauauucgcauccgg

SEQ ID NO: 214197 - RNA, 22 nt, Salmonella typhimurium LT2
ggaccugaugaugcgccggauu

SEQ ID NO: 214198 - RNA, 22 nt, Salmonella typhimurium LT2
uauccgacucaagguaaauggc

SEQ ID NO: 214199 - RNA, 22 nt, Salmonella typhimurium LT2
agcuauucggccagcgccaccg

SEQ ID NO: 214200 - RNA, 22 nt, Salmonella typhimurium LT2
ugauggcauuuuugucggccca

SEQ ID NO: 214201 - RNA, 22 nt, Salmonella typhimurium LT2
gucgauagcuauuaccgcacau

SEQ ID NO: 214202 - RNA, 22 nt, Salmonella typhimurium LT2
ccgaccuggcgucgacggcggc

SEQ ID NO: 214203 - RNA, 22 nt, Salmonella typhimurium LT2
uggcguaaauagagggucguug

SEQ ID NO: 214204 - RNA, 22 nt, Salmonella typhimurium LT2
gcgauucgucaauuggcgguag

SEQ ID NO: 214205 - RNA, 22 nt, Salmonella typhimurium LT2
aaucgaguagcgucaguugccc

SEQ ID NO: 214206 - RNA, 22 nt, Salmonella typhimurium LT2
augcuguucagcgaaaaagcgc

SEQ ID NO: 214207 - RNA, 22 nt, Salmonella typhimurium LT2
gcugccuugcuugauacuggcu

SEQ ID NO: 214208 - RNA, 21 nt, Salmonella typhimurium LT2
cgguaucgucaccuacggcgc

SEQ ID NO: 214209 - RNA, 21 nt, Salmonella typhimurium LT2
gcgacguuauccgucgugccg

SEQ ID NO: 214210 - RNA, 22 nt, Salmonella typhimurium LT2
cggcgagauugucaucgacccg

SEQ ID NO: 214211 - RNA, 22 nt, Salmonella typhimurium LT2
ccggaugaagucguuaauaagu

SEQ ID NO: 214212 - RNA, 22 nt, Salmonella typhimurium LT2
gcguagauacgcuccccggcgc

SEQ ID NO: 214213 - RNA, 22 nt, Salmonella typhimurium LT2
gguauggcgucaauuucaccca

SEQ ID NO: 214214 - RNA, 22 nt, Salmonella typhimurium LT2
cggagcauuaauggugucgcgc

SEQ ID NO: 214215 - RNA, 22 nt, Salmonella typhimurium LT2
gaugaugucaaaguucgccagg

SEQ ID NO: 214216 - RNA, 22 nt, Salmonella typhimurium LT2
aguacgcuauaugccgaguggc

SEQ ID NO: 214217 - RNA, 22 nt, Salmonella typhimurium LT2
uucgcuaucaugauauaucacu

SEQ ID NO: 214218 - RNA, 22 nt, Salmonella typhimurium LT2
gacgaacauuucguucguuaua

SEQ ID NO: 214219 - RNA, 21 nt, Salmonella typhimurium LT2
uugagucuauccauccggaua

SEQ ID NO: 214220 - RNA, 22 nt, Salmonella typhimurium LT2
uauggcgcgggggaaaagaugg

SEQ ID NO: 214221 - RNA, 22 nt, Salmonella typhimurium LT2
accuguggcagauugaauggau

SEQ ID NO: 214222 - RNA, 22 nt, Salmonella typhimurium LT2
uacaggauguucggcguaucgu

SEQ ID NO: 214223 - RNA, 22 nt, Salmonella typhimurium LT2
gucgacuuuaaggcaguaugua

SEQ ID NO: 214224 - RNA, 22 nt, Salmonella typhimurium LT2
cgcuccugcuccugcuccaucc

SEQ ID NO: 214225 - RNA, 22 nt, Salmonella typhimurium LT2
cucgcggacgucgaggaucugg

SEQ ID NO: 214226 - RNA, 22 nt, Salmonella typhimurium LT2
agguuaaaggcauucgcgugac

SEQ ID NO: 214227 - RNA, 22 nt, Salmonella typhimurium LT2
auugagugcgauuacgcucaac

SEQ ID NO: 214228 - RNA, 22 nt, Salmonella typhimurium LT2
uuacgcgggcaacgagcacaac

SEQ ID NO: 214229 - RNA, 22 nt, Salmonella typhimurium LT2
cggagugcgcgauguuggcggc

SEQ ID NO: 214230 - RNA, 22 nt, Salmonella typhimurium LT2
ggugcaguauuuggcaagcuga

SEQ ID NO: 214231 - RNA, 22 nt, Salmonella typhimurium LT2
cucaggugucggggaggcuggu

SEQ ID NO: 214232 - RNA, 22 nt, Salmonella typhimurium LT2
caccgguaucgucaugacaggc

SEQ ID NO: 214233 - RNA, 22 nt, Salmonella typhimurium LT2
gcgaauaauggagauauucuga

SEQ ID NO: 214234 - RNA, 22 nt, Salmonella typhimurium LT2
ugcaaccuuuuuaugcgcgguu

SEQ ID NO: 214235 - RNA, 22 nt, Salmonella typhimurium LT2
uauccuggcguuagucucaaag

SEQ ID NO: 214236 - RNA, 22 nt, Salmonella typhimurium LT2
ucuguaggccggauaaggcgua

SEQ ID NO: 214237 - RNA, 22 nt, Salmonella typhimurium LT2
cgucaauaucagcuuucgcguc

SEQ ID NO: 214238 - RNA, 22 nt, Salmonella typhimurium LT2
ggcgacaauuuuccccuggcga

SEQ ID NO: 214239 - RNA, 22 nt, Salmonella typhimurium LT2
gcggcgauuuuucucgauaacg

SEQ ID NO: 214240 - RNA, 22 nt, Salmonella typhimurium LT2
acgcccauuagcauuccgcccg

SEQ ID NO: 214241 - RNA, 22 nt, Salmonella typhimurium LT2
auggcgcugcgcuuaucaggcc

SEQ ID NO: 214242 - RNA, 21 nt, Salmonella typhimurium LT2
cggaucugcugaaggcagcgg

SEQ ID NO: 214243 - RNA, 22 nt, Salmonella typhimurium LT2
uaucacagccagaaaagggcua

SEQ ID NO: 214244 - RNA, 22 nt, Salmonella typhimurium LT2
ucuuaucaggccuacggucuuu

SEQ ID NO: 214245 - RNA, 22 nt, Salmonella typhimurium LT2
accggcgugccgacgggcguca

SEQ ID NO: 214246 - RNA, 22 nt, Salmonella typhimurium LT2
gccgucuuuaacgagguacugg

SEQ ID NO: 214247 - RNA, 22 nt, Salmonella typhimurium LT2
gguuucauuuguugccguuaug

SEQ ID NO: 214248 - RNA, 22 nt, Salmonella typhimurium LT2
gaacgcuggcuaggcagcagac

SEQ ID NO: 214249 - RNA, 22 nt, Salmonella typhimurium LT2
uaauacugucagucugacgccg

SEQ ID NO: 214250 - RNA, 22 nt, Salmonella typhimurium LT2
acgccgcaggcgauggaucugc

SEQ ID NO: 214251 - RNA, 22 nt, Salmonella typhimurium LT2
uuaugcgcggcuggcggcuuuc

SEQ ID NO: 214252 - RNA, 22 nt, Salmonella typhimurium LT2
caguugacgguuuuucgccagc

SEQ ID NO: 214253 - RNA, 22 nt, Salmonella typhimurium LT2
cgcugguguuugaccuuucgcu

SEQ ID NO: 214254 - RNA, 22 nt, Salmonella typhimurium LT2
ggaaccauuuugacuuuacgaa

SEQ ID NO: 214255 - RNA, 22 nt, Salmonella typhimurium LT2
uuaucgauaucgucaaugcguu

SEQ ID NO: 214256 - RNA, 22 nt, Salmonella typhimurium LT2
augcagaugaggaaaaugcugc

SEQ ID NO: 214257 - RNA, 22 nt, Salmonella typhimurium LT2
acuggcauaccuaucuccauga

SEQ ID NO: 214258 - RNA, 22 nt, Salmonella typhimurium LT2
gcguggaugccccgcugaauau

SEQ ID NO: 214259 - RNA, 22 nt, Salmonella typhimurium LT2
cagcggcucgacaugcagaucc

SEQ ID NO: 214260 - RNA, 22 nt, Salmonella typhimurium LT2
ccaaugauuaucauuucaguuu

SEQ ID NO: 214261 - RNA, 22 nt, Salmonella typhimurium LT2
aaagcguggggcgugccgcugu

SEQ ID NO: 214262 - RNA, 22 nt, Salmonella typhimurium LT2
uugaaugucugccggaacaggu

SEQ ID NO: 214263 - RNA, 22 nt, Salmonella typhimurium LT2
agucaauauuuauucauggaau

SEQ ID NO: 214264 - RNA, 22 nt, Salmonella typhimurium LT2
gucaacagccauauggcgcguu

SEQ ID NO: 214265 - RNA, 22 nt, Salmonella typhimurium LT2
uuaccguuugccaucuggccgc

SEQ ID NO: 214266 - RNA, 22 nt, Salmonella typhimurium LT2
cucuuugacuauuuucccugcc

SEQ ID NO: 214267 - RNA, 22 nt, Salmonella typhimurium LT2
ugggcgcuuguaugcacauagc

SEQ ID NO: 214268 - RNA, 22 nt, Salmonella typhimurium LT2
ugugcgcccugcgccaguuguu

SEQ ID NO: 214269 - RNA, 22 nt, Salmonella typhimurium LT2
acauuaacuaugguaaaggaga

SEQ ID NO: 214270 - RNA, 22 nt, Salmonella typhimurium LT2
caacgcggcaacaacgaucgcg

SEQ ID NO: 214271 - RNA, 22 nt, Salmonella typhimurium LT2
guguuacgccuuauccggccua

SEQ ID NO: 214272 - RNA, 22 nt, Salmonella typhimurium LT2
uggcgcugauucagcagcaguc

SEQ ID NO: 214273 - RNA, 22 nt, Salmonella typhimurium LT2
ccaguucgagauccggcguaga

SEQ ID NO: 214274 - RNA, 22 nt, Salmonella typhimurium LT2
gcuggacguugggggcuaccgg

SEQ ID NO: 214275 - RNA, 22 nt, Salmonella typhimurium LT2
ugucguacuugccguuaauccu

SEQ ID NO: 214276 - RNA, 22 nt, Salmonella typhimurium LT2
gcuagcgcuuaccugaccuaca

SEQ ID NO: 214277 - RNA, 22 nt, Salmonella typhimurium LT2
gauugcauccggaagaguuagg

SEQ ID NO: 214278 - RNA, 22 nt, Salmonella typhimurium LT2
cacgcuuuucccugacccugac

SEQ ID NO: 214279 - RNA, 22 nt, Salmonella typhimurium LT2
ugcgcugcgcuuaucaggccua

SEQ ID NO: 214280 - RNA, 22 nt, Salmonella typhimurium LT2
ucugucauucgacgaaugauua

SEQ ID NO: 214281 - RNA, 22 nt, Salmonella typhimurium LT2
cgcugauugauuaugauacguu

SEQ ID NO: 214282 - RNA, 22 nt, Salmonella typhimurium LT2
aacaugguggcggcgggcagug

SEQ ID NO: 214283 - RNA, 22 nt, Salmonella typhimurium LT2
uaugaagaucguaugguucagc

SEQ ID NO: 214284 - RNA, 22 nt, Salmonella typhimurium LT2
gcgcgucagggaagcgagguga

SEQ ID NO: 214285 - RNA, 22 nt, Salmonella typhimurium LT2
guccaggauguauaccgucugc

SEQ ID NO: 214286 - RNA, 22 nt, Salmonella typhimurium LT2
gccguuuauaaguauuacgaca

SEQ ID NO: 214287 - RNA, 22 nt, Salmonella typhimurium LT2
aaugcgaugaggaucagcgcga

SEQ ID NO: 214288 - RNA, 18 nt, Salmonella typhimurium LT2
acugcggaccgucgcggc

SEQ ID NO: 214289 - RNA, 22 nt, Salmonella typhimurium LT2
agccgcuauaucugggggcgca

SEQ ID NO: 214290 - RNA, 22 nt, Salmonella typhimurium LT2
aaauguacagaauacguggaua

SEQ ID NO: 214291 - RNA, 20 nt, Salmonella typhimurium LT2
ucaaugccgauaucgucaau

SEQ ID NO: 214292 - RNA, 22 nt, Salmonella typhimurium LT2
uggcucuuuugcggcguggaau

SEQ ID NO: 214293 - RNA, 22 nt, Salmonella typhimurium LT2
cgccaucagugccgccucuucg

SEQ ID NO: 214294 - RNA, 22 nt, Salmonella typhimurium LT2
augccggagauagaggcuuuca

SEQ ID NO: 214295 - RNA, 22 nt, Salmonella typhimurium LT2
aucagcgcgccgguggcguugu

SEQ ID NO: 214296 - RNA, 22 nt, Salmonella typhimurium LT2
acgguuacucauaugcguaacu

SEQ ID NO: 214297 - RNA, 22 nt, Salmonella typhimurium LT2
augccgcgcccggaagcguuug

SEQ ID NO: 214298 - RNA, 22 nt, Salmonella typhimurium LT2
guuacgcucgguucaccgaagg

SEQ ID NO: 214299 - RNA, 22 nt, Salmonella typhimurium LT2
ucagggugauuuuguccagcuu

SEQ ID NO: 214300 - RNA, 22 nt, Salmonella typhimurium LT2
auccgcagaugaagcgggcgcu

SEQ ID NO: 214301 - RNA, 22 nt, Salmonella typhimurium LT2
augcagcguuaacuggaaggcg

SEQ ID NO: 214302 - RNA, 22 nt, Salmonella typhimurium LT2
gagcugguuaacguguuccgcg

SEQ ID NO: 214303 - RNA, 22 nt, Salmonella typhimurium LT2
agacaucgcuaacaguauauau

SEQ ID NO: 214304 - RNA, 20 nt, Salmonella typhimurium LT2
cgguaagcgaagcgccaccg

SEQ ID NO: 214305 - RNA, 22 nt, Salmonella typhimurium LT2
cacgcgcugcuucaacauugua

SEQ ID NO: 214306 - RNA, 22 nt, Salmonella typhimurium LT2
gauuccucaggaguacgccauu

SEQ ID NO: 214307 - RNA, 22 nt, Salmonella typhimurium LT2
ucgcagcgccacaccgccauga

SEQ ID NO: 214308 - RNA, 22 nt, Salmonella typhimurium LT2
gaaaucaucgccacccaucucg

SEQ ID NO: 214309 - RNA, 22 nt, Salmonella typhimurium LT2
agcgccgucuacaaaaaagccc

SEQ ID NO: 214310 - RNA, 22 nt, Salmonella typhimurium LT2
ugcgcuuauccggucuacguaa

SEQ ID NO: 214311 - RNA, 23 nt, Salmonella typhimurium LT2
ucgugcugccagcggacaaaugu

SEQ ID NO: 214312 - RNA, 22 nt, Salmonella typhimurium LT2
uuaccucgaacgaucuggugac

SEQ ID NO: 214313 - RNA, 22 nt, Salmonella typhimurium LT2
caucauuuccauaacggcggcg

SEQ ID NO: 214314 - RNA, 22 nt, Salmonella typhimurium LT2
uccuggauagccauauuauuga

SEQ ID NO: 214315 - RNA, 22 nt, Salmonella typhimurium LT2
uacgcauauggcggaucuggau

SEQ ID NO: 214316 - RNA, 23 nt, Salmonella typhimurium LT2
gcgcaggucaaugguuuucaacg

SEQ ID NO: 214317 - RNA, 22 nt, Salmonella typhimurium LT2
ucagaccuucuucgauuucgcg

SEQ ID NO: 214318 - RNA, 22 nt, Salmonella typhimurium LT2
cgagcgaguacaaagugcaguu

SEQ ID NO: 214319 - RNA, 22 nt, Salmonella typhimurium LT2
acguggugcgcggcagccguuu

SEQ ID NO: 214320 - RNA, 22 nt, Salmonella typhimurium LT2
ucggccuggccaggcgcucuau

SEQ ID NO: 214321 - RNA, 22 nt, Salmonella typhimurium LT2
cugcgcuuaucaggccuacgag

SEQ ID NO: 214322 - RNA, 23 nt, Salmonella typhimurium LT2
ucugcuggccgcugccgguuuug

SEQ ID NO: 214323 - RNA, 22 nt, Salmonella typhimurium LT2
gcgaacguuucucaggugaugc

SEQ ID NO: 214324 - RNA, 21 nt, Salmonella typhimurium LT2
uacgacgcacuuuaugagguc

SEQ ID NO: 214325 - RNA, 22 nt, Salmonella typhimurium LT2
auaacgauauuucauccccauu

SEQ ID NO: 214326 - RNA, 18 nt, Salmonella typhimurium LT2
uuaaccgccaugaauagc

SEQ ID NO: 214327 - RNA, 22 nt, Salmonella typhimurium LT2
cggcuguuucccggccauccca

SEQ ID NO: 214328 - RNA, 22 nt, Salmonella typhimurium LT2
gccguggaaaagcucggggcgu

SEQ ID NO: 214329 - RNA, 22 nt, Salmonella typhimurium LT2
guccagcagugguuucauacuc

SEQ ID NO: 214330 - RNA, 22 nt, Salmonella typhimurium LT2
caggcgugaaugugucugcgug

SEQ ID NO: 214331 - RNA, 22 nt, Salmonella typhimurium LT2
ucgcguuuauuaaacaguggca

SEQ ID NO: 214332 - RNA, 22 nt, Salmonella typhimurium LT2
ucacugcucggcuuguugguca

SEQ ID NO: 214333 - RNA, 22 nt, Salmonella typhimurium LT2
ggucgcuggacgccauccugca

SEQ ID NO: 214334 - RNA, 22 nt, Salmonella typhimurium LT2
ugccauuuagcugagaaaagau

SEQ ID NO: 214335 - RNA, 22 nt, Salmonella typhimurium LT2
uccugaccugaugcgcgagaag

SEQ ID NO: 214336 - RNA, 22 nt, Salmonella typhimurium LT2
ucggcguaguacuuauccugaa

SEQ ID NO: 214337 - RNA, 22 nt, Salmonella typhimurium LT2
uggcggcaauggcgauagauuu

SEQ ID NO: 214338 - RNA, 22 nt, Salmonella typhimurium LT2
gaucgguuaggccgggcaggua

SEQ ID NO: 214339 - RNA, 22 nt, Salmonella typhimurium LT2
gcacgcugucguccgugaguga

SEQ ID NO: 214340 - RNA, 22 nt, Salmonella typhimurium LT2
uggcugauuaucccguguccug

SEQ ID NO: 214341 - RNA, 22 nt, Salmonella typhimurium LT2
cgcgacguuucguccagcggca

SEQ ID NO: 214342 - RNA, 22 nt, Salmonella typhimurium LT2
ccgucgaugauuuuggucacgg

SEQ ID NO: 214343 - RNA, 22 nt, Salmonella typhimurium LT2
ccauauagcaauaaacuuaucc

SEQ ID NO: 214344 - RNA, 22 nt, Salmonella typhimurium LT2
uacgcgaacaacuggaggucgg

SEQ ID NO: 214345 - RNA, 19 nt, Salmonella typhimurium LT2
uuuccggcgccauuggcgu

SEQ ID NO: 214346 - RNA, 22 nt, Salmonella typhimurium LT2
uaggccgggcaaggcacagccg

SEQ ID NO: 214347 - RNA, 22 nt, Salmonella typhimurium LT2
aucaggugucgguugcggaucu

SEQ ID NO: 214348 - RNA, 22 nt, Salmonella typhimurium LT2
gauuuccgcaacguggugcugg

SEQ ID NO: 214349 - RNA, 22 nt, Salmonella typhimurium LT2
augccuuauccggccuaccgau

SEQ ID NO: 214350 - RNA, 22 nt, Salmonella typhimurium LT2
cguuaucgucgaaaccgccguc

SEQ ID NO: 214351 - RNA, 22 nt, Salmonella typhimurium LT2
uccggcuuuuggucugcugauc

SEQ ID NO: 214352 - RNA, 22 nt, Salmonella typhimurium LT2
cuguaugguuauaaaaaggaug

SEQ ID NO: 214353 - RNA, 22 nt, Salmonella typhimurium LT2
ugauacugaggauuuucgcguc

SEQ ID NO: 214354 - RNA, 22 nt, Salmonella typhimurium LT2
ugcugacccguucuuacgguga

SEQ ID NO: 214355 - RNA, 22 nt, Salmonella typhimurium LT2
gcguaucaucaacccgaugcgc

SEQ ID NO: 214356 - RNA, 22 nt, Salmonella typhimurium LT2
aucugguugaauuugaucagga

SEQ ID NO: 214357 - RNA, 22 nt, Salmonella typhimurium LT2
auccugcaaugcgcugacgccg

SEQ ID NO: 214358 - RNA, 22 nt, Salmonella typhimurium LT2
caagccauguugcccaugccag

SEQ ID NO: 214359 - RNA, 22 nt, Salmonella typhimurium LT2
ugacguuaggcggcgacaacag

SEQ ID NO: 214360 - RNA, 22 nt, Salmonella typhimurium LT2
ggcgcguaaaaaacugucugaa

SEQ ID NO: 214361 - RNA, 22 nt, Salmonella typhimurium LT2
gucgccaauaccgagguagcgg

SEQ ID NO: 214362 - RNA, 22 nt, Salmonella typhimurium LT2
aagugcgagaauaaucuucacg

SEQ ID NO: 214363 - RNA, 22 nt, Salmonella typhimurium LT2
aacugcggcccgccuguugagc

SEQ ID NO: 214364 - RNA, 22 nt, Salmonella typhimurium LT2
agucgcuguacugcgcgagcag

SEQ ID NO: 214365 - RNA, 22 nt, Salmonella typhimurium LT2
cagcaugugguucaacauguuc

SEQ ID NO: 214366 - RNA, 22 nt, Salmonella typhimurium LT2
uaggccaaccgccauccggcau

SEQ ID NO: 214367 - RNA, 22 nt, Salmonella typhimurium LT2
auagagauaucgccauugcacu

SEQ ID NO: 214368 - RNA, 22 nt, Salmonella typhimurium LT2
gaaugguugccaguugcggcgg

SEQ ID NO: 214369 - RNA, 22 nt, Salmonella typhimurium LT2
gauggacuggugcucggcaugu

SEQ ID NO: 214370 - RNA, 22 nt, Salmonella typhimurium LT2
gggcuuaugcacuaaauaagac

SEQ ID NO: 214371 - RNA, 23 nt, Salmonella typhimurium LT2
gcuaucgacggcagcguggcgga

SEQ ID NO: 214372 - RNA, 22 nt, Salmonella typhimurium LT2
gcuauaccacgggaagaugguc

SEQ ID NO: 214373 - RNA, 22 nt, Salmonella typhimurium LT2
caucguuuugauaucgaagcgg

SEQ ID NO: 214374 - RNA, 22 nt, Salmonella typhimurium LT2
aagguuaugcuauucauuuauc

SEQ ID NO: 214375 - RNA, 22 nt, Salmonella typhimurium LT2
uauggcagguuucuuuggcgcu

SEQ ID NO: 214376 - RNA, 22 nt, Salmonella typhimurium LT2
uaucuggcaauuuauugcguug

SEQ ID NO: 214377 - RNA, 22 nt, Salmonella typhimurium LT2
cuggcugcugacgguccuguua

SEQ ID NO: 214378 - RNA, 20 nt, Salmonella typhimurium LT2
uggcacgaaaauaaucugcu

SEQ ID NO: 214379 - RNA, 22 nt, Salmonella typhimurium LT2
ugcgccaguugcgcuucuauga

SEQ ID NO: 214380 - RNA, 22 nt, Salmonella typhimurium LT2
cggaacgcacagccuuucgucg

SEQ ID NO: 214381 - RNA, 22 nt, Salmonella typhimurium LT2
gaccauccgcacauucaucugc

SEQ ID NO: 214382 - RNA, 22 nt, Salmonella typhimurium LT2
gccgcgauggcuuucauuucca

SEQ ID NO: 214383 - RNA, 22 nt, Salmonella typhimurium LT2
aagacgcgucgccaucuggcuc

SEQ ID NO: 214384 - RNA, 22 nt, Salmonella typhimurium LT2
aacgugaugccauacggcgagu

SEQ ID NO: 214385 - RNA, 22 nt, Salmonella typhimurium LT2
gcagauguccgccuucugguau

SEQ ID NO: 214386 - RNA, 22 nt, Salmonella typhimurium LT2
uuccggcgucauugccguggau

SEQ ID NO: 214387 - RNA, 22 nt, Salmonella typhimurium LT2
ccgacaggaagccguaaauuaa

SEQ ID NO: 214388 - RNA, 22 nt, Salmonella typhimurium LT2
cgaucagcuuuuugccgaaauu

SEQ ID NO: 214389 - RNA, 22 nt, Salmonella typhimurium LT2
guccaacugcgcggcaagauua

SEQ ID NO: 214390 - RNA, 22 nt, Salmonella typhimurium LT2
cuggugcacgagguggaacaua

SEQ ID NO: 214391 - RNA, 22 nt, Salmonella typhimurium LT2
gauugguaacggcguugagcug

SEQ ID NO: 214392 - RNA, 22 nt, Salmonella typhimurium LT2
ccgggucugccagccgccguua

SEQ ID NO: 214393 - RNA, 22 nt, Salmonella typhimurium LT2
uaugaguuugucgaugccgaua

SEQ ID NO: 214394 - RNA, 22 nt, Salmonella typhimurium LT2
cuuaugcagaucgccguuggcg

SEQ ID NO: 214395 - RNA, 22 nt, Salmonella typhimurium LT2
ucaugccugcgcgccgggcuuu

SEQ ID NO: 214396 - RNA, 22 nt, Salmonella typhimurium LT2
gcgguugaucggguaguuugcg

SEQ ID NO: 214397 - RNA, 22 nt, Salmonella typhimurium LT2
uucgaugagaagaucccacucg

SEQ ID NO: 214398 - RNA, 22 nt, Salmonella typhimurium LT2
ccggaccuuugucaucggcugg

SEQ ID NO: 214399 - RNA, 22 nt, Salmonella typhimurium LT2
ccgccguaagcgcgauaguuau

SEQ ID NO: 214400 - RNA, 22 nt, Salmonella typhimurium LT2
auggcgauagacauaaaccggu

SEQ ID NO: 214401 - RNA, 22 nt, Salmonella typhimurium LT2
ccggauggcguguagcgauccg

SEQ ID NO: 214402 - RNA, 22 nt, Salmonella typhimurium LT2
aagcgcgucaagauacugguca

SEQ ID NO: 214403 - RNA, 22 nt, Salmonella typhimurium LT2
cauuggcaauagauaaucgucc

SEQ ID NO: 214404 - RNA, 22 nt, Salmonella typhimurium LT2
aaguucuuuucuuaauuaccag

SEQ ID NO: 214405 - RNA, 22 nt, Salmonella typhimurium LT2
cgaaggcgacaucagcagccgu

SEQ ID NO: 214406 - RNA, 22 nt, Salmonella typhimurium LT2
gcauugacgauuuuguacaggu

SEQ ID NO: 214407 - RNA, 22 nt, Salmonella typhimurium LT2
caugagcugggcuaugaaugcc

SEQ ID NO: 214408 - RNA, 22 nt, Salmonella typhimurium LT2
cggcuacgggcagaagucaggu

SEQ ID NO: 214409 - RNA, 22 nt, Salmonella typhimurium LT2
ugccgguugucgaugaagaaca

SEQ ID NO: 214410 - RNA, 22 nt, Salmonella typhimurium LT2
aucgcgugauaaagcgcugacc

SEQ ID NO: 214411 - RNA, 22 nt, Salmonella typhimurium LT2
acacugauuggcgcuggugucg

SEQ ID NO: 214412 - RNA, 20 nt, Salmonella typhimurium LT2
auucaagucggugcgacgau

SEQ ID NO: 214413 - RNA, 22 nt, Salmonella typhimurium LT2
ggaaugcaacgccugauuugcc

SEQ ID NO: 214414 - RNA, 22 nt, Salmonella typhimurium LT2
augacgguaacauuuuguuggc

SEQ ID NO: 214415 - RNA, 22 nt, Salmonella typhimurium LT2
ucgcccgaacguuugucgcacc

SEQ ID NO: 214416 - RNA, 22 nt, Salmonella typhimurium LT2
acuuuaucuaccgcgccgguuc

SEQ ID NO: 214417 - RNA, 19 nt, Salmonella typhimurium LT2
uaucgaaguucacgccucc

SEQ ID NO: 214418 - RNA, 22 nt, Salmonella typhimurium LT2
uugccguugacgacguaagccg

SEQ ID NO: 214419 - RNA, 22 nt, Salmonella typhimurium LT2
gcuuucaggccuccuggugugg

SEQ ID NO: 214420 - RNA, 22 nt, Salmonella typhimurium LT2
uggguaaugcuuugauaacccg

SEQ ID NO: 214421 - RNA, 23 nt, Salmonella typhimurium LT2
guguaccauaauccacugcaucc

SEQ ID NO: 214422 - RNA, 22 nt, Salmonella typhimurium LT2
ucgcucaguucuaucuuguugc

SEQ ID NO: 214423 - RNA, 22 nt, Salmonella typhimurium LT2
ugguaccguuaugacgaucugc

SEQ ID NO: 214424 - RNA, 22 nt, Salmonella typhimurium LT2
uaggccugauaagguaaagccg

SEQ ID NO: 214425 - RNA, 22 nt, Salmonella typhimurium LT2
uugauaccacgaaaaucgggau

SEQ ID NO: 214426 - RNA, 22 nt, Salmonella typhimurium LT2
ucgguaguaaccagcucuauug

SEQ ID NO: 214427 - RNA, 22 nt, Salmonella typhimurium LT2
ggcauuuaucgauggcgcagga

SEQ ID NO: 214428 - RNA, 22 nt, Salmonella typhimurium LT2
ucgggaacagcaacgagcugau

SEQ ID NO: 214429 - RNA, 22 nt, Salmonella typhimurium LT2
ucgaugcugacgguauccugca

SEQ ID NO: 214430 - RNA, 22 nt, Salmonella typhimurium LT2
cuuaccgguaugacgcgcuaaa

SEQ ID NO: 214431 - RNA, 22 nt, Salmonella typhimurium LT2
aucuggcaugcagggccggaag

SEQ ID NO: 214432 - RNA, 19 nt, Salmonella typhimurium LT2
caucuuuaccuuuguguug

SEQ ID NO: 214433 - RNA, 22 nt, Salmonella typhimurium LT2
ugguacaggcauucaccguuug

SEQ ID NO: 214434 - RNA, 22 nt, Salmonella typhimurium LT2
gcgcgauugauaugaauauauu

SEQ ID NO: 214435 - RNA, 20 nt, Salmonella typhimurium LT2
auccggguaaagaccaaaga

SEQ ID NO: 214436 - RNA, 22 nt, Salmonella typhimurium LT2
cgaucguaugccgggcgaugcg

SEQ ID NO: 214437 - RNA, 22 nt, Salmonella typhimurium LT2
guccaugaaguccaugccaucu

SEQ ID NO: 214438 - RNA, 22 nt, Salmonella typhimurium LT2
uauugucggccuggugcuguug

SEQ ID NO: 214439 - RNA, 22 nt, Salmonella typhimurium LT2
caguggcgauaagacgcaaugu

SEQ ID NO: 214440 - RNA, 22 nt, Salmonella typhimurium LT2
auucucgucugucaugcacauc

SEQ ID NO: 214441 - RNA, 22 nt, Salmonella typhimurium LT2
ugcacgucggcgaagcgccaaa

SEQ ID NO: 214442 - RNA, 22 nt, Salmonella typhimurium LT2
auuuagcgguggucggguuugg

SEQ ID NO: 214443 - RNA, 22 nt, Salmonella typhimurium LT2
guagcgggcggcauccggucaa

SEQ ID NO: 214444 - RNA, 22 nt, Salmonella typhimurium LT2
uuucgacaguagcuuauaugug

SEQ ID NO: 214445 - RNA, 22 nt, Salmonella typhimurium LT2
uugccguugaugccauuagugc

SEQ ID NO: 214446 - RNA, 22 nt, Salmonella typhimurium LT2
uuaacaugcggcuagccgggaa

SEQ ID NO: 214447 - RNA, 22 nt, Salmonella typhimurium LT2
agcgcguuggcgcagauauugu

SEQ ID NO: 214448 - RNA, 22 nt, Salmonella typhimurium LT2
gcauguuugccugagcgcgaac

SEQ ID NO: 214449 - RNA, 22 nt, Salmonella typhimurium LT2
ugcgucgauuucuggugcggua

SEQ ID NO: 214450 - RNA, 22 nt, Salmonella typhimurium LT2
acaccggguuuagcagaaaaau

SEQ ID NO: 214451 - RNA, 22 nt, Salmonella typhimurium LT2
gcggauaucgaaguggaucugg

SEQ ID NO: 214452 - RNA, 23 nt, Salmonella typhimurium LT2
uuaagcaccacauuggugcaaca

SEQ ID NO: 214453 - RNA, 22 nt, Salmonella typhimurium LT2
agcugccucaggaagcguuccu

SEQ ID NO: 214454 - RNA, 22 nt, Salmonella typhimurium LT2
uacgugauuugagcggcuggcg

SEQ ID NO: 214455 - RNA, 22 nt, Salmonella typhimurium LT2
uuguaagaaagcgcuuugcccu

SEQ ID NO: 214456 - RNA, 22 nt, Salmonella typhimurium LT2
accaccugcccggcuuuguuca

SEQ ID NO: 214457 - RNA, 22 nt, Salmonella typhimurium LT2
agccagacuuaucgcuccuaug

SEQ ID NO: 214458 - RNA, 22 nt, Salmonella typhimurium LT2
cagugaggacgcuaaugccgcu

SEQ ID NO: 214459 - RNA, 20 nt, Salmonella typhimurium LT2
gugauggaaaucagcuugua

SEQ ID NO: 214460 - RNA, 22 nt, Salmonella typhimurium LT2
ucaucggcgcccguaugcgcau

SEQ ID NO: 214461 - RNA, 22 nt, Salmonella typhimurium LT2
gucgucgggucguugcauauug

SEQ ID NO: 214462 - RNA, 22 nt, Salmonella typhimurium LT2
augaccguuuugauaucagugu

SEQ ID NO: 214463 - RNA, 22 nt, Salmonella typhimurium LT2
cgugccugauggcgcugugcuu

SEQ ID NO: 214464 - RNA, 22 nt, Salmonella typhimurium LT2
cagcuauauuuucgccgccacg

SEQ ID NO: 214465 - RNA, 22 nt, Salmonella typhimurium LT2
uaagccgccagcguuaugcuga

SEQ ID NO: 214466 - RNA, 22 nt, Salmonella typhimurium LT2
uuuaccguuugauuucaaucgc

SEQ ID NO: 214467 - RNA, 21 nt, Salmonella typhimurium LT2
gccgaugcaaaugcugccagu

SEQ ID NO: 214468 - RNA, 19 nt, Salmonella typhimurium LT2
cggugccugguggcggaga

SEQ ID NO: 214469 - RNA, 19 nt, Salmonella typhimurium LT2
ucgcgcuuacacagacugc

SEQ ID NO: 214470 - RNA, 22 nt, Salmonella typhimurium LT2
agcgguuuuauuuacguugcuc

SEQ ID NO: 214471 - RNA, 22 nt, Salmonella typhimurium LT2
aucccgccagcgaaagcgucug

SEQ ID NO: 214472 - RNA, 22 nt, Salmonella typhimurium LT2
cugcguuuaccuggccuacaga

SEQ ID NO: 214473 - RNA, 22 nt, Salmonella typhimurium LT2
uugcgcggucagaauuuccagc

SEQ ID NO: 214474 - RNA, 22 nt, Salmonella typhimurium LT2
cagauagcgccggaaaugauug

SEQ ID NO: 214475 - RNA, 22 nt, Salmonella typhimurium LT2
ugcgcugauggccguguuuuuc

SEQ ID NO: 214476 - RNA, 22 nt, Salmonella typhimurium LT2
aggauaugagauuaugaguacc

SEQ ID NO: 214477 - RNA, 22 nt, Salmonella typhimurium LT2
gugaaggcauccgcaugaauag

SEQ ID NO: 214478 - RNA, 21 nt, Salmonella typhimurium LT2
ucauccagccaacaaacucaa

SEQ ID NO: 214479 - RNA, 22 nt, Salmonella typhimurium LT2
aauggacuaagguaaauuguga

SEQ ID NO: 214480 - RNA, 22 nt, Salmonella typhimurium LT2
uugucgcgauucuggagcaaca

SEQ ID NO: 214481 - RNA, 22 nt, Salmonella typhimurium LT2
uucgcuuaucaggccuacgaca

SEQ ID NO: 214482 - RNA, 22 nt, Salmonella typhimurium LT2
guccgacucaaacugaaaucgu

SEQ ID NO: 214483 - RNA, 22 nt, Salmonella typhimurium LT2
ucguuauaccgcugggccgcgc

SEQ ID NO: 214484 - RNA, 22 nt, Salmonella typhimurium LT2
aaagcguaggccugauaagcgc

SEQ ID NO: 214485 - RNA, 22 nt, Salmonella typhimurium LT2
ucagcggcguguucccgacgcu

SEQ ID NO: 214486 - RNA, 22 nt, Salmonella typhimurium LT2
ucuauccggcucgcgcuaucgg

SEQ ID NO: 214487 - RNA, 22 nt, Salmonella typhimurium LT2
agcgucugacuauuccgguuau

SEQ ID NO: 214488 - RNA, 22 nt, Salmonella typhimurium LT2
gcgcacuuuaaucgccaugauc

SEQ ID NO: 214489 - RNA, 23 nt, Salmonella typhimurium LT2
cugcgcauauuacgccggcguuu

SEQ ID NO: 214490 - RNA, 22 nt, Salmonella typhimurium LT2
ggccugauaagcgcagcgccau

SEQ ID NO: 214491 - RNA, 22 nt, Salmonella typhimurium LT2
ugaucgaugaugaacaucaccg

SEQ ID NO: 214492 - RNA, 22 nt, Salmonella typhimurium LT2
cgcguuguuaacgaaagcgcug

SEQ ID NO: 214493 - RNA, 21 nt, Salmonella typhimurium LT2
uugacguuggagcgguagguc

SEQ ID NO: 214494 - RNA, 22 nt, Salmonella typhimurium LT2
uugaggaaugggcgaguauuug

SEQ ID NO: 214495 - RNA, 22 nt, Salmonella typhimurium LT2
accaggaagugaaagcgcugau

SEQ ID NO: 214496 - RNA, 22 nt, Salmonella typhimurium LT2
ugcguucaguuauugcggaaga

SEQ ID NO: 214497 - RNA, 22 nt, Salmonella typhimurium LT2
uccguaaccgucuggcggaguc

SEQ ID NO: 214498 - RNA, 22 nt, Salmonella typhimurium LT2
gacacccugaugacgcuggcgu

SEQ ID NO: 214499 - RNA, 22 nt, Salmonella typhimurium LT2
uggccgcuucgccuuauccggc

SEQ ID NO: 214500 - RNA, 23 nt, Salmonella typhimurium LT2
ccaacgcuggcgugcgagaaacc

SEQ ID NO: 214501 - RNA, 20 nt, Salmonella typhimurium LT2
aauccguccggcgacgccgc

SEQ ID NO: 214502 - RNA, 22 nt, Salmonella typhimurium LT2
uguacugguuuauuugcgucau

SEQ ID NO: 214503 - RNA, 22 nt, Salmonella typhimurium LT2
gucagugccuuuggcggcagcc

SEQ ID NO: 214504 - RNA, 22 nt, Salmonella typhimurium LT2
ugauggcgguaaccccuuccgu

SEQ ID NO: 214505 - RNA, 22 nt, Salmonella typhimurium LT2
uuucgccgaugguuacaacgcc

SEQ ID NO: 214506 - RNA, 22 nt, Salmonella typhimurium LT2
gcugagccugauuuuaccgcug

SEQ ID NO: 214507 - RNA, 22 nt, Salmonella typhimurium LT2
augcauguuauauucgccguga

SEQ ID NO: 214508 - RNA, 22 nt, Salmonella typhimurium LT2
ggugagacgcguggauaacgga

SEQ ID NO: 214509 - RNA, 21 nt, Salmonella typhimurium LT2
gccaggucagcggauggguuu

SEQ ID NO: 214510 - RNA, 19 nt, Salmonella typhimurium LT2
cauugcuggauaagauuua

SEQ ID NO: 214511 - RNA, 22 nt, Salmonella typhimurium LT2
agguucuaccuccggcgcgacg

SEQ ID NO: 214512 - RNA, 22 nt, Salmonella typhimurium LT2
ggugcggaagauaagguguuua

SEQ ID NO: 214513 - RNA, 22 nt, Salmonella typhimurium LT2
acagcguugauuuuccgcagcc

SEQ ID NO: 214514 - RNA, 22 nt, Salmonella typhimurium LT2
gacgguaauacgcuucaccuga

SEQ ID NO: 214515 - RNA, 22 nt, Salmonella typhimurium LT2
ucgauggagucguauuugcccc

SEQ ID NO: 214516 - RNA, 22 nt, Salmonella typhimurium LT2
auggugaacggcaggaaauggu

SEQ ID NO: 214517 - RNA, 22 nt, Salmonella typhimurium LT2
gagucgauuaguuuccugcgug

SEQ ID NO: 214518 - RNA, 22 nt, Salmonella typhimurium LT2
uucuggacggccgccgcgaaac

SEQ ID NO: 214519 - RNA, 22 nt, Salmonella typhimurium LT2
gaacagcacgugcgagccugau

SEQ ID NO: 214520 - RNA, 22 nt, Salmonella typhimurium LT2
uaggccugauaagcguagcgcc

SEQ ID NO: 214521 - RNA, 22 nt, Salmonella typhimurium LT2
cgcgaaugauuuaggggauaaa

SEQ ID NO: 214522 - RNA, 22 nt, Salmonella typhimurium LT2
aggccgguauuuucuccaucag

SEQ ID NO: 214523 - RNA, 22 nt, Salmonella typhimurium LT2
ccugauguuguugcaugauggu

SEQ ID NO: 214524 - RNA, 22 nt, Salmonella typhimurium LT2
gauuggccaguguuucaaaguc

SEQ ID NO: 214525 - RNA, 22 nt, Salmonella typhimurium LT2
ccguucggggaaaagaugauua

SEQ ID NO: 214526 - RNA, 22 nt, Salmonella typhimurium LT2
auuggcgcgguacuggaagucg

SEQ ID NO: 214527 - RNA, 19 nt, Salmonella typhimurium LT2
uaugaaaccacugcuggac

SEQ ID NO: 214528 - RNA, 22 nt, Salmonella typhimurium LT2
uuuacggaucugcaggaucagg

SEQ ID NO: 214529 - RNA, 22 nt, Salmonella typhimurium LT2
gaugauguguaggccggguaag

SEQ ID NO: 214530 - RNA, 22 nt, Salmonella typhimurium LT2
cugaggccgcugguggcgacuu

SEQ ID NO: 214531 - RNA, 22 nt, Salmonella typhimurium LT2
caucgucgggcacguuuaccuc

SEQ ID NO: 214532 - RNA, 22 nt, Salmonella typhimurium LT2
ggcgugaguuccggcggcgcgg

SEQ ID NO: 214533 - RNA, 19 nt, Salmonella typhimurium LT2
aagugcgcgccauucgccg

SEQ ID NO: 214534 - RNA, 19 nt, Salmonella typhimurium LT2
gucaugcauggugaaguca

SEQ ID NO: 214535 - RNA, 22 nt, Salmonella typhimurium LT2
acuacgcugaaaaauggacggc

SEQ ID NO: 214536 - RNA, 22 nt, Salmonella typhimurium LT2
aaucgcccugucauuucaggcg

SEQ ID NO: 214537 - RNA, 22 nt, Salmonella typhimurium LT2
aucaggcgguaguaucagggaa

SEQ ID NO: 214538 - RNA, 22 nt, Salmonella typhimurium LT2
ccgcguaugaagagcggugagc

SEQ ID NO: 214539 - RNA, 22 nt, Salmonella typhimurium LT2
ucgguagcauugcgccggguaa

SEQ ID NO: 214540 - RNA, 22 nt, Salmonella typhimurium LT2
uauugugcauagagguaagaau

SEQ ID NO: 214541 - RNA, 22 nt, Salmonella typhimurium LT2
uggcuaucgccauuacgcauug

SEQ ID NO: 214542 - RNA, 22 nt, Salmonella typhimurium LT2
gcccagaaaggcgagaucaugc

SEQ ID NO: 214543 - RNA, 22 nt, Salmonella typhimurium LT2
aggccugauaagcgcagcgcca

SEQ ID NO: 214544 - RNA, 22 nt, Salmonella typhimurium LT2
ugcagggccuuuucucccgcca

SEQ ID NO: 214545 - RNA, 22 nt, Salmonella typhimurium LT2
aagguugagcguugggaagucg

SEQ ID NO: 214546 - RNA, 22 nt, Salmonella typhimurium LT2
ccgcugcuugcugcucuauccg

SEQ ID NO: 214547 - RNA, 22 nt, Salmonella typhimurium LT2
uggcgcacgcgucacuaaugcc

SEQ ID NO: 214548 - RNA, 22 nt, Salmonella typhimurium LT2
uuugaugaucagauccguggcc

SEQ ID NO: 214549 - RNA, 22 nt, Salmonella typhimurium LT2
uaagucgagcucaauaugguug

SEQ ID NO: 214550 - RNA, 22 nt, Salmonella typhimurium LT2
gaauuucacaagcauggugguc

SEQ ID NO: 214551 - RNA, 22 nt, Salmonella typhimurium LT2
gcaugguugcgcccggcaucgc

SEQ ID NO: 214552 - RNA, 22 nt, Salmonella typhimurium LT2
auuggcaccgacacgcuggcug

SEQ ID NO: 214553 - RNA, 22 nt, Salmonella typhimurium LT2
ccggugaucccaccaggaguug

SEQ ID NO: 214554 - RNA, 22 nt, Salmonella typhimurium LT2
ucaagucaccgguuacagcguc

SEQ ID NO: 214555 - RNA, 21 nt, Salmonella typhimurium LT2
ucguucagucccaugugccgg

SEQ ID NO: 214556 - RNA, 22 nt, Salmonella typhimurium LT2
aucgccaucuuaugcuuuuucu

SEQ ID NO: 214557 - RNA, 22 nt, Salmonella typhimurium LT2
gcuaaauccuuauaugcgcguu

SEQ ID NO: 214558 - RNA, 22 nt, Salmonella typhimurium LT2
acaguuccggcacuuucaccga

SEQ ID NO: 214559 - RNA, 22 nt, Salmonella typhimurium LT2
ugguagcgccuguuuuugcugc

SEQ ID NO: 214560 - RNA, 22 nt, Salmonella typhimurium LT2
gccaggaaguuaugcggguuug

SEQ ID NO: 214561 - RNA, 22 nt, Salmonella typhimurium LT2
ugccggauggcgguuggccuac

SEQ ID NO: 214562 - RNA, 22 nt, Salmonella typhimurium LT2
uggcggcaaucggugcugcgau

SEQ ID NO: 214563 - RNA, 20 nt, Salmonella typhimurium LT2
uggacgaauggcgcgcgcug

SEQ ID NO: 214564 - RNA, 22 nt, Salmonella typhimurium LT2
gccagguuacggaccaggagcu

SEQ ID NO: 214565 - RNA, 22 nt, Salmonella typhimurium LT2
gcaggucagcauagauacgacg

SEQ ID NO: 214566 - RNA, 22 nt, Salmonella typhimurium LT2
gcgugcguauacguaaucuuga

SEQ ID NO: 214567 - RNA, 22 nt, Salmonella typhimurium LT2
augugcaugacagacgagaaug

SEQ ID NO: 214568 - RNA, 22 nt, Salmonella typhimurium LT2
aggcaaacgucgucuggugauu

SEQ ID NO: 214569 - RNA, 19 nt, Salmonella typhimurium LT2
ucagcuccauguucgccgc

SEQ ID NO: 214570 - RNA, 22 nt, Salmonella typhimurium LT2
acaaucugaacauuaagucaug

SEQ ID NO: 214571 - RNA, 22 nt, Salmonella typhimurium LT2
uacacccuguuccgugaugcgu

SEQ ID NO: 214572 - RNA, 22 nt, Salmonella typhimurium LT2
ugccgauuuuggucccggcggc

SEQ ID NO: 214573 - RNA, 22 nt, Salmonella typhimurium LT2
uuaccgacgaguuuauucgugg

SEQ ID NO: 214574 - RNA, 22 nt, Salmonella typhimurium LT2
caauaucuacaaaggucgugua

SEQ ID NO: 214575 - RNA, 22 nt, Salmonella typhimurium LT2
ggcugauacaguuucauugccg

SEQ ID NO: 214576 - RNA, 22 nt, Salmonella typhimurium LT2
cuggcguaacgcauuauacuuu

SEQ ID NO: 214577 - RNA, 22 nt, Salmonella typhimurium LT2
gacccagcgcgauauaagaagg

SEQ ID NO: 214578 - RNA, 22 nt, Salmonella typhimurium LT2
ucuguaggcccgguaagcguua

SEQ ID NO: 214579 - RNA, 22 nt, Salmonella typhimurium LT2
gggauacggugcugguugaaaa

SEQ ID NO: 214580 - RNA, 22 nt, Salmonella typhimurium LT2
agucagguaacgaugccuguau

SEQ ID NO: 214581 - RNA, 22 nt, Salmonella typhimurium LT2
auugccggauggcgccguaggc

SEQ ID NO: 214582 - RNA, 22 nt, Salmonella typhimurium LT2
agagugacgcccaucguguaag

SEQ ID NO: 214583 - RNA, 22 nt, Salmonella typhimurium LT2
cuggcguuggcuaagggguaaa

SEQ ID NO: 214584 - RNA, 22 nt, Salmonella typhimurium LT2
gaacauugaugagcaaaacguc

SEQ ID NO: 214585 - RNA, 22 nt, Salmonella typhimurium LT2
uggacaggacacgggauaauca

SEQ ID NO: 214586 - RNA, 22 nt, Salmonella typhimurium LT2
gucuguuauggcuuccagugcg

SEQ ID NO: 214587 - RNA, 22 nt, Salmonella typhimurium LT2
uaggucuggucuaucucuuuuu

SEQ ID NO: 214588 - RNA, 22 nt, Salmonella typhimurium LT2
uguuccuggcuaauuuuggcuu

SEQ ID NO: 214589 - RNA, 22 nt, Salmonella typhimurium LT2
uacucggccacagcgggaauga

SEQ ID NO: 214590 - RNA, 23 nt, Salmonella typhimurium LT2
gcucaaagaggccugguuugccg

SEQ ID NO: 214591 - RNA, 22 nt, Salmonella typhimurium LT2
gaagcugaugauuaauaaaaag

SEQ ID NO: 214592 - RNA, 22 nt, Salmonella typhimurium LT2
ucguaauagccgaccugauugc

SEQ ID NO: 214593 - RNA, 22 nt, Salmonella typhimurium LT2
acccugccggaaacggugacac

SEQ ID NO: 214594 - RNA, 22 nt, Salmonella typhimurium LT2
ggauucugccgaaacugaucgg

SEQ ID NO: 214595 - RNA, 22 nt, Salmonella typhimurium LT2
cgcgaugggcguaaacaucaac

SEQ ID NO: 214596 - RNA, 22 nt, Salmonella typhimurium LT2
auggcgauaaugccgcgguuag

SEQ ID NO: 214597 - RNA, 22 nt, Salmonella typhimurium LT2
aaucaguuggcuggccgccggg

SEQ ID NO: 214598 - RNA, 22 nt, Salmonella typhimurium LT2
gccgcguagcguccggcguaau

SEQ ID NO: 214599 - RNA, 22 nt, Salmonella typhimurium LT2
cugaauuucuccggcgcgcaga

SEQ ID NO: 214600 - RNA, 22 nt, Salmonella typhimurium LT2
cuggaagcggcgcugaucuuug

SEQ ID NO: 214601 - RNA, 22 nt, Salmonella typhimurium LT2
aacgcuggcuggaaacgauggg

SEQ ID NO: 214602 - RNA, 22 nt, Salmonella typhimurium LT2
uuggcggaacccgacugguuuu

SEQ ID NO: 214603 - RNA, 22 nt, Salmonella typhimurium LT2
aucuggcuaaaaucugaaggcg

SEQ ID NO: 214604 - RNA, 22 nt, Salmonella typhimurium LT2
ggucgccagccagcgugucggu

SEQ ID NO: 214605 - RNA, 22 nt, Salmonella typhimurium LT2
aaugucgacgcgcuccagcaac

SEQ ID NO: 214606 - RNA, 22 nt, Salmonella typhimurium LT2
gcagcaaauuaaaagucagacu

SEQ ID NO: 214607 - RNA, 22 nt, Salmonella typhimurium LT2
ucacuguugaagauaaacucuu

SEQ ID NO: 214608 - RNA, 22 nt, Salmonella typhimurium LT2
auggugaaauugcuggaagcga

SEQ ID NO: 214609 - RNA, 22 nt, Salmonella typhimurium LT2
cgaugaaguuuaucaaagguga

SEQ ID NO: 214610 - RNA, 21 nt, Salmonella typhimurium LT2
cugcauaaucgcaaagguauc

SEQ ID NO: 214611 - RNA, 21 nt, Salmonella typhimurium LT2
auaucgagucauuucgcggcg

SEQ ID NO: 214612 - RNA, 22 nt, Salmonella typhimurium LT2
auaacggacucuucuuccgaau

SEQ ID NO: 214613 - RNA, 22 nt, Salmonella typhimurium LT2
ggaugaauuugugcacugccug

SEQ ID NO: 214614 - RNA, 22 nt, Salmonella typhimurium LT2
gauguauaccguuugcuauaca

SEQ ID NO: 214615 - RNA, 22 nt, Salmonella typhimurium LT2
accaggaauaucucuuuuuccu

SEQ ID NO: 214616 - RNA, 22 nt, Salmonella typhimurium LT2
gaggauucacugggaauggaag

SEQ ID NO: 214617 - RNA, 22 nt, Salmonella typhimurium LT2
aacccuuaccgcuaguuuuauc

SEQ ID NO: 214618 - RNA, 22 nt, Salmonella typhimurium LT2
uuccgguagucugacaucgacg

SEQ ID NO: 214619 - RNA, 22 nt, Salmonella typhimurium LT2
aucacgcacagauuuggcaucg

SEQ ID NO: 214620 - RNA, 22 nt, Salmonella typhimurium LT2
caucauccagaucuuucgcgcc

SEQ ID NO: 214621 - RNA, 21 nt, Salmonella typhimurium LT2
ugacccacaucgugcagaugc

SEQ ID NO: 214622 - RNA, 22 nt, Salmonella typhimurium LT2
cuggcguugaaaccacuacugg

SEQ ID NO: 214623 - RNA, 22 nt, Salmonella typhimurium LT2
cugacggguaguaucgcucuau

SEQ ID NO: 214624 - RNA, 22 nt, Salmonella typhimurium LT2
aguucgcgauagcuaauguugg

SEQ ID NO: 214625 - RNA, 22 nt, Salmonella typhimurium LT2
uagcgugauuacgaccggcgag

SEQ ID NO: 214626 - RNA, 21 nt, Salmonella typhimurium LT2
ccgguuguggaaaaaccgcag

SEQ ID NO: 214627 - RNA, 22 nt, Salmonella typhimurium LT2
acagugguugaauguagaggga

SEQ ID NO: 214628 - RNA, 22 nt, Salmonella typhimurium LT2
uugauucgccgcaucgcguaag

SEQ ID NO: 214629 - RNA, 22 nt, Salmonella typhimurium LT2
aacggcuaucugacagaaguag

SEQ ID NO: 214630 - RNA, 22 nt, Salmonella typhimurium LT2
uguucguaggcuggaucaggcg

SEQ ID NO: 214631 - RNA, 22 nt, Salmonella typhimurium LT2
caguacgccggaagucaugaau

SEQ ID NO: 214632 - RNA, 22 nt, Salmonella typhimurium LT2
uguaccagaucgcgcaggguga

SEQ ID NO: 214633 - RNA, 22 nt, Salmonella typhimurium LT2
ucgcuggaaaguauucgccagc

SEQ ID NO: 214634 - RNA, 22 nt, Salmonella typhimurium LT2
ucgguugcggaaaguguggcga

SEQ ID NO: 214635 - RNA, 22 nt, Salmonella typhimurium LT2
cguaaggcauuacaaggcgaua

SEQ ID NO: 214636 - RNA, 22 nt, Salmonella typhimurium LT2
ggaauugauaugaaugacaugu

SEQ ID NO: 214637 - RNA, 22 nt, Salmonella typhimurium LT2
cgcuggaugucaccguacaugc

SEQ ID NO: 214638 - RNA, 22 nt, Salmonella typhimurium LT2
acacgguugaaugggacgaggc

SEQ ID NO: 214639 - RNA, 22 nt, Salmonella typhimurium LT2
gugaugaugaccgggauggucu

SEQ ID NO: 214640 - RNA, 22 nt, Salmonella typhimurium LT2
cagaaugucggugcgcagguua

SEQ ID NO: 214641 - RNA, 22 nt, Salmonella typhimurium LT2
gugcgacaaacguucgggcgau

SEQ ID NO: 214642 - RNA, 22 nt, Salmonella typhimurium LT2
agcagguuggcgucgcgaagcc

SEQ ID NO: 214643 - RNA, 22 nt, Salmonella typhimurium LT2
uacgugcugaacgauauucauu

SEQ ID NO: 214644 - RNA, 22 nt, Salmonella typhimurium LT2
cgguuaaagggaauguaguaaa

SEQ ID NO: 214645 - RNA, 22 nt, Salmonella typhimurium LT2
uacugucgccaccacuguugca

SEQ ID NO: 214646 - RNA, 22 nt, Salmonella typhimurium LT2
cggaaugcaaucuaauaauggc

SEQ ID NO: 214647 - RNA, 22 nt, Salmonella typhimurium LT2
cauguuuacucuacuggccgua

SEQ ID NO: 214648 - RNA, 22 nt, Salmonella typhimurium LT2
gcuggcaagauggaagguacgu

SEQ ID NO: 214649 - RNA, 22 nt, Salmonella typhimurium LT2
uuccgguagggcacguagaagc

SEQ ID NO: 214650 - RNA, 22 nt, Salmonella typhimurium LT2
accgguuuccaguccagcguac

SEQ ID NO: 214651 - RNA, 23 nt, Salmonella typhimurium LT2
agcuggugauuuccggugccgau

SEQ ID NO: 214652 - RNA, 22 nt, Salmonella typhimurium LT2
cgucguggcauuugccggccca

SEQ ID NO: 214653 - RNA, 22 nt, Salmonella typhimurium LT2
ugcggcaagcuggcgaucguuc

SEQ ID NO: 214654 - RNA, 22 nt, Salmonella typhimurium LT2
acgacccgauagauucucugga

SEQ ID NO: 214655 - RNA, 22 nt, Salmonella typhimurium LT2
aacuccuggugggaucaccggc

SEQ ID NO: 214656 - RNA, 22 nt, Salmonella typhimurium LT2
ucgauuguugauguuaacgcug

SEQ ID NO: 214657 - RNA, 22 nt, Salmonella typhimurium LT2
cagcuaacgguugcauaaucug

SEQ ID NO: 214658 - RNA, 22 nt, Salmonella typhimurium LT2
agacucugcggguugauguuug

SEQ ID NO: 214659 - RNA, 22 nt, Salmonella typhimurium LT2
gaccggauuguggccgacaggu

SEQ ID NO: 214660 - RNA, 19 nt, Salmonella typhimurium LT2
gcuccugcuggcggucucc

SEQ ID NO: 214661 - RNA, 22 nt, Salmonella typhimurium LT2
uauuaccgucgauacugcugac

SEQ ID NO: 214662 - RNA, 22 nt, Salmonella typhimurium LT2
ugcugccggaaaugucugcgga

SEQ ID NO: 214663 - RNA, 22 nt, Salmonella typhimurium LT2
ugaugcugucuggucagcgugg

SEQ ID NO: 214664 - RNA, 22 nt, Salmonella typhimurium LT2
cuggaagcgcucgguguuuggc

SEQ ID NO: 214665 - RNA, 22 nt, Salmonella typhimurium LT2
uugagcuucaugacauuaaugu

SEQ ID NO: 214666 - RNA, 22 nt, Salmonella typhimurium LT2
gcgugcaggaaaucuuuaacgu

SEQ ID NO: 214667 - RNA, 22 nt, Salmonella typhimurium LT2
agauucaucuaauuugauuacu

SEQ ID NO: 214668 - RNA, 22 nt, Salmonella typhimurium LT2
ucauuugucagccagggagaaa

SEQ ID NO: 214669 - RNA, 22 nt, Salmonella typhimurium LT2
guucuacguacaacgugcccag

SEQ ID NO: 214670 - RNA, 22 nt, Salmonella typhimurium LT2
cggacgauuuuggucgcggcga

SEQ ID NO: 214671 - RNA, 22 nt, Salmonella typhimurium LT2
ugcuggcagaagaaauggcaga

SEQ ID NO: 214672 - RNA, 22 nt, Salmonella typhimurium LT2
uugugccauuccugagcaauua

SEQ ID NO: 214673 - RNA, 22 nt, Salmonella typhimurium LT2
ggccugauccgcaaagccggga

SEQ ID NO: 214674 - RNA, 22 nt, Salmonella typhimurium LT2
caccggaugaaauuguuaguga

SEQ ID NO: 214675 - RNA, 22 nt, Salmonella typhimurium LT2
gcuaacgcuuaccgggccuaca

SEQ ID NO: 214676 - RNA, 22 nt, Salmonella typhimurium LT2
uggcgugcuggccagcagccug

SEQ ID NO: 214677 - RNA, 22 nt, Salmonella typhimurium LT2
cggauuucuggcgcuguuguug

SEQ ID NO: 214678 - RNA, 22 nt, Salmonella typhimurium LT2
ucgauggaucgggcgauagcgc

SEQ ID NO: 214679 - RNA, 22 nt, Salmonella typhimurium LT2
ucagaauaucuccauuauucgc

SEQ ID NO: 214680 - RNA, 22 nt, Salmonella typhimurium LT2
augugcuguucgauguagccaa

SEQ ID NO: 214681 - RNA, 22 nt, Salmonella typhimurium LT2
gcgcauccuccaguuggcuguu

SEQ ID NO: 214682 - RNA, 23 nt, Salmonella typhimurium LT2
uauggcuauuaggguagacgggu

SEQ ID NO: 214683 - RNA, 22 nt, Salmonella typhimurium LT2
cuggcaaagaaucguacaugcg

SEQ ID NO: 214684 - RNA, 22 nt, Salmonella typhimurium LT2
cgcaggauacgaaacgggugcu

SEQ ID NO: 214685 - RNA, 22 nt, Salmonella typhimurium LT2
ggcaguggaugaccaugauugu

SEQ ID NO: 214686 - RNA, 22 nt, Salmonella typhimurium LT2
gcuuaacagcggaauggucgca

SEQ ID NO: 214687 - RNA, 20 nt, Salmonella typhimurium LT2
ccgguaagcacauugcgcag

SEQ ID NO: 214688 - RNA, 22 nt, Salmonella typhimurium LT2
agcggguuaugcgacgugcgug

SEQ ID NO: 214689 - RNA, 22 nt, Salmonella typhimurium LT2
aucgaucgcggcgguuuucugg

SEQ ID NO: 214690 - RNA, 22 nt, Salmonella typhimurium LT2
auagguggcguaaaauccgaac

SEQ ID NO: 214691 - RNA, 22 nt, Salmonella typhimurium LT2
ggcgagguguaagaaagcagaa

SEQ ID NO: 214692 - RNA, 22 nt, Salmonella typhimurium LT2
gcguucugaucugucugcggac

SEQ ID NO: 214693 - RNA, 22 nt, Salmonella typhimurium LT2
agauuugcuauauuugcgcccc

SEQ ID NO: 214694 - RNA, 22 nt, Salmonella typhimurium LT2
ccagcgcuucaguauggcgggu

SEQ ID NO: 214695 - RNA, 22 nt, Salmonella typhimurium LT2
aagcacuauuuuggugcaacau

SEQ ID NO: 214696 - RNA, 22 nt, Salmonella typhimurium LT2
aauaccaguucaucggcgucag

SEQ ID NO: 214697 - RNA, 20 nt, Salmonella typhimurium LT2
aucauugcgccggaccugca

SEQ ID NO: 214698 - RNA, 22 nt, Salmonella typhimurium LT2
ccggugcugucgguguagccca

SEQ ID NO: 214699 - RNA, 21 nt, Salmonella typhimurium LT2
uucaagcguaucggucaggga

SEQ ID NO: 214700 - RNA, 22 nt, Salmonella typhimurium LT2
gugcggauaaaaugacgcuggc

SEQ ID NO: 214701 - RNA, 22 nt, Salmonella typhimurium LT2
aaaucuuggacuggcagagcgc

SEQ ID NO: 214702 - RNA, 22 nt, Salmonella typhimurium LT2
cuacgcuugccauucuuaucac

SEQ ID NO: 214703 - RNA, 21 nt, Salmonella typhimurium LT2
uucaaggaaauugccgcuugu

SEQ ID NO: 214704 - RNA, 22 nt, Salmonella typhimurium LT2
cggauggcgcuaugcuuauccg

SEQ ID NO: 214705 - RNA, 22 nt, Salmonella typhimurium LT2
acggucugucccagucggcgcu

SEQ ID NO: 214706 - RNA, 22 nt, Salmonella typhimurium LT2
uugcgaucauuuuuaucgcuuc

SEQ ID NO: 214707 - RNA, 22 nt, Salmonella typhimurium LT2
ucugaauuuaaaaauccugaac

SEQ ID NO: 214708 - RNA, 23 nt, Salmonella typhimurium LT2
aagcgguuccacaacaaugaaaa

SEQ ID NO: 214709 - RNA, 23 nt, Salmonella typhimurium LT2
ucggcguuuaccguaggcgacca

SEQ ID NO: 214710 - RNA, 22 nt, Salmonella typhimurium LT2
acagaauggcauccgccugcuc

SEQ ID NO: 214711 - RNA, 22 nt, Salmonella typhimurium LT2
ggcggaauaaguagauaagcaa

SEQ ID NO: 214712 - RNA, 22 nt, Salmonella typhimurium LT2
cgguagaaaacuuucuagcgcc

SEQ ID NO: 214713 - RNA, 22 nt, Salmonella typhimurium LT2
ggauauugaugcggcgaucauu

SEQ ID NO: 214714 - RNA, 22 nt, Salmonella typhimurium LT2
ucgcuuaguccgguuggugauu

SEQ ID NO: 214715 - RNA, 22 nt, Salmonella typhimurium LT2
agcaggacuggagccaucagca

SEQ ID NO: 214716 - RNA, 22 nt, Salmonella typhimurium LT2
agcuuugcgaacaucauuagcg

SEQ ID NO: 214717 - RNA, 22 nt, Salmonella typhimurium LT2
gaggcguugaaguucuggaauc

SEQ ID NO: 214718 - RNA, 22 nt, Salmonella typhimurium LT2
uguaggcccgguaagcgucagc

SEQ ID NO: 214719 - RNA, 22 nt, Salmonella typhimurium LT2
cgcgugaugcggcgguaaagau

SEQ ID NO: 214720 - RNA, 18 nt, Salmonella typhimurium LT2
aacugggcgucaggcaau

SEQ ID NO: 214721 - RNA, 22 nt, Salmonella typhimurium LT2
gccggauggcgugcgcuucuau

SEQ ID NO: 214722 - RNA, 22 nt, Salmonella typhimurium LT2
agucgauuagcgucggcgaucg

SEQ ID NO: 214723 - RNA, 22 nt, Salmonella typhimurium LT2
acucgaaagcgaccaacgucgg

SEQ ID NO: 214724 - RNA, 22 nt, Salmonella typhimurium LT2
ugaguaaggcaagagcgcuuuu

SEQ ID NO: 214725 - RNA, 22 nt, Salmonella typhimurium LT2
augcucagugccgaaaauggcg

SEQ ID NO: 214726 - RNA, 22 nt, Salmonella typhimurium LT2
caaccugggaacaagagccauu

SEQ ID NO: 214727 - RNA, 22 nt, Salmonella typhimurium LT2
ugcuuuaaaugcugcgcuaacu

SEQ ID NO: 214728 - RNA, 23 nt, Salmonella typhimurium LT2
cuggcgcauaaagagcucgacca

SEQ ID NO: 214729 - RNA, 22 nt, Salmonella typhimurium LT2
cagauucugaaggugcauaugc

SEQ ID NO: 214730 - RNA, 22 nt, Salmonella typhimurium LT2
ugcgcugcuugaaaagcaucag

SEQ ID NO: 214731 - RNA, 22 nt, Salmonella typhimurium LT2
uugcucaacguauucgccagua

SEQ ID NO: 214732 - RNA, 17 nt, Salmonella typhimurium LT2
ggcuggcaacggccagc

SEQ ID NO: 214733 - RNA, 20 nt, Salmonella typhimurium LT2
cggauggcgacguggcagcg

SEQ ID NO: 214734 - RNA, 22 nt, Salmonella typhimurium LT2
gggaucaguauaccucgucaga

SEQ ID NO: 214735 - RNA, 22 nt, Salmonella typhimurium LT2
acugcugcgguaaugcagagua

SEQ ID NO: 214736 - RNA, 22 nt, Salmonella typhimurium LT2
gccgugauuacggcgguaggua

SEQ ID NO: 214737 - RNA, 22 nt, Salmonella typhimurium LT2
gcugauuaucgacuuucuggcg

SEQ ID NO: 214738 - RNA, 22 nt, Salmonella typhimurium LT2
uguaggccggauaagacgcguu

SEQ ID NO: 214739 - RNA, 22 nt, Salmonella typhimurium LT2
uguaggcagcauaagcguuagc

SEQ ID NO: 214740 - RNA, 22 nt, Salmonella typhimurium LT2
uagucuggaaagcuggcuacuc

SEQ ID NO: 214741 - RNA, 22 nt, Salmonella typhimurium LT2
gacucuggcgcguauauguuug

SEQ ID NO: 214742 - RNA, 22 nt, Salmonella typhimurium LT2
gggcgcauguuuugaguaaaac

SEQ ID NO: 214743 - RNA, 22 nt, Salmonella typhimurium LT2
agccagacgcuguuaccuaagc

SEQ ID NO: 214744 - RNA, 22 nt, Salmonella typhimurium LT2
ucgcugguucaggaauccgcag

SEQ ID NO: 214745 - RNA, 22 nt, Salmonella typhimurium LT2
uuugcccggauacuucgcgugg

SEQ ID NO: 214746 - RNA, 22 nt, Salmonella typhimurium LT2
uaggccggauaagacguuaguc

SEQ ID NO: 214747 - RNA, 22 nt, Salmonella typhimurium LT2
ugguggaacuugcugauauuau

SEQ ID NO: 214748 - RNA, 22 nt, Salmonella typhimurium LT2
accggcugcgauuacgcuggcg

SEQ ID NO: 214749 - RNA, 22 nt, Salmonella typhimurium LT2
ggcguugaaguucgucauaucg

SEQ ID NO: 214750 - RNA, 22 nt, Salmonella typhimurium LT2
ccgacugcugcugaaucagcgc

SEQ ID NO: 214751 - RNA, 22 nt, Salmonella typhimurium LT2
gaauuucuuaccaggagugaua

SEQ ID NO: 214752 - RNA, 22 nt, Salmonella typhimurium LT2
uuagcgccgguauuuuuggcgg

SEQ ID NO: 214753 - RNA, 23 nt, Salmonella typhimurium LT2
cugauugacgucaaucugggcga

SEQ ID NO: 214754 - RNA, 22 nt, Salmonella typhimurium LT2
gagcacauuuuagacuugugcg

SEQ ID NO: 214755 - RNA, 22 nt, Salmonella typhimurium LT2
gauggugaucagcgcuaccaga

SEQ ID NO: 214756 - RNA, 22 nt, Salmonella typhimurium LT2
gcggcgaugagugaaucguuca

SEQ ID NO: 214757 - RNA, 22 nt, Salmonella typhimurium LT2
gguuguaaaugacuuuuaugca

SEQ ID NO: 214758 - RNA, 22 nt, Salmonella typhimurium LT2
gucgacaauguugaugccaucg

SEQ ID NO: 214759 - RNA, 21 nt, Salmonella typhimurium LT2
cugacgccgcuguuuucacuc

SEQ ID NO: 214760 - RNA, 22 nt, Salmonella typhimurium LT2
cgucuuauccggccuacgagug

SEQ ID NO: 214761 - RNA, 22 nt, Salmonella typhimurium LT2
guuaaggcauuuucgccggccu

SEQ ID NO: 214762 - RNA, 20 nt, Salmonella typhimurium LT2
gacgucgccggaaagcguag

SEQ ID NO: 214763 - RNA, 22 nt, Salmonella typhimurium LT2
ccgauaagacgcagccgccauc

SEQ ID NO: 214764 - RNA, 22 nt, Salmonella typhimurium LT2
cggugagcugugaugcacggcg

SEQ ID NO: 214765 - RNA, 23 nt, Salmonella typhimurium LT2
gguuaauguugcggugucggagg

SEQ ID NO: 214766 - RNA, 22 nt, Salmonella typhimurium LT2
uuuggcaccauguuuagcacca

SEQ ID NO: 214767 - RNA, 21 nt, Salmonella typhimurium LT2
uuuggcagucguuuaucggaa

SEQ ID NO: 214768 - RNA, 21 nt, Salmonella typhimurium LT2
uugucgcgagguaaucgucau

SEQ ID NO: 214769 - RNA, 22 nt, Salmonella typhimurium LT2
agugggcguuuaaucgggaaga

SEQ ID NO: 214770 - RNA, 22 nt, Salmonella typhimurium LT2
cgaaccugauuguuuuacccaa

SEQ ID NO: 214771 - RNA, 22 nt, Salmonella typhimurium LT2
accacgcguggaaaugauguac

SEQ ID NO: 214772 - RNA, 22 nt, Salmonella typhimurium LT2
auggcuguuggggaucuuugcc

SEQ ID NO: 214773 - RNA, 20 nt, Salmonella typhimurium LT2
aacuggcggaaggcuugucu

SEQ ID NO: 214774 - RNA, 20 nt, Salmonella typhimurium LT2
ccugaccgcugaccacggcu

SEQ ID NO: 214775 - RNA, 22 nt, Salmonella typhimurium LT2
uccggucaggauaucgugcgua

SEQ ID NO: 214776 - RNA, 22 nt, Salmonella typhimurium LT2
gccgaucaauaauagaaacgac

SEQ ID NO: 214777 - RNA, 22 nt, Salmonella typhimurium LT2
uuucagguggccuucacgcugu

SEQ ID NO: 214778 - RNA, 22 nt, Salmonella typhimurium LT2
gcgccaucgcucugggaaucgu

SEQ ID NO: 214779 - RNA, 22 nt, Salmonella typhimurium LT2
cgcguuauauuugucauaaauu

SEQ ID NO: 214780 - RNA, 23 nt, Salmonella typhimurium LT2
acgcggaacacguuaaccagcuc

SEQ ID NO: 214781 - RNA, 22 nt, Salmonella typhimurium LT2
acauccgucaacggaaaaacgc

SEQ ID NO: 214782 - RNA, 22 nt, Salmonella typhimurium LT2
ccggaaccuuccugccguuggu

SEQ ID NO: 214783 - RNA, 22 nt, Salmonella typhimurium LT2
gccgaacguggcgguuuauccc

SEQ ID NO: 214784 - RNA, 22 nt, Salmonella typhimurium LT2
uggguagaccgggagucuguga

SEQ ID NO: 214785 - RNA, 22 nt, Salmonella typhimurium LT2
cgaguacgauagcgccgauugc

SEQ ID NO: 214786 - RNA, 20 nt, Salmonella typhimurium LT2
gcucgccaggauuagccugu

SEQ ID NO: 214787 - RNA, 22 nt, Salmonella typhimurium LT2
aucgauaaaguaaugacccgcc

SEQ ID NO: 214788 - RNA, 22 nt, Salmonella typhimurium LT2
cgcugucgucgaugucgcccac

SEQ ID NO: 214789 - RNA, 22 nt, Salmonella typhimurium LT2
gccgaugcguacccgcaccauc

SEQ ID NO: 214790 - RNA, 22 nt, Salmonella typhimurium LT2
cuggcggaugcguuagggaugg

SEQ ID NO: 214791 - RNA, 22 nt, Salmonella typhimurium LT2
uggcgauuuagcgaugaaggcu

SEQ ID NO: 214792 - RNA, 22 nt, Salmonella typhimurium LT2
uggcgcugucgaucaacuucaa

SEQ ID NO: 214793 - RNA, 22 nt, Salmonella typhimurium LT2
ugggcguacucgucuauuaaug

SEQ ID NO: 214794 - RNA, 23 nt, Salmonella typhimurium LT2
gucgucugaaggaugaagcguaa

SEQ ID NO: 214795 - RNA, 22 nt, Salmonella typhimurium LT2
augcgcuuguugcgucaggcua

SEQ ID NO: 214796 - RNA, 22 nt, Salmonella typhimurium LT2
cucgcgcuuaacaguacguugg

SEQ ID NO: 214797 - RNA, 22 nt, Salmonella typhimurium LT2
ugccgacaaucugcgagguggg

SEQ ID NO: 214798 - RNA, 22 nt, Salmonella typhimurium LT2
ugcuggacaccgacgauaacug

SEQ ID NO: 214799 - RNA, 22 nt, Salmonella typhimurium LT2
ucuguaucgccggcgguucaau

SEQ ID NO: 214800 - RNA, 22 nt, Salmonella typhimurium LT2
guuaucuucguugggcuggucg

SEQ ID NO: 214801 - RNA, 22 nt, Salmonella typhimurium LT2
gcauuacugcacgauccccuuu

SEQ ID NO: 214802 - RNA, 22 nt, Salmonella typhimurium LT2
gugcgcgugcgcgaugaacauc

SEQ ID NO: 214803 - RNA, 20 nt, Salmonella typhimurium LT2
ccgcguucauccaugcagaa

SEQ ID NO: 214804 - RNA, 22 nt, Salmonella typhimurium LT2
acauccgcuuuuccacggcccg

SEQ ID NO: 214805 - RNA, 22 nt, Salmonella typhimurium LT2
gcuguuaucaucaaggcguggc

SEQ ID NO: 214806 - RNA, 22 nt, Salmonella typhimurium LT2
guauuggcgaaguaggacuggc

SEQ ID NO: 214807 - RNA, 22 nt, Salmonella typhimurium LT2
ccugaacgguuuuauccagcga

SEQ ID NO: 214808 - RNA, 22 nt, Salmonella typhimurium LT2
uacggcagucucgauccugaau

SEQ ID NO: 214809 - RNA, 20 nt, Salmonella typhimurium LT2
gggcaugaagcacuauguug

SEQ ID NO: 214810 - RNA, 21 nt, Salmonella typhimurium LT2
gucagcgcuuuaucacgcgau

SEQ ID NO: 214811 - RNA, 22 nt, Salmonella typhimurium LT2
uugccaggccugcggcgcguua

SEQ ID NO: 214812 - RNA, 22 nt, Salmonella typhimurium LT2
acaaugcgggcacugaauacgc

SEQ ID NO: 214813 - RNA, 22 nt, Salmonella typhimurium LT2
gccugcgucuggacguggugaa

SEQ ID NO: 214814 - RNA, 22 nt, Salmonella typhimurium LT2
uaggccgacuguucaccacuac

SEQ ID NO: 214815 - RNA, 22 nt, Salmonella typhimurium LT2
ugccagccgcauugucgucgau

SEQ ID NO: 214816 - RNA, 22 nt, Salmonella typhimurium LT2
aaugcaguagucgcugcggagg

SEQ ID NO: 214817 - RNA, 22 nt, Salmonella typhimurium LT2
uuaucagucuacaaauuacuuu

SEQ ID NO: 214818 - RNA, 22 nt, Salmonella typhimurium LT2
ucugcguguuaacugcauuaac

SEQ ID NO: 214819 - RNA, 17 nt, Salmonella typhimurium LT2
ccagcgacaguaguauc

SEQ ID NO: 214820 - RNA, 22 nt, Salmonella typhimurium LT2
ugcguauagcauuuacgauguc

SEQ ID NO: 214821 - RNA, 22 nt, Salmonella typhimurium LT2
gcacagaugcagguagucgauc

SEQ ID NO: 214822 - RNA, 22 nt, Salmonella typhimurium LT2
gacaacguuauaucgccuccga

SEQ ID NO: 214823 - RNA, 22 nt, Salmonella typhimurium LT2
ccugaucccgaugguggauuuu

SEQ ID NO: 214824 - RNA, 22 nt, Salmonella typhimurium LT2
cgacgguuugcaaaugggugau

SEQ ID NO: 214825 - RNA, 22 nt, Salmonella typhimurium LT2
uuccgguauugguaaaucaggu

SEQ ID NO: 214826 - RNA, 22 nt, Salmonella typhimurium LT2
acauugagggcgaaaucucaua

SEQ ID NO: 214827 - RNA, 22 nt, Salmonella typhimurium LT2
aaacggugcgauaucggcuuca

SEQ ID NO: 214828 - RNA, 23 nt, Salmonella typhimurium LT2
uguggaacgccagccgcuuugug

SEQ ID NO: 214829 - RNA, 22 nt, Salmonella typhimurium LT2
auggcggcuucgccuuauccgg

SEQ ID NO: 214830 - RNA, 22 nt, Salmonella typhimurium LT2
cugaucgaggucguuacgcuca

SEQ ID NO: 214831 - RNA, 22 nt, Salmonella typhimurium LT2
aaaggcuuucuuuauaggaguc

SEQ ID NO: 214832 - RNA, 22 nt, Salmonella typhimurium LT2
ucgcugaugaaauccucuaugc

SEQ ID NO: 214833 - RNA, 22 nt, Salmonella typhimurium LT2
cuguguaugauucauccggaga

SEQ ID NO: 214834 - RNA, 22 nt, Salmonella typhimurium LT2
uucugcugauugccgcggcgcu

SEQ ID NO: 214835 - RNA, 22 nt, Salmonella typhimurium LT2
ggcgcuagaaaguuuucuaccg

SEQ ID NO: 214836 - RNA, 22 nt, Salmonella typhimurium LT2
agugauuauuacgcagcauaug

SEQ ID NO: 214837 - RNA, 22 nt, Salmonella typhimurium LT2
cuguugcaccaauguggugcuu

SEQ ID NO: 214838 - RNA, 22 nt, Salmonella typhimurium LT2
guaaugaugccuugcugugccg

SEQ ID NO: 214839 - RNA, 22 nt, Salmonella typhimurium LT2
cuggaagaagccacuauccaac

SEQ ID NO: 214840 - RNA, 22 nt, Salmonella typhimurium LT2
cgccaacgccgugggagguauc

SEQ ID NO: 214841 - RNA, 22 nt, Salmonella typhimurium LT2
cugauugccgccaacgucaacg

SEQ ID NO: 214842 - RNA, 22 nt, Salmonella typhimurium LT2
uacgacgcacuuuaugaggucc

SEQ ID NO: 214843 - RNA, 22 nt, Salmonella typhimurium LT2
uggaccgcaugggcgcgaacuu

SEQ ID NO: 214844 - RNA, 22 nt, Salmonella typhimurium LT2
gcggguauuugagcacggugug

SEQ ID NO: 214845 - RNA, 22 nt, Salmonella typhimurium LT2
aaguugauccgcccgugaucgg

SEQ ID NO: 214846 - RNA, 22 nt, Salmonella typhimurium LT2
aaaccagguugcgguugauggu

SEQ ID NO: 214847 - RNA, 22 nt, Salmonella typhimurium LT2
cuacgcuuaucaggccuacggg

SEQ ID NO: 214848 - RNA, 22 nt, Salmonella typhimurium LT2
acuuugcuaucggcucccaucc

SEQ ID NO: 214849 - RNA, 22 nt, Salmonella typhimurium LT2
cugcugcucaauaauacguuua

SEQ ID NO: 214850 - RNA, 22 nt, Salmonella typhimurium LT2
agaucucgaacacccgaucgaa

SEQ ID NO: 214851 - RNA, 22 nt, Salmonella typhimurium LT2
agcaaucgcaagcggaagcgcg

SEQ ID NO: 214852 - RNA, 22 nt, Salmonella typhimurium LT2
gccaugaaggaugacuaugugg

SEQ ID NO: 214853 - RNA, 22 nt, Salmonella typhimurium LT2
gugcgcuguauauuaccuuuau

SEQ ID NO: 214854 - RNA, 22 nt, Salmonella typhimurium LT2
gucagcaacauguucagcgcgg

SEQ ID NO: 214855 - RNA, 22 nt, Salmonella typhimurium LT2
guccagcagguggucgccauau

SEQ ID NO: 214856 - RNA, 22 nt, Salmonella typhimurium LT2
cauagcauaacaaagaugcgaa

SEQ ID NO: 214857 - RNA, 22 nt, Salmonella typhimurium LT2
cugauucgcuacuuucgccuuu

SEQ ID NO: 214858 - RNA, 22 nt, Salmonella typhimurium LT2
acggugauuaucgacgcgguca

SEQ ID NO: 214859 - RNA, 22 nt, Salmonella typhimurium LT2
cugugagacggcggauugcgug

SEQ ID NO: 214860 - RNA, 22 nt, Salmonella typhimurium LT2
uggcaacgucauaggcggcuuu

SEQ ID NO: 214861 - RNA, 22 nt, Salmonella typhimurium LT2
gauuguauuuguacaccaauug

SEQ ID NO: 214862 - RNA, 22 nt, Salmonella typhimurium LT2
gauuuacuacgggaagauuucg

SEQ ID NO: 214863 - RNA, 22 nt, Salmonella typhimurium LT2
aucgcgcucgucagauccugac

SEQ ID NO: 214864 - RNA, 22 nt, Salmonella typhimurium LT2
gacgaacuuauucguucgcaaa

SEQ ID NO: 214865 - RNA, 22 nt, Salmonella typhimurium LT2
ugaacuggaagccgacauuuau

SEQ ID NO: 214866 - RNA, 20 nt, Salmonella typhimurium LT2
ggcaucgcucuccauuggca

SEQ ID NO: 214867 - RNA, 22 nt, Salmonella typhimurium LT2
ugccgcuaucacccacggcgau

SEQ ID NO: 214868 - RNA, 22 nt, Salmonella typhimurium LT2
gucgcguggcgcgaucgauccc

SEQ ID NO: 214869 - RNA, 22 nt, Salmonella typhimurium LT2
ugcaggucggguaagcguauug

SEQ ID NO: 214870 - RNA, 22 nt, Salmonella typhimurium LT2
agcgcaccauuuauaaaaagua

SEQ ID NO: 214871 - RNA, 22 nt, Salmonella typhimurium LT2
cuaacgcuuaugcugccuacaa

SEQ ID NO: 214872 - RNA, 22 nt, Salmonella typhimurium LT2
ucgaacagugccccguuuuggc

SEQ ID NO: 214873 - RNA, 22 nt, Salmonella typhimurium LT2
ugugcaaagacugauagccguu

SEQ ID NO: 214874 - RNA, 22 nt, Salmonella typhimurium LT2
gcgcugcugaaaucaacgauac

SEQ ID NO: 214875 - RNA, 22 nt, Salmonella typhimurium LT2
cagaugagcuucccgcuauuug

SEQ ID NO: 214876 - RNA, 22 nt, Salmonella typhimurium LT2
uucacauugucagacacaugaa

SEQ ID NO: 214877 - RNA, 22 nt, Salmonella typhimurium LT2
agcggguuuuaccauuaccgau

SEQ ID NO: 214878 - RNA, 22 nt, Salmonella typhimurium LT2
acuguggaauaaagguuagcgc

SEQ ID NO: 214879 - RNA, 22 nt, Salmonella typhimurium LT2
auggcggcuccgccuuauccgg

SEQ ID NO: 214880 - RNA, 22 nt, Salmonella typhimurium LT2
uugaggaugacgacggccaucg

SEQ ID NO: 214881 - RNA, 22 nt, Salmonella typhimurium LT2
cgggucgaggaucgccauaucc

SEQ ID NO: 214882 - RNA, 22 nt, Salmonella typhimurium LT2
cauccugagaggcuugcaguga

SEQ ID NO: 214883 - RNA, 22 nt, Salmonella typhimurium LT2
auucgcgcaucgcgucgagcag

SEQ ID NO: 214884 - RNA, 22 nt, Salmonella typhimurium LT2
cgccugguuuuauagccguauu

SEQ ID NO: 214885 - RNA, 22 nt, Salmonella typhimurium LT2
ggcauuaugcgguauuauaucu

SEQ ID NO: 214886 - RNA, 22 nt, Salmonella typhimurium LT2
acggacagcguuuacugaaugc

SEQ ID NO: 214887 - RNA, 22 nt, Salmonella typhimurium LT2
cgugaacaaacugcuguuucuc

SEQ ID NO: 214888 - RNA, 22 nt, Salmonella typhimurium LT2
aauguucacugccguuauuaug

SEQ ID NO: 214889 - RNA, 22 nt, Salmonella typhimurium LT2
agcgauauccccuaucgccacg

SEQ ID NO: 214890 - RNA, 22 nt, Salmonella typhimurium LT2
cucauuuagcgcucgcguuuug

SEQ ID NO: 214891 - RNA, 22 nt, Salmonella typhimurium LT2
ugguaggccggauaaggcguuc

SEQ ID NO: 214892 - RNA, 22 nt, Salmonella typhimurium LT2
ggguaucgacaccaucauauug

SEQ ID NO: 214893 - RNA, 22 nt, Salmonella typhimurium LT2
auccgcuaaccguauacggacc

SEQ ID NO: 214894 - RNA, 21 nt, Salmonella typhimurium LT2
caucgauagggaucaccacau

SEQ ID NO: 214895 - RNA, 22 nt, Salmonella typhimurium LT2
gaaugaugcaggugcuggcgga

SEQ ID NO: 214896 - RNA, 22 nt, Salmonella typhimurium LT2
ugugaccauuaucgggcaauca

SEQ ID NO: 214897 - RNA, 22 nt, Salmonella typhimurium LT2
ugcggccuggugguugaaggcg

SEQ ID NO: 214898 - RNA, 20 nt, Salmonella typhimurium LT2
uccgucgaucauuauugacc

SEQ ID NO: 214899 - RNA, 22 nt, Salmonella typhimurium LT2
gcuaccaacauccaguccgucg

SEQ ID NO: 214900 - RNA, 22 nt, Salmonella typhimurium LT2
guuacgcgccaucaggcaaaac

SEQ ID NO: 214901 - RNA, 22 nt, Salmonella typhimurium LT2
gcgcguuuacccagcucaaacu

SEQ ID NO: 214902 - RNA, 22 nt, Salmonella typhimurium LT2
cgucaaguugcaacugauauuc

SEQ ID NO: 214903 - RNA, 19 nt, Salmonella typhimurium LT2
gcuucggugugccgacgcu

SEQ ID NO: 214904 - RNA, 22 nt, Salmonella typhimurium LT2
uauccggauggauagacucaag

SEQ ID NO: 214905 - RNA, 22 nt, Salmonella typhimurium LT2
uugaacaagaguugcuugauaa

SEQ ID NO: 214906 - RNA, 22 nt, Salmonella typhimurium LT2
ggugacggggcgugagcaugaa

SEQ ID NO: 214907 - RNA, 22 nt, Salmonella typhimurium LT2
gaguuuaucuucaacagugaaa

SEQ ID NO: 214908 - RNA, 22 nt, Salmonella typhimurium LT2
aaccaggaaucguuaacgucgg

SEQ ID NO: 214909 - RNA, 22 nt, Salmonella typhimurium LT2
acgcccugcuucagggcauggg

SEQ ID NO: 214910 - RNA, 22 nt, Salmonella typhimurium LT2
gaugccgguucgucaaagguag

SEQ ID NO: 214911 - RNA, 22 nt, Salmonella typhimurium LT2
aucgccaucguguuaauacuca

SEQ ID NO: 214912 - RNA, 22 nt, Salmonella typhimurium LT2
gcuacgccuuacccggccuaca

SEQ ID NO: 214913 - RNA, 22 nt, Salmonella typhimurium LT2
gccaauaaguuggucugacuua

SEQ ID NO: 214914 - RNA, 22 nt, Salmonella typhimurium LT2
gauggugaugaccgucaaugcc

SEQ ID NO: 214915 - RNA, 21 nt, Salmonella typhimurium LT2
cacagcaugcgucucagaaug

SEQ ID NO: 214916 - RNA, 22 nt, Salmonella typhimurium LT2
uuucaugcauuggacagcacgc

SEQ ID NO: 214917 - RNA, 22 nt, Salmonella typhimurium LT2
auucgcaaugagaguuugguag

SEQ ID NO: 214918 - RNA, 22 nt, Salmonella typhimurium LT2
aaagugccauugcaaucgcgug

SEQ ID NO: 214919 - RNA, 20 nt, Salmonella typhimurium LT2
uugcugacugguaggcguga

SEQ ID NO: 214920 - RNA, 22 nt, Salmonella typhimurium LT2
cagcuuaagugguggaggauag

SEQ ID NO: 214921 - RNA, 22 nt, Salmonella typhimurium LT2
gcgguuaucgccgggcuaccga

SEQ ID NO: 214922 - RNA, 22 nt, Salmonella typhimurium LT2
uuucauuguuguggaaccgcuu

SEQ ID NO: 214923 - RNA, 22 nt, Salmonella typhimurium LT2
uguaggccggacaaggcguuca

SEQ ID NO: 214924 - RNA, 22 nt, Salmonella typhimurium LT2
uucgguauggcaugaugcggaa

SEQ ID NO: 214925 - RNA, 22 nt, Salmonella typhimurium LT2
ugacgcugaaguugcugccgca

SEQ ID NO: 214926 - RNA, 22 nt, Salmonella typhimurium LT2
aaccugcugugcagccacggua

SEQ ID NO: 214927 - RNA, 22 nt, Salmonella typhimurium LT2
cuggaagucaugggcauuuaug

SEQ ID NO: 214928 - RNA, 22 nt, Salmonella typhimurium LT2
uucgugagcuacgucaaaaugu

SEQ ID NO: 214929 - RNA, 22 nt, Salmonella typhimurium LT2
uccgccaugauccaggcgugau

SEQ ID NO: 214930 - RNA, 22 nt, Salmonella typhimurium LT2
gccaucgcgcgacaaucgggua

SEQ ID NO: 214931 - RNA, 22 nt, Salmonella typhimurium LT2
auggcgcgaaacuauccgcaac

SEQ ID NO: 214932 - RNA, 22 nt, Salmonella typhimurium LT2
uugccggcgagaugauggcagg

SEQ ID NO: 214933 - RNA, 22 nt, Salmonella typhimurium LT2
gauucaauugaagcgauaaaaa

SEQ ID NO: 214934 - RNA, 22 nt, Salmonella typhimurium LT2
cgucugaccggaugaugcguuu

SEQ ID NO: 214935 - RNA, 23 nt, Salmonella typhimurium LT2
aauccgucgcugucguuauacac

SEQ ID NO: 214936 - RNA, 22 nt, Salmonella typhimurium LT2
uuaccgaugagguggucgcgca

SEQ ID NO: 214937 - RNA, 22 nt, Salmonella typhimurium LT2
auaucggcaaugucauaaacaa

SEQ ID NO: 214938 - RNA, 22 nt, Salmonella typhimurium LT2
gcgguacgcgcccccgccagag

SEQ ID NO: 214939 - RNA, 22 nt, Salmonella typhimurium LT2
gcguugacgagucgcugauucu

SEQ ID NO: 214940 - RNA, 22 nt, Salmonella typhimurium LT2
gaaugacgcugcgcuuauucgg

SEQ ID NO: 214941 - RNA, 22 nt, Salmonella typhimurium LT2
cgccugcugaauuugggcgaac

SEQ ID NO: 214942 - RNA, 22 nt, Salmonella typhimurium LT2
aauggcggccaggaagcgauag

SEQ ID NO: 214943 - RNA, 22 nt, Salmonella typhimurium LT2
uggcgcugaugaaacgcauucu

SEQ ID NO: 214944 - RNA, 22 nt, Salmonella typhimurium LT2
gguggcaacggacgcuucuuuc

SEQ ID NO: 214945 - RNA, 23 nt, Salmonella typhimurium LT2
uugacgagguuuaccgcgccugc

SEQ ID NO: 214946 - RNA, 22 nt, Salmonella typhimurium LT2
ggaagccaaagccuuuuuccgu

SEQ ID NO: 214947 - RNA, 22 nt, Salmonella typhimurium LT2
aaugaacagugaugaaaacgag

SEQ ID NO: 214948 - RNA, 22 nt, Salmonella typhimurium LT2
ccggucaguuccacaccguuag

SEQ ID NO: 214949 - RNA, 22 nt, Salmonella typhimurium LT2
gcugauaagcaggugaucggcc

SEQ ID NO: 214950 - RNA, 22 nt, Salmonella typhimurium LT2
cgucggugauguucaucaucga

SEQ ID NO: 214951 - RNA, 20 nt, Salmonella typhimurium LT2
gcgaugagugggauagccag

SEQ ID NO: 214952 - RNA, 22 nt, Salmonella typhimurium LT2
ccuguuggaaguaccaggcgug

SEQ ID NO: 214953 - RNA, 22 nt, Salmonella typhimurium LT2
agcgauaaccugcugaugauca

SEQ ID NO: 214954 - RNA, 22 nt, Salmonella typhimurium LT2
uggcgaagauagcgguacuguu

SEQ ID NO: 214955 - RNA, 22 nt, Salmonella typhimurium LT2
gccgugagauguucgcguucuu

SEQ ID NO: 214956 - RNA, 22 nt, Salmonella typhimurium LT2
uaccugugcuggcgcugaccgc

SEQ ID NO: 214957 - RNA, 22 nt, Salmonella typhimurium LT2
uagcccuguuguuuuuucaugu

SEQ ID NO: 214958 - RNA, 22 nt, Salmonella typhimurium LT2
gaugcuggaugaauuacgcagc

SEQ ID NO: 214959 - RNA, 22 nt, Salmonella typhimurium LT2
uauaggcgcuaagcugauccgg

SEQ ID NO: 214960 - RNA, 22 nt, Salmonella typhimurium LT2
gucguaccacaauuagcguauu

SEQ ID NO: 214961 - RNA, 22 nt, Salmonella typhimurium LT2
auugacgccgaugugauggagu

SEQ ID NO: 214962 - RNA, 22 nt, Salmonella typhimurium LT2
augacaacauuaaaugggagaa

SEQ ID NO: 214963 - RNA, 22 nt, Salmonella typhimurium LT2
uacaaacggcgguauaacauga

SEQ ID NO: 214964 - RNA, 22 nt, Salmonella typhimurium LT2
agaacgcacggucagcauugau

SEQ ID NO: 214965 - RNA, 22 nt, Salmonella typhimurium LT2
cacuggugaaaucgccuuccgg

SEQ ID NO: 214966 - RNA, 22 nt, Salmonella typhimurium LT2
ugucugaacggagaaaaggugc

SEQ ID NO: 214967 - RNA, 22 nt, Salmonella typhimurium LT2
agucaggaucugacgagcgcga

SEQ ID NO: 214968 - RNA, 22 nt, Salmonella typhimurium LT2
uucaaacugauaacaauguggg

SEQ ID NO: 214969 - RNA, 22 nt, Salmonella typhimurium LT2
aucgcggagaagucgacuucga

SEQ ID NO: 214970 - RNA, 22 nt, Salmonella typhimurium LT2
aauaccugccggauaacccgaa

SEQ ID NO: 214971 - RNA, 22 nt, Salmonella typhimurium LT2
gccugugggugaauccggacug

SEQ ID NO: 214972 - RNA, 22 nt, Salmonella typhimurium LT2
ucacuggaguaugaaacaaucg

SEQ ID NO: 214973 - RNA, 22 nt, Salmonella typhimurium LT2
auccggacgacuuacagcgggu

SEQ ID NO: 214974 - RNA, 22 nt, Salmonella typhimurium LT2
uugccggucauccaagccgcaa

SEQ ID NO: 214975 - RNA, 22 nt, Salmonella typhimurium LT2
ucuguaggccggauaaggcgga

SEQ ID NO: 214976 - RNA, 22 nt, Salmonella typhimurium LT2
cauucuuaccucuaugcacaau

SEQ ID NO: 214977 - RNA, 22 nt, Salmonella typhimurium LT2
ugaacgccuuguccggccuaca

SEQ ID NO: 214978 - RNA, 22 nt, Salmonella typhimurium LT2
aacgcugugucaugccgguauu

SEQ ID NO: 214979 - RNA, 22 nt, Salmonella typhimurium LT2
aacgcgcagauuaaucugguga

SEQ ID NO: 214980 - RNA, 22 nt, Salmonella typhimurium LT2
uacaggccggauaaggcgcagc

SEQ ID NO: 214981 - RNA, 22 nt, Salmonella typhimurium LT2
gucgcugguaaagaugacgaug

SEQ ID NO: 214982 - RNA, 22 nt, Salmonella typhimurium LT2
ugacgcgccugcgcuaccgcug

SEQ ID NO: 214983 - RNA, 22 nt, Salmonella typhimurium LT2
ucaacgugaaugucccggaucu

SEQ ID NO: 214984 - RNA, 22 nt, Salmonella typhimurium LT2
cagcgaggcaccaucauugaaa

SEQ ID NO: 214985 - RNA, 22 nt, Salmonella typhimurium LT2
gcgcuuuaacagcagccgaggu

SEQ ID NO: 214986 - RNA, 22 nt, Salmonella typhimurium LT2
aguguccgggcaccgaaguacg

SEQ ID NO: 214987 - RNA, 22 nt, Salmonella typhimurium LT2
augugggauuacuucgauggga

SEQ ID NO: 214988 - RNA, 22 nt, Salmonella typhimurium LT2
cuuacguaaaacugcgcauggc

SEQ ID NO: 214989 - RNA, 22 nt, Salmonella typhimurium LT2
gauacucaguugcggccauacg

SEQ ID NO: 214990 - RNA, 22 nt, Salmonella typhimurium LT2
ugcgcuagaaaguuuucuaccg

SEQ ID NO: 214991 - RNA, 22 nt, Salmonella typhimurium LT2
ugacgacgccagguuuuccagu

SEQ ID NO: 214992 - RNA, 22 nt, Salmonella typhimurium LT2
aaacgcaucgguaugauugcgc

SEQ ID NO: 214993 - RNA, 22 nt, Salmonella typhimurium LT2
uauuccggugaucuuugucucc

SEQ ID NO: 214994 - RNA, 22 nt, Salmonella typhimurium LT2
ucaccgagaguauguuuaagcg

SEQ ID NO: 214995 - RNA, 22 nt, Salmonella typhimurium LT2
cgauagagcaacugguucuggu

SEQ ID NO: 214996 - RNA, 22 nt, Salmonella typhimurium LT2
gcaucagcaaaaugggaucggc

SEQ ID NO: 214997 - RNA, 22 nt, Salmonella typhimurium LT2
ggcgcugaacugaacgaugaag

SEQ ID NO: 214998 - RNA, 22 nt, Salmonella typhimurium LT2
uggcugaaugaagccuuagcgg

SEQ ID NO: 214999 - RNA, 22 nt, Salmonella typhimurium LT2
aauggcugcuguaucgugccca

SEQ ID NO: 215000 - RNA, 22 nt, Salmonella typhimurium LT2
gaaugccgaaugacgggccuac

SEQ ID NO: 215001 - RNA, 22 nt, Salmonella typhimurium LT2
aucaucgccuucaucuucaugu

SEQ ID NO: 215002 - RNA, 22 nt, Salmonella typhimurium LT2
cgcgaugaucggcugguuuggc

SEQ ID NO: 215003 - RNA, 22 nt, Salmonella typhimurium LT2
uacgggcugcaugacaucgcca

SEQ ID NO: 215004 - RNA, 22 nt, Salmonella typhimurium LT2
agaaucauucuugucuuucgca

SEQ ID NO: 215005 - RNA, 22 nt, Salmonella typhimurium LT2
acuggcggauuagcgaaggcac

SEQ ID NO: 215006 - RNA, 22 nt, Salmonella typhimurium LT2
gacgucugaaaucgugaccugg

SEQ ID NO: 215007 - RNA, 22 nt, Salmonella typhimurium LT2
augugucuggcuuugagcuggc

SEQ ID NO: 215008 - RNA, 22 nt, Salmonella typhimurium LT2
aaugagauggccgcguuggguu

SEQ ID NO: 215009 - RNA, 22 nt, Salmonella typhimurium LT2
agagguucaugaugcgccugca

SEQ ID NO: 215010 - RNA, 22 nt, Salmonella typhimurium LT2
augagauuaauacacuggagau

SEQ ID NO: 215011 - RNA, 22 nt, Salmonella typhimurium LT2
caacggcauaggugugguccug

SEQ ID NO: 215012 - RNA, 22 nt, Salmonella typhimurium LT2
gccugucccgucagcuuugguc

SEQ ID NO: 215013 - RNA, 17 nt, Salmonella typhimurium LT2
cacagagaauauauuuu

SEQ ID NO: 215014 - RNA, 22 nt, Salmonella typhimurium LT2
cagguuguugggauguuucaga

SEQ ID NO: 215015 - RNA, 22 nt, Salmonella typhimurium LT2
uaccgccguguuuuucauaaaa

SEQ ID NO: 215016 - RNA, 22 nt, Salmonella typhimurium LT2
cugguggcuuuccgggcagccg

SEQ ID NO: 215017 - RNA, 22 nt, Salmonella typhimurium LT2
aagaucggucggcgccuuaugu

SEQ ID NO: 215018 - RNA, 22 nt, Salmonella typhimurium LT2
gucauuuaugauaagcguuugu

SEQ ID NO: 215019 - RNA, 22 nt, Salmonella typhimurium LT2
ugaggugauuaaaaucauuaug

SEQ ID NO: 215020 - RNA, 22 nt, Salmonella typhimurium LT2
ucucguuggugguucuuagcau

SEQ ID NO: 215021 - RNA, 18 nt, Salmonella typhimurium LT2
cuggcaguagugaaagua

SEQ ID NO: 215022 - RNA, 22 nt, Salmonella typhimurium LT2
ucaguacgaucugauugucacu

SEQ ID NO: 215023 - RNA, 22 nt, Salmonella typhimurium LT2
ucagcgcguuuuuuuaucuauu

SEQ ID NO: 215024 - RNA, 22 nt, Salmonella typhimurium LT2
uggaucauucugaacgcgauuu

SEQ ID NO: 215025 - RNA, 22 nt, Salmonella typhimurium LT2
uggccuggaguaauucgcugau

SEQ ID NO: 215026 - RNA, 22 nt, Salmonella typhimurium LT2
cagcgcuuucguuaacaacgcg

SEQ ID NO: 215027 - RNA, 22 nt, Salmonella typhimurium LT2
agauucauguaugauugccggg

SEQ ID NO: 215028 - RNA, 22 nt, Salmonella typhimurium LT2
gcacugcugguguuaaugcugg

SEQ ID NO: 215029 - RNA, 22 nt, Salmonella typhimurium LT2
guuguacuugucuggucaauaa

SEQ ID NO: 215030 - RNA, 20 nt, Salmonella typhimurium LT2
gcgucaugcggcugcguuuc

SEQ ID NO: 215031 - RNA, 22 nt, Salmonella typhimurium LT2
uuugccgucuggcuggcccugu

SEQ ID NO: 215032 - RNA, 18 nt, Salmonella typhimurium LT2
ugcaggaacugguuauuc

SEQ ID NO: 215033 - RNA, 20 nt, Salmonella typhimurium LT2
accagccuggggcggcgcug

SEQ ID NO: 215034 - RNA, 22 nt, Salmonella typhimurium LT2
aguuuaucuuucaggcguucaa

SEQ ID NO: 215035 - RNA, 22 nt, Salmonella typhimurium LT2
uaggcgugcccgcgcaggccuc

SEQ ID NO: 215036 - RNA, 22 nt, Salmonella typhimurium LT2
agccgguuucccgggcgcggaa

SEQ ID NO: 215037 - RNA, 22 nt, Salmonella typhimurium LT2
uuccugacgauccgacgggcga

SEQ ID NO: 215038 - RNA, 17 nt, Salmonella typhimurium LT2
aucggcauauaggaaug

SEQ ID NO: 215039 - RNA, 22 nt, Salmonella typhimurium LT2
gaucagcuuaaagggauuauca

SEQ ID NO: 215040 - RNA, 23 nt, Salmonella typhimurium LT2
cgcuggaugauuuuugucagagc

SEQ ID NO: 215041 - RNA, 22 nt, Salmonella typhimurium LT2
ucauuacccgugaugaagaugc

SEQ ID NO: 215042 - RNA, 22 nt, Salmonella typhimurium LT2
cagucgcuggaugacaacgcgc

SEQ ID NO: 215043 - RNA, 22 nt, Salmonella typhimurium LT2
uuucgguaauggcgugcgaaaa

SEQ ID NO: 215044 - RNA, 21 nt, Salmonella typhimurium LT2
ugggaucuucucaucgaacgg

SEQ ID NO: 215045 - RNA, 22 nt, Salmonella typhimurium LT2
gacaauauucagcguaaagaag

SEQ ID NO: 215046 - RNA, 22 nt, Salmonella typhimurium LT2
caggcaagggaagaagugagga

SEQ ID NO: 215047 - RNA, 22 nt, Salmonella typhimurium LT2
ugcugguaugacgcgccguuaa

SEQ ID NO: 215048 - RNA, 19 nt, Salmonella typhimurium LT2
gagauacacagcguuuacc

SEQ ID NO: 215049 - RNA, 22 nt, Salmonella typhimurium LT2
acuggucacuauuuuugucacc

SEQ ID NO: 215050 - RNA, 22 nt, Salmonella typhimurium LT2
agugccggggauuaccgcggcu

SEQ ID NO: 215051 - RNA, 22 nt, Salmonella typhimurium LT2
agcgcgguaucgcugagcuccu

SEQ ID NO: 215052 - RNA, 22 nt, Salmonella typhimurium LT2
acucuugagauuugguauucau

SEQ ID NO: 215053 - RNA, 22 nt, Salmonella typhimurium LT2
aaucuggggcguuaucgcgggu

SEQ ID NO: 215054 - RNA, 22 nt, Salmonella typhimurium LT2
uugcaaauauuguaggccggau

SEQ ID NO: 215055 - RNA, 20 nt, Salmonella typhimurium LT2
agcugcugcgcuuuccaggc

SEQ ID NO: 215056 - RNA, 22 nt, Salmonella typhimurium LT2
uaguugccgccguuuugccgcu

SEQ ID NO: 215057 - RNA, 22 nt, Salmonella typhimurium LT2
acgcguugcugaaccgguagau

SEQ ID NO: 215058 - RNA, 22 nt, Salmonella typhimurium LT2
cuggaacuuuguaguagcgauc

SEQ ID NO: 215059 - RNA, 19 nt, Salmonella typhimurium LT2
caauaucggcgucgaaucc

SEQ ID NO: 215060 - RNA, 22 nt, Salmonella typhimurium LT2
uuuaucagcuuguugagaagau

SEQ ID NO: 215061 - RNA, 22 nt, Salmonella typhimurium LT2
uacagggcuguagcaggcgucg

SEQ ID NO: 215062 - RNA, 22 nt, Salmonella typhimurium LT2
ugacgcguauuguuguucgggu

SEQ ID NO: 215063 - RNA, 22 nt, Salmonella typhimurium LT2
uguaggccggauaagacgcguc

SEQ ID NO: 215064 - RNA, 22 nt, Salmonella typhimurium LT2
ugucgcuuugaugaccuuugcg

SEQ ID NO: 215065 - RNA, 22 nt, Salmonella typhimurium LT2
ucgccgcuggaucugcgccgaa

SEQ ID NO: 215066 - RNA, 22 nt, Salmonella typhimurium LT2
ugggcauuuugcacaagaaauu

SEQ ID NO: 215067 - RNA, 22 nt, Salmonella typhimurium LT2
cacagaauuaacguugggaauu

SEQ ID NO: 215068 - RNA, 22 nt, Salmonella typhimurium LT2
aguuggcgcaguuggaauuccg

SEQ ID NO: 215069 - RNA, 22 nt, Salmonella typhimurium LT2
ccgaucccuuuuuugaugccgc

SEQ ID NO: 215070 - RNA, 22 nt, Salmonella typhimurium LT2
ugcgccacgauauccaugguug

SEQ ID NO: 215071 - RNA, 22 nt, Salmonella typhimurium LT2
gagcuggacgaucugaucauuc

SEQ ID NO: 215072 - RNA, 22 nt, Salmonella typhimurium LT2
cggacuugauccauucuggcgc

SEQ ID NO: 215073 - RNA, 22 nt, Salmonella typhimurium LT2
gucugcuaugcagccggucgau

SEQ ID NO: 215074 - RNA, 22 nt, Salmonella typhimurium LT2
aaguucagcuucagaagcugga

SEQ ID NO: 215075 - RNA, 22 nt, Salmonella typhimurium LT2
ccggauaaggcggagccgccau

SEQ ID NO: 215076 - RNA, 22 nt, Salmonella typhimurium LT2
ucaccgucggcucggcggcgua

SEQ ID NO: 215077 - RNA, 17 nt, Salmonella typhimurium LT2
cguagggcacaaugaaa

SEQ ID NO: 215078 - RNA, 22 nt, Salmonella typhimurium LT2
cgcaggaauacauaggacacca

SEQ ID NO: 215079 - RNA, 22 nt, Salmonella typhimurium LT2
gugacgauugucaucccaauaa

SEQ ID NO: 215080 - RNA, 22 nt, Salmonella typhimurium LT2
uauccgcagauccagcacggcc

SEQ ID NO: 215081 - RNA, 22 nt, Salmonella typhimurium LT2
ucgugaaauacaucaagcgucu

SEQ ID NO: 215082 - RNA, 22 nt, Salmonella typhimurium LT2
auugcuuaucuacuuauuccgc

SEQ ID NO: 215083 - RNA, 22 nt, Salmonella typhimurium LT2
gcugccuuauccggccuacaag

SEQ ID NO: 215084 - RNA, 22 nt, Salmonella typhimurium LT2
cgaugggcguagagacgcgcgg

SEQ ID NO: 215085 - RNA, 22 nt, Salmonella typhimurium LT2
uugcgcauccaguuccugacgg

SEQ ID NO: 215086 - RNA, 22 nt, Salmonella typhimurium LT2
uccggcuuuuuuauaucaggca

SEQ ID NO: 215087 - RNA, 22 nt, Salmonella typhimurium LT2
cguguaggccugguaagcgcag

SEQ ID NO: 215088 - RNA, 22 nt, Salmonella typhimurium LT2
gucaguaucgcgcaguuuggcg

SEQ ID NO: 215089 - RNA, 22 nt, Salmonella typhimurium LT2
ucagcgcuuucacuuccugguc

SEQ ID NO: 215090 - RNA, 22 nt, Salmonella typhimurium LT2
gcgcuugaugcgaagcggcaua

SEQ ID NO: 215091 - RNA, 22 nt, Salmonella typhimurium LT2
aucgccaggggaaaauugucgc

SEQ ID NO: 215092 - RNA, 22 nt, Salmonella typhimurium LT2
uacguaugggguaugaggcggu

SEQ ID NO: 215093 - RNA, 19 nt, Salmonella typhimurium LT2
ucgaacgcugcgaauuuau

SEQ ID NO: 215094 - RNA, 22 nt, Salmonella typhimurium LT2
cggcuguaugacgcggugcaau

SEQ ID NO: 215095 - RNA, 22 nt, Salmonella typhimurium LT2
ccgugaauaaagaggccaucau

SEQ ID NO: 215096 - RNA, 22 nt, Salmonella typhimurium LT2
gccauugaccaccgauaucgcg

SEQ ID NO: 215097 - RNA, 22 nt, Salmonella typhimurium LT2
gccacgcucagucuucacggau

SEQ ID NO: 215098 - RNA, 22 nt, Salmonella typhimurium LT2
aaucgguggugcccaaagcauu

SEQ ID NO: 215099 - RNA, 22 nt, Salmonella typhimurium LT2
aacgugaugauacagaauggug

SEQ ID NO: 215100 - RNA, 22 nt, Salmonella typhimurium LT2
ucacgcggccgugcagcagugg

SEQ ID NO: 215101 - RNA, 22 nt, Salmonella typhimurium LT2
auuccaggaauaaguauccaga

SEQ ID NO: 215102 - RNA, 22 nt, Salmonella typhimurium LT2
ccggccuacucacugcaacgcg

SEQ ID NO: 215103 - RNA, 22 nt, Salmonella typhimurium LT2
acaaauucgccaggcuaauagu

SEQ ID NO: 215104 - RNA, 22 nt, Salmonella typhimurium LT2
gcucgacuggacggacagacau

SEQ ID NO: 215105 - RNA, 22 nt, Salmonella typhimurium LT2
aacguguaggccugguaagcga

SEQ ID NO: 215106 - RNA, 22 nt, Salmonella typhimurium LT2
ugggcuuaaugccguagagucu

SEQ ID NO: 215107 - RNA, 23 nt, Salmonella typhimurium LT2
gccauggcgggacacagucuaug

SEQ ID NO: 215108 - RNA, 18 nt, Salmonella typhimurium LT2
uucugcugcgccgucgcc

SEQ ID NO: 215109 - RNA, 22 nt, Salmonella typhimurium LT2
uggaugaacuuuguaugaucuc

SEQ ID NO: 215110 - RNA, 21 nt, Salmonella typhimurium LT2
ccguucugaggauuuucuccg

SEQ ID NO: 215111 - RNA, 22 nt, Salmonella typhimurium LT2
ccuguguccugugcgguaaucu

SEQ ID NO: 215112 - RNA, 22 nt, Salmonella typhimurium LT2
auguugagcagcuuucgcuguu

SEQ ID NO: 215113 - RNA, 23 nt, Salmonella typhimurium LT2
gcgcuucaggaacagcaguccgg

SEQ ID NO: 215114 - RNA, 19 nt, Salmonella typhimurium LT2
gacgcggauaaucaugcua

SEQ ID NO: 215115 - RNA, 22 nt, Salmonella typhimurium LT2
aucgcagauagcaaaaaagcgc

SEQ ID NO: 215116 - RNA, 21 nt, Salmonella typhimurium LT2
gcgucgucgaugaucuucgcc

SEQ ID NO: 215117 - RNA, 22 nt, Salmonella typhimurium LT2
ugauugaagccgaugccgguga

SEQ ID NO: 215118 - RNA, 22 nt, Salmonella typhimurium LT2
acguuucucaaccuaugcgauu

SEQ ID NO: 215119 - RNA, 22 nt, Salmonella typhimurium LT2
uguaggccggguaaggcguagc

SEQ ID NO: 215120 - RNA, 22 nt, Salmonella typhimurium LT2
accugguugggauaaaaaagcg

SEQ ID NO: 215121 - RNA, 22 nt, Salmonella typhimurium LT2
uuccaggcuucuauguuggcuu

SEQ ID NO: 215122 - RNA, 22 nt, Salmonella typhimurium LT2
agcagaugaaugugcggauggu

SEQ ID NO: 215123 - RNA, 22 nt, Salmonella typhimurium LT2
aagcgucuggaagguuaccgua

SEQ ID NO: 215124 - RNA, 20 nt, Salmonella typhimurium LT2
ugcugcauaaagggaugagc

SEQ ID NO: 215125 - RNA, 22 nt, Salmonella typhimurium LT2
gcguuuccggccuggaugcguu

SEQ ID NO: 215126 - RNA, 22 nt, Salmonella typhimurium LT2
uccgacaugugcugcaaccgcu

SEQ ID NO: 215127 - RNA, 22 nt, Salmonella typhimurium LT2
cugcgguucaggccaguuguua

SEQ ID NO: 215128 - RNA, 22 nt, Salmonella typhimurium LT2
cgucaugguauugauggcgccu

SEQ ID NO: 215129 - RNA, 22 nt, Salmonella typhimurium LT2
gauaaggcguucacgccgccau

SEQ ID NO: 215130 - RNA, 22 nt, Salmonella typhimurium LT2
aggccgugcuggaucugcggau

SEQ ID NO: 215131 - RNA, 19 nt, Salmonella typhimurium LT2
gcggcuuuuguagauauug

SEQ ID NO: 215132 - RNA, 22 nt, Salmonella typhimurium LT2
agcaguuuaauaagguucuggc

SEQ ID NO: 215133 - RNA, 22 nt, Salmonella typhimurium LT2
cugucgcguuaaaacugggucu

SEQ ID NO: 215134 - RNA, 22 nt, Salmonella typhimurium LT2
cgacauggucacgaugauuauu

SEQ ID NO: 215135 - RNA, 22 nt, Salmonella typhimurium LT2
ucacgguaagaggagucaggua

SEQ ID NO: 215136 - RNA, 22 nt, Salmonella typhimurium LT2
uccagcuaccucgcggaucguc

SEQ ID NO: 215137 - RNA, 20 nt, Salmonella typhimurium LT2
uucacgcccggcaguuugcc

SEQ ID NO: 215138 - RNA, 22 nt, Salmonella typhimurium LT2
ucgucaauguucgguuccuggg

SEQ ID NO: 215139 - RNA, 22 nt, Salmonella typhimurium LT2
augccgcguaaagcacgaacgg

SEQ ID NO: 215140 - RNA, 22 nt, Salmonella typhimurium LT2
uggcgcugcgcuuaucaggccu

SEQ ID NO: 215141 - RNA, 22 nt, Salmonella typhimurium LT2
caacaguauuagccacggcauu

SEQ ID NO: 215142 - RNA, 21 nt, Salmonella typhimurium LT2
uuauccggccuacaaacccaa

SEQ ID NO: 215143 - RNA, 19 nt, Salmonella typhimurium LT2
gucgauggcaaauuugugc

SEQ ID NO: 215144 - RNA, 22 nt, Salmonella typhimurium LT2
uaugugauccaucgugacuauc

SEQ ID NO: 215145 - RNA, 22 nt, Salmonella typhimurium LT2
agcaccucuggcacaucaugcg

SEQ ID NO: 215146 - RNA, 22 nt, Salmonella typhimurium LT2
aucagcguaucuucauuuucgc

SEQ ID NO: 215147 - RNA, 22 nt, Salmonella typhimurium LT2
uugcgauaacgcgauucucgca

SEQ ID NO: 215148 - RNA, 22 nt, Salmonella typhimurium LT2
cgcgguuauauuggcgauaauu

SEQ ID NO: 215149 - RNA, 22 nt, Salmonella typhimurium LT2
uccgcgaugcucgcccaccacc

SEQ ID NO: 215150 - RNA, 22 nt, Salmonella typhimurium LT2
ugagcggcuggcgaaacuggcg

SEQ ID NO: 215151 - RNA, 22 nt, Salmonella typhimurium LT2
ugugaacaucucauccggccua

SEQ ID NO: 215152 - RNA, 22 nt, Salmonella typhimurium LT2
ggaugcgcaccauggcuucugc

SEQ ID NO: 215153 - RNA, 19 nt, Salmonella typhimurium LT2
cgguuacugggauagagac

SEQ ID NO: 215154 - RNA, 22 nt, Salmonella typhimurium LT2
guuccgguuaucuaugcgccag

SEQ ID NO: 215155 - RNA, 22 nt, Salmonella typhimurium LT2
ggcguugcuggaugucgauggc

SEQ ID NO: 215156 - RNA, 22 nt, Salmonella typhimurium LT2
uccgggaucgccuccagcagca

SEQ ID NO: 215157 - RNA, 22 nt, Salmonella typhimurium LT2
ccggauaaggcgaagcggccau

SEQ ID NO: 215158 - RNA, 22 nt, Salmonella typhimurium LT2
ucgcggugaugggacgcgucau

SEQ ID NO: 215159 - RNA, 22 nt, Salmonella typhimurium LT2
uggaugccacuauuuuucugag

SEQ ID NO: 215160 - RNA, 22 nt, Salmonella typhimurium LT2
acagauuaugcgucauucgcua

SEQ ID NO: 215161 - RNA, 22 nt, Salmonella typhimurium LT2
gaucagcagcguuuccgucgug

SEQ ID NO: 215162 - RNA, 20 nt, Salmonella typhimurium LT2
ugcugucaggggacuguccg

SEQ ID NO: 215163 - RNA, 22 nt, Salmonella typhimurium LT2
ggcauucagcaauugagucagu

SEQ ID NO: 215164 - RNA, 22 nt, Salmonella typhimurium LT2
uggcgagagacuuucgcgacug

SEQ ID NO: 215165 - RNA, 22 nt, Salmonella typhimurium LT2
cggauaacgccaccgugguuau

SEQ ID NO: 215166 - RNA, 21 nt, Salmonella typhimurium LT2
agucaugcaggaucuggcgga

SEQ ID NO: 215167 - RNA, 22 nt, Salmonella typhimurium LT2
aaugaccguuuuaugucggcgc

SEQ ID NO: 215168 - RNA, 22 nt, Salmonella typhimurium LT2
gguggcauggcuugccgguccg

SEQ ID NO: 215169 - RNA, 22 nt, Salmonella typhimurium LT2
gcagcccugcgcgcagcacguu

SEQ ID NO: 215170 - RNA, 20 nt, Salmonella typhimurium LT2
gugauaaaugacaaguggga

SEQ ID NO: 215171 - RNA, 22 nt, Salmonella typhimurium LT2
gcucgugcgcauuagucagguu

SEQ ID NO: 215172 - RNA, 22 nt, Salmonella typhimurium LT2
ccggucucccgauguaccgcac

SEQ ID NO: 215173 - RNA, 20 nt, Salmonella typhimurium LT2
aucagacgauaagcugugga

SEQ ID NO: 215174 - RNA, 22 nt, Salmonella typhimurium LT2
ggaucgaucgcgccacgcgacu

SEQ ID NO: 215175 - RNA, 22 nt, Salmonella typhimurium LT2
cggauuguguccuggaagaagg

SEQ ID NO: 215176 - RNA, 22 nt, Salmonella typhimurium LT2
cugacgccccugaugcuggaug

SEQ ID NO: 215177 - RNA, 22 nt, Salmonella typhimurium LT2
cuaacggcgcaugugguauugu

SEQ ID NO: 215178 - RNA, 22 nt, Salmonella typhimurium LT2
gccggaugucaucaccagcggg

SEQ ID NO: 215179 - RNA, 22 nt, Salmonella typhimurium LT2
agcuacugacgcaaauguuugu

SEQ ID NO: 215180 - RNA, 22 nt, Salmonella typhimurium LT2
aauggcuuuugaacacccaggu

SEQ ID NO: 215181 - RNA, 22 nt, Salmonella typhimurium LT2
ggcgauaauguguugacggaua

SEQ ID NO: 215182 - RNA, 22 nt, Salmonella typhimurium LT2
guugcgcucaaugaccuggcca

SEQ ID NO: 215183 - RNA, 22 nt, Salmonella typhimurium LT2
gacuucauggagucgaguugca

SEQ ID NO: 215184 - RNA, 22 nt, Salmonella typhimurium LT2
ucgcucauuguaguaaucucaa

SEQ ID NO: 215185 - RNA, 22 nt, Salmonella typhimurium LT2
agcggcaucgauaucgcgcugu

SEQ ID NO: 215186 - RNA, 20 nt, Salmonella typhimurium LT2
ccgagugcgccugcauuuug

SEQ ID NO: 215187 - RNA, 21 nt, Salmonella typhimurium LT2
ggcguacauuacaauuuuuca

SEQ ID NO: 215188 - RNA, 22 nt, Salmonella typhimurium LT2
cuacgcuuaucaggccuacagg

SEQ ID NO: 215189 - RNA, 18 nt, Salmonella typhimurium LT2
uggacgaugcguugcagc

SEQ ID NO: 215190 - RNA, 22 nt, Salmonella typhimurium LT2
ccgcgguaccugauaggggccg

SEQ ID NO: 215191 - RNA, 22 nt, Salmonella typhimurium LT2
acuuucuggcccacuucgauga

SEQ ID NO: 215192 - RNA, 22 nt, Salmonella typhimurium LT2
agauuugcuugaguuguuuagc

SEQ ID NO: 215193 - RNA, 22 nt, Salmonella typhimurium LT2
uccggcguuauccggcaacgua

SEQ ID NO: 215194 - RNA, 22 nt, Salmonella typhimurium LT2
cugauucguaaugucggaaaag

SEQ ID NO: 215195 - RNA, 22 nt, Salmonella typhimurium LT2
cauccggcgucuccugacggau

SEQ ID NO: 215196 - RNA, 22 nt, Salmonella typhimurium LT2
gugacguugauggugcagguuu

SEQ ID NO: 215197 - RNA, 22 nt, Salmonella typhimurium LT2
uggucgucugcguaagcugaac

SEQ ID NO: 215198 - RNA, 22 nt, Salmonella typhimurium LT2
ccguuaacguuuuacgcugccg

SEQ ID NO: 215199 - RNA, 22 nt, Salmonella typhimurium LT2
cccggaaaccaucauggaugcg

SEQ ID NO: 215200 - RNA, 18 nt, Salmonella typhimurium LT2
accagcugaucgaaggug

SEQ ID NO: 215201 - RNA, 22 nt, Salmonella typhimurium LT2
uaaugcuuauccggccuacagg

SEQ ID NO: 215202 - RNA, 22 nt, Salmonella typhimurium LT2
gugcaggaugacucggcuucgc

SEQ ID NO: 215203 - RNA, 22 nt, Salmonella typhimurium LT2
ucauguucauuauuaacugcuc

SEQ ID NO: 215204 - RNA, 22 nt, Salmonella typhimurium LT2
ggauugccauuggacuugccgg

SEQ ID NO: 215205 - RNA, 22 nt, Salmonella typhimurium LT2
ccguuaaggccuuauugugccg

SEQ ID NO: 215206 - RNA, 22 nt, Salmonella typhimurium LT2
uuugcccgguaagacuuccugc

SEQ ID NO: 215207 - RNA, 22 nt, Salmonella typhimurium LT2
ccaggguuugacguuuccacuu

SEQ ID NO: 215208 - RNA, 22 nt, Salmonella typhimurium LT2
cgugaugaaaucggcgcgcaua

SEQ ID NO: 215209 - RNA, 22 nt, Salmonella typhimurium LT2
gccguacuggaugccggguaug

SEQ ID NO: 215210 - RNA, 22 nt, Salmonella typhimurium LT2
acaauggacgccgccgaagcgu

SEQ ID NO: 215211 - RNA, 20 nt, Salmonella typhimurium LT2
accggcguacugaucgccaa

SEQ ID NO: 215212 - RNA, 22 nt, Salmonella typhimurium LT2
accgcagcagcuugcaguuuau

SEQ ID NO: 215213 - RNA, 22 nt, Salmonella typhimurium LT2
gaagcgcucuccgaucgcgcau

SEQ ID NO: 215214 - RNA, 22 nt, Salmonella typhimurium LT2
caggcgcacugucagcauauuu

SEQ ID NO: 215215 - RNA, 22 nt, Salmonella typhimurium LT2
acauuggcuccgggcaguucac

SEQ ID NO: 215216 - RNA, 22 nt, Salmonella typhimurium LT2
acgcccuggaacagcaggcggu

SEQ ID NO: 215217 - RNA, 22 nt, Salmonella typhimurium LT2
aucuucaugguuaauggucuga

SEQ ID NO: 215218 - RNA, 22 nt, Salmonella typhimurium LT2
agaauccguaucuucgagugcc

SEQ ID NO: 215219 - RNA, 22 nt, Salmonella typhimurium LT2
augugcaguuugcgaucgaauu

SEQ ID NO: 215220 - RNA, 22 nt, Salmonella typhimurium LT2
agcguugcuugaucgccugccg

SEQ ID NO: 215221 - RNA, 22 nt, Salmonella typhimurium LT2
uaucgcgucgugucccagcgug

SEQ ID NO: 215222 - RNA, 22 nt, Salmonella typhimurium LT2
uaagagauaaagaccgaggcga

SEQ ID NO: 215223 - RNA, 23 nt, Salmonella typhimurium LT2
cggcaacguuuugauggucagcc

SEQ ID NO: 215224 - RNA, 19 nt, Salmonella typhimurium LT2
aguggccgcauucagacug

SEQ ID NO: 215225 - RNA, 22 nt, Salmonella typhimurium LT2
cuggcgaugcugcaucgcgcuu

SEQ ID NO: 215226 - RNA, 23 nt, Salmonella typhimurium LT2
gcugacgcaacguuauccuucac

SEQ ID NO: 215227 - RNA, 22 nt, Salmonella typhimurium LT2
auccggguaacuaugaugagua

SEQ ID NO: 215228 - RNA, 21 nt, Salmonella typhimurium LT2
uguccgacuguuaacguaaaa

SEQ ID NO: 215229 - RNA, 22 nt, Salmonella typhimurium LT2
acaguuccggcacuuucaccga

SEQ ID NO: 215230 - RNA, 22 nt, Salmonella typhimurium LT2
acagugguugaauguagaggga

SEQ ID NO: 215231 - RNA, 22 nt, Salmonella typhimurium LT2
acauugagggcgaaaucucaua

SEQ ID NO: 215232 - RNA, 22 nt, Salmonella typhimurium LT2
acaguuugaucgcaagggcaug

SEQ ID NO: 215233 - RNA, 22 nt, Salmonella typhimurium LT2
acauugugaugccugaugacga

SEQ ID NO: 215234 - RNA, 22 nt, Salmonella typhimurium LT2
acucuuaacaaauagaaauuac

SEQ ID NO: 215235 - RNA, 20 nt, Salmonella typhimurium LT2
accagccuggggcggcgcug

SEQ ID NO: 215236 - RNA, 18 nt, Salmonella typhimurium LT2
accagcugaucgaaggug

SEQ ID NO: 215237 - RNA, 22 nt, Salmonella typhimurium LT2
acuccuguuaaacccgcuaacg

SEQ ID NO: 215238 - RNA, 18 nt, Salmonella typhimurium LT2
acugcggaccgucgcggc

SEQ ID NO: 215239 - RNA, 22 nt, Salmonella typhimurium LT2
acugcugcgguaaugcagagua

SEQ ID NO: 215240 - RNA, 22 nt, Salmonella typhimurium LT2
acuguaaugccgguguuuuuuc

SEQ ID NO: 215241 - RNA, 22 nt, Salmonella typhimurium LT2
acagagccugucucagcaauga

SEQ ID NO: 215242 - RNA, 22 nt, Salmonella typhimurium LT2
acagaauggcauccgccugcuc

SEQ ID NO: 215243 - RNA, 22 nt, Salmonella typhimurium LT2
acagauuaugcgucauucgcua

SEQ ID NO: 215244 - RNA, 22 nt, Salmonella typhimurium LT2
acagcguugauuuuccgcagcc

SEQ ID NO: 215245 - RNA, 22 nt, Salmonella typhimurium LT2
acaaucugaacauuaagucaug

SEQ ID NO: 215246 - RNA, 22 nt, Salmonella typhimurium LT2
acacugauuggcgcuggugucg

SEQ ID NO: 215247 - RNA, 22 nt, Salmonella typhimurium LT2
aauguucacugccguuauuaug

SEQ ID NO: 215248 - RNA, 22 nt, Salmonella typhimurium LT2
aauguuugccggauaaagauga

SEQ ID NO: 215249 - RNA, 20 nt, Salmonella typhimurium LT2
aagugccugcgccuugcuua

SEQ ID NO: 215250 - RNA, 22 nt, Salmonella typhimurium LT2
aaguucagcuucagaagcugga

SEQ ID NO: 215251 - RNA, 22 nt, Salmonella typhimurium LT2
acaaauucgccaggcuaauagu

SEQ ID NO: 215252 - RNA, 22 nt, Salmonella typhimurium LT2
acaaaguuuuaccagaagaagc

SEQ ID NO: 215253 - RNA, 22 nt, Salmonella typhimurium LT2
aaugcuuugggcaccaccgauu

SEQ ID NO: 215254 - RNA, 22 nt, Salmonella typhimurium LT2
aagguuaugcuauucauuuauc

SEQ ID NO: 215255 - RNA, 22 nt, Salmonella typhimurium LT2
aacaugguggcggcgggcagug

SEQ ID NO: 215256 - RNA, 22 nt, Salmonella typhimurium LT2
aaaucuuggacuggcagagcgc

SEQ ID NO: 215257 - RNA, 21 nt, Salmonella typhimurium LT2
aaaugguuucgccgugggaga

SEQ ID NO: 215258 - RNA, 22 nt, Salmonella typhimurium LT2
aaagcguggggcgugccgcugu

SEQ ID NO: 215259 - RNA, 22 nt, Salmonella typhimurium LT2
aaaggcuuucuuuauaggaguc

SEQ ID NO: 215260 - RNA, 22 nt, Salmonella typhimurium LT2
aaagucaggguacguuuguacu

SEQ ID NO: 215261 - RNA, 22 nt, Salmonella typhimurium LT2
aaagugccauugcaaucgcgug

SEQ ID NO: 215262 - RNA, 22 nt, Salmonella typhimurium LT2
auugaugacaucgaccugaacc

SEQ ID NO: 215263 - RNA, 22 nt, Salmonella typhimurium LT2
auugccuuucagcgccagacug

SEQ ID NO: 215264 - RNA, 22 nt, Salmonella typhimurium LT2
caaauuccggccuggcauagaa

SEQ ID NO: 215265 - RNA, 22 nt, Salmonella typhimurium LT2
augguaaauaagcggauuuucu

SEQ ID NO: 215266 - RNA, 22 nt, Salmonella typhimurium LT2
auggugaaauugcuggaagcga

SEQ ID NO: 215267 - RNA, 22 nt, Salmonella typhimurium LT2
auggugaacggcaggaaauggu

SEQ ID NO: 215268 - RNA, 22 nt, Salmonella typhimurium LT2
auggcuggagauaggcgcgcuu

SEQ ID NO: 215269 - RNA, 22 nt, Salmonella typhimurium LT2
auggcuguuggggaucuuugcc

SEQ ID NO: 215270 - RNA, 22 nt, Salmonella typhimurium LT2
auggcgcgaaacuauccgcaac

SEQ ID NO: 215271 - RNA, 19 nt, Salmonella typhimurium LT2
auguggagcaacuauggga

SEQ ID NO: 215272 - RNA, 22 nt, Salmonella typhimurium LT2
augugcuguucgauguagccaa

SEQ ID NO: 215273 - RNA, 22 nt, Salmonella typhimurium LT2
auguucucccgcauaagguacu

SEQ ID NO: 215274 - RNA, 22 nt, Salmonella typhimurium LT2
auuccaggaauaaguauccaga

SEQ ID NO: 215275 - RNA, 20 nt, Salmonella typhimurium LT2
auucaagucggugcgacgau

SEQ ID NO: 215276 - RNA, 22 nt, Salmonella typhimurium LT2
auucucgucugucaugcacauc

SEQ ID NO: 215277 - RNA, 22 nt, Salmonella typhimurium LT2
auucaaucaaauuaagaucaca

SEQ ID NO: 215278 - RNA, 22 nt, Salmonella typhimurium LT2
auucacuacaugauugccgccg

SEQ ID NO: 215279 - RNA, 22 nt, Salmonella typhimurium LT2
auuauggauguccagggcagcg

SEQ ID NO: 215280 - RNA, 22 nt, Salmonella typhimurium LT2
cacuggugaaaucgccuuccgg

SEQ ID NO: 215281 - RNA, 22 nt, Salmonella typhimurium LT2
cacgcuuuucccugacccugac

SEQ ID NO: 215282 - RNA, 22 nt, Salmonella typhimurium LT2
caaugucaccggcgaaauuggu

SEQ ID NO: 215283 - RNA, 23 nt, Salmonella typhimurium LT2
cacauuccaguacaguugaaaua

SEQ ID NO: 215284 - RNA, 20 nt, Salmonella typhimurium LT2
caagaaauuuuaagcccggg

SEQ ID NO: 215285 - RNA, 22 nt, Salmonella typhimurium LT2
caagcauaguguuuugcuaacu

SEQ ID NO: 215286 - RNA, 22 nt, Salmonella typhimurium LT2
caagccauguugcccaugccag

SEQ ID NO: 215287 - RNA, 22 nt, Salmonella typhimurium LT2
caaccugggaacaagagccauu

SEQ ID NO: 215288 - RNA, 22 nt, Salmonella typhimurium LT2
cacagaauuaacguugggaauu

SEQ ID NO: 215289 - RNA, 17 nt, Salmonella typhimurium LT2
cacagagaauauauuuu

SEQ ID NO: 215290 - RNA, 21 nt, Salmonella typhimurium LT2
cacagcaugcgucucagaaug

SEQ ID NO: 215291 - RNA, 22 nt, Salmonella typhimurium LT2
caauaucuacaaaggucgugua

SEQ ID NO: 215292 - RNA, 22 nt, Salmonella typhimurium LT2
cagcuccugguccguaaccugg

SEQ ID NO: 215293 - RNA, 22 nt, Salmonella typhimurium LT2
cagcggcucgacaugcagaucc

SEQ ID NO: 215294 - RNA, 22 nt, Salmonella typhimurium LT2
cagcgaggcaccaucauugaaa

SEQ ID NO: 215295 - RNA, 22 nt, Salmonella typhimurium LT2
caggaguugcagauuuaccggu

SEQ ID NO: 215296 - RNA, 22 nt, Salmonella typhimurium LT2
caggcaagggaagaagugagga

SEQ ID NO: 215297 - RNA, 22 nt, Salmonella typhimurium LT2
cagcaugugguucaacauguuc

SEQ ID NO: 215298 - RNA, 22 nt, Salmonella typhimurium LT2
cagaugagcuucccgcuauuug

SEQ ID NO: 215299 - RNA, 22 nt, Salmonella typhimurium LT2
aucaggcuauccggcuuuuaac

SEQ ID NO: 215300 - RNA, 22 nt, Salmonella typhimurium LT2
aucagcguaucuucauuuucgc

SEQ ID NO: 215301 - RNA, 22 nt, Salmonella typhimurium LT2
aucacgcacagauuuggcaucg

SEQ ID NO: 215302 - RNA, 22 nt, Salmonella typhimurium LT2
aucgccaucuuaugcuuuuucu

SEQ ID NO: 215303 - RNA, 19 nt, Salmonella typhimurium LT2
auccaugaugguuuccggg

SEQ ID NO: 215304 - RNA, 22 nt, Salmonella typhimurium LT2
aucccgccagcgaaagcgucug

SEQ ID NO: 215305 - RNA, 22 nt, Salmonella typhimurium LT2
auauggcugucgcccgugccgg

SEQ ID NO: 215306 - RNA, 22 nt, Salmonella typhimurium LT2
auauggugcgcggcaccacgca

SEQ ID NO: 215307 - RNA, 22 nt, Salmonella typhimurium LT2
auaucggcaaugucauaaacaa

SEQ ID NO: 215308 - RNA, 22 nt, Salmonella typhimurium LT2
aucuggcuaaaaucugaaggcg

SEQ ID NO: 215309 - RNA, 22 nt, Salmonella typhimurium LT2
aucuucaugguuaauggucuga

SEQ ID NO: 215310 - RNA, 19 nt, Salmonella typhimurium LT2
aucuuugugaacuuuauug

SEQ ID NO: 215311 - RNA, 22 nt, Salmonella typhimurium LT2
augacaacauuaaaugggagaa

SEQ ID NO: 215312 - RNA, 22 nt, Salmonella typhimurium LT2
augcuguucagcgaaaaagcgc

SEQ ID NO: 215313 - RNA, 22 nt, Salmonella typhimurium LT2
augcgcuuguugcgucaggcua

SEQ ID NO: 215314 - RNA, 22 nt, Salmonella typhimurium LT2
augcauguuauauucgccguga

SEQ ID NO: 215315 - RNA, 22 nt, Salmonella typhimurium LT2
aguucaaaccguuauuaauuaa

SEQ ID NO: 215316 - RNA, 22 nt, Salmonella typhimurium LT2
agugauuauuacgcagcauaug

SEQ ID NO: 215317 - RNA, 22 nt, Salmonella typhimurium LT2
agucaauauuuauucauggaau

SEQ ID NO: 215318 - RNA, 22 nt, Salmonella typhimurium LT2
agucagguaacgaugccuguau

SEQ ID NO: 215319 - RNA, 22 nt, Salmonella typhimurium LT2
agugagccgucuggauaucgug

SEQ ID NO: 215320 - RNA, 22 nt, Salmonella typhimurium LT2
aguggaaucagccaggagucgg

SEQ ID NO: 215321 - RNA, 22 nt, Salmonella typhimurium LT2
acuuuaucuaccgcgccgguuc

SEQ ID NO: 215322 - RNA, 20 nt, Salmonella typhimurium LT2
accagcagcgcggcgaccgc

SEQ ID NO: 215323 - RNA, 22 nt, Salmonella typhimurium LT2
cauagcauaacaaagaugcgaa

SEQ ID NO: 215324 - RNA, 22 nt, Salmonella typhimurium LT2
cagugaggacgcuaaugccgcu

SEQ ID NO: 215325 - RNA, 22 nt, Salmonella typhimurium LT2
cagguuguugggauguuucaga

SEQ ID NO: 215326 - RNA, 22 nt, Salmonella typhimurium LT2
caguacuuauccgggugaauac

SEQ ID NO: 215327 - RNA, 22 nt, Salmonella typhimurium LT2
caggcgugaaugugucugcgug

SEQ ID NO: 215328 - RNA, 22 nt, Salmonella typhimurium LT2
caucauccagaucuuucgcgcc

SEQ ID NO: 215329 - RNA, 22 nt, Salmonella typhimurium LT2
cgaaggcgacaucagcagccgu

SEQ ID NO: 215330 - RNA, 22 nt, Salmonella typhimurium LT2
cgugccugauggcgcugugcuu

SEQ ID NO: 215331 - RNA, 22 nt, Salmonella typhimurium LT2
cguuccaccuuuaucagcagug

SEQ ID NO: 215332 - RNA, 22 nt, Salmonella typhimurium LT2
cguagaaacgagcgguaacugg

SEQ ID NO: 215333 - RNA, 22 nt, Salmonella typhimurium LT2
cgcaggauacgaaacgggugcu

SEQ ID NO: 215334 - RNA, 22 nt, Salmonella typhimurium LT2
cgcauauucucgaaguggcccc

SEQ ID NO: 215335 - RNA, 22 nt, Salmonella typhimurium LT2
cgcaggaauacauaggacacca

SEQ ID NO: 215336 - RNA, 22 nt, Salmonella typhimurium LT2
cgcaaguagauaacgccuucuu

SEQ ID NO: 215337 - RNA, 22 nt, Salmonella typhimurium LT2
cgccagagucgucauauuaucc

SEQ ID NO: 215338 - RNA, 22 nt, Salmonella typhimurium LT2
cggguccuuuuuuggcgaauaa

SEQ ID NO: 215339 - RNA, 22 nt, Salmonella typhimurium LT2
cugcauaagcugauggaugaag

SEQ ID NO: 215340 - RNA, 21 nt, Salmonella typhimurium LT2
cugcauaaucgcaaagguauc

SEQ ID NO: 215341 - RNA, 22 nt, Salmonella typhimurium LT2
cugaugauggaaaacgcgcuga

SEQ ID NO: 215342 - RNA, 22 nt, Salmonella typhimurium LT2
cugaggccgcugguggcgacuu

SEQ ID NO: 215343 - RNA, 22 nt, Salmonella typhimurium LT2
cugacggguaguaucgcucuau

SEQ ID NO: 215344 - RNA, 22 nt, Salmonella typhimurium LT2
cucuuugacuauuuucccugcc

SEQ ID NO: 215345 - RNA, 22 nt, Salmonella typhimurium LT2
cucaggugucggggaggcuggu

SEQ ID NO: 215346 - RNA, 22 nt, Salmonella typhimurium LT2
cuaucggcaaucgagcgugaag

SEQ ID NO: 215347 - RNA, 20 nt, Salmonella typhimurium LT2
cguuggcuuaauacgcugug

SEQ ID NO: 215348 - RNA, 22 nt, Salmonella typhimurium LT2
cuaacuuacuuaauuaaggcaa

SEQ ID NO: 215349 - RNA, 22 nt, Salmonella typhimurium LT2
cuucaccaacguggcgugcagg

SEQ ID NO: 215350 - RNA, 22 nt, Salmonella typhimurium LT2
cuuggagaugaaacauguuucu

SEQ ID NO: 215351 - RNA, 22 nt, Salmonella typhimurium LT2
gaaaucaucgccacccaucucg

SEQ ID NO: 215352 - RNA, 22 nt, Salmonella typhimurium LT2
gccaugaaggaugacuaugugg

SEQ ID NO: 215353 - RNA, 23 nt, Salmonella typhimurium LT2
gccauggcgggacacagucuaug

SEQ ID NO: 215354 - RNA, 22 nt, Salmonella typhimurium LT2
gcaguauguaccuucgcugagu

SEQ ID NO: 215355 - RNA, 22 nt, Salmonella typhimurium LT2
gcauguguucuuuucucuugcu

SEQ ID NO: 215356 - RNA, 22 nt, Salmonella typhimurium LT2
gcauguuugccugagcgcgaac

SEQ ID NO: 215357 - RNA, 22 nt, Salmonella typhimurium LT2
gaaguuuauagugaaaaaaugg

SEQ ID NO: 215358 - RNA, 22 nt, Salmonella typhimurium LT2
gaauuucacaagcauggugguc

SEQ ID NO: 215359 - RNA, 22 nt, Salmonella typhimurium LT2
gaauuucuuaccaggagugaua

SEQ ID NO: 215360 - RNA, 22 nt, Salmonella typhimurium LT2
gacccagcgcgauauaagaagg

SEQ ID NO: 215361 - RNA, 22 nt, Salmonella typhimurium LT2
gacaagauggcauagccgucau

SEQ ID NO: 215362 - RNA, 22 nt, Salmonella typhimurium LT2
gacacacucccugucauauuca

SEQ ID NO: 215363 - RNA, 22 nt, Salmonella typhimurium LT2
gcagcccugcgcgcagcacguu

SEQ ID NO: 215364 - RNA, 22 nt, Salmonella typhimurium LT2
ggcagguuugccggauaucagc

SEQ ID NO: 215365 - RNA, 22 nt, Salmonella typhimurium LT2
ggcauucagcaauugagucagu

SEQ ID NO: 215366 - RNA, 22 nt, Salmonella typhimurium LT2
ggauuucaugucgacgcaaggg

SEQ ID NO: 215367 - RNA, 22 nt, Salmonella typhimurium LT2
ggcaaguaaccccagauuugcg

SEQ ID NO: 215368 - RNA, 22 nt, Salmonella typhimurium LT2
ggcggaauaaguagauaagcaa

SEQ ID NO: 215369 - RNA, 22 nt, Salmonella typhimurium LT2
ggccugauaagcgcagcgccau

SEQ ID NO: 215370 - RNA, 22 nt, Salmonella typhimurium LT2
ggccugauccgcaaagccggga

SEQ ID NO: 215371 - RNA, 22 nt, Salmonella typhimurium LT2
gcugaugaccgauaagcugcaa

SEQ ID NO: 215372 - RNA, 20 nt, Salmonella typhimurium LT2
gcugucucgccagacgcagc

SEQ ID NO: 215373 - RNA, 22 nt, Salmonella typhimurium LT2
gcugccuuauccggccuacaag

SEQ ID NO: 215374 - RNA, 22 nt, Salmonella typhimurium LT2
ggcuggaugugugacgugcugg

SEQ ID NO: 215375 - RNA, 17 nt, Salmonella typhimurium LT2
ggcuggcaacggccagc

SEQ ID NO: 215376 - RNA, 22 nt, Salmonella typhimurium LT2
gugcuggaaaaacagggcucca

SEQ ID NO: 215377 - RNA, 22 nt, Salmonella typhimurium LT2
gugcaggaugacucggcuucgc

SEQ ID NO: 215378 - RNA, 22 nt, Salmonella typhimurium LT2
gugagggcgucgauggcccggc

SEQ ID NO: 215379 - RNA, 22 nt, Salmonella typhimurium LT2
ucagggugauacuggcguugca

SEQ ID NO: 215380 - RNA, 22 nt, Salmonella typhimurium LT2
ucagggugauuuuguccagcuu

SEQ ID NO: 215381 - RNA, 22 nt, Salmonella typhimurium LT2
ucaggaaaaccaacaugaugua

SEQ ID NO: 215382 - RNA, 22 nt, Salmonella typhimurium LT2
uauccuggcguuagucucaaag

SEQ ID NO: 215383 - RNA, 19 nt, Salmonella typhimurium LT2
uaugaaaccacugcuggac

SEQ ID NO: 215384 - RNA, 22 nt, Salmonella typhimurium LT2
uaacagccccagcccuggcgua

SEQ ID NO: 215385 - RNA, 22 nt, Salmonella typhimurium LT2
uaaaucugauuugcguagcggc

SEQ ID NO: 215386 - RNA, 22 nt, Salmonella typhimurium LT2
uaaagcaauauucgguuuaacu

SEQ ID NO: 215387 - RNA, 22 nt, Salmonella typhimurium LT2
uaaagcaccgcggccuuuuuug

SEQ ID NO: 215388 - RNA, 22 nt, Salmonella typhimurium LT2
uaaugcuuauccggccuacagg

SEQ ID NO: 215389 - RNA, 20 nt, Salmonella typhimurium LT2
uagucuuccuggcauccagc

SEQ ID NO: 215390 - RNA, 22 nt, Salmonella typhimurium LT2
uggcgcugcgcuuaucaggccu

SEQ ID NO: 215391 - RNA, 22 nt, Salmonella typhimurium LT2
uggcugagguguuugccuaugc

SEQ ID NO: 215392 - RNA, 22 nt, Salmonella typhimurium LT2
ugggaaauuccgaaaaugcgcc

SEQ ID NO: 215393 - RNA, 19 nt, Salmonella typhimurium LT2
ugguguacguugauucgcg

SEQ ID NO: 215394 - RNA, 22 nt, Salmonella typhimurium LT2
uguaggccggauaagacgcguc

SEQ ID NO: 215395 - RNA, 22 nt, Salmonella typhimurium LT2
uguaggccggauaagacgcguu

SEQ ID NO: 215396 - RNA, 22 nt, Salmonella typhimurium LT2
uguaggccggguaaggcguagc

SEQ ID NO: 215397 - RNA, 22 nt, Salmonella typhimurium LT2
uguaggucagguaagcgcuagc

SEQ ID NO: 215398 - RNA, 22 nt, Salmonella typhimurium LT2
uguaggcccgguaagcgucagc

SEQ ID NO: 215399 - RNA, 22 nt, Salmonella typhimurium LT2
ugugaccauuaucgggcaauca

SEQ ID NO: 215400 - RNA, 22 nt, Salmonella typhimurium LT2
uggaugaacuuuguaugaucuc

SEQ ID NO: 215401 - RNA, 22 nt, Salmonella typhimurium LT2
uggccugcuauuuauguggcug

SEQ ID NO: 215402 - RNA, 22 nt, Salmonella typhimurium LT2
uggcaugugguauugauccuga

SEQ ID NO: 215403 - RNA, 22 nt, Salmonella typhimurium LT2
ugagagauaucggauuuuacuu

SEQ ID NO: 215404 - RNA, 22 nt, Salmonella typhimurium LT2
ugagcaagugacagacuuauug

SEQ ID NO: 215405 - RNA, 22 nt, Salmonella typhimurium LT2
ugaugcugucuggucagcgugg

SEQ ID NO: 215406 - RNA, 22 nt, Salmonella typhimurium LT2
ugaugcagacgacgacaugcgc

SEQ ID NO: 215407 - RNA, 22 nt, Salmonella typhimurium LT2
ugaggugauuaaaaucauuaug

SEQ ID NO: 215408 - RNA, 21 nt, Salmonella typhimurium LT2
ugauaacggguuaacaggcgu

SEQ ID NO: 215409 - RNA, 22 nt, Salmonella typhimurium LT2
ucuggaaaccguugaucauuuu

SEQ ID NO: 215410 - RNA, 22 nt, Salmonella typhimurium LT2
ucuucaagcauuuccgagagau

SEQ ID NO: 215411 - RNA, 22 nt, Salmonella typhimurium LT2
ucuuaucaggccuacggucuuu

SEQ ID NO: 215412 - RNA, 22 nt, Salmonella typhimurium LT2
ugagaaucaauccaacccgcgc

SEQ ID NO: 215413 - RNA, 20 nt, Salmonella typhimurium LT2
ucuuccagcaaaugauggcg

SEQ ID NO: 215414 - RNA, 22 nt, Salmonella typhimurium LT2
uccagcaaaaaucuuucuuuag

SEQ ID NO: 215415 - RNA, 22 nt, Salmonella typhimurium LT2
uccaggcuaugugcauacaagc

SEQ ID NO: 215416 - RNA, 22 nt, Salmonella typhimurium LT2
uccagucugaauguugaacacg

SEQ ID NO: 215417 - RNA, 22 nt, Salmonella typhimurium LT2
ucaucagaccgauguugccuuc

SEQ ID NO: 215418 - RNA, 21 nt, Salmonella typhimurium LT2
ucauccagccaacaaacucaa

SEQ ID NO: 215419 - RNA, 17 nt, Salmonella typhimurium LT2
ucaugguggauuccggg

SEQ ID NO: 215420 - RNA, 22 nt, Salmonella typhimurium LT2
uccaacaguugcguaaucugau

SEQ ID NO: 215421 - RNA, 22 nt, Salmonella typhimurium LT2
ucauugcugagacaggcucugu

SEQ ID NO: 215422 - RNA, 23 nt, Salmonella typhimurium LT2
uuaagcaccacauuggugcaaca

SEQ ID NO: 215423 - RNA, 22 nt, Salmonella typhimurium LT2
uuagcgccgguauuuuuggcgg

SEQ ID NO: 215424 - RNA, 22 nt, Salmonella typhimurium LT2
uuacuacuggcuaaugggcagc

SEQ ID NO: 215425 - RNA, 22 nt, Salmonella typhimurium LT2
uguuccuggcuaauuuuggcuu

SEQ ID NO: 215426 - RNA, 19 nt, Salmonella typhimurium LT2
ugugccuguuaagccggau

SEQ ID NO: 215427 - RNA, 22 nt, Salmonella typhimurium LT2
aagcauauuacucagcccuuga

SEQ ID NO: 215428 - RNA, 22 nt, Salmonella typhimurium LT2
aagcacuauuuuggugcaacau

SEQ ID NO: 215429 - RNA, 22 nt, Salmonella typhimurium LT2
aauaccugccggauaacccgaa

SEQ ID NO: 215430 - RNA, 22 nt, Salmonella typhimurium LT2
aacugcggcccgccuguugagc

SEQ ID NO: 215431 - RNA, 22 nt, Salmonella typhimurium LT2
aacugcuugaugaggccgaacg

SEQ ID NO: 215432 - RNA, 22 nt, Salmonella typhimurium LT2
aacgccugugaacuguugcaaa

SEQ ID NO: 215433 - RNA, 23 nt, Salmonella typhimurium LT2
aacucucucuuguugaagagggg

SEQ ID NO: 215434 - RNA, 22 nt, Salmonella typhimurium LT2
aagacuuugcacauuuugcuaa

SEQ ID NO: 215435 - RNA, 22 nt, Salmonella typhimurium LT2
aggaaucacaggcggcuuaucu

SEQ ID NO: 215436 - RNA, 22 nt, Salmonella typhimurium LT2
aggccaucacuuuccggauguc

SEQ ID NO: 215437 - RNA, 22 nt, Salmonella typhimurium LT2
aggcccuguuugauggcguaca

SEQ ID NO: 215438 - RNA, 22 nt, Salmonella typhimurium LT2
aggauaugagauuaugaguacc

SEQ ID NO: 215439 - RNA, 22 nt, Salmonella typhimurium LT2
aggauauugaguauuaugacua

SEQ ID NO: 215440 - RNA, 22 nt, Salmonella typhimurium LT2
agcggccugcuggucucgcugu

SEQ ID NO: 215441 - RNA, 23 nt, Salmonella typhimurium LT2
agcuggugauuuccggugccgau

SEQ ID NO: 215442 - RNA, 22 nt, Salmonella typhimurium LT2
agcaguuuaauaagguucuggc

SEQ ID NO: 215443 - RNA, 22 nt, Salmonella typhimurium LT2
agcagaugaaugugcggauggu

SEQ ID NO: 215444 - RNA, 22 nt, Salmonella typhimurium LT2
agccagacuuaucgcuccuaug

SEQ ID NO: 215445 - RNA, 22 nt, Salmonella typhimurium LT2
aaugaacagugaugaaaacgag

SEQ ID NO: 215446 - RNA, 22 nt, Salmonella typhimurium LT2
aaugaacaugauggaaggcacg

SEQ ID NO: 215447 - RNA, 22 nt, Salmonella typhimurium LT2
acggaaauauuauugcuaucgg

SEQ ID NO: 215448 - RNA, 22 nt, Salmonella typhimurium LT2
accugucaucuuccuuaugcuu

SEQ ID NO: 215449 - RNA, 22 nt, Salmonella typhimurium LT2
accgcagcagcuugcaguuuau

SEQ ID NO: 215450 - RNA, 22 nt, Salmonella typhimurium LT2
aaucuacuauuucacggagucu

SEQ ID NO: 215451 - RNA, 22 nt, Salmonella typhimurium LT2
agauuugcuugaguuguuuagc

SEQ ID NO: 215452 - RNA, 22 nt, Salmonella typhimurium LT2
agauucaucuaauuugauuacu

SEQ ID NO: 215453 - RNA, 18 nt, Salmonella typhimurium LT2
agauugcuguaucguagu

SEQ ID NO: 215454 - RNA, 22 nt, Salmonella typhimurium LT2
agauugguaaugaugguuuauu

SEQ ID NO: 215455 - RNA, 22 nt, Salmonella typhimurium LT2
agauaaugagauaucauccaua

SEQ ID NO: 215456 - RNA, 22 nt, Salmonella typhimurium LT2
agacugcauuucaauggcuucc

SEQ ID NO: 215457 - RNA, 22 nt, Salmonella typhimurium LT2
acguggugcgcggcagccguuu

SEQ ID NO: 215458 - RNA, 22 nt, Salmonella typhimurium LT2
agacucugcggguugauguuug

SEQ ID NO: 215459 - RNA, 22 nt, Salmonella typhimurium LT2
uuucauuguuguggaaccgcuu

SEQ ID NO: 215460 - RNA, 22 nt, Salmonella typhimurium LT2
uuugaacccgcaucacugccga

SEQ ID NO: 215461 - RNA, 22 nt, Salmonella typhimurium LT2
uuaucagucuacaaauuacuuu

SEQ ID NO: 215462 - RNA, 22 nt, Salmonella typhimurium LT2
uuaugauguucacuuuacuggc

SEQ ID NO: 215463 - RNA, 22 nt, Salmonella typhimurium LT2
ugguggaacuugcugauauuau

SEQ ID NO: 215464 - RNA, 22 nt, Salmonella typhimurium LT2
uggugccgaacaugguagccac

SEQ ID NO: 215465 - RNA, 22 nt, Salmonella typhimurium LT2
ugguaggccggauaaggcguuc

SEQ ID NO: 215466 - RNA, 22 nt, Salmonella typhimurium LT2
uggucaaacuggcggagacgaa

SEQ ID NO: 215467 - RNA, 22 nt, Salmonella typhimurium LT2
ugggcuuaaugccguagagucu

SEQ ID NO: 215468 - RNA, 21 nt, Salmonella typhimurium LT2
ugggaucuucucaucgaacgg

SEQ ID NO: 215469 - RNA, 21 nt, Salmonella typhimurium LT2
uucaaggaaauugccgcuugu

SEQ ID NO: 215470 - RNA, 22 nt, Salmonella typhimurium LT2
uucacauugucagacacaugaa

SEQ ID NO: 215471 - RNA, 20 nt, Salmonella typhimurium LT2
uucacgcccggcaguuugcc

SEQ ID NO: 215472 - RNA, 22 nt, Salmonella typhimurium LT2
uuccaggcuucuauguuggcuu

SEQ ID NO: 215473 - RNA, 22 nt, Salmonella typhimurium LT2
uucaaacugauaacaauguggg

SEQ ID NO: 215474 - RNA, 22 nt, Salmonella typhimurium LT2
uucgaugagaagaucccacucg

SEQ ID NO: 215475 - RNA, 22 nt, Salmonella typhimurium LT2
uucgcuaucaugauauaucacu

SEQ ID NO: 215476 - RNA, 22 nt, Salmonella typhimurium LT2
uugccggcgagaugauggcagg

SEQ ID NO: 215477 - RNA, 22 nt, Salmonella typhimurium LT2
uugcucaacguauucgccagua

SEQ ID NO: 215478 - RNA, 22 nt, Salmonella typhimurium LT2
uugcccgucuggcaggaaacgc

SEQ ID NO: 215479 - RNA, 22 nt, Salmonella typhimurium LT2
uugcauuucacggucagaucga

SEQ ID NO: 215480 - RNA, 21 nt, Salmonella typhimurium LT2
uugagucuauccauccggaua

SEQ ID NO: 215481 - RNA, 22 nt, Salmonella typhimurium LT2
uugauaccacgaaaaucgggau

SEQ ID NO: 215482 - RNA, 22 nt, Salmonella typhimurium LT2
uugacuuugggucugcgcgucg

SEQ ID NO: 215483 - RNA, 22 nt, Salmonella typhimurium LT2
uugagcaauagccguaucaaac

SEQ ID NO: 215484 - RNA, 22 nt, Salmonella typhimurium LT2
uugagcuucaugacauuaaugu

SEQ ID NO: 215485 - RNA, 22 nt, Salmonella typhimurium LT2
uugaggaaugggcgaguauuug

SEQ ID NO: 215486 - RNA, 22 nt, Salmonella typhimurium LT2
uuuaucagcuuguugagaagau

SEQ ID NO: 215487 - RNA, 22 nt, Salmonella typhimurium LT2
uuguaagaaagcgcuuugcccu

SEQ ID NO: 215488 - RNA, 22 nt, Salmonella typhimurium LT2
uugcuggagcgauuucaggagg

SEQ ID NO: 215489 - RNA, 22 nt, Salmonella typhimurium LT2
ucaaucuucauccgcgcgccca

SEQ ID NO: 215490 - RNA, 22 nt, Salmonella typhimurium LT2
uaggccgacuguucaccacuac

SEQ ID NO: 215491 - RNA, 23 nt, Salmonella typhimurium LT2
uacuucauucagggcaagguggc

SEQ ID NO: 215492 - RNA, 22 nt, Salmonella typhimurium LT2
ucagagaguagugcaguuacag

SEQ ID NO: 215493 - RNA, 19 nt, Salmonella typhimurium LT2
ucagcuccauguucgccgc

SEQ ID NO: 215494 - RNA, 22 nt, Salmonella typhimurium LT2
ucagcgccugggugucaaucug

SEQ ID NO: 215495 - RNA, 22 nt, Salmonella typhimurium LT2
ucagauagauauucgcauccgg

SEQ ID NO: 215496 - RNA, 22 nt, Salmonella typhimurium LT2
ucacugaugagccagguucugg

SEQ ID NO: 215497 - RNA, 22 nt, Salmonella typhimurium LT2
ucagaauaucuccauuauucgc

SEQ ID NO: 215498 - RNA, 22 nt, Salmonella typhimurium LT2
ucgccuguacuugaugucuggc

SEQ ID NO: 215499 - RNA, 22 nt, Salmonella typhimurium LT2
ucggcagcgaaaaauucacugc

SEQ ID NO: 215500 - RNA, 22 nt, Salmonella typhimurium LT2
ucgcucaguucuaucuuguugc

SEQ ID NO: 215501 - RNA, 21 nt, Salmonella typhimurium LT2
ucguucagucccaugugccgg

SEQ ID NO: 215502 - RNA, 18 nt, Salmonella typhimurium LT2
ugcaggaacugguuauuc

SEQ ID NO: 215503 - RNA, 22 nt, Salmonella typhimurium LT2
ugcagggccuuuucucccgcca

SEQ ID NO: 215504 - RNA, 22 nt, Salmonella typhimurium LT2
ugccagccgcauugucgucgau

SEQ ID NO: 215505 - RNA, 22 nt, Salmonella typhimurium LT2
ugcaggucggguaagcguauug

SEQ ID NO: 215506 - RNA, 22 nt, Salmonella typhimurium LT2
ugccuggcaaucuauuuauggu

SEQ ID NO: 215507 - RNA, 22 nt, Salmonella typhimurium LT2
ugccucgcugauucaggcgugu

SEQ ID NO: 215508 - RNA, 22 nt, Salmonella typhimurium LT2
ugaccucaauuuucugcucaau

SEQ ID NO: 215509 - RNA, 20 nt, Salmonella typhimurium LT2
ugcugucaggggacuguccg

SEQ ID NO: 215510 - RNA, 22 nt, Salmonella typhimurium LT2
ugcuggauagagaaaacccccg

SEQ ID NO: 215511 - RNA, 22 nt, Salmonella typhimurium LT2
uggacaggacacgggauaauca

SEQ ID NO: 215512 - RNA, 22 nt, Salmonella typhimurium LT2
uggaccugcguacuuucucgcu

SEQ ID NO: 215513 - RNA, 22 nt, Salmonella typhimurium LT2
ugcucacggauugcugaagggg

SEQ ID NO: 215514 - RNA, 22 nt, Salmonella typhimurium LT2
ugcuccaguuuccacggcgggu

SEQ ID NO: 215515 - RNA, 22 nt, Salmonella typhimurium LT2
ugcgucugccugagcuggugca

SEQ ID NO: 215516 - RNA, 22 nt, Salmonella typhimurium LT2
ugcguuauaguguuuucaucau

SEQ ID NO: 215517 - RNA, 19 nt, Salmonella typhimurium LT2
ugcguacccgaaaaaugcc

SEQ ID NO: 215518 - RNA, 22 nt, Salmonella typhimurium LT2
ugcgcugcuugaaaagcaucag

SEQ ID NO: 215519 - RNA, 22 nt, Salmonella typhimurium LT2
uagcccuguuguuuuuucaugu

SEQ ID NO: 215520 - RNA, 19 nt, Salmonella typhimurium LT2
uaccaguaaccaaagucaa

SEQ ID NO: 215521 - RNA, 22 nt, Salmonella typhimurium LT2
uacaaaugauaacauaacccgu

SEQ ID NO: 215522 - RNA, 22 nt, Salmonella typhimurium LT2
uacacccuguuccgugaugcgu

SEQ ID NO: 215523 - RNA, 22 nt, Salmonella typhimurium LT2
uacaggccggauaaggcgcagc

SEQ ID NO: 215524 - RNA, 22 nt, Salmonella typhimurium LT2
uacagggcuguagcaggcgucg

SEQ ID NO: 215525 - RNA, 22 nt, Salmonella typhimurium LT2
gugaauaagcgguagaguaaac

SEQ ID NO: 215526 - RNA, 22 nt, Salmonella typhimurium LT2
guguggaacggcagaucggaaa

SEQ ID NO: 215527 - RNA, 22 nt, Salmonella typhimurium LT2
guuggauaguggcuucuuccag

SEQ ID NO: 215528 - RNA, 18 nt, Salmonella typhimurium LT2
gucugccugauuaucagg

SEQ ID NO: 215529 - RNA, 22 nt, Salmonella typhimurium LT2
gucaggcuuguggcugauaucg

SEQ ID NO: 215530 - RNA, 22 nt, Salmonella typhimurium LT2
gucagggcugccgaugucgcca

SEQ ID NO: 215531 - RNA, 22 nt, Salmonella typhimurium LT2
guccaugaaguccaugccaucu

SEQ ID NO: 215532 - RNA, 22 nt, Salmonella typhimurium LT2
gucauuuaugauaagcguuugu

SEQ ID NO: 215533 - RNA, 22 nt, Salmonella typhimurium LT2
guccagcagguggucgccauau

SEQ ID NO: 215534 - RNA, 22 nt, Salmonella typhimurium LT2
guccagcagugguuucauacuc

SEQ ID NO: 215535 - RNA, 22 nt, Salmonella typhimurium LT2
gucacuuccgugaacauuggcg

SEQ ID NO: 215536 - RNA, 22 nt, Salmonella typhimurium LT2
guagggcguuacaguaucauac

SEQ ID NO: 215537 - RNA, 22 nt, Salmonella typhimurium LT2
guacuuucacuacugccagaau

SEQ ID NO: 215538 - RNA, 22 nt, Salmonella typhimurium LT2
gguggcauggcuugccgguccg

SEQ ID NO: 215539 - RNA, 22 nt, Salmonella typhimurium LT2
ggugcaguauuuggcaagcuga

SEQ ID NO: 215540 - RNA, 22 nt, Salmonella typhimurium LT2
ggugcauguucgggacuugcug

SEQ ID NO: 215541 - RNA, 23 nt, Salmonella typhimurium LT2
ggauacuugaugccuuuauccgg

SEQ ID NO: 215542 - RNA, 22 nt, Salmonella typhimurium LT2
ggauauugaugcggcgaucauu

SEQ ID NO: 215543 - RNA, 22 nt, Salmonella typhimurium LT2
ggugaaacgcugaaugucuccc

SEQ ID NO: 215544 - RNA, 22 nt, Salmonella typhimurium LT2
gcuuucaggccuccuggugugg

SEQ ID NO: 215545 - RNA, 22 nt, Salmonella typhimurium LT2
gcuuucacgcccauuuucggga

SEQ ID NO: 215546 - RNA, 22 nt, Salmonella typhimurium LT2
ggagccuguaucgucggcgcgc

SEQ ID NO: 215547 - RNA, 21 nt, Salmonella typhimurium LT2
ggaauguuacugcauuggcaa

SEQ ID NO: 215548 - RNA, 22 nt, Salmonella typhimurium LT2
ggaauugauaugaaugacaugu

SEQ ID NO: 215549 - RNA, 22 nt, Salmonella typhimurium LT2
ggacagcguugcgugguguuuu

SEQ ID NO: 215550 - RNA, 22 nt, Salmonella typhimurium LT2
gcuauuucuggugguucaguau

SEQ ID NO: 215551 - RNA, 22 nt, Salmonella typhimurium LT2
gcguuauucugcgcgcgcucua

SEQ ID NO: 215552 - RNA, 22 nt, Salmonella typhimurium LT2
ccuguuggaaguaccaggcgug

SEQ ID NO: 215553 - RNA, 22 nt, Salmonella typhimurium LT2
ccuguugguuuacguuauggcu

SEQ ID NO: 215554 - RNA, 22 nt, Salmonella typhimurium LT2
ccuguaggccggauaagcauua

SEQ ID NO: 215555 - RNA, 22 nt, Salmonella typhimurium LT2
ccuucggaccaauuuuacgccg

SEQ ID NO: 215556 - RNA, 22 nt, Salmonella typhimurium LT2
cgaaacauguuacuuaauggca

SEQ ID NO: 215557 - RNA, 22 nt, Salmonella typhimurium LT2
cgccugagcuguaacggcagag

SEQ ID NO: 215558 - RNA, 22 nt, Salmonella typhimurium LT2
cgcuccugcuccugcuccaucc

SEQ ID NO: 215559 - RNA, 22 nt, Salmonella typhimurium LT2
cuggaagaagccacuauccaac

SEQ ID NO: 215560 - RNA, 22 nt, Salmonella typhimurium LT2
cuggaagcgcucgguguuuggc

SEQ ID NO: 215561 - RNA, 22 nt, Salmonella typhimurium LT2
ccugauucagggaucggggacg

SEQ ID NO: 215562 - RNA, 22 nt, Salmonella typhimurium LT2
ccuggguguauuuccccugggu

SEQ ID NO: 215563 - RNA, 22 nt, Salmonella typhimurium LT2
ccgcugcuugcugcucuauccg

SEQ ID NO: 215564 - RNA, 22 nt, Salmonella typhimurium LT2
ccgacugcugcugaaucagcgc

SEQ ID NO: 215565 - RNA, 22 nt, Salmonella typhimurium LT2
cccucaguaugcaggccgcgau

SEQ ID NO: 215566 - RNA, 22 nt, Salmonella typhimurium LT2
aggccugauaagcgcagcgcca

SEQ ID NO: 215567 - RNA, 22 nt, Salmonella typhimurium LT2
aggccggauaagcguagcgcca

SEQ ID NO: 215568 - RNA, 22 nt, Salmonella typhimurium LT2
caucuucaaaacgcugcaugag

SEQ ID NO: 215569 - RNA, 19 nt, Salmonella typhimurium LT2
caucuuuaccuuuguguug

SEQ ID NO: 215570 - RNA, 22 nt, Salmonella typhimurium LT2
caugaagcuuuggauaaauuug

SEQ ID NO: 215571 - RNA, 22 nt, Salmonella typhimurium LT2
caugaauuucagcaucaaaauc

SEQ ID NO: 215572 - RNA, 22 nt, Salmonella typhimurium LT2
caugagcugggcuaugaaugcc

SEQ ID NO: 215573 - RNA, 22 nt, Salmonella typhimurium LT2
ccaaugauuaucauuucaguuu

SEQ ID NO: 215574 - RNA, 22 nt, Salmonella typhimurium LT2
cauguugucauuauaaaaguga

SEQ ID NO: 215575 - RNA, 19 nt, Salmonella typhimurium LT2
cauugcuggauaagauuua

SEQ ID NO: 215576 - RNA, 22 nt, Salmonella typhimurium LT2
ccagcgcuucaguauggcgggu

SEQ ID NO: 215577 - RNA, 22 nt, Salmonella typhimurium LT2
ccaggguuugacguuuccacuu

SEQ ID NO: 215578 - RNA, 22 nt, Salmonella typhimurium LT2
ccagcagcaggaugccgaaagc

SEQ ID NO: 215579 - RNA, 22 nt, Salmonella typhimurium LT2
gaucgcuaaaacguuuuuaugu

SEQ ID NO: 215580 - RNA, 22 nt, Salmonella typhimurium LT2
gauauugaugccgaugugguga

SEQ ID NO: 215581 - RNA, 22 nt, Salmonella typhimurium LT2
gaucaggucgguaaucaauagc

SEQ ID NO: 215582 - RNA, 22 nt, Salmonella typhimurium LT2
gaguuuaucuucaacagugaaa

SEQ ID NO: 215583 - RNA, 22 nt, Salmonella typhimurium LT2
gaggauucacugggaauggaag

SEQ ID NO: 215584 - RNA, 22 nt, Salmonella typhimurium LT2
gagcuggacgaucugaucauuc

SEQ ID NO: 215585 - RNA, 22 nt, Salmonella typhimurium LT2
cuggaagucaugggcauuuaug

SEQ ID NO: 215586 - RNA, 18 nt, Salmonella typhimurium LT2
cuggcaguagugaaagua

SEQ ID NO: 215587 - RNA, 19 nt, Salmonella typhimurium LT2
cuggcauaguaagaaguau

SEQ ID NO: 215588 - RNA, 22 nt, Salmonella typhimurium LT2
cuggcggaugcguuagggaugg

SEQ ID NO: 215589 - RNA, 22 nt, Salmonella typhimurium LT2
cuggaggccgcuaaucugaguc

SEQ ID NO: 215590 - RNA, 22 nt, Salmonella typhimurium LT2
cuggcugcugacgguccuguua

SEQ ID NO: 215591 - RNA, 22 nt, Salmonella typhimurium LT2
cuggcuggagucucagggcgca

SEQ ID NO: 215592 - RNA, 22 nt, Salmonella typhimurium LT2
cugguggcuuuccgggcagccg

SEQ ID NO: 215593 - RNA, 22 nt, Salmonella typhimurium LT2
cuggugcacgagguggaacaua

SEQ ID NO: 215594 - RNA, 22 nt, Salmonella typhimurium LT2
cuguaugguuauaaaaaggaug

SEQ ID NO: 215595 - RNA, 22 nt, Salmonella typhimurium LT2
cugugagacggcggauugcgug

SEQ ID NO: 215596 - RNA, 22 nt, Salmonella typhimurium LT2
gauggugaugaccgucaaugcc

SEQ ID NO: 215597 - RNA, 22 nt, Salmonella typhimurium LT2
gauggugaucagcgcuaccaga

SEQ ID NO: 215598 - RNA, 22 nt, Salmonella typhimurium LT2
gaugauuaacgcauaagcgaug

SEQ ID NO: 215599 - RNA, 22 nt, Salmonella typhimurium LT2
gauugagcguuuacuggagucg

SEQ ID NO: 215600 - RNA, 22 nt, Salmonella typhimurium LT2
gccuguuuuugcguaaagaggg

SEQ ID NO: 215601 - RNA, 22 nt, Salmonella typhimurium LT2
gccugucccgucagcuuugguc

SEQ ID NO: 215602 - RNA, 22 nt, Salmonella typhimurium LT2
gccugugggugaauccggacug

SEQ ID NO: 215603 - RNA, 22 nt, Salmonella typhimurium LT2
gcgcauccuccaguuggcuguu

SEQ ID NO: 215604 - RNA, 20 nt, Salmonella typhimurium LT2
gcgucaugcggcugcguuuc

SEQ ID NO: 215605 - RNA, 22 nt, Salmonella typhimurium LT2
gcgccaucgcucugggaaucgu

SEQ ID NO: 215606 - RNA, 22 nt, Human
aaaaaaacuaauuuuaaaugug

SEQ ID NO: 215607 - RNA, 22 nt, Human
aaaaaguaccacuuggacacuu

SEQ ID NO: 215608 - RNA, 22 nt, Human
aaaaacuuaccccagggcaagg

SEQ ID NO: 215609 - RNA, 22 nt, Human
aaaacauuuuacugccaucuca

SEQ ID NO: 215610 - RNA, 22 nt, Human
aaaagauguaaacauauauuaa

SEQ ID NO: 215611 - RNA, 22 nt, Human
aaaagaaugaugggagcugggu

SEQ ID NO: 215612 - RNA, 22 nt, Human
aaaaaauugcuggcagagcugu

SEQ ID NO: 215613 - RNA, 20 nt, Human
aaaaacaguaaugcugaaga

SEQ ID NO: 215614 - RNA, 20 nt, Human
aaaaauguguuuauggagau

SEQ ID NO: 215615 - RNA, 22 nt, Human
aaacugcuuucucugccuuucc

SEQ ID NO: 215616 - RNA, 22 nt, Human
aaagagacaacaacaacuucua

SEQ ID NO: 215617 - RNA, 21 nt, Human
aaagaagagcucagagguaga

SEQ ID NO: 215618 - RNA, 22 nt, Human
aaagaacguuucugggaaucag

SEQ ID NO: 215619 - RNA, 22 nt, Human
aaacuuuaucaaguacucuuca

SEQ ID NO: 215620 - RNA, 22 nt, Human
aaacugacugaugugaucuuau

SEQ ID NO: 215621 - RNA, 20 nt, Human
aaacucucugaucuuacagu

SEQ ID NO: 215622 - RNA, 22 nt, Human
aaacugugcagucacauaagga

SEQ ID NO: 215623 - RNA, 22 nt, Human
aaacucaugccagagaacuuaa

SEQ ID NO: 215624 - RNA, 22 nt, Human
aaacucaucaguuuagaaaccu

SEQ ID NO: 215625 - RNA, 20 nt, Human
aaacucuuuucuuacauuuu

SEQ ID NO: 215626 - RNA, 22 nt, Human
aaaagcauuauuagucugggug

SEQ ID NO: 215627 - RNA, 22 nt, Human
aaaauaaccuucauuugcauug

SEQ ID NO: 215628 - RNA, 22 nt, Human
aaaauauaaaggauguggguuu

SEQ ID NO: 215629 - RNA, 22 nt, Human
aaacacacaacauauuuuggaa

SEQ ID NO: 215630 - RNA, 22 nt, Human
aaaauaauauuauaccacugcu

SEQ ID NO: 215631 - RNA, 22 nt, Human
aaacaauaauaauuaggaagga

SEQ ID NO: 215632 - RNA, 22 nt, Human
aaacaagagcuuacauggcugc

SEQ ID NO: 215633 - RNA, 22 nt, Human
aaacauaugccuucuuuuguaa

SEQ ID NO: 215634 - RNA, 22 nt, Human
aaacauguagugcaugaggauc

SEQ ID NO: 215635 - RNA, 21 nt, Human
aaacaugcagccugccaauuc

SEQ ID NO: 215636 - RNA, 22 nt, Human
aaaauacuaggaaaauaaauca

SEQ ID NO: 215637 - RNA, 22 nt, Human
aauuauugucuuuuuuaaaagc

SEQ ID NO: 215638 - RNA, 22 nt, Human
aauucaacagucaguuaucuca

SEQ ID NO: 215639 - RNA, 22 nt, Human
aauucaggacaaauguuuucaa

SEQ ID NO: 215640 - RNA, 21 nt, Human
aauuauuugcauuuuucuugu

SEQ ID NO: 215641 - RNA, 22 nt, Human
aauuauguuugcuuuagaugga

SEQ ID NO: 215642 - RNA, 22 nt, Human
aauuagaagcuguuagcaaaau

SEQ ID NO: 215643 - RNA, 22 nt, Human
aauuauucuugccuagguuuaa

SEQ ID NO: 215644 - RNA, 22 nt, Human
aauuacuuuaggaaaacuccuc

SEQ ID NO: 215645 - RNA, 22 nt, Human
aauguuguaaauauucuuugag

SEQ ID NO: 215646 - RNA, 23 nt, Human
aauguugaggguggguuuuuaac

SEQ ID NO: 215647 - RNA, 22 nt, Human
aauguuuaagcuuuuauuuaca

SEQ ID NO: 215648 - RNA, 22 nt, Human
aauguuuaacuguggucagcag

SEQ ID NO: 215649 - RNA, 22 nt, Human
aauguugacguuggccagggcc

SEQ ID NO: 215650 - RNA, 22 nt, Human
aauguugaaccuuuuuggccug

SEQ ID NO: 215651 - RNA, 22 nt, Human
aauguucucuaaucuuucucuu

SEQ ID NO: 215652 - RNA, 22 nt, Human
aauguaguuuacugugagugca

SEQ ID NO: 215653 - RNA, 22 nt, Human
aaugguggaugucuguucugac

SEQ ID NO: 215654 - RNA, 22 nt, Human
aaugggauuaagaaagaucuug

SEQ ID NO: 215655 - RNA, 23 nt, Human
aaugggcggaaguguuaaguugc

SEQ ID NO: 215656 - RNA, 22 nt, Human
aauguacucgaaugauguuaag

SEQ ID NO: 215657 - RNA, 22 nt, Human
aauguacucuguguuucucaug

SEQ ID NO: 215658 - RNA, 22 nt, Human
aauguaaauaauuguaaaauuu

SEQ ID NO: 215659 - RNA, 22 nt, Human
aaugguuacuacccugggucuu

SEQ ID NO: 215660 - RNA, 22 nt, Human
aauggcagauaauuuuccagau

SEQ ID NO: 215661 - RNA, 22 nt, Human
aauggagaaaagacaauguuga

SEQ ID NO: 215662 - RNA, 22 nt, Human
aauggaugauuaaauggaugaa

SEQ ID NO: 215663 - RNA, 22 nt, Human
aaugcagaugugucuuuaauuu

SEQ ID NO: 215664 - RNA, 22 nt, Human
aaugcugaaugcauguuuccau

SEQ ID NO: 215665 - RNA, 22 nt, Human
aaugcuaaagaagaaggaguag

SEQ ID NO: 215666 - RNA, 22 nt, Human
aaugccuucauuggcgaagugc

SEQ ID NO: 215667 - RNA, 22 nt, Human
aauggaaaaauccacagggaac

SEQ ID NO: 215668 - RNA, 22 nt, Human
aaugcauacguguuuguggcaa

SEQ ID NO: 215669 - RNA, 22 nt, Human
aauggacuucucugagccuguu

SEQ ID NO: 215670 - RNA, 22 nt, Human
aauggaccuuaaauugcuucag

SEQ ID NO: 215671 - RNA, 22 nt, Human
aaugaaacuaguagaaucuuug

SEQ ID NO: 215672 - RNA, 22 nt, Human
aaugaacuuucaguucagagag

SEQ ID NO: 215673 - RNA, 22 nt, Human
aaugaauaaauuuuaaagacag

SEQ ID NO: 215674 - RNA, 22 nt, Human
aaucugugugugagaaauggca

SEQ ID NO: 215675 - RNA, 22 nt, Human
aaucuguugucaggaauccaca

SEQ ID NO: 215676 - RNA, 22 nt, Human
aaucugugaggaauaaugaguu

SEQ ID NO: 215677 - RNA, 22 nt, Human
aaucuuguucaacauuaucugu

SEQ ID NO: 215678 - RNA, 22 nt, Human
aaucugaccguggagaucucca

SEQ ID NO: 215679 - RNA, 22 nt, Human
aaucugacaaaauauuuccagu

SEQ ID NO: 215680 - RNA, 22 nt, Human
aaucucuugggaagagugagug

SEQ ID NO: 215681 - RNA, 22 nt, Human
aaucaaagccugcaaguugacu

SEQ ID NO: 215682 - RNA, 22 nt, Human
aauauuuugggacugaggaauu

SEQ ID NO: 215683 - RNA, 22 nt, Human
aauauuuaccuaccugucaucu

SEQ ID NO: 215684 - RNA, 23 nt, Human
aaucacuggauuugagcaugagg

SEQ ID NO: 215685 - RNA, 22 nt, Human
aaucaugagguguuucuuugca

SEQ ID NO: 215686 - RNA, 22 nt, Human
aaucaagcugcuguuuguucua

SEQ ID NO: 215687 - RNA, 22 nt, Human
aaucaauuauccauuuguuagu

SEQ ID NO: 215688 - RNA, 22 nt, Human
aaucucguuaugaagaugguug

SEQ ID NO: 215689 - RNA, 22 nt, Human
aaucgacuguagagacuuggcg

SEQ ID NO: 215690 - RNA, 22 nt, Human
aaucccaguugacagaacuguu

SEQ ID NO: 215691 - RNA, 23 nt, Human
aaugaguugggcagcauacaggc

SEQ ID NO: 215692 - RNA, 22 nt, Human
aaugagauaagaaaaccuuugc

SEQ ID NO: 215693 - RNA, 22 nt, Human
aaugagauggaggacucuuaau

SEQ ID NO: 215694 - RNA, 22 nt, Human
aaugagacgagagaacccauuu

SEQ ID NO: 215695 - RNA, 22 nt, Human
aaugaguucaucugaauucugg

SEQ ID NO: 215696 - RNA, 22 nt, Human
aaugauuuucugcaaacaguga

SEQ ID NO: 215697 - RNA, 22 nt, Human
aaucuuuuugaaggaggagaga

SEQ ID NO: 215698 - RNA, 22 nt, Human
aaugaaugaaugaaugauuaug

SEQ ID NO: 215699 - RNA, 22 nt, Human
aaugacagccuauacugucugc

SEQ ID NO: 215700 - RNA, 22 nt, Human
aaugagaauguaagugaagaga

SEQ ID NO: 215701 - RNA, 22 nt, Human
aaugacaguggcacagucacuu

SEQ ID NO: 215702 - RNA, 22 nt, Human
aaugaacuuugaagauggugaa

SEQ ID NO: 215703 - RNA, 22 nt, Human
aaugaaaaucugucaguucaag

SEQ ID NO: 215704 - RNA, 20 nt, Human
aaguugaaguuacuucaugg

SEQ ID NO: 215705 - RNA, 22 nt, Human
aaguuaaaaaagcuggguaaaa

SEQ ID NO: 215706 - RNA, 22 nt, Human
aaguugacuguuuuacuuaugu

SEQ ID NO: 215707 - RNA, 22 nt, Human
aagugucucugggaggcccgga

SEQ ID NO: 215708 - RNA, 22 nt, Human
aaguuaugauuggcguggacaa

SEQ ID NO: 215709 - RNA, 22 nt, Human
aaguuaauugcuucuaguuaau

SEQ ID NO: 215710 - RNA, 22 nt, Human
aagugugugugcgcaugugcau

SEQ ID NO: 215711 - RNA, 22 nt, Human
aagugugugagaaggggucgca

SEQ ID NO: 215712 - RNA, 22 nt, Human
aaguguucucuguuuuaucuac

SEQ ID NO: 215713 - RNA, 22 nt, Human
aaguauuccccaaguauucugg

SEQ ID NO: 215714 - RNA, 22 nt, Human
aaggugccacuucccucagacu

SEQ ID NO: 215715 - RNA, 22 nt, Human
aagucauuaucucuucuaaucu

SEQ ID NO: 215716 - RNA, 22 nt, Human
aaguagaaaaccgcacuggacu

SEQ ID NO: 215717 - RNA, 22 nt, Human
aaguggcccuaauugggccaaa

SEQ ID NO: 215718 - RNA, 23 nt, Human
aaguggucaucuaucccaugguu

SEQ ID NO: 215719 - RNA, 23 nt, Human
aaguggugacugugcuacugaga

SEQ ID NO: 215720 - RNA, 22 nt, Human
aaguggcaggggaaggguugga

SEQ ID NO: 215721 - RNA, 22 nt, Human
aaguggugagacccugcugaaa

SEQ ID NO: 215722 - RNA, 22 nt, Human
aauaagagaauaaaaucuguua

SEQ ID NO: 215723 - RNA, 22 nt, Human
aauaacaguuuauuugagggcu

SEQ ID NO: 215724 - RNA, 22 nt, Human
aauaagacugucauggaguaaa

SEQ ID NO: 215725 - RNA, 22 nt, Human
aauaacuuaaugacuguguaca

SEQ ID NO: 215726 - RNA, 22 nt, Human
aauaacuuacucuaugcuuagu

SEQ ID NO: 215727 - RNA, 22 nt, Human
aaguugaaugucuugcugaaug

SEQ ID NO: 215728 - RNA, 22 nt, Human
aaguuuaagguagugaugauga

SEQ ID NO: 215729 - RNA, 22 nt, Human
aauacagauggcaugugaagau

SEQ ID NO: 215730 - RNA, 22 nt, Human
aauaauacaauuggugucaugu

SEQ ID NO: 215731 - RNA, 22 nt, Human
aauacaaucagauuaugguagu

SEQ ID NO: 215732 - RNA, 22 nt, Human
aauagaguccuguacugaauga

SEQ ID NO: 215733 - RNA, 22 nt, Human
aauaggaaggaaauguuuaccu

SEQ ID NO: 215734 - RNA, 22 nt, Human
aauagguaaaugaguaagaaau

SEQ ID NO: 215735 - RNA, 22 nt, Human
aauauauaugggugcaugucug

SEQ ID NO: 215736 - RNA, 22 nt, Human
aauaggguccuuuguguuauau

SEQ ID NO: 215737 - RNA, 22 nt, Human
aauaugaugccaaauugcuaca

SEQ ID NO: 215738 - RNA, 22 nt, Human
aaguacugauucuguuccucaa

SEQ ID NO: 215739 - RNA, 21 nt, Human
aaguacccuuuugcuacucag

SEQ ID NO: 215740 - RNA, 21 nt, Human
aaguaaauuuuuacuuaggcc

SEQ ID NO: 215741 - RNA, 22 nt, Human
aagguuuuguaugaaaucucug

SEQ ID NO: 215742 - RNA, 22 nt, Human
aagguguaaguagcugguucau

SEQ ID NO: 215743 - RNA, 22 nt, Human
aagguggugaucaucuugaagg

SEQ ID NO: 215744 - RNA, 22 nt, Human
aagguuuuguuuucgguuuuuu

SEQ ID NO: 215745 - RNA, 22 nt, Human
aaguaaaucuuaugucagggag

SEQ ID NO: 215746 - RNA, 22 nt, Human
aaggucuucgaaccuuauguua

SEQ ID NO: 215747 - RNA, 22 nt, Human
aaggucucucgggcuuugcuga

SEQ ID NO: 215748 - RNA, 22 nt, Human
aagguccuguagccacagagcc

SEQ ID NO: 215749 - RNA, 22 nt, Human
aagguaaugcaucaggcaggga

SEQ ID NO: 215750 - RNA, 22 nt, Human
aagguccaugaauaucuaagcc

SEQ ID NO: 215751 - RNA, 22 nt, Human
aagggggacaagcauuggcuua

SEQ ID NO: 215752 - RNA, 22 nt, Human
aagggaaacagccaggcccugu

SEQ ID NO: 215753 - RNA, 22 nt, Human
aagggaauagagcagcaaaaau

SEQ ID NO: 215754 - RNA, 22 nt, Human
aagggaaggaugggcauuuaca

SEQ ID NO: 215755 - RNA, 22 nt, Human
aagggaaguuugacacuuuuua

SEQ ID NO: 215756 - RNA, 22 nt, Human
aagggaaaagcugaaugagaug

SEQ ID NO: 215757 - RNA, 22 nt, Human
aagggcuucucgccugugugca

SEQ ID NO: 215758 - RNA, 22 nt, Human
aaggcaguuaauuuggcuagaa

SEQ ID NO: 215759 - RNA, 22 nt, Human
aagcccuuugaaaauguguguc

SEQ ID NO: 215760 - RNA, 22 nt, Human
aaggcggcggcggcggcugcgg

SEQ ID NO: 215761 - RNA, 22 nt, Human
aaggcgccacagugauugcaaa

SEQ ID NO: 215762 - RNA, 22 nt, Human
aaggcuuugugcugaguugucg

SEQ ID NO: 215763 - RNA, 22 nt, Human
aaggaugguaacaguuucauuu

SEQ ID NO: 215764 - RNA, 22 nt, Human
aaggaggaugaauugucugcaa

SEQ ID NO: 215765 - RNA, 22 nt, Human
aagcgcaaggugucagcagguu

SEQ ID NO: 215766 - RNA, 18 nt, Human
aaggaggaaugaauagca

SEQ ID NO: 215767 - RNA, 22 nt, Human
aagcaggaaaugaaaugcuugc

SEQ ID NO: 215768 - RNA, 22 nt, Human
aagcauaucaaguuuuaugugc

SEQ ID NO: 215769 - RNA, 22 nt, Human
aagccuccgugcugcuggaucu

SEQ ID NO: 215770 - RNA, 22 nt, Human
aagccuguugacagcugucagu

SEQ ID NO: 215771 - RNA, 22 nt, Human
aacgggcacuuuauuuaaaaaa

SEQ ID NO: 215772 - RNA, 22 nt, Human
aacuacucugggguggcagguu

SEQ ID NO: 215773 - RNA, 22 nt, Human
aacgugcuuuacaaaugaccuu

SEQ ID NO: 215774 - RNA, 22 nt, Human
aacgucugagaccccuccucuc

SEQ ID NO: 215775 - RNA, 22 nt, Human
aacugaaguuuucagauuuugc

SEQ ID NO: 215776 - RNA, 22 nt, Human
aacgcaacaacuggagcuguag

SEQ ID NO: 215777 - RNA, 22 nt, Human
aacgccgggacucgcagggagc

SEQ ID NO: 215778 - RNA, 22 nt, Human
aacucgaugcaauucacuuugu

SEQ ID NO: 215779 - RNA, 22 nt, Human
aacgcugugcacuggguccagg

SEQ ID NO: 215780 - RNA, 19 nt, Human
aacuacagcgcacuguccu

SEQ ID NO: 215781 - RNA, 23 nt, Human
aacucuggcuagcauagaauaga

SEQ ID NO: 215782 - RNA, 19 nt, Human
aacucugccgaggcaagcc

SEQ ID NO: 215783 - RNA, 22 nt, Human
aacucugcaaugaaaucauguu

SEQ ID NO: 215784 - RNA, 22 nt, Human
aacucaggagagaguaacaggg

SEQ ID NO: 215785 - RNA, 22 nt, Human
aacucugagaaacuugcaguug

SEQ ID NO: 215786 - RNA, 22 nt, Human
aagaaaccauauuaguuccugg

SEQ ID NO: 215787 - RNA, 22 nt, Human
aacuucuggaaacuuccaugug

SEQ ID NO: 215788 - RNA, 22 nt, Human
aacuuauacccagggcagaaau

SEQ ID NO: 215789 - RNA, 22 nt, Human
aacuugaagacaccccacauuc

SEQ ID NO: 215790 - RNA, 22 nt, Human
aacuuuacagacuagagcuuuc

SEQ ID NO: 215791 - RNA, 22 nt, Human
aacuuuuaugaaggaaaucaua

SEQ ID NO: 215792 - RNA, 19 nt, Human
aagaacaguucuaauuuca

SEQ ID NO: 215793 - RNA, 22 nt, Human
aacuuucugaaaagcuugauca

SEQ ID NO: 215794 - RNA, 22 nt, Human
aacuuucagaauccuaugcauu

SEQ ID NO: 215795 - RNA, 22 nt, Human
aacuuaacucugcaauccagcu

SEQ ID NO: 215796 - RNA, 22 nt, Human
aagaaaagaaacauggguaugc

SEQ ID NO: 215797 - RNA, 22 nt, Human
aacuggguuuaucuaaugugua

SEQ ID NO: 215798 - RNA, 22 nt, Human
aacugguaauuuaguauuacug

SEQ ID NO: 215799 - RNA, 22 nt, Human
aacuguugucacgaauguggcu

SEQ ID NO: 215800 - RNA, 22 nt, Human
aacugcauaagcuucgggaccu

SEQ ID NO: 215801 - RNA, 22 nt, Human
aacugggugauucaggcuguuu

SEQ ID NO: 215802 - RNA, 22 nt, Human
aacuuuuucuuaggggaaagca

SEQ ID NO: 215803 - RNA, 23 nt, Human
aacugcaagguugcugggaagua

SEQ ID NO: 215804 - RNA, 20 nt, Human
aacuuugagugcaugacuuu

SEQ ID NO: 215805 - RNA, 22 nt, Human
aacuuucuuugcaucuaaguuu

SEQ ID NO: 215806 - RNA, 21 nt, Human
aacuuucccaauccagauuug

SEQ ID NO: 215807 - RNA, 22 nt, Human
aagcaugagguggugagugaca

SEQ ID NO: 215808 - RNA, 22 nt, Human
aagcaguuuagucaucgggauu

SEQ ID NO: 215809 - RNA, 22 nt, Human
aagcaaaagguuacacuucugg

SEQ ID NO: 215810 - RNA, 22 nt, Human
aagaggaggcuggaauccuaaa

SEQ ID NO: 215811 - RNA, 22 nt, Human
aagaggaggacgguucccagaa

SEQ ID NO: 215812 - RNA, 22 nt, Human
aagaggauuuuaguuugccaga

SEQ ID NO: 215813 - RNA, 22 nt, Human
aagagaaacauauggccagauu

SEQ ID NO: 215814 - RNA, 22 nt, Human
aagaggaauaauaaaaauugca

SEQ ID NO: 215815 - RNA, 22 nt, Human
aagagcuuguuaugcugcucuu

SEQ ID NO: 215816 - RNA, 21 nt, Human
aagagcgccgggcagggcuga

SEQ ID NO: 215817 - RNA, 22 nt, Human
aagcaacccagugcuuguauag

SEQ ID NO: 215818 - RNA, 22 nt, Human
aagcaaguucuaaaguaauucu

SEQ ID NO: 215819 - RNA, 22 nt, Human
aagcacagggacucaggaccgg

SEQ ID NO: 215820 - RNA, 22 nt, Human
aagcaauucacaguucacuuaa

SEQ ID NO: 215821 - RNA, 22 nt, Human
aagcagaaaaacugagcuccaa

SEQ ID NO: 215822 - RNA, 22 nt, Human
aagaugcaagcauuuugaacug

SEQ ID NO: 215823 - RNA, 22 nt, Human
aagaugcuucaugagaguuggg

SEQ ID NO: 215824 - RNA, 22 nt, Human
aagauguuguagauuagugaga

SEQ ID NO: 215825 - RNA, 22 nt, Human
aagauucaguugguuuuggaaa

SEQ ID NO: 215826 - RNA, 22 nt, Human
aagagaaaaaucuuaaucuagu

SEQ ID NO: 215827 - RNA, 22 nt, Human
aagacagugacagucacaauug

SEQ ID NO: 215828 - RNA, 22 nt, Human
aagagaggaaagggugugaggu

SEQ ID NO: 215829 - RNA, 22 nt, Human
aagagaaagggaaaaugguaaa

SEQ ID NO: 215830 - RNA, 22 nt, Human
aagagaaaugcuuuaacuuuau

SEQ ID NO: 215831 - RNA, 20 nt, Human
aagacacuguccccacugga

SEQ ID NO: 215832 - RNA, 22 nt, Human
aagacacuuucuaaauagaagu

SEQ ID NO: 215833 - RNA, 23 nt, Human
aagaaugcuucugaagagcugcc

SEQ ID NO: 215834 - RNA, 22 nt, Human
aagaaggaaggcaagagauggg

SEQ ID NO: 215835 - RNA, 22 nt, Human
aagaagcuacugucacuaucag

SEQ ID NO: 215836 - RNA, 22 nt, Human
aagaaugaaaugaaagaacuaa

SEQ ID NO: 215837 - RNA, 22 nt, Human
aaccuggguguacauuaugguc

SEQ ID NO: 215838 - RNA, 22 nt, Human
aaccugaggguagacaaguuca

SEQ ID NO: 215839 - RNA, 22 nt, Human
aaccaggcgagagagcggucag

SEQ ID NO: 215840 - RNA, 22 nt, Human
aaccaauaagaggaugccauuu

SEQ ID NO: 215841 - RNA, 22 nt, Human
aaccauggauuucaguucaccu

SEQ ID NO: 215842 - RNA, 22 nt, Human
aacccacuaugauuguccucau

SEQ ID NO: 215843 - RNA, 22 nt, Human
aacaugggcaacuucuuuucag

SEQ ID NO: 215844 - RNA, 22 nt, Human
aacaucugagagcccuugugca

SEQ ID NO: 215845 - RNA, 22 nt, Human
aaccggauugauccuucuuuga

SEQ ID NO: 215846 - RNA, 22 nt, Human
aacccguagaucaguucuaggu

SEQ ID NO: 215847 - RNA, 22 nt, Human
aaccagaagucaucagagcuga

SEQ ID NO: 215848 - RNA, 22 nt, Human
aacaucaaaggaagaaugauau

SEQ ID NO: 215849 - RNA, 22 nt, Human
aacaguaugugagauuuacaca

SEQ ID NO: 215850 - RNA, 21 nt, Human
aacagguuuccuaccacuugc

SEQ ID NO: 215851 - RNA, 22 nt, Human
aacagguucaagccuugcagca

SEQ ID NO: 215852 - RNA, 22 nt, Human
aaccaaucaaauuggaauugaa

SEQ ID NO: 215853 - RNA, 22 nt, Human
aacgcagagaguaaugcugaac

SEQ ID NO: 215854 - RNA, 22 nt, Human
aacccuguuguguacaugcaua

SEQ ID NO: 215855 - RNA, 20 nt, Human
aaccuauuguaauauucuaa

SEQ ID NO: 215856 - RNA, 22 nt, Human
aaccaguacuucucuauucagu

SEQ ID NO: 215857 - RNA, 22 nt, Human
aaccuuucucccugcacacugg

SEQ ID NO: 215858 - RNA, 22 nt, Human
aacgauuugaguuaguuuuuag

SEQ ID NO: 215859 - RNA, 22 nt, Human
aacguaauuuguggaaggggua

SEQ ID NO: 215860 - RNA, 22 nt, Human
aacgggguugauuauuggaaga

SEQ ID NO: 215861 - RNA, 22 nt, Human
aaccuggaggaccuuaugcuaa

SEQ ID NO: 215862 - RNA, 22 nt, Human
aaccucuuugugaaugucauga

SEQ ID NO: 215863 - RNA, 21 nt, Human
aacuauuaauaccauuagcaa

SEQ ID NO: 215864 - RNA, 22 nt, Human
aacgaugauaaauuguucucug

SEQ ID NO: 215865 - RNA, 22 nt, Human
aacgagcugggggggccggggg

SEQ ID NO: 215866 - RNA, 22 nt, Human
aaagaggacgugcuauuuuuua

SEQ ID NO: 215867 - RNA, 22 nt, Human
aaagagggaaggaaggagugaa

SEQ ID NO: 215868 - RNA, 22 nt, Human
aaagaccuucacuuucuggcug

SEQ ID NO: 215869 - RNA, 20 nt, Human
aaagauacuuuuuguaaugg

SEQ ID NO: 215870 - RNA, 22 nt, Human
aaauggaaguuuguucucagcc

SEQ ID NO: 215871 - RNA, 22 nt, Human
aaaugcuuuaauugaguucaug

SEQ ID NO: 215872 - RNA, 22 nt, Human
aaagaucaguuaacgccaucaa

SEQ ID NO: 215873 - RNA, 17 nt, Human
aaaugguccuagggauu

SEQ ID NO: 215874 - RNA, 22 nt, Human
aaaugguguucuuuagaugaaa

SEQ ID NO: 215875 - RNA, 22 nt, Human
aaauggauaaucaagauaauca

SEQ ID NO: 215876 - RNA, 20 nt, Human
aaauugaacaagccaggcug

SEQ ID NO: 215877 - RNA, 22 nt, Human
aaauucuuccaggaggaaauac

SEQ ID NO: 215878 - RNA, 22 nt, Human
aaauucagauggcuuucuuuuc

SEQ ID NO: 215879 - RNA, 20 nt, Human
aaauucgacuaaaaccagaa

SEQ ID NO: 215880 - RNA, 22 nt, Human
aaauguguagaggggagagccg

SEQ ID NO: 215881 - RNA, 22 nt, Human
aaauguuucauucuauuuuuag

SEQ ID NO: 215882 - RNA, 22 nt, Human
aaauuaaaguuuuauuuagagc

SEQ ID NO: 215883 - RNA, 22 nt, Human
aaauguuugguggauaaaagga

SEQ ID NO: 215884 - RNA, 22 nt, Human
aaaugucugagacuucugaacu

SEQ ID NO: 215885 - RNA, 22 nt, Human
aacagaaaucauuuagggcucu

SEQ ID NO: 215886 - RNA, 22 nt, Human
aacagguucaucuuggaagcag

SEQ ID NO: 215887 - RNA, 22 nt, Human
aacaguacaucaugaggucauc

SEQ ID NO: 215888 - RNA, 22 nt, Human
aacaguuaagaggaggcagaga

SEQ ID NO: 215889 - RNA, 21 nt, Human
aacaaaagggaagaacagcug

SEQ ID NO: 215890 - RNA, 22 nt, Human
aacaguguaggagcugguuuau

SEQ ID NO: 215891 - RNA, 22 nt, Human
aacacguuuauccuaagaacuc

SEQ ID NO: 215892 - RNA, 22 nt, Human
aacacuaaaggucaguuagaag

SEQ ID NO: 215893 - RNA, 20 nt, Human
aacagcucucgacuuaucuu

SEQ ID NO: 215894 - RNA, 22 nt, Human
aaauugcauuuuaaagguagau

SEQ ID NO: 215895 - RNA, 21 nt, Human
aaauuucauauggccaaccua

SEQ ID NO: 215896 - RNA, 22 nt, Human
aacacuguaucagucuucaaua

SEQ ID NO: 215897 - RNA, 22 nt, Human
aaauucggggaguuuugaggau

SEQ ID NO: 215898 - RNA, 22 nt, Human
aaauuuuguugaaaaauauuuu

SEQ ID NO: 215899 - RNA, 22 nt, Human
aaauuugggagaaaugggucau

SEQ ID NO: 215900 - RNA, 22 nt, Human
aacacaucagcacacuaacgga

SEQ ID NO: 215901 - RNA, 19 nt, Human
agucugugacaaggagugg

SEQ ID NO: 215902 - RNA, 22 nt, Human
aguccucagauauggagaucug

SEQ ID NO: 215903 - RNA, 22 nt, Human
agucugaaccagauggcaaggu

SEQ ID NO: 215904 - RNA, 18 nt, Human
agucugagugaaauguag

SEQ ID NO: 215905 - RNA, 20 nt, Human
agucuuaucugcauuuagaa

SEQ ID NO: 215906 - RNA, 22 nt, Human
agucuuuguuccugggaccuga

SEQ ID NO: 215907 - RNA, 22 nt, Human
agucugugguccucuguaucuc

SEQ ID NO: 215908 - RNA, 22 nt, Human
aguccagggcuuagucagcggg

SEQ ID NO: 215909 - RNA, 22 nt, Human
agucggauuucccagguuauug

SEQ ID NO: 215910 - RNA, 22 nt, Human
agucccugauggacuggaugag

SEQ ID NO: 215911 - RNA, 22 nt, Human
aguccauccagaaaacaaagcu

SEQ ID NO: 215912 - RNA, 22 nt, Human
agucauuguguucaguaaaauc

SEQ ID NO: 215913 - RNA, 22 nt, Human
agucauuugaggcaugauuaug

SEQ ID NO: 215914 - RNA, 22 nt, Human
agucauuugucauuuuuuugag

SEQ ID NO: 215915 - RNA, 18 nt, Human
agucauguuuuagucacu

SEQ ID NO: 215916 - RNA, 20 nt, Human
agucacagacccucagguag

SEQ ID NO: 215917 - RNA, 22 nt, Human
agucaggacagauuuucugggg

SEQ ID NO: 215918 - RNA, 22 nt, Human
agucagaaggugucagaucuug

SEQ ID NO: 215919 - RNA, 22 nt, Human
agucaacauuugagaugcaaug

SEQ ID NO: 215920 - RNA, 22 nt, Human
agucaggggaucuagacuugaa

SEQ ID NO: 215921 - RNA, 22 nt, Human
agucaguguagaaagcccaggc

SEQ ID NO: 215922 - RNA, 22 nt, Human
agucaguaugacuuauaguucu

SEQ ID NO: 215923 - RNA, 22 nt, Human
agucacuguuuaaucuagcuaa

SEQ ID NO: 215924 - RNA, 22 nt, Human
agucaccuacagcucaugcuuc

SEQ ID NO: 215925 - RNA, 22 nt, Human
agucacuguucugucaugucaa

SEQ ID NO: 215926 - RNA, 22 nt, Human
agucaagguggaccagaaaaau

SEQ ID NO: 215927 - RNA, 21 nt, Human
agucaagcugccugcuuggca

SEQ ID NO: 215928 - RNA, 22 nt, Human
aguauuuucuuuaguuuguuag

SEQ ID NO: 215929 - RNA, 22 nt, Human
aguauuuuaaaauacauuaucc

SEQ ID NO: 215930 - RNA, 22 nt, Human
agucaaaaaaccuagaaacacc

SEQ ID NO: 215931 - RNA, 22 nt, Human
aguauucaguuagugagcuaag

SEQ ID NO: 215932 - RNA, 22 nt, Human
aguauugguaaguguagcaaau

SEQ ID NO: 215933 - RNA, 22 nt, Human
aguauuuaguauucuauauuag

SEQ ID NO: 215934 - RNA, 19 nt, Human
aguauuggcagguccugua

SEQ ID NO: 215935 - RNA, 22 nt, Human
aguaucgcuuuguaucaugagg

SEQ ID NO: 215936 - RNA, 22 nt, Human
aguaucugccagaaucucaguu

SEQ ID NO: 215937 - RNA, 22 nt, Human
aguauggaauuuuuaaugacag

SEQ ID NO: 215938 - RNA, 22 nt, Human
aguaucuuccucaugaacacgu

SEQ ID NO: 215939 - RNA, 22 nt, Human
aguauuggauauaaucuaggaa

SEQ ID NO: 215940 - RNA, 22 nt, Human
aguauaagugaugcuaucuucu

SEQ ID NO: 215941 - RNA, 22 nt, Human
aguaagaaagaaugauaggccu

SEQ ID NO: 215942 - RNA, 22 nt, Human
aguaagaacugugggugggguu

SEQ ID NO: 215943 - RNA, 22 nt, Human
aguaauggucucaauaaauucu

SEQ ID NO: 215944 - RNA, 22 nt, Human
aguaauuucuuacggagaccuu

SEQ ID NO: 215945 - RNA, 22 nt, Human
aguaaucgugaucgagagauca

SEQ ID NO: 215946 - RNA, 22 nt, Human
aguacuuuuuguucaauugugc

SEQ ID NO: 215947 - RNA, 22 nt, Human
aguauagacaucaaacugaaga

SEQ ID NO: 215948 - RNA, 21 nt, Human
aguagucgauucaggagaagu

SEQ ID NO: 215949 - RNA, 22 nt, Human
aggucugcccaggaugcugcuu

SEQ ID NO: 215950 - RNA, 22 nt, Human
agguaguggaaccaaggcauca

SEQ ID NO: 215951 - RNA, 21 nt, Human
aggugaaggcgagggggacag

SEQ ID NO: 215952 - RNA, 22 nt, Human
aggugcuugcauacugcuugac

SEQ ID NO: 215953 - RNA, 22 nt, Human
aggugagaaggacuguugcauu

SEQ ID NO: 215954 - RNA, 22 nt, Human
agguggucuuguggaugccgca

SEQ ID NO: 215955 - RNA, 21 nt, Human
aggugguuccaauaaguaggu

SEQ ID NO: 215956 - RNA, 22 nt, Human
aggugggcuuagaaaucuguau

SEQ ID NO: 215957 - RNA, 22 nt, Human
aggugcuuaaagaauguguggu

SEQ ID NO: 215958 - RNA, 22 nt, Human
agguggggacuccaccgaugcu

SEQ ID NO: 215959 - RNA, 22 nt, Human
aggugguauuuaaaauuauuug

SEQ ID NO: 215960 - RNA, 22 nt, Human
agguuuuagaagcugaagccaa

SEQ ID NO: 215961 - RNA, 22 nt, Human
aguaacagguguacagacuauc

SEQ ID NO: 215962 - RNA, 22 nt, Human
agguuaaaagagugaguggaua

SEQ ID NO: 215963 - RNA, 18 nt, Human
agguguguuucuaggagc

SEQ ID NO: 215964 - RNA, 22 nt, Human
agguuaauaugaacagcagaag

SEQ ID NO: 215965 - RNA, 18 nt, Human
aggugagaauuuggcuuu

SEQ ID NO: 215966 - RNA, 22 nt, Human
agguuagcuguaugucuguaaa

SEQ ID NO: 215967 - RNA, 18 nt, Human
agguuguguaaaaagaag

SEQ ID NO: 215968 - RNA, 22 nt, Human
agguuuggguucauugcuggcu

SEQ ID NO: 215969 - RNA, 22 nt, Human
agguuguaagcuuuauauaaau

SEQ ID NO: 215970 - RNA, 22 nt, Human
aggccgagaugacagagccacu

SEQ ID NO: 215971 - RNA, 20 nt, Human
aggccgcccgcugccgcuuc

SEQ ID NO: 215972 - RNA, 22 nt, Human
aggcccugcugaggccucccuc

SEQ ID NO: 215973 - RNA, 22 nt, Human
aggccauuucacagguuuugga

SEQ ID NO: 215974 - RNA, 22 nt, Human
aggagcugccggauggggcaug

SEQ ID NO: 215975 - RNA, 16 nt, Human
aggagcagaaagcagu

SEQ ID NO: 215976 - RNA, 22 nt, Human
aggauggaaguaacuggauaau

SEQ ID NO: 215977 - RNA, 22 nt, Human
aggaugagugaagagguaaauu

SEQ ID NO: 215978 - RNA, 22 nt, Human
aggauauguccuuuuuuucccc

SEQ ID NO: 215979 - RNA, 22 nt, Human
aggcucagcaucugauucauau

SEQ ID NO: 215980 - RNA, 20 nt, Human
aggcuccuccaggaugugug

SEQ ID NO: 215981 - RNA, 22 nt, Human
aggcucucccacauucauuaca

SEQ ID NO: 215982 - RNA, 23 nt, Human
aggcugcagaagaauagggucau

SEQ ID NO: 215983 - RNA, 22 nt, Human
aggcugccuaugaaggcagaag

SEQ ID NO: 215984 - RNA, 22 nt, Human
aggccgcgguggcgaaggcguu

SEQ ID NO: 215985 - RNA, 22 nt, Human
aggccugcccuuggggagccuu

SEQ ID NO: 215986 - RNA, 22 nt, Human
aggcgaagggaccagacgguag

SEQ ID NO: 215987 - RNA, 22 nt, Human
aggcuguagaucuagacaugua

SEQ ID NO: 215988 - RNA, 18 nt, Human
aggcuggggaucacaggg

SEQ ID NO: 215989 - RNA, 22 nt, Human
agggaagagaaacaaagauuca

SEQ ID NO: 215990 - RNA, 22 nt, Human
aggcgguuggcuuugucugggu

SEQ ID NO: 215991 - RNA, 22 nt, Human
aggcgagcgcggccggugcccc

SEQ ID NO: 215992 - RNA, 22 nt, Human
aggccgguggaggagguggagg

SEQ ID NO: 215993 - RNA, 22 nt, Human
aggccugaggaccagauaaaug

SEQ ID NO: 215994 - RNA, 22 nt, Human
aggccgcuggggcagcgcccga

SEQ ID NO: 215995 - RNA, 22 nt, Human
aggcggguuuaggacaaugcuu

SEQ ID NO: 215996 - RNA, 22 nt, Human
agggaagccggagcgacggggg

SEQ ID NO: 215997 - RNA, 22 nt, Human
agggaagaggaccagagucucu

SEQ ID NO: 215998 - RNA, 22 nt, Human
aggcugaagcacacucaugcag

SEQ ID NO: 215999 - RNA, 22 nt, Human
aggcugggaaguguguccugag

SEQ ID NO: 216000 - RNA, 22 nt, Human
agggcggucccugagacucucc

SEQ ID NO: 216001 - RNA, 22 nt, Human
agggcguacuuucgccccuccu

SEQ ID NO: 216002 - RNA, 22 nt, Human
agggccggggagggcugugggg

SEQ ID NO: 216003 - RNA, 22 nt, Human
agggccagcagcuuggccaacc

SEQ ID NO: 216004 - RNA, 22 nt, Human
agggaggagggacagaaagagg

SEQ ID NO: 216005 - RNA, 22 nt, Human
agggaaauuaaugugagcaaug

SEQ ID NO: 216006 - RNA, 17 nt, Human
agggaaguagggugggc

SEQ ID NO: 216007 - RNA, 22 nt, Human
agggacuugugucuguguuuuu

SEQ ID NO: 216008 - RNA, 22 nt, Human
agggaaguucuagggagucugg

SEQ ID NO: 216009 - RNA, 22 nt, Human
agggagcagcuagagggggucc

SEQ ID NO: 216010 - RNA, 22 nt, Human
agggcuuaggcacacugugacu

SEQ ID NO: 216011 - RNA, 22 nt, Human
agggcuugggggccuugaaggc

SEQ ID NO: 216012 - RNA, 22 nt, Human
agggcgugguggugcuggagca

SEQ ID NO: 216013 - RNA, 22 nt, Human
aggggagggcuggccuuuggau

SEQ ID NO: 216014 - RNA, 22 nt, Human
aggggaggcugcgggcugccgu

SEQ ID NO: 216015 - RNA, 22 nt, Human
aggggaguuauuagacagggag

SEQ ID NO: 216016 - RNA, 22 nt, Human
agggggaaaauguggauuaugg

SEQ ID NO: 216017 - RNA, 22 nt, Human
agggggaauccugcuuauggau

SEQ ID NO: 216018 - RNA, 22 nt, Human
aggggagaguuaaugugaaugu

SEQ ID NO: 216019 - RNA, 22 nt, Human
aggggagaagcacuccuugccu

SEQ ID NO: 216020 - RNA, 22 nt, Human
aggggcagccucacaauccucu

SEQ ID NO: 216021 - RNA, 19 nt, Human
aggggccugcuuggccuug

SEQ ID NO: 216022 - RNA, 21 nt, Human
agguagauagccccaggaagg

SEQ ID NO: 216023 - RNA, 22 nt, Human
agguagaaggaccagaauuuau

SEQ ID NO: 216024 - RNA, 22 nt, Human
agguagcuggugcugggcuccu

SEQ ID NO: 216025 - RNA, 22 nt, Human
aggguggcuggaguggucuggu

SEQ ID NO: 216026 - RNA, 22 nt, Human
aggguuugugaagacuuggcca

SEQ ID NO: 216027 - RNA, 22 nt, Human
aggguuuucauauauuauuagu

SEQ ID NO: 216028 - RNA, 22 nt, Human
aggguuugaauccucuuucuua

SEQ ID NO: 216029 - RNA, 22 nt, Human
aggggaggcugggcuggggggc

SEQ ID NO: 216030 - RNA, 22 nt, Human
aggggaggggaguaucaggauu

SEQ ID NO: 216031 - RNA, 22 nt, Human
aggggauggagcuggaaggcag

SEQ ID NO: 216032 - RNA, 22 nt, Human
agguaagaagugagcaaguuua

SEQ ID NO: 216033 - RNA, 22 nt, Human
aggucguauaguuaccuccuug

SEQ ID NO: 216034 - RNA, 22 nt, Human
aggucuacaugcuuaauauauc

SEQ ID NO: 216035 - RNA, 22 nt, Human
agguauuuuaugucgugugaug

SEQ ID NO: 216036 - RNA, 22 nt, Human
agcuucuucugccuugucccug

SEQ ID NO: 216037 - RNA, 19 nt, Human
agcuuauuuacugcaggac

SEQ ID NO: 216038 - RNA, 22 nt, Human
agcugugaccuucaagagcuac

SEQ ID NO: 216039 - RNA, 20 nt, Human
agcuggcccccgguggccug

SEQ ID NO: 216040 - RNA, 22 nt, Human
agcuggauuaaucacagugacu

SEQ ID NO: 216041 - RNA, 22 nt, Human
aggaaaguugcuuguagugcug

SEQ ID NO: 216042 - RNA, 22 nt, Human
aggaaaggcucugugguuccua

SEQ ID NO: 216043 - RNA, 22 nt, Human
aggaaaguugagcugucuguag

SEQ ID NO: 216044 - RNA, 22 nt, Human
agcuugaugaaagugggugcuc

SEQ ID NO: 216045 - RNA, 22 nt, Human
agcuugaaccuaaaacaauaau

SEQ ID NO: 216046 - RNA, 22 nt, Human
agcuugauggauugcugaggca

SEQ ID NO: 216047 - RNA, 22 nt, Human
agcuuucaagaaauugucacaa

SEQ ID NO: 216048 - RNA, 22 nt, Human
agcuuugcccaaugaguuaugu

SEQ ID NO: 216049 - RNA, 22 nt, Human
agcuuucuauauaugaguugcu

SEQ ID NO: 216050 - RNA, 22 nt, Human
agcuuugcugcuggagaagggu

SEQ ID NO: 216051 - RNA, 22 nt, Human
aggaagaagggacagaauuuug

SEQ ID NO: 216052 - RNA, 20 nt, Human
aggaacuggaagggaggaaa

SEQ ID NO: 216053 - RNA, 22 nt, Human
aggaacaguuucaaagagugaa

SEQ ID NO: 216054 - RNA, 22 nt, Human
aggaagagcuggaccagaggac

SEQ ID NO: 216055 - RNA, 22 nt, Human
aggaagccuggaguccugccca

SEQ ID NO: 216056 - RNA, 22 nt, Human
aggaagucucucaaaacuggaa

SEQ ID NO: 216057 - RNA, 22 nt, Human
aggaaaauggaccagaguuguu

SEQ ID NO: 216058 - RNA, 20 nt, Human
aggaagauccuuucuuuuaa

SEQ ID NO: 216059 - RNA, 20 nt, Human
aggaaggagaaucugagcaa

SEQ ID NO: 216060 - RNA, 22 nt, Human
aggacacuuccugaguggacaa

SEQ ID NO: 216061 - RNA, 22 nt, Human
aggacauuugcuuuuuuucuuu

SEQ ID NO: 216062 - RNA, 22 nt, Human
aggacucagcgucugucucccg

SEQ ID NO: 216063 - RNA, 22 nt, Human
aggagacaguuuggacguguag

SEQ ID NO: 216064 - RNA, 22 nt, Human
aggagagaacaagaguauccug

SEQ ID NO: 216065 - RNA, 22 nt, Human
agcuguaacagguuaauaugga

SEQ ID NO: 216066 - RNA, 19 nt, Human
aggaaggggauaaguaaca

SEQ ID NO: 216067 - RNA, 22 nt, Human
aggaaguucuggaauuacuagg

SEQ ID NO: 216068 - RNA, 23 nt, Human
aggaagucugacacuacagcguu

SEQ ID NO: 216069 - RNA, 22 nt, Human
aggacacagaguauggaagugu

SEQ ID NO: 216070 - RNA, 22 nt, Human
aggauaaaugggucauuaggca

SEQ ID NO: 216071 - RNA, 22 nt, Human
aggaguuugaaaacuuaacuaa

SEQ ID NO: 216072 - RNA, 22 nt, Human
aggacuggucucuuuucuccaa

SEQ ID NO: 216073 - RNA, 22 nt, Human
aggagaaagaccagccugccga

SEQ ID NO: 216074 - RNA, 22 nt, Human
aggaaaaagaagaaaagaauca

SEQ ID NO: 216075 - RNA, 22 nt, Human
agcuuugucccaagugcucugg

SEQ ID NO: 216076 - RNA, 22 nt, Human
agcuuggcaagcacuguuugag

SEQ ID NO: 216077 - RNA, 20 nt, Human
agcuuucaccaguacuucca

SEQ ID NO: 216078 - RNA, 22 nt, Human
agcugaggccccgcagcagggu

SEQ ID NO: 216079 - RNA, 22 nt, Human
agcugcauguauauucuuaaca

SEQ ID NO: 216080 - RNA, 19 nt, Human
agcugcugauugguggagg

SEQ ID NO: 216081 - RNA, 22 nt, Human
agcugcuuuacuggucggcugg

SEQ ID NO: 216082 - RNA, 22 nt, Human
aggaaagacgcauuucuguagg

SEQ ID NO: 216083 - RNA, 22 nt, Human
agcuggaaucucggcaaagcgu

SEQ ID NO: 216084 - RNA, 20 nt, Human
agcugucccugacacuagga

SEQ ID NO: 216085 - RNA, 22 nt, Human
agcugcuaagcugcauaacuua

SEQ ID NO: 216086 - RNA, 22 nt, Human
agcugugccuauucguggcaag

SEQ ID NO: 216087 - RNA, 22 nt, Human
agcuugcccuuguaccagccag

SEQ ID NO: 216088 - RNA, 22 nt, Human
agcuuccaaagaccaggauuga

SEQ ID NO: 216089 - RNA, 22 nt, Human
agcuucccaggagaucuccgcc

SEQ ID NO: 216090 - RNA, 22 nt, Human
agcuguugaccuucccuuucag

SEQ ID NO: 216091 - RNA, 22 nt, Human
agcugaugucucaccuguuaga

SEQ ID NO: 216092 - RNA, 22 nt, Human
agcugauugucuuuuuaaaagu

SEQ ID NO: 216093 - RNA, 22 nt, Human
agcucuuuggacuuuguuuuau

SEQ ID NO: 216094 - RNA, 22 nt, Human
agcucuguugcggucacaggag

SEQ ID NO: 216095 - RNA, 22 nt, Human
agcugcauucguaucauauugu

SEQ ID NO: 216096 - RNA, 22 nt, Human
agcugcuggcggauguuggacu

SEQ ID NO: 216097 - RNA, 22 nt, Human
agcugcugcaaguggugcuaac

SEQ ID NO: 216098 - RNA, 22 nt, Human
agcuaauguauguugaaagcac

SEQ ID NO: 216099 - RNA, 22 nt, Human
agcucugauccuuuaaaggaga

SEQ ID NO: 216100 - RNA, 22 nt, Human
agcucucaccauagugcuuaaa

SEQ ID NO: 216101 - RNA, 22 nt, Human
agcuagugcaguucucaaaugg

SEQ ID NO: 216102 - RNA, 19 nt, Human
agcucaggcccaucguccc

SEQ ID NO: 216103 - RNA, 22 nt, Human
agcugaccugauugcuuuucag

SEQ ID NO: 216104 - RNA, 20 nt, Human
agcugaauaguuuugugaaa

SEQ ID NO: 216105 - RNA, 22 nt, Human
agcucugcuucuugggaagaug

SEQ ID NO: 216106 - RNA, 22 nt, Human
agcucugugcaggcagaggcau

SEQ ID NO: 216107 - RNA, 22 nt, Human
agcucggcuguccugugccccu

SEQ ID NO: 216108 - RNA, 22 nt, Human
agcuccugcgcacggugcacac

SEQ ID NO: 216109 - RNA, 22 nt, Human
agcuaaaaugagguuuuuggau

SEQ ID NO: 216110 - RNA, 22 nt, Human
agcguucuguuccaugcuaaca

SEQ ID NO: 216111 - RNA, 22 nt, Human
agcggccucgcugccugcucag

SEQ ID NO: 216112 - RNA, 22 nt, Human
agcgucaugugaccagcgcgcc

SEQ ID NO: 216113 - RNA, 22 nt, Human
agcgggucaugucggccgccca

SEQ ID NO: 216114 - RNA, 22 nt, Human
agcgccgcugugauuggugagg

SEQ ID NO: 216115 - RNA, 22 nt, Human
agcgacuguaagagggccccgg

SEQ ID NO: 216116 - RNA, 22 nt, Human
agcgcgcggggcugcggcaggg

SEQ ID NO: 216117 - RNA, 22 nt, Human
agcgcggccuuacacccagggg

SEQ ID NO: 216118 - RNA, 22 nt, Human
agcgcuguguucccgugggcau

SEQ ID NO: 216119 - RNA, 19 nt, Human
agcgccucuacugcaugga

SEQ ID NO: 216120 - RNA, 22 nt, Human
agcggcgcgucuccgagcugga

SEQ ID NO: 216121 - RNA, 22 nt, Human
agcggcaggaagcgcgcaagcg

SEQ ID NO: 216122 - RNA, 22 nt, Human
agcggugacauccuucugugcu

SEQ ID NO: 216123 - RNA, 22 nt, Human
agcgcccguugagucgcgcggu

SEQ ID NO: 216124 - RNA, 22 nt, Human
agcgcaguuaccgcgcggggcu

SEQ ID NO: 216125 - RNA, 22 nt, Human
agccuguacuuagagggauuaa

SEQ ID NO: 216126 - RNA, 22 nt, Human
agccugugcuguguuugcucca

SEQ ID NO: 216127 - RNA, 22 nt, Human
agccuucccuuucaacaauuug

SEQ ID NO: 216128 - RNA, 22 nt, Human
agccuguuacuguccugugcca

SEQ ID NO: 216129 - RNA, 22 nt, Human
agcccuuucuuguuuaacugca

SEQ ID NO: 216130 - RNA, 22 nt, Human
agcccugugugcuuguguuccu

SEQ ID NO: 216131 - RNA, 22 nt, Human
agcccuucccuuucacuggugc

SEQ ID NO: 216132 - RNA, 22 nt, Human
agccgcgcuguuccugcugcug

SEQ ID NO: 216133 - RNA, 23 nt, Human
agcccagcagagaaccuaggucc

SEQ ID NO: 216134 - RNA, 22 nt, Human
agccauggaggaugugcagcau

SEQ ID NO: 216135 - RNA, 22 nt, Human
agcaugucuaacucuucagggu

SEQ ID NO: 216136 - RNA, 22 nt, Human
agcauuucuacugugucagaaa

SEQ ID NO: 216137 - RNA, 22 nt, Human
agcauucuguggucuucuaugg

SEQ ID NO: 216138 - RNA, 22 nt, Human
agccuggagcaggcucugcucu

SEQ ID NO: 216139 - RNA, 22 nt, Human
agcauuugcuguucuagaaagu

SEQ ID NO: 216140 - RNA, 22 nt, Human
agcccgggagggcugucuggga

SEQ ID NO: 216141 - RNA, 22 nt, Human
agcccugaccuguccuguucug

SEQ ID NO: 216142 - RNA, 19 nt, Human
agcagugaaaucuggugag

SEQ ID NO: 216143 - RNA, 22 nt, Human
agccacagucuguagccagcuu

SEQ ID NO: 216144 - RNA, 19 nt, Human
agcaguggagccaugccug

SEQ ID NO: 216145 - RNA, 22 nt, Human
agcaguucucugucuagcuaga

SEQ ID NO: 216146 - RNA, 22 nt, Human
agcaugaauugccauuuauuaa

SEQ ID NO: 216147 - RNA, 21 nt, Human
agcaucugaggcaguuuccua

SEQ ID NO: 216148 - RNA, 19 nt, Human
agcaucuccacagaaaaag

SEQ ID NO: 216149 - RNA, 22 nt, Human
agcaucggacggagcaccugcu

SEQ ID NO: 216150 - RNA, 21 nt, Human
agccagguuuccuuugaagag

SEQ ID NO: 216151 - RNA, 22 nt, Human
agccagauuuuuugagaggcga

SEQ ID NO: 216152 - RNA, 22 nt, Human
agccagcauauauauaguugaa

SEQ ID NO: 216153 - RNA, 22 nt, Human
agcauucagacaucugauggau

SEQ ID NO: 216154 - RNA, 22 nt, Human
agcauauaugcaugagugugca

SEQ ID NO: 216155 - RNA, 22 nt, Human
agcaucuaucuucaaugugugu

SEQ ID NO: 216156 - RNA, 22 nt, Human
agauacaaaagauaagauuuag

SEQ ID NO: 216157 - RNA, 22 nt, Human
agcagcaccuguccucgcugcu

SEQ ID NO: 216158 - RNA, 22 nt, Human
agcagcaggcugggaugagucu

SEQ ID NO: 216159 - RNA, 22 nt, Human
agauagccagauauaaauaguc

SEQ ID NO: 216160 - RNA, 16 nt, Human
agcagcgugggggugg

SEQ ID NO: 216161 - RNA, 22 nt, Human
agcacgcccaccuccugcggcg

SEQ ID NO: 216162 - RNA, 22 nt, Human
agcacggugguuaagagagugg

SEQ ID NO: 216163 - RNA, 17 nt, Human
agcagcuggguugaucu

SEQ ID NO: 216164 - RNA, 22 nt, Human
agcaggaggagagccuggcggu

SEQ ID NO: 216165 - RNA, 22 nt, Human
agcaggagaaagaguaugggcu

SEQ ID NO: 216166 - RNA, 22 nt, Human
agcaggacuugcugagcccucc

SEQ ID NO: 216167 - RNA, 22 nt, Human
agcaggaggguuuuguagaguc

SEQ ID NO: 216168 - RNA, 22 nt, Human
agcagggagacagugcagcauu

SEQ ID NO: 216169 - RNA, 22 nt, Human
agcagggugugggugugagugu

SEQ ID NO: 216170 - RNA, 22 nt, Human
agcagguucaagggcaaagcug

SEQ ID NO: 216171 - RNA, 22 nt, Human
agcaggguggcaagucuuucug

SEQ ID NO: 216172 - RNA, 22 nt, Human
agcagggagaccaucucuuccu

SEQ ID NO: 216173 - RNA, 22 nt, Human
agcaguuagauccugguuagcg

SEQ ID NO: 216174 - RNA, 22 nt, Human
agcaguugcuuuguauauuaaa

SEQ ID NO: 216175 - RNA, 18 nt, Human
agcagugcggaucauuuu

SEQ ID NO: 216176 - RNA, 22 nt, Human
agcaggucagugguaaucaaaa

SEQ ID NO: 216177 - RNA, 22 nt, Human
agcagucagaucguggggaaaa

SEQ ID NO: 216178 - RNA, 21 nt, Human
agcagucugcggccggugcgg

SEQ ID NO: 216179 - RNA, 22 nt, Human
accccagcucugagccacacca

SEQ ID NO: 216180 - RNA, 22 nt, Human
acccauggcucucugggaugcu

SEQ ID NO: 216181 - RNA, 22 nt, Human
accgucagguuagaaugagcac

SEQ ID NO: 216182 - RNA, 22 nt, Human
accgguucccaucuggagaguu

SEQ ID NO: 216183 - RNA, 22 nt, Human
acccugacggugggcagcuuga

SEQ ID NO: 216184 - RNA, 21 nt, Human
accgucaguacuaguauugac

SEQ ID NO: 216185 - RNA, 22 nt, Human
accauuauagaggacauuaugu

SEQ ID NO: 216186 - RNA, 22 nt, Human
accaugacugucacauuauuau

SEQ ID NO: 216187 - RNA, 22 nt, Human
accgauguggaaaauuucauuu

SEQ ID NO: 216188 - RNA, 22 nt, Human
accgauuucaaauggugcuaga

SEQ ID NO: 216189 - RNA, 22 nt, Human
accgcuggcacuggggacgggg

SEQ ID NO: 216190 - RNA, 19 nt, Human
acccaugcucuguggacuu

SEQ ID NO: 216191 - RNA, 22 nt, Human
accuauuuauacaacugcacca

SEQ ID NO: 216192 - RNA, 22 nt, Human
accuauuguccagagccaggcc

SEQ ID NO: 216193 - RNA, 22 nt, Human
accucauucugcauagaacuuu

SEQ ID NO: 216194 - RNA, 23 nt, Human
accuggucccaugggugggccug

SEQ ID NO: 216195 - RNA, 22 nt, Human
accuggauauuuucaguugcau

SEQ ID NO: 216196 - RNA, 22 nt, Human
accugcucucccucucgcaguc

SEQ ID NO: 216197 - RNA, 22 nt, Human
accugagauuuuuacucaguaa

SEQ ID NO: 216198 - RNA, 23 nt, Human
accgccgcugccgccgcccccgc

SEQ ID NO: 216199 - RNA, 22 nt, Human
accugcagguguuuccacacuu

SEQ ID NO: 216200 - RNA, 22 nt, Human
accugauuuuauggauuuugag

SEQ ID NO: 216201 - RNA, 22 nt, Human
accgggcagcucugccccugcc

SEQ ID NO: 216202 - RNA, 22 nt, Human
accucuuucuauggauuuuuug

SEQ ID NO: 216203 - RNA, 22 nt, Human
accugaccagguggcuucccaa

SEQ ID NO: 216204 - RNA, 22 nt, Human
accugaucugagaaguggaggg

SEQ ID NO: 216205 - RNA, 22 nt, Human
accgagcaggguguuugcgcac

SEQ ID NO: 216206 - RNA, 22 nt, Human
acgggaggcguggucuuguagu

SEQ ID NO: 216207 - RNA, 22 nt, Human
acggggagcgucggccucuccc

SEQ ID NO: 216208 - RNA, 22 nt, Human
acggugagacuggcgaaggaaa

SEQ ID NO: 216209 - RNA, 22 nt, Human
acgggugcuuguucccgcugcu

SEQ ID NO: 216210 - RNA, 22 nt, Human
acgguuuggggaggaggauccc

SEQ ID NO: 216211 - RNA, 22 nt, Human
acguuuuagccauguaguuucu

SEQ ID NO: 216212 - RNA, 22 nt, Human
acuaaacauaucacugcuuuac

SEQ ID NO: 216213 - RNA, 22 nt, Human
acuaaagcagcucagacgagaa

SEQ ID NO: 216214 - RNA, 22 nt, Human
acgugcauuacucaaaucucaa

SEQ ID NO: 216215 - RNA, 22 nt, Human
acgaggauuuccuuagaugaaa

SEQ ID NO: 216216 - RNA, 22 nt, Human
acgaagggggcauggugagagu

SEQ ID NO: 216217 - RNA, 22 nt, Human
accuuguuguagguacaaaaga

SEQ ID NO: 216218 - RNA, 20 nt, Human
acgaacauauugcaggguuu

SEQ ID NO: 216219 - RNA, 22 nt, Human
acgcaacacugcuauuuuuuuc

SEQ ID NO: 216220 - RNA, 22 nt, Human
acgcgcuccagcaggugcuuca

SEQ ID NO: 216221 - RNA, 22 nt, Human
acgcuucacaggugcgcauugu

SEQ ID NO: 216222 - RNA, 23 nt, Human
acgggaggcggggcagggcugag

SEQ ID NO: 216223 - RNA, 22 nt, Human
acggcuugaacgcgccuguggg

SEQ ID NO: 216224 - RNA, 22 nt, Human
accugguaaccugccugacuaa

SEQ ID NO: 216225 - RNA, 22 nt, Human
accuggcccugggucuccugac

SEQ ID NO: 216226 - RNA, 21 nt, Human
accuggugaugaaugggaggc

SEQ ID NO: 216227 - RNA, 22 nt, Human
accuguagcccaaucauggcag

SEQ ID NO: 216228 - RNA, 22 nt, Human
acgauuugguucagugaagaca

SEQ ID NO: 216229 - RNA, 21 nt, Human
accugguuuacugaucccagg

SEQ ID NO: 216230 - RNA, 22 nt, Human
accuucugaccucucggacuuc

SEQ ID NO: 216231 - RNA, 22 nt, Human
accuugauggagugaugaauga

SEQ ID NO: 216232 - RNA, 22 nt, Human
accuuggauauucuuacucggu

SEQ ID NO: 216233 - RNA, 22 nt, Human
accuucguuuaguacucauuuu

SEQ ID NO: 216234 - RNA, 22 nt, Human
accuuaaacagauggcggcugg

SEQ ID NO: 216235 - RNA, 19 nt, Human
accuguucaaccucgugcu

SEQ ID NO: 216236 - RNA, 22 nt, Human
acgauaacaauaguagcaugua

SEQ ID NO: 216237 - RNA, 22 nt, Human
acgaaauaaaauuaaagcccua

SEQ ID NO: 216238 - RNA, 22 nt, Human
acgaaugacaugugauuugaaa

SEQ ID NO: 216239 - RNA, 22 nt, Human
accuugggcccagaccggcacg

SEQ ID NO: 216240 - RNA, 22 nt, Human
acauggcaugaauaauguguac

SEQ ID NO: 216241 - RNA, 22 nt, Human
acauggaccucagauccuggcc

SEQ ID NO: 216242 - RNA, 22 nt, Human
acaugcuucauauuauaaccaa

SEQ ID NO: 216243 - RNA, 22 nt, Human
acauauaugugcauacaacuau

SEQ ID NO: 216244 - RNA, 22 nt, Human
acaucacuugguuaaugugguc

SEQ ID NO: 216245 - RNA, 22 nt, Human
acauggguuaaagaagauggaa

SEQ ID NO: 216246 - RNA, 22 nt, Human
acaugguguggcacuaggggcu

SEQ ID NO: 216247 - RNA, 21 nt, Human
acauguacacauguaugcaca

SEQ ID NO: 216248 - RNA, 22 nt, Human
acauggaauuucagaagagcau

SEQ ID NO: 216249 - RNA, 22 nt, Human
acaguuuucugagaaucacagg

SEQ ID NO: 216250 - RNA, 19 nt, Human
acaguucuguggccuguuc

SEQ ID NO: 216251 - RNA, 22 nt, Human
acauaaaccccccuuccccagg

SEQ ID NO: 216252 - RNA, 22 nt, Human
acauaaacaugcagccugccaa

SEQ ID NO: 216253 - RNA, 22 nt, Human
aauucugaggccauuuauuucc

SEQ ID NO: 216254 - RNA, 22 nt, Human
aauucagguuauauuugcaacu

SEQ ID NO: 216255 - RNA, 22 nt, Human
aauucgcugcauuccaucuagg

SEQ ID NO: 216256 - RNA, 22 nt, Human
aauucugcagucguacuauaau

SEQ ID NO: 216257 - RNA, 22 nt, Human
aauucuaaugaguucuuaucua

SEQ ID NO: 216258 - RNA, 21 nt, Human
aauucccagaaacagcacaag

SEQ ID NO: 216259 - RNA, 22 nt, Human
aauucuguugguuagaguugga

SEQ ID NO: 216260 - RNA, 22 nt, Human
aauugcauucauuuguauauuu

SEQ ID NO: 216261 - RNA, 22 nt, Human
acagugugcaagaaauggggga

SEQ ID NO: 216262 - RNA, 22 nt, Human
acauggaaacacgcagccccaa

SEQ ID NO: 216263 - RNA, 22 nt, Human
acaugcuuucuagguccuucug

SEQ ID NO: 216264 - RNA, 22 nt, Human
acauuucuccuacuuguuauuu

SEQ ID NO: 216265 - RNA, 22 nt, Human
acauuuccaaagaugccaguca

SEQ ID NO: 216266 - RNA, 22 nt, Human
acauuuguuucucuagaguagg

SEQ ID NO: 216267 - RNA, 22 nt, Human
acaugggggugggacggcagag

SEQ ID NO: 216268 - RNA, 22 nt, Human
acaugggcaaucgcuuuauuca

SEQ ID NO: 216269 - RNA, 22 nt, Human
acauguggaggaggcgagggua

SEQ ID NO: 216270 - RNA, 22 nt, Human
acaugucagaaaauucagaggg

SEQ ID NO: 216271 - RNA, 22 nt, Human
acauccagcagauuguccagag

SEQ ID NO: 216272 - RNA, 22 nt, Human
acauccaguaucagaagcauca

SEQ ID NO: 216273 - RNA, 22 nt, Human
acaugugugucugugugugugu

SEQ ID NO: 216274 - RNA, 22 nt, Human
acauucucuuuuagaaagcugu

SEQ ID NO: 216275 - RNA, 22 nt, Human
acauugcagcuccuaccuuguc

SEQ ID NO: 216276 - RNA, 22 nt, Human
acauuuugggagaaaguuguua

SEQ ID NO: 216277 - RNA, 22 nt, Human
acauuguuuuugugacuucuau

SEQ ID NO: 216278 - RNA, 22 nt, Human
accagccacacacauuagucac

SEQ ID NO: 216279 - RNA, 20 nt, Human
accagacagcuguuggggug

SEQ ID NO: 216280 - RNA, 22 nt, Human
accacguccugguggcuguugg

SEQ ID NO: 216281 - RNA, 22 nt, Human
accaggaguuuugaccaggggc

SEQ ID NO: 216282 - RNA, 22 nt, Human
acauugguauuaguguggcuga

SEQ ID NO: 216283 - RNA, 22 nt, Human
acauuguuauuccucaggaguu

SEQ ID NO: 216284 - RNA, 22 nt, Human
accaccacugacaccagcucgg

SEQ ID NO: 216285 - RNA, 22 nt, Human
acauuuuguuuauggaaaagau

SEQ ID NO: 216286 - RNA, 22 nt, Human
acauuccugaagguaaugagaa

SEQ ID NO: 216287 - RNA, 22 nt, Human
acauuauuguguagugugggca

SEQ ID NO: 216288 - RNA, 23 nt, Human
acauuacacgcaguaauugcccc

SEQ ID NO: 216289 - RNA, 22 nt, Human
accaaucuccuauuuuguuuca

SEQ ID NO: 216290 - RNA, 22 nt, Human
acauguuuacaaaccucaagcc

SEQ ID NO: 216291 - RNA, 22 nt, Human
acauuuuuggguugaugucuga

SEQ ID NO: 216292 - RNA, 22 nt, Human
accaauaaaagcaauucacagu

SEQ ID NO: 216293 - RNA, 21 nt, Human
acccagaauggagccaagccu

SEQ ID NO: 216294 - RNA, 22 nt, Human
accaguuuuuugaccaugggug

SEQ ID NO: 216295 - RNA, 17 nt, Human
accaggggcagcacugc

SEQ ID NO: 216296 - RNA, 22 nt, Human
accauuuaucagaagagacacc

SEQ ID NO: 216297 - RNA, 22 nt, Human
accauccaaaagcuuuucauca

SEQ ID NO: 216298 - RNA, 22 nt, Human
accagccacccugccgcguccg

SEQ ID NO: 216299 - RNA, 22 nt, Human
accagcgcguuuucaguuucau

SEQ ID NO: 216300 - RNA, 22 nt, Human
accaggcagcaccaaagccggu

SEQ ID NO: 216301 - RNA, 22 nt, Human
accaguucuauguagauaauga

SEQ ID NO: 216302 - RNA, 22 nt, Human
acccggccuacucagugcccag

SEQ ID NO: 216303 - RNA, 22 nt, Human
acccaucauuagucuuucagga

SEQ ID NO: 216304 - RNA, 22 nt, Human
acccccacuccgcaguagaacu

SEQ ID NO: 216305 - RNA, 22 nt, Human
acccccuuucuugaccucaugu

SEQ ID NO: 216306 - RNA, 22 nt, Human
agaggcacccaguuaagcugca

SEQ ID NO: 216307 - RNA, 22 nt, Human
agaggaguagcugagcucugca

SEQ ID NO: 216308 - RNA, 22 nt, Human
agagcuccaggguuuuguagug

SEQ ID NO: 216309 - RNA, 22 nt, Human
agagcuuuggaguaaguuuuga

SEQ ID NO: 216310 - RNA, 22 nt, Human
agaggagaauguaaauuuguca

SEQ ID NO: 216311 - RNA, 22 nt, Human
agagcagcaaucuuugaaauua

SEQ ID NO: 216312 - RNA, 22 nt, Human
agagcagauggagcuggaagag

SEQ ID NO: 216313 - RNA, 22 nt, Human
agagcugggacuuggacucaau

SEQ ID NO: 216314 - RNA, 22 nt, Human
agagauugagcucagaagaccu

SEQ ID NO: 216315 - RNA, 23 nt, Human
agagggaagagcuuagaugggga

SEQ ID NO: 216316 - RNA, 22 nt, Human
agaggugcuuaugcucaugguu

SEQ ID NO: 216317 - RNA, 22 nt, Human
agagggagcuccaagaucaagg

SEQ ID NO: 216318 - RNA, 23 nt, Human
agauaaggaagcauuugagccag

SEQ ID NO: 216319 - RNA, 22 nt, Human
agaguuaaugcaggccaagccu

SEQ ID NO: 216320 - RNA, 22 nt, Human
agaguacagaagcauuucagau

SEQ ID NO: 216321 - RNA, 19 nt, Human
agacugaagggcccgaguc

SEQ ID NO: 216322 - RNA, 22 nt, Human
agagcaucgguggaguccccac

SEQ ID NO: 216323 - RNA, 22 nt, Human
agagccauuuaaauaguuguca

SEQ ID NO: 216324 - RNA, 22 nt, Human
agagccaugcuugugcauauau

SEQ ID NO: 216325 - RNA, 22 nt, Human
agagccggagucuucuuguuug

SEQ ID NO: 216326 - RNA, 22 nt, Human
agagaagaauccccugguggag

SEQ ID NO: 216327 - RNA, 22 nt, Human
agagaaccauggcauccaggua

SEQ ID NO: 216328 - RNA, 22 nt, Human
agagacaagggaccucuggaga

SEQ ID NO: 216329 - RNA, 22 nt, Human
agagacugauggaucaccaaau

SEQ ID NO: 216330 - RNA, 21 nt, Human
agagaccuaagcugagauucc

SEQ ID NO: 216331 - RNA, 22 nt, Human
agagcagaggcauggccguggg

SEQ ID NO: 216332 - RNA, 22 nt, Human
agagauacugcaggccauaaau

SEQ ID NO: 216333 - RNA, 22 nt, Human
agagauuagagaagaugauaaa

SEQ ID NO: 216334 - RNA, 22 nt, Human
agagcaauggugcuuuaauucu

SEQ ID NO: 216335 - RNA, 22 nt, Human
agagcacaggguuuugugccgg

SEQ ID NO: 216336 - RNA, 22 nt, Human
agacuuuggcagggccaguggu

SEQ ID NO: 216337 - RNA, 22 nt, Human
agagaaacauuaauugaugagg

SEQ ID NO: 216338 - RNA, 22 nt, Human
agacuuugaaugaugacagcgu

SEQ ID NO: 216339 - RNA, 22 nt, Human
agacuucucuuggcuauauuau

SEQ ID NO: 216340 - RNA, 22 nt, Human
agagaguacuuucaucagggaa

SEQ ID NO: 216341 - RNA, 22 nt, Human
agagaguagaagggacaguauu

SEQ ID NO: 216342 - RNA, 22 nt, Human
agagaacauuuucaggguuuca

SEQ ID NO: 216343 - RNA, 22 nt, Human
agacuauuuugugauaacuaau

SEQ ID NO: 216344 - RNA, 21 nt, Human
agacugaugggaagacucugu

SEQ ID NO: 216345 - RNA, 22 nt, Human
agacucacuucuuucucguauu

SEQ ID NO: 216346 - RNA, 22 nt, Human
agagacauagcacaguuuuucg

SEQ ID NO: 216347 - RNA, 22 nt, Human
agagagggaugguguccagaga

SEQ ID NO: 216348 - RNA, 22 nt, Human
agacuguuuucccaucucuugg

SEQ ID NO: 216349 - RNA, 22 nt, Human
agacccugauucugcuggcggu

SEQ ID NO: 216350 - RNA, 22 nt, Human
agagaaauguacuagucuaacu

SEQ ID NO: 216351 - RNA, 22 nt, Human
agagaacaggcagcuggugccg

SEQ ID NO: 216352 - RNA, 22 nt, Human
agacgacucuuaaggcagaauu

SEQ ID NO: 216353 - RNA, 22 nt, Human
agacauauuggcuugcuuuaau

SEQ ID NO: 216354 - RNA, 22 nt, Human
agacuguuccgucagacucagu

SEQ ID NO: 216355 - RNA, 22 nt, Human
agacuggagucuccuuuggagc

SEQ ID NO: 216356 - RNA, 22 nt, Human
agacagcggugcaauaaauggu

SEQ ID NO: 216357 - RNA, 21 nt, Human
agaaugaagaagaggucuuug

SEQ ID NO: 216358 - RNA, 22 nt, Human
agacagaacauaauuaguacug

SEQ ID NO: 216359 - RNA, 22 nt, Human
agaaccauccugguuccagcuu

SEQ ID NO: 216360 - RNA, 22 nt, Human
agacagaaaaguugucaaucau

SEQ ID NO: 216361 - RNA, 22 nt, Human
agaaucaggaagacagccuggc

SEQ ID NO: 216362 - RNA, 22 nt, Human
agaauccugagggaaauuuggc

SEQ ID NO: 216363 - RNA, 20 nt, Human
agaaggagagaugaggcaaa

SEQ ID NO: 216364 - RNA, 22 nt, Human
agaaccaauacuacagcaagua

SEQ ID NO: 216365 - RNA, 22 nt, Human
agaaauuguaauaaaucugguc

SEQ ID NO: 216366 - RNA, 22 nt, Human
agaaauggggugaagcaaaugg

SEQ ID NO: 216367 - RNA, 22 nt, Human
agaacaagaaacccgaaaagug

SEQ ID NO: 216368 - RNA, 22 nt, Human
acuuuuccuggguagcuccugg

SEQ ID NO: 216369 - RNA, 22 nt, Human
agaaaagagacaauguuuuugg

SEQ ID NO: 216370 - RNA, 22 nt, Human
acuuuggugcgaagucacuuua

SEQ ID NO: 216371 - RNA, 22 nt, Human
acuuugccuucuuacuguguug

SEQ ID NO: 216372 - RNA, 23 nt, Human
acuuugaggagaagaaugucagu

SEQ ID NO: 216373 - RNA, 22 nt, Human
acuuugaauuagaauuuugcug

SEQ ID NO: 216374 - RNA, 22 nt, Human
agaagcauaagggcuuugccag

SEQ ID NO: 216375 - RNA, 21 nt, Human
agaagcggucgaaucgcagac

SEQ ID NO: 216376 - RNA, 22 nt, Human
agaagcagaaggaagcagggcc

SEQ ID NO: 216377 - RNA, 22 nt, Human
agaagaaugguuugaaagauuu

SEQ ID NO: 216378 - RNA, 22 nt, Human
agaagaucccugugguuacgac

SEQ ID NO: 216379 - RNA, 22 nt, Human
agaaagcacccugcacuuucug

SEQ ID NO: 216380 - RNA, 19 nt, Human
agaaauagccuuccuuguc

SEQ ID NO: 216381 - RNA, 20 nt, Human
agaaaggaguaaagaagaga

SEQ ID NO: 216382 - RNA, 22 nt, Human
acuuggcuaggguuuuuaucuu

SEQ ID NO: 216383 - RNA, 22 nt, Human
acuuuaaaucuguugcuuagcu

SEQ ID NO: 216384 - RNA, 22 nt, Human
acuugaagcaugaaaauaagcc

SEQ ID NO: 216385 - RNA, 22 nt, Human
acuucuuuugcaugauucuuua

SEQ ID NO: 216386 - RNA, 22 nt, Human
acuucugcccuggcgagggcgu

SEQ ID NO: 216387 - RNA, 22 nt, Human
acuuugucuugaucaaaggugu

SEQ ID NO: 216388 - RNA, 19 nt, Human
acuugcuuucauuuaagau

SEQ ID NO: 216389 - RNA, 22 nt, Human
acuuugugaauagaacuggaug

SEQ ID NO: 216390 - RNA, 22 nt, Human
acuuuuaaggggccuugauuua

SEQ ID NO: 216391 - RNA, 22 nt, Human
acuuuuuugccaucccuccagc

SEQ ID NO: 216392 - RNA, 22 nt, Human
acuucucuuuucauuaauuuug

SEQ ID NO: 216393 - RNA, 22 nt, Human
acuuaagcagaucuguggucca

SEQ ID NO: 216394 - RNA, 22 nt, Human
acuguugugaauaaugaaaugc

SEQ ID NO: 216395 - RNA, 22 nt, Human
acuguuauugguguauguggca

SEQ ID NO: 216396 - RNA, 22 nt, Human
acuguggcugcuacccuggcuc

SEQ ID NO: 216397 - RNA, 22 nt, Human
acuguugcuuguuuggaauguu

SEQ ID NO: 216398 - RNA, 18 nt, Human
acuguccucaggacguug

SEQ ID NO: 216399 - RNA, 22 nt, Human
acugugaagagcauucuggcug

SEQ ID NO: 216400 - RNA, 22 nt, Human
acugugauuuguuuuuguguuu

SEQ ID NO: 216401 - RNA, 18 nt, Human
acuguggcucagaguugc

SEQ ID NO: 216402 - RNA, 22 nt, Human
acugugacugugucuucugggc

SEQ ID NO: 216403 - RNA, 22 nt, Human
acugugacucuguuucuuggau

SEQ ID NO: 216404 - RNA, 22 nt, Human
acuggguuguuugucucaugag

SEQ ID NO: 216405 - RNA, 22 nt, Human
acugucaggauugagucucugg

SEQ ID NO: 216406 - RNA, 22 nt, Human
acuggugcucuggccaccgcug

SEQ ID NO: 216407 - RNA, 22 nt, Human
acuggcauuccuaggggagggg

SEQ ID NO: 216408 - RNA, 22 nt, Human
acuggcgucugucuccccugcc

SEQ ID NO: 216409 - RNA, 22 nt, Human
acuggcuuauuguuguggagcu

SEQ ID NO: 216410 - RNA, 22 nt, Human
acuggcaugauagaccauaaca

SEQ ID NO: 216411 - RNA, 22 nt, Human
acugggacuguaugugcuggac

SEQ ID NO: 216412 - RNA, 19 nt, Human
acuggggcaggcugggcuu

SEQ ID NO: 216413 - RNA, 22 nt, Human
acugguuucaaguuggacugaa

SEQ ID NO: 216414 - RNA, 22 nt, Human
acuguccucgaaguaccugugc

SEQ ID NO: 216415 - RNA, 22 nt, Human
acugucuuguuguaugugagcu

SEQ ID NO: 216416 - RNA, 22 nt, Human
acuggggcaggaaaguaugcug

SEQ ID NO: 216417 - RNA, 22 nt, Human
acugugauguaaagaaauaggc

SEQ ID NO: 216418 - RNA, 22 nt, Human
acugucauuaaugaauguaaua

SEQ ID NO: 216419 - RNA, 22 nt, Human
acugguagcugauuaaguauag

SEQ ID NO: 216420 - RNA, 22 nt, Human
acugugcccccucuacugcuga

SEQ ID NO: 216421 - RNA, 23 nt, Human
acuggauuguucuugggcgcuga

SEQ ID NO: 216422 - RNA, 22 nt, Human
acuggagcccguggaggcgcag

SEQ ID NO: 216423 - RNA, 22 nt, Human
acugggcaaggauaugaugggu

SEQ ID NO: 216424 - RNA, 21 nt, Human
acugggcuagccugacuucug

SEQ ID NO: 216425 - RNA, 22 nt, Human
acuggggauugguucuucaaca

SEQ ID NO: 216426 - RNA, 22 nt, Human
acuggggaggucuggauggauc

SEQ ID NO: 216427 - RNA, 15 nt, Human
acugggaaggaguau

SEQ ID NO: 216428 - RNA, 19 nt, Human
acugggaugggcagugcca

SEQ ID NO: 216429 - RNA, 22 nt, Human
acuggcuuggaaauggguauuu

SEQ ID NO: 216430 - RNA, 22 nt, Human
acuaauuguuuaaggauaggaa

SEQ ID NO: 216431 - RNA, 20 nt, Human
acuaccaugcaauuccgcuu

SEQ ID NO: 216432 - RNA, 22 nt, Human
acuaagcugugugguucacuca

SEQ ID NO: 216433 - RNA, 20 nt, Human
acugcaagagacagaugaaa

SEQ ID NO: 216434 - RNA, 22 nt, Human
acugauuccaagcuuguggagg

SEQ ID NO: 216435 - RNA, 22 nt, Human
acugacuacauguccugucauu

SEQ ID NO: 216436 - RNA, 22 nt, Human
acugagaacuuggggacagagg

SEQ ID NO: 216437 - RNA, 22 nt, Human
acugacuucugguauuuuuagu

SEQ ID NO: 216438 - RNA, 22 nt, Human
acugagcaaaacugauccuguu

SEQ ID NO: 216439 - RNA, 22 nt, Human
acugcauuaucaccaagaugua

SEQ ID NO: 216440 - RNA, 22 nt, Human
acugccauauuaggagcuucag

SEQ ID NO: 216441 - RNA, 22 nt, Human
cgaccccugaaaauggcagcca

SEQ ID NO: 216442 - RNA, 19 nt, Human
cgacauggguaaugggaga

SEQ ID NO: 216443 - RNA, 22 nt, Human
ccucucccugcagggcccaggg

SEQ ID NO: 216444 - RNA, 22 nt, Human
ccucaguguguggauguuagag

SEQ ID NO: 216445 - RNA, 22 nt, Human
cgccaguggcagcuggaacagg

SEQ ID NO: 216446 - RNA, 22 nt, Human
cgccaaccaggcuguccuccca

SEQ ID NO: 216447 - RNA, 23 nt, Human
cgagagccugcaggaccuucgga

SEQ ID NO: 216448 - RNA, 22 nt, Human
cgcagcuucagggccaggaggg

SEQ ID NO: 216449 - RNA, 22 nt, Human
ccugcugcugaugcuguuucac

SEQ ID NO: 216450 - RNA, 22 nt, Human
ccgauuuauucugacaguuuau

SEQ ID NO: 216451 - RNA, 22 nt, Human
ccgcaccgucugccauacacgc

SEQ ID NO: 216452 - RNA, 22 nt, Human
ccgcagucugcaaucucccugg

SEQ ID NO: 216453 - RNA, 22 nt, Human
ccgcagggcccggcgggcucag

SEQ ID NO: 216454 - RNA, 22 nt, Human
ccucaggaauuuauucuucugu

SEQ ID NO: 216455 - RNA, 22 nt, Human
ccucagcuguuucucucaucag

SEQ ID NO: 216456 - RNA, 22 nt, Human
ccucaauucgugccucacauug

SEQ ID NO: 216457 - RNA, 22 nt, Human
ccgccccaggcccugagccaag

SEQ ID NO: 216458 - RNA, 22 nt, Human
ccgccacggggcaugggaggca

SEQ ID NO: 216459 - RNA, 22 nt, Human
ccugcugagccuggugggcagc

SEQ ID NO: 216460 - RNA, 22 nt, Human
cggcggcgaaccgaccugggug

SEQ ID NO: 216461 - RNA, 22 nt, Human
ccuggaccgacacaggaaggga

SEQ ID NO: 216462 - RNA, 22 nt, Human
cggccgcgggauggcgggcagc

SEQ ID NO: 216463 - RNA, 22 nt, Human
ccugccagaaaagagggaguuc

SEQ ID NO: 216464 - RNA, 22 nt, Human
ccugcccaucccaccccagcau

SEQ ID NO: 216465 - RNA, 22 nt, Human
ccugcucuaauucauucaugcu

SEQ ID NO: 216466 - RNA, 22 nt, Human
ccugcucccccugcaagccuug

SEQ ID NO: 216467 - RNA, 22 nt, Human
cggcccggccucgcggcgcaug

SEQ ID NO: 216468 - RNA, 22 nt, Human
ccugaauuuaucugaauggugg

SEQ ID NO: 216469 - RNA, 22 nt, Human
ccugaagaugguugauccccuu

SEQ ID NO: 216470 - RNA, 22 nt, Human
ccucuggacuugggacagugag

SEQ ID NO: 216471 - RNA, 22 nt, Human
ccucuuuugaaccaguucuuca

SEQ ID NO: 216472 - RNA, 22 nt, Human
ccugaaaugaguucugcucacu

SEQ ID NO: 216473 - RNA, 22 nt, Human
cgcgggcuugggcaccugcgga

SEQ ID NO: 216474 - RNA, 22 nt, Human
cgccugucugcauggccacugg

SEQ ID NO: 216475 - RNA, 22 nt, Human
cgcucggcuuucccuccgccgg

SEQ ID NO: 216476 - RNA, 22 nt, Human
cgcuagggagcacuuggcagug

SEQ ID NO: 216477 - RNA, 22 nt, Human
ccugaguucuuauuuccaguca

SEQ ID NO: 216478 - RNA, 22 nt, Human
cgcucugccugcccuaacuucc

SEQ ID NO: 216479 - RNA, 22 nt, Human
ccugcacuaccuggggcugcug

SEQ ID NO: 216480 - RNA, 22 nt, Human
ccugauauggugucauuuaaac

SEQ ID NO: 216481 - RNA, 22 nt, Human
cgacagauuauuuugugacugc

SEQ ID NO: 216482 - RNA, 22 nt, Human
cuaauaauuuacugagugcuac

SEQ ID NO: 216483 - RNA, 22 nt, Human
cuaaaaauguucuaguaguuca

SEQ ID NO: 216484 - RNA, 22 nt, Human
cguucccuccugccacgggagg

SEQ ID NO: 216485 - RNA, 22 nt, Human
cguuauagagcacucgaacuuu

SEQ ID NO: 216486 - RNA, 20 nt, Human
cguugccagcccggcccggg

SEQ ID NO: 216487 - RNA, 22 nt, Human
ccuuuggaugucauucuuggca

SEQ ID NO: 216488 - RNA, 22 nt, Human
ccuuuuaucgcgaagaacucca

SEQ ID NO: 216489 - RNA, 22 nt, Human
cggugcuuuccauaucagcagc

SEQ ID NO: 216490 - RNA, 22 nt, Human
ccuuugcugggccucuccaucu

SEQ ID NO: 216491 - RNA, 22 nt, Human
cgugcaggagcuggagguccga

SEQ ID NO: 216492 - RNA, 19 nt, Human
cggugaagagaguuuagau

SEQ ID NO: 216493 - RNA, 22 nt, Human
cgggucgcacaggagaaaggcg

SEQ ID NO: 216494 - RNA, 22 nt, Human
cggucggagagaaugaccugga

SEQ ID NO: 216495 - RNA, 19 nt, Human
cggugcugauuggugcagu

SEQ ID NO: 216496 - RNA, 22 nt, Human
cgguggcccauuguacgcagcu

SEQ ID NO: 216497 - RNA, 22 nt, Human
cgguugcaggaugugcgggcag

SEQ ID NO: 216498 - RNA, 22 nt, Human
cggggugugacggugcgggccu

SEQ ID NO: 216499 - RNA, 18 nt, Human
ccuucaucucugcuucuu

SEQ ID NO: 216500 - RNA, 22 nt, Human
ccuucaguguuacuagaaagcg

SEQ ID NO: 216501 - RNA, 19 nt, Human
cgguaugaauguacuaugg

SEQ ID NO: 216502 - RNA, 22 nt, Human
cggggcuggcguuagggaggca

SEQ ID NO: 216503 - RNA, 22 nt, Human
ccuguuuguucauguacuguga

SEQ ID NO: 216504 - RNA, 20 nt, Human
ccuguucacugcgcaguuuc

SEQ ID NO: 216505 - RNA, 23 nt, Human
ccuggcugaccugaagguguagu

SEQ ID NO: 216506 - RNA, 22 nt, Human
ccugggugaugugcugcccucg

SEQ ID NO: 216507 - RNA, 22 nt, Human
ccugggcucgcgcacuucaccc

SEQ ID NO: 216508 - RNA, 22 nt, Human
ccuggggcucugcacagagcag

SEQ ID NO: 216509 - RNA, 22 nt, Human
cggggcggcgagcgggccgggc

SEQ ID NO: 216510 - RNA, 22 nt, Human
ccugucuuuucugaucauacua

SEQ ID NO: 216511 - RNA, 22 nt, Human
ccugugacucugucugaugguc

SEQ ID NO: 216512 - RNA, 22 nt, Human
ccugggccuaaacaaacaagag

SEQ ID NO: 216513 - RNA, 21 nt, Human
ccugucagcccaacuuuugga

SEQ ID NO: 216514 - RNA, 22 nt, Human
cuccuugguuccggcguuggag

SEQ ID NO: 216515 - RNA, 22 nt, Human
cuccuuuuuauaucuuucucug

SEQ ID NO: 216516 - RNA, 22 nt, Human
cucuauuuuuucaucuuucagg

SEQ ID NO: 216517 - RNA, 22 nt, Human
cggccuuuggcuucuccugugu

SEQ ID NO: 216518 - RNA, 22 nt, Human
cucguccugguuuaaguguccu

SEQ ID NO: 216519 - RNA, 22 nt, Human
cucggcccuggucuuacgggac

SEQ ID NO: 216520 - RNA, 22 nt, Human
cgcuuuccaggcacauccucuu

SEQ ID NO: 216521 - RNA, 22 nt, Human
cggaagcacuagacacugacac

SEQ ID NO: 216522 - RNA, 22 nt, Human
cuccugcuuuuucuucuuccga

SEQ ID NO: 216523 - RNA, 22 nt, Human
cuccuggagcagcaggcgcagg

SEQ ID NO: 216524 - RNA, 22 nt, Human
cuccaggcccagggccaagagc

SEQ ID NO: 216525 - RNA, 22 nt, Human
cuccaguugugucuuguaagaa

SEQ ID NO: 216526 - RNA, 22 nt, Human
cuccaugagccaggagggcuac

SEQ ID NO: 216527 - RNA, 22 nt, Human
cgcucggugagccaguggcgga

SEQ ID NO: 216528 - RNA, 22 nt, Human
cucaggaaaauauugaagaagu

SEQ ID NO: 216529 - RNA, 22 nt, Human
cucagcugcuuuguuuugcuuu

SEQ ID NO: 216530 - RNA, 19 nt, Human
cgcugcucccgcuguggcu

SEQ ID NO: 216531 - RNA, 22 nt, Human
cucagcgggagucuggccgaac

SEQ ID NO: 216532 - RNA, 22 nt, Human
cuauugguaucacacugauuuc

SEQ ID NO: 216533 - RNA, 22 nt, Human
cucaauuuuuauugcuuuuuug

SEQ ID NO: 216534 - RNA, 22 nt, Human
cuauuauuauugucguuuuaca

SEQ ID NO: 216535 - RNA, 22 nt, Human
cuaugaaucaauuucugcaguu

SEQ ID NO: 216536 - RNA, 22 nt, Human
cgccuggccccgcagcgcuugu

SEQ ID NO: 216537 - RNA, 22 nt, Human
cuaauugcuggcugcuggcaga

SEQ ID NO: 216538 - RNA, 22 nt, Human
cgacgacaggcgcccgaggagg

SEQ ID NO: 216539 - RNA, 19 nt, Human
cggggcuugguggguucuc

SEQ ID NO: 216540 - RNA, 19 nt, Human
cugacccaacauuaguuca

SEQ ID NO: 216541 - RNA, 22 nt, Human
cgggguguggggcgguagugug

SEQ ID NO: 216542 - RNA, 20 nt, Human
cugaauaccacagagccauc

SEQ ID NO: 216543 - RNA, 22 nt, Human
cugaagcugggcacuuccuuuu

SEQ ID NO: 216544 - RNA, 22 nt, Human
cugaaggacacgugaggagcca

SEQ ID NO: 216545 - RNA, 22 nt, Human
cugacagaucuggaucugaacu

SEQ ID NO: 216546 - RNA, 22 nt, Human
cugaauucuuguugucggagca

SEQ ID NO: 216547 - RNA, 22 nt, Human
cggggcgggcgugggaggugga

SEQ ID NO: 216548 - RNA, 23 nt, Human
cugaaauucagaugcuaaagaua

SEQ ID NO: 216549 - RNA, 22 nt, Human
cgggagaugaggagagcuucgg

SEQ ID NO: 216550 - RNA, 22 nt, Human
cggggcaaggggggcuggugga

SEQ ID NO: 216551 - RNA, 22 nt, Human
cgggcacucagggucgaggugg

SEQ ID NO: 216552 - RNA, 22 nt, Human
cgggcacagguugagguagaug

SEQ ID NO: 216553 - RNA, 22 nt, Human
cggcugcgguucaccuagggca

SEQ ID NO: 216554 - RNA, 22 nt, Human
cggcgcugguacaguggaagag

SEQ ID NO: 216555 - RNA, 22 nt, Human
cugaaacuauggggaggggagc

SEQ ID NO: 216556 - RNA, 19 nt, Human
cugaaacacagagagggcu

SEQ ID NO: 216557 - RNA, 22 nt, Human
cucuuuguauucuagaagcucu

SEQ ID NO: 216558 - RNA, 22 nt, Human
cucuuuuuccuaugaaaucuau

SEQ ID NO: 216559 - RNA, 22 nt, Human
cucuuucauucuuagguugccg

SEQ ID NO: 216560 - RNA, 22 nt, Human
cucuucugugggugcuauguca

SEQ ID NO: 216561 - RNA, 19 nt, Human
cucuucauuggaggguuga

SEQ ID NO: 216562 - RNA, 22 nt, Human
cucuuucauucuguccuuguuu

SEQ ID NO: 216563 - RNA, 22 nt, Human
cucuguugucaguggaagcagc

SEQ ID NO: 216564 - RNA, 22 nt, Human
cucuucauguuggugcagaagc

SEQ ID NO: 216565 - RNA, 22 nt, Human
cucuguauauugagugcuuacu

SEQ ID NO: 216566 - RNA, 22 nt, Human
cucuggggaagugcacucgcug

SEQ ID NO: 216567 - RNA, 17 nt, Human
cucugggucuccugcuu

SEQ ID NO: 216568 - RNA, 22 nt, Human
cucugguuucgcaggaaauaga

SEQ ID NO: 216569 - RNA, 22 nt, Human
cucuccagucauauucucaguc

SEQ ID NO: 216570 - RNA, 18 nt, Human
cucuggacagcaggcauc

SEQ ID NO: 216571 - RNA, 22 nt, Human
cucugcuuguaucacauuugcu

SEQ ID NO: 216572 - RNA, 22 nt, Human
cucuggagggaggcugagcugg

SEQ ID NO: 216573 - RNA, 22 nt, Human
cucuggcaacgauggugcuuau

SEQ ID NO: 216574 - RNA, 21 nt, Human
cccuugccugcacuccucggc

SEQ ID NO: 216575 - RNA, 22 nt, Human
ccugcaugacuuugucagaccu

SEQ ID NO: 216576 - RNA, 19 nt, Human
ccugcugaagugaugcagc

SEQ ID NO: 216577 - RNA, 18 nt, Human
ccugcguggauguccucu

SEQ ID NO: 216578 - RNA, 22 nt, Human
ccugccagccugccaucccaca

SEQ ID NO: 216579 - RNA, 20 nt, Human
cccuggaaugagaugcauau

SEQ ID NO: 216580 - RNA, 22 nt, Human
cccuggacuccauuuucccgua

SEQ ID NO: 216581 - RNA, 17 nt, Human
cccugcauugauccuca

SEQ ID NO: 216582 - RNA, 17 nt, Human
cccugcacccuacucuc

SEQ ID NO: 216583 - RNA, 20 nt, Human
cccuggcuggcaucuggacu

SEQ ID NO: 216584 - RNA, 22 nt, Human
ccugacgcugauauauaguuaa

SEQ ID NO: 216585 - RNA, 22 nt, Human
ccugacucugauuucgcugcau

SEQ ID NO: 216586 - RNA, 22 nt, Human
ccugagacucuccugugcagcc

SEQ ID NO: 216587 - RNA, 21 nt, Human
ccugagccuguuuauccagaa

SEQ ID NO: 216588 - RNA, 22 nt, Human
ccugagccgagcgcucuuucuc

SEQ ID NO: 216589 - RNA, 20 nt, Human
ccucuuuaguugauggguuu

SEQ ID NO: 216590 - RNA, 22 nt, Human
cccuggucucugacuugauccu

SEQ ID NO: 216591 - RNA, 22 nt, Human
cccuucuguaucuucugaguuu

SEQ ID NO: 216592 - RNA, 22 nt, Human
cccuguccugcuaggcccuggu

SEQ ID NO: 216593 - RNA, 22 nt, Human
cccugauaaaucagcaccucag

SEQ ID NO: 216594 - RNA, 22 nt, Human
ccugacagcgugucccuggccc

SEQ ID NO: 216595 - RNA, 22 nt, Human
cccggcucggcuucuuccccac

SEQ ID NO: 216596 - RNA, 22 nt, Human
cccgggucugugugaaauucca

SEQ ID NO: 216597 - RNA, 19 nt, Human
cccucggcuucugguuacu

SEQ ID NO: 216598 - RNA, 21 nt, Human
ccuccagccagagggucugga

SEQ ID NO: 216599 - RNA, 22 nt, Human
cccgccggccacaccggccgcc

SEQ ID NO: 216600 - RNA, 22 nt, Human
cccgaaaauuguuguacugcag

SEQ ID NO: 216601 - RNA, 22 nt, Human
ccuccuuucaggaaguaggugg

SEQ ID NO: 216602 - RNA, 22 nt, Human
ccuccuggaguuacuuccaaaa

SEQ ID NO: 216603 - RNA, 22 nt, Human
cccggcgccucguuuccuaguc

SEQ ID NO: 216604 - RNA, 22 nt, Human
cccggagcagucgggcuccggg

SEQ ID NO: 216605 - RNA, 22 nt, Human
cccgcuaaaucaguucugaguc

SEQ ID NO: 216606 - RNA, 19 nt, Human
ccuccgcauccucaucugu

SEQ ID NO: 216607 - RNA, 22 nt, Human
ccgggcuuccuuagagcaagau

SEQ ID NO: 216608 - RNA, 22 nt, Human
ccgggcggcauccagccguucc

SEQ ID NO: 216609 - RNA, 19 nt, Human
ccggucaugcauuccuuug

SEQ ID NO: 216610 - RNA, 22 nt, Human
ccggguucuuguucuaggaugu

SEQ ID NO: 216611 - RNA, 22 nt, Human
ccggguccagugggcacugggc

SEQ ID NO: 216612 - RNA, 22 nt, Human
cccagcuuugcggacccgggag

SEQ ID NO: 216613 - RNA, 22 nt, Human
cccagcugaacuugcauuccaa

SEQ ID NO: 216614 - RNA, 22 nt, Human
cccagccuuugcuuccugguuc

SEQ ID NO: 216615 - RNA, 22 nt, Human
cccagcucuggaagguggggga

SEQ ID NO: 216616 - RNA, 22 nt, Human
cccagccgcuguggucuagggu

SEQ ID NO: 216617 - RNA, 22 nt, Human
ccggcggguggagcaugcgcgg

SEQ ID NO: 216618 - RNA, 22 nt, Human
ccggauuugggagccaccaggg

SEQ ID NO: 216619 - RNA, 22 nt, Human
ccgcggcagaggcgggggcgcc

SEQ ID NO: 216620 - RNA, 22 nt, Human
ccgccucucgcucccagcuugc

SEQ ID NO: 216621 - RNA, 22 nt, Human
cccagaagaguauguguuugcu

SEQ ID NO: 216622 - RNA, 22 nt, Human
cccaagcuccacauuuuagcuu

SEQ ID NO: 216623 - RNA, 22 nt, Human
ccgcggauggggagucaccacc

SEQ ID NO: 216624 - RNA, 22 nt, Human
ccgcuggccgacuuccgagagc

SEQ ID NO: 216625 - RNA, 22 nt, Human
cccagcaccauaacucaggccu

SEQ ID NO: 216626 - RNA, 22 nt, Human
cccagcccaucauuccugcaaa

SEQ ID NO: 216627 - RNA, 22 nt, Human
cccacgccuucuuucuucaaau

SEQ ID NO: 216628 - RNA, 22 nt, Human
cccagaccagagugccuggacg

SEQ ID NO: 216629 - RNA, 22 nt, Human
ccccugcucagggaggagaccg

SEQ ID NO: 216630 - RNA, 22 nt, Human
ccguuugugcugcaggagaucg

SEQ ID NO: 216631 - RNA, 22 nt, Human
ccuaauuuuagacccacuccua

SEQ ID NO: 216632 - RNA, 22 nt, Human
ccuauauuacaggcuugcucua

SEQ ID NO: 216633 - RNA, 22 nt, Human
ccuagcauagcuuuugccuccc

SEQ ID NO: 216634 - RNA, 22 nt, Human
ccucaucagaaagcagaaagca

SEQ ID NO: 216635 - RNA, 22 nt, Human
ccccagugguugcaacagcaga

SEQ ID NO: 216636 - RNA, 22 nt, Human
cccauuuuuuggauguguggau

SEQ ID NO: 216637 - RNA, 22 nt, Human
ccccaguuccugucaaggguaa

SEQ ID NO: 216638 - RNA, 22 nt, Human
ccguccgcuccuccagccgcug

SEQ ID NO: 216639 - RNA, 22 nt, Human
ccagugcagacgcggaacuggc

SEQ ID NO: 216640 - RNA, 22 nt, Human
cccugggucagagcgacuucuc

SEQ ID NO: 216641 - RNA, 22 nt, Human
ccagugcaguacaaaccuuagu

SEQ ID NO: 216642 - RNA, 22 nt, Human
ccaguggugcauguuugagcaa

SEQ ID NO: 216643 - RNA, 22 nt, Human
ccaguuuuuccagugcuuucug

SEQ ID NO: 216644 - RNA, 22 nt, Human
ccagucuuggugucuguagcac

SEQ ID NO: 216645 - RNA, 22 nt, Human
cccugcuuccucuucuguuugu

SEQ ID NO: 216646 - RNA, 22 nt, Human
ccagugagauagugguauaugc

SEQ ID NO: 216647 - RNA, 22 nt, Human
cccugggccccgaacugcugag

SEQ ID NO: 216648 - RNA, 22 nt, Human
cccgugggaugagaggcccugg

SEQ ID NO: 216649 - RNA, 22 nt, Human
cccguggugggaugacaccaug

SEQ ID NO: 216650 - RNA, 22 nt, Human
cccgguggagaugugggacagg

SEQ ID NO: 216651 - RNA, 22 nt, Human
cccgggcucuggcagaggcggu

SEQ ID NO: 216652 - RNA, 22 nt, Human
ccagggucggcaucagcguggg

SEQ ID NO: 216653 - RNA, 22 nt, Human
ccagggcuggguuugucggugu

SEQ ID NO: 216654 - RNA, 22 nt, Human
ccagguggacggcgaguacagg

SEQ ID NO: 216655 - RNA, 22 nt, Human
ccaguccacgucaagaagaggu

SEQ ID NO: 216656 - RNA, 22 nt, Human
ccaggggagagucugagucguu

SEQ ID NO: 216657 - RNA, 22 nt, Human
cccuuuuuuauggaguuggcca

SEQ ID NO: 216658 - RNA, 22 nt, Human
cccuuuucuaauuuagccuguu

SEQ ID NO: 216659 - RNA, 21 nt, Human
ccgacggcgcagaugccggcc

SEQ ID NO: 216660 - RNA, 22 nt, Human
ccauaaaagagaaucuaaauga

SEQ ID NO: 216661 - RNA, 22 nt, Human
ccaugaggcaaagacugauaua

SEQ ID NO: 216662 - RNA, 22 nt, Human
ccaugauguugccuacacugcu

SEQ ID NO: 216663 - RNA, 22 nt, Human
ccauggauacuaagguauguga

SEQ ID NO: 216664 - RNA, 22 nt, Human
cccuuuuuugccauuccuuccu

SEQ ID NO: 216665 - RNA, 22 nt, Human
ccauaaaguaggaaacacuaca

SEQ ID NO: 216666 - RNA, 21 nt, Human
ccgaggagugcggggagcccc

SEQ ID NO: 216667 - RNA, 22 nt, Human
ccgauuuaugucucugacuuga

SEQ ID NO: 216668 - RNA, 22 nt, Human
ccaugugaccugugucaguugc

SEQ ID NO: 216669 - RNA, 22 nt, Human
ccauguaagcuggacuccuggg

SEQ ID NO: 216670 - RNA, 22 nt, Human
ccaugggugucuggagcacccu

SEQ ID NO: 216671 - RNA, 23 nt, Human
ccaugugcaggguucagcacuua

SEQ ID NO: 216672 - RNA, 22 nt, Human
ccauuuggccauucaguuguuc

SEQ ID NO: 216673 - RNA, 22 nt, Human
ccauuucacaucccugacaugu

SEQ ID NO: 216674 - RNA, 18 nt, Human
ccccucuuccagacagag

SEQ ID NO: 216675 - RNA, 22 nt, Human
ccagcucgaggcaggggcugca

SEQ ID NO: 216676 - RNA, 22 nt, Human
ccccuuguuuuauucaaauugg

SEQ ID NO: 216677 - RNA, 22 nt, Human
ccagcuuuucagaaucugccug

SEQ ID NO: 216678 - RNA, 22 nt, Human
ccagcugcugcaccgugcaugg

SEQ ID NO: 216679 - RNA, 22 nt, Human
ccagccugagcuugcugcccuc

SEQ ID NO: 216680 - RNA, 22 nt, Human
ccccaggcagcccuccaggagc

SEQ ID NO: 216681 - RNA, 22 nt, Human
ccagccuucugaugggacccuc

SEQ ID NO: 216682 - RNA, 22 nt, Human
cccccauccccugaaggagcug

SEQ ID NO: 216683 - RNA, 22 nt, Human
ccccauggaaaacccaccuagg

SEQ ID NO: 216684 - RNA, 22 nt, Human
ccccaguuucaccuaccccgcc

SEQ ID NO: 216685 - RNA, 22 nt, Human
ccccucuguagcccgagcugcu

SEQ ID NO: 216686 - RNA, 22 nt, Human
cccgacuccuccugguaccuaa

SEQ ID NO: 216687 - RNA, 19 nt, Human
cccgauggagacuuagcag

SEQ ID NO: 216688 - RNA, 22 nt, Human
ccaggcccugccugugguuccu

SEQ ID NO: 216689 - RNA, 22 nt, Human
ccaggacuuauuacaguauaac

SEQ ID NO: 216690 - RNA, 22 nt, Human
ccaggcagaggggucuggagca

SEQ ID NO: 216691 - RNA, 22 nt, Human
ccaggaguccgugggucuugag

SEQ ID NO: 216692 - RNA, 22 nt, Human
ccagggagggccacagggccau

SEQ ID NO: 216693 - RNA, 22 nt, Human
ccaggcucaccuggagccccug

SEQ ID NO: 216694 - RNA, 22 nt, Human
ccagggaagaaagaugaagugc

SEQ ID NO: 216695 - RNA, 22 nt, Human
caucaaaugcaagagcguucuu

SEQ ID NO: 216696 - RNA, 22 nt, Human
caugucaagacugaagauccag

SEQ ID NO: 216697 - RNA, 23 nt, Human
cauguacacacagcuguacagug

SEQ ID NO: 216698 - RNA, 22 nt, Human
cauuaccuggggagaggauacc

SEQ ID NO: 216699 - RNA, 20 nt, Human
caucaacaccuugucagccu

SEQ ID NO: 216700 - RNA, 22 nt, Human
cccagccugaucucggccagcu

SEQ ID NO: 216701 - RNA, 22 nt, Human
ccagaggcuuaugcagcugcug

SEQ ID NO: 216702 - RNA, 16 nt, Human
ccagaugaaugggagu

SEQ ID NO: 216703 - RNA, 22 nt, Human
ccagaugggggcugugggaggg

SEQ ID NO: 216704 - RNA, 22 nt, Human
ccagcaagacucgcagugggau

SEQ ID NO: 216705 - RNA, 22 nt, Human
cccaguuguuccuauucuucuu

SEQ ID NO: 216706 - RNA, 22 nt, Human
cccaucugugaaauggggcugc

SEQ ID NO: 216707 - RNA, 22 nt, Human
cccaugacucucauucacaguc

SEQ ID NO: 216708 - RNA, 22 nt, Human
ccagccacagcuuccagcuccu

SEQ ID NO: 216709 - RNA, 22 nt, Human
ccagcaucagcucuuggcuggc

SEQ ID NO: 216710 - RNA, 22 nt, Human
ccagcaggagacuagcaacaua

SEQ ID NO: 216711 - RNA, 22 nt, Human
cccagcuggcaaaggcguccuu

SEQ ID NO: 216712 - RNA, 22 nt, Human
cccagcgccugcccuccgccgc

SEQ ID NO: 216713 - RNA, 22 nt, Human
cccaggccguguaaucagcagc

SEQ ID NO: 216714 - RNA, 22 nt, Human
cccaggucgucagcaguguggu

SEQ ID NO: 216715 - RNA, 22 nt, Human
cccagggguugaggccguaggg

SEQ ID NO: 216716 - RNA, 22 nt, Human
cuguuucucugccugcacacau

SEQ ID NO: 216717 - RNA, 22 nt, Human
cuguuuggcuuccacugcuucu

SEQ ID NO: 216718 - RNA, 22 nt, Human
cuguuuggaugccauggucaag

SEQ ID NO: 216719 - RNA, 22 nt, Human
cuguuuuugccugugacaaaaa

SEQ ID NO: 216720 - RNA, 22 nt, Human
cuguucuccacuccugacuucu

SEQ ID NO: 216721 - RNA, 22 nt, Human
cuguuccuccaccucaacaaac

SEQ ID NO: 216722 - RNA, 22 nt, Human
cuguguuaggaucuugcuggca

SEQ ID NO: 216723 - RNA, 22 nt, Human
cuguuacggaggcuuucuaguu

SEQ ID NO: 216724 - RNA, 22 nt, Human
cuuauucuucuggacuuggagu

SEQ ID NO: 216725 - RNA, 22 nt, Human
gaagcagguucuucaggaugaa

SEQ ID NO: 216726 - RNA, 22 nt, Human
cuuauaucaacuggaaaaauua

SEQ ID NO: 216727 - RNA, 23 nt, Human
cuuauauaaucauuagaaaccau

SEQ ID NO: 216728 - RNA, 22 nt, Human
cuucacugcagucauggcucug

SEQ ID NO: 216729 - RNA, 22 nt, Human
cuuauuugcccauguuucuuua

SEQ ID NO: 216730 - RNA, 22 nt, Human
gaagccaugauaaccagugugg

SEQ ID NO: 216731 - RNA, 23 nt, Human
cuucagaccucagaaggucuguu

SEQ ID NO: 216732 - RNA, 22 nt, Human
cuguguggccuaaguggagaca

SEQ ID NO: 216733 - RNA, 22 nt, Human
cuguguguauaauguuugauaa

SEQ ID NO: 216734 - RNA, 22 nt, Human
cugugugcagggcacaauggaa

SEQ ID NO: 216735 - RNA, 22 nt, Human
gaaauagagacaguaagugucu

SEQ ID NO: 216736 - RNA, 22 nt, Human
gaaaggagacugcacuggagcc

SEQ ID NO: 216737 - RNA, 22 nt, Human
cugugcuguuaagaaauuuagu

SEQ ID NO: 216738 - RNA, 22 nt, Human
cuguggaaugcaguugcgagca

SEQ ID NO: 216739 - RNA, 22 nt, Human
cuggcccugucagcacagaauc

SEQ ID NO: 216740 - RNA, 22 nt, Human
cuggcaguguccagcucgugau

SEQ ID NO: 216741 - RNA, 22 nt, Human
cuggaugucugggaggcuuccc

SEQ ID NO: 216742 - RNA, 19 nt, Human
cuuugugguuuucagaacu

SEQ ID NO: 216743 - RNA, 22 nt, Human
cuuugugcagcagaaaugugug

SEQ ID NO: 216744 - RNA, 22 nt, Human
cuuuggggcugaggaggagguu

SEQ ID NO: 216745 - RNA, 22 nt, Human
gaaugccugggguucuucgauc

SEQ ID NO: 216746 - RNA, 22 nt, Human
gaaugcauuuuuuaaaagcaua

SEQ ID NO: 216747 - RNA, 22 nt, Human
gaauggaugcuggucaguuugg

SEQ ID NO: 216748 - RNA, 22 nt, Human
gaauggagaacccuggacacug

SEQ ID NO: 216749 - RNA, 22 nt, Human
cuugcuuuaucugguuucucau

SEQ ID NO: 216750 - RNA, 22 nt, Human
cuugcugggagagcuuuagaga

SEQ ID NO: 216751 - RNA, 22 nt, Human
gaaugacuugcucauucugugu

SEQ ID NO: 216752 - RNA, 22 nt, Human
gaauacaagccugccaccugga

SEQ ID NO: 216753 - RNA, 22 nt, Human
cuucuuucuuuucuucuucucu

SEQ ID NO: 216754 - RNA, 22 nt, Human
cuucuuugacucacugguacgc

SEQ ID NO: 216755 - RNA, 22 nt, Human
cuucuugucagugauuucuucc

SEQ ID NO: 216756 - RNA, 21 nt, Human
gaaguagcucugagaaaagug

SEQ ID NO: 216757 - RNA, 22 nt, Human
cuucuuuucuacuggccuagaa

SEQ ID NO: 216758 - RNA, 22 nt, Human
gaagcccuggaggggcuggagg

SEQ ID NO: 216759 - RNA, 22 nt, Human
cuucagcgucgucaguguugcu

SEQ ID NO: 216760 - RNA, 22 nt, Human
gaagcgugcagguccguauacu

SEQ ID NO: 216761 - RNA, 19 nt, Human
cuucaguguucaccuggcc

SEQ ID NO: 216762 - RNA, 22 nt, Human
gaagcuucgaaagagugauuuc

SEQ ID NO: 216763 - RNA, 22 nt, Human
cuucauuucaggcugaagaaua

SEQ ID NO: 216764 - RNA, 22 nt, Human
gaaggaaaagacgugcuaagua

SEQ ID NO: 216765 - RNA, 22 nt, Human
gaagcuucucaacugguggaau

SEQ ID NO: 216766 - RNA, 22 nt, Human
cuucauccguaccacggccaca

SEQ ID NO: 216767 - RNA, 22 nt, Human
gaaggcagucuggggagcagcc

SEQ ID NO: 216768 - RNA, 22 nt, Human
cuuccagugcauagguagauca

SEQ ID NO: 216769 - RNA, 22 nt, Human
cuuccauucugauggcuaauua

SEQ ID NO: 216770 - RNA, 22 nt, Human
cuucuggaggcucuagaggaga

SEQ ID NO: 216771 - RNA, 22 nt, Human
gacggagugcgcuugcuguuca

SEQ ID NO: 216772 - RNA, 22 nt, Human
gacggaggacaucagcaguguc

SEQ ID NO: 216773 - RNA, 22 nt, Human
cuuuuaaucuaauuuuuauauu

SEQ ID NO: 216774 - RNA, 20 nt, Human
gacgaacuagaacaguggua

SEQ ID NO: 216775 - RNA, 19 nt, Human
cuuuuagagggagaggacu

SEQ ID NO: 216776 - RNA, 22 nt, Human
gacccgacaaguaaucagguga

SEQ ID NO: 216777 - RNA, 22 nt, Human
gacccggauguuguacucgagg

SEQ ID NO: 216778 - RNA, 22 nt, Human
gaccagaacuucuagucuaagu

SEQ ID NO: 216779 - RNA, 22 nt, Human
gaccaggagauuugagcuaggc

SEQ ID NO: 216780 - RNA, 22 nt, Human
gacauuuauuggauuuuacgag

SEQ ID NO: 216781 - RNA, 22 nt, Human
gacaucuguccauggcacugga

SEQ ID NO: 216782 - RNA, 22 nt, Human
cuuguuaacaauugguaucuuu

SEQ ID NO: 216783 - RNA, 22 nt, Human
cuuuaaaaauguauuuuugugg

SEQ ID NO: 216784 - RNA, 22 nt, Human
cuuuaagugaaaggggauuaaa

SEQ ID NO: 216785 - RNA, 22 nt, Human
gagaauaauaauaggcauggug

SEQ ID NO: 216786 - RNA, 22 nt, Human
gagaagugaauaacgaagcagg

SEQ ID NO: 216787 - RNA, 22 nt, Human
gagaaguaggaauaucaggagu

SEQ ID NO: 216788 - RNA, 22 nt, Human
gaaaaguauuaugugaggguuc

SEQ ID NO: 216789 - RNA, 22 nt, Human
gaaagaggcugucagggaaugg

SEQ ID NO: 216790 - RNA, 22 nt, Human
gagaagugggggucugggauga

SEQ ID NO: 216791 - RNA, 22 nt, Human
gaaagcauucuggaggggcaga

SEQ ID NO: 216792 - RNA, 22 nt, Human
gaaagggggcuuggacacuggc

SEQ ID NO: 216793 - RNA, 22 nt, Human
gaaagcuuggaaacgacuuuau

SEQ ID NO: 216794 - RNA, 22 nt, Human
gaaacguuguggaaaauccucu

SEQ ID NO: 216795 - RNA, 22 nt, Human
gaaaaggaggggaggcagaugg

SEQ ID NO: 216796 - RNA, 22 nt, Human
gaaaagcucuuuagaagagguu

SEQ ID NO: 216797 - RNA, 22 nt, Human
gaaaaagucuuaaaguaaggca

SEQ ID NO: 216798 - RNA, 22 nt, Human
gacuucuuaaagaggugaggaa

SEQ ID NO: 216799 - RNA, 22 nt, Human
gacugggacucaacccaccauu

SEQ ID NO: 216800 - RNA, 22 nt, Human
gacuggcucuaucaggauaaau

SEQ ID NO: 216801 - RNA, 16 nt, Human
gaauuccauugcucug

SEQ ID NO: 216802 - RNA, 22 nt, Human
gacuggguaaagcuuauccaaa

SEQ ID NO: 216803 - RNA, 22 nt, Human
gacugucaaauaaaucguuuac

SEQ ID NO: 216804 - RNA, 22 nt, Human
gaacuuuaauuagcuuuugucu

SEQ ID NO: 216805 - RNA, 22 nt, Human
gaacugggguagggguagcuuu

SEQ ID NO: 216806 - RNA, 22 nt, Human
gagcagcugagcuggaaugaga

SEQ ID NO: 216807 - RNA, 22 nt, Human
gagcaggcuggcagggccaggg

SEQ ID NO: 216808 - RNA, 22 nt, Human
gagcagggagaggcagagaggc

SEQ ID NO: 216809 - RNA, 22 nt, Human
gaagaugacaucggaucugucu

SEQ ID NO: 216810 - RNA, 22 nt, Human
gaacuuaauauacaaucaguuc

SEQ ID NO: 216811 - RNA, 22 nt, Human
gagcaggucucaguucugccuc

SEQ ID NO: 216812 - RNA, 22 nt, Human
gagcagguuauuagaaauggaa

SEQ ID NO: 216813 - RNA, 22 nt, Human
gagcagucuuugaaaggcacca

SEQ ID NO: 216814 - RNA, 22 nt, Human
gagcacauguggagagucuggg

SEQ ID NO: 216815 - RNA, 22 nt, Human
gagcaacacauugaaugaggau

SEQ ID NO: 216816 - RNA, 22 nt, Human
gagcacugagcuggaauuggag

SEQ ID NO: 216817 - RNA, 22 nt, Human
gaaccuggcagcccuauaucug

SEQ ID NO: 216818 - RNA, 22 nt, Human
gaacggccucguuccucggugu

SEQ ID NO: 216819 - RNA, 22 nt, Human
gagcagccugaggauucugcuc

SEQ ID NO: 216820 - RNA, 22 nt, Human
gagcagcucgagaaggaagcag

SEQ ID NO: 216821 - RNA, 22 nt, Human
gagauuguggcagcagcuguuu

SEQ ID NO: 216822 - RNA, 22 nt, Human
gagauuucauuugugaggcuca

SEQ ID NO: 216823 - RNA, 22 nt, Human
gagauuaauuaaaaccuuuaug

SEQ ID NO: 216824 - RNA, 22 nt, Human
gaacaaaagauagcccaaacau

SEQ ID NO: 216825 - RNA, 22 nt, Human
gagauuugaguuccuacugagu

SEQ ID NO: 216826 - RNA, 22 nt, Human
gaacauauuuagcaccuaauau

SEQ ID NO: 216827 - RNA, 20 nt, Human
gaacauaaauaacucuuuac

SEQ ID NO: 216828 - RNA, 22 nt, Human
gaacaguuucccuguagaaaau

SEQ ID NO: 216829 - RNA, 22 nt, Human
gaacagauucaucuaguggcua

SEQ ID NO: 216830 - RNA, 22 nt, Human
gaaaugucaagauauguuugga

SEQ ID NO: 216831 - RNA, 22 nt, Human
gaaauuucuuuguuaucuuggu

SEQ ID NO: 216832 - RNA, 22 nt, Human
gaaaugggggcaugcguuacau

SEQ ID NO: 216833 - RNA, 22 nt, Human
gaaagugaauguaacauguuau

SEQ ID NO: 216834 - RNA, 22 nt, Human
gaaauaggcccuuacauggaaa

SEQ ID NO: 216835 - RNA, 22 nt, Human
gagagcaaaccuguguuuggag

SEQ ID NO: 216836 - RNA, 22 nt, Human
gagagauacauucccaaccuga

SEQ ID NO: 216837 - RNA, 22 nt, Human
gagaggaagugccugcucccag

SEQ ID NO: 216838 - RNA, 22 nt, Human
gagaggcugagcaguccggguu

SEQ ID NO: 216839 - RNA, 22 nt, Human
gagaggugaagcuaauuaauuu

SEQ ID NO: 216840 - RNA, 22 nt, Human
cugccuuggcccuaguucaugg

SEQ ID NO: 216841 - RNA, 22 nt, Human
cuugauucauuuaagguuggag

SEQ ID NO: 216842 - RNA, 22 nt, Human
cuugcagccuggagcucagccu

SEQ ID NO: 216843 - RNA, 22 nt, Human
cuugcagagcccauggauguca

SEQ ID NO: 216844 - RNA, 20 nt, Human
cuugaguucagagcugucau

SEQ ID NO: 216845 - RNA, 22 nt, Human
cugccccucgcucaccagcucu

SEQ ID NO: 216846 - RNA, 22 nt, Human
cugccuggggaaugugaggauu

SEQ ID NO: 216847 - RNA, 22 nt, Human
cugccugugcgccaagugcacg

SEQ ID NO: 216848 - RNA, 22 nt, Human
cuugagcugaguuugcagcucu

SEQ ID NO: 216849 - RNA, 22 nt, Human
cugccucucaugccugcuugcu

SEQ ID NO: 216850 - RNA, 22 nt, Human
cugccgaugcgcaguggcgccu

SEQ ID NO: 216851 - RNA, 22 nt, Human
cugcccugcagcuccacggacu

SEQ ID NO: 216852 - RNA, 22 nt, Human
cugcccauggcuccuggcugug

SEQ ID NO: 216853 - RNA, 22 nt, Human
cuucugaugugugcucuuaguu

SEQ ID NO: 216854 - RNA, 22 nt, Human
cuucucuuugacaguugggugu

SEQ ID NO: 216855 - RNA, 22 nt, Human
cuucuguggcugagaaggcagc

SEQ ID NO: 216856 - RNA, 22 nt, Human
cuucuguguggauacagucccu

SEQ ID NO: 216857 - RNA, 22 nt, Human
cuucuucaucuuuuggaggaac

SEQ ID NO: 216858 - RNA, 22 nt, Human
cuucucuuccuucucauccuca

SEQ ID NO: 216859 - RNA, 22 nt, Human
cugccaguaucuuuggggcugu

SEQ ID NO: 216860 - RNA, 21 nt, Human
cuucgcuguuccagcucuugg

SEQ ID NO: 216861 - RNA, 22 nt, Human
cugcagauaaguguuuugaaaa

SEQ ID NO: 216862 - RNA, 22 nt, Human
cuuccugcaacaccuguguugc

SEQ ID NO: 216863 - RNA, 22 nt, Human
cugcagauguagcugcuuuccu

SEQ ID NO: 216864 - RNA, 22 nt, Human
cugcaguguccgcuugcucagc

SEQ ID NO: 216865 - RNA, 22 nt, Human
cugcaucacagcaggaggcaca

SEQ ID NO: 216866 - RNA, 20 nt, Human
cugauguucgugcuuccugg

SEQ ID NO: 216867 - RNA, 22 nt, Human
cugauggagagugugauuuggg

SEQ ID NO: 216868 - RNA, 22 nt, Human
cugaugucaaauuuaucaaagc

SEQ ID NO: 216869 - RNA, 22 nt, Human
cuucaguuaguuucaugugagc

SEQ ID NO: 216870 - RNA, 22 nt, Human
cuucauaagauuguugugagga

SEQ ID NO: 216871 - RNA, 22 nt, Human
cuucauuacagcaaccauuuga

SEQ ID NO: 216872 - RNA, 22 nt, Human
cuuccacucaguuuuucauugc

SEQ ID NO: 216873 - RNA, 22 nt, Human
cuucccugucuacaacccugcc

SEQ ID NO: 216874 - RNA, 22 nt, Human
cugcacuggguacauagaaaca

SEQ ID NO: 216875 - RNA, 22 nt, Human
cugcacagucauuuccucucaa

SEQ ID NO: 216876 - RNA, 22 nt, Human
cugauuguagccacugugauga

SEQ ID NO: 216877 - RNA, 22 nt, Human
cugaugugcauguggggggaug

SEQ ID NO: 216878 - RNA, 22 nt, Human
cuggaaauggcagaguugcauu

SEQ ID NO: 216879 - RNA, 22 nt, Human
cuuguuuggccauaggugcugg

SEQ ID NO: 216880 - RNA, 22 nt, Human
cuggaagcgucggaggaagggc

SEQ ID NO: 216881 - RNA, 23 nt, Human
cuggacauucgcaaaguucaucu

SEQ ID NO: 216882 - RNA, 22 nt, Human
cugcuuguguugcucagaguca

SEQ ID NO: 216883 - RNA, 19 nt, Human
cuuguggcuaugcagauac

SEQ ID NO: 216884 - RNA, 22 nt, Human
cuuguuaaaagugacccuaaug

SEQ ID NO: 216885 - RNA, 18 nt, Human
cuuucugcccccauuagc

SEQ ID NO: 216886 - RNA, 22 nt, Human
cuuugauuucucugguccaauc

SEQ ID NO: 216887 - RNA, 22 nt, Human
cuuuccugaaaucucuucugca

SEQ ID NO: 216888 - RNA, 22 nt, Human
cuuuccaugucuucuuucucca

SEQ ID NO: 216889 - RNA, 22 nt, Human
cuuucugauguaaggaacuagg

SEQ ID NO: 216890 - RNA, 22 nt, Human
cuuucuccagagugaagauccu

SEQ ID NO: 216891 - RNA, 22 nt, Human
cuggagaacagagcuguuuaga

SEQ ID NO: 216892 - RNA, 22 nt, Human
cuggagaagagguaguauguag

SEQ ID NO: 216893 - RNA, 22 nt, Human
cuuggcaaaguggcaaaauuag

SEQ ID NO: 216894 - RNA, 22 nt, Human
cugcucuucccaucccuuaaau

SEQ ID NO: 216895 - RNA, 20 nt, Human
cugcuccauggcaucuuuag

SEQ ID NO: 216896 - RNA, 22 nt, Human
cuugcuguccgaugggucugua

SEQ ID NO: 216897 - RNA, 22 nt, Human
cugcuauaacacuaacaucuaa

SEQ ID NO: 216898 - RNA, 22 nt, Human
cugcucugagaggcucuuccua

SEQ ID NO: 216899 - RNA, 22 nt, Human
cugcggcaccaaccccuucaug

SEQ ID NO: 216900 - RNA, 22 nt, Human
cugcguugaccagacuccuggg

SEQ ID NO: 216901 - RNA, 22 nt, Human
cuuggugagcuccuggcgcagc

SEQ ID NO: 216902 - RNA, 22 nt, Human
cuuggugcgaagagucagggga

SEQ ID NO: 216903 - RNA, 22 nt, Human
cugcuugaugaggaaaggauug

SEQ ID NO: 216904 - RNA, 22 nt, Human
cugcuggugcugcccacacggu

SEQ ID NO: 216905 - RNA, 22 nt, Human
cugcugccagcuuaauacucac

SEQ ID NO: 216906 - RNA, 22 nt, Human
cuuggcauguucaucugcuugg

SEQ ID NO: 216907 - RNA, 22 nt, Human
cugcuguugagguuccaggcca

SEQ ID NO: 216908 - RNA, 23 nt, Human
cuuggcuagccacuuccacgcuc

SEQ ID NO: 216909 - RNA, 22 nt, Human
cucccaucacaauucagggccu

SEQ ID NO: 216910 - RNA, 22 nt, Human
cuccaggacugaggacagagcu

SEQ ID NO: 216911 - RNA, 22 nt, Human
cuccagucccuccuugcccagc

SEQ ID NO: 216912 - RNA, 22 nt, Human
cugggaaucuagagggcucauu

SEQ ID NO: 216913 - RNA, 21 nt, Human
cugggaacccgaccaaggccu

SEQ ID NO: 216914 - RNA, 22 nt, Human
cuccggccuucugacuccccug

SEQ ID NO: 216915 - RNA, 22 nt, Human
cuccggggacgcagucgccgcc

SEQ ID NO: 216916 - RNA, 22 nt, Human
cuccugauuucuaggccuuauc

SEQ ID NO: 216917 - RNA, 22 nt, Human
cuccuuuuuuuaaagauggauu

SEQ ID NO: 216918 - RNA, 22 nt, Human
cucggagggcaaguacuggcug

SEQ ID NO: 216919 - RNA, 22 nt, Human
cucuaaauguggucugcagaua

SEQ ID NO: 216920 - RNA, 22 nt, Human
cuccuuuuugggaccgugcagc

SEQ ID NO: 216921 - RNA, 22 nt, Human
cucgccugacucggaugggcug

SEQ ID NO: 216922 - RNA, 22 nt, Human
cugggagaggaaccucgagggu

SEQ ID NO: 216923 - RNA, 22 nt, Human
cuggccagccucccagguaccc

SEQ ID NO: 216924 - RNA, 22 nt, Human
cuggccaggugggggguagugg

SEQ ID NO: 216925 - RNA, 22 nt, Human
cuggccugugggcugucuccgg

SEQ ID NO: 216926 - RNA, 22 nt, Human
cuggauagaccccuuauugcau

SEQ ID NO: 216927 - RNA, 22 nt, Human
cuggauuaaacaguuugauacu

SEQ ID NO: 216928 - RNA, 22 nt, Human
cucaugcugcaaauggcuguuu

SEQ ID NO: 216929 - RNA, 22 nt, Human
cuggaucgccccgaugugcccc

SEQ ID NO: 216930 - RNA, 22 nt, Human
cuggauagaggaugguaggcac

SEQ ID NO: 216931 - RNA, 22 nt, Human
cuggaugagcuucgugcgcacg

SEQ ID NO: 216932 - RNA, 22 nt, Human
cuggagcuucaggguucucggg

SEQ ID NO: 216933 - RNA, 22 nt, Human
cugcuuuggaucucucucugcc

SEQ ID NO: 216934 - RNA, 20 nt, Human
cuggaguguagcaguggcug

SEQ ID NO: 216935 - RNA, 22 nt, Human
cuggagaacucugugcuucacu

SEQ ID NO: 216936 - RNA, 22 nt, Human
cuggaauugcuugagcuaggaa

SEQ ID NO: 216937 - RNA, 22 nt, Human
cugagaaauacccaagucuggu

SEQ ID NO: 216938 - RNA, 22 nt, Human
cugacugaggaucaguucauca

SEQ ID NO: 216939 - RNA, 22 nt, Human
cugaccugugagcuaugccggc

SEQ ID NO: 216940 - RNA, 22 nt, Human
cuggaaaaauggauccugucuu

SEQ ID NO: 216941 - RNA, 22 nt, Human
cuggaaagauuuacacggggaa

SEQ ID NO: 216942 - RNA, 19 nt, Human
cugagcagggaaaaacccu

SEQ ID NO: 216943 - RNA, 22 nt, Human
cugagaggcacaaggcauuucg

SEQ ID NO: 216944 - RNA, 22 nt, Human
cugaguuuuucaaaucugaauu

SEQ ID NO: 216945 - RNA, 22 nt, Human
cuucacuccuggagugaguuuc

SEQ ID NO: 216946 - RNA, 22 nt, Human
cugauagagcauuagugugaga

SEQ ID NO: 216947 - RNA, 22 nt, Human
cugauaauaaccauuuuaaaau

SEQ ID NO: 216948 - RNA, 22 nt, Human
cugaggaguaguucuggaggac

SEQ ID NO: 216949 - RNA, 22 nt, Human
cugagcggugagggcauacagc

SEQ ID NO: 216950 - RNA, 22 nt, Human
cuuaggcgugugcgggugaggc

SEQ ID NO: 216951 - RNA, 22 nt, Human
cugacacagccauuguccuugu

SEQ ID NO: 216952 - RNA, 22 nt, Human
cugaccgugccgcgguacugcu

SEQ ID NO: 216953 - RNA, 20 nt, Human
cugaccagcagccugucucc

SEQ ID NO: 216954 - RNA, 22 nt, Human
cuguguugggauggugcgcgca

SEQ ID NO: 216955 - RNA, 22 nt, Human
cugaaucaaaugacuuagccau

SEQ ID NO: 216956 - RNA, 22 nt, Human
cugaaggcuuugaauggaauga

SEQ ID NO: 216957 - RNA, 22 nt, Human
cugugucucccaaggaggguca

SEQ ID NO: 216958 - RNA, 22 nt, Human
cugugugugcacacguguaugg

SEQ ID NO: 216959 - RNA, 22 nt, Human
cugugcuguuagcgauuuuuaa

SEQ ID NO: 216960 - RNA, 22 nt, Human
cucuugacagcuuuaguaucau

SEQ ID NO: 216961 - RNA, 22 nt, Human
cucuucauuauucacgcccugu

SEQ ID NO: 216962 - RNA, 22 nt, Human
cugugcauaugucuugaggucu

SEQ ID NO: 216963 - RNA, 22 nt, Human
cuguggcuaggaagcuguggga

SEQ ID NO: 216964 - RNA, 22 nt, Human
cugugcuugcugugcuggggcc

SEQ ID NO: 216965 - RNA, 22 nt, Human
cucuuuucaaaccuguuuaugg

SEQ ID NO: 216966 - RNA, 22 nt, Human
cugugguuucuaugggccuuga

SEQ ID NO: 216967 - RNA, 22 nt, Human
cucugcuagaaggucaaucucu

SEQ ID NO: 216968 - RNA, 22 nt, Human
cucugcguggcugggcccaggg

SEQ ID NO: 216969 - RNA, 22 nt, Human
cucucuguuaugcuuucaugaa

SEQ ID NO: 216970 - RNA, 22 nt, Human
cucucugcugucuuucgggaaa

SEQ ID NO: 216971 - RNA, 22 nt, Human
cucucuccuuagcugcagacca

SEQ ID NO: 216972 - RNA, 20 nt, Human
cucugggaggcuugucaccu

SEQ ID NO: 216973 - RNA, 19 nt, Human
cucuggcuccugggcugcc

SEQ ID NO: 216974 - RNA, 22 nt, Human
cucugcuuagacaggcuuuaag

SEQ ID NO: 216975 - RNA, 22 nt, Human
caggguaagagagagugacauu

SEQ ID NO: 216976 - RNA, 22 nt, Human
cagggggacuuguuagguuuua

SEQ ID NO: 216977 - RNA, 19 nt, Human
caggggcuuaugcgaccuc

SEQ ID NO: 216978 - RNA, 22 nt, Human
cagguaguuagaaugaccagga

SEQ ID NO: 216979 - RNA, 22 nt, Human
caggaaaauaauggugauggga

SEQ ID NO: 216980 - RNA, 22 nt, Human
cagcuuuugcagacuucuugcc

SEQ ID NO: 216981 - RNA, 22 nt, Human
cagggcuuuuuccuccucuuug

SEQ ID NO: 216982 - RNA, 22 nt, Human
cagcuuauggcuucuccaguag

SEQ ID NO: 216983 - RNA, 22 nt, Human
caggggcuccaggugagccugg

SEQ ID NO: 216984 - RNA, 22 nt, Human
cagggccaggccucaggggcgc

SEQ ID NO: 216985 - RNA, 22 nt, Human
cagggcaucucugaaucuucac

SEQ ID NO: 216986 - RNA, 22 nt, Human
cagggcagaguuaagaugcugg

SEQ ID NO: 216987 - RNA, 22 nt, Human
cagcuccagcccaggcagcucc

SEQ ID NO: 216988 - RNA, 22 nt, Human
cagcuauuguucuguauaauga

SEQ ID NO: 216989 - RNA, 22 nt, Human
cagcuauggaauuggcccagau

SEQ ID NO: 216990 - RNA, 22 nt, Human
caggaagucugaauucugagag

SEQ ID NO: 216991 - RNA, 22 nt, Human
caggagagucucugucuguacu

SEQ ID NO: 216992 - RNA, 21 nt, Human
caggccaaaagguucaacauu

SEQ ID NO: 216993 - RNA, 22 nt, Human
caggcacagcuaagacuggcca

SEQ ID NO: 216994 - RNA, 22 nt, Human
caggcagagagggcagugugga

SEQ ID NO: 216995 - RNA, 22 nt, Human
caggcaggagaaaaggcgcggg

SEQ ID NO: 216996 - RNA, 22 nt, Human
cagcuguacgugaucuacaugg

SEQ ID NO: 216997 - RNA, 22 nt, Human
cagcuucaugacaaacaguuuu

SEQ ID NO: 216998 - RNA, 22 nt, Human
cagcuugcccugauguggaaga

SEQ ID NO: 216999 - RNA, 22 nt, Human
cagcccaggcucagauguuggg

SEQ ID NO: 217000 - RNA, 22 nt, Human
cagcauugagcacagaaggaaa

SEQ ID NO: 217001 - RNA, 22 nt, Human
cagcuucuccauucuucuggcu

SEQ ID NO: 217002 - RNA, 22 nt, Human
cagcccuugcgacacccuggcu

SEQ ID NO: 217003 - RNA, 22 nt, Human
cagccuacaucagaauaccaau

SEQ ID NO: 217004 - RNA, 22 nt, Human
cagccgcucaugggcccggagc

SEQ ID NO: 217005 - RNA, 22 nt, Human
cagaugccauagguauaguaua

SEQ ID NO: 217006 - RNA, 22 nt, Human
cagaucacucugggcggcggga

SEQ ID NO: 217007 - RNA, 22 nt, Human
cagauuuagcacugauaggacu

SEQ ID NO: 217008 - RNA, 22 nt, Human
cagauuuaauaaaaaaugcauc

SEQ ID NO: 217009 - RNA, 22 nt, Human
cagauggaguuaguuucuaaca

SEQ ID NO: 217010 - RNA, 19 nt, Human
cagcaaacacuguaaaugg

SEQ ID NO: 217011 - RNA, 22 nt, Human
cagcagaggagguggcagcacc

SEQ ID NO: 217012 - RNA, 21 nt, Human
cagcagaaaugagaggagaaa

SEQ ID NO: 217013 - RNA, 22 nt, Human
cagcagaugacuauuggagcug

SEQ ID NO: 217014 - RNA, 21 nt, Human
cagcagaugccagggucucug

SEQ ID NO: 217015 - RNA, 22 nt, Human
cagcuguauuucucugguuaga

SEQ ID NO: 217016 - RNA, 22 nt, Human
cagcuggggagagacauggcag

SEQ ID NO: 217017 - RNA, 22 nt, Human
cagcuggaggagcagcuuccag

SEQ ID NO: 217018 - RNA, 22 nt, Human
cagcagccuccccggccgaccu

SEQ ID NO: 217019 - RNA, 22 nt, Human
cagaaacacuguauuuagggaa

SEQ ID NO: 217020 - RNA, 22 nt, Human
cagaaaacauuguguguauaag

SEQ ID NO: 217021 - RNA, 22 nt, Human
cagacagagucuucccaucagu

SEQ ID NO: 217022 - RNA, 22 nt, Human
cagcauggagacaaagugggca

SEQ ID NO: 217023 - RNA, 22 nt, Human
cagcaugcaaguccagaugugg

SEQ ID NO: 217024 - RNA, 22 nt, Human
cagcaugguggagcugcucuuu

SEQ ID NO: 217025 - RNA, 22 nt, Human
cagacugagaaagugccacagg

SEQ ID NO: 217026 - RNA, 23 nt, Human
cagagaaaauagaauaugcugug

SEQ ID NO: 217027 - RNA, 22 nt, Human
cagacugugagcuccuugaggg

SEQ ID NO: 217028 - RNA, 19 nt, Human
cagagacuguaacacuuuu

SEQ ID NO: 217029 - RNA, 22 nt, Human
cagcucugcugggaggaugcag

SEQ ID NO: 217030 - RNA, 22 nt, Human
cagcucuccacccuccugguuc

SEQ ID NO: 217031 - RNA, 22 nt, Human
cagaguccugcaccagcuccag

SEQ ID NO: 217032 - RNA, 22 nt, Human
cagauaagcuauaaguaguacc

SEQ ID NO: 217033 - RNA, 22 nt, Human
cagaguaaugugauuuccaugu

SEQ ID NO: 217034 - RNA, 22 nt, Human
cagagguagaaguagauguuug

SEQ ID NO: 217035 - RNA, 22 nt, Human
cagauagccugguccuaacaug

SEQ ID NO: 217036 - RNA, 22 nt, Human
cagaggauggaaaugagaacaa

SEQ ID NO: 217037 - RNA, 22 nt, Human
cagaggaugucuacaccuugag

SEQ ID NO: 217038 - RNA, 22 nt, Human
cagagggagcuaaccagcagcc

SEQ ID NO: 217039 - RNA, 20 nt, Human
cagagccaggguuuuguuuu

SEQ ID NO: 217040 - RNA, 22 nt, Human
cagagcugagucuucaagguug

SEQ ID NO: 217041 - RNA, 22 nt, Human
cacaacaaaaaauaaguaugag

SEQ ID NO: 217042 - RNA, 22 nt, Human
cacaaggagaaauagauauuga

SEQ ID NO: 217043 - RNA, 22 nt, Human
caauugcuuccuucuguaagua

SEQ ID NO: 217044 - RNA, 22 nt, Human
cacaaagugucaggggagagaa

SEQ ID NO: 217045 - RNA, 22 nt, Human
caguaucucuaaaauuacucuu

SEQ ID NO: 217046 - RNA, 22 nt, Human
caguaaccaguaguuuuggaaa

SEQ ID NO: 217047 - RNA, 22 nt, Human
caggguuuuauuuggcuuuaaa

SEQ ID NO: 217048 - RNA, 22 nt, Human
cagguauaugugugucuaauac

SEQ ID NO: 217049 - RNA, 22 nt, Human
caggucauaacuaugcaugaac

SEQ ID NO: 217050 - RNA, 22 nt, Human
caguaugagcacagugccugga

SEQ ID NO: 217051 - RNA, 22 nt, Human
caggcagggcugccuucugcuu

SEQ ID NO: 217052 - RNA, 22 nt, Human
caggcagggagcuggaaaggau

SEQ ID NO: 217053 - RNA, 22 nt, Human
caggccagcuggaggggcagcu

SEQ ID NO: 217054 - RNA, 22 nt, Human
caggggaagccagcugccaugu

SEQ ID NO: 217055 - RNA, 22 nt, Human
cagggcuugaaucaaggaaguc

SEQ ID NO: 217056 - RNA, 22 nt, Human
caguuuuggaagaaacaaggaa

SEQ ID NO: 217057 - RNA, 22 nt, Human
caguuuuauacacugcagcucc

SEQ ID NO: 217058 - RNA, 22 nt, Human
cagggcacaguuauggaggugg

SEQ ID NO: 217059 - RNA, 22 nt, Human
cagggagguuggauuggggccu

SEQ ID NO: 217060 - RNA, 22 nt, Human
cagggagcggggagaucucggg

SEQ ID NO: 217061 - RNA, 22 nt, Human
cagugcuggaggggugcuugca

SEQ ID NO: 217062 - RNA, 22 nt, Human
caggccgccacugcagcagcug

SEQ ID NO: 217063 - RNA, 20 nt, Human
caggccuucaggauggcugg

SEQ ID NO: 217064 - RNA, 22 nt, Human
caguauguuuauuagaacugca

SEQ ID NO: 217065 - RNA, 22 nt, Human
caguaucucccauucacagugu

SEQ ID NO: 217066 - RNA, 22 nt, Human
caucccaacaggugaucuggua

SEQ ID NO: 217067 - RNA, 22 nt, Human
caucgagaauuggcagcuaaag

SEQ ID NO: 217068 - RNA, 21 nt, Human
caguagcgcgacaugguuagc

SEQ ID NO: 217069 - RNA, 22 nt, Human
caguaguucucauaacucauga

SEQ ID NO: 217070 - RNA, 22 nt, Human
caguacugucuuccugauggca

SEQ ID NO: 217071 - RNA, 22 nt, Human
cagguuguugacugcauauagg

SEQ ID NO: 217072 - RNA, 23 nt, Human
cauauucagaaacaccuaguggu

SEQ ID NO: 217073 - RNA, 22 nt, Human
cauaauuggugcuuauuaaaug

SEQ ID NO: 217074 - RNA, 22 nt, Human
cagggggcagcguagaaaauga

SEQ ID NO: 217075 - RNA, 22 nt, Human
cauacauguuagcaguagccuu

SEQ ID NO: 217076 - RNA, 22 nt, Human
cagguauuugaaggcaguggga

SEQ ID NO: 217077 - RNA, 22 nt, Human
cagguuguucugggcauggagg

SEQ ID NO: 217078 - RNA, 22 nt, Human
cagguugucuaauuccaagggg

SEQ ID NO: 217079 - RNA, 22 nt, Human
caggucagcacuuggaggugca

SEQ ID NO: 217080 - RNA, 19 nt, Human
caggucuucuuggaggacu

SEQ ID NO: 217081 - RNA, 22 nt, Human
cauguauguuaguggcugcuuu

SEQ ID NO: 217082 - RNA, 22 nt, Human
caugggaauaaaguuauuucaa

SEQ ID NO: 217083 - RNA, 22 nt, Human
caugguaaucggggccaucugu

SEQ ID NO: 217084 - RNA, 22 nt, Human
caugggcucuucuggacugcac

SEQ ID NO: 217085 - RNA, 22 nt, Human
cauaccuugguaagagugauca

SEQ ID NO: 217086 - RNA, 22 nt, Human
cauaaucaagggguugugaugu

SEQ ID NO: 217087 - RNA, 22 nt, Human
cauaacuugguguuggaaacug

SEQ ID NO: 217088 - RNA, 22 nt, Human
cauggcaggugcagauucugug

SEQ ID NO: 217089 - RNA, 22 nt, Human
cauaaauuuuaccuuguaagug

SEQ ID NO: 217090 - RNA, 22 nt, Human
cauaagaauauuuaguggcagc

SEQ ID NO: 217091 - RNA, 22 nt, Human
cauggcacagaagaugucguuu

SEQ ID NO: 217092 - RNA, 22 nt, Human
caugccaguagccggcuugacu

SEQ ID NO: 217093 - RNA, 22 nt, Human
caugcgucugcauuggguggug

SEQ ID NO: 217094 - RNA, 22 nt, Human
caugcagcagaauaaugacuau

SEQ ID NO: 217095 - RNA, 22 nt, Human
caugcagauugccaggcucccu

SEQ ID NO: 217096 - RNA, 22 nt, Human
caguugcagagugauguguuug

SEQ ID NO: 217097 - RNA, 22 nt, Human
caguggaugucucauaguguga

SEQ ID NO: 217098 - RNA, 17 nt, Human
cagugcuguuuuagaaa

SEQ ID NO: 217099 - RNA, 22 nt, Human
caguuaaugauaggaauucggu

SEQ ID NO: 217100 - RNA, 22 nt, Human
caugauaacacuucuguuuaau

SEQ ID NO: 217101 - RNA, 22 nt, Human
caugaugaacugugcuguuagg

SEQ ID NO: 217102 - RNA, 22 nt, Human
caugauguuaucaagcacaaag

SEQ ID NO: 217103 - RNA, 22 nt, Human
caugauucccacauugcgauca

SEQ ID NO: 217104 - RNA, 22 nt, Human
caugaacucucggguuuggaau

SEQ ID NO: 217105 - RNA, 22 nt, Human
caugaagugaaaagguuaauuu

SEQ ID NO: 217106 - RNA, 22 nt, Human
caugaauaauucuuuuucuugg

SEQ ID NO: 217107 - RNA, 22 nt, Human
caucuuuguuuuggauauaauc

SEQ ID NO: 217108 - RNA, 22 nt, Human
caucugcagccucugcauuccc

SEQ ID NO: 217109 - RNA, 22 nt, Human
cagucaaauuugaaaacuuuga

SEQ ID NO: 217110 - RNA, 22 nt, Human
cagugcaacguugugcauucaa

SEQ ID NO: 217111 - RNA, 22 nt, Human
cagugccggccaggaccuccug

SEQ ID NO: 217112 - RNA, 22 nt, Human
auuucauuuuagaaauaagugu

SEQ ID NO: 217113 - RNA, 17 nt, Human
auuuccgaguuucuuuc

SEQ ID NO: 217114 - RNA, 22 nt, Human
auuguuuugugaaacauaguga

SEQ ID NO: 217115 - RNA, 22 nt, Human
auuucaguuugcaguuucucuc

SEQ ID NO: 217116 - RNA, 22 nt, Human
auuuauuuucccucaaguaccu

SEQ ID NO: 217117 - RNA, 22 nt, Human
auuucacucuuaauugcuuccu

SEQ ID NO: 217118 - RNA, 22 nt, Human
auuuauuugaagagccauugca

SEQ ID NO: 217119 - RNA, 22 nt, Human
auuuaucugcucuucgcguuga

SEQ ID NO: 217120 - RNA, 22 nt, Human
auuggcugucagcccggauggg

SEQ ID NO: 217121 - RNA, 22 nt, Human
auuucagcagcccauguuugga

SEQ ID NO: 217122 - RNA, 22 nt, Human
auuucagaaugaaaggaaaaau

SEQ ID NO: 217123 - RNA, 23 nt, Human
auuuccuaaaagauaaucauuac

SEQ ID NO: 217124 - RNA, 22 nt, Human
auuugcuuguucaccaguacuu

SEQ ID NO: 217125 - RNA, 22 nt, Human
auuucuguaauucugaggagug

SEQ ID NO: 217126 - RNA, 22 nt, Human
auuucaacagaguuugaaggca

SEQ ID NO: 217127 - RNA, 22 nt, Human
auugaguacuugcugggcucuc

SEQ ID NO: 217128 - RNA, 22 nt, Human
auuuaaaggaagugggugauaa

SEQ ID NO: 217129 - RNA, 22 nt, Human
auuuacugagguaaauaaacug

SEQ ID NO: 217130 - RNA, 22 nt, Human
auuuaaaaacugguacaacagg

SEQ ID NO: 217131 - RNA, 22 nt, Human
auuuaaagaguaauacaaucca

SEQ ID NO: 217132 - RNA, 17 nt, Human
auuguuuuuaauuugca

SEQ ID NO: 217133 - RNA, 22 nt, Human
auugugaaugccugucagucuu

SEQ ID NO: 217134 - RNA, 22 nt, Human
auuguuacuggguuaauuugga

SEQ ID NO: 217135 - RNA, 22 nt, Human
auucuuuauuuucuguacuugc

SEQ ID NO: 217136 - RNA, 22 nt, Human
auuguauugcguuugcgaaugu

SEQ ID NO: 217137 - RNA, 22 nt, Human
auuagugguguauuuggcacua

SEQ ID NO: 217138 - RNA, 22 nt, Human
auuacugaggcaaaguaguuuu

SEQ ID NO: 217139 - RNA, 22 nt, Human
auuagaagagcuuuuuacucuu

SEQ ID NO: 217140 - RNA, 22 nt, Human
auuaauaucaauauauuauaug

SEQ ID NO: 217141 - RNA, 22 nt, Human
auuaauguguaugauauaaauu

SEQ ID NO: 217142 - RNA, 22 nt, Human
auuacagaagauaugcucaaca

SEQ ID NO: 217143 - RNA, 22 nt, Human
auuuuacuaugauaguugagaa

SEQ ID NO: 217144 - RNA, 22 nt, Human
auuugaaaaucuaugaugugca

SEQ ID NO: 217145 - RNA, 22 nt, Human
auuuccacaaauuaagauugca

SEQ ID NO: 217146 - RNA, 21 nt, Human
auuuguggugcaauuguggua

SEQ ID NO: 217147 - RNA, 22 nt, Human
auuuuaccauuaguuuguaaua

SEQ ID NO: 217148 - RNA, 22 nt, Human
auuucagaguagaucguuauuu

SEQ ID NO: 217149 - RNA, 23 nt, Human
auuugcugaucguagaugacuag

SEQ ID NO: 217150 - RNA, 22 nt, Human
auuugcauguuuauuucuuaga

SEQ ID NO: 217151 - RNA, 22 nt, Human
auuuuugugucacaucuaggaa

SEQ ID NO: 217152 - RNA, 22 nt, Human
auuuuugugcuuuauuggggua

SEQ ID NO: 217153 - RNA, 22 nt, Human
auuuggaaacaugcugaccaug

SEQ ID NO: 217154 - RNA, 21 nt, Human
auuuggucaaugucugcguga

SEQ ID NO: 217155 - RNA, 18 nt, Human
auuuguggggguuauaga

SEQ ID NO: 217156 - RNA, 22 nt, Human
auuuuucuuucacauuuucuua

SEQ ID NO: 217157 - RNA, 22 nt, Human
auuuuucucucaugugcaacua

SEQ ID NO: 217158 - RNA, 22 nt, Human
caaagaugccaaaaggaagaca

SEQ ID NO: 217159 - RNA, 22 nt, Human
caaagccuggggagaguaagga

SEQ ID NO: 217160 - RNA, 22 nt, Human
caaagagaugcaccauauuucu

SEQ ID NO: 217161 - RNA, 22 nt, Human
auuuucuugucucuguuguagg

SEQ ID NO: 217162 - RNA, 22 nt, Human
caaagaagagauuuacagagcu

SEQ ID NO: 217163 - RNA, 22 nt, Human
auuuugcaguuuauugccaauc

SEQ ID NO: 217164 - RNA, 22 nt, Human
caaaagcaaagaucuuugauug

SEQ ID NO: 217165 - RNA, 22 nt, Human
caaaacauucagagagcucacu

SEQ ID NO: 217166 - RNA, 22 nt, Human
caaaacccaagugcuauugcaa

SEQ ID NO: 217167 - RNA, 22 nt, Human
auuuuuuuggucauaugagaua

SEQ ID NO: 217168 - RNA, 22 nt, Human
auuuuuuuuccugucucuuuca

SEQ ID NO: 217169 - RNA, 22 nt, Human
caaccaguagcugaguucaaaa

SEQ ID NO: 217170 - RNA, 22 nt, Human
auuuuuuuaggcugucagccgc

SEQ ID NO: 217171 - RNA, 22 nt, Human
caacguggauucuuccaggggc

SEQ ID NO: 217172 - RNA, 22 nt, Human
caaagcuucaucuguuguuuug

SEQ ID NO: 217173 - RNA, 22 nt, Human
caacaaguugauuucacgcugc

SEQ ID NO: 217174 - RNA, 22 nt, Human
caacaagcgcucagagcaaagc

SEQ ID NO: 217175 - RNA, 21 nt, Human
auuuuucagaaggaugugaua

SEQ ID NO: 217176 - RNA, 22 nt, Human
auuuuuauuugccuaugauaua

SEQ ID NO: 217177 - RNA, 22 nt, Human
cacaauuuccauugagcagcag

SEQ ID NO: 217178 - RNA, 22 nt, Human
cacacaccagaaagccugggac

SEQ ID NO: 217179 - RNA, 22 nt, Human
caacuucuauucagucugcagu

SEQ ID NO: 217180 - RNA, 17 nt, Human
caaccaggaaaggaggg

SEQ ID NO: 217181 - RNA, 22 nt, Human
caacauuucaaggucuuuagga

SEQ ID NO: 217182 - RNA, 22 nt, Human
caacacaucaguucagucuuga

SEQ ID NO: 217183 - RNA, 22 nt, Human
caaauguuugguggcauuuugu

SEQ ID NO: 217184 - RNA, 22 nt, Human
caaugggagaugcagaacagcu

SEQ ID NO: 217185 - RNA, 22 nt, Human
caauggaguccucuuccucuuu

SEQ ID NO: 217186 - RNA, 22 nt, Human
caauggguuuucuauagagugc

SEQ ID NO: 217187 - RNA, 22 nt, Human
caaaucagaucagagacaggcu

SEQ ID NO: 217188 - RNA, 22 nt, Human
caaauacaaauacgggcagcuu

SEQ ID NO: 217189 - RNA, 22 nt, Human
caauggagccaagaggaggaaa

SEQ ID NO: 217190 - RNA, 22 nt, Human
caaucuucucuagaguauucua

SEQ ID NO: 217191 - RNA, 22 nt, Human
caaaggagcccuuugccggguu

SEQ ID NO: 217192 - RNA, 22 nt, Human
caaaggaaagagaaaaagucuu

SEQ ID NO: 217193 - RNA, 22 nt, Human
caauaccucuuggugauugggc

SEQ ID NO: 217194 - RNA, 22 nt, Human
caauaauugcuuuccagaguua

SEQ ID NO: 217195 - RNA, 22 nt, Human
caaggucagacagccaggacag

SEQ ID NO: 217196 - RNA, 22 nt, Human
caagguauugaggccagugucc

SEQ ID NO: 217197 - RNA, 22 nt, Human
caaggggagcugguauggaugg

SEQ ID NO: 217198 - RNA, 22 nt, Human
caaggaagguugguugaaggua

SEQ ID NO: 217199 - RNA, 22 nt, Human
caagaaaaaacaugaugagugu

SEQ ID NO: 217200 - RNA, 22 nt, Human
caagaugcaagaccagucaggc

SEQ ID NO: 217201 - RNA, 22 nt, Human
caaagaaccuucgagacagggc

SEQ ID NO: 217202 - RNA, 22 nt, Human
caaggaaaugucagaaaggcaa

SEQ ID NO: 217203 - RNA, 22 nt, Human
caccgaacuuugcaaaugcaau

SEQ ID NO: 217204 - RNA, 22 nt, Human
caauccccaggucccagaacag

SEQ ID NO: 217205 - RNA, 20 nt, Human
caccggguugcugguuucuu

SEQ ID NO: 217206 - RNA, 22 nt, Human
caccugcaaauuccagauuucu

SEQ ID NO: 217207 - RNA, 22 nt, Human
caccuggaggcagcaccgggcu

SEQ ID NO: 217208 - RNA, 22 nt, Human
caauaguaaucaaugcaguuag

SEQ ID NO: 217209 - RNA, 22 nt, Human
caaguugcaugugcuugaaaua

SEQ ID NO: 217210 - RNA, 22 nt, Human
caccaccaguaccaucacacgc

SEQ ID NO: 217211 - RNA, 22 nt, Human
caccaucagacuucugggcagg

SEQ ID NO: 217212 - RNA, 22 nt, Human
caccacuuggcccugagguccu

SEQ ID NO: 217213 - RNA, 22 nt, Human
caccagcgacugugaccagcaa

SEQ ID NO: 217214 - RNA, 22 nt, Human
caaggguguacagauaugagag

SEQ ID NO: 217215 - RNA, 22 nt, Human
caccacauguccgaaauucagc

SEQ ID NO: 217216 - RNA, 22 nt, Human
caagggcagaggcagggccccg

SEQ ID NO: 217217 - RNA, 22 nt, Human
caaggaaaacagaugaucaaca

SEQ ID NO: 217218 - RNA, 22 nt, Human
cacauuuuccagaagaaucaga

SEQ ID NO: 217219 - RNA, 22 nt, Human
cacauuguuuggucagagcaua

SEQ ID NO: 217220 - RNA, 22 nt, Human
caagagcuuuagaaaugcucau

SEQ ID NO: 217221 - RNA, 22 nt, Human
caagagguaugagccgggauga

SEQ ID NO: 217222 - RNA, 22 nt, Human
caagauauguccuguuacuaag

SEQ ID NO: 217223 - RNA, 22 nt, Human
cacagcuggggaagcugaggcc

SEQ ID NO: 217224 - RNA, 22 nt, Human
cacaguuuuaucuuauacugau

SEQ ID NO: 217225 - RNA, 22 nt, Human
caagcgcgccgcuuccuuccgc

SEQ ID NO: 217226 - RNA, 22 nt, Human
cacauuaagcccaagcauagaa

SEQ ID NO: 217227 - RNA, 22 nt, Human
cacaucucagggcuacaggcag

SEQ ID NO: 217228 - RNA, 22 nt, Human
cacagcagcaucauuuaucugg

SEQ ID NO: 217229 - RNA, 22 nt, Human
cacacagcuagugacaggagaa

SEQ ID NO: 217230 - RNA, 18 nt, Human
cacagcauccaaguuaug

SEQ ID NO: 217231 - RNA, 22 nt, Human
caacuucugcuuucuuccuugc

SEQ ID NO: 217232 - RNA, 22 nt, Human
caagaaccuagcgaucagguaa

SEQ ID NO: 217233 - RNA, 22 nt, Human
caagaaguugacagccagguga

SEQ ID NO: 217234 - RNA, 19 nt, Human
caagagcaaagucuuauga

SEQ ID NO: 217235 - RNA, 20 nt, Human
cacagcugacgaguauccaa

SEQ ID NO: 217236 - RNA, 22 nt, Human
caagagcucccagaccugggca

SEQ ID NO: 217237 - RNA, 22 nt, Human
augcugacaacaaagaaggaag

SEQ ID NO: 217238 - RNA, 22 nt, Human
augcucuggucucuucuuuccu

SEQ ID NO: 217239 - RNA, 22 nt, Human
augcuagaaaauuucauauuau

SEQ ID NO: 217240 - RNA, 22 nt, Human
augcuaaucaaacuuucugcag

SEQ ID NO: 217241 - RNA, 22 nt, Human
augcagcggucagaggaacuca

SEQ ID NO: 217242 - RNA, 22 nt, Human
augcagauguagauucugaaau

SEQ ID NO: 217243 - RNA, 22 nt, Human
augcagaaucucuuuccugagg

SEQ ID NO: 217244 - RNA, 22 nt, Human
augcagagacugugggaaagca

SEQ ID NO: 217245 - RNA, 22 nt, Human
augcacuaugaugagcuagucu

SEQ ID NO: 217246 - RNA, 19 nt, Human
augcacgugaaaugcauuu

SEQ ID NO: 217247 - RNA, 22 nt, Human
augccccucucucucccaauca

SEQ ID NO: 217248 - RNA, 22 nt, Human
augcacuacuagaugcaaaagu

SEQ ID NO: 217249 - RNA, 22 nt, Human
augauaucuuguuuuucaugca

SEQ ID NO: 217250 - RNA, 22 nt, Human
augauggagaacaaagaaaauc

SEQ ID NO: 217251 - RNA, 22 nt, Human
augaugaugguuuaacuucagg

SEQ ID NO: 217252 - RNA, 22 nt, Human
augaucacagugucagucauua

SEQ ID NO: 217253 - RNA, 22 nt, Human
augccccuuuauauguuaaguc

SEQ ID NO: 217254 - RNA, 22 nt, Human
augccgggguggcuccagcacc

SEQ ID NO: 217255 - RNA, 19 nt, Human
augcaauguuaucaauaac

SEQ ID NO: 217256 - RNA, 23 nt, Human
augcaacauugccaguaugggca

SEQ ID NO: 217257 - RNA, 22 nt, Human
augcacaagguagauuauuauu

SEQ ID NO: 217258 - RNA, 22 nt, Human
auggagugggaggacaugaagg

SEQ ID NO: 217259 - RNA, 22 nt, Human
auggccugaagcuaaccccccu

SEQ ID NO: 217260 - RNA, 22 nt, Human
augcuuuauuggagacagucau

SEQ ID NO: 217261 - RNA, 22 nt, Human
augcuugcccauguuucugaag

SEQ ID NO: 217262 - RNA, 22 nt, Human
augcuugaaaguuauuucauuu

SEQ ID NO: 217263 - RNA, 22 nt, Human
augcugugccuggaaagcggcu

SEQ ID NO: 217264 - RNA, 22 nt, Human
auggccuuucucaguggugcuu

SEQ ID NO: 217265 - RNA, 22 nt, Human
augcauaucuccuaucuccuca

SEQ ID NO: 217266 - RNA, 22 nt, Human
augcugccuaaagcuacuuaca

SEQ ID NO: 217267 - RNA, 18 nt, Human
augcugacacaaugugga

SEQ ID NO: 217268 - RNA, 22 nt, Human
augcaggcuaagaguaaagacg

SEQ ID NO: 217269 - RNA, 22 nt, Human
augcugcuccuuuucaggcauu

SEQ ID NO: 217270 - RNA, 22 nt, Human
augcugcuuguccauuuauuug

SEQ ID NO: 217271 - RNA, 22 nt, Human
augcuucuguugcuuaggaggu

SEQ ID NO: 217272 - RNA, 22 nt, Human
augccucuugagagccagugcu

SEQ ID NO: 217273 - RNA, 22 nt, Human
augccugcugucaggaacucuu

SEQ ID NO: 217274 - RNA, 21 nt, Human
augcgcgguggagugagcgaa

SEQ ID NO: 217275 - RNA, 22 nt, Human
augccugggcuuuaggguucuc

SEQ ID NO: 217276 - RNA, 22 nt, Human
augcggcugugggggaauggga

SEQ ID NO: 217277 - RNA, 22 nt, Human
augcgcugugcacacucuuaac

SEQ ID NO: 217278 - RNA, 22 nt, Human
augaucaagaauuuuguauucc

SEQ ID NO: 217279 - RNA, 22 nt, Human
augaugauuauucauuuucugu

SEQ ID NO: 217280 - RNA, 20 nt, Human
augaaugcuccccacguuuc

SEQ ID NO: 217281 - RNA, 22 nt, Human
augauuacagcaugauguuuca

SEQ ID NO: 217282 - RNA, 22 nt, Human
augauguuggaauuuuaacuua

SEQ ID NO: 217283 - RNA, 22 nt, Human
augaauuaucugguguuggaaa

SEQ ID NO: 217284 - RNA, 22 nt, Human
augaauuugaacaccagguugg

SEQ ID NO: 217285 - RNA, 22 nt, Human
augacuguuaugaggugggugg

SEQ ID NO: 217286 - RNA, 22 nt, Human
augauuuguuaacagacuuaau

SEQ ID NO: 217287 - RNA, 22 nt, Human
augcacuccucagcuguucugg

SEQ ID NO: 217288 - RNA, 22 nt, Human
augauucuaccaaugccaucuu

SEQ ID NO: 217289 - RNA, 22 nt, Human
augaccauccagaaguccagcu

SEQ ID NO: 217290 - RNA, 14 nt, Human
augauuucugggaa

SEQ ID NO: 217291 - RNA, 19 nt, Human
augagccccaguucguucc

SEQ ID NO: 217292 - RNA, 22 nt, Human
augagaguuagccugcauaguu

SEQ ID NO: 217293 - RNA, 22 nt, Human
aucugucagaccuuggucacag

SEQ ID NO: 217294 - RNA, 20 nt, Human
aucugguggggaauaacuuc

SEQ ID NO: 217295 - RNA, 22 nt, Human
aucugggaaggggaaaaugcug

SEQ ID NO: 217296 - RNA, 22 nt, Human
aucuucaggggcaauggagaua

SEQ ID NO: 217297 - RNA, 22 nt, Human
aucuucaaagcacaucguuugu

SEQ ID NO: 217298 - RNA, 22 nt, Human
augaggaacagcaagaauauuu

SEQ ID NO: 217299 - RNA, 22 nt, Human
augagcucuaaguacaugccca

SEQ ID NO: 217300 - RNA, 22 nt, Human
augagcuaagcagaaagcacac

SEQ ID NO: 217301 - RNA, 22 nt, Human
aucuucuuucaucagccccuca

SEQ ID NO: 217302 - RNA, 22 nt, Human
augagaaauaauuguguacuga

SEQ ID NO: 217303 - RNA, 22 nt, Human
aucucacuucugucauguggca

SEQ ID NO: 217304 - RNA, 22 nt, Human
augaaacucuagcuuucagcac

SEQ ID NO: 217305 - RNA, 22 nt, Human
aucuauguaucucagaagcuag

SEQ ID NO: 217306 - RNA, 22 nt, Human
auccucugcucaugagaaaugu

SEQ ID NO: 217307 - RNA, 22 nt, Human
aucuagucccugcccuugaaga

SEQ ID NO: 217308 - RNA, 22 nt, Human
augaaacuggagcgccuggagg

SEQ ID NO: 217309 - RNA, 22 nt, Human
augaaaacgugugugugugugu

SEQ ID NO: 217310 - RNA, 22 nt, Human
aucugcugcuccuucuucuugc

SEQ ID NO: 217311 - RNA, 23 nt, Human
augaacgcacugagaucauaauu

SEQ ID NO: 217312 - RNA, 22 nt, Human
aucuggaacuucucugcauuga

SEQ ID NO: 217313 - RNA, 22 nt, Human
auuauucuuugggaaaguugaa

SEQ ID NO: 217314 - RNA, 22 nt, Human
auuauucaaggugaggguaaaa

SEQ ID NO: 217315 - RNA, 22 nt, Human
auuauggacuuucuuguuuggg

SEQ ID NO: 217316 - RNA, 20 nt, Human
auuauuucuucugcccaaag

SEQ ID NO: 217317 - RNA, 22 nt, Human
auuauuugcuuaagcuggucuc

SEQ ID NO: 217318 - RNA, 22 nt, Human
auuaagacugcccauguuuuua

SEQ ID NO: 217319 - RNA, 22 nt, Human
auuaaauagcagaagaaagaug

SEQ ID NO: 217320 - RNA, 22 nt, Human
auuaaagcuaguugagauuuaa

SEQ ID NO: 217321 - RNA, 22 nt, Human
auuaaacuaaauuaugaauugg

SEQ ID NO: 217322 - RNA, 22 nt, Human
auuaaaaaugagaguagggauu

SEQ ID NO: 217323 - RNA, 17 nt, Human
auucaugaacauguccu

SEQ ID NO: 217324 - RNA, 22 nt, Human
auuccaccccauccucccaggu

SEQ ID NO: 217325 - RNA, 22 nt, Human
auucaggacucuuccuugaaga

SEQ ID NO: 217326 - RNA, 22 nt, Human
auucaccaucuugauccccucu

SEQ ID NO: 217327 - RNA, 22 nt, Human
auucaaugcacauguuuuggau

SEQ ID NO: 217328 - RNA, 22 nt, Human
auucaguucuaaggucagugcc

SEQ ID NO: 217329 - RNA, 22 nt, Human
auucauauagcgcuuacagccu

SEQ ID NO: 217330 - RNA, 21 nt, Human
auucaaagaagaggaaggccc

SEQ ID NO: 217331 - RNA, 22 nt, Human
auucaagagcccauguuuccug

SEQ ID NO: 217332 - RNA, 22 nt, Human
auuagcaccccuggauguggga

SEQ ID NO: 217333 - RNA, 22 nt, Human
auuagguaguauaaucuuuguu

SEQ ID NO: 217334 - RNA, 22 nt, Human
auuauacauuaggagauugauu

SEQ ID NO: 217335 - RNA, 22 nt, Human
auguuuuauacacauguaucac

SEQ ID NO: 217336 - RNA, 22 nt, Human
auguuuucuugucuggagaagu

SEQ ID NO: 217337 - RNA, 22 nt, Human
auuauaguuuugcccuuaagaa

SEQ ID NO: 217338 - RNA, 22 nt, Human
auuaucugacugaguagucugu

SEQ ID NO: 217339 - RNA, 21 nt, Human
auuauagugacuaaauugaua

SEQ ID NO: 217340 - RNA, 22 nt, Human
auguuuuuugaaaauguauuuu

SEQ ID NO: 217341 - RNA, 22 nt, Human
auuagaaaugacaugugggaau

SEQ ID NO: 217342 - RNA, 22 nt, Human
auuacagauuauaaauuugagc

SEQ ID NO: 217343 - RNA, 20 nt, Human
auuaauuuuuagggcucacc

SEQ ID NO: 217344 - RNA, 22 nt, Human
auuaaguuauuaagcuaaauau

SEQ ID NO: 217345 - RNA, 22 nt, Human
auguuccuuaaugugcuuguag

SEQ ID NO: 217346 - RNA, 22 nt, Human
auguucccaaaaucccuguaga

SEQ ID NO: 217347 - RNA, 19 nt, Human
auguucugaauuacuguaa

SEQ ID NO: 217348 - RNA, 19 nt, Human
auguuuccauuucuggaua

SEQ ID NO: 217349 - RNA, 18 nt, Human
auguuccugcaguuauuu

SEQ ID NO: 217350 - RNA, 22 nt, Human
auguuccaugacuaugcaugaa

SEQ ID NO: 217351 - RNA, 22 nt, Human
auguuagcaucuggcacuaugg

SEQ ID NO: 217352 - RNA, 22 nt, Human
auguaacauaugugaucgcauu

SEQ ID NO: 217353 - RNA, 22 nt, Human
augugccuuaauauaggcgcug

SEQ ID NO: 217354 - RNA, 22 nt, Human
augguugugaaagagcaaagac

SEQ ID NO: 217355 - RNA, 23 nt, Human
augugaggcaaaggcaggcacuc

SEQ ID NO: 217356 - RNA, 22 nt, Human
augugcauguauguaucauauu

SEQ ID NO: 217357 - RNA, 22 nt, Human
auguuccuuuaaaauauagauu

SEQ ID NO: 217358 - RNA, 22 nt, Human
auguucucagguuguauuuauu

SEQ ID NO: 217359 - RNA, 22 nt, Human
auguugagaaucucucuucuaa

SEQ ID NO: 217360 - RNA, 22 nt, Human
augugggugaggaggccauugu

SEQ ID NO: 217361 - RNA, 22 nt, Human
auguggaaagcuugucuuagag

SEQ ID NO: 217362 - RNA, 22 nt, Human
augugaaccuggguccugggcc

SEQ ID NO: 217363 - RNA, 22 nt, Human
auguugaguggaugaacaaaca

SEQ ID NO: 217364 - RNA, 22 nt, Human
auguguuuugaccccugcuaaa

SEQ ID NO: 217365 - RNA, 22 nt, Human
auguuuuaaaaaacaggcuacc

SEQ ID NO: 217366 - RNA, 22 nt, Human
augugucauuauccagaauaac

SEQ ID NO: 217367 - RNA, 22 nt, Human
auguguguaugugugcauguau

SEQ ID NO: 217368 - RNA, 22 nt, Human
auguguguaugacugaaucuau

SEQ ID NO: 217369 - RNA, 22 nt, Human
augcuuucucuucuauuucuca

SEQ ID NO: 217370 - RNA, 22 nt, Human
auggcuucugucuuggaaauuu

SEQ ID NO: 217371 - RNA, 22 nt, Human
auggcuguguuguuccucugaa

SEQ ID NO: 217372 - RNA, 22 nt, Human
auggccuguuuccucugaaaga

SEQ ID NO: 217373 - RNA, 22 nt, Human
auggcaucuucgguuggacugc

SEQ ID NO: 217374 - RNA, 20 nt, Human
auggcgagucagcacaaaac

SEQ ID NO: 217375 - RNA, 18 nt, Human
auggcuccagugucuucc

SEQ ID NO: 217376 - RNA, 22 nt, Human
augguuagauggaugagaugug

SEQ ID NO: 217377 - RNA, 22 nt, Human
auguaaauauuuauauaugcau

SEQ ID NO: 217378 - RNA, 22 nt, Human
auggucugcucagucucuugac

SEQ ID NO: 217379 - RNA, 22 nt, Human
augguuuugugaaaaugcuuug

SEQ ID NO: 217380 - RNA, 22 nt, Human
augguuuuguccucuuugguuc

SEQ ID NO: 217381 - RNA, 22 nt, Human
auguaugagagauucuuuuauu

SEQ ID NO: 217382 - RNA, 22 nt, Human
auguauauauacauguauugua

SEQ ID NO: 217383 - RNA, 22 nt, Human
auguauuuauguauguguuaua

SEQ ID NO: 217384 - RNA, 22 nt, Human
auguauguauguauauacacac

SEQ ID NO: 217385 - RNA, 20 nt, Human
augucaggaagggagucagg

SEQ ID NO: 217386 - RNA, 22 nt, Human
augguugggggaugucagcagg

SEQ ID NO: 217387 - RNA, 22 nt, Human
augguugccugagauaagacug

SEQ ID NO: 217388 - RNA, 22 nt, Human
augugaaagagguguucagugg

SEQ ID NO: 217389 - RNA, 22 nt, Human
augugaaauuugggcucuggga

SEQ ID NO: 217390 - RNA, 22 nt, Human
auauugcuuuauucuugaauau

SEQ ID NO: 217391 - RNA, 22 nt, Human
auauuguagcaucacugucuug

SEQ ID NO: 217392 - RNA, 22 nt, Human
auauuuuacagcucucguugaa

SEQ ID NO: 217393 - RNA, 22 nt, Human
aucaaaauguguagucuugauc

SEQ ID NO: 217394 - RNA, 22 nt, Human
auauuugucuguuuuaguggca

SEQ ID NO: 217395 - RNA, 22 nt, Human
auauuuguacagcuugugaguu

SEQ ID NO: 217396 - RNA, 21 nt, Human
auauuguugggguuuucuuuu

SEQ ID NO: 217397 - RNA, 22 nt, Human
auauuuuugcagaauuuuucgu

SEQ ID NO: 217398 - RNA, 22 nt, Human
aucaauaaccauagugguuaca

SEQ ID NO: 217399 - RNA, 22 nt, Human
aucagagcuaguacuugcaggu

SEQ ID NO: 217400 - RNA, 22 nt, Human
aucaaaauuuucagauacuaca

SEQ ID NO: 217401 - RNA, 22 nt, Human
aucaaacuaugguccaugggca

SEQ ID NO: 217402 - RNA, 22 nt, Human
aucaacucacagugugcuggca

SEQ ID NO: 217403 - RNA, 22 nt, Human
aucaacacuguuggcggggacc

SEQ ID NO: 217404 - RNA, 22 nt, Human
aucaaugggucaaagagaaggu

SEQ ID NO: 217405 - RNA, 22 nt, Human
aucaaguuauuaaguagcuuuc

SEQ ID NO: 217406 - RNA, 22 nt, Human
aucauaugugauaccauaauga

SEQ ID NO: 217407 - RNA, 22 nt, Human
aucagaagaaauggaugugacu

SEQ ID NO: 217408 - RNA, 22 nt, Human
aucacugcaggcauauaggggu

SEQ ID NO: 217409 - RNA, 22 nt, Human
aucacauggauuuuaucuuuug

SEQ ID NO: 217410 - RNA, 22 nt, Human
aucauguauaugcagcguuugu

SEQ ID NO: 217411 - RNA, 22 nt, Human
aucaugcgguuaaggagugugu

SEQ ID NO: 217412 - RNA, 22 nt, Human
aucaugcugacacaguuuaucu

SEQ ID NO: 217413 - RNA, 17 nt, Human
aucagaggauaggacaa

SEQ ID NO: 217414 - RNA, 19 nt, Human
aucagcaguuuugccugga

SEQ ID NO: 217415 - RNA, 22 nt, Human
aucagcucuugaugccuuucuu

SEQ ID NO: 217416 - RNA, 22 nt, Human
aucauguauauuuuugcuauua

SEQ ID NO: 217417 - RNA, 21 nt, Human
aucagaaucucuagauuugga

SEQ ID NO: 217418 - RNA, 22 nt, Human
auccaggguuggggucacgagu

SEQ ID NO: 217419 - RNA, 22 nt, Human
auccaggggucugaauggauau

SEQ ID NO: 217420 - RNA, 22 nt, Human
aucauuuuuauuagcugggguu

SEQ ID NO: 217421 - RNA, 22 nt, Human
auccuucaaaaggaauagcagg

SEQ ID NO: 217422 - RNA, 22 nt, Human
auccuccuggggcagucuuccc

SEQ ID NO: 217423 - RNA, 22 nt, Human
auccucaaggaauuaaauaggg

SEQ ID NO: 217424 - RNA, 22 nt, Human
auccgugagcgagcgagcaccc

SEQ ID NO: 217425 - RNA, 18 nt, Human
auccccagucccuggaau

SEQ ID NO: 217426 - RNA, 22 nt, Human
aucuaaucugccuuccuaaucu

SEQ ID NO: 217427 - RNA, 22 nt, Human
auccuccuuugcccugagauca

SEQ ID NO: 217428 - RNA, 22 nt, Human
auccugauggaaacugguauga

SEQ ID NO: 217429 - RNA, 22 nt, Human
aucguuaugauagagaaagaga

SEQ ID NO: 217430 - RNA, 23 nt, Human
aucgcccggguccagucccggcu

SEQ ID NO: 217431 - RNA, 22 nt, Human
aucgcagaguggaaauugauga

SEQ ID NO: 217432 - RNA, 22 nt, Human
aucuaauguggcaaguugcuga

SEQ ID NO: 217433 - RNA, 22 nt, Human
aucccuggccacgaagcugccc

SEQ ID NO: 217434 - RNA, 22 nt, Human
aucuaaaacuacgaauacuacc

SEQ ID NO: 217435 - RNA, 22 nt, Human
auccagaaguauuuuggguacu

SEQ ID NO: 217436 - RNA, 22 nt, Human
aucauccuagaaggaagcuagg

SEQ ID NO: 217437 - RNA, 22 nt, Human
aucaucccuuucucccagugaa

SEQ ID NO: 217438 - RNA, 22 nt, Human
auccacccugcaggccaacucu

SEQ ID NO: 217439 - RNA, 22 nt, Human
aucauugcuaguaaggaucuug

SEQ ID NO: 217440 - RNA, 22 nt, Human
aucauaccaguuuccaucagga

SEQ ID NO: 217441 - RNA, 22 nt, Human
aucagugcacgcgaugggcaga

SEQ ID NO: 217442 - RNA, 19 nt, Human
auccucucuagaaguggga

SEQ ID NO: 217443 - RNA, 22 nt, Human
aucaugugacuagguuuggcca

SEQ ID NO: 217444 - RNA, 20 nt, Human
aucaugugcacugcugacag

SEQ ID NO: 217445 - RNA, 22 nt, Human
aucauuaacagugcagggguag

SEQ ID NO: 217446 - RNA, 22 nt, Human
aucauugaaaauuuaugcauuu

SEQ ID NO: 217447 - RNA, 22 nt, Human
aucauuugaacagaauuuguuu

SEQ ID NO: 217448 - RNA, 21 nt, Human
auauugguaucuuuuuaaauc

SEQ ID NO: 217449 - RNA, 22 nt, Human
auauuauuaaaauagauggaua

SEQ ID NO: 217450 - RNA, 22 nt, Human
auauucaaugaggucauauaag

SEQ ID NO: 217451 - RNA, 22 nt, Human
auauguuaugccauuuucaagg

SEQ ID NO: 217452 - RNA, 22 nt, Human
auauauguauauacacauauau

SEQ ID NO: 217453 - RNA, 22 nt, Human
auauauguauauaugugugugu

SEQ ID NO: 217454 - RNA, 22 nt, Human
auauaguuggguuucauucuac

SEQ ID NO: 217455 - RNA, 22 nt, Human
auauaguacauguauauauaua

SEQ ID NO: 217456 - RNA, 22 nt, Human
auauaaugcaguaggugauuaa

SEQ ID NO: 217457 - RNA, 22 nt, Human
auauuugcccccaugcccuggc

SEQ ID NO: 217458 - RNA, 22 nt, Human
auauuuguuagcugcuuuggag

SEQ ID NO: 217459 - RNA, 22 nt, Human
auauuuguuuggcagaguucag

SEQ ID NO: 217460 - RNA, 22 nt, Human
auauuucuacaggcugauuuua

SEQ ID NO: 217461 - RNA, 22 nt, Human
auauguaguuucagaaguggaa

SEQ ID NO: 217462 - RNA, 23 nt, Human
auaugucaugcaccagcacuuua

SEQ ID NO: 217463 - RNA, 22 nt, Human
auaugagaggaggagcaucagu

SEQ ID NO: 217464 - RNA, 21 nt, Human
auauggauauuauuuuguguc

SEQ ID NO: 217465 - RNA, 22 nt, Human
auauggugauuuuaugcaggaa

SEQ ID NO: 217466 - RNA, 22 nt, Human
auaugcacauguacauguauau

SEQ ID NO: 217467 - RNA, 22 nt, Human
auaugaagaaugaucugaagua

SEQ ID NO: 217468 - RNA, 22 nt, Human
auauaacccaaggcaggcugug

SEQ ID NO: 217469 - RNA, 22 nt, Human
auagauuuuaucagauuuuauc

SEQ ID NO: 217470 - RNA, 22 nt, Human
auagauagaagggacguggugc

SEQ ID NO: 217471 - RNA, 22 nt, Human
auauaugcaacaagaaagcaua

SEQ ID NO: 217472 - RNA, 22 nt, Human
auauaaugugugcuuuauugaa

SEQ ID NO: 217473 - RNA, 22 nt, Human
auauccugguucuaucaaaagg

SEQ ID NO: 217474 - RNA, 22 nt, Human
auaggacuguacagaauacaag

SEQ ID NO: 217475 - RNA, 22 nt, Human
auaggcggagccauaucaucca

SEQ ID NO: 217476 - RNA, 22 nt, Human
auaggaguuauggaaugagccc

SEQ ID NO: 217477 - RNA, 22 nt, Human
auaggaguauaaggcaguaacu

SEQ ID NO: 217478 - RNA, 22 nt, Human
auaggcauaacacugauguccu

SEQ ID NO: 217479 - RNA, 22 nt, Human
auaguguguaaagugcagugau

SEQ ID NO: 217480 - RNA, 23 nt, Human
auagucuuaaaccagacuucacc

SEQ ID NO: 217481 - RNA, 22 nt, Human
auaugcagaaaauaaaggaauu

SEQ ID NO: 217482 - RNA, 22 nt, Human
auaucuuguuuuugauuucuug

SEQ ID NO: 217483 - RNA, 22 nt, Human
auaguuuuagauacugagaaaa

SEQ ID NO: 217484 - RNA, 22 nt, Human
auaucugaugacgugacuaugu

SEQ ID NO: 217485 - RNA, 20 nt, Human
auagaguggugugucacauu

SEQ ID NO: 217486 - RNA, 22 nt, Human
auauaagauaauaacuuuuuua

SEQ ID NO: 217487 - RNA, 22 nt, Human
auaguugcugucauuauuugag

SEQ ID NO: 217488 - RNA, 23 nt, Human
auagucaggaacuguuggugugu

SEQ ID NO: 217489 - RNA, 22 nt, Human
auagaagugaaaagggaugacu

SEQ ID NO: 217490 - RNA, 22 nt, Human
auagagcuggggaagaagcugg

SEQ ID NO: 217491 - RNA, 22 nt, Human
auagagaggaacagcaagaacu

SEQ ID NO: 217492 - RNA, 22 nt, Human
auagacacagcuaugauuugag

SEQ ID NO: 217493 - RNA, 22 nt, Human
auaguaaauguuaacagcaaca

SEQ ID NO: 217494 - RNA, 22 nt, Human
auagcaguauuaugagauaacu

SEQ ID NO: 217495 - RNA, 22 nt, Human
auagcaacucugcuuccuugcc

SEQ ID NO: 217496 - RNA, 22 nt, Human
auagcacuuaauaugaaacagu

SEQ ID NO: 217497 - RNA, 22 nt, Human
auaccuauagcagacugagacu

SEQ ID NO: 217498 - RNA, 22 nt, Human
auacuacaucacagccaagaag

SEQ ID NO: 217499 - RNA, 22 nt, Human
auagaaauagacaaugcaaaga

SEQ ID NO: 217500 - RNA, 22 nt, Human
auacuucaccuaacccaguuuc

SEQ ID NO: 217501 - RNA, 22 nt, Human
auacuuccugcuucccugaucu

SEQ ID NO: 217502 - RNA, 22 nt, Human
auacauauaugcacauuaauau

SEQ ID NO: 217503 - RNA, 22 nt, Human
auagaguguguguuauguguga

SEQ ID NO: 217504 - RNA, 22 nt, Human
auacaugugugugcauacaugu

SEQ ID NO: 217505 - RNA, 22 nt, Human
auagaugaggaaauucaggugc

SEQ ID NO: 217506 - RNA, 22 nt, Human
auagauguauucauuguuuggc

SEQ ID NO: 217507 - RNA, 22 nt, Human
auagaugacaguuaggaagcug

SEQ ID NO: 217508 - RNA, 22 nt, Human
agugaaagaaaacuguuagaac

SEQ ID NO: 217509 - RNA, 22 nt, Human
agugaaaacugaaucaccuucc

SEQ ID NO: 217510 - RNA, 22 nt, Human
agugaauuagccuauuuguaaa

SEQ ID NO: 217511 - RNA, 22 nt, Human
agugagcauuagugcuuauauu

SEQ ID NO: 217512 - RNA, 21 nt, Human
agugagugacagaagaagguu

SEQ ID NO: 217513 - RNA, 23 nt, Human
auacuuuuuuucuacguuaucuc

SEQ ID NO: 217514 - RNA, 22 nt, Human
auagaauggcaccagcaucuac

SEQ ID NO: 217515 - RNA, 20 nt, Human
auacuuguuuucaggcuuuu

SEQ ID NO: 217516 - RNA, 18 nt, Human
auagacaggaaaaaugga

SEQ ID NO: 217517 - RNA, 22 nt, Human
uuuuuuuuacuccggacagcuc

SEQ ID NO: 217518 - RNA, 22 nt, Human
uuuuuuuguagguguaugaaaa

SEQ ID NO: 217519 - RNA, 22 nt, Human
uuuuuuaaucaaguaggaaaca

SEQ ID NO: 217520 - RNA, 22 nt, Human
uuuuuguggggggcggugugaa

SEQ ID NO: 217521 - RNA, 22 nt, Human
uuuuuguuauuuagguguagag

SEQ ID NO: 217522 - RNA, 22 nt, Human
uuuuuuccagcuucuagaggcc

SEQ ID NO: 217523 - RNA, 22 nt, Human
uuuuuucuucucuaucuuaaua

SEQ ID NO: 217524 - RNA, 22 nt, Human
uuuuuucuggaguuugggguuu

SEQ ID NO: 217525 - RNA, 22 nt, Human
uuuuuuuaaguuuugauuuuag

SEQ ID NO: 217526 - RNA, 18 nt, Human
uuuuuuguucuguuuugu

SEQ ID NO: 217527 - RNA, 22 nt, Human
uuuuuuguggcuggaagaaaaa

SEQ ID NO: 217528 - RNA, 22 nt, Human
uuuuucugccucucucccacau

SEQ ID NO: 217529 - RNA, 19 nt, Human
uuuuucccccucuccucag

SEQ ID NO: 217530 - RNA, 22 nt, Human
uuuuucuuugguaacucuuccu

SEQ ID NO: 217531 - RNA, 22 nt, Human
uuuuucuccauuccaggugccu

SEQ ID NO: 217532 - RNA, 22 nt, Human
uuuuucugacugcuaacaaaaa

SEQ ID NO: 217533 - RNA, 22 nt, Human
uuuuucuccucucucuuucauu

SEQ ID NO: 217534 - RNA, 22 nt, Human
uuuuugcuuuuuugucaucuaa

SEQ ID NO: 217535 - RNA, 22 nt, Human
uuuuugggaagaauucugauau

SEQ ID NO: 217536 - RNA, 22 nt, Human
uuuuuguauaugcuucgaggau

SEQ ID NO: 217537 - RNA, 22 nt, Human
uuuuuaaaagaugauuuaauga

SEQ ID NO: 217538 - RNA, 22 nt, Human
uuuuuaaaauuaggacggcacg

SEQ ID NO: 217539 - RNA, 22 nt, Human
uuuuuaagguuuguuuauauau

SEQ ID NO: 217540 - RNA, 22 nt, Human
uuuuuaauuuuaagcuauuugu

SEQ ID NO: 217541 - RNA, 22 nt, Human
uuuuuagcauaugucaaaucag

SEQ ID NO: 217542 - RNA, 22 nt, Human
uuuuuaccugguguccagcuuc

SEQ ID NO: 217543 - RNA, 22 nt, Human
uuuuuagcuguuauuguggaag

SEQ ID NO: 217544 - RNA, 22 nt, Human
uuuuuauaagauuuaaaaugua

SEQ ID NO: 217545 - RNA, 22 nt, Human
uuuuucacacuccuuuccaguu

SEQ ID NO: 217546 - RNA, 20 nt, Human
uuuuguccaccugcaggaag

SEQ ID NO: 217547 - RNA, 22 nt, Human
uuuugcuucuaguauauuuuuu

SEQ ID NO: 217548 - RNA, 22 nt, Human
uuuugguuugaguauuuuuuuu

SEQ ID NO: 217549 - RNA, 22 nt, Human
uuuuccuuagaaauacauugau

SEQ ID NO: 217550 - RNA, 22 nt, Human
uuuuccuguccuugggucugca

SEQ ID NO: 217551 - RNA, 22 nt, Human
uuuucauagccagaaacugaaa

SEQ ID NO: 217552 - RNA, 22 nt, Human
uuuuccccuacuaacacugagu

SEQ ID NO: 217553 - RNA, 22 nt, Human
uuuucuaggcccuggauuaugu

SEQ ID NO: 217554 - RNA, 22 nt, Human
uuuucucaguuuuuuucaaaag

SEQ ID NO: 217555 - RNA, 22 nt, Human
uuuucggagaauguuaaugugu

SEQ ID NO: 217556 - RNA, 22 nt, Human
uuuuccuugagucggggcacag

SEQ ID NO: 217557 - RNA, 22 nt, Human
uuuucuguuuaugaaauugugu

SEQ ID NO: 217558 - RNA, 22 nt, Human
uuuucucucacuucacauauuu

SEQ ID NO: 217559 - RNA, 22 nt, Human
uuuucuugagucacuccaguga

SEQ ID NO: 217560 - RNA, 22 nt, Human
uuuucuucucauucugaccuca

SEQ ID NO: 217561 - RNA, 22 nt, Human
uuuucugauccuucuaacuuga

SEQ ID NO: 217562 - RNA, 22 nt, Human
uuuucuucggugcuggguugau

SEQ ID NO: 217563 - RNA, 22 nt, Human
uuuugcuagaaaucaccaauac

SEQ ID NO: 217564 - RNA, 22 nt, Human
uuuugaauaauucagaaacagc

SEQ ID NO: 217565 - RNA, 22 nt, Human
uuuucuuggaguggcuguccuu

SEQ ID NO: 217566 - RNA, 22 nt, Human
uuuugauacaaguuguaaaaaa

SEQ ID NO: 217567 - RNA, 22 nt, Human
uuuuacgucuuugcugccucgu

SEQ ID NO: 217568 - RNA, 22 nt, Human
uuuuagaagcauuuaugagauu

SEQ ID NO: 217569 - RNA, 22 nt, Human
uuuuaggauuugaguugcugga

SEQ ID NO: 217570 - RNA, 22 nt, Human
uuuuauaauacccuugacuaau

SEQ ID NO: 217571 - RNA, 22 nt, Human
uuuuauaaaaccuguuugaccu

SEQ ID NO: 217572 - RNA, 22 nt, Human
uuuucacugacuuggucuggaa

SEQ ID NO: 217573 - RNA, 22 nt, Human
uuuucaguuccaucucugcucu

SEQ ID NO: 217574 - RNA, 19 nt, Human
uuuucaacguccgguucau

SEQ ID NO: 217575 - RNA, 22 nt, Human
uuuuauguuccugaagcuaucu

SEQ ID NO: 217576 - RNA, 22 nt, Human
uuuuacauuuuauucguuuauu

SEQ ID NO: 217577 - RNA, 22 nt, Human
uuuuacaaugcaaauucuugcu

SEQ ID NO: 217578 - RNA, 22 nt, Human
uuuuaauccucuugguaucuua

SEQ ID NO: 217579 - RNA, 22 nt, Human
uuuuaauucaacauuugcuuuu

SEQ ID NO: 217580 - RNA, 22 nt, Human
uuuuaaauggcuuuuacuuuuc

SEQ ID NO: 217581 - RNA, 22 nt, Human
uuuuaacuuuaccauuucuuca

SEQ ID NO: 217582 - RNA, 22 nt, Human
uuuuaauaguauaucuagacac

SEQ ID NO: 217583 - RNA, 22 nt, Human
uuuuaaguauuuucuuuuuuua

SEQ ID NO: 217584 - RNA, 22 nt, Human
uuuuaaaagguugcuguuauaa

SEQ ID NO: 217585 - RNA, 22 nt, Human
uuuguguuuugaggucuugcaa

SEQ ID NO: 217586 - RNA, 22 nt, Human
uuuguguuuucaggcacauggc

SEQ ID NO: 217587 - RNA, 22 nt, Human
uuuguuaugguuggaagcagga

SEQ ID NO: 217588 - RNA, 22 nt, Human
uuuguuaggguuucagcuagcc

SEQ ID NO: 217589 - RNA, 22 nt, Human
uuuacuuuugguaaggucauuu

SEQ ID NO: 217590 - RNA, 22 nt, Human
uuuaaugucuuuggccuuuaau

SEQ ID NO: 217591 - RNA, 22 nt, Human
uuuguugucuucauaauacuuu

SEQ ID NO: 217592 - RNA, 22 nt, Human
uuuuaaaacaugucaaaaugug

SEQ ID NO: 217593 - RNA, 22 nt, Human
uuuguuugcuaguauuuuguuu

SEQ ID NO: 217594 - RNA, 19 nt, Human
uuuguuguaucagagcuuu

SEQ ID NO: 217595 - RNA, 22 nt, Human
uuuguugaauggcaggauuuua

SEQ ID NO: 217596 - RNA, 22 nt, Human
uuuguucaccuagcaaacuuuu

SEQ ID NO: 217597 - RNA, 22 nt, Human
uuuguucuucucaugcacacaa

SEQ ID NO: 217598 - RNA, 22 nt, Human
uuuuucagacuaauagggcaua

SEQ ID NO: 217599 - RNA, 22 nt, Human
uuuuuauguaaaauauuaaaag

SEQ ID NO: 217600 - RNA, 22 nt, Human
uugaaaaaugcccagcagacaa

SEQ ID NO: 217601 - RNA, 21 nt, Human
uuuuucuccagaguuuccacu

SEQ ID NO: 217602 - RNA, 22 nt, Human
uuuuuauaagagcagcagaguu

SEQ ID NO: 217603 - RNA, 22 nt, Human
uucuugagaacaaauuccugga

SEQ ID NO: 217604 - RNA, 22 nt, Human
uuuuguuuacauuaaauuuuga

SEQ ID NO: 217605 - RNA, 22 nt, Human
uuuuguuacugauuauuaaaau

SEQ ID NO: 217606 - RNA, 21 nt, Human
uuuuguguugcgcacuuugag

SEQ ID NO: 217607 - RNA, 18 nt, Human
uuuuguguuuauucugca

SEQ ID NO: 217608 - RNA, 22 nt, Human
uuuuguggacugugagggugca

SEQ ID NO: 217609 - RNA, 22 nt, Human
uucuuaaugcauccuguguuca

SEQ ID NO: 217610 - RNA, 22 nt, Human
uucuuacuaaguagaguacuca

SEQ ID NO: 217611 - RNA, 22 nt, Human
uuuuguagauuggaaaaucugg

SEQ ID NO: 217612 - RNA, 22 nt, Human
uuuugucagggcaggaggaaga

SEQ ID NO: 217613 - RNA, 22 nt, Human
uuuuguagauagggaaacagag

SEQ ID NO: 217614 - RNA, 19 nt, Human
uucuguggucccaggccuu

SEQ ID NO: 217615 - RNA, 22 nt, Human
uucuguucuuuguccccuuggu

SEQ ID NO: 217616 - RNA, 22 nt, Human
uucuguucugcuuucuccaucc

SEQ ID NO: 217617 - RNA, 22 nt, Human
uuuuuugguuuggggauuauuu

SEQ ID NO: 217618 - RNA, 22 nt, Human
uugaaucauauguaauugacuu

SEQ ID NO: 217619 - RNA, 22 nt, Human
uuuuuuguuccuugguuuuugu

SEQ ID NO: 217620 - RNA, 22 nt, Human
uuuuuuuagaaagaucauaguu

SEQ ID NO: 217621 - RNA, 22 nt, Human
uugaggaagggaggcaaaacug

SEQ ID NO: 217622 - RNA, 22 nt, Human
uugaggucuguguaggcagcaa

SEQ ID NO: 217623 - RNA, 22 nt, Human
uugaguaaugcaagccuuugua

SEQ ID NO: 217624 - RNA, 22 nt, Human
uugaaaauuaauagguguacaa

SEQ ID NO: 217625 - RNA, 22 nt, Human
uugaaaaguuuguuacucacau

SEQ ID NO: 217626 - RNA, 22 nt, Human
uugaaaacugucaccuuuauuc

SEQ ID NO: 217627 - RNA, 20 nt, Human
uugaaagucagggcuccagu

SEQ ID NO: 217628 - RNA, 22 nt, Human
uugaacucagcuacugguuggu

SEQ ID NO: 217629 - RNA, 22 nt, Human
uugaagccaccacuguaaguca

SEQ ID NO: 217630 - RNA, 22 nt, Human
uugaagaagucaaaagcugcag

SEQ ID NO: 217631 - RNA, 22 nt, Human
uuuuuuccuguuugucuuuggg

SEQ ID NO: 217632 - RNA, 22 nt, Human
uucccuuggcuuugauuguguu

SEQ ID NO: 217633 - RNA, 22 nt, Human
uuccuaagugcugguaugaggc

SEQ ID NO: 217634 - RNA, 22 nt, Human
uuuguucuagauaacugguaau

SEQ ID NO: 217635 - RNA, 22 nt, Human
uucuaauauuaugauuucuaag

SEQ ID NO: 217636 - RNA, 22 nt, Human
uuuuagccagcaucugggucga

SEQ ID NO: 217637 - RNA, 20 nt, Human
uucguuucaguguuggauca

SEQ ID NO: 217638 - RNA, 22 nt, Human
uucguucagcgcuugcgcaugc

SEQ ID NO: 217639 - RNA, 22 nt, Human
uucguugaagcaacgacuuugg

SEQ ID NO: 217640 - RNA, 22 nt, Human
uuuucaacuuuauuuuccccca

SEQ ID NO: 217641 - RNA, 22 nt, Human
uuuuauuuguauguugaaugua

SEQ ID NO: 217642 - RNA, 22 nt, Human
uucucaauggcaacuuguugcu

SEQ ID NO: 217643 - RNA, 22 nt, Human
uucuccacguucuucucggccu

SEQ ID NO: 217644 - RNA, 22 nt, Human
uucuccucaaaccaucagacau

SEQ ID NO: 217645 - RNA, 22 nt, Human
uucuccucagcaaggcagcuuu

SEQ ID NO: 217646 - RNA, 22 nt, Human
uucuggagacccagcaacaggg

SEQ ID NO: 217647 - RNA, 22 nt, Human
uuuugaugaccauucuucuuuu

SEQ ID NO: 217648 - RNA, 22 nt, Human
uucugcuuuaaagcucauguuu

SEQ ID NO: 217649 - RNA, 23 nt, Human
uucugcuucccauagcacuuugu

SEQ ID NO: 217650 - RNA, 22 nt, Human
uuuuggauugcuaacucagggu

SEQ ID NO: 217651 - RNA, 22 nt, Human
uuuucaauuuucauuugcaaga

SEQ ID NO: 217652 - RNA, 22 nt, Human
uuuucaaucaaguuuauuuaua

SEQ ID NO: 217653 - RNA, 22 nt, Human
uucugaaacauugcuauuuucc

SEQ ID NO: 217654 - RNA, 22 nt, Human
uucugaaccauugagcacugcc

SEQ ID NO: 217655 - RNA, 22 nt, Human
uuuuccuuaacagagggagaaa

SEQ ID NO: 217656 - RNA, 17 nt, Human
uucugcucaggaacaga

SEQ ID NO: 217657 - RNA, 20 nt, Human
uucugcucuagagucuagaa

SEQ ID NO: 217658 - RNA, 22 nt, Human
uucugcccuugccagacaagua

SEQ ID NO: 217659 - RNA, 22 nt, Human
uucugauacagucccaacacaa

SEQ ID NO: 217660 - RNA, 22 nt, Human
uucugcauaggcuauauuuguu

SEQ ID NO: 217661 - RNA, 22 nt, Human
uugggucaugggaucccagcau

SEQ ID NO: 217662 - RNA, 22 nt, Human
uugggugcugcacccuucaaca

SEQ ID NO: 217663 - RNA, 22 nt, Human
uuggggcugcguauuuccaugu

SEQ ID NO: 217664 - RNA, 22 nt, Human
uuggggcugcguguuuccaugu

SEQ ID NO: 217665 - RNA, 22 nt, Human
uugguauuuguuuaaauuacac

SEQ ID NO: 217666 - RNA, 22 nt, Human
uuggucaagacugauaucaaga

SEQ ID NO: 217667 - RNA, 22 nt, Human
uugguaaccaaucaaaugugag

SEQ ID NO: 217668 - RNA, 22 nt, Human
uuggcaaaaauacuguaggccu

SEQ ID NO: 217669 - RNA, 22 nt, Human
uuggcauuccagaugcuuuucu

SEQ ID NO: 217670 - RNA, 22 nt, Human
uuggccaaaaaagucauuagaa

SEQ ID NO: 217671 - RNA, 22 nt, Human
uuggugaugcuaggaauguagu

SEQ ID NO: 217672 - RNA, 22 nt, Human
uuggugaugcccaccuuuucau

SEQ ID NO: 217673 - RNA, 20 nt, Human
uuguacuuaugugagaagga

SEQ ID NO: 217674 - RNA, 22 nt, Human
uuguacaaauaggaaccucuga

SEQ ID NO: 217675 - RNA, 22 nt, Human
uuguccacuaagaaagugcccu

SEQ ID NO: 217676 - RNA, 22 nt, Human
uugucuguacuggcugcaucga

SEQ ID NO: 217677 - RNA, 22 nt, Human
uugucauuuucuuaauguuccu

SEQ ID NO: 217678 - RNA, 22 nt, Human
uuguauaaagauggcuagaucc

SEQ ID NO: 217679 - RNA, 22 nt, Human
uuuaaaauguuuuauuuauuua

SEQ ID NO: 217680 - RNA, 22 nt, Human
uuguuuucuugaugaaauuauu

SEQ ID NO: 217681 - RNA, 22 nt, Human
uuguuuuucucuagggaaggcu

SEQ ID NO: 217682 - RNA, 22 nt, Human
uuguuuucuaguguuuugaaua

SEQ ID NO: 217683 - RNA, 22 nt, Human
uuguuuacuugagcugcacucu

SEQ ID NO: 217684 - RNA, 22 nt, Human
uuguuucauggggacgacuggc

SEQ ID NO: 217685 - RNA, 22 nt, Human
uugugacaauacagcauggaga

SEQ ID NO: 217686 - RNA, 22 nt, Human
uuguuugcacuuuagagacugu

SEQ ID NO: 217687 - RNA, 20 nt, Human
uuuaacuggccuucuggcuc

SEQ ID NO: 217688 - RNA, 22 nt, Human
uuuaaacuaacaguacacguug

SEQ ID NO: 217689 - RNA, 22 nt, Human
uuuaaaccuuggaagccacaua

SEQ ID NO: 217690 - RNA, 22 nt, Human
uuuaaagucaggcuguaguggu

SEQ ID NO: 217691 - RNA, 22 nt, Human
uuuaaauaguugguuuuuuugc

SEQ ID NO: 217692 - RNA, 22 nt, Human
uuuaaucaguugguaauauuga

SEQ ID NO: 217693 - RNA, 22 nt, Human
uuuaaugguuuauggucuaaga

SEQ ID NO: 217694 - RNA, 22 nt, Human
uuuaacccaaauaaccacagga

SEQ ID NO: 217695 - RNA, 22 nt, Human
uuuaauauucucuuugaaggaa

SEQ ID NO: 217696 - RNA, 22 nt, Human
uugcuuuuugggguuuacuggg

SEQ ID NO: 217697 - RNA, 22 nt, Human
uuggaaaugcauuuguuauuau

SEQ ID NO: 217698 - RNA, 22 nt, Human
uuggaaauguagaaaagcagau

SEQ ID NO: 217699 - RNA, 22 nt, Human
uuggagaaagcugcaggcucug

SEQ ID NO: 217700 - RNA, 22 nt, Human
uuggagagggugggcuuugaag

SEQ ID NO: 217701 - RNA, 22 nt, Human
uuggacugggauggccgaggcu

SEQ ID NO: 217702 - RNA, 22 nt, Human
uuggaagagagauggggagaga

SEQ ID NO: 217703 - RNA, 22 nt, Human
uugcugugucauuuguuuaauc

SEQ ID NO: 217704 - RNA, 22 nt, Human
uugcuuaaaucgcuuaaacugg

SEQ ID NO: 217705 - RNA, 22 nt, Human
uugcuugcggccuuugugccuu

SEQ ID NO: 217706 - RNA, 22 nt, Human
uugcuuucuuuguagguuuucc

SEQ ID NO: 217707 - RNA, 22 nt, Human
uugcugaggcuggggagaggug

SEQ ID NO: 217708 - RNA, 22 nt, Human
uugcugccagcgcccugcaggg

SEQ ID NO: 217709 - RNA, 22 nt, Human
uugcaagcccugaagggcugga

SEQ ID NO: 217710 - RNA, 22 nt, Human
uugcagaauucuucccacucag

SEQ ID NO: 217711 - RNA, 22 nt, Human
uugcacuccagcccgagcaaca

SEQ ID NO: 217712 - RNA, 22 nt, Human
uugaguuuacauuguauuagcc

SEQ ID NO: 217713 - RNA, 22 nt, Human
uugcaagauaguguauuuuuca

SEQ ID NO: 217714 - RNA, 22 nt, Human
uugcaugugugaaaugcacaga

SEQ ID NO: 217715 - RNA, 22 nt, Human
uugcagauuucuuguccccauu

SEQ ID NO: 217716 - RNA, 22 nt, Human
uugcagagaacuaaagggagua

SEQ ID NO: 217717 - RNA, 18 nt, Human
uugcucucucugggggca

SEQ ID NO: 217718 - RNA, 20 nt, Human
uugcucucuuguguugaugu

SEQ ID NO: 217719 - RNA, 22 nt, Human
uugcggauguccacgucacacu

SEQ ID NO: 217720 - RNA, 22 nt, Human
uugcguaauuugagauuguaaa

SEQ ID NO: 217721 - RNA, 22 nt, Human
uugcguaucuacauugccugua

SEQ ID NO: 217722 - RNA, 23 nt, Human
uugcauuaauguggaggcacagg

SEQ ID NO: 217723 - RNA, 22 nt, Human
uugccaggggacaucuggagcc

SEQ ID NO: 217724 - RNA, 22 nt, Human
uugccucuaauuagcucuguga

SEQ ID NO: 217725 - RNA, 22 nt, Human
uuauuguuuggguauaauuuga

SEQ ID NO: 217726 - RNA, 22 nt, Human
uuucucuccucgaaauucuuau

SEQ ID NO: 217727 - RNA, 22 nt, Human
uuauuucaggcauuuguaaaug

SEQ ID NO: 217728 - RNA, 22 nt, Human
uuauuucuucucgaagcuuggg

SEQ ID NO: 217729 - RNA, 22 nt, Human
uuucugaugaaguagaaagacc

SEQ ID NO: 217730 - RNA, 22 nt, Human
uuucugcuuucuaguugguguu

SEQ ID NO: 217731 - RNA, 22 nt, Human
uuucugagccacauauaauuug

SEQ ID NO: 217732 - RNA, 22 nt, Human
uuucucugggugaugagguggc

SEQ ID NO: 217733 - RNA, 22 nt, Human
uuucuuaguuaaguagguaggc

SEQ ID NO: 217734 - RNA, 22 nt, Human
uuauuuuauaaagagaagacuu

SEQ ID NO: 217735 - RNA, 22 nt, Human
uuauuugcccauguuuagcaga

SEQ ID NO: 217736 - RNA, 22 nt, Human
uuucuuccaucuggcuuuauuu

SEQ ID NO: 217737 - RNA, 22 nt, Human
uuucuugugauuuugaugaacu

SEQ ID NO: 217738 - RNA, 22 nt, Human
uuucuguucuguuggauucuuu

SEQ ID NO: 217739 - RNA, 22 nt, Human
uuucuuaaaagcuuuuaaaguu

SEQ ID NO: 217740 - RNA, 22 nt, Human
uuucuggacuaaagggagagau

SEQ ID NO: 217741 - RNA, 22 nt, Human
uuucugggggucgugcuggcug

SEQ ID NO: 217742 - RNA, 19 nt, Human
uuucuggguucaccucuug

SEQ ID NO: 217743 - RNA, 22 nt, Human
uuugagaaugucaaucacaaga

SEQ ID NO: 217744 - RNA, 22 nt, Human
uuugagugcccauguuucccag

SEQ ID NO: 217745 - RNA, 21 nt, Human
uuugacagaccagguauaguu

SEQ ID NO: 217746 - RNA, 23 nt, Human
uuugaaucauuguggggcuuuug

SEQ ID NO: 217747 - RNA, 22 nt, Human
uucaacaacuugguucaaaugg

SEQ ID NO: 217748 - RNA, 22 nt, Human
uucaacacaaguugugcaguaa

SEQ ID NO: 217749 - RNA, 22 nt, Human
uuauuuuuguuuguuaagccua

SEQ ID NO: 217750 - RNA, 22 nt, Human
uucaaaaugcagaauaguuugg

SEQ ID NO: 217751 - RNA, 22 nt, Human
uuugaagaaacagucuuaagag

SEQ ID NO: 217752 - RNA, 22 nt, Human
uuugaaaggagcuuuauccaga

SEQ ID NO: 217753 - RNA, 22 nt, Human
uuugaagaccuuaucucuaaau

SEQ ID NO: 217754 - RNA, 22 nt, Human
uuucuuuuucuacaccuuagcu

SEQ ID NO: 217755 - RNA, 22 nt, Human
uuauuuuuguaacacuguauag

SEQ ID NO: 217756 - RNA, 22 nt, Human
uuucuuugggcccuggcagucu

SEQ ID NO: 217757 - RNA, 22 nt, Human
uuauuuucgugugugugugugu

SEQ ID NO: 217758 - RNA, 22 nt, Human
uuauuuuguagcucugaucuuu

SEQ ID NO: 217759 - RNA, 22 nt, Human
uucaguuuugcuuuuaaucaug

SEQ ID NO: 217760 - RNA, 18 nt, Human
uuugggauccucuuuucu

SEQ ID NO: 217761 - RNA, 22 nt, Human
uuugggaaguaauuaauugcag

SEQ ID NO: 217762 - RNA, 22 nt, Human
uucaguagagguggaaauaaca

SEQ ID NO: 217763 - RNA, 22 nt, Human
uucaguuugaauucuguagaac

SEQ ID NO: 217764 - RNA, 22 nt, Human
uucaguguuagaauuccaagaa

SEQ ID NO: 217765 - RNA, 19 nt, Human
uucaggcuuuucauuuuuc

SEQ ID NO: 217766 - RNA, 22 nt, Human
uuugggcauuuuuaaggaucuu

SEQ ID NO: 217767 - RNA, 22 nt, Human
uuuggggcucauuugcuuuugu

SEQ ID NO: 217768 - RNA, 22 nt, Human
uuuggucuggaaucuucagggu

SEQ ID NO: 217769 - RNA, 22 nt, Human
uuuggguuuuuccuuagggacu

SEQ ID NO: 217770 - RNA, 22 nt, Human
uuuggguuaguuuuccaaucuu

SEQ ID NO: 217771 - RNA, 22 nt, Human
uucagacugcccauguuugcca

SEQ ID NO: 217772 - RNA, 23 nt, Human
uuugcaaauuggacacaaccaca

SEQ ID NO: 217773 - RNA, 22 nt, Human
uuugcaggaaauguacugaaug

SEQ ID NO: 217774 - RNA, 22 nt, Human
uucagguacuaagugcugauuc

SEQ ID NO: 217775 - RNA, 22 nt, Human
uuugcauuugagagaggaaaca

SEQ ID NO: 217776 - RNA, 22 nt, Human
uucaggaucuaggaguauuuuu

SEQ ID NO: 217777 - RNA, 22 nt, Human
uucagguuuuuaaguucugccu

SEQ ID NO: 217778 - RNA, 22 nt, Human
uuccccagaaaaguaaacaagg

SEQ ID NO: 217779 - RNA, 22 nt, Human
uucccugggggggccgcuuucc

SEQ ID NO: 217780 - RNA, 22 nt, Human
uuugugauaaguggauucaagg

SEQ ID NO: 217781 - RNA, 22 nt, Human
uuccaugccccucuuuggguac

SEQ ID NO: 217782 - RNA, 22 nt, Human
uuugucaucuuccauauuugca

SEQ ID NO: 217783 - RNA, 22 nt, Human
uuccagguggcuuuccuggggg

SEQ ID NO: 217784 - RNA, 22 nt, Human
uuuguggugagcagggaacguc

SEQ ID NO: 217785 - RNA, 17 nt, Human
uuugugauggcagaugc

SEQ ID NO: 217786 - RNA, 22 nt, Human
uuuguaguuguggaugcugaag

SEQ ID NO: 217787 - RNA, 20 nt, Human
uuugucaacugcauccagca

SEQ ID NO: 217788 - RNA, 22 nt, Human
uuugucauuuagcccauggugg

SEQ ID NO: 217789 - RNA, 21 nt, Human
uucauucauggcauaauauag

SEQ ID NO: 217790 - RNA, 22 nt, Human
uuuguacuuucuaauguauuua

SEQ ID NO: 217791 - RNA, 22 nt, Human
uucauugauuuccuuggaauaa

SEQ ID NO: 217792 - RNA, 22 nt, Human
uucauugcagaauuuggccuca

SEQ ID NO: 217793 - RNA, 22 nt, Human
uuuguaaguuuguucuccuggg

SEQ ID NO: 217794 - RNA, 22 nt, Human
uuuccagacaugguuuuucaaa

SEQ ID NO: 217795 - RNA, 22 nt, Human
uuucauggaggccaggacagag

SEQ ID NO: 217796 - RNA, 19 nt, Human
uuauccacagggaauuuau

SEQ ID NO: 217797 - RNA, 22 nt, Human
uuaucagggaguuguguguucu

SEQ ID NO: 217798 - RNA, 22 nt, Human
uuuccacacucacugcacucau

SEQ ID NO: 217799 - RNA, 22 nt, Human
uuaucaaaaaauaguacuuuga

SEQ ID NO: 217800 - RNA, 22 nt, Human
uuaucuuuuaaaaacacuugug

SEQ ID NO: 217801 - RNA, 19 nt, Human
uuauccggacuuaauuuau

SEQ ID NO: 217802 - RNA, 22 nt, Human
uuauggauuagaguuugauucu

SEQ ID NO: 217803 - RNA, 22 nt, Human
uuauacugaaagucuuuuaaua

SEQ ID NO: 217804 - RNA, 22 nt, Human
uuauaucagaaggugagauuga

SEQ ID NO: 217805 - RNA, 22 nt, Human
uuucacugaguaggagagcacu

SEQ ID NO: 217806 - RNA, 22 nt, Human
uuauaagugccucuuuauuuuc

SEQ ID NO: 217807 - RNA, 22 nt, Human
uuucaugauuaacuuagugaau

SEQ ID NO: 217808 - RNA, 22 nt, Human
uuucagugaaugaauggcuaac

SEQ ID NO: 217809 - RNA, 22 nt, Human
uuucagaaauggcacugaaauc

SEQ ID NO: 217810 - RNA, 22 nt, Human
uuucuacacuucgugguguuuu

SEQ ID NO: 217811 - RNA, 22 nt, Human
uuucuauauucaguuucauaaa

SEQ ID NO: 217812 - RNA, 22 nt, Human
uuucucagcauauugccuuuga

SEQ ID NO: 217813 - RNA, 22 nt, Human
uuucucagccuccuugcuggag

SEQ ID NO: 217814 - RNA, 22 nt, Human
uuucuccauuuuguguguucug

SEQ ID NO: 217815 - RNA, 22 nt, Human
uuucgcuuguucggagugcuuu

SEQ ID NO: 217816 - RNA, 22 nt, Human
uuucuaaaauuacugcagucgg

SEQ ID NO: 217817 - RNA, 22 nt, Human
uuucguugcacucauaugguug

SEQ ID NO: 217818 - RNA, 22 nt, Human
uuauuguagcacuuuggcagug

SEQ ID NO: 217819 - RNA, 22 nt, Human
uuucccuugcgcuugcucuccg

SEQ ID NO: 217820 - RNA, 22 nt, Human
uuuccccugggaacauugauuc

SEQ ID NO: 217821 - RNA, 22 nt, Human
uuuccugacuucaccuuuuacc

SEQ ID NO: 217822 - RNA, 22 nt, Human
uuaugucauuugaauuaauuuu

SEQ ID NO: 217823 - RNA, 22 nt, Human
uuaugguuuaauauccagcaca

SEQ ID NO: 217824 - RNA, 22 nt, Human
uuauuaauacaugcaccugcau

SEQ ID NO: 217825 - RNA, 22 nt, Human
uuauuggcagcuccugcacaug

SEQ ID NO: 217826 - RNA, 22 nt, Human
uuaugugcuuuuugagcucuaa

SEQ ID NO: 217827 - RNA, 22 nt, Human
uuuccuuaauuguaaaauggag

SEQ ID NO: 217828 - RNA, 22 nt, Human
uuuccuguuuugguuuggagag

SEQ ID NO: 217829 - RNA, 22 nt, Human
uuuagcugugugugucgcucca

SEQ ID NO: 217830 - RNA, 22 nt, Human
uuuagguccguguugcaguugg

SEQ ID NO: 217831 - RNA, 22 nt, Human
uuuaggaauuugcugggcauga

SEQ ID NO: 217832 - RNA, 22 nt, Human
uuuagcaguuuauuuaaggggg

SEQ ID NO: 217833 - RNA, 22 nt, Human
uuuagcauggacacugagggcu

SEQ ID NO: 217834 - RNA, 22 nt, Human
uuuagcaaggagaaauaauccu

SEQ ID NO: 217835 - RNA, 22 nt, Human
uuagaaauguccuacuaauaug

SEQ ID NO: 217836 - RNA, 22 nt, Human
uuagacaucaagaagccaaugu

SEQ ID NO: 217837 - RNA, 22 nt, Human
uuaccauaguacuaucaguuua

SEQ ID NO: 217838 - RNA, 22 nt, Human
uuacccuugaauuugugacaaa

SEQ ID NO: 217839 - RNA, 22 nt, Human
uuuacucagucugagcaggugu

SEQ ID NO: 217840 - RNA, 22 nt, Human
uuuacuguuuacagcuaaugca

SEQ ID NO: 217841 - RNA, 22 nt, Human
uuaccugagcggauuuguugca

SEQ ID NO: 217842 - RNA, 22 nt, Human
uguuugaggugacucuggaaug

SEQ ID NO: 217843 - RNA, 22 nt, Human
uuguaugcugggaagcgggagg

SEQ ID NO: 217844 - RNA, 22 nt, Human
uuuacaaggcaguuauuuuccu

SEQ ID NO: 217845 - RNA, 22 nt, Human
uguuucguugguggagagcuac

SEQ ID NO: 217846 - RNA, 22 nt, Human
uguuuccuguaccacagguuuu

SEQ ID NO: 217847 - RNA, 22 nt, Human
uguuugaugugcacgugugugu

SEQ ID NO: 217848 - RNA, 22 nt, Human
uuuauccacucauccaugccuc

SEQ ID NO: 217849 - RNA, 22 nt, Human
uuuaucucugcauagaagugau

SEQ ID NO: 217850 - RNA, 22 nt, Human
uuuaucaggccaucuuaugucu

SEQ ID NO: 217851 - RNA, 22 nt, Human
uuuaucaucuucugaauuugga

SEQ ID NO: 217852 - RNA, 22 nt, Human
uuuauaauuguuauguuaccca

SEQ ID NO: 217853 - RNA, 22 nt, Human
uuuauaauuacguaaaauauuu

SEQ ID NO: 217854 - RNA, 22 nt, Human
uuagcgcucucuccauucuuaa

SEQ ID NO: 217855 - RNA, 22 nt, Human
uuagagagguuggagugguaga

SEQ ID NO: 217856 - RNA, 22 nt, Human
uuagagagaggagagagagaga

SEQ ID NO: 217857 - RNA, 22 nt, Human
uuaguuauaggugaaucagaga

SEQ ID NO: 217858 - RNA, 19 nt, Human
uuuauuugagacaugccuu

SEQ ID NO: 217859 - RNA, 22 nt, Human
uuuauucuuugcuagguuccau

SEQ ID NO: 217860 - RNA, 22 nt, Human
uuuauugcuaugucuugauugu

SEQ ID NO: 217861 - RNA, 22 nt, Human
uuauaaaccgcuaacagcacuu

SEQ ID NO: 217862 - RNA, 19 nt, Human
uuucacaaagagagcguga

SEQ ID NO: 217863 - RNA, 22 nt, Human
uuuauuugugguaguguaaucu

SEQ ID NO: 217864 - RNA, 22 nt, Human
uuucaagccucacugcguuuug

SEQ ID NO: 217865 - RNA, 22 nt, Human
ugggcaguccagcuggaaacgg

SEQ ID NO: 217866 - RNA, 23 nt, Human
ugggccucuccacccuuuucugu

SEQ ID NO: 217867 - RNA, 22 nt, Human
uggggaauguaauucuuuggcu

SEQ ID NO: 217868 - RNA, 22 nt, Human
uggggagacauggaguaaaaga

SEQ ID NO: 217869 - RNA, 22 nt, Human
uggcuugagcugggcccaccug

SEQ ID NO: 217870 - RNA, 22 nt, Human
uggcuuuucaccugcuccucug

SEQ ID NO: 217871 - RNA, 22 nt, Human
uggcuugacaucaauacuuauu

SEQ ID NO: 217872 - RNA, 22 nt, Human
ugggaugagcuauauagaaagu

SEQ ID NO: 217873 - RNA, 22 nt, Human
uucccagggaucucuaguauuu

SEQ ID NO: 217874 - RNA, 22 nt, Human
uggcuucuggccaggcacagga

SEQ ID NO: 217875 - RNA, 22 nt, Human
uucccauuccagcucgaucaau

SEQ ID NO: 217876 - RNA, 20 nt, Human
uuccccauaaaaauguucca

SEQ ID NO: 217877 - RNA, 22 nt, Human
uggggugccccccucgguuugc

SEQ ID NO: 217878 - RNA, 22 nt, Human
ugggucaguagccuugcagaac

SEQ ID NO: 217879 - RNA, 22 nt, Human
ugggucagauugagccccuggu

SEQ ID NO: 217880 - RNA, 22 nt, Human
ugggucagauacaguguuuggu

SEQ ID NO: 217881 - RNA, 22 nt, Human
ugggucacuggccaagcucgac

SEQ ID NO: 217882 - RNA, 22 nt, Human
uucucuggggacugucucuauu

SEQ ID NO: 217883 - RNA, 22 nt, Human
uucucugaagagccagcccuua

SEQ ID NO: 217884 - RNA, 20 nt, Human
uucucugcagcaggcggccc

SEQ ID NO: 217885 - RNA, 22 nt, Human
uucuccaccugcuccucccacc

SEQ ID NO: 217886 - RNA, 22 nt, Human
uucuacauugugaaguucuuua

SEQ ID NO: 217887 - RNA, 22 nt, Human
uucgucauuguuguugguuuuc

SEQ ID NO: 217888 - RNA, 22 nt, Human
ugggggagggagaguugauggg

SEQ ID NO: 217889 - RNA, 22 nt, Human
uucuacuagugguugauggccu

SEQ ID NO: 217890 - RNA, 22 nt, Human
ugggggcacccagccgaugagg

SEQ ID NO: 217891 - RNA, 22 nt, Human
ugggggauucaucucagagcgu

SEQ ID NO: 217892 - RNA, 22 nt, Human
uucaguaugcugaaugauuuuu

SEQ ID NO: 217893 - RNA, 22 nt, Human
uggccaaauuggccugauguau

SEQ ID NO: 217894 - RNA, 22 nt, Human
uggccagucuuagcugugccug

SEQ ID NO: 217895 - RNA, 22 nt, Human
uggccaugagaaucuuugcugu

SEQ ID NO: 217896 - RNA, 22 nt, Human
uucagguuauugaagagcuuuc

SEQ ID NO: 217897 - RNA, 22 nt, Human
uucagguuuuaugguaaugcuu

SEQ ID NO: 217898 - RNA, 20 nt, Human
uggcccagcacgacgaggac

SEQ ID NO: 217899 - RNA, 22 nt, Human
uucauagaagggaguuuuuccu

SEQ ID NO: 217900 - RNA, 23 nt, Human
uggccguccccugacucucuggc

SEQ ID NO: 217901 - RNA, 22 nt, Human
uggccgaugagcaugcgcugau

SEQ ID NO: 217902 - RNA, 22 nt, Human
uucauauuguggucuugcauuc

SEQ ID NO: 217903 - RNA, 22 nt, Human
uggccccauuuuucuggagccu

SEQ ID NO: 217904 - RNA, 21 nt, Human
uggcccgagccgggguuggcu

SEQ ID NO: 217905 - RNA, 22 nt, Human
uucaugcaagagugugaggucc

SEQ ID NO: 217906 - RNA, 22 nt, Human
uucaucuucaaaccccagugcc

SEQ ID NO: 217907 - RNA, 22 nt, Human
uucaugcgcuuuucaggagugu

SEQ ID NO: 217908 - RNA, 20 nt, Human
uucaugcagugguugcugug

SEQ ID NO: 217909 - RNA, 22 nt, Human
uggccugauuuugcuaagagaa

SEQ ID NO: 217910 - RNA, 22 nt, Human
uucauccucuaguacugaagug

SEQ ID NO: 217911 - RNA, 22 nt, Human
uuccagaacaauguggacguau

SEQ ID NO: 217912 - RNA, 22 nt, Human
uuccagcaaagguaguguguua

SEQ ID NO: 217913 - RNA, 22 nt, Human
uuccagucugggcucuucacug

SEQ ID NO: 217914 - RNA, 22 nt, Human
uggcuucagacuucugcuacgu

SEQ ID NO: 217915 - RNA, 22 nt, Human
uuccaggacuggguguuugaag

SEQ ID NO: 217916 - RNA, 22 nt, Human
uggcuucugguuuauccuuaua

SEQ ID NO: 217917 - RNA, 22 nt, Human
uggcuacguacaauggaacuuu

SEQ ID NO: 217918 - RNA, 22 nt, Human
uggcucagcgcggccuggucuu

SEQ ID NO: 217919 - RNA, 22 nt, Human
uggcucacaggaggcagaggug

SEQ ID NO: 217920 - RNA, 19 nt, Human
uuccacugcuuagcauugc

SEQ ID NO: 217921 - RNA, 22 nt, Human
uggcucaguaaucgagucuccu

SEQ ID NO: 217922 - RNA, 22 nt, Human
uucauugcuacuuaaaauacca

SEQ ID NO: 217923 - RNA, 22 nt, Human
uucauuauuaauaauagcagcu

SEQ ID NO: 217924 - RNA, 22 nt, Human
uggcgcgcucgcucucgcugag

SEQ ID NO: 217925 - RNA, 22 nt, Human
uggccuucagcucuggggugca

SEQ ID NO: 217926 - RNA, 22 nt, Human
uggcagugggaagcuggaaguc

SEQ ID NO: 217927 - RNA, 22 nt, Human
uggcaguagagcuggaacuuga

SEQ ID NO: 217928 - RNA, 22 nt, Human
uggcaucucggugcugguucuu

SEQ ID NO: 217929 - RNA, 22 nt, Human
uggcaucuggugauauggacua

SEQ ID NO: 217930 - RNA, 21 nt, Human
uggcaggcagcuggaagcuug

SEQ ID NO: 217931 - RNA, 22 nt, Human
uucagauuuguuuuuguuucug

SEQ ID NO: 217932 - RNA, 22 nt, Human
uucagaugcuugauuauggcaa

SEQ ID NO: 217933 - RNA, 22 nt, Human
uucagaccucaaauccacaugc

SEQ ID NO: 217934 - RNA, 22 nt, Human
uucagaauuaucauaauuuuga

SEQ ID NO: 217935 - RNA, 20 nt, Human
uggcaugaaauuuuccaagc

SEQ ID NO: 217936 - RNA, 20 nt, Human
uggcaugcucucuuuuuagg

SEQ ID NO: 217937 - RNA, 18 nt, Human
uggcaugcuuugauacau

SEQ ID NO: 217938 - RNA, 22 nt, Human
uucagcaagugucucuacuguc

SEQ ID NO: 217939 - RNA, 22 nt, Human
uucagcacuggacagcgagucu

SEQ ID NO: 217940 - RNA, 18 nt, Human
uucaggcucuugcaugaa

SEQ ID NO: 217941 - RNA, 22 nt, Human
uucaggaaacaaauuugcaguu

SEQ ID NO: 217942 - RNA, 22 nt, Human
uucagcauggcuguuuucccuu

SEQ ID NO: 217943 - RNA, 22 nt, Human
uggcacaggcagaaggugccgc

SEQ ID NO: 217944 - RNA, 22 nt, Human
uucacuuuuucucugcuugaga

SEQ ID NO: 217945 - RNA, 22 nt, Human
uucacugugauugggguggauu

SEQ ID NO: 217946 - RNA, 22 nt, Human
uucacucagagcaggacagccc

SEQ ID NO: 217947 - RNA, 20 nt, Human
uucacggaggccgcgccccc

SEQ ID NO: 217948 - RNA, 22 nt, Human
uucagaaagugaaucuuguuau

SEQ ID NO: 217949 - RNA, 22 nt, Human
uggcagaaugaagacuggggcc

SEQ ID NO: 217950 - RNA, 22 nt, Human
uggcacugcccugucucggugg

SEQ ID NO: 217951 - RNA, 22 nt, Human
uggcacaguuaaaguuguagaa

SEQ ID NO: 217952 - RNA, 22 nt, Human
uggcaaacacaauauggguaca

SEQ ID NO: 217953 - RNA, 15 nt, Human
uggauuugccacaua

SEQ ID NO: 217954 - RNA, 22 nt, Human
uggcaacucaauuucuacaaga

SEQ ID NO: 217955 - RNA, 18 nt, Human
uggcaaugccaaaggcuu

SEQ ID NO: 217956 - RNA, 22 nt, Human
uggcacagcuugucauaaacuc

SEQ ID NO: 217957 - RNA, 22 nt, Human
uggauuagugcugaaaugaugg

SEQ ID NO: 217958 - RNA, 22 nt, Human
uggauuuuggaauguuucagua

SEQ ID NO: 217959 - RNA, 22 nt, Human
uggauuguuuacaucaugucug

SEQ ID NO: 217960 - RNA, 22 nt, Human
uggauucucuguagccugguuc

SEQ ID NO: 217961 - RNA, 20 nt, Human
uggaugacuucaggcagccu

SEQ ID NO: 217962 - RNA, 22 nt, Human
uggaugacaaccauuggaagag

SEQ ID NO: 217963 - RNA, 22 nt, Human
uggaucaugcgaggccuccccu

SEQ ID NO: 217964 - RNA, 21 nt, Human
uggauauugaguaguuucuga

SEQ ID NO: 217965 - RNA, 22 nt, Human
uggauaugaaacaaaacaagag

SEQ ID NO: 217966 - RNA, 22 nt, Human
uucaauggaauucuuagguuuc

SEQ ID NO: 217967 - RNA, 23 nt, Human
uucaccaaugcuguccaaguacc

SEQ ID NO: 217968 - RNA, 22 nt, Human
uucaaacacugugcaauugggu

SEQ ID NO: 217969 - RNA, 22 nt, Human
uucaaacaguguagaauauaug

SEQ ID NO: 217970 - RNA, 22 nt, Human
uggaguucauauuggacauaag

SEQ ID NO: 217971 - RNA, 22 nt, Human
uggaguaauggguguuuuugaa

SEQ ID NO: 217972 - RNA, 21 nt, Human
uucaaccagcaauuggcagaa

SEQ ID NO: 217973 - RNA, 22 nt, Human
uucaaaccuaucuaagaaauag

SEQ ID NO: 217974 - RNA, 22 nt, Human
uggaguuuuaaucuguacagaa

SEQ ID NO: 217975 - RNA, 22 nt, Human
uggagguagcugacuccagccc

SEQ ID NO: 217976 - RNA, 22 nt, Human
uggaguguuggucccacugagg

SEQ ID NO: 217977 - RNA, 22 nt, Human
uuauuuuuaggaauguagaggu

SEQ ID NO: 217978 - RNA, 22 nt, Human
uggaggaggagaacuuggcacu

SEQ ID NO: 217979 - RNA, 22 nt, Human
uggaggauaacacaagaaguga

SEQ ID NO: 217980 - RNA, 22 nt, Human
uuauuuaaguauuuauugaagu

SEQ ID NO: 217981 - RNA, 22 nt, Human
uuauuuaagaucuuaauauaua

SEQ ID NO: 217982 - RNA, 22 nt, Human
uuauuugguuuuggcuuuagcu

SEQ ID NO: 217983 - RNA, 22 nt, Human
uuauuucauguaaaauuuaugu

SEQ ID NO: 217984 - RNA, 22 nt, Human
uuauuuaaaauguagguuggga

SEQ ID NO: 217985 - RNA, 22 nt, Human
uggaggagaacugauuuggcuu

SEQ ID NO: 217986 - RNA, 22 nt, Human
uggagcugguucuggggaagcu

SEQ ID NO: 217987 - RNA, 22 nt, Human
uuauucuuagccucgguauuuc

SEQ ID NO: 217988 - RNA, 22 nt, Human
ugcuauccagacacauaugauc

SEQ ID NO: 217989 - RNA, 22 nt, Human
ugcucagaagacuuacugguua

SEQ ID NO: 217990 - RNA, 22 nt, Human
uuauguugauaggaaucugauu

SEQ ID NO: 217991 - RNA, 22 nt, Human
uucuguuuaaccuggaaagugu

SEQ ID NO: 217992 - RNA, 22 nt, Human
uucuguguauggaagaaugucc

SEQ ID NO: 217993 - RNA, 22 nt, Human
uggugcagacaggagccccgcu

SEQ ID NO: 217994 - RNA, 22 nt, Human
uggugcaggauuuauuuaacua

SEQ ID NO: 217995 - RNA, 22 nt, Human
uucugagccacaguaaggaucu

SEQ ID NO: 217996 - RNA, 22 nt, Human
uucugaaggcaggggcuaucuu

SEQ ID NO: 217997 - RNA, 22 nt, Human
uucucugcgcuccggcccaguu

SEQ ID NO: 217998 - RNA, 22 nt, Human
uucugaugccuggguugcuucu

SEQ ID NO: 217999 - RNA, 20 nt, Human
uucugcagcagguguugaag

SEQ ID NO: 218000 - RNA, 22 nt, Human
ugguggccucaguggcuucugu

SEQ ID NO: 218001 - RNA, 22 nt, Human
ugguggcuuuucguagguucac

SEQ ID NO: 218002 - RNA, 22 nt, Human
uggugguaggggugguuucuga

SEQ ID NO: 218003 - RNA, 22 nt, Human
ugguggagucugggggaggcuu

SEQ ID NO: 218004 - RNA, 22 nt, Human
uucuuauuuuucguaaauccug

SEQ ID NO: 218005 - RNA, 22 nt, Human
ugguggcaauuuuuggggucaa

SEQ ID NO: 218006 - RNA, 22 nt, Human
uucuucgacuguauaaaaguau

SEQ ID NO: 218007 - RNA, 22 nt, Human
uucuuccagugaaacgugcauc

SEQ ID NO: 218008 - RNA, 22 nt, Human
uguaaagaaagacgcagaguua

SEQ ID NO: 218009 - RNA, 22 nt, Human
uguaaagguuuuagagcagaga

SEQ ID NO: 218010 - RNA, 23 nt, Human
uguaaaacaccguuauugcaccu

SEQ ID NO: 218011 - RNA, 22 nt, Human
uucuuuuuagcugguuguaaga

SEQ ID NO: 218012 - RNA, 22 nt, Human
uucuuuucuucccuguuuauua

SEQ ID NO: 218013 - RNA, 21 nt, Human
ugguuuuaucuugguggcugc

SEQ ID NO: 218014 - RNA, 21 nt, Human
uucuuugaagacccauuugag

SEQ ID NO: 218015 - RNA, 22 nt, Human
uguaauuugguuagauuucuuu

SEQ ID NO: 218016 - RNA, 22 nt, Human
uugaaaucuucccuccugucug

SEQ ID NO: 218017 - RNA, 22 nt, Human
uguacagauaucaggagugagg

SEQ ID NO: 218018 - RNA, 22 nt, Human
uguaaacuuuugcauacugcuu

SEQ ID NO: 218019 - RNA, 22 nt, Human
uugaaagaacaauucugugaug

SEQ ID NO: 218020 - RNA, 22 nt, Human
uguagaaguuaauugaugagua

SEQ ID NO: 218021 - RNA, 22 nt, Human
uugaacguguaggaagcugguu

SEQ ID NO: 218022 - RNA, 22 nt, Human
uugaaccaggauaaacauagaa

SEQ ID NO: 218023 - RNA, 22 nt, Human
ugugagauuuuauuugauaugc

SEQ ID NO: 218024 - RNA, 20 nt, Human
uugcaugcagccggaugcug

SEQ ID NO: 218025 - RNA, 22 nt, Human
ugugacugaaaaugauugagug

SEQ ID NO: 218026 - RNA, 22 nt, Human
ugugacaugauggcgucaugua

SEQ ID NO: 218027 - RNA, 22 nt, Human
ugugaagcgugugcaggggaca

SEQ ID NO: 218028 - RNA, 22 nt, Human
ugugcagaaggagguucuccgg

SEQ ID NO: 218029 - RNA, 22 nt, Human
ugugaugagaugaacuguagac

SEQ ID NO: 218030 - RNA, 22 nt, Human
ugucuuuuaaaaauguguaaaa

SEQ ID NO: 218031 - RNA, 22 nt, Human
ugugaagaauuaaugugaauca

SEQ ID NO: 218032 - RNA, 22 nt, Human
ugucuuuagagugaacagaaga

SEQ ID NO: 218033 - RNA, 22 nt, Human
ugucuuucuuucucuugacaga

SEQ ID NO: 218034 - RNA, 22 nt, Human
uugcacagaugcacaugguugc

SEQ ID NO: 218035 - RNA, 23 nt, Human
ugucugccuaucaugugaaggac

SEQ ID NO: 218036 - RNA, 22 nt, Human
ugucguaaaagggccgcagugg

SEQ ID NO: 218037 - RNA, 22 nt, Human
uugcacgucacccuucccaccu

SEQ ID NO: 218038 - RNA, 22 nt, Human
uguauuuuuucccugaaauaaa

SEQ ID NO: 218039 - RNA, 22 nt, Human
ugucacaccucguuuagcauuc

SEQ ID NO: 218040 - RNA, 22 nt, Human
ugucacagagcgugcaacagaa

SEQ ID NO: 218041 - RNA, 22 nt, Human
uguauauuuucuguauaaaaua

SEQ ID NO: 218042 - RNA, 22 nt, Human
uguauauuccagggguagggcc

SEQ ID NO: 218043 - RNA, 22 nt, Human
uguaucuguguguauguguuua

SEQ ID NO: 218044 - RNA, 22 nt, Human
ugucaucuuggugcugugagag

SEQ ID NO: 218045 - RNA, 22 nt, Human
ugucaucuuucuaaagcugguc

SEQ ID NO: 218046 - RNA, 22 nt, Human
ugucauggacuggauuucugcu

SEQ ID NO: 218047 - RNA, 20 nt, Human
ugucccuggagagcugcaga

SEQ ID NO: 218048 - RNA, 22 nt, Human
uugauuuggaauuuuuagagcu

SEQ ID NO: 218049 - RNA, 22 nt, Human
ugucccuggacuccaggagcca

SEQ ID NO: 218050 - RNA, 22 nt, Human
uugauuuccauuguccagcauu

SEQ ID NO: 218051 - RNA, 22 nt, Human
ugucauauagaauguucuauga

SEQ ID NO: 218052 - RNA, 21 nt, Human
ugucaucucuaaaaagauugu

SEQ ID NO: 218053 - RNA, 22 nt, Human
uugauuaauugaugaaccucuc

SEQ ID NO: 218054 - RNA, 22 nt, Human
uugauggaggaaaaguuggaau

SEQ ID NO: 218055 - RNA, 22 nt, Human
ugucacggccggguggcaccga

SEQ ID NO: 218056 - RNA, 23 nt, Human
ugucacugcggaguggccugcag

SEQ ID NO: 218057 - RNA, 22 nt, Human
ugucacguaaaaacuagauuuc

SEQ ID NO: 218058 - RNA, 22 nt, Human
uuggugauguagcagcaauugu

SEQ ID NO: 218059 - RNA, 22 nt, Human
uguuggauuuugugaaauauga

SEQ ID NO: 218060 - RNA, 22 nt, Human
uguuggcagugcuacagucagu

SEQ ID NO: 218061 - RNA, 21 nt, Human
uguuggccuucauucucuguc

SEQ ID NO: 218062 - RNA, 22 nt, Human
uuggugaugaaagugcugcgcu

SEQ ID NO: 218063 - RNA, 19 nt, Human
uuggugaagguucacugac

SEQ ID NO: 218064 - RNA, 22 nt, Human
uuguagccaugucacaagcaca

SEQ ID NO: 218065 - RNA, 22 nt, Human
uuguacuuguucuguuuccuug

SEQ ID NO: 218066 - RNA, 22 nt, Human
uuguagaucagauggccaguag

SEQ ID NO: 218067 - RNA, 22 nt, Human
uuguaauaguguuuuacguugu

SEQ ID NO: 218068 - RNA, 22 nt, Human
uugguugaaauguguucaugcu

SEQ ID NO: 218069 - RNA, 22 nt, Human
uuguacuuaaauaugcaaauag

SEQ ID NO: 218070 - RNA, 22 nt, Human
uugguguuucacuuccuugucg

SEQ ID NO: 218071 - RNA, 22 nt, Human
uguugguuucaagcaggagccu

SEQ ID NO: 218072 - RNA, 22 nt, Human
uguuggugcacugaaaggcagg

SEQ ID NO: 218073 - RNA, 18 nt, Human
uguugguguucacucacu

SEQ ID NO: 218074 - RNA, 22 nt, Human
uguugaagcaccucugucuuuc

SEQ ID NO: 218075 - RNA, 22 nt, Human
uguugaucucuuuccaaauucu

SEQ ID NO: 218076 - RNA, 22 nt, Human
uugggauucugucagugugugu

SEQ ID NO: 218077 - RNA, 20 nt, Human
uguuccgugguguccuuuuc

SEQ ID NO: 218078 - RNA, 22 nt, Human
uugggagaggcagcagagucau

SEQ ID NO: 218079 - RNA, 22 nt, Human
uugggcauuucuuauguauuuu

SEQ ID NO: 218080 - RNA, 22 nt, Human
uugggauuggugggguggguuu

SEQ ID NO: 218081 - RNA, 22 nt, Human
uuggggaaaaagaccuaaugac

SEQ ID NO: 218082 - RNA, 22 nt, Human
uguguguauauauggaauauug

SEQ ID NO: 218083 - RNA, 22 nt, Human
ugugugggcgaagacagccuuu

SEQ ID NO: 218084 - RNA, 22 nt, Human
uuggccuaggcacaggcaggug

SEQ ID NO: 218085 - RNA, 22 nt, Human
uuggccugcuccagaacaaggg

SEQ ID NO: 218086 - RNA, 22 nt, Human
uguuaacugccaggacagaucg

SEQ ID NO: 218087 - RNA, 22 nt, Human
uguuccggucuaucgugucaau

SEQ ID NO: 218088 - RNA, 22 nt, Human
uuggcuuuucaguuuuaaguua

SEQ ID NO: 218089 - RNA, 22 nt, Human
uguuaacuuagcugaccuuaaa

SEQ ID NO: 218090 - RNA, 22 nt, Human
uugcuuugcuucuuuaugguca

SEQ ID NO: 218091 - RNA, 23 nt, Human
uugcuuuugccccaaaagaguua

SEQ ID NO: 218092 - RNA, 23 nt, Human
uugcuugagcccaggaaguggag

SEQ ID NO: 218093 - RNA, 22 nt, Human
uugcuugaacccaggaagugga

SEQ ID NO: 218094 - RNA, 22 nt, Human
uugcuuaggccaaauggcgcau

SEQ ID NO: 218095 - RNA, 22 nt, Human
uguggugacuugagcuuccuaa

SEQ ID NO: 218096 - RNA, 22 nt, Human
uuggaaaagaaauacucauaua

SEQ ID NO: 218097 - RNA, 22 nt, Human
uugcuuuuuuggguuuacuggg

SEQ ID NO: 218098 - RNA, 22 nt, Human
uuggaggucucugugguggugg

SEQ ID NO: 218099 - RNA, 22 nt, Human
uuggaguucuucaugcucugua

SEQ ID NO: 218100 - RNA, 22 nt, Human
uuggaggcagagucuugcugag

SEQ ID NO: 218101 - RNA, 22 nt, Human
uuggauguccucuguggaguau

SEQ ID NO: 218102 - RNA, 22 nt, Human
uguguggaaaugcuguauaugu

SEQ ID NO: 218103 - RNA, 22 nt, Human
ugugugcuaguuuugucaguau

SEQ ID NO: 218104 - RNA, 22 nt, Human
ugugguuuguaagcaaagcaaa

SEQ ID NO: 218105 - RNA, 22 nt, Human
uguggugcucagggaggauggg

SEQ ID NO: 218106 - RNA, 19 nt, Human
uuggagcaucccaaaggcu

SEQ ID NO: 218107 - RNA, 17 nt, Human
uguguaaguugcauaga

SEQ ID NO: 218108 - RNA, 22 nt, Human
ugugcuggcuucugugagcuga

SEQ ID NO: 218109 - RNA, 22 nt, Human
uugcugagcugaaccagccacc

SEQ ID NO: 218110 - RNA, 22 nt, Human
uugcucuuaccauuauguguga

SEQ ID NO: 218111 - RNA, 22 nt, Human
ugugcuaauguuaggauugaau

SEQ ID NO: 218112 - RNA, 22 nt, Human
ugugcgucuguguacagaugug

SEQ ID NO: 218113 - RNA, 22 nt, Human
ugugcugcagcgagagcuacga

SEQ ID NO: 218114 - RNA, 22 nt, Human
uugcucaccugagaagaauaga

SEQ ID NO: 218115 - RNA, 22 nt, Human
uugcucaugucaccaaagcaca

SEQ ID NO: 218116 - RNA, 22 nt, Human
ugugccuuucacuaugucauuc

SEQ ID NO: 218117 - RNA, 22 nt, Human
ugugcgcgugugcuuugugugu

SEQ ID NO: 218118 - RNA, 22 nt, Human
ugugcagugcguggguguugaa

SEQ ID NO: 218119 - RNA, 22 nt, Human
ugugcaucuggaggcaauguuu

SEQ ID NO: 218120 - RNA, 22 nt, Human
ugugccuagauuccaugcacuc

SEQ ID NO: 218121 - RNA, 22 nt, Human
ugugggaggauuuaggugaauc

SEQ ID NO: 218122 - RNA, 22 nt, Human
uugcugguggcucugauuucau

SEQ ID NO: 218123 - RNA, 22 nt, Human
uguggcuuaggugagcauguga

SEQ ID NO: 218124 - RNA, 21 nt, Human
uguggccauuugaaaacaggg

SEQ ID NO: 218125 - RNA, 22 nt, Human
uguggcucugaugucauaaagg

SEQ ID NO: 218126 - RNA, 22 nt, Human
uugcugcgcugaccuccaguga

SEQ ID NO: 218127 - RNA, 21 nt, Human
uugcuggagcaauguaaauca

SEQ ID NO: 218128 - RNA, 22 nt, Human
uugcuggaguagaaaacuuaac

SEQ ID NO: 218129 - RNA, 22 nt, Human
ugugcuugucuguuuugauugu

SEQ ID NO: 218130 - RNA, 22 nt, Human
uugcugggauucauugaagggu

SEQ ID NO: 218131 - RNA, 22 nt, Human
ugccaacaggcuugccugaugu

SEQ ID NO: 218132 - RNA, 22 nt, Human
ugcauuuuuaauuuggaaaaaa

SEQ ID NO: 218133 - RNA, 22 nt, Human
ugccaaagauagagguuugagu

SEQ ID NO: 218134 - RNA, 22 nt, Human
ugugggcguggguuggggaggg

SEQ ID NO: 218135 - RNA, 22 nt, Human
ugcccacaggaagacaccagcg

SEQ ID NO: 218136 - RNA, 22 nt, Human
ugccauuggucuuaaggcuagc

SEQ ID NO: 218137 - RNA, 22 nt, Human
ugccauauuuugaggauguaca

SEQ ID NO: 218138 - RNA, 22 nt, Human
uguggguggucagcgugugaug

SEQ ID NO: 218139 - RNA, 22 nt, Human
ugugguagagcuuaaaugaggu

SEQ ID NO: 218140 - RNA, 22 nt, Human
ugugguuggggucagauaggga

SEQ ID NO: 218141 - RNA, 22 nt, Human
uguguguauauauauguaucau

SEQ ID NO: 218142 - RNA, 22 nt, Human
ugugugguaaugagagauccaa

SEQ ID NO: 218143 - RNA, 22 nt, Human
uguguguaugagcauuuguaug

SEQ ID NO: 218144 - RNA, 22 nt, Human
ugccucucuggaucugcuguga

SEQ ID NO: 218145 - RNA, 22 nt, Human
ugcccacuuugucuccaugcug

SEQ ID NO: 218146 - RNA, 22 nt, Human
uguguaacaacauaaugguuau

SEQ ID NO: 218147 - RNA, 22 nt, Human
uguggugcagcgggaacagcuu

SEQ ID NO: 218148 - RNA, 20 nt, Human
ugucugugugugauaauagu

SEQ ID NO: 218149 - RNA, 22 nt, Human
ugucuuaugcugcauagacuau

SEQ ID NO: 218150 - RNA, 22 nt, Human
ugucuucagguuccucaccacu

SEQ ID NO: 218151 - RNA, 22 nt, Human
ugugcagaaaacacuuaagaac

SEQ ID NO: 218152 - RNA, 22 nt, Human
ugugcaguauugaaauauaugu

SEQ ID NO: 218153 - RNA, 20 nt, Human
ugcacggcugugugugugca

SEQ ID NO: 218154 - RNA, 22 nt, Human
ugcaggagcccaggaauacuau

SEQ ID NO: 218155 - RNA, 22 nt, Human
ugcaggguuucaauacacagga

SEQ ID NO: 218156 - RNA, 22 nt, Human
ugcagguggcagcggggcacca

SEQ ID NO: 218157 - RNA, 22 nt, Human
ugcagggucuccuguacuuggg

SEQ ID NO: 218158 - RNA, 18 nt, Human
ugcaggggaggggugaua

SEQ ID NO: 218159 - RNA, 22 nt, Human
ugcaggaagcucagcggggccg

SEQ ID NO: 218160 - RNA, 22 nt, Human
uguggccaccagagcugcuauu

SEQ ID NO: 218161 - RNA, 22 nt, Human
ugcaguugcguuugcauuccau

SEQ ID NO: 218162 - RNA, 22 nt, Human
ugcauugccucuauucauuaua

SEQ ID NO: 218163 - RNA, 22 nt, Human
ugcauaagguuaaauuagcaga

SEQ ID NO: 218164 - RNA, 22 nt, Human
ugcgccuccugcugccugcccu

SEQ ID NO: 218165 - RNA, 22 nt, Human
uguuccuuuuguuguuuuguuu

SEQ ID NO: 218166 - RNA, 22 nt, Human
uguuccacgcguaguuccugcu

SEQ ID NO: 218167 - RNA, 19 nt, Human
ugcgggcugcggucagggc

SEQ ID NO: 218168 - RNA, 22 nt, Human
ugcggcucaaagggaaggccuu

SEQ ID NO: 218169 - RNA, 22 nt, Human
ugcggaaggcagcgcagggugg

SEQ ID NO: 218170 - RNA, 22 nt, Human
ugcgcgccgacggcuccgugac

SEQ ID NO: 218171 - RNA, 22 nt, Human
ugcgcgcaccugcauauauaug

SEQ ID NO: 218172 - RNA, 19 nt, Human
uguucuacuugcuaguauu

SEQ ID NO: 218173 - RNA, 22 nt, Human
ugcggugcgcccgggcgagugc

SEQ ID NO: 218174 - RNA, 22 nt, Human
uguucugaggaggguuucaagg

SEQ ID NO: 218175 - RNA, 22 nt, Human
uguugaaacagcuauugacuuu

SEQ ID NO: 218176 - RNA, 22 nt, Human
uguucuucaaacucaguuccac

SEQ ID NO: 218177 - RNA, 21 nt, Human
ugcuaagugucacaugucugc

SEQ ID NO: 218178 - RNA, 22 nt, Human
ugcuaaugaauggaggaucuga

SEQ ID NO: 218179 - RNA, 22 nt, Human
ugcuaaugagugcugugugaag

SEQ ID NO: 218180 - RNA, 22 nt, Human
ugcuacaucuacugguaagggu

SEQ ID NO: 218181 - RNA, 22 nt, Human
ugcguggauuuaggagugaggg

SEQ ID NO: 218182 - RNA, 22 nt, Human
uguuggaauaagugcuugaagg

SEQ ID NO: 218183 - RNA, 22 nt, Human
uguugcauguggcuguuugcca

SEQ ID NO: 218184 - RNA, 22 nt, Human
uguugccaucuaaaauguuacu

SEQ ID NO: 218185 - RNA, 19 nt, Human
uguugcagcuugaucggua

SEQ ID NO: 218186 - RNA, 22 nt, Human
uguugaugaccacaauuuaugc

SEQ ID NO: 218187 - RNA, 22 nt, Human
uguugauuaauuuucccaaaca

SEQ ID NO: 218188 - RNA, 22 nt, Human
uguugagaacaucucggggaca

SEQ ID NO: 218189 - RNA, 22 nt, Human
ugcuagggcaggaggugaggag

SEQ ID NO: 218190 - RNA, 22 nt, Human
uguguuguuuggggauguccau

SEQ ID NO: 218191 - RNA, 22 nt, Human
uguguuguuggggauguuuuca

SEQ ID NO: 218192 - RNA, 22 nt, Human
uguguucuuugcuuaauuaaag

SEQ ID NO: 218193 - RNA, 22 nt, Human
uguguuucggauagcagauucu

SEQ ID NO: 218194 - RNA, 19 nt, Human
uguguguguuuuguuugaa

SEQ ID NO: 218195 - RNA, 22 nt, Human
uguguucagaagaggcugccgg

SEQ ID NO: 218196 - RNA, 22 nt, Human
uguguguuguuuugccagaaua

SEQ ID NO: 218197 - RNA, 22 nt, Human
uguguuacaauaauggcaagua

SEQ ID NO: 218198 - RNA, 22 nt, Human
ugccuggacgacaucacaguga

SEQ ID NO: 218199 - RNA, 23 nt, Human
ugugugugugugugugugugugu

SEQ ID NO: 218200 - RNA, 22 nt, Human
uguuaaaaagucccuguuuugu

SEQ ID NO: 218201 - RNA, 22 nt, Human
ugccuuuggcuguucugugacc

SEQ ID NO: 218202 - RNA, 22 nt, Human
ugccuuccuucuccccuccuuc

SEQ ID NO: 218203 - RNA, 22 nt, Human
uguuccucuuagucuuaugugu

SEQ ID NO: 218204 - RNA, 22 nt, Human
uguucccgaugacaggaccagg

SEQ ID NO: 218205 - RNA, 22 nt, Human
uguuacugaaugucucugcuuu

SEQ ID NO: 218206 - RNA, 23 nt, Human
uguuaucacauguuccuuuaaau

SEQ ID NO: 218207 - RNA, 22 nt, Human
uguuauugccucaugagacucc

SEQ ID NO: 218208 - RNA, 22 nt, Human
ugaggaaugugacaaaaccaag

SEQ ID NO: 218209 - RNA, 22 nt, Human
ugagcuauuucaccauauagau

SEQ ID NO: 218210 - RNA, 22 nt, Human
uggugcacgugggcagucggcc

SEQ ID NO: 218211 - RNA, 23 nt, Human
uggugcagcgcaggccggguggc

SEQ ID NO: 218212 - RNA, 21 nt, Human
ugaggccugccagucucagaa

SEQ ID NO: 218213 - RNA, 22 nt, Human
ugguggaggugggggguauuuu

SEQ ID NO: 218214 - RNA, 22 nt, Human
uggugcuuuuguggaugcuaac

SEQ ID NO: 218215 - RNA, 19 nt, Human
ugguggaggugcaccugac

SEQ ID NO: 218216 - RNA, 22 nt, Human
ugggggaugacuugcucuuuca

SEQ ID NO: 218217 - RNA, 22 nt, Human
ugggggauauggcuccauacuu

SEQ ID NO: 218218 - RNA, 22 nt, Human
uggugacaucuaccuagguaaa

SEQ ID NO: 218219 - RNA, 22 nt, Human
ugagccugaguguguauugaac

SEQ ID NO: 218220 - RNA, 22 nt, Human
ugagccauguucaugagguuca

SEQ ID NO: 218221 - RNA, 22 nt, Human
ugaugaugaagaaauauuauca

SEQ ID NO: 218222 - RNA, 22 nt, Human
ugaugaucaugcagguugguuu

SEQ ID NO: 218223 - RNA, 22 nt, Human
ugaguugcagucaauauugcaa

SEQ ID NO: 218224 - RNA, 22 nt, Human
ugaguuuuggaagauguuacag

SEQ ID NO: 218225 - RNA, 22 nt, Human
ugagugugugucuuggguaccg

SEQ ID NO: 218226 - RNA, 22 nt, Human
ugguugugcuucuuugccucag

SEQ ID NO: 218227 - RNA, 22 nt, Human
ugguuuacucuguaaaccagga

SEQ ID NO: 218228 - RNA, 22 nt, Human
ugaguuagcucuauucuuuugg

SEQ ID NO: 218229 - RNA, 22 nt, Human
ugaguucugacugagcaugggg

SEQ ID NO: 218230 - RNA, 22 nt, Human
ugguugcaguggugcuuauaca

SEQ ID NO: 218231 - RNA, 20 nt, Human
ugguguccuaugcuugugcu

SEQ ID NO: 218232 - RNA, 18 nt, Human
ugguuggugggggugaag

SEQ ID NO: 218233 - RNA, 22 nt, Human
ugguugguuaaugugcccauuu

SEQ ID NO: 218234 - RNA, 22 nt, Human
ugguugugcucuguuugaaagu

SEQ ID NO: 218235 - RNA, 22 nt, Human
ugaggggaggggagaaaauggu

SEQ ID NO: 218236 - RNA, 22 nt, Human
ugagggauuucuggccuuaacu

SEQ ID NO: 218237 - RNA, 22 nt, Human
ugaggucaggcagggguuuggc

SEQ ID NO: 218238 - RNA, 17 nt, Human
ugguucuuuuccugacc

SEQ ID NO: 218239 - RNA, 22 nt, Human
ugguucugucugugcugggggg

SEQ ID NO: 218240 - RNA, 22 nt, Human
uggugugggauccugggaagga

SEQ ID NO: 218241 - RNA, 23 nt, Human
uggugugaggaaggaagacuuua

SEQ ID NO: 218242 - RNA, 22 nt, Human
ugagguuacauuaggaauaacc

SEQ ID NO: 218243 - RNA, 22 nt, Human
ugcacagagggaggcauaaaau

SEQ ID NO: 218244 - RNA, 21 nt, Human
ugucugcaauuccagggaacc

SEQ ID NO: 218245 - RNA, 22 nt, Human
ugucugcauucgaguucaugga

SEQ ID NO: 218246 - RNA, 21 nt, Human
ugcaacugaaaggaauauggu

SEQ ID NO: 218247 - RNA, 22 nt, Human
ugucauuuauucucuuauucua

SEQ ID NO: 218248 - RNA, 22 nt, Human
ugcaaauucuuuacucugugau

SEQ ID NO: 218249 - RNA, 23 nt, Human
ugcaaaauuugcagaguucgaug

SEQ ID NO: 218250 - RNA, 22 nt, Human
ugauucuuugaccaaaaaauug

SEQ ID NO: 218251 - RNA, 22 nt, Human
ugauugcucagcuagccucuuu

SEQ ID NO: 218252 - RNA, 22 nt, Human
uguauuuauuuuucaacuacca

SEQ ID NO: 218253 - RNA, 19 nt, Human
uguauuuauauuucugugc

SEQ ID NO: 218254 - RNA, 18 nt, Human
uguauuguucacuucugu

SEQ ID NO: 218255 - RNA, 22 nt, Human
ugucagacagggcugcagucag

SEQ ID NO: 218256 - RNA, 21 nt, Human
ugucagcaacaauacuuucuc

SEQ ID NO: 218257 - RNA, 22 nt, Human
ugauuuguuuaaauugcucguu

SEQ ID NO: 218258 - RNA, 22 nt, Human
ugcaaaaagagcgaggagcccu

SEQ ID NO: 218259 - RNA, 22 nt, Human
uguauuugaagaaagagcuucu

SEQ ID NO: 218260 - RNA, 22 nt, Human
ugucaaguuguuaaguucuggg

SEQ ID NO: 218261 - RNA, 22 nt, Human
uguauauguguguagcauguua

SEQ ID NO: 218262 - RNA, 20 nt, Human
ugauuauuccaacaagaaug

SEQ ID NO: 218263 - RNA, 22 nt, Human
ugauguuucugaagggguuacu

SEQ ID NO: 218264 - RNA, 22 nt, Human
ugauguggaucuauaacuguaa

SEQ ID NO: 218265 - RNA, 22 nt, Human
uguaucucugacacagucucac

SEQ ID NO: 218266 - RNA, 22 nt, Human
uguauguguuuuauguguguuu

SEQ ID NO: 218267 - RNA, 22 nt, Human
uguauggguaggaaacagcugg

SEQ ID NO: 218268 - RNA, 22 nt, Human
ugauucacagacuucacaaggc

SEQ ID NO: 218269 - RNA, 22 nt, Human
uguauugaggauucauuuuugu

SEQ ID NO: 218270 - RNA, 22 nt, Human
uguauugugggugucagagugc

SEQ ID NO: 218271 - RNA, 22 nt, Human
uguacuacaugauuauugacca

SEQ ID NO: 218272 - RNA, 22 nt, Human
uguagcaauauaucagugcaca

SEQ ID NO: 218273 - RNA, 22 nt, Human
ugauggaucuguuggcggguuu

SEQ ID NO: 218274 - RNA, 17 nt, Human
uguaccgaguguguaua

SEQ ID NO: 218275 - RNA, 22 nt, Human
ugaucaguacuguaugagggau

SEQ ID NO: 218276 - RNA, 22 nt, Human
uguagggaucugccucuuccuc

SEQ ID NO: 218277 - RNA, 22 nt, Human
uguaggcacauguauauauccc

SEQ ID NO: 218278 - RNA, 21 nt, Human
uguauacacacauuguaccaa

SEQ ID NO: 218279 - RNA, 22 nt, Human
uggcuuuuuucuccccuuggau

SEQ ID NO: 218280 - RNA, 22 nt, Human
ugggaacuggaaaaaaugaagu

SEQ ID NO: 218281 - RNA, 22 nt, Human
ugggaaacucuaaacuugagua

SEQ ID NO: 218282 - RNA, 22 nt, Human
ugaaccuaacauuucuggcagu

SEQ ID NO: 218283 - RNA, 22 nt, Human
ugaaccgcuucauggugccugu

SEQ ID NO: 218284 - RNA, 22 nt, Human
ugaaccaugaauuacaggagca

SEQ ID NO: 218285 - RNA, 22 nt, Human
ugaacuaauguuguguccuaau

SEQ ID NO: 218286 - RNA, 22 nt, Human
ugggauauagaauuggcagagu

SEQ ID NO: 218287 - RNA, 22 nt, Human
ugaagccaugcuaaauguuaca

SEQ ID NO: 218288 - RNA, 22 nt, Human
ugaagccacacuagcuuguccu

SEQ ID NO: 218289 - RNA, 22 nt, Human
ugaagaauuccauggcuuccau

SEQ ID NO: 218290 - RNA, 22 nt, Human
ugaagacaguuuuacucaugag

SEQ ID NO: 218291 - RNA, 22 nt, Human
ugggacaugaugcauuugaaag

SEQ ID NO: 218292 - RNA, 22 nt, Human
ugggaauuuaugagaaaauaua

SEQ ID NO: 218293 - RNA, 22 nt, Human
ugggagccuuccacugggggaa

SEQ ID NO: 218294 - RNA, 22 nt, Human
ugggagagaagcugaggcaggg

SEQ ID NO: 218295 - RNA, 22 nt, Human
ugaacuucccauguacagacug

SEQ ID NO: 218296 - RNA, 22 nt, Human
ucuuuuaucuguuguguaacaa

SEQ ID NO: 218297 - RNA, 22 nt, Human
ucuuuucagccagcugguagga

SEQ ID NO: 218298 - RNA, 22 nt, Human
ucuuugcauggacauguguuuu

SEQ ID NO: 218299 - RNA, 22 nt, Human
ucuuuguuagucagaauugauc

SEQ ID NO: 218300 - RNA, 23 nt, Human
uggcucugagcuuccugguggcc

SEQ ID NO: 218301 - RNA, 22 nt, Human
uggcucuucucaagcauuggcu

SEQ ID NO: 218302 - RNA, 22 nt, Human
uggcugagcugcagcguggcuu

SEQ ID NO: 218303 - RNA, 22 nt, Human
uggcugggagcuggaacugggc

SEQ ID NO: 218304 - RNA, 22 nt, Human
uggcuguuggagcuggaagaug

SEQ ID NO: 218305 - RNA, 22 nt, Human
uggcugaggcuuuucuuaaaga

SEQ ID NO: 218306 - RNA, 22 nt, Human
uggcuuauggguccucccucuu

SEQ ID NO: 218307 - RNA, 22 nt, Human
uggcuuuugaaaaggugaugua

SEQ ID NO: 218308 - RNA, 22 nt, Human
ugaaauuuuuuggagauaauuu

SEQ ID NO: 218309 - RNA, 22 nt, Human
ugaaauguggagaugguaagua

SEQ ID NO: 218310 - RNA, 21 nt, Human
ugaacaccaggagaaaucggu

SEQ ID NO: 218311 - RNA, 16 nt, Human
uggcuuccaguucucu

SEQ ID NO: 218312 - RNA, 22 nt, Human
ugggauucucagaaacacagag

SEQ ID NO: 218313 - RNA, 22 nt, Human
ugggauggacuuuagagaaucg

SEQ ID NO: 218314 - RNA, 20 nt, Human
ugggauggaaucaccugcac

SEQ ID NO: 218315 - RNA, 22 nt, Human
ugaaggaggugaauccaugcau

SEQ ID NO: 218316 - RNA, 22 nt, Human
ugaaggagucgaggugggugag

SEQ ID NO: 218317 - RNA, 22 nt, Human
ugggcaaaugcuuuuuagucaa

SEQ ID NO: 218318 - RNA, 22 nt, Human
ugggcagggauuuggggaaacu

SEQ ID NO: 218319 - RNA, 22 nt, Human
ugggccacguggagucuguagg

SEQ ID NO: 218320 - RNA, 22 nt, Human
ugggcagagggugaggaaggcg

SEQ ID NO: 218321 - RNA, 21 nt, Human
ugaagggugagauauaaguga

SEQ ID NO: 218322 - RNA, 22 nt, Human
ugaaggggaaagucuugcuaua

SEQ ID NO: 218323 - RNA, 22 nt, Human
ugaagcuaguauuaacucagau

SEQ ID NO: 218324 - RNA, 22 nt, Human
ugggcacacugaaucugcuauu

SEQ ID NO: 218325 - RNA, 22 nt, Human
ugaagguggcuugcagcuaguc

SEQ ID NO: 218326 - RNA, 22 nt, Human
ugaauaaucuuggguauuaaua

SEQ ID NO: 218327 - RNA, 22 nt, Human
ugaauaaauaaacuuuuacuac

SEQ ID NO: 218328 - RNA, 22 nt, Human
ugggccgugagacgucucuggg

SEQ ID NO: 218329 - RNA, 22 nt, Human
ugggccaaaugucugcauaagu

SEQ ID NO: 218330 - RNA, 22 nt, Human
ugggccucuguuuccucaucug

SEQ ID NO: 218331 - RNA, 21 nt, Human
uggggaugcauugcagaggca

SEQ ID NO: 218332 - RNA, 22 nt, Human
ugggcuguuucuuaaggauaug

SEQ ID NO: 218333 - RNA, 22 nt, Human
uggggaagaacuugccauuuca

SEQ ID NO: 218334 - RNA, 22 nt, Human
ugaaucaaugaauugcacuuca

SEQ ID NO: 218335 - RNA, 22 nt, Human
ugacacagaccaaguggugcug

SEQ ID NO: 218336 - RNA, 22 nt, Human
ugacagaggagcuggaaugauu

SEQ ID NO: 218337 - RNA, 22 nt, Human
ugaauuuuggcaauuuucugug

SEQ ID NO: 218338 - RNA, 22 nt, Human
ugacagugugcccggagguuag

SEQ ID NO: 218339 - RNA, 22 nt, Human
ugaauucaaacuuuuuaacaag

SEQ ID NO: 218340 - RNA, 22 nt, Human
ugaauuuguaggaauucuccau

SEQ ID NO: 218341 - RNA, 22 nt, Human
ugaauuuuaacauucugcugga

SEQ ID NO: 218342 - RNA, 22 nt, Human
ugaauuacacugggaucagggc

SEQ ID NO: 218343 - RNA, 22 nt, Human
ugaauggugcccuagagggaug

SEQ ID NO: 218344 - RNA, 22 nt, Human
ugaaugaacugaugaacuuaac

SEQ ID NO: 218345 - RNA, 22 nt, Human
uggggcuuucgcggagcgucgg

SEQ ID NO: 218346 - RNA, 22 nt, Human
uggggcugguaccguaauauau

SEQ ID NO: 218347 - RNA, 22 nt, Human
uggggcuauggcccgaccacgu

SEQ ID NO: 218348 - RNA, 22 nt, Human
uggggcggaaggaggagaggug

SEQ ID NO: 218349 - RNA, 22 nt, Human
uggggcgccuggcugaggcugc

SEQ ID NO: 218350 - RNA, 22 nt, Human
ucugcggccggaauucccuuca

SEQ ID NO: 218351 - RNA, 22 nt, Human
uggaacugauuaaaagggcaga

SEQ ID NO: 218352 - RNA, 23 nt, Human
ucugccuccuaauuguugguguc

SEQ ID NO: 218353 - RNA, 22 nt, Human
ucugccuucaggagcagacucu

SEQ ID NO: 218354 - RNA, 22 nt, Human
ucugcaugccucaggaggccug

SEQ ID NO: 218355 - RNA, 22 nt, Human
ucuggaaauggaaguaacuaug

SEQ ID NO: 218356 - RNA, 22 nt, Human
uggaagaaaugguugagccaug

SEQ ID NO: 218357 - RNA, 22 nt, Human
uggaacugguuugcuucagacu

SEQ ID NO: 218358 - RNA, 22 nt, Human
uggaaauacaagaaguauguca

SEQ ID NO: 218359 - RNA, 22 nt, Human
uggaaaggcccauaaaaggaua

SEQ ID NO: 218360 - RNA, 21 nt, Human
ucugccaguuucucuuacuuu

SEQ ID NO: 218361 - RNA, 22 nt, Human
uggaaauagauguaggaaauug

SEQ ID NO: 218362 - RNA, 17 nt, Human
ucugcagaggcaaaccu

SEQ ID NO: 218363 - RNA, 22 nt, Human
ugcugccucugaauggagcagu

SEQ ID NO: 218364 - RNA, 22 nt, Human
uggagcuuuguguauuuuuaau

SEQ ID NO: 218365 - RNA, 22 nt, Human
uggaggaugacagagaugggcu

SEQ ID NO: 218366 - RNA, 22 nt, Human
uggaggauggaaggaaagcugg

SEQ ID NO: 218367 - RNA, 22 nt, Human
uggagcaagaagggaggcagaa

SEQ ID NO: 218368 - RNA, 21 nt, Human
uggagcagggaggauuugggg

SEQ ID NO: 218369 - RNA, 22 nt, Human
uggagagcaaugaggggcaggc

SEQ ID NO: 218370 - RNA, 22 nt, Human
uggagccuugugagaccacaau

SEQ ID NO: 218371 - RNA, 22 nt, Human
ucugggccaacccuuccauggg

SEQ ID NO: 218372 - RNA, 21 nt, Human
ucuggggacaagguccaggaa

SEQ ID NO: 218373 - RNA, 22 nt, Human
uggaagaucugguguagcuccu

SEQ ID NO: 218374 - RNA, 22 nt, Human
uggaaggggagcuggaaagggg

SEQ ID NO: 218375 - RNA, 22 nt, Human
uggaaggggccaggcgcggagu

SEQ ID NO: 218376 - RNA, 21 nt, Human
uggaagggaagucuugguugu

SEQ ID NO: 218377 - RNA, 22 nt, Human
uggagagaaguucuauaaauca

SEQ ID NO: 218378 - RNA, 22 nt, Human
uggagagauagucauucuagag

SEQ ID NO: 218379 - RNA, 22 nt, Human
ucugguuuggguugcuauggcu

SEQ ID NO: 218380 - RNA, 22 nt, Human
uggacuguaauguguguggacc

SEQ ID NO: 218381 - RNA, 22 nt, Human
ucuuuaaauucuuaugagugaa

SEQ ID NO: 218382 - RNA, 22 nt, Human
ucuuggggagacuaguguuugg

SEQ ID NO: 218383 - RNA, 22 nt, Human
ucuuuauuucccuaacuugcua

SEQ ID NO: 218384 - RNA, 23 nt, Human
ucuuuccuuucauacagucagcu

SEQ ID NO: 218385 - RNA, 22 nt, Human
uggccucauggccuuaucuggg

SEQ ID NO: 218386 - RNA, 22 nt, Human
uggccauuuacucuguaagagu

SEQ ID NO: 218387 - RNA, 22 nt, Human
uggccaaucagcugugaccugc

SEQ ID NO: 218388 - RNA, 22 nt, Human
uggcaguaaagcuggaaaagug

SEQ ID NO: 218389 - RNA, 22 nt, Human
uggcagccucugguccuuaguu

SEQ ID NO: 218390 - RNA, 22 nt, Human
uggcaugugaauuguuacauug

SEQ ID NO: 218391 - RNA, 22 nt, Human
uggcaggggaaaagggguggga

SEQ ID NO: 218392 - RNA, 22 nt, Human
uggcagccugcgugaaggagcu

SEQ ID NO: 218393 - RNA, 22 nt, Human
uggcagcucauuuggaaaugga

SEQ ID NO: 218394 - RNA, 22 nt, Human
uggagucuugcuuugggagugc

SEQ ID NO: 218395 - RNA, 22 nt, Human
uggaguuuauuugaauucuugg

SEQ ID NO: 218396 - RNA, 22 nt, Human
uggagucucacuuccuggaauu

SEQ ID NO: 218397 - RNA, 22 nt, Human
ucuguucucuuguucugacggu

SEQ ID NO: 218398 - RNA, 21 nt, Human
uggaggcguaaucacuguuga

SEQ ID NO: 218399 - RNA, 19 nt, Human
uggaggcggguggcccaga

SEQ ID NO: 218400 - RNA, 22 nt, Human
ucuguucaugucuuuuuaagug

SEQ ID NO: 218401 - RNA, 22 nt, Human
ucuguuuuucagaccuuuuugg

SEQ ID NO: 218402 - RNA, 22 nt, Human
uggaugcuccaaguagaccuua

SEQ ID NO: 218403 - RNA, 22 nt, Human
uggaugccuugggggaggagga

SEQ ID NO: 218404 - RNA, 22 nt, Human
uggaugccauuugauuaaggcu

SEQ ID NO: 218405 - RNA, 22 nt, Human
uggaugagugaauggauaaauc

SEQ ID NO: 218406 - RNA, 22 nt, Human
uggauauagcugaggugucuug

SEQ ID NO: 218407 - RNA, 22 nt, Human
uggcacugaagcuggaaagccu

SEQ ID NO: 218408 - RNA, 22 nt, Human
uggcacguuggauugggaguuc

SEQ ID NO: 218409 - RNA, 22 nt, Human
uggcagcauuuuuuccagaaca

SEQ ID NO: 218410 - RNA, 22 nt, Human
uggauuguauugauugguuggc

SEQ ID NO: 218411 - RNA, 22 nt, Human
ucuuauucuuuuaaacaacgca

SEQ ID NO: 218412 - RNA, 22 nt, Human
uccuuuuuagguuauuguacau

SEQ ID NO: 218413 - RNA, 22 nt, Human
ucgaaacuucucauuuaucugu

SEQ ID NO: 218414 - RNA, 21 nt, Human
ugccuggccuuugcuuuuccu

SEQ ID NO: 218415 - RNA, 22 nt, Human
ucgaaugccaacaccgaaguuu

SEQ ID NO: 218416 - RNA, 22 nt, Human
ugccuggugcggagugaguggc

SEQ ID NO: 218417 - RNA, 23 nt, Human
ugccggaucuacuuuggguucuc

SEQ ID NO: 218418 - RNA, 22 nt, Human
ugccgccgugggucccgacgcg

SEQ ID NO: 218419 - RNA, 22 nt, Human
ugccgcaggaggggcgauuucu

SEQ ID NO: 218420 - RNA, 22 nt, Human
ugcccugucccuagguuugugg

SEQ ID NO: 218421 - RNA, 22 nt, Human
uccugagaagcacuuaauacac

SEQ ID NO: 218422 - RNA, 22 nt, Human
uccugaaugguguaauagguuu

SEQ ID NO: 218423 - RNA, 22 nt, Human
uccucugagguccucucggcca

SEQ ID NO: 218424 - RNA, 22 nt, Human
ugcccuuucuccagugaccauu

SEQ ID NO: 218425 - RNA, 22 nt, Human
ugcccugcagacccugcagugu

SEQ ID NO: 218426 - RNA, 22 nt, Human
uccugggucugugagccauacu

SEQ ID NO: 218427 - RNA, 22 nt, Human
ugccaucaugucagauuuggga

SEQ ID NO: 218428 - RNA, 22 nt, Human
ugccaucuuugccccuauuuua

SEQ ID NO: 218429 - RNA, 22 nt, Human
ugccaugguuguacaguagcag

SEQ ID NO: 218430 - RNA, 20 nt, Human
ugccagagagcucauacccu

SEQ ID NO: 218431 - RNA, 22 nt, Human
ugccagauuaugucuccagggc

SEQ ID NO: 218432 - RNA, 22 nt, Human
ugccagcuccgaggagcugcag

SEQ ID NO: 218433 - RNA, 22 nt, Human
ugccagugugccuuccgcucac

SEQ ID NO: 218434 - RNA, 22 nt, Human
ugccagucggcacuuuaucugg

SEQ ID NO: 218435 - RNA, 22 nt, Human
uccucagcaagacgcuggcagc

SEQ ID NO: 218436 - RNA, 22 nt, Human
ugccaguaauuguccuguagcu

SEQ ID NO: 218437 - RNA, 22 nt, Human
ugcauugccauagcagggggau

SEQ ID NO: 218438 - RNA, 22 nt, Human
ugcauuauaacaauaaggcuua

SEQ ID NO: 218439 - RNA, 22 nt, Human
ugcauucugaacguaaauguga

SEQ ID NO: 218440 - RNA, 22 nt, Human
ucccuuuucauccuaucccagc

SEQ ID NO: 218441 - RNA, 22 nt, Human
ucccuuuuagccccgcccuccu

SEQ ID NO: 218442 - RNA, 22 nt, Human
ucccuucccaccccugccuuuu

SEQ ID NO: 218443 - RNA, 22 nt, Human
ucccuugauauccuuuuaaugg

SEQ ID NO: 218444 - RNA, 22 nt, Human
ugcaugacugaucuguuuguca

SEQ ID NO: 218445 - RNA, 23 nt, Human
ugcaugagcaucuccaccucagu

SEQ ID NO: 218446 - RNA, 22 nt, Human
ugcaugacaauugccgucaagu

SEQ ID NO: 218447 - RNA, 22 nt, Human
ugcaugcagcuggucgggcgcc

SEQ ID NO: 218448 - RNA, 22 nt, Human
uccguugaggcugccaggcgag

SEQ ID NO: 218449 - RNA, 17 nt, Human
uccuacaggugugcuga

SEQ ID NO: 218450 - RNA, 22 nt, Human
ugcguuuaguuucaagacacgu

SEQ ID NO: 218451 - RNA, 22 nt, Human
ugcguugaggaccgcgagggcg

SEQ ID NO: 218452 - RNA, 21 nt, Human
ugcguaugucuuguauuacuc

SEQ ID NO: 218453 - RNA, 22 nt, Human
ugcggugcagcccugcccucuc

SEQ ID NO: 218454 - RNA, 22 nt, Human
ugcgccaggacacccguggcgg

SEQ ID NO: 218455 - RNA, 22 nt, Human
ucgccauguacaugaagggcgg

SEQ ID NO: 218456 - RNA, 22 nt, Human
ugcuauuuuguuuucaguccau

SEQ ID NO: 218457 - RNA, 22 nt, Human
ucggcgaccugucauggaccaa

SEQ ID NO: 218458 - RNA, 22 nt, Human
ucggauuggggaugggugggag

SEQ ID NO: 218459 - RNA, 22 nt, Human
ugcucgauuauuucauuuugca

SEQ ID NO: 218460 - RNA, 22 nt, Human
ugcuauucuuggagcugaugga

SEQ ID NO: 218461 - RNA, 22 nt, Human
ugcuaucuagaaauacuggguu

SEQ ID NO: 218462 - RNA, 22 nt, Human
ucuaagcuugaucacuugcuuu

SEQ ID NO: 218463 - RNA, 22 nt, Human
ucuaaucuacaaaaggaaauuc

SEQ ID NO: 218464 - RNA, 22 nt, Human
ugcugacuauacauuuagcauu

SEQ ID NO: 218465 - RNA, 22 nt, Human
ugcugcacuuauggcucugagg

SEQ ID NO: 218466 - RNA, 22 nt, Human
ucuaaaaauuagaaauuagguc

SEQ ID NO: 218467 - RNA, 22 nt, Human
ucgugagugcugucaccugcug

SEQ ID NO: 218468 - RNA, 22 nt, Human
ucgugaagaaauguggacuuca

SEQ ID NO: 218469 - RNA, 22 nt, Human
ucguccaauaaccugccagcgc

SEQ ID NO: 218470 - RNA, 22 nt, Human
ugcucuguucaguguaucuugu

SEQ ID NO: 218471 - RNA, 22 nt, Human
ucguauucagugcaagucaacg

SEQ ID NO: 218472 - RNA, 22 nt, Human
ugcugaccggccuccccccagc

SEQ ID NO: 218473 - RNA, 22 nt, Human
ucgggccacauccacacaucca

SEQ ID NO: 218474 - RNA, 21 nt, Human
ucgggcggcggcugaggcggc

SEQ ID NO: 218475 - RNA, 22 nt, Human
ugcucugcuaggagaagaauga

SEQ ID NO: 218476 - RNA, 22 nt, Human
ugcagaauauucuggugacaau

SEQ ID NO: 218477 - RNA, 22 nt, Human
ugcacugccuuucuuggcauga

SEQ ID NO: 218478 - RNA, 19 nt, Human
ugcagcacuaaaaacuuuc

SEQ ID NO: 218479 - RNA, 22 nt, Human
ugcagacuguuucuugacugaa

SEQ ID NO: 218480 - RNA, 22 nt, Human
ugcacgcacuugcucuccagcg

SEQ ID NO: 218481 - RNA, 22 nt, Human
ugcacgcgcccuucgauggccc

SEQ ID NO: 218482 - RNA, 18 nt, Human
ugcagcuuugugauuggc

SEQ ID NO: 218483 - RNA, 22 nt, Human
ugcagcgugaggacagcugagc

SEQ ID NO: 218484 - RNA, 22 nt, Human
uccaugcaguagaggcgcuggg

SEQ ID NO: 218485 - RNA, 22 nt, Human
uccauguugauaaucuugugaa

SEQ ID NO: 218486 - RNA, 22 nt, Human
ugcaaggcacccacucugcuuu

SEQ ID NO: 218487 - RNA, 19 nt, Human
ugcaagcuuuuucuuguua

SEQ ID NO: 218488 - RNA, 22 nt, Human
ugcaagauccagucuugagaag

SEQ ID NO: 218489 - RNA, 22 nt, Human
ugcacauuucucacaauguaca

SEQ ID NO: 218490 - RNA, 22 nt, Human
ugcacccacuuagcugaaguuc

SEQ ID NO: 218491 - RNA, 16 nt, Human
ugcaccgggaacacug

SEQ ID NO: 218492 - RNA, 23 nt, Human
ugcaaugcagcuagauguaaaau

SEQ ID NO: 218493 - RNA, 22 nt, Human
ugcaagugccauggauucaggu

SEQ ID NO: 218494 - RNA, 17 nt, Human
uccauugagacaagaag

SEQ ID NO: 218495 - RNA, 22 nt, Human
uccagguaggagaccaggcugu

SEQ ID NO: 218496 - RNA, 22 nt, Human
uccaggcagcugcuugaugaua

SEQ ID NO: 218497 - RNA, 22 nt, Human
ugauuugauuuguuuaugccug

SEQ ID NO: 218498 - RNA, 22 nt, Human
uccaccuaagucuccgggagcu

SEQ ID NO: 218499 - RNA, 22 nt, Human
uccacuguguagucucccaagu

SEQ ID NO: 218500 - RNA, 22 nt, Human
uccagaaagccguugacuuauu

SEQ ID NO: 218501 - RNA, 22 nt, Human
uccaccacgaaacugcagcugc

SEQ ID NO: 218502 - RNA, 22 nt, Human
ugauguauaaaaagagugaaau

SEQ ID NO: 218503 - RNA, 22 nt, Human
uccacagcagagcacgguaccu

SEQ ID NO: 218504 - RNA, 22 nt, Human
uccacagggaugccugcggcuu

SEQ ID NO: 218505 - RNA, 20 nt, Human
uccacugagcgucacggcag

SEQ ID NO: 218506 - RNA, 22 nt, Human
uccauacuggccucuuucccag

SEQ ID NO: 218507 - RNA, 22 nt, Human
uccaucaccacagaggacagag

SEQ ID NO: 218508 - RNA, 22 nt, Human
uccagugguggcucccggaccu

SEQ ID NO: 218509 - RNA, 22 nt, Human
uccaugauauauaugugcacau

SEQ ID NO: 218510 - RNA, 22 nt, Human
ugcaaaaguuuuauacacagau

SEQ ID NO: 218511 - RNA, 20 nt, Human
uccaguuuuggagacauucu

SEQ ID NO: 218512 - RNA, 22 nt, Human
ugauuugguauccaggauuuaa

SEQ ID NO: 218513 - RNA, 22 nt, Human
ugauuuggcaucaguguauccu

SEQ ID NO: 218514 - RNA, 22 nt, Human
uccagugccagcuguuaaaguu

SEQ ID NO: 218515 - RNA, 22 nt, Human
uccagguccuacuggcccauag

SEQ ID NO: 218516 - RNA, 22 nt, Human
uccaggucauucucuccgaccg

SEQ ID NO: 218517 - RNA, 22 nt, Human
ugaugccauaguaaaauuugcu

SEQ ID NO: 218518 - RNA, 22 nt, Human
uccaaguuugagacugagagug

SEQ ID NO: 218519 - RNA, 21 nt, Human
uccaaaggagacugagugugu

SEQ ID NO: 218520 - RNA, 22 nt, Human
ugaucuuugcuuuuggcuuagu

SEQ ID NO: 218521 - RNA, 22 nt, Human
ucauuuaauuuggaacucagag

SEQ ID NO: 218522 - RNA, 22 nt, Human
ucauuagcuaucagaguggaac

SEQ ID NO: 218523 - RNA, 22 nt, Human
ugauaguaucugauuauuucac

SEQ ID NO: 218524 - RNA, 20 nt, Human
ugauaggcauugacauaagg

SEQ ID NO: 218525 - RNA, 22 nt, Human
ucauuauuuugauguauuuccu

SEQ ID NO: 218526 - RNA, 20 nt, Human
ucauucagaaucaguaugca

SEQ ID NO: 218527 - RNA, 22 nt, Human
ucauuguuuacugucuuuuuuc

SEQ ID NO: 218528 - RNA, 22 nt, Human
ucauuguuucugcuuuucauga

SEQ ID NO: 218529 - RNA, 22 nt, Human
ucauugguugcguaauuugauu

SEQ ID NO: 218530 - RNA, 22 nt, Human
ugaguguuguaaccauaugauu

SEQ ID NO: 218531 - RNA, 22 nt, Human
ugagugugugcugcuuacauuc

SEQ ID NO: 218532 - RNA, 22 nt, Human
ugagugacuguugucaagaugg

SEQ ID NO: 218533 - RNA, 22 nt, Human
ugagucuguugcuagggggaau

SEQ ID NO: 218534 - RNA, 22 nt, Human
ucauaucauuuugaaagcugag

SEQ ID NO: 218535 - RNA, 22 nt, Human
ucauaggaguagcagugagagg

SEQ ID NO: 218536 - RNA, 22 nt, Human
ugaguuucuuacucaggagcug

SEQ ID NO: 218537 - RNA, 22 nt, Human
ugaguugucacaacgucacaag

SEQ ID NO: 218538 - RNA, 22 nt, Human
ugauagcaugcucucaguaaaa

SEQ ID NO: 218539 - RNA, 22 nt, Human
ugaguuuaggccaggauauggu

SEQ ID NO: 218540 - RNA, 22 nt, Human
ugagggaguguggauacaguag

SEQ ID NO: 218541 - RNA, 22 nt, Human
ugaggcuuucacuuggcaaaga

SEQ ID NO: 218542 - RNA, 22 nt, Human
ucaggcgcucuucguggcugcc

SEQ ID NO: 218543 - RNA, 22 nt, Human
ugacuuuucuccucugaaguuu

SEQ ID NO: 218544 - RNA, 22 nt, Human
uagugcuagaagcaaagacaaa

SEQ ID NO: 218545 - RNA, 22 nt, Human
ucuaaugcuuccucucauccca

SEQ ID NO: 218546 - RNA, 22 nt, Human
ucuaccuucagaaugugggguu

SEQ ID NO: 218547 - RNA, 22 nt, Human
ucuuccagauacuuccugacuu

SEQ ID NO: 218548 - RNA, 22 nt, Human
ucuuccucuccuggggcauuug

SEQ ID NO: 218549 - RNA, 22 nt, Human
uauugaucuuugaaaccuuggu

SEQ ID NO: 218550 - RNA, 22 nt, Human
uauucuucagcauaaaaauucu

SEQ ID NO: 218551 - RNA, 22 nt, Human
uauuguauuagcucuuggagau

SEQ ID NO: 218552 - RNA, 22 nt, Human
uauugguagauggagagagaca

SEQ ID NO: 218553 - RNA, 22 nt, Human
uauuggcucagucagaaguuuu

SEQ ID NO: 218554 - RNA, 22 nt, Human
ucuucuuuccuuuugugcauuu

SEQ ID NO: 218555 - RNA, 22 nt, Human
ucuugauggugauguuguguca

SEQ ID NO: 218556 - RNA, 22 nt, Human
ucuucuuugugguugcccaagg

SEQ ID NO: 218557 - RNA, 22 nt, Human
ucuugcuguagcuguuucuucu

SEQ ID NO: 218558 - RNA, 19 nt, Human
ucuugaggaaaguaaggca

SEQ ID NO: 218559 - RNA, 22 nt, Human
ucuugccccugcuuuggaacaa

SEQ ID NO: 218560 - RNA, 20 nt, Human
ucuugucuggcagccuggag

SEQ ID NO: 218561 - RNA, 22 nt, Human
ucuugugagcugagauaaagcc

SEQ ID NO: 218562 - RNA, 22 nt, Human
ucuuguuaaagguuaaagguga

SEQ ID NO: 218563 - RNA, 22 nt, Human
ucuuggucccugagcucuuuca

SEQ ID NO: 218564 - RNA, 22 nt, Human
ucuugcuguggcagaucuggag

SEQ ID NO: 218565 - RNA, 22 nt, Human
ucuuggcaguucuugugcuuuu

SEQ ID NO: 218566 - RNA, 19 nt, Human
ucuuucauuucuagcucug

SEQ ID NO: 218567 - RNA, 22 nt, Human
ucuuuaaggggccuuuguguca

SEQ ID NO: 218568 - RNA, 22 nt, Human
ucuuuaagugugugccuccagg

SEQ ID NO: 218569 - RNA, 22 nt, Human
ucuuucucuccagccuggaccu

SEQ ID NO: 218570 - RNA, 22 nt, Human
ucuuucucauccaaacuaguug

SEQ ID NO: 218571 - RNA, 22 nt, Human
uauuuacgcaaacaauugugca

SEQ ID NO: 218572 - RNA, 18 nt, Human
uauuuacuguguguuacc

SEQ ID NO: 218573 - RNA, 22 nt, Human
uauuuacuguguucaucccucu

SEQ ID NO: 218574 - RNA, 19 nt, Human
ucuuugcuuuucuaagagg

SEQ ID NO: 218575 - RNA, 22 nt, Human
ucuuugcugacacuuacacugu

SEQ ID NO: 218576 - RNA, 20 nt, Human
uauuucaaugugccaaguuu

SEQ ID NO: 218577 - RNA, 17 nt, Human
ucuuuuacuuucucucc

SEQ ID NO: 218578 - RNA, 22 nt, Human
uauuuuuacuguuugaugauuc

SEQ ID NO: 218579 - RNA, 22 nt, Human
uauuuuuaccuaauuuaugaga

SEQ ID NO: 218580 - RNA, 22 nt, Human
uauuuuggcuccugagcucuga

SEQ ID NO: 218581 - RNA, 22 nt, Human
ugaacuggauuugugagcuccu

SEQ ID NO: 218582 - RNA, 22 nt, Human
ugaacuguccuuguugucuaga

SEQ ID NO: 218583 - RNA, 22 nt, Human
ugaacuuacauugaggaauucu

SEQ ID NO: 218584 - RNA, 22 nt, Human
ugaaccugagggcaaagggaca

SEQ ID NO: 218585 - RNA, 22 nt, Human
ugaacauuuuugcuugcagcuu

SEQ ID NO: 218586 - RNA, 22 nt, Human
ugaacagacuauucucccaugu

SEQ ID NO: 218587 - RNA, 22 nt, Human
ugaacagugugagggugugacc

SEQ ID NO: 218588 - RNA, 22 nt, Human
ucaaccagcuuaucugcaggau

SEQ ID NO: 218589 - RNA, 21 nt, Human
ugaagccuagagaauugggga

SEQ ID NO: 218590 - RNA, 21 nt, Human
ugaagcccugugaggugcuua

SEQ ID NO: 218591 - RNA, 22 nt, Human
uauuuuucacagauuggugcuu

SEQ ID NO: 218592 - RNA, 22 nt, Human
uauuuuuguuuaccaguuaaca

SEQ ID NO: 218593 - RNA, 22 nt, Human
ucaaaucugauaggcgacaccu

SEQ ID NO: 218594 - RNA, 22 nt, Human
ucaaaggcuugugguucuggga

SEQ ID NO: 218595 - RNA, 22 nt, Human
ugaaaaauauuuuuagaaauaa

SEQ ID NO: 218596 - RNA, 22 nt, Human
ugaaaaaugcuuuaaugcaugu

SEQ ID NO: 218597 - RNA, 22 nt, Human
ugaaagccuacagcucacuguu

SEQ ID NO: 218598 - RNA, 22 nt, Human
ugaaagcuggcucugcagagug

SEQ ID NO: 218599 - RNA, 22 nt, Human
ugaaauugaguaccucuuuaua

SEQ ID NO: 218600 - RNA, 22 nt, Human
ugaaaugccucuuugguucuaa

SEQ ID NO: 218601 - RNA, 22 nt, Human
ugaaaggaauuuaaauguuguu

SEQ ID NO: 218602 - RNA, 22 nt, Human
uauuuucucugccacacuucca

SEQ ID NO: 218603 - RNA, 22 nt, Human
uauuuugaggugaaagaguuug

SEQ ID NO: 218604 - RNA, 23 nt, Human
uauuuuccccuguaauauguauu

SEQ ID NO: 218605 - RNA, 22 nt, Human
uauuuacuuugaggaaguuguu

SEQ ID NO: 218606 - RNA, 18 nt, Human
uauuugugugugugugug

SEQ ID NO: 218607 - RNA, 22 nt, Human
uauuuguuucuaguggcagcaa

SEQ ID NO: 218608 - RNA, 22 nt, Human
uauuuguuuuuaaugcugggug

SEQ ID NO: 218609 - RNA, 22 nt, Human
ucuuuuucccugguuccuuuuu

SEQ ID NO: 218610 - RNA, 22 nt, Human
ucagcaguuaagcuucccugcc

SEQ ID NO: 218611 - RNA, 19 nt, Human
ucagcagauuuugcaaaca

SEQ ID NO: 218612 - RNA, 22 nt, Human
ucagcaggugcuuuguuuacuc

SEQ ID NO: 218613 - RNA, 22 nt, Human
ugacgcauggccagcucugucu

SEQ ID NO: 218614 - RNA, 22 nt, Human
ucagauggucauucacuagggu

SEQ ID NO: 218615 - RNA, 22 nt, Human
ucagauagcaagggauaccugu

SEQ ID NO: 218616 - RNA, 22 nt, Human
ucagcacagcugcuuuuacuuc

SEQ ID NO: 218617 - RNA, 23 nt, Human
ugaccauauauccaucagauaua

SEQ ID NO: 218618 - RNA, 22 nt, Human
ugacauuugagagagauauaca

SEQ ID NO: 218619 - RNA, 21 nt, Human
ucaggaagagccaguucaugc

SEQ ID NO: 218620 - RNA, 22 nt, Human
ucagcucucucuuggugaucuc

SEQ ID NO: 218621 - RNA, 22 nt, Human
ucagcucaggggauguggggga

SEQ ID NO: 218622 - RNA, 22 nt, Human
ucagcguuaguuuuucaucuaa

SEQ ID NO: 218623 - RNA, 22 nt, Human
ucagcguuggccuccuccaggg

SEQ ID NO: 218624 - RNA, 22 nt, Human
ugacugagacugcaaugaccga

SEQ ID NO: 218625 - RNA, 22 nt, Human
ugacuaauacagaaacuacaag

SEQ ID NO: 218626 - RNA, 19 nt, Human
ugacuggguucuaggcagg

SEQ ID NO: 218627 - RNA, 22 nt, Human
ugacugguauuuguaaaccaua

SEQ ID NO: 218628 - RNA, 22 nt, Human
ucaggaggucugcugcggggug

SEQ ID NO: 218629 - RNA, 22 nt, Human
ucaggcaggaucccagggaagg

SEQ ID NO: 218630 - RNA, 22 nt, Human
ucagcuucaucuugagcccaca

SEQ ID NO: 218631 - RNA, 22 nt, Human
ucacuuccuugcagcuguagaa

SEQ ID NO: 218632 - RNA, 22 nt, Human
ucacuguugccacggugauaau

SEQ ID NO: 218633 - RNA, 22 nt, Human
ugacagaaaccaccccccaggu

SEQ ID NO: 218634 - RNA, 22 nt, Human
ugacacacagggggauggaguu

SEQ ID NO: 218635 - RNA, 22 nt, Human
ucagaacuaacuuugcugaacc

SEQ ID NO: 218636 - RNA, 22 nt, Human
ucacuguuucaccgucugaagg

SEQ ID NO: 218637 - RNA, 22 nt, Human
ugacaagagaccccuccgcagg

SEQ ID NO: 218638 - RNA, 22 nt, Human
ugaauuucuuuuuaaaauauua

SEQ ID NO: 218639 - RNA, 22 nt, Human
ucagaacugcggggaagguggg

SEQ ID NO: 218640 - RNA, 18 nt, Human
ucagaaugauuuggugga

SEQ ID NO: 218641 - RNA, 20 nt, Human
ucagaaugugacccccaugg

SEQ ID NO: 218642 - RNA, 22 nt, Human
ucagagaaguaggcuaauggug

SEQ ID NO: 218643 - RNA, 22 nt, Human
ucagagugagcuggggcugcuu

SEQ ID NO: 218644 - RNA, 18 nt, Human
ucagaggagauaccuaaa

SEQ ID NO: 218645 - RNA, 22 nt, Human
ucagagccagacacacagcaga

SEQ ID NO: 218646 - RNA, 22 nt, Human
ucagacucaguuuugucuccug

SEQ ID NO: 218647 - RNA, 22 nt, Human
ugacauccuacaccccuggguc

SEQ ID NO: 218648 - RNA, 22 nt, Human
ucagaaggagagacagcgugga

SEQ ID NO: 218649 - RNA, 23 nt, Human
ugacagguucuaugguuuccaac

SEQ ID NO: 218650 - RNA, 17 nt, Human
ugacagcuaaggggcuu

SEQ ID NO: 218651 - RNA, 22 nt, Human
ugacagucacagcagaaacucg

SEQ ID NO: 218652 - RNA, 22 nt, Human
ugacaucagacugugagaagag

SEQ ID NO: 218653 - RNA, 22 nt, Human
ucacucagucugagcaauugcu

SEQ ID NO: 218654 - RNA, 22 nt, Human
ucaccuguucaacagcaauaau

SEQ ID NO: 218655 - RNA, 22 nt, Human
ucaccuuuugaauugcuguugu

SEQ ID NO: 218656 - RNA, 22 nt, Human
ucaccuguuggauguauacugu

SEQ ID NO: 218657 - RNA, 22 nt, Human
ucaccugccuggguggucaccu

SEQ ID NO: 218658 - RNA, 22 nt, Human
ucacuggaaaacaaauguuuua

SEQ ID NO: 218659 - RNA, 22 nt, Human
ugaauuauaugguauugaacau

SEQ ID NO: 218660 - RNA, 22 nt, Human
ugaaucagaccuucauugggua

SEQ ID NO: 218661 - RNA, 21 nt, Human
ucacagggucacucuuaccac

SEQ ID NO: 218662 - RNA, 22 nt, Human
ucacaggagucaaggaauagua

SEQ ID NO: 218663 - RNA, 22 nt, Human
ucaccauguacaugaagggcgg

SEQ ID NO: 218664 - RNA, 22 nt, Human
ucaccaugcccuucucugcucu

SEQ ID NO: 218665 - RNA, 22 nt, Human
ucacauggauuaacucauuuau

SEQ ID NO: 218666 - RNA, 22 nt, Human
ugaauguggucaggaaauuguu

SEQ ID NO: 218667 - RNA, 22 nt, Human
ugaauguguacacgauuguuug

SEQ ID NO: 218668 - RNA, 22 nt, Human
ugaaugcuacccugcuggcucu

SEQ ID NO: 218669 - RNA, 22 nt, Human
ugaaugaguucaccgcucaguu

SEQ ID NO: 218670 - RNA, 22 nt, Human
ugaaugaagcacuguaauucuc

SEQ ID NO: 218671 - RNA, 22 nt, Human
ugaauuagagugaaggaaagcu

SEQ ID NO: 218672 - RNA, 22 nt, Human
ucaauuuauguggcuauucauu

SEQ ID NO: 218673 - RNA, 22 nt, Human
ugaauagcaccuugaguaauga

SEQ ID NO: 218674 - RNA, 22 nt, Human
ugaaucuuguuuacugauuccu

SEQ ID NO: 218675 - RNA, 22 nt, Human
ugaaucugagccugcgcaaagu

SEQ ID NO: 218676 - RNA, 22 nt, Human
ugaaguuuagaaaaagugccuu

SEQ ID NO: 218677 - RNA, 23 nt, Human
ugaagugaaauuucacaagggac

SEQ ID NO: 218678 - RNA, 21 nt, Human
ucaagcggcagagcaguuauu

SEQ ID NO: 218679 - RNA, 22 nt, Human
ugaaggccagggauuugcagcc

SEQ ID NO: 218680 - RNA, 22 nt, Human
ucaagcaaggaauccuuuugua

SEQ ID NO: 218681 - RNA, 22 nt, Human
ugaagcuagguucaugaggucg

SEQ ID NO: 218682 - RNA, 22 nt, Human
guuccgcugcaaggccaggaaa

SEQ ID NO: 218683 - RNA, 22 nt, Human
guucaccaguagcugggcuguu

SEQ ID NO: 218684 - RNA, 22 nt, Human
guucauuucaagucuaauccau

SEQ ID NO: 218685 - RNA, 21 nt, Human
uauucgcauuucugucuuuac

SEQ ID NO: 218686 - RNA, 22 nt, Human
uauucuucaacuuuucuccucu

SEQ ID NO: 218687 - RNA, 18 nt, Human
uauuccucuuccucuauc

SEQ ID NO: 218688 - RNA, 22 nt, Human
uauguuuugcaaauaucaaaca

SEQ ID NO: 218689 - RNA, 22 nt, Human
uauuaaaagagaaaaagccacc

SEQ ID NO: 218690 - RNA, 22 nt, Human
guucacauccuugugaggauuu

SEQ ID NO: 218691 - RNA, 23 nt, Human
guuauugcuggugcuggccagcc

SEQ ID NO: 218692 - RNA, 22 nt, Human
uauggcuaguguguuuguaaca

SEQ ID NO: 218693 - RNA, 22 nt, Human
uaugggaaggauuugucuuuca

SEQ ID NO: 218694 - RNA, 22 nt, Human
uaugguuagugcuguagauuau

SEQ ID NO: 218695 - RNA, 22 nt, Human
uaugugugaguauauaugcaca

SEQ ID NO: 218696 - RNA, 18 nt, Human
uaugugucuguuacaacu

SEQ ID NO: 218697 - RNA, 22 nt, Human
guuacagagcugcuaugugugc

SEQ ID NO: 218698 - RNA, 22 nt, Human
uaugggcaagagauaggugguc

SEQ ID NO: 218699 - RNA, 22 nt, Human
uauuuaaagucagcaacuuuuc

SEQ ID NO: 218700 - RNA, 22 nt, Human
uauuucaguuaagaugagguca

SEQ ID NO: 218701 - RNA, 22 nt, Human
uauuuaugcaucacuuuuuucc

SEQ ID NO: 218702 - RNA, 22 nt, Human
uauuuaggcagaaagugauauu

SEQ ID NO: 218703 - RNA, 22 nt, Human
uauugauuuuguugcuaccugg

SEQ ID NO: 218704 - RNA, 22 nt, Human
uauuacugccacaucauuaggu

SEQ ID NO: 218705 - RNA, 22 nt, Human
uauuguuuuaagguguauuaau

SEQ ID NO: 218706 - RNA, 22 nt, Human
uauugugaaggccaugugcuaa

SEQ ID NO: 218707 - RNA, 22 nt, Human
uauuucaugagugaauaucuag

SEQ ID NO: 218708 - RNA, 22 nt, Human
uauuucuagggcaugaaaauaa

SEQ ID NO: 218709 - RNA, 22 nt, Human
uauuuguauugucuuaucacuu

SEQ ID NO: 218710 - RNA, 22 nt, Human
uauuugauggaacucuugcuuu

SEQ ID NO: 218711 - RNA, 22 nt, Human
uauauuaaagugcuuugcagug

SEQ ID NO: 218712 - RNA, 22 nt, Human
guguauuucuagaagaaaugaa

SEQ ID NO: 218713 - RNA, 22 nt, Human
uaucuguauuguagaacuguug

SEQ ID NO: 218714 - RNA, 22 nt, Human
uaucugcuggagguaauuacuc

SEQ ID NO: 218715 - RNA, 23 nt, Human
uaucccauacagagagugguaca

SEQ ID NO: 218716 - RNA, 22 nt, Human
uaugaggagaacauuccugaac

SEQ ID NO: 218717 - RNA, 22 nt, Human
uaugaguauagugcaccauggu

SEQ ID NO: 218718 - RNA, 19 nt, Human
uaugaaguugauaaaaguu

SEQ ID NO: 218719 - RNA, 19 nt, Human
uaugacaaguacuaguucu

SEQ ID NO: 218720 - RNA, 22 nt, Human
uaugaccuuaggaagcaagaag

SEQ ID NO: 218721 - RNA, 22 nt, Human
uaguucugaauagcauugaaga

SEQ ID NO: 218722 - RNA, 22 nt, Human
uaguuggguagacaguucuaca

SEQ ID NO: 218723 - RNA, 22 nt, Human
gugcuaugugcugaacucaggu

SEQ ID NO: 218724 - RNA, 22 nt, Human
gugcucaagacauuaggaauau

SEQ ID NO: 218725 - RNA, 22 nt, Human
uagcauccugugugaauguauu

SEQ ID NO: 218726 - RNA, 22 nt, Human
gugguuugcugguguacguuua

SEQ ID NO: 218727 - RNA, 22 nt, Human
uaguuaaugauagggagagggg

SEQ ID NO: 218728 - RNA, 22 nt, Human
uauauaauacacaaauauguac

SEQ ID NO: 218729 - RNA, 22 nt, Human
uauaggugagugaagcucagga

SEQ ID NO: 218730 - RNA, 22 nt, Human
uauagcccaaucuggaugcagu

SEQ ID NO: 218731 - RNA, 22 nt, Human
uauauauaauguguacagguga

SEQ ID NO: 218732 - RNA, 22 nt, Human
uauauacacgcacauauacaua

SEQ ID NO: 218733 - RNA, 22 nt, Human
uauauacuugaaaauugcugag

SEQ ID NO: 218734 - RNA, 22 nt, Human
uauaaucuugcccauaguauuu

SEQ ID NO: 218735 - RNA, 22 nt, Human
uauaaugucuuuguugaaaucu

SEQ ID NO: 218736 - RNA, 18 nt, Human
uauaaacacacuuagguu

SEQ ID NO: 218737 - RNA, 22 nt, Human
uauaagaaacaaggcaaauuuu

SEQ ID NO: 218738 - RNA, 22 nt, Human
guuguugucauuagcuguuuaa

SEQ ID NO: 218739 - RNA, 19 nt, Human
guuguguuugguucuuuug

SEQ ID NO: 218740 - RNA, 21 nt, Human
guugugaccaugggaguugcu

SEQ ID NO: 218741 - RNA, 22 nt, Human
ucaagguauuauuuuuguggug

SEQ ID NO: 218742 - RNA, 22 nt, Human
ucaaggaagggguaggaauaau

SEQ ID NO: 218743 - RNA, 22 nt, Human
guugauuuaggguuuugguuuu

SEQ ID NO: 218744 - RNA, 22 nt, Human
guugauauggaaacucuagguu

SEQ ID NO: 218745 - RNA, 22 nt, Human
guuuaaguuaaaauuuaccugc

SEQ ID NO: 218746 - RNA, 22 nt, Human
guuuagauguagauucucuggu

SEQ ID NO: 218747 - RNA, 22 nt, Human
guuguuuuuguuaaaacaguga

SEQ ID NO: 218748 - RNA, 22 nt, Human
ucacauugcauuuucucauuug

SEQ ID NO: 218749 - RNA, 22 nt, Human
ucacaugcucaccuaagccaca

SEQ ID NO: 218750 - RNA, 22 nt, Human
ucacaagaagaaauuaaacugu

SEQ ID NO: 218751 - RNA, 22 nt, Human
ucaauuggcuacaaauaaugua

SEQ ID NO: 218752 - RNA, 22 nt, Human
ucacacaucucagguguuuaau

SEQ ID NO: 218753 - RNA, 22 nt, Human
ucacagguuuaguccagcaguc

SEQ ID NO: 218754 - RNA, 22 nt, Human
ucacaguucaacuaguucagau

SEQ ID NO: 218755 - RNA, 22 nt, Human
ucacccagacugucugacucuu

SEQ ID NO: 218756 - RNA, 22 nt, Human
ucaccauguuuucauaggaaca

SEQ ID NO: 218757 - RNA, 22 nt, Human
ucaccaggauugggcuguaggc

SEQ ID NO: 218758 - RNA, 22 nt, Human
guuuccaggcuuugguaugguu

SEQ ID NO: 218759 - RNA, 22 nt, Human
ucaccuggagagcuugcuaaua

SEQ ID NO: 218760 - RNA, 22 nt, Human
guuucucuuugguggguugaga

SEQ ID NO: 218761 - RNA, 22 nt, Human
ucacuggauucauguuucuuua

SEQ ID NO: 218762 - RNA, 22 nt, Human
ucacugaacucucauagagaaa

SEQ ID NO: 218763 - RNA, 22 nt, Human
ucacuucugcuccuuggaugcc

SEQ ID NO: 218764 - RNA, 22 nt, Human
guuugcagacuauguaaacuuc

SEQ ID NO: 218765 - RNA, 22 nt, Human
guuuggguggcuagagaaagaa

SEQ ID NO: 218766 - RNA, 22 nt, Human
ucacucgccuuuucguucgccg

SEQ ID NO: 218767 - RNA, 22 nt, Human
ucacuagcaucugaauauuguu

SEQ ID NO: 218768 - RNA, 22 nt, Human
ucacugaauuucaagcuagugg

SEQ ID NO: 218769 - RNA, 23 nt, Human
ucacugccaagaaaaguuacaga

SEQ ID NO: 218770 - RNA, 22 nt, Human
ucacugccuagggcuacugugc

SEQ ID NO: 218771 - RNA, 22 nt, Human
uaaaaugcucagauaaauauau

SEQ ID NO: 218772 - RNA, 22 nt, Human
uaaaaguuagcuaggacaaagu

SEQ ID NO: 218773 - RNA, 22 nt, Human
uaaaauaccacauauggugcuc

SEQ ID NO: 218774 - RNA, 21 nt, Human
ucagccuguccaguguuaacc

SEQ ID NO: 218775 - RNA, 22 nt, Human
uaaaaucaugacagauugacau

SEQ ID NO: 218776 - RNA, 22 nt, Human
ucagcugggagaaaguuuuagg

SEQ ID NO: 218777 - RNA, 22 nt, Human
ucagcuauccauucuccuauga

SEQ ID NO: 218778 - RNA, 22 nt, Human
ucagcucacaauguugagaaag

SEQ ID NO: 218779 - RNA, 21 nt, Human
uaaaagaugacaagacagcuc

SEQ ID NO: 218780 - RNA, 22 nt, Human
uaaaaaccuuguauuuaacucu

SEQ ID NO: 218781 - RNA, 22 nt, Human
ucagcgucuccaaaagagcccg

SEQ ID NO: 218782 - RNA, 22 nt, Human
guuuuucuuugauuuagaacca

SEQ ID NO: 218783 - RNA, 22 nt, Human
ucagcaaugggauucaggcuuu

SEQ ID NO: 218784 - RNA, 23 nt, Human
ucagccgcuggcgaguccacugg

SEQ ID NO: 218785 - RNA, 22 nt, Human
ucagccuugguuuugguguugg

SEQ ID NO: 218786 - RNA, 22 nt, Human
guuuuaaucuccuuauuccuaa

SEQ ID NO: 218787 - RNA, 22 nt, Human
guuugguucucauuguuuuucu

SEQ ID NO: 218788 - RNA, 22 nt, Human
guuugggauucuagacaaaaau

SEQ ID NO: 218789 - RNA, 22 nt, Human
ucagaacucuagucucagccug

SEQ ID NO: 218790 - RNA, 22 nt, Human
ucagaaacuaaauguggauuug

SEQ ID NO: 218791 - RNA, 22 nt, Human
ucagaaugaaauuucuuucaga

SEQ ID NO: 218792 - RNA, 21 nt, Human
ucagaaucguuccagguagau

SEQ ID NO: 218793 - RNA, 22 nt, Human
guuuucuccugcuauacagugc

SEQ ID NO: 218794 - RNA, 22 nt, Human
guuuucuaaaacacauauaagu

SEQ ID NO: 218795 - RNA, 23 nt, Human
ucagaccaaccucuugcuggaac

SEQ ID NO: 218796 - RNA, 22 nt, Human
guuuuauguuuuauagacacaa

SEQ ID NO: 218797 - RNA, 22 nt, Human
guuuuuaguuuaaguuuuugca

SEQ ID NO: 218798 - RNA, 22 nt, Human
ucagagacaucagguuguagca

SEQ ID NO: 218799 - RNA, 22 nt, Human
ucagauaauccaauagagagga

SEQ ID NO: 218800 - RNA, 22 nt, Human
guuuugauggaguguguuaaau

SEQ ID NO: 218801 - RNA, 22 nt, Human
guuuugaagagaagcaagucug

SEQ ID NO: 218802 - RNA, 22 nt, Human
guuuuggagauguccauuuucc

SEQ ID NO: 218803 - RNA, 22 nt, Human
guuuuuacuuccaaugcuauga

SEQ ID NO: 218804 - RNA, 22 nt, Human
ucccagguugaggccuugccug

SEQ ID NO: 218805 - RNA, 22 nt, Human
ucccagucuagagccggauugg

SEQ ID NO: 218806 - RNA, 22 nt, Human
uacuucaguuacaugaagguau

SEQ ID NO: 218807 - RNA, 22 nt, Human
uacuuaauuuuaaaagcuagau

SEQ ID NO: 218808 - RNA, 22 nt, Human
uagaaguuaaaggaauacagaa

SEQ ID NO: 218809 - RNA, 22 nt, Human
uagacauuuacuuugaaaaaau

SEQ ID NO: 218810 - RNA, 22 nt, Human
uagagaaauauuuguagugcug

SEQ ID NO: 218811 - RNA, 19 nt, Human
uagaggagaauggcaaaga

SEQ ID NO: 218812 - RNA, 22 nt, Human
uccucuucaaaauagcucugaa

SEQ ID NO: 218813 - RNA, 22 nt, Human
uccucagagacaaguugagagg

SEQ ID NO: 218814 - RNA, 22 nt, Human
uagcaggaggcaguuccucgcu

SEQ ID NO: 218815 - RNA, 22 nt, Human
uagcauaaaguuucuguguggu

SEQ ID NO: 218816 - RNA, 22 nt, Human
uagccaaguguuuuucaugacc

SEQ ID NO: 218817 - RNA, 22 nt, Human
uagcauuuagaacaccuugaga

SEQ ID NO: 218818 - RNA, 21 nt, Human
uccugcagggcagcagagugg

SEQ ID NO: 218819 - RNA, 22 nt, Human
uagauuuaaaaagggugggaug

SEQ ID NO: 218820 - RNA, 22 nt, Human
uccucuucucuagagccggaau

SEQ ID NO: 218821 - RNA, 22 nt, Human
uagauuguaagcuccuugaggg

SEQ ID NO: 218822 - RNA, 22 nt, Human
uccugcaugcuagugagugcuu

SEQ ID NO: 218823 - RNA, 22 nt, Human
uccugcccuguccuugccucug

SEQ ID NO: 218824 - RNA, 17 nt, Human
uagccagcuugugauuu

SEQ ID NO: 218825 - RNA, 22 nt, Human
uagcccgugaggaggggcugug

SEQ ID NO: 218826 - RNA, 22 nt, Human
uagccucaagagauucagggac

SEQ ID NO: 218827 - RNA, 22 nt, Human
uagccucauuauuuacucauga

SEQ ID NO: 218828 - RNA, 22 nt, Human
uagcgggucacccugcugugaa

SEQ ID NO: 218829 - RNA, 22 nt, Human
uccuuuauuuaugggcagugua

SEQ ID NO: 218830 - RNA, 22 nt, Human
uccuuucaaauuuauuugacau

SEQ ID NO: 218831 - RNA, 22 nt, Human
uccuuguuggaauauccuuacc

SEQ ID NO: 218832 - RNA, 21 nt, Human
uccuuguuucuuccaaaacug

SEQ ID NO: 218833 - RNA, 22 nt, Human
uccuuguucugauuuuucuggg

SEQ ID NO: 218834 - RNA, 22 nt, Human
ucguggaugaagaauagaggcc

SEQ ID NO: 218835 - RNA, 22 nt, Human
ucguuucuuuuucuucccugga

SEQ ID NO: 218836 - RNA, 22 nt, Human
uagugcauaccuaacauuuuug

SEQ ID NO: 218837 - RNA, 22 nt, Human
ucgugacuggacaaacuugggu

SEQ ID NO: 218838 - RNA, 22 nt, Human
uagucuaguggaaccaucacug

SEQ ID NO: 218839 - RNA, 22 nt, Human
uaguauuuguaauuaucaaagc

SEQ ID NO: 218840 - RNA, 22 nt, Human
uaguccacagagggcaggguca

SEQ ID NO: 218841 - RNA, 23 nt, Human
ucgucgucagccacuaccucccc

SEQ ID NO: 218842 - RNA, 22 nt, Human
ucgucaaaguaaugucauagca

SEQ ID NO: 218843 - RNA, 22 nt, Human
uaguaauauuccuacauuaugu

SEQ ID NO: 218844 - RNA, 22 nt, Human
uaguacguuccaaaucacugga

SEQ ID NO: 218845 - RNA, 22 nt, Human
ucgggcgaauguuguuuuucuc

SEQ ID NO: 218846 - RNA, 22 nt, Human
ucggguguguguguuggguaug

SEQ ID NO: 218847 - RNA, 22 nt, Human
ucgggaggaggcggagcucguu

SEQ ID NO: 218848 - RNA, 22 nt, Human
ucgcuguguccuuuucacuuau

SEQ ID NO: 218849 - RNA, 22 nt, Human
ucgcuugaacccaggaagugga

SEQ ID NO: 218850 - RNA, 22 nt, Human
ucgcuuuaauggucuucacagc

SEQ ID NO: 218851 - RNA, 19 nt, Human
ucggaaugugggaagcaug

SEQ ID NO: 218852 - RNA, 22 nt, Human
ucggccggagggggcgggcgca

SEQ ID NO: 218853 - RNA, 22 nt, Human
ucgcucgcuggcuccugcccgc

SEQ ID NO: 218854 - RNA, 22 nt, Human
uaggguagugggaaacuggacg

SEQ ID NO: 218855 - RNA, 22 nt, Human
uaggguuucaugcugguuucca

SEQ ID NO: 218856 - RNA, 22 nt, Human
uaggccugcugaagagcaagcu

SEQ ID NO: 218857 - RNA, 19 nt, Human
uaggcccugcgaauggcuu

SEQ ID NO: 218858 - RNA, 22 nt, Human
uaggggaagcauagguuuagaa

SEQ ID NO: 218859 - RNA, 22 nt, Human
uaggcuuuguuacuuucccuuu

SEQ ID NO: 218860 - RNA, 20 nt, Human
ucgcugcaagggaaauggag

SEQ ID NO: 218861 - RNA, 22 nt, Human
uaggcagggauuaggguugauu

SEQ ID NO: 218862 - RNA, 22 nt, Human
uaggcagauuccauauuuuggc

SEQ ID NO: 218863 - RNA, 22 nt, Human
ucgacuccauuuuucuugguuc

SEQ ID NO: 218864 - RNA, 22 nt, Human
ucgagcacaccagacuugcaga

SEQ ID NO: 218865 - RNA, 22 nt, Human
ucgagauguuuguuguggugau

SEQ ID NO: 218866 - RNA, 22 nt, Human
uaggaucaugaugguaaggcaa

SEQ ID NO: 218867 - RNA, 22 nt, Human
ucgcccagguuggagugcagug

SEQ ID NO: 218868 - RNA, 22 nt, Human
ucgaugcuggcgcagguuucac

SEQ ID NO: 218869 - RNA, 22 nt, Human
uccagccauaucuuguagcccu

SEQ ID NO: 218870 - RNA, 22 nt, Human
uccaggucgggggugggccggc

SEQ ID NO: 218871 - RNA, 20 nt, Human
uacccgcagcugggucuggc

SEQ ID NO: 218872 - RNA, 19 nt, Human
uacccggauagccagguag

SEQ ID NO: 218873 - RNA, 23 nt, Human
uaccauugauuuuaugguuuucu

SEQ ID NO: 218874 - RNA, 20 nt, Human
uaccagggguuugggacagc

SEQ ID NO: 218875 - RNA, 22 nt, Human
uccaguggcaccuuggcccuca

SEQ ID NO: 218876 - RNA, 22 nt, Human
uccagguuuggcuuuauaacuu

SEQ ID NO: 218877 - RNA, 22 nt, Human
uccagugaacaucauggcucca

SEQ ID NO: 218878 - RNA, 22 nt, Human
ucccacgugccaucugcucugu

SEQ ID NO: 218879 - RNA, 22 nt, Human
uccauuuacuauucucauaucg

SEQ ID NO: 218880 - RNA, 21 nt, Human
uacugugccagggcagcucug

SEQ ID NO: 218881 - RNA, 22 nt, Human
ucccagaaauccaggcuuaaau

SEQ ID NO: 218882 - RNA, 22 nt, Human
ucccagaaccuuuuagcuucac

SEQ ID NO: 218883 - RNA, 22 nt, Human
uacucuggaguugagaugcgag

SEQ ID NO: 218884 - RNA, 22 nt, Human
uacugccauuauccugcugaaa

SEQ ID NO: 218885 - RNA, 22 nt, Human
uacucgaaaucagagagaauaa

SEQ ID NO: 218886 - RNA, 22 nt, Human
uccagcacacagguggcucuca

SEQ ID NO: 218887 - RNA, 20 nt, Human
uaccaucauuggcaaaccuc

SEQ ID NO: 218888 - RNA, 22 nt, Human
uccagaaaucucuguugauugu

SEQ ID NO: 218889 - RNA, 22 nt, Human
uccagacucaaaaaccagaugg

SEQ ID NO: 218890 - RNA, 22 nt, Human
uccacuuaaaacucuuuuuguc

SEQ ID NO: 218891 - RNA, 22 nt, Human
uccagagcuguccuacugugag

SEQ ID NO: 218892 - RNA, 23 nt, Human
uaccagacccugaaagaaagugu

SEQ ID NO: 218893 - RNA, 21 nt, Human
uaccacugaaauugaucguuc

SEQ ID NO: 218894 - RNA, 22 nt, Human
uaccaauuaaauagccaaucua

SEQ ID NO: 218895 - RNA, 22 nt, Human
uacauuugauuuuugcuucuuu

SEQ ID NO: 218896 - RNA, 22 nt, Human
uacauuccagaaaguuucugua

SEQ ID NO: 218897 - RNA, 22 nt, Human
uacauguggagauaacugaagc

SEQ ID NO: 218898 - RNA, 22 nt, Human
uccaccaccaucacagucagac

SEQ ID NO: 218899 - RNA, 19 nt, Human
uccaccgcgugcaccucua

SEQ ID NO: 218900 - RNA, 21 nt, Human
uacaucaguuuucuuggcuca

SEQ ID NO: 218901 - RNA, 22 nt, Human
uacagauggacacuguuucaag

SEQ ID NO: 218902 - RNA, 22 nt, Human
ucaucuuucuuuauggaaauac

SEQ ID NO: 218903 - RNA, 22 nt, Human
uaagggaagucuucaggagaca

SEQ ID NO: 218904 - RNA, 22 nt, Human
ucauccugucucuguucggaau

SEQ ID NO: 218905 - RNA, 22 nt, Human
uaagcguuugggaguuaugaac

SEQ ID NO: 218906 - RNA, 23 nt, Human
uaagccugugccugcuaccugcu

SEQ ID NO: 218907 - RNA, 22 nt, Human
uaagaaaggggaaguuccucuu

SEQ ID NO: 218908 - RNA, 22 nt, Human
uaaagacaauuucgagcuguag

SEQ ID NO: 218909 - RNA, 22 nt, Human
uaagaauguuuguugaguaaau

SEQ ID NO: 218910 - RNA, 22 nt, Human
uaacuuuucuguucaauuuucc

SEQ ID NO: 218911 - RNA, 22 nt, Human
uaagauauugagugguaauuug

SEQ ID NO: 218912 - RNA, 22 nt, Human
uaagaggucugaaacgguggga

SEQ ID NO: 218913 - RNA, 22 nt, Human
uacaaaugaucaucucuuugaa

SEQ ID NO: 218914 - RNA, 22 nt, Human
ucauuguguaguagagguggca

SEQ ID NO: 218915 - RNA, 22 nt, Human
uaauuccacacucccgcaagcg

SEQ ID NO: 218916 - RNA, 22 nt, Human
uaauucuacagggaacucugga

SEQ ID NO: 218917 - RNA, 22 nt, Human
uccaaauucccaugacagaagu

SEQ ID NO: 218918 - RNA, 22 nt, Human
uccaacuuaauugggaagauua

SEQ ID NO: 218919 - RNA, 22 nt, Human
uacaacuuacuugaauggcuuu

SEQ ID NO: 218920 - RNA, 22 nt, Human
uacaaauuguuuugccacaaag

SEQ ID NO: 218921 - RNA, 21 nt, Human
uacaagaccggauucgggccc

SEQ ID NO: 218922 - RNA, 22 nt, Human
uaagugugcauguguauuauau

SEQ ID NO: 218923 - RNA, 22 nt, Human
uaauaaaaauuuaauucacauu

SEQ ID NO: 218924 - RNA, 22 nt, Human
uaauaauuaacagugauggguc

SEQ ID NO: 218925 - RNA, 22 nt, Human
uaauaagugcuggcuguacauc

SEQ ID NO: 218926 - RNA, 22 nt, Human
ucauucucucguauucgcgaau

SEQ ID NO: 218927 - RNA, 23 nt, Human
ucauugcucaagauaaugguuga

SEQ ID NO: 218928 - RNA, 22 nt, Human
ucauugguugcauaauuugauc

SEQ ID NO: 218929 - RNA, 22 nt, Human
uaaugcucauuuggcucugcaa

SEQ ID NO: 218930 - RNA, 22 nt, Human
uaaugaugaacacuuggaagaa

SEQ ID NO: 218931 - RNA, 22 nt, Human
uacugaagaugccaucacaagc

SEQ ID NO: 218932 - RNA, 22 nt, Human
uacugaguuucacugucugugc

SEQ ID NO: 218933 - RNA, 22 nt, Human
uacugauggagauaggcuauca

SEQ ID NO: 218934 - RNA, 22 nt, Human
uacucauuggagaauuacgagg

SEQ ID NO: 218935 - RNA, 22 nt, Human
uacuaucauuuuuuguugccaa

SEQ ID NO: 218936 - RNA, 22 nt, Human
uacugaaagagugguggacucu

SEQ ID NO: 218937 - RNA, 22 nt, Human
uacuggaugcaacaaagcccag

SEQ ID NO: 218938 - RNA, 22 nt, Human
gugaagcaagggucaccugugg

SEQ ID NO: 218939 - RNA, 22 nt, Human
gugaagaugccucaggugaccc

SEQ ID NO: 218940 - RNA, 22 nt, Human
uacuuacacugaagcaaagaua

SEQ ID NO: 218941 - RNA, 22 nt, Human
uacagcuuccucuaugguggcc

SEQ ID NO: 218942 - RNA, 22 nt, Human
uacaguauuuuuuaagaaaaaa

SEQ ID NO: 218943 - RNA, 22 nt, Human
uacagcgaaaauuuagcuugau

SEQ ID NO: 218944 - RNA, 22 nt, Human
uacagugaggcgagauucacca

SEQ ID NO: 218945 - RNA, 22 nt, Human
uacagucauaagguuucucucc

SEQ ID NO: 218946 - RNA, 22 nt, Human
uacccauuuugguucuugaugc

SEQ ID NO: 218947 - RNA, 22 nt, Human
gucuauucaucauucaucaaac

SEQ ID NO: 218948 - RNA, 22 nt, Human
uaauagauagggagaguugcug

SEQ ID NO: 218949 - RNA, 22 nt, Human
uacaaagugauuuuggaauuga

SEQ ID NO: 218950 - RNA, 22 nt, Human
uacaaauugccugacggcaggu

SEQ ID NO: 218951 - RNA, 21 nt, Human
uaauaauugggggcagggugg

SEQ ID NO: 218952 - RNA, 20 nt, Human
uacaauauucccacuuugcu

SEQ ID NO: 218953 - RNA, 22 nt, Human
gucugcagcacugugcacgguc

SEQ ID NO: 218954 - RNA, 18 nt, Human
uacagauguaugucuaca

SEQ ID NO: 218955 - RNA, 22 nt, Human
gucugccagauucugcuggauc

SEQ ID NO: 218956 - RNA, 22 nt, Human
uacaccaugcuccagcaggaca

SEQ ID NO: 218957 - RNA, 22 nt, Human
uacacacacaugcauguacgug

SEQ ID NO: 218958 - RNA, 22 nt, Human
gugcccaguugaggccaggacu

SEQ ID NO: 218959 - RNA, 22 nt, Human
uagcaaucugugaugugugugu

SEQ ID NO: 218960 - RNA, 20 nt, Human
uagcacuguauccucuucau

SEQ ID NO: 218961 - RNA, 22 nt, Human
uagcacauaguaggcacaggcu

SEQ ID NO: 218962 - RNA, 20 nt, Human
gugcggcucuaccacucggu

SEQ ID NO: 218963 - RNA, 22 nt, Human
gugccuggugcaggauaaucac

SEQ ID NO: 218964 - RNA, 22 nt, Human
uagcaggagagaaguuuuaagu

SEQ ID NO: 218965 - RNA, 22 nt, Human
gugccaaauagcuugauuaaga

SEQ ID NO: 218966 - RNA, 22 nt, Human
gugcaucuguaauuacaauggu

SEQ ID NO: 218967 - RNA, 22 nt, Human
gugccgaugaggccuggcauuc

SEQ ID NO: 218968 - RNA, 22 nt, Human
uagaguguaagcuccuugaggg

SEQ ID NO: 218969 - RNA, 23 nt, Human
uagauccuuccaacuacucuuac

SEQ ID NO: 218970 - RNA, 22 nt, Human
uagaugguguccagaaagagaa

SEQ ID NO: 218971 - RNA, 22 nt, Human
uagaugaacagaaagccacugu

SEQ ID NO: 218972 - RNA, 19 nt, Human
gugcacugucacuuugcuc

SEQ ID NO: 218973 - RNA, 22 nt, Human
gugcagcugguggagucugggg

SEQ ID NO: 218974 - RNA, 22 nt, Human
uagaggguccaggagggcaaga

SEQ ID NO: 218975 - RNA, 22 nt, Human
uagagugcugucaaagacuugu

SEQ ID NO: 218976 - RNA, 22 nt, Human
gugaugaaggccugcaccuggu

SEQ ID NO: 218977 - RNA, 19 nt, Human
uagacuaauucauccccuu

SEQ ID NO: 218978 - RNA, 22 nt, Human
gugaggcccaggugaaauuaac

SEQ ID NO: 218979 - RNA, 22 nt, Human
gugaguuuucgugacacuauuu

SEQ ID NO: 218980 - RNA, 22 nt, Human
gugauaguucuuacuccaaagu

SEQ ID NO: 218981 - RNA, 22 nt, Human
uagaaauaaacacugcuaccuu

SEQ ID NO: 218982 - RNA, 17 nt, Human
gugagcugagucaggac

SEQ ID NO: 218983 - RNA, 22 nt, Human
uacuuaucuuagggaugcuugc

SEQ ID NO: 218984 - RNA, 22 nt, Human
gugaguugugugaguaagcaga

SEQ ID NO: 218985 - RNA, 22 nt, Human
gugaugaagguggagaaucaga

SEQ ID NO: 218986 - RNA, 22 nt, Human
gugauggucgagcgcuuguugu

SEQ ID NO: 218987 - RNA, 22 nt, Human
uagagaaauuacagcuuucuuu

SEQ ID NO: 218988 - RNA, 22 nt, Human
uagagagaaaccaggguuuggg

SEQ ID NO: 218989 - RNA, 19 nt, Human
uagagcagcuucagauucc

SEQ ID NO: 218990 - RNA, 22 nt, Human
gugauuucaaauauagagugag

SEQ ID NO: 218991 - RNA, 22 nt, Human
uagaggauucuaaaggaagcug

SEQ ID NO: 218992 - RNA, 22 nt, Human
gugauucaucuggggccuuauu

SEQ ID NO: 218993 - RNA, 22 nt, Human
guuuuucuagaaaucuccuccu

SEQ ID NO: 218994 - RNA, 22 nt, Human
gguuaacaccacagcugggaca

SEQ ID NO: 218995 - RNA, 19 nt, Human
gguuaccagugugucuggc

SEQ ID NO: 218996 - RNA, 22 nt, Human
gguugauuuuuaugaagccaug

SEQ ID NO: 218997 - RNA, 22 nt, Human
uaaagaagaaaaggcuucaggc

SEQ ID NO: 218998 - RNA, 22 nt, Human
gguuccagacaguuauaugggc

SEQ ID NO: 218999 - RNA, 22 nt, Human
gguucuggaaaagaaagcaaag

SEQ ID NO: 219000 - RNA, 22 nt, Human
uaaagaggagaauuaagucagc

SEQ ID NO: 219001 - RNA, 23 nt, Human
uaaagauaguuuaaaggugaguu

SEQ ID NO: 219002 - RNA, 22 nt, Human
uaaagcacucaaaauuguagcu

SEQ ID NO: 219003 - RNA, 22 nt, Human
gguuuaucuuuacaaaugaaau

SEQ ID NO: 219004 - RNA, 23 nt, Human
gguuggcuguacccaggcucccu

SEQ ID NO: 219005 - RNA, 22 nt, Human
gguuuauucccacaaaggaagu

SEQ ID NO: 219006 - RNA, 22 nt, Human
guaaauacuaugagauaaugaa

SEQ ID NO: 219007 - RNA, 22 nt, Human
gguuuuuggcucaauauuuugg

SEQ ID NO: 219008 - RNA, 22 nt, Human
uaaauguacugaggcaacagga

SEQ ID NO: 219009 - RNA, 22 nt, Human
uaaagcauguuucaguaagguu

SEQ ID NO: 219010 - RNA, 22 nt, Human
uaaaugagcaccucuaguuuug

SEQ ID NO: 219011 - RNA, 22 nt, Human
gguggccuaacaaugguggcaa

SEQ ID NO: 219012 - RNA, 22 nt, Human
gguggcauguaccucacagacu

SEQ ID NO: 219013 - RNA, 22 nt, Human
guuuucuuguuaauuuugaacg

SEQ ID NO: 219014 - RNA, 22 nt, Human
guuuuguucaugaacauugggu

SEQ ID NO: 219015 - RNA, 22 nt, Human
guuuuguagucuggagacuguc

SEQ ID NO: 219016 - RNA, 22 nt, Human
guuuugaugugauuucucaugu

SEQ ID NO: 219017 - RNA, 22 nt, Human
ggucaauuuggucaaucguuua

SEQ ID NO: 219018 - RNA, 22 nt, Human
gguaugaggaugaggguggcau

SEQ ID NO: 219019 - RNA, 22 nt, Human
ggucauagagcuggaaauuggc

SEQ ID NO: 219020 - RNA, 23 nt, Human
gguagguggggagauuaaagucu

SEQ ID NO: 219021 - RNA, 22 nt, Human
guugcuaugaaauuaaaauuua

SEQ ID NO: 219022 - RNA, 22 nt, Human
guuuuagugauaagaacaccaa

SEQ ID NO: 219023 - RNA, 22 nt, Human
guuuuauaacuauagugagaau

SEQ ID NO: 219024 - RNA, 22 nt, Human
guuuuaucuauguaauuauaaa

SEQ ID NO: 219025 - RNA, 22 nt, Human
gguggagacucagauuuguugc

SEQ ID NO: 219026 - RNA, 22 nt, Human
guagucuuaggaaugauuuugu

SEQ ID NO: 219027 - RNA, 22 nt, Human
guaggggccagaaagacuuaga

SEQ ID NO: 219028 - RNA, 22 nt, Human
uaaccuuuuuuaaaguuuccug

SEQ ID NO: 219029 - RNA, 22 nt, Human
guauauuuaugagcauuagccu

SEQ ID NO: 219030 - RNA, 22 nt, Human
uaacgcaucuggaaacaggaca

SEQ ID NO: 219031 - RNA, 22 nt, Human
uaacaacuuucugguguaacuu

SEQ ID NO: 219032 - RNA, 22 nt, Human
guaaugcuuuuauuucggggaa

SEQ ID NO: 219033 - RNA, 22 nt, Human
uaacagugcuacaguuacuuuc

SEQ ID NO: 219034 - RNA, 22 nt, Human
uaacccaaaggcaaugucucga

SEQ ID NO: 219035 - RNA, 22 nt, Human
uaacauuucggugacaguggga

SEQ ID NO: 219036 - RNA, 22 nt, Human
uaacauuuaguuuuaagauggu

SEQ ID NO: 219037 - RNA, 22 nt, Human
uaacauuagcuuugcucaugca

SEQ ID NO: 219038 - RNA, 22 nt, Human
uaaccuugaagacugagcugac

SEQ ID NO: 219039 - RNA, 22 nt, Human
guagaucaugaaaauucacugc

SEQ ID NO: 219040 - RNA, 22 nt, Human
guagccauuuucuagagaguua

SEQ ID NO: 219041 - RNA, 22 nt, Human
gucacuuugcuugcgaugcucc

SEQ ID NO: 219042 - RNA, 22 nt, Human
uaagcuauuccugaagaagguu

SEQ ID NO: 219043 - RNA, 22 nt, Human
gucagacucuggggccccaggc

SEQ ID NO: 219044 - RNA, 22 nt, Human
gucagaagauagaggaaguuug

SEQ ID NO: 219045 - RNA, 22 nt, Human
gucagauucuuucauuugcuga

SEQ ID NO: 219046 - RNA, 22 nt, Human
gucaaaggcggugcaggaggag

SEQ ID NO: 219047 - RNA, 22 nt, Human
gucaaaguuaacuagcaggugc

SEQ ID NO: 219048 - RNA, 22 nt, Human
guaucaggugugagcauuuuaa

SEQ ID NO: 219049 - RNA, 22 nt, Human
uaagaaacauuuuuaugacagu

SEQ ID NO: 219050 - RNA, 22 nt, Human
uaacuuuuuauccuguuaaaug

SEQ ID NO: 219051 - RNA, 22 nt, Human
uaagacuuuaccaggcucaaau

SEQ ID NO: 219052 - RNA, 22 nt, Human
guaucugaaaaagaauucugac

SEQ ID NO: 219053 - RNA, 21 nt, Human
uaagccaccaugugaaaccag

SEQ ID NO: 219054 - RNA, 22 nt, Human
guaugugugcauacauguacga

SEQ ID NO: 219055 - RNA, 22 nt, Human
guaugugucuuagaacuuggga

SEQ ID NO: 219056 - RNA, 22 nt, Human
guaugugguaccaugcaacggg

SEQ ID NO: 219057 - RNA, 22 nt, Human
guggagaagggaccgggaagga

SEQ ID NO: 219058 - RNA, 22 nt, Human
guggagaugagauauaccccuu

SEQ ID NO: 219059 - RNA, 22 nt, Human
guggagauauuugugauagggg

SEQ ID NO: 219060 - RNA, 22 nt, Human
guggagaucuggugcccccugg

SEQ ID NO: 219061 - RNA, 22 nt, Human
gggccggcuggggcggggcggg

SEQ ID NO: 219062 - RNA, 22 nt, Human
gggccggagaagguagcugaag

SEQ ID NO: 219063 - RNA, 22 nt, Human
gggccucccggagcugcuccca

SEQ ID NO: 219064 - RNA, 22 nt, Human
guggaguggguuguacucaggg

SEQ ID NO: 219065 - RNA, 22 nt, Human
guggaggguuugcaaugugcag

SEQ ID NO: 219066 - RNA, 20 nt, Human
gggccagguggaccaggggc

SEQ ID NO: 219067 - RNA, 22 nt, Human
guggaggaagaucuuugaugau

SEQ ID NO: 219068 - RNA, 22 nt, Human
guggaaggaauuaacagacuag

SEQ ID NO: 219069 - RNA, 22 nt, Human
gggcaggacccguuagaguggc

SEQ ID NO: 219070 - RNA, 22 nt, Human
gggcaguuucaugugguucaac

SEQ ID NO: 219071 - RNA, 22 nt, Human
gggcaggcuggguggugguccc

SEQ ID NO: 219072 - RNA, 22 nt, Human
gggcagaaaggaaggcuggggg

SEQ ID NO: 219073 - RNA, 22 nt, Human
gggcacggaaggcgccaggggu

SEQ ID NO: 219074 - RNA, 22 nt, Human
guggaagggaaaccgcacuggc

SEQ ID NO: 219075 - RNA, 22 nt, Human
gggcagagagcuggaacuccuu

SEQ ID NO: 219076 - RNA, 18 nt, Human
guggccauugaccagcuu

SEQ ID NO: 219077 - RNA, 22 nt, Human
guggcgucgaugauggugucau

SEQ ID NO: 219078 - RNA, 22 nt, Human
guggcuuauguccagcagauau

SEQ ID NO: 219079 - RNA, 22 nt, Human
guggcuuucuaccauuaaauug

SEQ ID NO: 219080 - RNA, 22 nt, Human
guggcuuaauauuuauagcaga

SEQ ID NO: 219081 - RNA, 22 nt, Human
guggauggagcuggaagccauu

SEQ ID NO: 219082 - RNA, 22 nt, Human
guggcagguguacagcucagcu

SEQ ID NO: 219083 - RNA, 20 nt, Human
guggcagugguggcagcagu

SEQ ID NO: 219084 - RNA, 22 nt, Human
gugggauaaccugagauaacau

SEQ ID NO: 219085 - RNA, 22 nt, Human
gugggaguggagcucagcaugu

SEQ ID NO: 219086 - RNA, 22 nt, Human
gugggcuuuuuugaaaccugaa

SEQ ID NO: 219087 - RNA, 22 nt, Human
guggggcgggucccccgccugg

SEQ ID NO: 219088 - RNA, 22 nt, Human
gugggcacguccuacugucacu

SEQ ID NO: 219089 - RNA, 22 nt, Human
guggguauauauaugugugcug

SEQ ID NO: 219090 - RNA, 22 nt, Human
gugggggugaggaauguucuau

SEQ ID NO: 219091 - RNA, 21 nt, Human
gggccugggccagggccgggu

SEQ ID NO: 219092 - RNA, 22 nt, Human
gggccugcgcuggggggagccg

SEQ ID NO: 219093 - RNA, 22 nt, Human
gugguuugacccuucagguaaa

SEQ ID NO: 219094 - RNA, 17 nt, Human
gugguguacauuuccau

SEQ ID NO: 219095 - RNA, 23 nt, Human
gugguguaaaugccaaaaugaaa

SEQ ID NO: 219096 - RNA, 22 nt, Human
guguaucagaggcuguguuaua

SEQ ID NO: 219097 - RNA, 22 nt, Human
guguagauuuguucaccuauua

SEQ ID NO: 219098 - RNA, 22 nt, Human
guggugguguuggugacaaguu

SEQ ID NO: 219099 - RNA, 22 nt, Human
guggugggcgugguguaugccu

SEQ ID NO: 219100 - RNA, 22 nt, Human
gugguggggaguuggauggaag

SEQ ID NO: 219101 - RNA, 22 nt, Human
gggcggcguccucagucgggug

SEQ ID NO: 219102 - RNA, 22 nt, Human
gggcggggcucacggugcggca

SEQ ID NO: 219103 - RNA, 22 nt, Human
guggugaacauuugcaucugcu

SEQ ID NO: 219104 - RNA, 22 nt, Human
gugguaaagugugccugugguc

SEQ ID NO: 219105 - RNA, 22 nt, Human
guggugauuugggucuagcuuu

SEQ ID NO: 219106 - RNA, 22 nt, Human
gggcgccgggagugagagugag

SEQ ID NO: 219107 - RNA, 22 nt, Human
gugguaagugcuccuauuggcg

SEQ ID NO: 219108 - RNA, 22 nt, Human
guguugaaaaguagcacugcuu

SEQ ID NO: 219109 - RNA, 22 nt, Human
guguucuuuguagaggaucuug

SEQ ID NO: 219110 - RNA, 19 nt, Human
guguucuguuauacaguug

SEQ ID NO: 219111 - RNA, 19 nt, Human
gggcuuguuggcaaaugac

SEQ ID NO: 219112 - RNA, 22 nt, Human
gggcuuuuccaacacucuggag

SEQ ID NO: 219113 - RNA, 18 nt, Human
gggcuuugggguucuauc

SEQ ID NO: 219114 - RNA, 18 nt, Human
gggcuuuacagaguggag

SEQ ID NO: 219115 - RNA, 22 nt, Human
guguuaaucauuuuugauuuug

SEQ ID NO: 219116 - RNA, 22 nt, Human
gggcuuguuaacuuggcuucca

SEQ ID NO: 219117 - RNA, 22 nt, Human
guguuaggugcauuaaacgugg

SEQ ID NO: 219118 - RNA, 22 nt, Human
gugugcacaaucuggcaugugc

SEQ ID NO: 219119 - RNA, 22 nt, Human
guguggcgacucagagcugccu

SEQ ID NO: 219120 - RNA, 22 nt, Human
gugugaguggcuaagugugccu

SEQ ID NO: 219121 - RNA, 22 nt, Human
gugugguguuaagcaaauuaau

SEQ ID NO: 219122 - RNA, 22 nt, Human
gggcuguggggccugcagaagg

SEQ ID NO: 219123 - RNA, 22 nt, Human
gggcugcuccgcccgcugcgcc

SEQ ID NO: 219124 - RNA, 22 nt, Human
gugucuuauugauguuggcacu

SEQ ID NO: 219125 - RNA, 22 nt, Human
gugucuuggaacuggaauugag

SEQ ID NO: 219126 - RNA, 22 nt, Human
gugucauuggcuucccaagucc

SEQ ID NO: 219127 - RNA, 22 nt, Human
guucuuuacuucgcaucugcua

SEQ ID NO: 219128 - RNA, 22 nt, Human
guugaacagucacccugggagu

SEQ ID NO: 219129 - RNA, 22 nt, Human
guugagaagaccauuuuguuca

SEQ ID NO: 219130 - RNA, 22 nt, Human
guugagaaucucuagcuuagga

SEQ ID NO: 219131 - RNA, 22 nt, Human
ggguuguagagcuggaagggga

SEQ ID NO: 219132 - RNA, 22 nt, Human
ggguuguuuguauuucucugaa

SEQ ID NO: 219133 - RNA, 22 nt, Human
ggguuuuggggaggaagugagc

SEQ ID NO: 219134 - RNA, 22 nt, Human
ggguuuuaccagauguguggug

SEQ ID NO: 219135 - RNA, 22 nt, Human
gguagauacaaaaagauugugg

SEQ ID NO: 219136 - RNA, 22 nt, Human
gguagagagugaggaggggcuc

SEQ ID NO: 219137 - RNA, 22 nt, Human
gguaauugaaaguuuguugaug

SEQ ID NO: 219138 - RNA, 22 nt, Human
gguaccuggcccuggggcugcu

SEQ ID NO: 219139 - RNA, 18 nt, Human
gguacguuuugaucaaug

SEQ ID NO: 219140 - RNA, 22 nt, Human
guugagacguguauuggaaucu

SEQ ID NO: 219141 - RNA, 22 nt, Human
guugagaggccuggcucuuuuc

SEQ ID NO: 219142 - RNA, 22 nt, Human
guugauaauuaauagcuuuuga

SEQ ID NO: 219143 - RNA, 22 nt, Human
guugauuuaaccucaccuuuga

SEQ ID NO: 219144 - RNA, 22 nt, Human
gguagggggaggagaagaaaaa

SEQ ID NO: 219145 - RNA, 23 nt, Human
guugccuuugcaucuucauccau

SEQ ID NO: 219146 - RNA, 22 nt, Human
guugcaaaugggaagaugguua

SEQ ID NO: 219147 - RNA, 22 nt, Human
gggucggcacucuggcagcacc

SEQ ID NO: 219148 - RNA, 17 nt, Human
guucucaaacugacuga

SEQ ID NO: 219149 - RNA, 22 nt, Human
guucuacaacuucgcuugcaga

SEQ ID NO: 219150 - RNA, 22 nt, Human
gggucuggagauccgggugaag

SEQ ID NO: 219151 - RNA, 20 nt, Human
gggucuggcaucucucucug

SEQ ID NO: 219152 - RNA, 21 nt, Human
guucucacagcugaggugguu

SEQ ID NO: 219153 - RNA, 22 nt, Human
guuccgcggccucgcgcugagc

SEQ ID NO: 219154 - RNA, 22 nt, Human
guucaaucucucaugcauuuuc

SEQ ID NO: 219155 - RNA, 22 nt, Human
guuccugagcaguuccuggcca

SEQ ID NO: 219156 - RNA, 22 nt, Human
guuccucucacaggcuggagcu

SEQ ID NO: 219157 - RNA, 22 nt, Human
guucuguuguugaucuuuggag

SEQ ID NO: 219158 - RNA, 22 nt, Human
guucuguauauauccuagcaaa

SEQ ID NO: 219159 - RNA, 22 nt, Human
guucucuccugcuggugaugga

SEQ ID NO: 219160 - RNA, 22 nt, Human
ggguggaaugugagugugugug

SEQ ID NO: 219161 - RNA, 22 nt, Human
gggugguuccuggaucugacug

SEQ ID NO: 219162 - RNA, 22 nt, Human
ggguguggaggugacacauuug

SEQ ID NO: 219163 - RNA, 22 nt, Human
guucuuagguacucauauuuaa

SEQ ID NO: 219164 - RNA, 22 nt, Human
ggggcuuggguaagaaugcaaa

SEQ ID NO: 219165 - RNA, 22 nt, Human
gggggaaaguggagguucguga

SEQ ID NO: 219166 - RNA, 22 nt, Human
ggggcuggguuugcgcaggcuc

SEQ ID NO: 219167 - RNA, 22 nt, Human
gggggcgccgccgcucaucuca

SEQ ID NO: 219168 - RNA, 22 nt, Human
gggggcugugugcccgcucccc

SEQ ID NO: 219169 - RNA, 22 nt, Human
gggggcagguuccaggccagcu

SEQ ID NO: 219170 - RNA, 22 nt, Human
gggucauugcgugacgcgagca

SEQ ID NO: 219171 - RNA, 22 nt, Human
ggguacaccaauggaugccagg

SEQ ID NO: 219172 - RNA, 22 nt, Human
guuauuuugucuuguucaugaa

SEQ ID NO: 219173 - RNA, 18 nt, Human
guucaagcauuuugcucu

SEQ ID NO: 219174 - RNA, 22 nt, Human
guuaguucccaccccuguaaga

SEQ ID NO: 219175 - RNA, 22 nt, Human
guuauuguuauugcguugucga

SEQ ID NO: 219176 - RNA, 22 nt, Human
ggggugaggcagggcagggguc

SEQ ID NO: 219177 - RNA, 22 nt, Human
ggggugagaguguuuuaaagca

SEQ ID NO: 219178 - RNA, 22 nt, Human
guuauugggagagggaauggga

SEQ ID NO: 219179 - RNA, 22 nt, Human
guuaucauccucagaggcaguu

SEQ ID NO: 219180 - RNA, 17 nt, Human
ggggcguguauuugaug

SEQ ID NO: 219181 - RNA, 23 nt, Human
guuaccgaccugauucggcagcc

SEQ ID NO: 219182 - RNA, 22 nt, Human
guuaaaugcagauucugacuca

SEQ ID NO: 219183 - RNA, 22 nt, Human
guuaauaugcaaaacggaugcg

SEQ ID NO: 219184 - RNA, 22 nt, Human
ggggccgggccggcagacuggg

SEQ ID NO: 219185 - RNA, 22 nt, Human
ggggaggugugcaggacaccuc

SEQ ID NO: 219186 - RNA, 22 nt, Human
guuaaaaugauuugugauuuau

SEQ ID NO: 219187 - RNA, 22 nt, Human
ggggcgaguguggaccgcagcc

SEQ ID NO: 219188 - RNA, 22 nt, Human
ggggcaucguugauugcauggu

SEQ ID NO: 219189 - RNA, 22 nt, Human
ggggauuuuucuuacucuuagg

SEQ ID NO: 219190 - RNA, 22 nt, Human
ggggauuucccaaugcgaagca

SEQ ID NO: 219191 - RNA, 22 nt, Human
ggggacggcuggccggggcccc

SEQ ID NO: 219192 - RNA, 22 nt, Human
ggggagaugauaagugcauuug

SEQ ID NO: 219193 - RNA, 22 nt, Human
ggggacuugguuuuaaugagcu

SEQ ID NO: 219194 - RNA, 22 nt, Human
guguugaugugucuguauucua

SEQ ID NO: 219195 - RNA, 22 nt, Human
ggggaauaaacacuuugucacu

SEQ ID NO: 219196 - RNA, 22 nt, Human
ggggaaggaaggggagggcacg

SEQ ID NO: 219197 - RNA, 22 nt, Human
ggggaggguuuggaugagaguc

SEQ ID NO: 219198 - RNA, 21 nt, Human
guguugugagguugguguuag

SEQ ID NO: 219199 - RNA, 22 nt, Human
guguuugagagguacaagggaa

SEQ ID NO: 219200 - RNA, 23 nt, Human
guguuguugauuuucgaaucuuu

SEQ ID NO: 219201 - RNA, 22 nt, Human
guguuuauguuuuugcuaggga

SEQ ID NO: 219202 - RNA, 22 nt, Human
ggaagcuguugugagugcagca

SEQ ID NO: 219203 - RNA, 22 nt, Human
ggaagccugggcgcaggcaggg

SEQ ID NO: 219204 - RNA, 22 nt, Human
gcugggacacacagucuucuuu

SEQ ID NO: 219205 - RNA, 22 nt, Human
gcugggucucucccugguccug

SEQ ID NO: 219206 - RNA, 22 nt, Human
gcuggguuguucuccuggucca

SEQ ID NO: 219207 - RNA, 22 nt, Human
gcuggguaguucuuguuuggga

SEQ ID NO: 219208 - RNA, 22 nt, Human
gcugggccucuuacuucuuacg

SEQ ID NO: 219209 - RNA, 22 nt, Human
ggaauaaaaggagguggcgaga

SEQ ID NO: 219210 - RNA, 22 nt, Human
gccugcugggcucuuccugcug

SEQ ID NO: 219211 - RNA, 22 nt, Human
ggaauacggguuuauuuagucu

SEQ ID NO: 219212 - RNA, 22 nt, Human
gccuggaaugcaaugugacgaa

SEQ ID NO: 219213 - RNA, 20 nt, Human
ggaaguauccacaaauuccu

SEQ ID NO: 219214 - RNA, 22 nt, Human
ggaagaggaagaugaggcagca

SEQ ID NO: 219215 - RNA, 22 nt, Human
ggaaguuaguucuuggcaaagg

SEQ ID NO: 219216 - RNA, 22 nt, Human
gcgcacaaccccguggcgguga

SEQ ID NO: 219217 - RNA, 22 nt, Human
ggacugggagaauggaggcaag

SEQ ID NO: 219218 - RNA, 22 nt, Human
ggacggggagcuggaaagggga

SEQ ID NO: 219219 - RNA, 22 nt, Human
ggaccagagcuaaugcgcgccc

SEQ ID NO: 219220 - RNA, 22 nt, Human
ggacaauuguacucgauuucaa

SEQ ID NO: 219221 - RNA, 22 nt, Human
gccuuuauauuacauuuggaag

SEQ ID NO: 219222 - RNA, 22 nt, Human
ggagaugaaugugguaaaacug

SEQ ID NO: 219223 - RNA, 22 nt, Human
ggagcaagagugagcaagcaga

SEQ ID NO: 219224 - RNA, 22 nt, Human
ggagaugucugugccacgucuc

SEQ ID NO: 219225 - RNA, 22 nt, Human
ggagauaugugaaaaagacagc

SEQ ID NO: 219226 - RNA, 22 nt, Human
ggagagcuagugagcuggaggu

SEQ ID NO: 219227 - RNA, 22 nt, Human
gcgcgccugccucccgcggugc

SEQ ID NO: 219228 - RNA, 20 nt, Human
gcgcaguuccgggcgcgucu

SEQ ID NO: 219229 - RNA, 22 nt, Human
gcgcagugagguuaagaaugca

SEQ ID NO: 219230 - RNA, 20 nt, Human
ggauugaacuauuucucagc

SEQ ID NO: 219231 - RNA, 22 nt, Human
ggaugggcuuggggaggucuag

SEQ ID NO: 219232 - RNA, 22 nt, Human
ggauuucuucucauaacugaga

SEQ ID NO: 219233 - RNA, 22 nt, Human
ggcaaagaguacaucguccugg

SEQ ID NO: 219234 - RNA, 22 nt, Human
ggcagaaaacaauaaccauuuc

SEQ ID NO: 219235 - RNA, 23 nt, Human
gcgggcggagccgggaggcgggg

SEQ ID NO: 219236 - RNA, 23 nt, Human
ggauccugacauauaccaucacc

SEQ ID NO: 219237 - RNA, 22 nt, Human
ggaucagcgagaagggcugaaa

SEQ ID NO: 219238 - RNA, 20 nt, Human
ggagcgggcauuuguguucc

SEQ ID NO: 219239 - RNA, 22 nt, Human
ggagccuggaguuucugauggg

SEQ ID NO: 219240 - RNA, 22 nt, Human
ggaugaguuguauauaggauuc

SEQ ID NO: 219241 - RNA, 22 nt, Human
ggaugcugcuccacaucccaca

SEQ ID NO: 219242 - RNA, 20 nt, Human
gcucaguggagaaaugcacc

SEQ ID NO: 219243 - RNA, 22 nt, Human
gcucagccuuuuguucuauuca

SEQ ID NO: 219244 - RNA, 22 nt, Human
gcuccagcuccauaaacauaag

SEQ ID NO: 219245 - RNA, 22 nt, Human
gcucccagcuuuuguccacggc

SEQ ID NO: 219246 - RNA, 22 nt, Human
gcuauuuagaaaggcuuggaga

SEQ ID NO: 219247 - RNA, 22 nt, Human
ggcaggauggagcagggcuaaa

SEQ ID NO: 219248 - RNA, 22 nt, Human
ggcaggaaguaaggaugcuaca

SEQ ID NO: 219249 - RNA, 22 nt, Human
gcuacaacugugucuguggggc

SEQ ID NO: 219250 - RNA, 21 nt, Human
ggcagagaagcuggaaguugg

SEQ ID NO: 219251 - RNA, 22 nt, Human
ggcagaggagcuggaaacaugg

SEQ ID NO: 219252 - RNA, 22 nt, Human
ggcagagguagcuggaaccagg

SEQ ID NO: 219253 - RNA, 22 nt, Human
gcuaagcuuugagucuggacag

SEQ ID NO: 219254 - RNA, 22 nt, Human
gcgguggcuacuaaaguucgaa

SEQ ID NO: 219255 - RNA, 22 nt, Human
gcggguggaggagggacgggca

SEQ ID NO: 219256 - RNA, 22 nt, Human
gcgguguuuuaacacucccucg

SEQ ID NO: 219257 - RNA, 23 nt, Human
gcucugauaccagcuacaucuag

SEQ ID NO: 219258 - RNA, 21 nt, Human
gcucccgaagugcucggcguu

SEQ ID NO: 219259 - RNA, 22 nt, Human
gcugagcagcgaaggcacaugc

SEQ ID NO: 219260 - RNA, 22 nt, Human
gcucuugcuuuuucuagaaaga

SEQ ID NO: 219261 - RNA, 22 nt, Human
gcugccgcugcggggcgcgggc

SEQ ID NO: 219262 - RNA, 22 nt, Human
ggccagcgugggggaguagcgg

SEQ ID NO: 219263 - RNA, 22 nt, Human
gcugcccauugcucucccacuc

SEQ ID NO: 219264 - RNA, 22 nt, Human
ggcccgcgcugcuggcgcgcca

SEQ ID NO: 219265 - RNA, 22 nt, Human
ggccagucaaggggauccugaa

SEQ ID NO: 219266 - RNA, 22 nt, Human
ggccgcuuucuggggagugagg

SEQ ID NO: 219267 - RNA, 22 nt, Human
ggcccugcuuccccaguguaca

SEQ ID NO: 219268 - RNA, 22 nt, Human
ggcccuggggcaggagcagagg

SEQ ID NO: 219269 - RNA, 22 nt, Human
ggccgggcaugcgagcugagcg

SEQ ID NO: 219270 - RNA, 22 nt, Human
ggccuccaucuuaucuuacucu

SEQ ID NO: 219271 - RNA, 18 nt, Human
ggccucagccuggccgga

SEQ ID NO: 219272 - RNA, 22 nt, Human
ggccugcuaccagcugugaccu

SEQ ID NO: 219273 - RNA, 22 nt, Human
ggccugcucuggcuguggucag

SEQ ID NO: 219274 - RNA, 22 nt, Human
ggccuggcacauaguaggcagu

SEQ ID NO: 219275 - RNA, 22 nt, Human
ggccuggccuccugcuuuucca

SEQ ID NO: 219276 - RNA, 22 nt, Human
ggcuaaucaagaaggcccagug

SEQ ID NO: 219277 - RNA, 22 nt, Human
ggcgucuugcgggcgguagcgc

SEQ ID NO: 219278 - RNA, 22 nt, Human
ggcggaggucacgcacccgcca

SEQ ID NO: 219279 - RNA, 22 nt, Human
ggcgcuccccgccugcgucgcg

SEQ ID NO: 219280 - RNA, 22 nt, Human
ggcggagggcuguguccccggc

SEQ ID NO: 219281 - RNA, 22 nt, Human
ggcgccauuuuugccuucggag

SEQ ID NO: 219282 - RNA, 23 nt, Human
ggccuuuuuaaccgcgagcgaca

SEQ ID NO: 219283 - RNA, 22 nt, Human
ggccuugggauguggcugcagc

SEQ ID NO: 219284 - RNA, 22 nt, Human
ggccuucuuuucaugucuuucg

SEQ ID NO: 219285 - RNA, 22 nt, Human
ggccuugauuccggucauugaa

SEQ ID NO: 219286 - RNA, 22 nt, Human
gcugccuugaacuuggccuggg

SEQ ID NO: 219287 - RNA, 23 nt, Human
gcugccguuucccaucgugguga

SEQ ID NO: 219288 - RNA, 22 nt, Human
gcugcucaaaaaaacacuagcu

SEQ ID NO: 219289 - RNA, 22 nt, Human
gcugcgcugggacgccaccaac

SEQ ID NO: 219290 - RNA, 22 nt, Human
gcugcgcgcagccggcgccgag

SEQ ID NO: 219291 - RNA, 22 nt, Human
gcugcgccgggagccggggccg

SEQ ID NO: 219292 - RNA, 22 nt, Human
ggcugugaaguacguugaaggu

SEQ ID NO: 219293 - RNA, 18 nt, Human
ggcugggcugugccccuu

SEQ ID NO: 219294 - RNA, 22 nt, Human
ggcuggagcaggcugcacagug

SEQ ID NO: 219295 - RNA, 22 nt, Human
ggcuggggccuguugaagaugc

SEQ ID NO: 219296 - RNA, 22 nt, Human
ggcugggagguggcgaggaggc

SEQ ID NO: 219297 - RNA, 22 nt, Human
gcugguuacuucauuagguccu

SEQ ID NO: 219298 - RNA, 22 nt, Human
gcuggucuggcaauccucaugg

SEQ ID NO: 219299 - RNA, 19 nt, Human
gcugggauaggauguauuu

SEQ ID NO: 219300 - RNA, 22 nt, Human
gcuggggaucgaaggcagagcc

SEQ ID NO: 219301 - RNA, 22 nt, Human
ggcuuauauguauucccagaga

SEQ ID NO: 219302 - RNA, 22 nt, Human
ggcugugggguccuguggugug

SEQ ID NO: 219303 - RNA, 22 nt, Human
gcugucccccaaagaugcuccu

SEQ ID NO: 219304 - RNA, 22 nt, Human
ggcuuacgcgcuaacagugaau

SEQ ID NO: 219305 - RNA, 22 nt, Human
ggcuuaguagggacagaugcac

SEQ ID NO: 219306 - RNA, 22 nt, Human
gcugucaggaacaugccuuggu

SEQ ID NO: 219307 - RNA, 22 nt, Human
gcugguuucucucauugucagu

SEQ ID NO: 219308 - RNA, 22 nt, Human
gcuguaacuuuuucauuuucaa

SEQ ID NO: 219309 - RNA, 18 nt, Human
gcuguccgguagcuggug

SEQ ID NO: 219310 - RNA, 22 nt, Human
gcuguauaucuuuugaagugau

SEQ ID NO: 219311 - RNA, 22 nt, Human
ggcucagaggagcuggaacggu

SEQ ID NO: 219312 - RNA, 22 nt, Human
ggcuccagauguccccuggcaa

SEQ ID NO: 219313 - RNA, 22 nt, Human
gcuggaagggccagcuuucagg

SEQ ID NO: 219314 - RNA, 22 nt, Human
gcugcuucgcugcacacccgag

SEQ ID NO: 219315 - RNA, 22 nt, Human
gcuggauaaggaucaguuucuu

SEQ ID NO: 219316 - RNA, 22 nt, Human
gcuggaugucugugccaggcac

SEQ ID NO: 219317 - RNA, 22 nt, Human
ggcugaggccucuggggaggga

SEQ ID NO: 219318 - RNA, 22 nt, Human
ggcugaugacgccugagucuga

SEQ ID NO: 219319 - RNA, 22 nt, Human
ggcugagguguggggaacuaua

SEQ ID NO: 219320 - RNA, 22 nt, Human
ggcugcuugauagauaugagua

SEQ ID NO: 219321 - RNA, 22 nt, Human
ggcugcuauuggucuggcuugg

SEQ ID NO: 219322 - RNA, 22 nt, Human
ggcugcagggaacaggaugggu

SEQ ID NO: 219323 - RNA, 21 nt, Human
ggcugcucgugaugaacuuca

SEQ ID NO: 219324 - RNA, 22 nt, Human
gcuggcggguuggggaggcgga

SEQ ID NO: 219325 - RNA, 22 nt, Human
gcuggccugcgagggcaggcug

SEQ ID NO: 219326 - RNA, 22 nt, Human
ggcuggaacuucuucuggcauu

SEQ ID NO: 219327 - RNA, 22 nt, Human
gcugggagaggcagcuuucgga

SEQ ID NO: 219328 - RNA, 22 nt, Human
gcugggagucgcgucuguggcc

SEQ ID NO: 219329 - RNA, 22 nt, Human
ggcagucaucacuuauucauca

SEQ ID NO: 219330 - RNA, 22 nt, Human
ggcagguggcacugcugcuccc

SEQ ID NO: 219331 - RNA, 22 nt, Human
ggugcguggcccauccuccacc

SEQ ID NO: 219332 - RNA, 22 nt, Human
gguggcuucuguuugcaagagg

SEQ ID NO: 219333 - RNA, 22 nt, Human
ggugggaauccaggccuucauc

SEQ ID NO: 219334 - RNA, 22 nt, Human
ggugcugcugcugaacccagcu

SEQ ID NO: 219335 - RNA, 22 nt, Human
gguggggacuuggggucagcgg

SEQ ID NO: 219336 - RNA, 22 nt, Human
gguggcuugcugguaggugugc

SEQ ID NO: 219337 - RNA, 19 nt, Human
ggugggacaggugagauau

SEQ ID NO: 219338 - RNA, 22 nt, Human
gguggucaggagcgcccguugg

SEQ ID NO: 219339 - RNA, 22 nt, Human
ggcagugguaggagcccaggag

SEQ ID NO: 219340 - RNA, 22 nt, Human
ggcagguccugaguccugaggc

SEQ ID NO: 219341 - RNA, 18 nt, Human
ggcagggcucagcugcuc

SEQ ID NO: 219342 - RNA, 22 nt, Human
ggcagggagagcgccgccaugc

SEQ ID NO: 219343 - RNA, 22 nt, Human
ggcagggacugggauauggaga

SEQ ID NO: 219344 - RNA, 22 nt, Human
ggcagggagagcaugcugauaa

SEQ ID NO: 219345 - RNA, 22 nt, Human
ggcagcgcuuggcugcucgaca

SEQ ID NO: 219346 - RNA, 22 nt, Human
ggcagggaauucagagggaagg

SEQ ID NO: 219347 - RNA, 22 nt, Human
ggcagcuuucaauaggguuaug

SEQ ID NO: 219348 - RNA, 22 nt, Human
ggcagcagaacuggcccuguau

SEQ ID NO: 219349 - RNA, 22 nt, Human
ggcagcccuggacccuggagaa

SEQ ID NO: 219350 - RNA, 22 nt, Human
ggugcagucuggggcacauuau

SEQ ID NO: 219351 - RNA, 22 nt, Human
ggugcaauaaaguuguagaacc

SEQ ID NO: 219352 - RNA, 19 nt, Human
ggugaucugucccuugcuc

SEQ ID NO: 219353 - RNA, 22 nt, Human
ggauggugauguacccagucau

SEQ ID NO: 219354 - RNA, 22 nt, Human
gguauagacaaauuauauaucc

SEQ ID NO: 219355 - RNA, 22 nt, Human
ggauugaagggaaccucagaau

SEQ ID NO: 219356 - RNA, 22 nt, Human
gguaauguucugaugaauuugu

SEQ ID NO: 219357 - RNA, 22 nt, Human
ggguguuaugccucugagucag

SEQ ID NO: 219358 - RNA, 22 nt, Human
ggauaauguauuuuaaaauggg

SEQ ID NO: 219359 - RNA, 22 nt, Human
gggugugcuaaaccuacgcaca

SEQ ID NO: 219360 - RNA, 22 nt, Human
ggauaauugaugauuuauaaga

SEQ ID NO: 219361 - RNA, 22 nt, Human
ggauuugaugagacuaucuacu

SEQ ID NO: 219362 - RNA, 22 nt, Human
ggcaccuuucaucccaucuaga

SEQ ID NO: 219363 - RNA, 22 nt, Human
ggucgagcagcacccguucggc

SEQ ID NO: 219364 - RNA, 22 nt, Human
ggucgguuggagagaucaugaa

SEQ ID NO: 219365 - RNA, 22 nt, Human
ggucggggcuggccggcguggu

SEQ ID NO: 219366 - RNA, 22 nt, Human
ggucuuccuugggggacuugaa

SEQ ID NO: 219367 - RNA, 22 nt, Human
ggucugagcaaguuaccauggg

SEQ ID NO: 219368 - RNA, 20 nt, Human
ggucuguuucuucuuuucau

SEQ ID NO: 219369 - RNA, 22 nt, Human
ggucugauaccugcagguuguc

SEQ ID NO: 219370 - RNA, 22 nt, Human
ggucuagcucggugcuggcgac

SEQ ID NO: 219371 - RNA, 22 nt, Human
gguguauucuccaguuuuagca

SEQ ID NO: 219372 - RNA, 22 nt, Human
gguguagggaaacuugacuaau

SEQ ID NO: 219373 - RNA, 22 nt, Human
gguuuuccaguagaucagaaga

SEQ ID NO: 219374 - RNA, 22 nt, Human
ggccgccacacagauucccccg

SEQ ID NO: 219375 - RNA, 22 nt, Human
guaacugguuuucuucccucuc

SEQ ID NO: 219376 - RNA, 22 nt, Human
guaauucugugugaaucuauua

SEQ ID NO: 219377 - RNA, 22 nt, Human
guaauaggagggagucugcuuu

SEQ ID NO: 219378 - RNA, 22 nt, Human
guaccuguacauaacuacauau

SEQ ID NO: 219379 - RNA, 22 nt, Human
guaccuuucuaucuagaaggua

SEQ ID NO: 219380 - RNA, 22 nt, Human
guacaaagucaaggugaaaaua

SEQ ID NO: 219381 - RNA, 22 nt, Human
guacauauggcacaugcuauuu

SEQ ID NO: 219382 - RNA, 22 nt, Human
guaaaucuuggcaucugcuuuc

SEQ ID NO: 219383 - RNA, 22 nt, Human
guaagaauauacccaggaguca

SEQ ID NO: 219384 - RNA, 22 nt, Human
guaaacugaauuggauacugug

SEQ ID NO: 219385 - RNA, 22 nt, Human
gguuuucuuguucauuuuuuaa

SEQ ID NO: 219386 - RNA, 22 nt, Human
guagcaugauuuuaaaauccug

SEQ ID NO: 219387 - RNA, 22 nt, Human
guagccacugaaguaaggccac

SEQ ID NO: 219388 - RNA, 22 nt, Human
guagugauuguuccucaggggu

SEQ ID NO: 219389 - RNA, 22 nt, Human
guacuugauucauuauugcauu

SEQ ID NO: 219390 - RNA, 22 nt, Human
guagauaauuuuggaaagcugg

SEQ ID NO: 219391 - RNA, 22 nt, Human
guagaauggggcucucaaagca

SEQ ID NO: 219392 - RNA, 22 nt, Human
guagagcagaaacauggagaaa

SEQ ID NO: 219393 - RNA, 22 nt, Human
ggccgccacuuuccagugcugc

SEQ ID NO: 219394 - RNA, 22 nt, Human
ggccgccgcuuagcugagcccc

SEQ ID NO: 219395 - RNA, 22 nt, Human
guaguuuuugagcuguaaucuu

SEQ ID NO: 219396 - RNA, 22 nt, Human
guaguuuucaugguuagaaaua

SEQ ID NO: 219397 - RNA, 22 nt, Human
guaguggaauuuagaguauaau

SEQ ID NO: 219398 - RNA, 22 nt, Human
guaguucuccaggggcuguuca

SEQ ID NO: 219399 - RNA, 22 nt, Human
guaguucuuucucaauguucaa

SEQ ID NO: 219400 - RNA, 22 nt, Human
ggccgggugggaggcagcggag

SEQ ID NO: 219401 - RNA, 22 nt, Human
guaguuuuucuugcaagaguag

SEQ ID NO: 219402 - RNA, 20 nt, Human
ggccugagcauggcuggcag

SEQ ID NO: 219403 - RNA, 22 nt, Human
ggccugagaagcaaggacacaa

SEQ ID NO: 219404 - RNA, 22 nt, Human
gggcaagaggguuugacaugag

SEQ ID NO: 219405 - RNA, 22 nt, Human
gggauuuaaugggaaaaauaug

SEQ ID NO: 219406 - RNA, 22 nt, Human
ggaaagaggacaucuuacuucu

SEQ ID NO: 219407 - RNA, 22 nt, Human
ggaaaaucaaaccauuuacagu

SEQ ID NO: 219408 - RNA, 22 nt, Human
ggaaaagaauuguuaguuagug

SEQ ID NO: 219409 - RNA, 22 nt, Human
gggagggggauucuggcgagaa

SEQ ID NO: 219410 - RNA, 22 nt, Human
gggauuaaaaaucaccaaagua

SEQ ID NO: 219411 - RNA, 22 nt, Human
gggauguuuugcaggcaaagaa

SEQ ID NO: 219412 - RNA, 22 nt, Human
gggagcugagcuggaagagaau

SEQ ID NO: 219413 - RNA, 22 nt, Human
ggcuuccuggugcagaguuaua

SEQ ID NO: 219414 - RNA, 23 nt, Human
gcuuugaaaaugcuuucuuccag

SEQ ID NO: 219415 - RNA, 22 nt, Human
gcuguggacacagcucucuuca

SEQ ID NO: 219416 - RNA, 21 nt, Human
gggaggagcuucccuuugccc

SEQ ID NO: 219417 - RNA, 22 nt, Human
gcuuuccuggcccugucccugc

SEQ ID NO: 219418 - RNA, 22 nt, Human
gcuuuguugauggugagucugu

SEQ ID NO: 219419 - RNA, 22 nt, Human
gcuuuucaaguuacaauuagcu

SEQ ID NO: 219420 - RNA, 23 nt, Human
ggaauuucagaugugaaauaaaa

SEQ ID NO: 219421 - RNA, 22 nt, Human
ggaauugagcaagggguggggc

SEQ ID NO: 219422 - RNA, 22 nt, Human
gggcuacagaugggagggauga

SEQ ID NO: 219423 - RNA, 20 nt, Human
gggcucugcauccaucagcc

SEQ ID NO: 219424 - RNA, 22 nt, Human
gggcgcgcggagccucgccggg

SEQ ID NO: 219425 - RNA, 22 nt, Human
gggcgcuguguuaggugcugua

SEQ ID NO: 219426 - RNA, 22 nt, Human
gggcgcuuucugggucagggcu

SEQ ID NO: 219427 - RNA, 22 nt, Human
gggcggugccugucuccgaagc

SEQ ID NO: 219428 - RNA, 22 nt, Human
gggcggccugcucuguggggag

SEQ ID NO: 219429 - RNA, 17 nt, Human
ggaagaaaaggaucauc

SEQ ID NO: 219430 - RNA, 22 nt, Human
ggaacaguacucggaggccaga

SEQ ID NO: 219431 - RNA, 19 nt, Human
ggaacgcugggcuccccuc

SEQ ID NO: 219432 - RNA, 22 nt, Human
gggcaugugauggacgugugcc

SEQ ID NO: 219433 - RNA, 22 nt, Human
ggaaagagaaacaugaacuaga

SEQ ID NO: 219434 - RNA, 22 nt, Human
gggcaggggcagugguggcauu

SEQ ID NO: 219435 - RNA, 22 nt, Human
ggaaggugagugcugugugauu

SEQ ID NO: 219436 - RNA, 22 nt, Human
ggaagguauuucuccuugagug

SEQ ID NO: 219437 - RNA, 18 nt, Human
ggaaggugcuggagugca

SEQ ID NO: 219438 - RNA, 22 nt, Human
gggcgcaagcaugugucugggu

SEQ ID NO: 219439 - RNA, 22 nt, Human
gggccuuggaggagaaggacuu

SEQ ID NO: 219440 - RNA, 22 nt, Human
ggaagugagcucauuacuuuag

SEQ ID NO: 219441 - RNA, 22 nt, Human
gggcgcgccaggagcugcgcgg

SEQ ID NO: 219442 - RNA, 22 nt, Human
ggagagcguggaugggcuucca

SEQ ID NO: 219443 - RNA, 22 nt, Human
ggagaggaaguuuaaagaauug

SEQ ID NO: 219444 - RNA, 22 nt, Human
ggagacagauggcgucucaguu

SEQ ID NO: 219445 - RNA, 22 nt, Human
ggagaagaggagcuggaagccu

SEQ ID NO: 219446 - RNA, 23 nt, Human
ggagaaggaugucaucaaaagac

SEQ ID NO: 219447 - RNA, 22 nt, Human
ggggaauuaaaugagaagccuu

SEQ ID NO: 219448 - RNA, 22 nt, Human
ggacauggaaagugugugauuu

SEQ ID NO: 219449 - RNA, 22 nt, Human
gggcugaugcuuauacauacug

SEQ ID NO: 219450 - RNA, 22 nt, Human
gggcuggggcucuggggcuagg

SEQ ID NO: 219451 - RNA, 22 nt, Human
gggcuguaggagcuggaauggg

SEQ ID NO: 219452 - RNA, 22 nt, Human
gggcugagagcuggaaucugag

SEQ ID NO: 219453 - RNA, 22 nt, Human
gggcuggcaguuuucugaguuc

SEQ ID NO: 219454 - RNA, 22 nt, Human
ggggaagaaauagaacauuuug

SEQ ID NO: 219455 - RNA, 22 nt, Human
ggggaagugguggggcuccgag

SEQ ID NO: 219456 - RNA, 22 nt, Human
ggggaaauauuucugaccugug

SEQ ID NO: 219457 - RNA, 22 nt, Human
ggggaagagagaagaaugaucu

SEQ ID NO: 219458 - RNA, 22 nt, Human
ggagaaacuaguuagauccaau

SEQ ID NO: 219459 - RNA, 18 nt, Human
ggagaagaacagaugugg

SEQ ID NO: 219460 - RNA, 22 nt, Human
ggaggaagagaccagggggcuu

SEQ ID NO: 219461 - RNA, 22 nt, Human
ggagaucuuggacuggccggcc

SEQ ID NO: 219462 - RNA, 22 nt, Human
gggguauuugguagacauuuug

SEQ ID NO: 219463 - RNA, 22 nt, Human
ggggucugaucccuucuggcuu

SEQ ID NO: 219464 - RNA, 22 nt, Human
ggggcggcgugggcgcggugau

SEQ ID NO: 219465 - RNA, 22 nt, Human
ggggcguugccacggggacggg

SEQ ID NO: 219466 - RNA, 22 nt, Human
ggggcggggagcaugagcuggg

SEQ ID NO: 219467 - RNA, 22 nt, Human
gggugguggagguuugacagac

SEQ ID NO: 219468 - RNA, 22 nt, Human
ggaguucaaaucuuuuggaucu

SEQ ID NO: 219469 - RNA, 22 nt, Human
ggauaaaugaaggcauacagau

SEQ ID NO: 219470 - RNA, 22 nt, Human
ggaguucacagcaauggaacag

SEQ ID NO: 219471 - RNA, 22 nt, Human
ggguauuugacaaacugacacu

SEQ ID NO: 219472 - RNA, 22 nt, Human
ggaggcggaaguccaagcaggu

SEQ ID NO: 219473 - RNA, 22 nt, Human
ggagggaggggugggagaugga

SEQ ID NO: 219474 - RNA, 22 nt, Human
gggguugauaauuagagaaaug

SEQ ID NO: 219475 - RNA, 22 nt, Human
ggguggugauacugcuucugcc

SEQ ID NO: 219476 - RNA, 21 nt, Human
gccacugcugcucauucucug

SEQ ID NO: 219477 - RNA, 22 nt, Human
gccagcuuagaucccccagccc

SEQ ID NO: 219478 - RNA, 22 nt, Human
gcugcagggagcuggaaggcuc

SEQ ID NO: 219479 - RNA, 22 nt, Human
gcugcaggaggugguagggucu

SEQ ID NO: 219480 - RNA, 22 nt, Human
gcugcccucccagggcaagcuu

SEQ ID NO: 219481 - RNA, 23 nt, Human
gcauuugcaggaaacuggaaaag

SEQ ID NO: 219482 - RNA, 22 nt, Human
gcauuucauaaccagccaugcu

SEQ ID NO: 219483 - RNA, 22 nt, Human
gcugcacgguccuggcaccacg

SEQ ID NO: 219484 - RNA, 22 nt, Human
gcucugcuccaucuguuuccuc

SEQ ID NO: 219485 - RNA, 22 nt, Human
gcucugaacugucaugaauugg

SEQ ID NO: 219486 - RNA, 22 nt, Human
gcucuccuugaugcccucuguu

SEQ ID NO: 219487 - RNA, 22 nt, Human
gcucuggcuacuguggcuaccg

SEQ ID NO: 219488 - RNA, 22 nt, Human
gcucuggcugccuuaguuuugu

SEQ ID NO: 219489 - RNA, 22 nt, Human
gcugagaguguaggauguuuac

SEQ ID NO: 219490 - RNA, 22 nt, Human
gccauguucuugaaucuggguc

SEQ ID NO: 219491 - RNA, 22 nt, Human
gccaugguggggccucccugac

SEQ ID NO: 219492 - RNA, 21 nt, Human
gcuggcugucucuuacacggu

SEQ ID NO: 219493 - RNA, 22 nt, Human
gcccagaagguagcgaguaguc

SEQ ID NO: 219494 - RNA, 22 nt, Human
gccauguuuugguaaauaccau

SEQ ID NO: 219495 - RNA, 22 nt, Human
gcuggcgauggccgagucuccg

SEQ ID NO: 219496 - RNA, 22 nt, Human
gccaucugcuuagauugcuggg

SEQ ID NO: 219497 - RNA, 22 nt, Human
gcuggaaauaacuuguguagaa

SEQ ID NO: 219498 - RNA, 22 nt, Human
gcugcuggcggagcuggcgcug

SEQ ID NO: 219499 - RNA, 22 nt, Human
gcugcuggcuuccugcuguuuu

SEQ ID NO: 219500 - RNA, 22 nt, Human
gcugcuacagagcuggaggggg

SEQ ID NO: 219501 - RNA, 22 nt, Human
gccaggcagcagcgaggauggu

SEQ ID NO: 219502 - RNA, 22 nt, Human
gccaggccuggguggagcgcuc

SEQ ID NO: 219503 - RNA, 22 nt, Human
gcugcuuagaaccauauuuaaa

SEQ ID NO: 219504 - RNA, 22 nt, Human
gcugcuuacuauaggguuaacu

SEQ ID NO: 219505 - RNA, 22 nt, Human
gccagggcucgagcaggccagc

SEQ ID NO: 219506 - RNA, 22 nt, Human
gccauauucaugcaggugcuaa

SEQ ID NO: 219507 - RNA, 22 nt, Human
gccagucgucuuuauuacagcu

SEQ ID NO: 219508 - RNA, 22 nt, Human
gccaguaaaguaucuccuuuug

SEQ ID NO: 219509 - RNA, 22 nt, Human
gccaggugauuucaaaguccuu

SEQ ID NO: 219510 - RNA, 22 nt, Human
gcucccaguucccaaagugacc

SEQ ID NO: 219511 - RNA, 22 nt, Human
gcaucuguuguguuaauuuaca

SEQ ID NO: 219512 - RNA, 22 nt, Human
gcaucuccugagucagauuuug

SEQ ID NO: 219513 - RNA, 22 nt, Human
gcucgauugucaguguuaggga

SEQ ID NO: 219514 - RNA, 22 nt, Human
gcuauuggcuaauuguugcaac

SEQ ID NO: 219515 - RNA, 22 nt, Human
gcuacaaauaaaaugggugacu

SEQ ID NO: 219516 - RNA, 22 nt, Human
gcuacaaaaccagggcaaagga

SEQ ID NO: 219517 - RNA, 22 nt, Human
gcuaagucaaaaaauucaaaau

SEQ ID NO: 219518 - RNA, 22 nt, Human
gcguguauuccagaccuuaacg

SEQ ID NO: 219519 - RNA, 22 nt, Human
gcgugugugauaugccucugca

SEQ ID NO: 219520 - RNA, 22 nt, Human
gcgugcauggccguguguaugc

SEQ ID NO: 219521 - RNA, 22 nt, Human
gcgugcauguguguaugcgugu

SEQ ID NO: 219522 - RNA, 19 nt, Human
gcggcggugccggcuggga

SEQ ID NO: 219523 - RNA, 22 nt, Human
gcggcgucccagcuccgacggc

SEQ ID NO: 219524 - RNA, 22 nt, Human
gcggcuggcuguccaaacuggg

SEQ ID NO: 219525 - RNA, 22 nt, Human
gcgggccggcaggggaggaguu

SEQ ID NO: 219526 - RNA, 22 nt, Human
gcggcggcggaggcgggggcag

SEQ ID NO: 219527 - RNA, 22 nt, Human
gcagcguuaacauuuuuccugu

SEQ ID NO: 219528 - RNA, 22 nt, Human
gcggggcucuacuuggccugga

SEQ ID NO: 219529 - RNA, 22 nt, Human
gcggucuaggaccucagugugu

SEQ ID NO: 219530 - RNA, 22 nt, Human
gcgggugagauucgagagaugg

SEQ ID NO: 219531 - RNA, 22 nt, Human
gcggggggcucgggcagcucgg

SEQ ID NO: 219532 - RNA, 22 nt, Human
gcaggacuucuguuuaaccagu

SEQ ID NO: 219533 - RNA, 22 nt, Human
gcaggaaugguacauaccuguu

SEQ ID NO: 219534 - RNA, 22 nt, Human
gcgguuguucugugugcaugga

SEQ ID NO: 219535 - RNA, 22 nt, Human
gcguagaagaaagcugcugcua

SEQ ID NO: 219536 - RNA, 22 nt, Human
gcagccagggaccuuugacuau

SEQ ID NO: 219537 - RNA, 22 nt, Human
gcggacaauggaagaugucauu

SEQ ID NO: 219538 - RNA, 22 nt, Human
gccuuuugcaaugguguuggug

SEQ ID NO: 219539 - RNA, 22 nt, Human
gccuuuuaaggcagagggagau

SEQ ID NO: 219540 - RNA, 22 nt, Human
gcggcaguccuuccaguacagg

SEQ ID NO: 219541 - RNA, 22 nt, Human
gcggaucuccuugagugggcaa

SEQ ID NO: 219542 - RNA, 22 nt, Human
gcagccucugcaguucaggagg

SEQ ID NO: 219543 - RNA, 22 nt, Human
gcagccauggcuggccgggcau

SEQ ID NO: 219544 - RNA, 18 nt, Human
gaugaagaggaagaggag

SEQ ID NO: 219545 - RNA, 22 nt, Human
gaucauauccagucaccacuau

SEQ ID NO: 219546 - RNA, 22 nt, Human
gaucauuuucauuaauguugca

SEQ ID NO: 219547 - RNA, 22 nt, Human
gcauuuuaauuggggcaguuag

SEQ ID NO: 219548 - RNA, 22 nt, Human
gauauucauaggcagguauuua

SEQ ID NO: 219549 - RNA, 22 nt, Human
gcauuucuguuuuuuuaaauga

SEQ ID NO: 219550 - RNA, 19 nt, Human
gauauugagcugagaauuc

SEQ ID NO: 219551 - RNA, 22 nt, Human
gaucacuuugauuagauguccu

SEQ ID NO: 219552 - RNA, 22 nt, Human
gauauuuugugaaaaaacaacu

SEQ ID NO: 219553 - RNA, 22 nt, Human
gaugcuaauuaaugaagaggag

SEQ ID NO: 219554 - RNA, 22 nt, Human
gccaucuucggcagccgccugg

SEQ ID NO: 219555 - RNA, 22 nt, Human
gauauggaaacuugauguugug

SEQ ID NO: 219556 - RNA, 22 nt, Human
gcccgccaacuugccagcggug

SEQ ID NO: 219557 - RNA, 22 nt, Human
gcccguuuagcaaacgccuccu

SEQ ID NO: 219558 - RNA, 22 nt, Human
gcccgaccgcgccggcccgcac

SEQ ID NO: 219559 - RNA, 23 nt, Human
gcccagaggccccuggccugagc

SEQ ID NO: 219560 - RNA, 22 nt, Human
gcccagacaucuguugggaccu

SEQ ID NO: 219561 - RNA, 22 nt, Human
gcccagccucagggcaucagcu

SEQ ID NO: 219562 - RNA, 22 nt, Human
gaugccggggucguagccgugg

SEQ ID NO: 219563 - RNA, 22 nt, Human
gauggcauucacaaacuuaacu

SEQ ID NO: 219564 - RNA, 22 nt, Human
gauacuugaggagaucaccaca

SEQ ID NO: 219565 - RNA, 22 nt, Human
gcauguucaaguuaguauauuu

SEQ ID NO: 219566 - RNA, 22 nt, Human
gauaauuauaggcuaagccacu

SEQ ID NO: 219567 - RNA, 22 nt, Human
gcaugguuuccugcaacguucu

SEQ ID NO: 219568 - RNA, 22 nt, Human
gcauuagacuaguacacggcag

SEQ ID NO: 219569 - RNA, 20 nt, Human
gauagcacaaagagaauggg

SEQ ID NO: 219570 - RNA, 22 nt, Human
gcauucuugucaguggggucag

SEQ ID NO: 219571 - RNA, 22 nt, Human
gauaagugauucugauucacau

SEQ ID NO: 219572 - RNA, 22 nt, Human
gauaaauaguguuuggggacau

SEQ ID NO: 219573 - RNA, 22 nt, Human
gcauggaaaagggaugcuaacu

SEQ ID NO: 219574 - RNA, 20 nt, Human
gcauggcuggcugcugucug

SEQ ID NO: 219575 - RNA, 22 nt, Human
gcaugcuguuuggaaacgauaa

SEQ ID NO: 219576 - RNA, 22 nt, Human
gcaugcgugcgugcgugcaugu

SEQ ID NO: 219577 - RNA, 22 nt, Human
gagguucgauacagcguauuua

SEQ ID NO: 219578 - RNA, 22 nt, Human
gaggugcaggggcccgggcugg

SEQ ID NO: 219579 - RNA, 19 nt, Human
gaguaaaacuagagagaaa

SEQ ID NO: 219580 - RNA, 22 nt, Human
gcaggccgauuuguuagaaguc

SEQ ID NO: 219581 - RNA, 22 nt, Human
gagguuuaguccauaguauuua

SEQ ID NO: 219582 - RNA, 22 nt, Human
gcaacuccuaggcgaggccuuc

SEQ ID NO: 219583 - RNA, 22 nt, Human
gcaagagaagaaagaauaguuu

SEQ ID NO: 219584 - RNA, 22 nt, Human
gcaacguauauggguaaggaua

SEQ ID NO: 219585 - RNA, 22 nt, Human
gcaaaugacuuagucacuccag

SEQ ID NO: 219586 - RNA, 22 nt, Human
gauuugucuauauucaaauaug

SEQ ID NO: 219587 - RNA, 22 nt, Human
gauuuuaaaagauguauaaggu

SEQ ID NO: 219588 - RNA, 21 nt, Human
gauuuuagggcagccaaacac

SEQ ID NO: 219589 - RNA, 22 nt, Human
gccuccggagucgcagugucuu

SEQ ID NO: 219590 - RNA, 21 nt, Human
gccugcuguucacccugccac

SEQ ID NO: 219591 - RNA, 22 nt, Human
gccugcuugaaagcacuuucug

SEQ ID NO: 219592 - RNA, 22 nt, Human
gccugcaaagacuuccuucucu

SEQ ID NO: 219593 - RNA, 22 nt, Human
gccugagucaagauguggcacc

SEQ ID NO: 219594 - RNA, 22 nt, Human
gccugagauuggacauuauuua

SEQ ID NO: 219595 - RNA, 22 nt, Human
gccugaaaugaaccagaggacu

SEQ ID NO: 219596 - RNA, 22 nt, Human
gccuggcagggagauuguaaga

SEQ ID NO: 219597 - RNA, 20 nt, Human
gccugggagaagaucaggga

SEQ ID NO: 219598 - RNA, 22 nt, Human
gccugggccgggcgcggccccc

SEQ ID NO: 219599 - RNA, 21 nt, Human
gcacaacucucacauucuucu

SEQ ID NO: 219600 - RNA, 22 nt, Human
gccuggggaacuugauccuguc

SEQ ID NO: 219601 - RNA, 22 nt, Human
gccugggguuugcggggcugca

SEQ ID NO: 219602 - RNA, 22 nt, Human
gcccucugccacaggacgccag

SEQ ID NO: 219603 - RNA, 22 nt, Human
gaugguuuuacauuuuaauguu

SEQ ID NO: 219604 - RNA, 22 nt, Human
gccgcagauucugagacgugua

SEQ ID NO: 219605 - RNA, 18 nt, Human
gccgccuugcucgugaac

SEQ ID NO: 219606 - RNA, 22 nt, Human
gauugauuuaauaugagaggau

SEQ ID NO: 219607 - RNA, 22 nt, Human
gauucuaucauucuguauauua

SEQ ID NO: 219608 - RNA, 22 nt, Human
gauucugaaauuaacagacugg

SEQ ID NO: 219609 - RNA, 22 nt, Human
gauugcugccagcguguccgug

SEQ ID NO: 219610 - RNA, 22 nt, Human
gccggguguuccugggaagaug

SEQ ID NO: 219611 - RNA, 20 nt, Human
gauuuaacgcugcgucuguc

SEQ ID NO: 219612 - RNA, 22 nt, Human
gauuguagacauauuagacugc

SEQ ID NO: 219613 - RNA, 22 nt, Human
gauuucauaaaacgagaaacuc

SEQ ID NO: 219614 - RNA, 22 nt, Human
gauggcaaugcuagaaauuuag

SEQ ID NO: 219615 - RNA, 22 nt, Human
gauggacgguuuuaccagacag

SEQ ID NO: 219616 - RNA, 22 nt, Human
gauggauuuuuuauuaaaucag

SEQ ID NO: 219617 - RNA, 22 nt, Human
gagaggacaggauccggagggc

SEQ ID NO: 219618 - RNA, 22 nt, Human
gaugccuccaggaaagaggacg

SEQ ID NO: 219619 - RNA, 22 nt, Human
gaugcucuugauuggaccaggg

SEQ ID NO: 219620 - RNA, 22 nt, Human
gaugcauccuuucugucuucuc

SEQ ID NO: 219621 - RNA, 22 nt, Human
gaugauaacagcauuucaacug

SEQ ID NO: 219622 - RNA, 22 nt, Human
gagaggguugggaggcagcaga

SEQ ID NO: 219623 - RNA, 22 nt, Human
gagagcugucagcguagcaccg

SEQ ID NO: 219624 - RNA, 22 nt, Human
gaugauuuuguaacuggggaca

SEQ ID NO: 219625 - RNA, 22 nt, Human
gaugauugaauaaauaugguca

SEQ ID NO: 219626 - RNA, 22 nt, Human
gaugauuccuuuguucauugug

SEQ ID NO: 219627 - RNA, 23 nt, Human
gaugauggcaacuacauccggug

SEQ ID NO: 219628 - RNA, 22 nt, Human
gagagagacugggaaaucauca

SEQ ID NO: 219629 - RNA, 22 nt, Human
gagacugcguggcucugacaca

SEQ ID NO: 219630 - RNA, 22 nt, Human
gagccaugagauaagagcaccu

SEQ ID NO: 219631 - RNA, 22 nt, Human
gagcaugacgcaacaccaagug

SEQ ID NO: 219632 - RNA, 22 nt, Human
gagcccuguagcaagucauguc

SEQ ID NO: 219633 - RNA, 22 nt, Human
gaagauuauuacucauugcagg

SEQ ID NO: 219634 - RNA, 22 nt, Human
gagacagugucagccauugaaa

SEQ ID NO: 219635 - RNA, 22 nt, Human
gagaccaagcgugggugauaau

SEQ ID NO: 219636 - RNA, 22 nt, Human
gaugucauguuggcagacaguu

SEQ ID NO: 219637 - RNA, 22 nt, Human
gaugucuauguccagggccauc

SEQ ID NO: 219638 - RNA, 22 nt, Human
gagcagcaggccagguugcagg

SEQ ID NO: 219639 - RNA, 22 nt, Human
gagcagacugcacaguucuugc

SEQ ID NO: 219640 - RNA, 22 nt, Human
gagcagcacagaccaaacagaa

SEQ ID NO: 219641 - RNA, 22 nt, Human
gaugguggggggcagcugggag

SEQ ID NO: 219642 - RNA, 22 nt, Human
gaugguggaggaaucgcugaag

SEQ ID NO: 219643 - RNA, 22 nt, Human
gagcacuucagcauaaaucaca

SEQ ID NO: 219644 - RNA, 22 nt, Human
gauggguuugagauguuugggu

SEQ ID NO: 219645 - RNA, 22 nt, Human
gauggguugaguucauggagcc

SEQ ID NO: 219646 - RNA, 22 nt, Human
gaugggaaggugguaaaguuua

SEQ ID NO: 219647 - RNA, 22 nt, Human
gagauuuccauauuuuguaaca

SEQ ID NO: 219648 - RNA, 22 nt, Human
gauggugauggcccuaagcuga

SEQ ID NO: 219649 - RNA, 22 nt, Human
gagaucuguguuugcugaagcu

SEQ ID NO: 219650 - RNA, 22 nt, Human
gagaguuggaggguauguuagu

SEQ ID NO: 219651 - RNA, 22 nt, Human
gagaugugguucaaggguguuu

SEQ ID NO: 219652 - RNA, 22 nt, Human
gagauggauuuuuuugccaguc

SEQ ID NO: 219653 - RNA, 22 nt, Human
gagcggcucaguggccauguga

SEQ ID NO: 219654 - RNA, 22 nt, Human
gagcggcggugagaaguguggg

SEQ ID NO: 219655 - RNA, 22 nt, Human
gagcguuucccugggggucugc

SEQ ID NO: 219656 - RNA, 22 nt, Human
gagcgugaggcagcuuucuaag

SEQ ID NO: 219657 - RNA, 22 nt, Human
gagcuaagcccuggagaggucg

SEQ ID NO: 219658 - RNA, 22 nt, Human
gagcuggagaaacacauaagaa

SEQ ID NO: 219659 - RNA, 22 nt, Human
gauuuugcuuuagugaaggaag

SEQ ID NO: 219660 - RNA, 21 nt, Human
gcaaccagaccacagggcagu

SEQ ID NO: 219661 - RNA, 22 nt, Human
gaggaaaauggaguguaauuaa

SEQ ID NO: 219662 - RNA, 22 nt, Human
gcaaaaacaguguagucuucug

SEQ ID NO: 219663 - RNA, 22 nt, Human
gauuuuuaaaaguaguuuugaa

SEQ ID NO: 219664 - RNA, 22 nt, Human
gcaaagaauugauucauuuugc

SEQ ID NO: 219665 - RNA, 22 nt, Human
gauuuucauuauagcuaguuuc

SEQ ID NO: 219666 - RNA, 22 nt, Human
gauuucuucauuuaaaaauauu

SEQ ID NO: 219667 - RNA, 19 nt, Human
gagccgcucccgcagccgg

SEQ ID NO: 219668 - RNA, 22 nt, Human
gagccuggagcuggaacgaagc

SEQ ID NO: 219669 - RNA, 22 nt, Human
gagccggggcucccugaggucc

SEQ ID NO: 219670 - RNA, 22 nt, Human
gagcgcacagaaggaagcagcc

SEQ ID NO: 219671 - RNA, 22 nt, Human
gagccuguuaggcaccuguguu

SEQ ID NO: 219672 - RNA, 22 nt, Human
gagccucaggguuuuguugaca

SEQ ID NO: 219673 - RNA, 22 nt, Human
gauugcaucaauauuuagagua

SEQ ID NO: 219674 - RNA, 22 nt, Human
gauugcauaugcauucugauac

SEQ ID NO: 219675 - RNA, 22 nt, Human
gauugggagugugacauuguau

SEQ ID NO: 219676 - RNA, 22 nt, Human
gauuggucacacaauaguauau

SEQ ID NO: 219677 - RNA, 22 nt, Human
gauugauguaggugauaaaucu

SEQ ID NO: 219678 - RNA, 22 nt, Human
gauuccugcuauucacagggcu

SEQ ID NO: 219679 - RNA, 22 nt, Human
gagccauggaggaugugcagca

SEQ ID NO: 219680 - RNA, 22 nt, Human
gagcccgugugugugugugugu

SEQ ID NO: 219681 - RNA, 22 nt, Human
gauucagagcugcaacaaagaa

SEQ ID NO: 219682 - RNA, 22 nt, Human
gagccgcagcugcguagggucc

SEQ ID NO: 219683 - RNA, 22 nt, Human
gagcaguuagggaccgcaggcu

SEQ ID NO: 219684 - RNA, 19 nt, Human
gagcaugacuggccuugca

SEQ ID NO: 219685 - RNA, 22 nt, Human
gauuaucaccaaauggccuccu

SEQ ID NO: 219686 - RNA, 22 nt, Human
gauuaagaaagauagaugugga

SEQ ID NO: 219687 - RNA, 22 nt, Human
gauuaaaggucuugauuauaag

SEQ ID NO: 219688 - RNA, 22 nt, Human
gagcaggucuuugguaaugcuu

SEQ ID NO: 219689 - RNA, 22 nt, Human
gaggacugguugggaaugugaa

SEQ ID NO: 219690 - RNA, 22 nt, Human
gaggagaaacagccgugauagu

SEQ ID NO: 219691 - RNA, 22 nt, Human
gcaaggaagcagaguugcuauc

SEQ ID NO: 219692 - RNA, 22 nt, Human
gaggagcaggcaggaucugguc

SEQ ID NO: 219693 - RNA, 19 nt, Human
gcaaguuaucugucuccau

SEQ ID NO: 219694 - RNA, 22 nt, Human
gaggagagaaauguuuucugug

SEQ ID NO: 219695 - RNA, 22 nt, Human
gcaauagccuacaugcgucaga

SEQ ID NO: 219696 - RNA, 22 nt, Human
gcaauaaguuuucucuucuguc

SEQ ID NO: 219697 - RNA, 22 nt, Human
gaggagcggugcaugugggggc

SEQ ID NO: 219698 - RNA, 22 nt, Human
gcacaaaagguacuucauguag

SEQ ID NO: 219699 - RNA, 22 nt, Human
gcacaaguccuccgacagcacg

SEQ ID NO: 219700 - RNA, 22 nt, Human
gaggaggucaccuggugagcaa

SEQ ID NO: 219701 - RNA, 22 nt, Human
gaggagggagcuggaagcucuu

SEQ ID NO: 219702 - RNA, 22 nt, Human
gaggauaaugaaucugaaucau

SEQ ID NO: 219703 - RNA, 22 nt, Human
gcacacuguaugcugguauuug

SEQ ID NO: 219704 - RNA, 22 nt, Human
gaggaggcuggagaggccagga

SEQ ID NO: 219705 - RNA, 22 nt, Human
gcacagcuaugagcugaauugu

SEQ ID NO: 219706 - RNA, 22 nt, Human
gcacacaaaaauauguguugaa

SEQ ID NO: 219707 - RNA, 22 nt, Human
gcacagauaaucugccuuacca

SEQ ID NO: 219708 - RNA, 22 nt, Human
gaggcugguucccuugaucuuu

SEQ ID NO: 219709 - RNA, 21 nt, Human
gcagaaagugauuugcuauuc

SEQ ID NO: 219710 - RNA, 23 nt, Human
gcacuguuugaggagcacugugc

SEQ ID NO: 219711 - RNA, 22 nt, Human
gaggcgcgcugcgagggcgcgg

SEQ ID NO: 219712 - RNA, 22 nt, Human
gaggcggugguggcgagaguca

SEQ ID NO: 219713 - RNA, 23 nt, Human
gcacuccgagggcacgugucucu

SEQ ID NO: 219714 - RNA, 22 nt, Human
gcacucuguggagacaagauag

SEQ ID NO: 219715 - RNA, 21 nt, Human
gcacucagucacuacucaaga

SEQ ID NO: 219716 - RNA, 22 nt, Human
gcaccacccaaaggcggggcuc

SEQ ID NO: 219717 - RNA, 22 nt, Human
gcacauauuuagaucuugaugu

SEQ ID NO: 219718 - RNA, 22 nt, Human
gcacccagggcaggaagugagg

SEQ ID NO: 219719 - RNA, 22 nt, Human
gaggauggaaaaaccccaaagg

SEQ ID NO: 219720 - RNA, 22 nt, Human
gcaccauagagaagagacacaa

SEQ ID NO: 219721 - RNA, 22 nt, Human
gaggcccugagauugcugcccu

SEQ ID NO: 219722 - RNA, 22 nt, Human
gaggccagcacccagaugcaug

SEQ ID NO: 219723 - RNA, 22 nt, Human
gaggcaggcggggcccaggugg

SEQ ID NO: 219724 - RNA, 22 nt, Human
gcagccugaguuuagcucgucg

SEQ ID NO: 219725 - RNA, 22 nt, Human
gcagcgcugagaugauuuguug

SEQ ID NO: 219726 - RNA, 22 nt, Human
gcagcguguggcuaauggcucu

SEQ ID NO: 219727 - RNA, 20 nt, Human
gcagcugacccuagugcuug

SEQ ID NO: 219728 - RNA, 22 nt, Human
gcagcucagcacgcacagguaa

SEQ ID NO: 219729 - RNA, 22 nt, Human
gcaggaagauugcagaaggcug

SEQ ID NO: 219730 - RNA, 22 nt, Human
gcaggacugauggagcauaugu

SEQ ID NO: 219731 - RNA, 22 nt, Human
gcaggcaggauucagagauaca

SEQ ID NO: 219732 - RNA, 22 nt, Human
gaggugauuccucccauguaau

SEQ ID NO: 219733 - RNA, 22 nt, Human
gcaggcagauccagaagcacua

SEQ ID NO: 219734 - RNA, 22 nt, Human
gcaggagggggccuggagccca

SEQ ID NO: 219735 - RNA, 22 nt, Human
gaggucauuaaagaaaagaguc

SEQ ID NO: 219736 - RNA, 22 nt, Human
gaggguuucagugggacggguu

SEQ ID NO: 219737 - RNA, 22 nt, Human
gaggucagugugggggcaaggg

SEQ ID NO: 219738 - RNA, 22 nt, Human
gaggucagcaagccaugcuugu

SEQ ID NO: 219739 - RNA, 22 nt, Human
gcagccauuugcaucuaauuaa

SEQ ID NO: 219740 - RNA, 22 nt, Human
gcagcccucuuggucacuaggc

SEQ ID NO: 219741 - RNA, 22 nt, Human
gcagccaugcacgucauuauga

SEQ ID NO: 219742 - RNA, 23 nt, Human
gcagccaacccacgugagagaag

SEQ ID NO: 219743 - RNA, 21 nt, Human
gcagcaugagaaagccccaaa

SEQ ID NO: 219744 - RNA, 22 nt, Human
gcagccaauggcgagccccaca

SEQ ID NO: 219745 - RNA, 22 nt, Human
gcagauaaaauuuuugauggga

SEQ ID NO: 219746 - RNA, 22 nt, Human
gcagaguauaaguguggagcug

SEQ ID NO: 219747 - RNA, 22 nt, Human
gaggggaacaggcauucuuaag

SEQ ID NO: 219748 - RNA, 22 nt, Human
gaggggaagaacaauuuaauuu

SEQ ID NO: 219749 - RNA, 22 nt, Human
gcagaggcugccgugggcagga

SEQ ID NO: 219750 - RNA, 22 nt, Human
gcagagcugucuaagucacuuc

SEQ ID NO: 219751 - RNA, 22 nt, Human
gaggggaaggguguucaauggg

SEQ ID NO: 219752 - RNA, 22 nt, Human
gagggcugccacguugggcgag

SEQ ID NO: 219753 - RNA, 22 nt, Human
gcagaggcaaagucuggaugac

SEQ ID NO: 219754 - RNA, 22 nt, Human
gagggagugggcccgugggcac

SEQ ID NO: 219755 - RNA, 22 nt, Human
gaggggcugggguugacuccaa

SEQ ID NO: 219756 - RNA, 22 nt, Human
gagggggcggccccugugggca

SEQ ID NO: 219757 - RNA, 22 nt, Human
gcagauuggguacauaaacagu

SEQ ID NO: 219758 - RNA, 22 nt, Human
gagggugguggcggccggcacc

SEQ ID NO: 219759 - RNA, 22 nt, Human
gagggguuguuaacaaagaaua

SEQ ID NO: 219760 - RNA, 22 nt, Human
gaggguaaauucagaguaggag

SEQ ID NO: 219761 - RNA, 22 nt, Human
gaggguaagcugggacuccucg

SEQ ID NO: 219762 - RNA, 20 nt, Human
gcagcagacagacaggggac

SEQ ID NO: 219763 - RNA, 22 nt, Human
gcagcagugugggcugaaccua

SEQ ID NO: 219764 - RNA, 22 nt, Human
gcagcaauaaaacugaaggugu

SEQ ID NO: 219765 - RNA, 22 nt, Human
gcagauccaaauauaguucuug

SEQ ID NO: 219766 - RNA, 22 nt, Human
aaaacuuucagggauacagaaa

SEQ ID NO: 219767 - RNA, 22 nt, Human
aaaagacaaggaucuggaguga

SEQ ID NO: 219768 - RNA, 22 nt, Human
aaaaauuucuggugaaaugccu

SEQ ID NO: 219769 - RNA, 22 nt, Human
aaaacauuuaggguuuuuuuua

SEQ ID NO: 219770 - RNA, 22 nt, Human
aaaaccugcaagaugaaaucag

SEQ ID NO: 219771 - RNA, 22 nt, Human
aaaaggauauuuggugcaaagc

SEQ ID NO: 219772 - RNA, 22 nt, Human
aaaagggucugacacugcuuga

SEQ ID NO: 219773 - RNA, 22 nt, Human
aaaaguuguaauauuuccuuua

SEQ ID NO: 219774 - RNA, 22 nt, Human
aaaagguauuuagcgauugcau

SEQ ID NO: 219775 - RNA, 22 nt, Human
aaaaggacaguagccuugaggu

SEQ ID NO: 219776 - RNA, 22 nt, Human
aaaagcgaagagaacugaaguu

SEQ ID NO: 219777 - RNA, 22 nt, Human
aaaagcucucuucuucggcuuu

SEQ ID NO: 219778 - RNA, 22 nt, Human
aaaaugggaaaauuuuagauua

SEQ ID NO: 219779 - RNA, 18 nt, Human
aaacgguuucaugcugua

SEQ ID NO: 219780 - RNA, 23 nt, Human
aaacuacauuuauaguuuuucuc

SEQ ID NO: 219781 - RNA, 22 nt, Human
aaacagguuugaacuucuuaac

SEQ ID NO: 219782 - RNA, 22 nt, Human
aaacaaauccaauaauaaaauu

SEQ ID NO: 219783 - RNA, 22 nt, Human
aaaaguauaagugucuccugau

SEQ ID NO: 219784 - RNA, 22 nt, Human
aaaagguuauagcuuugccuug

SEQ ID NO: 219785 - RNA, 22 nt, Human
aaaaggucacuguaaaaugacg

SEQ ID NO: 219786 - RNA, 17 nt, Human
aaaaucaaaggaggugc

SEQ ID NO: 219787 - RNA, 22 nt, Human
aaaauauguugagauacugaaa

SEQ ID NO: 219788 - RNA, 22 nt, Human
aaaauauucuauaucaaagaua

SEQ ID NO: 219789 - RNA, 22 nt, Human
aaaauuuccuuggaccauuuuu

SEQ ID NO: 219790 - RNA, 22 nt, Human
aaaaucucagaaaaguuuaggu

SEQ ID NO: 219791 - RNA, 22 nt, Human
aaacaccaagagcuagcuauua

SEQ ID NO: 219792 - RNA, 22 nt, Human
aaacagcugcaguacacggccu

SEQ ID NO: 219793 - RNA, 22 nt, Human
aaaauauuuaucuagcucuuaa

SEQ ID NO: 219794 - RNA, 22 nt, Human
aaagaugucauacacauuaaga

SEQ ID NO: 219795 - RNA, 22 nt, Human
aaagaugaaguucagcgaagaa

SEQ ID NO: 219796 - RNA, 22 nt, Human
aaagccauaucuauucuauucu

SEQ ID NO: 219797 - RNA, 22 nt, Human
aaagccagggacagugugcaug

SEQ ID NO: 219798 - RNA, 22 nt, Human
aaagcaaagaucuguagcccaa

SEQ ID NO: 219799 - RNA, 22 nt, Human
aaagccaagguccauguacuuu

SEQ ID NO: 219800 - RNA, 22 nt, Human
aaagcugaaacgaaaugacaac

SEQ ID NO: 219801 - RNA, 22 nt, Human
aaagcgagccggcuuggaggga

SEQ ID NO: 219802 - RNA, 22 nt, Human
aaaggagugaaaugagaggaaa

SEQ ID NO: 219803 - RNA, 22 nt, Human
aaaggaaacuaugaaucucugg

SEQ ID NO: 219804 - RNA, 22 nt, Human
aaagcauuuguuucuccuggaa

SEQ ID NO: 219805 - RNA, 22 nt, Human
aaagggcugaaguagucucugu

SEQ ID NO: 219806 - RNA, 22 nt, Human
aaaggcaugugcaacuacaaau

SEQ ID NO: 219807 - RNA, 22 nt, Human
aaaggugccucuuacaaggcuu

SEQ ID NO: 219808 - RNA, 22 nt, Human
aaaggggugguauuucuuuugg

SEQ ID NO: 219809 - RNA, 22 nt, Human
aaagguggugguuagggaauau

SEQ ID NO: 219810 - RNA, 22 nt, Human
aaagaagugucuuacucccucu

SEQ ID NO: 219811 - RNA, 22 nt, Human
aaagacaauaauucucucuagc

SEQ ID NO: 219812 - RNA, 22 nt, Human
aaagaguuaagagucuuaagcu

SEQ ID NO: 219813 - RNA, 21 nt, Human
aaagaaguuaguucagugguu

SEQ ID NO: 219814 - RNA, 22 nt, Human
aaacuuuugaaggaggaaaaag

SEQ ID NO: 219815 - RNA, 22 nt, Human
aaacuuuaggcacauggaucua

SEQ ID NO: 219816 - RNA, 22 nt, Human
aaacgcauucuuacaugcuucc

SEQ ID NO: 219817 - RNA, 22 nt, Human
aaacgcaauuucuugcauguca

SEQ ID NO: 219818 - RNA, 22 nt, Human
aaaccgguacccuccugccugc

SEQ ID NO: 219819 - RNA, 23 nt, Human
aaagaggugaauccaggacaagc

SEQ ID NO: 219820 - RNA, 22 nt, Human
aaagaauuucaagauucccaca

SEQ ID NO: 219821 - RNA, 22 nt, Human
aaagcaaauaguugcuuaauau

SEQ ID NO: 219822 - RNA, 22 nt, Human
aaagagccaacuaccgcaaauu

SEQ ID NO: 219823 - RNA, 22 nt, Human
aaagagcugccaagguuacagu

SEQ ID NO: 219824 - RNA, 22 nt, Human
aaagaguuguauucuuuuugag

SEQ ID NO: 219825 - RNA, 22 nt, Human
aaagcagguugcaauuacagug

SEQ ID NO: 219826 - RNA, 22 nt, Human
aaagcagucuguuuuaaccuga

SEQ ID NO: 219827 - RNA, 22 nt, Human
aaagcauucuaaccgaucgacg

SEQ ID NO: 219828 - RNA, 22 nt, Human
aaaugcacaauaaaguaaaggc

SEQ ID NO: 219829 - RNA, 22 nt, Human
aaauuaacuaucacuuuuguga

SEQ ID NO: 219830 - RNA, 22 nt, Human
aaauguaaacuguauuuauaaa

SEQ ID NO: 219831 - RNA, 22 nt, Human
aaaucuuucacauauuuuuuau

SEQ ID NO: 219832 - RNA, 22 nt, Human
aaaucuuccugaaauuuguuca

SEQ ID NO: 219833 - RNA, 21 nt, Human
aaauccagugaucuccucuaa

SEQ ID NO: 219834 - RNA, 22 nt, Human
aaauauauccuucuguccugcc

SEQ ID NO: 219835 - RNA, 22 nt, Human
aaauauagugacacuuauaguc

SEQ ID NO: 219836 - RNA, 22 nt, Human
aaaucugaauuaaaaucugguu

SEQ ID NO: 219837 - RNA, 22 nt, Human
aaauaugguaucugccaaacua

SEQ ID NO: 219838 - RNA, 22 nt, Human
aaaucauguuaaagagggaguu

SEQ ID NO: 219839 - RNA, 22 nt, Human
aaaucauagccaugaacauuug

SEQ ID NO: 219840 - RNA, 22 nt, Human
aaaucaagucagcugaauucca

SEQ ID NO: 219841 - RNA, 22 nt, Human
aaaucaaaagugguuauuuuau

SEQ ID NO: 219842 - RNA, 22 nt, Human
aaauuagucacaccagugucuu

SEQ ID NO: 219843 - RNA, 22 nt, Human
aaauuuauaacuuaaagugaau

SEQ ID NO: 219844 - RNA, 22 nt, Human
aaauguauuagccuaugugaga

SEQ ID NO: 219845 - RNA, 22 nt, Human
aacaaaacauuuuacgaauaua

SEQ ID NO: 219846 - RNA, 19 nt, Human
aacaaaauaguucuaguua

SEQ ID NO: 219847 - RNA, 22 nt, Human
aacagagauucuucccuucuuu

SEQ ID NO: 219848 - RNA, 22 nt, Human
aacauuuauguuuugaccaagu

SEQ ID NO: 219849 - RNA, 22 nt, Human
aacauuuccggccuuuuguucu

SEQ ID NO: 219850 - RNA, 22 nt, Human
aacaaccuaguaguaucuuuca

SEQ ID NO: 219851 - RNA, 22 nt, Human
aacaaguagaauagguuuuuuu

SEQ ID NO: 219852 - RNA, 22 nt, Human
aacacaguuucucuaugagagu

SEQ ID NO: 219853 - RNA, 22 nt, Human
aacaaagaacuuucuuccuuug

SEQ ID NO: 219854 - RNA, 22 nt, Human
aacaaagaaaagcuugagguuu

SEQ ID NO: 219855 - RNA, 22 nt, Human
aacaggcuaaauuguccauuuc

SEQ ID NO: 219856 - RNA, 22 nt, Human
aacaggaagaauccagauggug

SEQ ID NO: 219857 - RNA, 22 nt, Human
aacagggcgugaauaaugaaga

SEQ ID NO: 219858 - RNA, 22 nt, Human
aaauauauauaauauauauauu

SEQ ID NO: 219859 - RNA, 22 nt, Human
aaaguguuuaacaaauugcuuu

SEQ ID NO: 219860 - RNA, 22 nt, Human
aaaguguuaacacuggcuacuu

SEQ ID NO: 219861 - RNA, 22 nt, Human
aaaguguaagucccugguuguc

SEQ ID NO: 219862 - RNA, 22 nt, Human
aaaguagaugagaauuuuguug

SEQ ID NO: 219863 - RNA, 22 nt, Human
aaaguugcauccuaugaccuca

SEQ ID NO: 219864 - RNA, 22 nt, Human
aaauauugaauuugaggaugua

SEQ ID NO: 219865 - RNA, 22 nt, Human
aaauauuugaaugguguaagau

SEQ ID NO: 219866 - RNA, 22 nt, Human
aaaguuacccaaucucuaugaa

SEQ ID NO: 219867 - RNA, 22 nt, Human
aaauauuaaugaugaagguagu

SEQ ID NO: 219868 - RNA, 22 nt, Human
aaauauuagacauaccuggaga

SEQ ID NO: 219869 - RNA, 22 nt, Human
aaauagucagaaaucaacgugc

SEQ ID NO: 219870 - RNA, 20 nt, Human
aaauccuugggaguggugca

SEQ ID NO: 219871 - RNA, 22 nt, Human
aaaucccacucacgaguuuugc

SEQ ID NO: 219872 - RNA, 22 nt, Human
aaaucugaaggaaacagcuuca

SEQ ID NO: 219873 - RNA, 22 nt, Human
aaaucgcuugaacccaggaagu

SEQ ID NO: 219874 - RNA, 22 nt, Human
aaauccaucaaaucuucuagaa

SEQ ID NO: 219875 - RNA, 17 nt, Human
aaagccgaucagauguu

SEQ ID NO: 219876 - RNA, 22 nt, Human
aaagccuacagucaugguuaga

SEQ ID NO: 219877 - RNA, 22 nt, Human
aaagggagauaaaguaauuuua

SEQ ID NO: 219878 - RNA, 22 nt, Human
aaaguagaauaauaaacccuug

SEQ ID NO: 219879 - RNA, 21 nt, Human
aaagugguaaggauuauuuug

SEQ ID NO: 219880 - RNA, 22 nt, Human
aaauaggaguagugauguauua

SEQ ID NO: 219881 - RNA, 22 nt, Human
aaauagauuugacuacuuggug

SEQ ID NO: 219882 - RNA, 22 nt, Human
aaaguuguccuuugugccuuua

SEQ ID NO: 219883 - RNA, 22 nt, Human
aaaguuuguacugggaguuacu

SEQ ID NO: 219884 - RNA, 23 nt, Human
aaauaauaauuucucuguuggga

SEQ ID NO: 219885 - RNA, 22 nt, Human
aaaggucagaugugucgaggag

SEQ ID NO: 219886 - RNA, 22 nt, Human
aaagggaugauuucugaagaua

SEQ ID NO: 219887 - RNA, 22 nt, Human
aaaguaaagccuauuuaauaau

SEQ ID NO: 219888 - RNA, 23 nt, Human
aaaguacuuaaucugcaaaccac

SEQ ID NO: 219889 - RNA, 22 nt, Human
aauugauauuagauuugucuca

SEQ ID NO: 219890 - RNA, 22 nt, Human
aauugcuuucacaaguguuaua

SEQ ID NO: 219891 - RNA, 21 nt, Human
aauugccuaauauaugggaag

SEQ ID NO: 219892 - RNA, 22 nt, Human
aauugccaagaauuagugauac

SEQ ID NO: 219893 - RNA, 22 nt, Human
aauucuuuguuccucugccaag

SEQ ID NO: 219894 - RNA, 22 nt, Human
aauuauucucucaacugagaug

SEQ ID NO: 219895 - RNA, 22 nt, Human
aauuauucaugucugggcagcc

SEQ ID NO: 219896 - RNA, 22 nt, Human
aauugugagaguuagagagcau

SEQ ID NO: 219897 - RNA, 22 nt, Human
aauuguuagaaaugacuguuuu

SEQ ID NO: 219898 - RNA, 22 nt, Human
aauugguuugaauaaauaaaga

SEQ ID NO: 219899 - RNA, 22 nt, Human
aauuuaauugguuuuuacuugu

SEQ ID NO: 219900 - RNA, 22 nt, Human
aauuuaaguuauugcuaaugug

SEQ ID NO: 219901 - RNA, 22 nt, Human
aauuuauccuuuugcuaaagca

SEQ ID NO: 219902 - RNA, 20 nt, Human
aauuuagaguuuuaccaagg

SEQ ID NO: 219903 - RNA, 22 nt, Human
aauuucagaccaacgagucagg

SEQ ID NO: 219904 - RNA, 22 nt, Human
aauuucaucugagacugggagc

SEQ ID NO: 219905 - RNA, 22 nt, Human
aauuuuagcuaaagauccaugg

SEQ ID NO: 219906 - RNA, 22 nt, Human
aauuuuauuuuuuccccuagau

SEQ ID NO: 219907 - RNA, 22 nt, Human
aauuuuauuagacaggcauaau

SEQ ID NO: 219908 - RNA, 18 nt, Human
acaaaaauagugcuuugg

SEQ ID NO: 219909 - RNA, 22 nt, Human
acaaaaauauuguagaagugcu

SEQ ID NO: 219910 - RNA, 22 nt, Human
aauuucuuuagagguacugauc

SEQ ID NO: 219911 - RNA, 22 nt, Human
aauuucuccuuuucaguuagau

SEQ ID NO: 219912 - RNA, 22 nt, Human
aauuucuuucagcugcuuuaag

SEQ ID NO: 219913 - RNA, 22 nt, Human
aauuugcuccaaugucaguucu

SEQ ID NO: 219914 - RNA, 21 nt, Human
acaaaaccuaacuuggcugcu

SEQ ID NO: 219915 - RNA, 22 nt, Human
acaaagugaaaagcaucgaauu

SEQ ID NO: 219916 - RNA, 22 nt, Human
acaaacugggauaggauccugu

SEQ ID NO: 219917 - RNA, 20 nt, Human
acaaccacugcucacaguuu

SEQ ID NO: 219918 - RNA, 22 nt, Human
acaaccaugucaguucaaacca

SEQ ID NO: 219919 - RNA, 22 nt, Human
acaaaucccuguaaacacagcu

SEQ ID NO: 219920 - RNA, 22 nt, Human
acaaauuuaaauguugucuguu

SEQ ID NO: 219921 - RNA, 22 nt, Human
aauuauguugaaauaugagaac

SEQ ID NO: 219922 - RNA, 22 nt, Human
aauuauuaagcuuucuccagug

SEQ ID NO: 219923 - RNA, 22 nt, Human
aauuauuaucauuaucuuccug

SEQ ID NO: 219924 - RNA, 22 nt, Human
aauuauuauguggaagacgacg

SEQ ID NO: 219925 - RNA, 22 nt, Human
aauuaaauguuugguuugagcu

SEQ ID NO: 219926 - RNA, 22 nt, Human
aauuaaggccuuuaaaugucuu

SEQ ID NO: 219927 - RNA, 22 nt, Human
aauguuugaacuuugcauauuu

SEQ ID NO: 219928 - RNA, 22 nt, Human
aauguuuuucaaguguggagca

SEQ ID NO: 219929 - RNA, 22 nt, Human
aauguuaguauuuaagagcuug

SEQ ID NO: 219930 - RNA, 22 nt, Human
aaugugguauuuuggcauucuu

SEQ ID NO: 219931 - RNA, 22 nt, Human
aaugugcugguaacugcuuugc

SEQ ID NO: 219932 - RNA, 23 nt, Human
aaugugaaauugaguuuuuguua

SEQ ID NO: 219933 - RNA, 22 nt, Human
aauguucauauggguagcagau

SEQ ID NO: 219934 - RNA, 22 nt, Human
aaugugugggagaacagucuuu

SEQ ID NO: 219935 - RNA, 22 nt, Human
aaugguagaguauuuuaauccu

SEQ ID NO: 219936 - RNA, 22 nt, Human
aauguauuuuuaggcagaauau

SEQ ID NO: 219937 - RNA, 22 nt, Human
aauggugaggagugcauugaga

SEQ ID NO: 219938 - RNA, 22 nt, Human
aaugugcauaacuuuauaaauu

SEQ ID NO: 219939 - RNA, 22 nt, Human
aaugggauaggucuucaggaau

SEQ ID NO: 219940 - RNA, 22 nt, Human
aaugguaauauuucauaguugu

SEQ ID NO: 219941 - RNA, 22 nt, Human
aaucaucuguuguucccuugga

SEQ ID NO: 219942 - RNA, 22 nt, Human
aauccaaacaggauuaccuauc

SEQ ID NO: 219943 - RNA, 22 nt, Human
aaucaugguacaaguaagcacg

SEQ ID NO: 219944 - RNA, 22 nt, Human
aaucauguguaaugggcagacc

SEQ ID NO: 219945 - RNA, 22 nt, Human
aaucgguugaacccaggaagug

SEQ ID NO: 219946 - RNA, 22 nt, Human
aaucuacaaugaaaaaauguuu

SEQ ID NO: 219947 - RNA, 22 nt, Human
aaugcgcagaguggugugugca

SEQ ID NO: 219948 - RNA, 22 nt, Human
aauggaaaaagaacuguuuaaa

SEQ ID NO: 219949 - RNA, 22 nt, Human
aauggauaacaccgguucuguc

SEQ ID NO: 219950 - RNA, 22 nt, Human
aauggagugguucuugcccucu

SEQ ID NO: 219951 - RNA, 22 nt, Human
aauggcaaaaguuucggaaauu

SEQ ID NO: 219952 - RNA, 22 nt, Human
aauggcaagccacaugcuuuuc

SEQ ID NO: 219953 - RNA, 22 nt, Human
aauggcaauagugcauuaugua

SEQ ID NO: 219954 - RNA, 22 nt, Human
aaugcugugggauagggcuccu

SEQ ID NO: 219955 - RNA, 22 nt, Human
aaugcuuuuugcgaaaugugca

SEQ ID NO: 219956 - RNA, 22 nt, Human
aauggaaaggagccugacuaua

SEQ ID NO: 219957 - RNA, 22 nt, Human
acauaaauagcacugugaauuu

SEQ ID NO: 219958 - RNA, 22 nt, Human
acaguguuacuugauaguguau

SEQ ID NO: 219959 - RNA, 22 nt, Human
acaguuuuccuugguauagaac

SEQ ID NO: 219960 - RNA, 21 nt, Human
acauccaggguccucacugcc

SEQ ID NO: 219961 - RNA, 22 nt, Human
acauauggcagguugaucaaug

SEQ ID NO: 219962 - RNA, 22 nt, Human
acagguuggagguguggaguca

SEQ ID NO: 219963 - RNA, 22 nt, Human
acagguaucccuuucuaccuga

SEQ ID NO: 219964 - RNA, 19 nt, Human
acaggaaggaaaauuucaa

SEQ ID NO: 219965 - RNA, 22 nt, Human
acagguuucuccccugguuauu

SEQ ID NO: 219966 - RNA, 22 nt, Human
acagguauuaugaagccuauuu

SEQ ID NO: 219967 - RNA, 22 nt, Human
acaggguaagggagggugagug

SEQ ID NO: 219968 - RNA, 22 nt, Human
acaggguauauaggcaaagcua

SEQ ID NO: 219969 - RNA, 22 nt, Human
acaggggauaggcaggaaggca

SEQ ID NO: 219970 - RNA, 22 nt, Human
acaggcugcccgcuccccaccu

SEQ ID NO: 219971 - RNA, 22 nt, Human
acaggcgucgccugcucuugcc

SEQ ID NO: 219972 - RNA, 21 nt, Human
acaguaugaucaaaugugcca

SEQ ID NO: 219973 - RNA, 22 nt, Human
acaggccuggguucaaauuugg

SEQ ID NO: 219974 - RNA, 22 nt, Human
acaggacgugugugcgcaugug

SEQ ID NO: 219975 - RNA, 22 nt, Human
acaggacaaaaaucuggauggc

SEQ ID NO: 219976 - RNA, 22 nt, Human
acagccacuaugacagauuuag

SEQ ID NO: 219977 - RNA, 20 nt, Human
acagccguaaugguccuugg

SEQ ID NO: 219978 - RNA, 22 nt, Human
acagccacccuggaacgguugu

SEQ ID NO: 219979 - RNA, 19 nt, Human
acagccuguugguggggcu

SEQ ID NO: 219980 - RNA, 22 nt, Human
acagcuggaggucugugagcac

SEQ ID NO: 219981 - RNA, 22 nt, Human
acagcugagaugcuacuugugg

SEQ ID NO: 219982 - RNA, 22 nt, Human
acagcucaggcccaucaacccc

SEQ ID NO: 219983 - RNA, 22 nt, Human
acaggaaugaagaugagagagu

SEQ ID NO: 219984 - RNA, 22 nt, Human
acaggaaaugaaaugguaucua

SEQ ID NO: 219985 - RNA, 22 nt, Human
acagcagguuauuguuauggca

SEQ ID NO: 219986 - RNA, 23 nt, Human
acagaggcaucagagcagcaggc

SEQ ID NO: 219987 - RNA, 22 nt, Human
acagaugccagcuacaccaccg

SEQ ID NO: 219988 - RNA, 22 nt, Human
acagaucuauauuauauauaca

SEQ ID NO: 219989 - RNA, 22 nt, Human
acagcuauuuaaaggcuuuagg

SEQ ID NO: 219990 - RNA, 22 nt, Human
acagccaacgucuuucuuacuu

SEQ ID NO: 219991 - RNA, 22 nt, Human
acagcauagaggaaauguggaa

SEQ ID NO: 219992 - RNA, 22 nt, Human
acagcaauccuggcagaggguu

SEQ ID NO: 219993 - RNA, 22 nt, Human
acagacuuuuagacuuaugagu

SEQ ID NO: 219994 - RNA, 21 nt, Human
acagaaguggcuuggucucag

SEQ ID NO: 219995 - RNA, 22 nt, Human
acagacuugaccuuggagaggc

SEQ ID NO: 219996 - RNA, 22 nt, Human
acagacuuaguauccugcugcu

SEQ ID NO: 219997 - RNA, 22 nt, Human
acagaucugcacagugaacaau

SEQ ID NO: 219998 - RNA, 23 nt, Human
acagcaagaggaccagaugugag

SEQ ID NO: 219999 - RNA, 22 nt, Human
acacucagaaaggcagagguuc

SEQ ID NO: 220000 - RNA, 22 nt, Human
acacaggacacaaaagucacca

SEQ ID NO: 220001 - RNA, 22 nt, Human
acacgcacaccugugcacucgu

SEQ ID NO: 220002 - RNA, 22 nt, Human
acacgauguuuuaagccccuaa

SEQ ID NO: 220003 - RNA, 22 nt, Human
acacccuuuagcaauucuucaa

SEQ ID NO: 220004 - RNA, 20 nt, Human
acacaccugcucagacugag

SEQ ID NO: 220005 - RNA, 22 nt, Human
acacagaguauuuagaaggggu

SEQ ID NO: 220006 - RNA, 20 nt, Human
acacagccuagaguuuggcu

SEQ ID NO: 220007 - RNA, 19 nt, Human
acacaccagugccugugac

SEQ ID NO: 220008 - RNA, 22 nt, Human
acaaucagcacugaguuuaucu

SEQ ID NO: 220009 - RNA, 22 nt, Human
acacaacuuuauuaauuuauac

SEQ ID NO: 220010 - RNA, 22 nt, Human
acaaugugcuuaugaaggcagu

SEQ ID NO: 220011 - RNA, 17 nt, Human
acaaugggcaacaauau

SEQ ID NO: 220012 - RNA, 22 nt, Human
acaaucuuauuaguaguauaga

SEQ ID NO: 220013 - RNA, 22 nt, Human
acaauaauguuuuuagguuauu

SEQ ID NO: 220014 - RNA, 22 nt, Human
acaaggaagaaaacauuacuuu

SEQ ID NO: 220015 - RNA, 22 nt, Human
acaagaaaggucugggaacaau

SEQ ID NO: 220016 - RNA, 22 nt, Human
acaacuuuaauggguuucagcu

SEQ ID NO: 220017 - RNA, 22 nt, Human
acaaggccugagggugacagca

SEQ ID NO: 220018 - RNA, 23 nt, Human
aaguugucauguaaaaugggcua

SEQ ID NO: 220019 - RNA, 22 nt, Human
aaguucuuauguucugaugugc

SEQ ID NO: 220020 - RNA, 22 nt, Human
aaguuccacuagugacccagaa

SEQ ID NO: 220021 - RNA, 22 nt, Human
aaguuccuaaagucagggguca

SEQ ID NO: 220022 - RNA, 22 nt, Human
aagugauuuuccuacuugcuaa

SEQ ID NO: 220023 - RNA, 23 nt, Human
aagugcucaguggacagcauugc

SEQ ID NO: 220024 - RNA, 20 nt, Human
aagugcuguuagcugccuga

SEQ ID NO: 220025 - RNA, 22 nt, Human
aagugcuggccuacucaaucga

SEQ ID NO: 220026 - RNA, 22 nt, Human
aauaauacaugugaugagaauu

SEQ ID NO: 220027 - RNA, 22 nt, Human
aauaagaguuaagaaguauauu

SEQ ID NO: 220028 - RNA, 21 nt, Human
aaguuuuggcuguacaguugu

SEQ ID NO: 220029 - RNA, 20 nt, Human
aauaaauauaacccauaauu

SEQ ID NO: 220030 - RNA, 21 nt, Human
aaguuucucccuaauuguugc

SEQ ID NO: 220031 - RNA, 22 nt, Human
aauaaagcuugaaagcagggaa

SEQ ID NO: 220032 - RNA, 22 nt, Human
aaucacuggcuccucacggcaa

SEQ ID NO: 220033 - RNA, 22 nt, Human
aaucaaauuucuugugguuguu

SEQ ID NO: 220034 - RNA, 22 nt, Human
aaucacuuagaacccaggaagu

SEQ ID NO: 220035 - RNA, 22 nt, Human
aaucauaacaaaagcaauuaua

SEQ ID NO: 220036 - RNA, 22 nt, Human
aauauuuaaauagaauuacauc

SEQ ID NO: 220037 - RNA, 22 nt, Human
aauagcaauuacccuucaacuc

SEQ ID NO: 220038 - RNA, 22 nt, Human
aauaauuuuuuugugauuaugu

SEQ ID NO: 220039 - RNA, 22 nt, Human
aauagagacaguuuaacaauau

SEQ ID NO: 220040 - RNA, 20 nt, Human
aauagcacagcucaaacauu

SEQ ID NO: 220041 - RNA, 22 nt, Human
aauaugucacacuccuuaauag

SEQ ID NO: 220042 - RNA, 22 nt, Human
aauaugcaaagcguguuaucug

SEQ ID NO: 220043 - RNA, 22 nt, Human
aauaugccaaauccugucacau

SEQ ID NO: 220044 - RNA, 22 nt, Human
aauaucuagccuuuagcagcuu

SEQ ID NO: 220045 - RNA, 22 nt, Human
aauaucuugaguuauaaauuca

SEQ ID NO: 220046 - RNA, 22 nt, Human
aagugauuuagagagcucuuag

SEQ ID NO: 220047 - RNA, 22 nt, Human
aagugagaugggagucagagga

SEQ ID NO: 220048 - RNA, 22 nt, Human
aagucuguucuacagcaccaga

SEQ ID NO: 220049 - RNA, 22 nt, Human
aagucuuugagaucggacauag

SEQ ID NO: 220050 - RNA, 22 nt, Human
aagugaagccaauuuuuuuagg

SEQ ID NO: 220051 - RNA, 20 nt, Human
aagucuauuuagaguugcuu

SEQ ID NO: 220052 - RNA, 22 nt, Human
aagugaaaaaagucaguacuga

SEQ ID NO: 220053 - RNA, 22 nt, Human
aaggugcugaggguccuggcuu

SEQ ID NO: 220054 - RNA, 22 nt, Human
aaguaauuugugaaggcauguu

SEQ ID NO: 220055 - RNA, 22 nt, Human
aaggucuuggcucuggccgcac

SEQ ID NO: 220056 - RNA, 22 nt, Human
aaguaacuggguggccccaguu

SEQ ID NO: 220057 - RNA, 22 nt, Human
aaguccgggcagcaggaauucu

SEQ ID NO: 220058 - RNA, 22 nt, Human
aagucccaucugccuccaugua

SEQ ID NO: 220059 - RNA, 22 nt, Human
aagucgccuaaacaaaguaucu

SEQ ID NO: 220060 - RNA, 22 nt, Human
aaggggaauaguaggaccuggg

SEQ ID NO: 220061 - RNA, 22 nt, Human
aagggccuccuggggagccugg

SEQ ID NO: 220062 - RNA, 23 nt, Human
aagggcgauuaacauucgcucga

SEQ ID NO: 220063 - RNA, 22 nt, Human
aagggagagggagaagguggga

SEQ ID NO: 220064 - RNA, 22 nt, Human
aagguauaaauaacucgggagg

SEQ ID NO: 220065 - RNA, 22 nt, Human
aagguauaucuuuaaaagugaa

SEQ ID NO: 220066 - RNA, 22 nt, Human
aaggggaggccugcgcuuucgg

SEQ ID NO: 220067 - RNA, 23 nt, Human
aaggugaagccaccaggugagga

SEQ ID NO: 220068 - RNA, 22 nt, Human
aaggucaggggcuuuugaaaca

SEQ ID NO: 220069 - RNA, 19 nt, Human
aaggcuuucugagugaaaa

SEQ ID NO: 220070 - RNA, 22 nt, Human
aaggacaccaaacuaauuggga

SEQ ID NO: 220071 - RNA, 22 nt, Human
aaggcgguuccgguucgcggcg

SEQ ID NO: 220072 - RNA, 22 nt, Human
aaggcugugaacuuuucgggaa

SEQ ID NO: 220073 - RNA, 22 nt, Human
aaggcuguuugagcacuggagc

SEQ ID NO: 220074 - RNA, 22 nt, Human
aaggcugaccaguuuacacuuu

SEQ ID NO: 220075 - RNA, 18 nt, Human
aagcugcauuauuuuggc

SEQ ID NO: 220076 - RNA, 22 nt, Human
aaggagaggagucauugggaua

SEQ ID NO: 220077 - RNA, 22 nt, Human
aagcuuugggcagaagaggauu

SEQ ID NO: 220078 - RNA, 22 nt, Human
aaggaaaaaauggcuugugaua

SEQ ID NO: 220079 - RNA, 22 nt, Human
aagaugaucagagggcaagagg

SEQ ID NO: 220080 - RNA, 22 nt, Human
aagaggcagcuugguaggcauc

SEQ ID NO: 220081 - RNA, 22 nt, Human
aagauauauaacccuuucacuu

SEQ ID NO: 220082 - RNA, 22 nt, Human
aagagugaguagcuugguuggu

SEQ ID NO: 220083 - RNA, 22 nt, Human
aagagggguggucugugaggau

SEQ ID NO: 220084 - RNA, 22 nt, Human
aagaguggagcuggaaaguggg

SEQ ID NO: 220085 - RNA, 22 nt, Human
aagagugugagguugugcuuuu

SEQ ID NO: 220086 - RNA, 22 nt, Human
aagcaaagucaucuagaguagu

SEQ ID NO: 220087 - RNA, 22 nt, Human
aagcaaaaucgcaucuggggcc

SEQ ID NO: 220088 - RNA, 22 nt, Human
aagauuugaaaguggugcauuu

SEQ ID NO: 220089 - RNA, 22 nt, Human
aagaucugaccgugauggcggc

SEQ ID NO: 220090 - RNA, 22 nt, Human
aagcagacugggccauaaggaa

SEQ ID NO: 220091 - RNA, 22 nt, Human
aagcagcauaugacagcaucca

SEQ ID NO: 220092 - RNA, 21 nt, Human
aagcagcugcagaauuucagu

SEQ ID NO: 220093 - RNA, 22 nt, Human
aagauuuaccacuuuauucaag

SEQ ID NO: 220094 - RNA, 22 nt, Human
aagcagaacuguuuuguuuucu

SEQ ID NO: 220095 - RNA, 21 nt, Human
aagacguaguuggguggacca

SEQ ID NO: 220096 - RNA, 22 nt, Human
aagaaggcggaccagaagggag

SEQ ID NO: 220097 - RNA, 22 nt, Human
aagacagaaaagcagagagagg

SEQ ID NO: 220098 - RNA, 22 nt, Human
aagacccuaccccuggagagga

SEQ ID NO: 220099 - RNA, 22 nt, Human
aagaccacaggaaucaaacagg

SEQ ID NO: 220100 - RNA, 22 nt, Human
aagaagagaauauauuuacguc

SEQ ID NO: 220101 - RNA, 22 nt, Human
aagaacuagauagugguguaaa

SEQ ID NO: 220102 - RNA, 22 nt, Human
aagaaaagcaucuuuguaguag

SEQ ID NO: 220103 - RNA, 22 nt, Human
aagaaagaucugaaagaagcga

SEQ ID NO: 220104 - RNA, 22 nt, Human
aaccaagcucaauggucugagu

SEQ ID NO: 220105 - RNA, 22 nt, Human
aagaaaagguaaccgcuuaucu

SEQ ID NO: 220106 - RNA, 22 nt, Human
aagaacaacugcuuuaaaagca

SEQ ID NO: 220107 - RNA, 22 nt, Human
aagaacaugggugugggcauuc

SEQ ID NO: 220108 - RNA, 22 nt, Human
aagaaauagauagaggaauacu

SEQ ID NO: 220109 - RNA, 22 nt, Human
aagaaauacagaaauggcagua

SEQ ID NO: 220110 - RNA, 22 nt, Human
aagaaaggagauauucuuuuag

SEQ ID NO: 220111 - RNA, 22 nt, Human
aagaaaggcacaagaaagaaaa

SEQ ID NO: 220112 - RNA, 22 nt, Human
aaggcaggagaguaggaggugg

SEQ ID NO: 220113 - RNA, 22 nt, Human
aaggccacacuugcuggccagc

SEQ ID NO: 220114 - RNA, 22 nt, Human
aaggcgaggggcacagcugaga

SEQ ID NO: 220115 - RNA, 22 nt, Human
aaggcagagggaaaacgggaau

SEQ ID NO: 220116 - RNA, 22 nt, Human
aaggcacuugcccagagcugca

SEQ ID NO: 220117 - RNA, 22 nt, Human
aaggauuuccaggccugcgccu

SEQ ID NO: 220118 - RNA, 22 nt, Human
aaggaguggugaagucagaugu

SEQ ID NO: 220119 - RNA, 22 nt, Human
aaggacaaaacagcuguucuaa

SEQ ID NO: 220120 - RNA, 22 nt, Human
aagcugcagacccccugucuca

SEQ ID NO: 220121 - RNA, 22 nt, Human
aagcucugggacugaggcuccu

SEQ ID NO: 220122 - RNA, 20 nt, Human
aagcuguguucaagauggga

SEQ ID NO: 220123 - RNA, 22 nt, Human
aagcuguuagggagugguaggu

SEQ ID NO: 220124 - RNA, 22 nt, Human
aagcuguuauuucacagguuca

SEQ ID NO: 220125 - RNA, 22 nt, Human
aagcgcggccgccgcggucgcu

SEQ ID NO: 220126 - RNA, 22 nt, Human
aagccuuagauuggcgaugucg

SEQ ID NO: 220127 - RNA, 22 nt, Human
aaggcgauuuaaagauguuagg

SEQ ID NO: 220128 - RNA, 22 nt, Human
aagcucagcugguggugauugc

SEQ ID NO: 220129 - RNA, 22 nt, Human
aagcucuauaggagauacagua

SEQ ID NO: 220130 - RNA, 22 nt, Human
aagcuagguccuccugaacugc

SEQ ID NO: 220131 - RNA, 22 nt, Human
aagcgggcagcggccugcgcca

SEQ ID NO: 220132 - RNA, 22 nt, Human
aagcuuugaauauuagaccuug

SEQ ID NO: 220133 - RNA, 22 nt, Human
aaggaaaaccugacugaagaac

SEQ ID NO: 220134 - RNA, 22 nt, Human
aaggaacuucagggcgaaugga

SEQ ID NO: 220135 - RNA, 22 nt, Human
aaggaaaguuaagguaaacucu

SEQ ID NO: 220136 - RNA, 22 nt, Human
aagccugguuauuugaggaugu

SEQ ID NO: 220137 - RNA, 22 nt, Human
aagcugccugggaggaagggcu

SEQ ID NO: 220138 - RNA, 22 nt, Human
aagcugaguaggaaugguaggu

SEQ ID NO: 220139 - RNA, 22 nt, Human
aagccgagggaggugauggaga

SEQ ID NO: 220140 - RNA, 22 nt, Human
aagccucaugccagauccaggu

SEQ ID NO: 220141 - RNA, 22 nt, Human
aagccagccaguuccagcagcu

SEQ ID NO: 220142 - RNA, 22 nt, Human
aagcauuuuagauaaagcauca

SEQ ID NO: 220143 - RNA, 22 nt, Human
aagcagugacucucagaggcag

SEQ ID NO: 220144 - RNA, 22 nt, Human
aagcaaaugguauugguauuau

SEQ ID NO: 220145 - RNA, 23 nt, Human
aagcaacagacuucaucagauau

SEQ ID NO: 220146 - RNA, 22 nt, Human
aguuuuguuuguuuguuuguua

SEQ ID NO: 220147 - RNA, 18 nt, Human
aguuuuuuuggcaaaagg

SEQ ID NO: 220148 - RNA, 22 nt, Human
auaaaucaagggcaguauuucc

SEQ ID NO: 220149 - RNA, 22 nt, Human
auaaauuugccagcauauguuc

SEQ ID NO: 220150 - RNA, 22 nt, Human
auaaaaauguuuuuguguggua

SEQ ID NO: 220151 - RNA, 22 nt, Human
auaaaaaguggcugcuauugga

SEQ ID NO: 220152 - RNA, 20 nt, Human
auaaauaggauuuucugaca

SEQ ID NO: 220153 - RNA, 22 nt, Human
auaaucuuugaguagaguugag

SEQ ID NO: 220154 - RNA, 22 nt, Human
auaacccuauuaaauggugcgc

SEQ ID NO: 220155 - RNA, 22 nt, Human
auaacgaaagcaauuauuuuca

SEQ ID NO: 220156 - RNA, 22 nt, Human
auaaaguaaugcauauaaugug

SEQ ID NO: 220157 - RNA, 22 nt, Human
auaaucuuuccagucaguuucc

SEQ ID NO: 220158 - RNA, 22 nt, Human
auaaugccucauaggguguucc

SEQ ID NO: 220159 - RNA, 23 nt, Human
auaaugauaaugcuauuuuuugu

SEQ ID NO: 220160 - RNA, 22 nt, Human
auaaaacagaucaggagaauga

SEQ ID NO: 220161 - RNA, 22 nt, Human
auaaaaucugaagcaagaauaa

SEQ ID NO: 220162 - RNA, 22 nt, Human
auaaaagcacaauagaguuaug

SEQ ID NO: 220163 - RNA, 22 nt, Human
auaaguuauuuuaguaaaucag

SEQ ID NO: 220164 - RNA, 22 nt, Human
auaaggcauagugagucaucau

SEQ ID NO: 220165 - RNA, 18 nt, Human
auaccaggauagggacaa

SEQ ID NO: 220166 - RNA, 22 nt, Human
auacaugacucacacauucugc

SEQ ID NO: 220167 - RNA, 22 nt, Human
auaccaaugaaucccugagaau

SEQ ID NO: 220168 - RNA, 22 nt, Human
auaaggaaagugagugcuuaaa

SEQ ID NO: 220169 - RNA, 22 nt, Human
auaagcuucucugcaguucagu

SEQ ID NO: 220170 - RNA, 22 nt, Human
auaaauuugacagcucuucaug

SEQ ID NO: 220171 - RNA, 22 nt, Human
auaaauucuaugauggauuggg

SEQ ID NO: 220172 - RNA, 22 nt, Human
auaaccaaaaauaguuuaguac

SEQ ID NO: 220173 - RNA, 22 nt, Human
auacacauguuauuguggaagc

SEQ ID NO: 220174 - RNA, 22 nt, Human
auacaaaaaguggugaguguau

SEQ ID NO: 220175 - RNA, 22 nt, Human
auaauugaauaagagcugcagg

SEQ ID NO: 220176 - RNA, 22 nt, Human
auacagccuaguuugaguccca

SEQ ID NO: 220177 - RNA, 22 nt, Human
auacaggcaguaagauucucag

SEQ ID NO: 220178 - RNA, 22 nt, Human
aguuuuugccucgaauucugcg

SEQ ID NO: 220179 - RNA, 22 nt, Human
aguuuucugccucuggaugcgu

SEQ ID NO: 220180 - RNA, 22 nt, Human
aguuuguagguuaggaucagca

SEQ ID NO: 220181 - RNA, 22 nt, Human
aguuuggaggagaaagugcggg

SEQ ID NO: 220182 - RNA, 22 nt, Human
aguuucccucacaggucugcau

SEQ ID NO: 220183 - RNA, 23 nt, Human
aguuuacguauucauucuuacuc

SEQ ID NO: 220184 - RNA, 22 nt, Human
aguuucaguuaguugggugaca

SEQ ID NO: 220185 - RNA, 22 nt, Human
aguuuuugagaauucuucugaa

SEQ ID NO: 220186 - RNA, 22 nt, Human
aguuuuuaacgccauguuugaa

SEQ ID NO: 220187 - RNA, 22 nt, Human
aguugugagaaugaacacugaa

SEQ ID NO: 220188 - RNA, 22 nt, Human
aguuuaaauuguucuaucagaa

SEQ ID NO: 220189 - RNA, 22 nt, Human
aguuuccacuggagacacugug

SEQ ID NO: 220190 - RNA, 22 nt, Human
aguuugauuugucuaucuucau

SEQ ID NO: 220191 - RNA, 21 nt, Human
aguuguacuguauagcagaug

SEQ ID NO: 220192 - RNA, 22 nt, Human
aguugguggaagcuaagcuucu

SEQ ID NO: 220193 - RNA, 22 nt, Human
aguugguguuagaguuuuucag

SEQ ID NO: 220194 - RNA, 22 nt, Human
aguuguucucagcagaagaacu

SEQ ID NO: 220195 - RNA, 22 nt, Human
aguugguauuuacugcaguugg

SEQ ID NO: 220196 - RNA, 22 nt, Human
aguugggaaaugcugcaguagu

SEQ ID NO: 220197 - RNA, 22 nt, Human
aguucuguucccccaguuacau

SEQ ID NO: 220198 - RNA, 22 nt, Human
aguugcuucccuauucuuagca

SEQ ID NO: 220199 - RNA, 22 nt, Human
aguugcagguucacguaucuug

SEQ ID NO: 220200 - RNA, 22 nt, Human
aguuggaagacacccugaaauc

SEQ ID NO: 220201 - RNA, 22 nt, Human
aguuguuuuucuuagauuuuag

SEQ ID NO: 220202 - RNA, 22 nt, Human
aguuccucagaagggccuggga

SEQ ID NO: 220203 - RNA, 22 nt, Human
aguucuggcccugaaacaggga

SEQ ID NO: 220204 - RNA, 22 nt, Human
aguugcugccagguccugggag

SEQ ID NO: 220205 - RNA, 22 nt, Human
aguucuuugcucccugcuuuuu

SEQ ID NO: 220206 - RNA, 22 nt, Human
aguucugggaggugcacgucca

SEQ ID NO: 220207 - RNA, 22 nt, Human
aguucucaagguuaggaaaagu

SEQ ID NO: 220208 - RNA, 22 nt, Human
agugcucagggaaugccacuga

SEQ ID NO: 220209 - RNA, 22 nt, Human
agugccuggcugauggguccug

SEQ ID NO: 220210 - RNA, 22 nt, Human
agugccuuaaaggucuugcagc

SEQ ID NO: 220211 - RNA, 21 nt, Human
aguggcacuguuucuucccua

SEQ ID NO: 220212 - RNA, 22 nt, Human
aguggagguuacagcuguacau

SEQ ID NO: 220213 - RNA, 22 nt, Human
aguggugaucuguuacagucac

SEQ ID NO: 220214 - RNA, 22 nt, Human
aguggguaaggacaggugucug

SEQ ID NO: 220215 - RNA, 22 nt, Human
aguggggcccaagaaucugcau

SEQ ID NO: 220216 - RNA, 23 nt, Human
aguggccgaucaucucgggcuug

SEQ ID NO: 220217 - RNA, 22 nt, Human
agugggaaagcugccuuguaga

SEQ ID NO: 220218 - RNA, 19 nt, Human
agugggauggcuuuuuccc

SEQ ID NO: 220219 - RNA, 22 nt, Human
agugccaucuuuaacuguccca

SEQ ID NO: 220220 - RNA, 22 nt, Human
agugccauggcugcuagauggc

SEQ ID NO: 220221 - RNA, 23 nt, Human
aguggaggucgggguggggagac

SEQ ID NO: 220222 - RNA, 20 nt, Human
agugaguuaucagcuacagu

SEQ ID NO: 220223 - RNA, 23 nt, Human
agugaucuguguuugaagaaugc

SEQ ID NO: 220224 - RNA, 23 nt, Human
agugaugcaguaucugggucugu

SEQ ID NO: 220225 - RNA, 22 nt, Human
agugaugcuuuggagaagaucc

SEQ ID NO: 220226 - RNA, 22 nt, Human
agugauguaauggugaauguga

SEQ ID NO: 220227 - RNA, 22 nt, Human
agugaaauaugcccauugcugu

SEQ ID NO: 220228 - RNA, 19 nt, Human
agugaacuccauaucaggu

SEQ ID NO: 220229 - RNA, 21 nt, Human
agugaagagugggcuugauca

SEQ ID NO: 220230 - RNA, 20 nt, Human
aguacugacaauauucugug

SEQ ID NO: 220231 - RNA, 22 nt, Human
aguaggauguuuagcccuucuu

SEQ ID NO: 220232 - RNA, 23 nt, Human
agugaagcugguuagugaugacc

SEQ ID NO: 220233 - RNA, 22 nt, Human
agugaagauagagccaggucug

SEQ ID NO: 220234 - RNA, 21 nt, Human
agugagauuuaugccugguuc

SEQ ID NO: 220235 - RNA, 22 nt, Human
agugagcuuuuaaaauuuacca

SEQ ID NO: 220236 - RNA, 22 nt, Human
agugagaguauuaaugugaacu

SEQ ID NO: 220237 - RNA, 22 nt, Human
agugacuguccuacuuuguaga

SEQ ID NO: 220238 - RNA, 20 nt, Human
agugauuuguuaguacauug

SEQ ID NO: 220239 - RNA, 22 nt, Human
agugaugauccaaaugaauuga

SEQ ID NO: 220240 - RNA, 21 nt, Human
agugaguagagcacugaguca

SEQ ID NO: 220241 - RNA, 22 nt, Human
agugaggggagaaugaggugga

SEQ ID NO: 220242 - RNA, 20 nt, Human
aguucagguuauuuuccucc

SEQ ID NO: 220243 - RNA, 22 nt, Human
aguucauccucauuuacaagga

SEQ ID NO: 220244 - RNA, 22 nt, Human
aguucaugcuuagaucucauuu

SEQ ID NO: 220245 - RNA, 22 nt, Human
aguucaugugguuuaacuuaau

SEQ ID NO: 220246 - RNA, 22 nt, Human
aguucauaucuacuuuuccauc

SEQ ID NO: 220247 - RNA, 22 nt, Human
aguuauuaagaaaauuuugcca

SEQ ID NO: 220248 - RNA, 22 nt, Human
aguucauucuagcugggagcag

SEQ ID NO: 220249 - RNA, 22 nt, Human
aguuaucuauaaaucccugagg

SEQ ID NO: 220250 - RNA, 22 nt, Human
aguuauggguauguauuauaau

SEQ ID NO: 220251 - RNA, 22 nt, Human
aguuauuuuucacuauuaggcu

SEQ ID NO: 220252 - RNA, 22 nt, Human
aguucaauuguuuuguaaaagu

SEQ ID NO: 220253 - RNA, 17 nt, Human
aguuacugcacuugcca

SEQ ID NO: 220254 - RNA, 22 nt, Human
aguuaauuauagugcuuaauau

SEQ ID NO: 220255 - RNA, 22 nt, Human
aguuacuauuacuuauuauuau

SEQ ID NO: 220256 - RNA, 22 nt, Human
aguuaugcaagcaaguaccacu

SEQ ID NO: 220257 - RNA, 22 nt, Human
aguuaaucuuguauuaaugguu

SEQ ID NO: 220258 - RNA, 22 nt, Human
aguuaacuugugguuuggcugu

SEQ ID NO: 220259 - RNA, 22 nt, Human
aguuaaagggggcuacagugug

SEQ ID NO: 220260 - RNA, 22 nt, Human
aguguuuuaagaaaguaauuuu

SEQ ID NO: 220261 - RNA, 22 nt, Human
aguguuuuaugugccaguuuaa

SEQ ID NO: 220262 - RNA, 22 nt, Human
aguguggcccaugaauuauugg

SEQ ID NO: 220263 - RNA, 23 nt, Human
aguguucagcauguaguaaauac

SEQ ID NO: 220264 - RNA, 20 nt, Human
aguguugaacuacacuuccc

SEQ ID NO: 220265 - RNA, 22 nt, Human
aguguuugggagagggugugag

SEQ ID NO: 220266 - RNA, 20 nt, Human
aguguuggugcuuuucccag

SEQ ID NO: 220267 - RNA, 22 nt, Human
agugucuuuagucgcugagcaa

SEQ ID NO: 220268 - RNA, 22 nt, Human
agugugacccauggcaagggca

SEQ ID NO: 220269 - RNA, 22 nt, Human
aguggggaaauaucaauauuug

SEQ ID NO: 220270 - RNA, 19 nt, Human
agugggcaaggaagaugac

SEQ ID NO: 220271 - RNA, 22 nt, Human
agugucagcagcuucauugucu

SEQ ID NO: 220272 - RNA, 22 nt, Human
aguggugccuaagcgcggaggc

SEQ ID NO: 220273 - RNA, 22 nt, Human
aguggcuguuccaggugaggac

SEQ ID NO: 220274 - RNA, 22 nt, Human
aguggcuucucuggggucaaga

SEQ ID NO: 220275 - RNA, 22 nt, Human
aguggcuggcaggggagggucc

SEQ ID NO: 220276 - RNA, 22 nt, Human
aguggcugugaaauacauggga

SEQ ID NO: 220277 - RNA, 22 nt, Human
aguguucaauuugagcucaaag

SEQ ID NO: 220278 - RNA, 22 nt, Human
aguguggccaaugaggaugggc

SEQ ID NO: 220279 - RNA, 22 nt, Human
agggggcaugaaauaaaggaaa

SEQ ID NO: 220280 - RNA, 22 nt, Human
agggggccucucccgcggcgcc

SEQ ID NO: 220281 - RNA, 22 nt, Human
agggggcuccugcaggccccca

SEQ ID NO: 220282 - RNA, 22 nt, Human
aggguuaugcuccuucaucuug

SEQ ID NO: 220283 - RNA, 22 nt, Human
aggguuccugaaaaguauguca

SEQ ID NO: 220284 - RNA, 22 nt, Human
agggucgucuggguccgugggg

SEQ ID NO: 220285 - RNA, 22 nt, Human
aggggcugagaguuugaugugg

SEQ ID NO: 220286 - RNA, 20 nt, Human
aggggcuguaguuagaugac

SEQ ID NO: 220287 - RNA, 22 nt, Human
agggcuuacaucccacaguuag

SEQ ID NO: 220288 - RNA, 22 nt, Human
agggcugggcuuggcaggcugg

SEQ ID NO: 220289 - RNA, 22 nt, Human
aggggcaagucuggccauuucu

SEQ ID NO: 220290 - RNA, 22 nt, Human
aggguguacauuuguuggugaa

SEQ ID NO: 220291 - RNA, 22 nt, Human
aggguguuugggagcagaggau

SEQ ID NO: 220292 - RNA, 22 nt, Human
aggguggcacucugggggcucc

SEQ ID NO: 220293 - RNA, 22 nt, Human
aggguggaggacaggccaguga

SEQ ID NO: 220294 - RNA, 22 nt, Human
aggguaauaacaguauggugau

SEQ ID NO: 220295 - RNA, 22 nt, Human
aggguauguuuuuaucuacugu

SEQ ID NO: 220296 - RNA, 22 nt, Human
agggguuugggaaggguuaggg

SEQ ID NO: 220297 - RNA, 22 nt, Human
aggggcugugucauuuguccua

SEQ ID NO: 220298 - RNA, 22 nt, Human
aggcugcucucgccggcggugu

SEQ ID NO: 220299 - RNA, 22 nt, Human
aggcugucucagccugcuugca

SEQ ID NO: 220300 - RNA, 22 nt, Human
aggcugucucaccucaggaggg

SEQ ID NO: 220301 - RNA, 22 nt, Human
aggcuuuugcucuggcuccucu

SEQ ID NO: 220302 - RNA, 22 nt, Human
aggcuuaacuacaauuuuugcc

SEQ ID NO: 220303 - RNA, 22 nt, Human
aggcuuaaaugcucauaucagu

SEQ ID NO: 220304 - RNA, 22 nt, Human
agggcaguuaugaaugucucca

SEQ ID NO: 220305 - RNA, 22 nt, Human
agggcaguguggugggacugac

SEQ ID NO: 220306 - RNA, 22 nt, Human
agggaaauaggagaagaaagga

SEQ ID NO: 220307 - RNA, 21 nt, Human
agggccagaucaccaaggagc

SEQ ID NO: 220308 - RNA, 22 nt, Human
agggcaguuuuacugaaaggug

SEQ ID NO: 220309 - RNA, 22 nt, Human
agggaggcccagcagacuggcg

SEQ ID NO: 220310 - RNA, 19 nt, Human
agggaggcaagagaaaugu

SEQ ID NO: 220311 - RNA, 22 nt, Human
agggaguuccgaucugugcacc

SEQ ID NO: 220312 - RNA, 22 nt, Human
agggaugcaguaaaaacuguag

SEQ ID NO: 220313 - RNA, 20 nt, Human
agggauuugguugguauugu

SEQ ID NO: 220314 - RNA, 22 nt, Human
agggcaggguuggugcuggugc

SEQ ID NO: 220315 - RNA, 22 nt, Human
aggggcagaggaugauggaaga

SEQ ID NO: 220316 - RNA, 22 nt, Human
agggcaugugaaguaaccuagg

SEQ ID NO: 220317 - RNA, 23 nt, Human
agggcacugaagcuggaauuggg

SEQ ID NO: 220318 - RNA, 20 nt, Human
aguacauauuugugauuuuu

SEQ ID NO: 220319 - RNA, 21 nt, Human
aguaccugugugccugugugu

SEQ ID NO: 220320 - RNA, 22 nt, Human
aguaauaaacaacucauuuugg

SEQ ID NO: 220321 - RNA, 22 nt, Human
agguuuuagagagccaggaugu

SEQ ID NO: 220322 - RNA, 22 nt, Human
agguuuuacuuuuuuuggaggu

SEQ ID NO: 220323 - RNA, 22 nt, Human
aguaaaggaaggaagggacagc

SEQ ID NO: 220324 - RNA, 22 nt, Human
agguuuuugucauuuucuggua

SEQ ID NO: 220325 - RNA, 19 nt, Human
aguaaagugguggcauuuu

SEQ ID NO: 220326 - RNA, 18 nt, Human
aguaaauguuaaauauug

SEQ ID NO: 220327 - RNA, 22 nt, Human
agguuaugcacugcacaacccu

SEQ ID NO: 220328 - RNA, 18 nt, Human
agguugcaucugugcaga

SEQ ID NO: 220329 - RNA, 22 nt, Human
agguucaucaauaacucagaga

SEQ ID NO: 220330 - RNA, 22 nt, Human
agguuguugagaucaucuggcu

SEQ ID NO: 220331 - RNA, 22 nt, Human
agguuuaggaaaacugagaguc

SEQ ID NO: 220332 - RNA, 22 nt, Human
agguuguaucauaugaaacugu

SEQ ID NO: 220333 - RNA, 22 nt, Human
agguuuauggagcaccacaucu

SEQ ID NO: 220334 - RNA, 20 nt, Human
agguuugcuguauaucaugg

SEQ ID NO: 220335 - RNA, 22 nt, Human
agguggcuaugaggaugcaguc

SEQ ID NO: 220336 - RNA, 22 nt, Human
agguggcguauguguucguguu

SEQ ID NO: 220337 - RNA, 22 nt, Human
aggugagaacguggaggggcgg

SEQ ID NO: 220338 - RNA, 19 nt, Human
aggugaugugacucuagaa

SEQ ID NO: 220339 - RNA, 22 nt, Human
aggugauauuauguauuucuau

SEQ ID NO: 220340 - RNA, 22 nt, Human
aggugcagcugguggagucugg

SEQ ID NO: 220341 - RNA, 22 nt, Human
aggugcauuuacuuggggcccu

SEQ ID NO: 220342 - RNA, 22 nt, Human
aggugcccaaaucuucuguuuu

SEQ ID NO: 220343 - RNA, 22 nt, Human
agguuagaauauuuuuucaaga

SEQ ID NO: 220344 - RNA, 22 nt, Human
agguuaggaggggagugccaca

SEQ ID NO: 220345 - RNA, 22 nt, Human
agguuaaacuuccugcagggcu

SEQ ID NO: 220346 - RNA, 22 nt, Human
aggugugcacccggucgcuucc

SEQ ID NO: 220347 - RNA, 22 nt, Human
agguggucccaauggcugggca

SEQ ID NO: 220348 - RNA, 22 nt, Human
aggugggucgcaggcaucagug

SEQ ID NO: 220349 - RNA, 22 nt, Human
agguggugacgaugcuccguac

SEQ ID NO: 220350 - RNA, 22 nt, Human
agguguaauuacucuugcaguu

SEQ ID NO: 220351 - RNA, 22 nt, Human
aggauuuaauugcauuuuucuc

SEQ ID NO: 220352 - RNA, 22 nt, Human
aggauuuauuccagaaaugcaa

SEQ ID NO: 220353 - RNA, 22 nt, Human
aggauaaaggucauuauuccca

SEQ ID NO: 220354 - RNA, 22 nt, Human
aggauugucuccugugaugugc

SEQ ID NO: 220355 - RNA, 22 nt, Human
aggauuuagcaugaaaugugaa

SEQ ID NO: 220356 - RNA, 22 nt, Human
aggcaacagacaggcuugguuc

SEQ ID NO: 220357 - RNA, 16 nt, Human
aggauauauucucuuc

SEQ ID NO: 220358 - RNA, 20 nt, Human
aggcagacaaggagucuguu

SEQ ID NO: 220359 - RNA, 22 nt, Human
aggcagagaggucuuccuggaa

SEQ ID NO: 220360 - RNA, 20 nt, Human
aggauuauguacauggaugc

SEQ ID NO: 220361 - RNA, 22 nt, Human
aggauggauagcaaggaagccg

SEQ ID NO: 220362 - RNA, 22 nt, Human
aggcaauagagggugaggagga

SEQ ID NO: 220363 - RNA, 22 nt, Human
aggcaagauuaggaccagaaga

SEQ ID NO: 220364 - RNA, 23 nt, Human
aggcaagaacggguuguucaccc

SEQ ID NO: 220365 - RNA, 22 nt, Human
aggcaauuuuuaggguuguugu

SEQ ID NO: 220366 - RNA, 22 nt, Human
aggaggaggacucgccaggcca

SEQ ID NO: 220367 - RNA, 22 nt, Human
aggaauuuuaauaugcuugucu

SEQ ID NO: 220368 - RNA, 22 nt, Human
aggaauuugggguuacaugaug

SEQ ID NO: 220369 - RNA, 22 nt, Human
aggagcacugggcaugucaccc

SEQ ID NO: 220370 - RNA, 22 nt, Human
aggaacaacagccuuuauaucc

SEQ ID NO: 220371 - RNA, 22 nt, Human
aggaaauaguuuagucccaaaa

SEQ ID NO: 220372 - RNA, 22 nt, Human
aggaauugucgucauguauaau

SEQ ID NO: 220373 - RNA, 22 nt, Human
aggaauuucacugcguuuuuua

SEQ ID NO: 220374 - RNA, 22 nt, Human
aggaaauaggaccagacaaagc

SEQ ID NO: 220375 - RNA, 22 nt, Human
aggaauguugagacauggcuaa

SEQ ID NO: 220376 - RNA, 22 nt, Human
agcgcugugaaggcugggccac

SEQ ID NO: 220377 - RNA, 22 nt, Human
agcggaggaggcggagcaggga

SEQ ID NO: 220378 - RNA, 22 nt, Human
agcggcaagguguauguggcag

SEQ ID NO: 220379 - RNA, 22 nt, Human
aggaaauaagggcacuucagau

SEQ ID NO: 220380 - RNA, 22 nt, Human
agcggcaggacgucuucuucga

SEQ ID NO: 220381 - RNA, 19 nt, Human
agcggccgccgcgggcgcc

SEQ ID NO: 220382 - RNA, 22 nt, Human
aggcaggggagcuggaagggua

SEQ ID NO: 220383 - RNA, 22 nt, Human
aggcagugccuggaccccagcu

SEQ ID NO: 220384 - RNA, 22 nt, Human
aggcauuuucuuguuauuuuua

SEQ ID NO: 220385 - RNA, 21 nt, Human
aggcauuuucuuggagauucu

SEQ ID NO: 220386 - RNA, 22 nt, Human
aggcauuuaucaggaaauguuc

SEQ ID NO: 220387 - RNA, 22 nt, Human
aggcaguguggagggcuguugc

SEQ ID NO: 220388 - RNA, 22 nt, Human
aggcauuuaaagauguaagacu

SEQ ID NO: 220389 - RNA, 22 nt, Human
aggccagggacaaugaggcaga

SEQ ID NO: 220390 - RNA, 22 nt, Human
aggccacucagggggccaagau

SEQ ID NO: 220391 - RNA, 22 nt, Human
aggccaggcgccggcgcgagac

SEQ ID NO: 220392 - RNA, 22 nt, Human
aggccagugcagcuggaacaga

SEQ ID NO: 220393 - RNA, 22 nt, Human
aggcugcuggcaggcguggacg

SEQ ID NO: 220394 - RNA, 22 nt, Human
aggcuccucugggggccccgga

SEQ ID NO: 220395 - RNA, 22 nt, Human
aggcguggcuucugcuggguug

SEQ ID NO: 220396 - RNA, 22 nt, Human
aggcccagcaccagcggucuuc

SEQ ID NO: 220397 - RNA, 19 nt, Human
aggcagccccaacuugcau

SEQ ID NO: 220398 - RNA, 23 nt, Human
aggcagaguccuggggcacagcc

SEQ ID NO: 220399 - RNA, 21 nt, Human
aggcagcgauuuucauauugc

SEQ ID NO: 220400 - RNA, 22 nt, Human
aggcagcagggagggagaaaug

SEQ ID NO: 220401 - RNA, 22 nt, Human
aggcaauuauacuagguuuugg

SEQ ID NO: 220402 - RNA, 22 nt, Human
aggcaggagcugugguggugag

SEQ ID NO: 220403 - RNA, 22 nt, Human
aggcagagauggcugcagggcc

SEQ ID NO: 220404 - RNA, 22 nt, Human
aggcacagaauccagucugcug

SEQ ID NO: 220405 - RNA, 22 nt, Human
aggcagaugggagcuggaaguu

SEQ ID NO: 220406 - RNA, 23 nt, Human
aggcagcaugcaacaggccauuu

SEQ ID NO: 220407 - RNA, 22 nt, Human
aggcaggauuugcgaugugguu

SEQ ID NO: 220408 - RNA, 22 nt, Human
aggcaucguguuuuucugcuuu

SEQ ID NO: 220409 - RNA, 22 nt, Human
aggcaguguguagcuggaagag

SEQ ID NO: 220410 - RNA, 22 nt, Human
aggcagugguguuugcuggugg

SEQ ID NO: 220411 - RNA, 22 nt, Human
aggcauauaguguuuaaaaaaa

SEQ ID NO: 220412 - RNA, 22 nt, Human
aggcaguggcuuuuguuguguu

SEQ ID NO: 220413 - RNA, 22 nt, Human
aggcaguggagcuggaauaggc

SEQ ID NO: 220414 - RNA, 22 nt, Human
aggcaggcucaaugcccagucu

SEQ ID NO: 220415 - RNA, 22 nt, Human
acgccuugagccuugccugaau

SEQ ID NO: 220416 - RNA, 22 nt, Human
acgccugccuguacuugugggg

SEQ ID NO: 220417 - RNA, 22 nt, Human
acgccggguaaggucauucugc

SEQ ID NO: 220418 - RNA, 23 nt, Human
acgcagacacauguaugggccuc

SEQ ID NO: 220419 - RNA, 22 nt, Human
acggcggguuccgggccagccc

SEQ ID NO: 220420 - RNA, 22 nt, Human
acggagggagagagggaggaga

SEQ ID NO: 220421 - RNA, 22 nt, Human
acgcugagcucauggagaugca

SEQ ID NO: 220422 - RNA, 22 nt, Human
acaucuaugucugaggccuugg

SEQ ID NO: 220423 - RNA, 22 nt, Human
acaucucacuucuuugaaggcu

SEQ ID NO: 220424 - RNA, 22 nt, Human
acagucucucaagcauauccug

SEQ ID NO: 220425 - RNA, 22 nt, Human
acaugacagugacuuuauaaga

SEQ ID NO: 220426 - RNA, 22 nt, Human
acaucuucuauggagguucgga

SEQ ID NO: 220427 - RNA, 22 nt, Human
acgccaggagcuucuccguuca

SEQ ID NO: 220428 - RNA, 20 nt, Human
acgccgcgaggugagcuggu

SEQ ID NO: 220429 - RNA, 22 nt, Human
acuagcacgccuuaccguaaga

SEQ ID NO: 220430 - RNA, 22 nt, Human
acuaggugggugucacugacuc

SEQ ID NO: 220431 - RNA, 22 nt, Human
acuaggaaguaaauaugucauc

SEQ ID NO: 220432 - RNA, 22 nt, Human
acuauacaguauguacgugcac

SEQ ID NO: 220433 - RNA, 22 nt, Human
acguugaaaugggcauuuuccg

SEQ ID NO: 220434 - RNA, 22 nt, Human
acguuauagaugcuucaugaaa

SEQ ID NO: 220435 - RNA, 22 nt, Human
acgugaccuuauuugaaaaaug

SEQ ID NO: 220436 - RNA, 22 nt, Human
acgugugugugcacguguguau

SEQ ID NO: 220437 - RNA, 22 nt, Human
acgucaucguugucaucgucau

SEQ ID NO: 220438 - RNA, 22 nt, Human
acguaaacagcaaagacaugau

SEQ ID NO: 220439 - RNA, 22 nt, Human
acgguguuucucguucaggguu

SEQ ID NO: 220440 - RNA, 22 nt, Human
acgguuuugugagguaguacuu

SEQ ID NO: 220441 - RNA, 22 nt, Human
acuauauaaugcacacaguaua

SEQ ID NO: 220442 - RNA, 22 nt, Human
acuaucaacagcaucagggugu

SEQ ID NO: 220443 - RNA, 22 nt, Human
acuauugcuuuagggggaaacc

SEQ ID NO: 220444 - RNA, 22 nt, Human
acucaaccaucugcauuuuuga

SEQ ID NO: 220445 - RNA, 22 nt, Human
acuauuguccgauuucuuuacu

SEQ ID NO: 220446 - RNA, 22 nt, Human
acuauggaguucagaucuugag

SEQ ID NO: 220447 - RNA, 22 nt, Human
acugauuuuauauauuaccccg

SEQ ID NO: 220448 - RNA, 22 nt, Human
acugcagauccucugagaaacc

SEQ ID NO: 220449 - RNA, 22 nt, Human
acugaucuguguaauauguuac

SEQ ID NO: 220450 - RNA, 22 nt, Human
acugaugacaaugugaguguuc

SEQ ID NO: 220451 - RNA, 22 nt, Human
acugcacuccagcccgagcaac

SEQ ID NO: 220452 - RNA, 22 nt, Human
acugcaggucccaucaccugcg

SEQ ID NO: 220453 - RNA, 22 nt, Human
acugcauuucauaaauuacaau

SEQ ID NO: 220454 - RNA, 22 nt, Human
acugcugauuauugaaguagag

SEQ ID NO: 220455 - RNA, 21 nt, Human
acugccaugcaggagccucca

SEQ ID NO: 220456 - RNA, 22 nt, Human
acugcuguugugauggguauuu

SEQ ID NO: 220457 - RNA, 22 nt, Human
acugaaggcuggaccaugcauc

SEQ ID NO: 220458 - RNA, 22 nt, Human
acugaaauuuauauuuugggca

SEQ ID NO: 220459 - RNA, 22 nt, Human
acugaaauggggacaguccuua

SEQ ID NO: 220460 - RNA, 22 nt, Human
acugaaaguugaugagucacug

SEQ ID NO: 220461 - RNA, 22 nt, Human
acugaauguucucaaaggggag

SEQ ID NO: 220462 - RNA, 22 nt, Human
acucuugacuaaugcuaauguc

SEQ ID NO: 220463 - RNA, 22 nt, Human
acucagcaccuagaaagugugc

SEQ ID NO: 220464 - RNA, 22 nt, Human
acucacuguuuugaaauugaac

SEQ ID NO: 220465 - RNA, 22 nt, Human
acucaucauuuuacggagcagc

SEQ ID NO: 220466 - RNA, 22 nt, Human
acucagucauuuggggaacagu

SEQ ID NO: 220467 - RNA, 22 nt, Human
acucaguuuugaucguucuuau

SEQ ID NO: 220468 - RNA, 22 nt, Human
acucaguaacuguuugcugaau

SEQ ID NO: 220469 - RNA, 22 nt, Human
acuccuuuuaugugugcuaaaa

SEQ ID NO: 220470 - RNA, 21 nt, Human
acuccagccacugacugucuc

SEQ ID NO: 220471 - RNA, 22 nt, Human
acucggcggccucgagugcugg

SEQ ID NO: 220472 - RNA, 22 nt, Human
acucucugcugcugagcuuggg

SEQ ID NO: 220473 - RNA, 22 nt, Human
acucggaggccaaggccaacgg

SEQ ID NO: 220474 - RNA, 22 nt, Human
acucugaggauuucaguuuuac

SEQ ID NO: 220475 - RNA, 22 nt, Human
acucugagguuuuccaaguaca

SEQ ID NO: 220476 - RNA, 18 nt, Human
acucugaagcuaagucac

SEQ ID NO: 220477 - RNA, 22 nt, Human
acucugagaugugucuugauuc

SEQ ID NO: 220478 - RNA, 23 nt, Human
acucucuguuuggaggcacuggu

SEQ ID NO: 220479 - RNA, 22 nt, Human
acucugaaaggcuacaaaugcu

SEQ ID NO: 220480 - RNA, 22 nt, Human
acuucccacugcagugacugag

SEQ ID NO: 220481 - RNA, 21 nt, Human
acuuccacaucacugaguaga

SEQ ID NO: 220482 - RNA, 22 nt, Human
acuggauuuugugguguaucuu

SEQ ID NO: 220483 - RNA, 22 nt, Human
acuggauucucuuacacagaug

SEQ ID NO: 220484 - RNA, 22 nt, Human
acugcguuucuaaaguagcaua

SEQ ID NO: 220485 - RNA, 22 nt, Human
acuucaggacggcaguggaggg

SEQ ID NO: 220486 - RNA, 22 nt, Human
acuugaugcauauggaagagca

SEQ ID NO: 220487 - RNA, 22 nt, Human
acuugauggaguuucacuguau

SEQ ID NO: 220488 - RNA, 22 nt, Human
acuugcauuguguaguguuuuu

SEQ ID NO: 220489 - RNA, 22 nt, Human
acuugggaaaugaaaauacaga

SEQ ID NO: 220490 - RNA, 22 nt, Human
acuguugagggaagcagaugaa

SEQ ID NO: 220491 - RNA, 22 nt, Human
acuguucacccagcacuagcag

SEQ ID NO: 220492 - RNA, 17 nt, Human
acuuaagacaguggaaa

SEQ ID NO: 220493 - RNA, 22 nt, Human
acuuacuuucuauucuuguagg

SEQ ID NO: 220494 - RNA, 22 nt, Human
acuuugccagcucccugcuggc

SEQ ID NO: 220495 - RNA, 22 nt, Human
acuuuaaauaucauuugguagg

SEQ ID NO: 220496 - RNA, 22 nt, Human
acuucaggagcagucucuggaa

SEQ ID NO: 220497 - RNA, 22 nt, Human
acuucauuugaaaugguugaau

SEQ ID NO: 220498 - RNA, 20 nt, Human
acuuucacaugaacauuuaa

SEQ ID NO: 220499 - RNA, 22 nt, Human
acuuuauacuagugauaguuug

SEQ ID NO: 220500 - RNA, 22 nt, Human
acuuguaaaauagagauaggga

SEQ ID NO: 220501 - RNA, 22 nt, Human
acuugagcuugaaagguaugcu

SEQ ID NO: 220502 - RNA, 22 nt, Human
acuuugagaauuuuacuugugu

SEQ ID NO: 220503 - RNA, 22 nt, Human
agaaacaagcccuagaaguccu

SEQ ID NO: 220504 - RNA, 22 nt, Human
agaaacacaaguaaagcuccca

SEQ ID NO: 220505 - RNA, 22 nt, Human
agaaauggccagacuugccccu

SEQ ID NO: 220506 - RNA, 22 nt, Human
agaaaauagguaguagacgggc

SEQ ID NO: 220507 - RNA, 22 nt, Human
agaaaagaggcuuucuaagcau

SEQ ID NO: 220508 - RNA, 22 nt, Human
acuuggucguggugcagcaugg

SEQ ID NO: 220509 - RNA, 22 nt, Human
agacaaucaacuguugaugccu

SEQ ID NO: 220510 - RNA, 22 nt, Human
agaccauuuuguagccagcaua

SEQ ID NO: 220511 - RNA, 22 nt, Human
agacaagagcugaggacauauu

SEQ ID NO: 220512 - RNA, 22 nt, Human
agaauuuguaucuacggugugc

SEQ ID NO: 220513 - RNA, 22 nt, Human
agacaaggggauuuuugauggu

SEQ ID NO: 220514 - RNA, 22 nt, Human
agacacagcaauaacuacuguu

SEQ ID NO: 220515 - RNA, 22 nt, Human
agaccauguuauccuucauuuu

SEQ ID NO: 220516 - RNA, 22 nt, Human
agaccccuggggaggauuauag

SEQ ID NO: 220517 - RNA, 22 nt, Human
agaaguuuguuauguaaacaaa

SEQ ID NO: 220518 - RNA, 22 nt, Human
agaauacaauuguucaguaaua

SEQ ID NO: 220519 - RNA, 22 nt, Human
agaagguggaguagaacaagcu

SEQ ID NO: 220520 - RNA, 22 nt, Human
agaagguagaugcaucaggagg

SEQ ID NO: 220521 - RNA, 19 nt, Human
agaauuggaaccaugaacc

SEQ ID NO: 220522 - RNA, 22 nt, Human
agaaguagacaguuggauauaa

SEQ ID NO: 220523 - RNA, 22 nt, Human
agaaucugcauuuuaacaagau

SEQ ID NO: 220524 - RNA, 22 nt, Human
agaauccucuagggauggcagg

SEQ ID NO: 220525 - RNA, 22 nt, Human
agaaucagagcagaaucuucau

SEQ ID NO: 220526 - RNA, 22 nt, Human
agaaggcagaaaagcuuuacaa

SEQ ID NO: 220527 - RNA, 22 nt, Human
agaagggaagcaggagaggcau

SEQ ID NO: 220528 - RNA, 22 nt, Human
agaauauaguaaauauuuucua

SEQ ID NO: 220529 - RNA, 21 nt, Human
agaaguuauuccauggguguu

SEQ ID NO: 220530 - RNA, 22 nt, Human
agaagcaauuggaaaguacagg

SEQ ID NO: 220531 - RNA, 22 nt, Human
agaagcaaagcaaacacauucu

SEQ ID NO: 220532 - RNA, 22 nt, Human
agaaguguacuuagagaacaua

SEQ ID NO: 220533 - RNA, 22 nt, Human
agaauaagucuaauauauuggu

SEQ ID NO: 220534 - RNA, 22 nt, Human
agaaggcaucugcucgcuucca

SEQ ID NO: 220535 - RNA, 22 nt, Human
agaacccaaggcccagggaugu

SEQ ID NO: 220536 - RNA, 22 nt, Human
agaaaaggaagcuuagacugua

SEQ ID NO: 220537 - RNA, 22 nt, Human
agaacaggaggaagccagcucc

SEQ ID NO: 220538 - RNA, 22 nt, Human
agaacauaucuguuuucuaacu

SEQ ID NO: 220539 - RNA, 22 nt, Human
agaagggcugcuuagaauauac

SEQ ID NO: 220540 - RNA, 22 nt, Human
agaagaagacccuaaggaaagg

SEQ ID NO: 220541 - RNA, 22 nt, Human
agaagauucagcaguagggugg

SEQ ID NO: 220542 - RNA, 22 nt, Human
agauaggcuuagccaagcuuuc

SEQ ID NO: 220543 - RNA, 22 nt, Human
agauaaacaacucuuagcuguu

SEQ ID NO: 220544 - RNA, 22 nt, Human
agauaagaacauuaguaagccg

SEQ ID NO: 220545 - RNA, 22 nt, Human
agauaacauguugcagauucug

SEQ ID NO: 220546 - RNA, 22 nt, Human
agauauuauuuucuauuuauca

SEQ ID NO: 220547 - RNA, 19 nt, Human
agaucaggauguauuuuug

SEQ ID NO: 220548 - RNA, 22 nt, Human
agaucauuaaccaccuguucug

SEQ ID NO: 220549 - RNA, 17 nt, Human
agaucugaaggagaaca

SEQ ID NO: 220550 - RNA, 22 nt, Human
agauagaaggauugugacacau

SEQ ID NO: 220551 - RNA, 22 nt, Human
agauaaucacaaucuagacuuu

SEQ ID NO: 220552 - RNA, 22 nt, Human
agaguaauguggaguuugugcu

SEQ ID NO: 220553 - RNA, 22 nt, Human
agaguggcaccuuaccugagac

SEQ ID NO: 220554 - RNA, 22 nt, Human
agagugagauaugugguuggua

SEQ ID NO: 220555 - RNA, 22 nt, Human
agaguuaguggccucagcaggg

SEQ ID NO: 220556 - RNA, 22 nt, Human
agaguguaauuaguauuuauau

SEQ ID NO: 220557 - RNA, 21 nt, Human
agaguuuucuccauuucaggc

SEQ ID NO: 220558 - RNA, 21 nt, Human
agaguugaaggcaguaaagag

SEQ ID NO: 220559 - RNA, 22 nt, Human
agaguucaccccacugaugagu

SEQ ID NO: 220560 - RNA, 22 nt, Human
agauaaaucauuuauuaagcgg

SEQ ID NO: 220561 - RNA, 22 nt, Human
agauaucuuguuggcauaaaug

SEQ ID NO: 220562 - RNA, 22 nt, Human
agagcccagaucccacccugga

SEQ ID NO: 220563 - RNA, 22 nt, Human
agagcagcuuuucggaaccacu

SEQ ID NO: 220564 - RNA, 22 nt, Human
agagcauagggcauuaggaagg

SEQ ID NO: 220565 - RNA, 22 nt, Human
agagggagagaccuccgugccu

SEQ ID NO: 220566 - RNA, 22 nt, Human
agaggcaggcagcagagaagau

SEQ ID NO: 220567 - RNA, 22 nt, Human
agaggcaugaacucccguagcc

SEQ ID NO: 220568 - RNA, 22 nt, Human
agaggcagagcugggguuugac

SEQ ID NO: 220569 - RNA, 22 nt, Human
agaggggaaggaugugauguga

SEQ ID NO: 220570 - RNA, 22 nt, Human
agacgggacagacuuuugagug

SEQ ID NO: 220571 - RNA, 22 nt, Human
agacuaauaucccauuucugac

SEQ ID NO: 220572 - RNA, 22 nt, Human
agacgcgcagaaggaagcggcc

SEQ ID NO: 220573 - RNA, 19 nt, Human
agagauuuucuguuuuagu

SEQ ID NO: 220574 - RNA, 22 nt, Human
agacacugacaggguccaugga

SEQ ID NO: 220575 - RNA, 22 nt, Human
agacacauuuucagcucugcca

SEQ ID NO: 220576 - RNA, 22 nt, Human
agagauuuacaacuugggcuuu

SEQ ID NO: 220577 - RNA, 22 nt, Human
agauguuaauaaccuuagggca

SEQ ID NO: 220578 - RNA, 22 nt, Human
agauguugucucuuacguuuga

SEQ ID NO: 220579 - RNA, 22 nt, Human
agauuaagcauuauaauuauaa

SEQ ID NO: 220580 - RNA, 22 nt, Human
agauugaacgagcuggcaugga

SEQ ID NO: 220581 - RNA, 22 nt, Human
agauuauuuaagacaggaacca

SEQ ID NO: 220582 - RNA, 22 nt, Human
agcaaaacuaaagacacagaca

SEQ ID NO: 220583 - RNA, 22 nt, Human
agcaaagccucuuugaaaaaaa

SEQ ID NO: 220584 - RNA, 22 nt, Human
agauggaguccugaagccagaa

SEQ ID NO: 220585 - RNA, 19 nt, Human
agauggcaaaaugcaaaga

SEQ ID NO: 220586 - RNA, 22 nt, Human
agaugguucagaauuauaaaga

SEQ ID NO: 220587 - RNA, 22 nt, Human
agauggcugggagcucuguuug

SEQ ID NO: 220588 - RNA, 22 nt, Human
agauucgucuuuaauucaccau

SEQ ID NO: 220589 - RNA, 20 nt, Human
agaugcccaacucuguuuug

SEQ ID NO: 220590 - RNA, 22 nt, Human
agauggaggaaagcaguuagaa

SEQ ID NO: 220591 - RNA, 21 nt, Human
agaugcaguuugcaggugggu

SEQ ID NO: 220592 - RNA, 22 nt, Human
agauugaugugaccauuggaag

SEQ ID NO: 220593 - RNA, 22 nt, Human
agauucucccuccuggcgcugu

SEQ ID NO: 220594 - RNA, 22 nt, Human
agauggggccugaggacacugu

SEQ ID NO: 220595 - RNA, 22 nt, Human
agaugucauguguugcuccaag

SEQ ID NO: 220596 - RNA, 22 nt, Human
agaugggacauuugucccuagg

SEQ ID NO: 220597 - RNA, 22 nt, Human
agauggcuccaguguccagagg

SEQ ID NO: 220598 - RNA, 22 nt, Human
agaugaacuuuuuuaaacugga

SEQ ID NO: 220599 - RNA, 22 nt, Human
agaugacuaacauaguauugcu

SEQ ID NO: 220600 - RNA, 22 nt, Human
agaucugucaccauccuggagc

SEQ ID NO: 220601 - RNA, 23 nt, Human
agaugaugaauaaagagugagga

SEQ ID NO: 220602 - RNA, 21 nt, Human
agauguucaguguccuaaccc

SEQ ID NO: 220603 - RNA, 22 nt, Human
agaugacuuuguccugagcuga

SEQ ID NO: 220604 - RNA, 22 nt, Human
agaugaguaaauggagucuucc

SEQ ID NO: 220605 - RNA, 22 nt, Human
agaugaugugugucuucagcua

SEQ ID NO: 220606 - RNA, 22 nt, Human
agauauucugccuaacagguuu

SEQ ID NO: 220607 - RNA, 22 nt, Human
agccauggagauguggguuggg

SEQ ID NO: 220608 - RNA, 22 nt, Human
agccgauaaauuguuuucuugg

SEQ ID NO: 220609 - RNA, 22 nt, Human
agccccaauuacagcugugcug

SEQ ID NO: 220610 - RNA, 22 nt, Human
agccacggcaaugauaggcugc

SEQ ID NO: 220611 - RNA, 22 nt, Human
agccagugucgugugacaugag

SEQ ID NO: 220612 - RNA, 22 nt, Human
agccaugcuguuuugccuggga

SEQ ID NO: 220613 - RNA, 22 nt, Human
agccaucuggugucaaugauuc

SEQ ID NO: 220614 - RNA, 22 nt, Human
agcaggggcaggguuuugugcu

SEQ ID NO: 220615 - RNA, 22 nt, Human
agccagugcagcuggaaauuca

SEQ ID NO: 220616 - RNA, 22 nt, Human
agcccccaaaauguuugccugc

SEQ ID NO: 220617 - RNA, 22 nt, Human
agccccuucuuuggggagcuga

SEQ ID NO: 220618 - RNA, 18 nt, Human
agcccucuguuacuggaa

SEQ ID NO: 220619 - RNA, 22 nt, Human
agcccuauacuuagauuuauuc

SEQ ID NO: 220620 - RNA, 22 nt, Human
agccuacauuugacuauagucu

SEQ ID NO: 220621 - RNA, 21 nt, Human
agccgggacaacguggacccc

SEQ ID NO: 220622 - RNA, 22 nt, Human
agcgaaaagaauggaguggagu

SEQ ID NO: 220623 - RNA, 22 nt, Human
agccuuucugcgcacucuuccg

SEQ ID NO: 220624 - RNA, 22 nt, Human
agccugaaccaauauagcagcc

SEQ ID NO: 220625 - RNA, 22 nt, Human
agccgcgcagccucauuaagga

SEQ ID NO: 220626 - RNA, 22 nt, Human
agccgcugaauuugaaacaagc

SEQ ID NO: 220627 - RNA, 22 nt, Human
agccuauucaucugaucuugaa

SEQ ID NO: 220628 - RNA, 22 nt, Human
agccucuagcuccccaaagcca

SEQ ID NO: 220629 - RNA, 22 nt, Human
agccucucugaugugacagcua

SEQ ID NO: 220630 - RNA, 22 nt, Human
agccugggucgagagacgagaa

SEQ ID NO: 220631 - RNA, 22 nt, Human
agccugugacucugugaaacca

SEQ ID NO: 220632 - RNA, 21 nt, Human
agcgcugcauccaccauggcu

SEQ ID NO: 220633 - RNA, 22 nt, Human
agcgcucauuuuccuccugcuc

SEQ ID NO: 220634 - RNA, 22 nt, Human
agccuggacagcuacggagaac

SEQ ID NO: 220635 - RNA, 22 nt, Human
agcagagaacauucauucaugu

SEQ ID NO: 220636 - RNA, 22 nt, Human
agcagauaaagguugcauuucu

SEQ ID NO: 220637 - RNA, 22 nt, Human
agcacuagcugcuugucucaag

SEQ ID NO: 220638 - RNA, 22 nt, Human
agcaaggguugguuuucugaca

SEQ ID NO: 220639 - RNA, 22 nt, Human
agcaagggucucucauggcuug

SEQ ID NO: 220640 - RNA, 22 nt, Human
agcaaauaauugucuuugaggg

SEQ ID NO: 220641 - RNA, 22 nt, Human
agcaacauggaguuugugcgca

SEQ ID NO: 220642 - RNA, 22 nt, Human
agcaaaguacugagcucaaagg

SEQ ID NO: 220643 - RNA, 22 nt, Human
agauuguaugaggacuccauga

SEQ ID NO: 220644 - RNA, 22 nt, Human
agcaauguuggccuauauaccu

SEQ ID NO: 220645 - RNA, 22 nt, Human
agcaccuuguucagaucuuaca

SEQ ID NO: 220646 - RNA, 20 nt, Human
agcacaggcagucauucagu

SEQ ID NO: 220647 - RNA, 22 nt, Human
agauuuucuuuuccaucuuugu

SEQ ID NO: 220648 - RNA, 22 nt, Human
agcaaaauuccaaaaugcuaau

SEQ ID NO: 220649 - RNA, 22 nt, Human
agauuucaauggauauugcaag

SEQ ID NO: 220650 - RNA, 22 nt, Human
agauuuggaauggggguucaua

SEQ ID NO: 220651 - RNA, 22 nt, Human
agauuuuacggaguauuagggu

SEQ ID NO: 220652 - RNA, 22 nt, Human
agauuuguauagaugugguuga

SEQ ID NO: 220653 - RNA, 22 nt, Human
agcacauguuucuuuugcaauu

SEQ ID NO: 220654 - RNA, 22 nt, Human
agcagauuguacagugcauuag

SEQ ID NO: 220655 - RNA, 22 nt, Human
agcacagugccugacauauaug

SEQ ID NO: 220656 - RNA, 22 nt, Human
agcaauucugaaauuacuugac

SEQ ID NO: 220657 - RNA, 22 nt, Human
agcaauucagagcauggacuuu

SEQ ID NO: 220658 - RNA, 22 nt, Human
agcagagggucaguuuuuuagu

SEQ ID NO: 220659 - RNA, 22 nt, Human
agcagcaaugacaauucaacca

SEQ ID NO: 220660 - RNA, 22 nt, Human
agcacuugggugauaguacuuu

SEQ ID NO: 220661 - RNA, 22 nt, Human
agcacuuuagaauuuagaguug

SEQ ID NO: 220662 - RNA, 22 nt, Human
agcaggaaggcuagaagcagga

SEQ ID NO: 220663 - RNA, 22 nt, Human
agcauaacaaagggcauaauug

SEQ ID NO: 220664 - RNA, 22 nt, Human
agcaggagagacuggcccaaaa

SEQ ID NO: 220665 - RNA, 20 nt, Human
agcauucaacuuucuauguu

SEQ ID NO: 220666 - RNA, 22 nt, Human
agcaggauggaguaacgugaaa

SEQ ID NO: 220667 - RNA, 22 nt, Human
agcagccgccgccgccgcgcac

SEQ ID NO: 220668 - RNA, 22 nt, Human
agcaguuuauccucauaaugga

SEQ ID NO: 220669 - RNA, 22 nt, Human
agcagcugagccccagcuguga

SEQ ID NO: 220670 - RNA, 22 nt, Human
agcagcaggugaccucgaugcc

SEQ ID NO: 220671 - RNA, 19 nt, Human
agcagccaucgaccaugga

SEQ ID NO: 220672 - RNA, 22 nt, Human
gaggggaaggauuucuucagaa

SEQ ID NO: 220673 - RNA, 22 nt, Human
gaggggaaggagcgaaggcggg

SEQ ID NO: 220674 - RNA, 22 nt, Human
gaauguuaaugcacuucuagcu

SEQ ID NO: 220675 - RNA, 22 nt, Human
gagggaaaggggccaugauugg

SEQ ID NO: 220676 - RNA, 22 nt, Human
gagggagagaugcuggaccggg

SEQ ID NO: 220677 - RNA, 22 nt, Human
gagggaggugacaaggacauag

SEQ ID NO: 220678 - RNA, 22 nt, Human
gagggauuuuagugcagcaacu

SEQ ID NO: 220679 - RNA, 22 nt, Human
gagggcauugucuucuuaguuu

SEQ ID NO: 220680 - RNA, 22 nt, Human
gaauggcagaaugaagcagugu

SEQ ID NO: 220681 - RNA, 22 nt, Human
gaggggcggggcgggaggagag

SEQ ID NO: 220682 - RNA, 22 nt, Human
gaggggcuccagguguugagga

SEQ ID NO: 220683 - RNA, 19 nt, Human
gaauugcacgagcagaggc

SEQ ID NO: 220684 - RNA, 18 nt, Human
gacaaaaguacagacaga

SEQ ID NO: 220685 - RNA, 22 nt, Human
gaggggcaagaaguuggccucu

SEQ ID NO: 220686 - RNA, 22 nt, Human
gaggggaauguuccugagcugg

SEQ ID NO: 220687 - RNA, 22 nt, Human
gaggggcgaggacgcugaagua

SEQ ID NO: 220688 - RNA, 20 nt, Human
gaauucugaagauaauuugg

SEQ ID NO: 220689 - RNA, 22 nt, Human
gaggggcacaguggggccuggg

SEQ ID NO: 220690 - RNA, 22 nt, Human
gaauuagguaauagaacuagua

SEQ ID NO: 220691 - RNA, 22 nt, Human
gaggaugacaaagaaggcagac

SEQ ID NO: 220692 - RNA, 22 nt, Human
gaagucagaucuuuugacuccc

SEQ ID NO: 220693 - RNA, 22 nt, Human
gaaguggggaggagaagacuga

SEQ ID NO: 220694 - RNA, 22 nt, Human
gaagucugacucuuuguaagcu

SEQ ID NO: 220695 - RNA, 22 nt, Human
gaauaccauuuacauuugaaaa

SEQ ID NO: 220696 - RNA, 22 nt, Human
gaauagauuagaaagaguaugu

SEQ ID NO: 220697 - RNA, 22 nt, Human
gaauaauuuugaucagaaggga

SEQ ID NO: 220698 - RNA, 22 nt, Human
gaggcagaggaaacagcucauu

SEQ ID NO: 220699 - RNA, 22 nt, Human
gaggcagaggaugggacuguau

SEQ ID NO: 220700 - RNA, 22 nt, Human
gaggauuugagggucacuccac

SEQ ID NO: 220701 - RNA, 22 nt, Human
gaauauuuaucucagcugcaga

SEQ ID NO: 220702 - RNA, 22 nt, Human
gaggcuccgccggggcgggccg

SEQ ID NO: 220703 - RNA, 22 nt, Human
gaggcuaugucuacgcucagcg

SEQ ID NO: 220704 - RNA, 22 nt, Human
gaauggaacauagcaacaucuu

SEQ ID NO: 220705 - RNA, 22 nt, Human
gaggcauaaguagaagagauug

SEQ ID NO: 220706 - RNA, 20 nt, Human
gaaucuggucaaaugucuau

SEQ ID NO: 220707 - RNA, 22 nt, Human
gaaucucuuugucccugaguuu

SEQ ID NO: 220708 - RNA, 22 nt, Human
gaaguaaugugauugcucaggg

SEQ ID NO: 220709 - RNA, 22 nt, Human
gaaguaaaacaguaacuuuguu

SEQ ID NO: 220710 - RNA, 22 nt, Human
gaggagcuucagaggaaucuua

SEQ ID NO: 220711 - RNA, 22 nt, Human
gaaggugcugaaacagaaauuu

SEQ ID NO: 220712 - RNA, 22 nt, Human
gaaggggccuggggcaaggcua

SEQ ID NO: 220713 - RNA, 22 nt, Human
gaagguuuuguuugcaaaucau

SEQ ID NO: 220714 - RNA, 22 nt, Human
gaagguuuacugaagauuuaaa

SEQ ID NO: 220715 - RNA, 22 nt, Human
gaaggggacuccauggaaugau

SEQ ID NO: 220716 - RNA, 22 nt, Human
gaggagcugggucagggagaca

SEQ ID NO: 220717 - RNA, 22 nt, Human
gaagggccaggggcaggcugga

SEQ ID NO: 220718 - RNA, 22 nt, Human
gaaggcuguggcuggucucagu

SEQ ID NO: 220719 - RNA, 22 nt, Human
gaggaagucuuaucuggaugca

SEQ ID NO: 220720 - RNA, 22 nt, Human
gaggacccuuaggucagacaga

SEQ ID NO: 220721 - RNA, 22 nt, Human
gaggagagcuggccagguuucu

SEQ ID NO: 220722 - RNA, 22 nt, Human
gaggacuucaggccuggccagg

SEQ ID NO: 220723 - RNA, 22 nt, Human
gagcuuuguuccgugguggcac

SEQ ID NO: 220724 - RNA, 22 nt, Human
gagcuuuagcugagaccugcuu

SEQ ID NO: 220725 - RNA, 22 nt, Human
gagcuggacauacaggaaacca

SEQ ID NO: 220726 - RNA, 22 nt, Human
gaaggagaggauugugaggcug

SEQ ID NO: 220727 - RNA, 22 nt, Human
gaaggcaguaaauggcuguuuu

SEQ ID NO: 220728 - RNA, 22 nt, Human
gaaggauaauuuugcuggaugu

SEQ ID NO: 220729 - RNA, 22 nt, Human
gaaggaagcugucuggaugugu

SEQ ID NO: 220730 - RNA, 22 nt, Human
gaagcucaguugcuuagaucuc

SEQ ID NO: 220731 - RNA, 22 nt, Human
gaagcuccaggaugccugcacu

SEQ ID NO: 220732 - RNA, 21 nt, Human
gaagcugcuaugaagggggac

SEQ ID NO: 220733 - RNA, 22 nt, Human
gagcuaauagacagcaacauca

SEQ ID NO: 220734 - RNA, 22 nt, Human
gagacugugucugucaagcuag

SEQ ID NO: 220735 - RNA, 22 nt, Human
gagcgacucuuuuaguccagag

SEQ ID NO: 220736 - RNA, 22 nt, Human
gagcgcgcaaucucuccagcug

SEQ ID NO: 220737 - RNA, 22 nt, Human
gaagcggguucacuggauggcu

SEQ ID NO: 220738 - RNA, 22 nt, Human
gaagcgucaugaaagaaaggcu

SEQ ID NO: 220739 - RNA, 18 nt, Human
gaagcaacaguucugagu

SEQ ID NO: 220740 - RNA, 22 nt, Human
gaagcaagagggaucaggaucu

SEQ ID NO: 220741 - RNA, 22 nt, Human
gagccuaccugcugcucuuuca

SEQ ID NO: 220742 - RNA, 22 nt, Human
gaaaaucaggauggaugugagg

SEQ ID NO: 220743 - RNA, 22 nt, Human
gagagaggggaagagaagcucu

SEQ ID NO: 220744 - RNA, 22 nt, Human
gaagauucugacccugacucag

SEQ ID NO: 220745 - RNA, 22 nt, Human
gaaacauuuguugaguacuugc

SEQ ID NO: 220746 - RNA, 21 nt, Human
gaaaaucuaaugugacaaugc

SEQ ID NO: 220747 - RNA, 22 nt, Human
gagaaugagucagagcuggcug

SEQ ID NO: 220748 - RNA, 22 nt, Human
gagaaggagcagaaaaucuccu

SEQ ID NO: 220749 - RNA, 22 nt, Human
gagaagguggaccugaaggagc

SEQ ID NO: 220750 - RNA, 22 nt, Human
gagaaaacauacuuaguguccu

SEQ ID NO: 220751 - RNA, 22 nt, Human
gagaaagggagaaaaagaucuu

SEQ ID NO: 220752 - RNA, 22 nt, Human
gauacuuuguggaauccuggau

SEQ ID NO: 220753 - RNA, 22 nt, Human
gauagaaagagaaucagaacuu

SEQ ID NO: 220754 - RNA, 22 nt, Human
gacugacagugguacuguaauu

SEQ ID NO: 220755 - RNA, 23 nt, Human
gacuucacacucucaaccacugc

SEQ ID NO: 220756 - RNA, 22 nt, Human
gacuugauugguuugucaaguu

SEQ ID NO: 220757 - RNA, 22 nt, Human
gauaccugccaagcugcacuca

SEQ ID NO: 220758 - RNA, 22 nt, Human
gauaaugcuuuggucagacaug

SEQ ID NO: 220759 - RNA, 22 nt, Human
gaguuucacguagaucaggguc

SEQ ID NO: 220760 - RNA, 22 nt, Human
gacuuaaaugcuccccucaggg

SEQ ID NO: 220761 - RNA, 22 nt, Human
gaguguuugcuguauaauugga

SEQ ID NO: 220762 - RNA, 22 nt, Human
gaguggugagaauacaacggaa

SEQ ID NO: 220763 - RNA, 20 nt, Human
gagugucacacacaaccccu

SEQ ID NO: 220764 - RNA, 22 nt, Human
gagugggugaaugugcucauaa

SEQ ID NO: 220765 - RNA, 19 nt, Human
gacuccugagaugugaaac

SEQ ID NO: 220766 - RNA, 22 nt, Human
gacuggaaucucugcuuguuaa

SEQ ID NO: 220767 - RNA, 22 nt, Human
gacuggggcauuagaguagcuu

SEQ ID NO: 220768 - RNA, 22 nt, Human
gacuggucuuuugugauggaug

SEQ ID NO: 220769 - RNA, 22 nt, Human
gaguugauggccauugaguuga

SEQ ID NO: 220770 - RNA, 22 nt, Human
gacucuucucucccaaaugccc

SEQ ID NO: 220771 - RNA, 22 nt, Human
gaguuggggcugcguguuucca

SEQ ID NO: 220772 - RNA, 22 nt, Human
gaguggucacuaauuuccuuaa

SEQ ID NO: 220773 - RNA, 22 nt, Human
gaguaaaagaugaggcaguaga

SEQ ID NO: 220774 - RNA, 22 nt, Human
gaccacugaaugcacuucuaau

SEQ ID NO: 220775 - RNA, 22 nt, Human
gaguaauuuucuuaaaacauca

SEQ ID NO: 220776 - RNA, 22 nt, Human
gacauugaauugaauccagauu

SEQ ID NO: 220777 - RNA, 22 nt, Human
gaguauuagaagaguaguuauu

SEQ ID NO: 220778 - RNA, 22 nt, Human
gaguaucagauuggaguccuca

SEQ ID NO: 220779 - RNA, 19 nt, Human
gaguacuuuacaaguuuuc

SEQ ID NO: 220780 - RNA, 22 nt, Human
gacggggcagccagcugguggc

SEQ ID NO: 220781 - RNA, 22 nt, Human
gacgacgggccccguggccacc

SEQ ID NO: 220782 - RNA, 22 nt, Human
gagugaucuguaggcagcaugg

SEQ ID NO: 220783 - RNA, 22 nt, Human
gaguggcaaagagaacaaagau

SEQ ID NO: 220784 - RNA, 22 nt, Human
gagucaauucaccuuggugcuu

SEQ ID NO: 220785 - RNA, 22 nt, Human
gagucaucucuagaaugaugau

SEQ ID NO: 220786 - RNA, 22 nt, Human
gagucaggucaggcuuguagau

SEQ ID NO: 220787 - RNA, 22 nt, Human
gaccugguggccauugucccag

SEQ ID NO: 220788 - RNA, 22 nt, Human
gaggugaacccaggugcuucac

SEQ ID NO: 220789 - RNA, 22 nt, Human
gaggucuugagugacuuagcag

SEQ ID NO: 220790 - RNA, 22 nt, Human
gacagaccucugcugacuggag

SEQ ID NO: 220791 - RNA, 22 nt, Human
gacagcguguuuugcaugaaca

SEQ ID NO: 220792 - RNA, 22 nt, Human
gacaggcagagaggaagagaga

SEQ ID NO: 220793 - RNA, 22 nt, Human
gacaggaauuaucuaaaguaga

SEQ ID NO: 220794 - RNA, 22 nt, Human
gacagcguaucaauugaacaua

SEQ ID NO: 220795 - RNA, 22 nt, Human
gagguuauucuucuaucaguau

SEQ ID NO: 220796 - RNA, 22 nt, Human
gacacaacuucccucccacauu

SEQ ID NO: 220797 - RNA, 22 nt, Human
gagggggcaggcucggcaccgg

SEQ ID NO: 220798 - RNA, 22 nt, Human
gaggguggggaauagacugcua

SEQ ID NO: 220799 - RNA, 22 nt, Human
gagggugugguauggauguguu

SEQ ID NO: 220800 - RNA, 22 nt, Human
gaggucaugcagcucugaguuc

SEQ ID NO: 220801 - RNA, 22 nt, Human
gaauaagaauccacuucuggca

SEQ ID NO: 220802 - RNA, 22 nt, Human
gaaguucuuagucucauuugca

SEQ ID NO: 220803 - RNA, 22 nt, Human
cuucuuuuggggaugaaaaugg

SEQ ID NO: 220804 - RNA, 22 nt, Human
cuugcaaugaaggcacacuuau

SEQ ID NO: 220805 - RNA, 22 nt, Human
cuucucugcugccugccucuuu

SEQ ID NO: 220806 - RNA, 22 nt, Human
gaaguauuucugaguugcccag

SEQ ID NO: 220807 - RNA, 22 nt, Human
cuucucuuggguguggugucuu

SEQ ID NO: 220808 - RNA, 22 nt, Human
gaaggcugaauuauuuguuccu

SEQ ID NO: 220809 - RNA, 23 nt, Human
cuucggcgcucgcugggcggagg

SEQ ID NO: 220810 - RNA, 22 nt, Human
gaagaugcugcuuguucacggg

SEQ ID NO: 220811 - RNA, 22 nt, Human
cuuauuagaaagaaaagacaug

SEQ ID NO: 220812 - RNA, 18 nt, Human
cuuuagcugucaucuuug

SEQ ID NO: 220813 - RNA, 23 nt, Human
cuugugacagcaauuauagcaag

SEQ ID NO: 220814 - RNA, 22 nt, Human
gacaacuucaguaaaguagauu

SEQ ID NO: 220815 - RNA, 22 nt, Human
gacaagaugacaucauggcuuc

SEQ ID NO: 220816 - RNA, 22 nt, Human
cuugguuugaaacauacucuac

SEQ ID NO: 220817 - RNA, 22 nt, Human
cuuucauuuuugggcaucugag

SEQ ID NO: 220818 - RNA, 22 nt, Human
gacacaacuauccaguauggga

SEQ ID NO: 220819 - RNA, 22 nt, Human
gacaauuucucaauauagaaac

SEQ ID NO: 220820 - RNA, 22 nt, Human
gacaccuucuacugacuaugga

SEQ ID NO: 220821 - RNA, 22 nt, Human
gaauuacagaguuguuaaguca

SEQ ID NO: 220822 - RNA, 22 nt, Human
gaaugggaauuauggugggacu

SEQ ID NO: 220823 - RNA, 22 nt, Human
gaauuacuccaguguguggguu

SEQ ID NO: 220824 - RNA, 22 nt, Human
gaauuagacggcaucacauggg

SEQ ID NO: 220825 - RNA, 22 nt, Human
cuuggcuccuucacagggagau

SEQ ID NO: 220826 - RNA, 22 nt, Human
cuuggggcuugcuguuguagcc

SEQ ID NO: 220827 - RNA, 22 nt, Human
cuuggggauuuuaaagaccucu

SEQ ID NO: 220828 - RNA, 22 nt, Human
cuugccagggacucagucaggg

SEQ ID NO: 220829 - RNA, 22 nt, Human
cuugccaguguugcagaagcuc

SEQ ID NO: 220830 - RNA, 22 nt, Human
gagacucagccccugcucucaa

SEQ ID NO: 220831 - RNA, 22 nt, Human
gagagaaggaagugaauuuccc

SEQ ID NO: 220832 - RNA, 20 nt, Human
gagaauuccagguuucugug

SEQ ID NO: 220833 - RNA, 22 nt, Human
gaaaacccuguauguagcguuu

SEQ ID NO: 220834 - RNA, 22 nt, Human
gaaaaauggguuguuugaagau

SEQ ID NO: 220835 - RNA, 22 nt, Human
gagaaagauuguccuucagggg

SEQ ID NO: 220836 - RNA, 16 nt, Human
gacuuucuacgacucu

SEQ ID NO: 220837 - RNA, 22 nt, Human
gagaaauagauucaugguagau

SEQ ID NO: 220838 - RNA, 22 nt, Human
gagaacagauaugaugacuuca

SEQ ID NO: 220839 - RNA, 22 nt, Human
cuuuuugcccuugggcuuccug

SEQ ID NO: 220840 - RNA, 22 nt, Human
gacuucaagaugaaucuuuggg

SEQ ID NO: 220841 - RNA, 22 nt, Human
gagaaaaauuucuuugcugcac

SEQ ID NO: 220842 - RNA, 22 nt, Human
gacuugcucaaaucagauuuua

SEQ ID NO: 220843 - RNA, 22 nt, Human
cuuuuggcaucagccucaggaa

SEQ ID NO: 220844 - RNA, 22 nt, Human
gacuuaaccacggucacauggu

SEQ ID NO: 220845 - RNA, 22 nt, Human
gacuguuggcagauguuugagu

SEQ ID NO: 220846 - RNA, 22 nt, Human
cuuugcaaagagagaaaguggg

SEQ ID NO: 220847 - RNA, 22 nt, Human
gacagugucccucuggggugga

SEQ ID NO: 220848 - RNA, 21 nt, Human
cuuugccuccagcagccgcag

SEQ ID NO: 220849 - RNA, 22 nt, Human
cuuuggacaacugagugacguu

SEQ ID NO: 220850 - RNA, 21 nt, Human
cuuuggcaagggagaagucac

SEQ ID NO: 220851 - RNA, 22 nt, Human
cuuuguaaucaauaagucuuuu

SEQ ID NO: 220852 - RNA, 22 nt, Human
gaccugcucagcccuguguguu

SEQ ID NO: 220853 - RNA, 22 nt, Human
gaccgggcucugcugacggucu

SEQ ID NO: 220854 - RNA, 22 nt, Human
gacacugccaagugccccgaga

SEQ ID NO: 220855 - RNA, 22 nt, Human
gacagcaggaugugaggggaug

SEQ ID NO: 220856 - RNA, 22 nt, Human
cuuucuuucaaguucugcuuua

SEQ ID NO: 220857 - RNA, 22 nt, Human
gacagggacacagccagugagg

SEQ ID NO: 220858 - RNA, 22 nt, Human
gacaggaccgagguggggcggg

SEQ ID NO: 220859 - RNA, 22 nt, Human
gacagguagacaugaauauuaa

SEQ ID NO: 220860 - RNA, 22 nt, Human
cuuucuuuuugguuucccccca

SEQ ID NO: 220861 - RNA, 20 nt, Human
cuuauuuuggagaacuuuuc

SEQ ID NO: 220862 - RNA, 20 nt, Human
cuuaugcaaaauguuaggga

SEQ ID NO: 220863 - RNA, 22 nt, Human
cugaucccuuuucauuugcagg

SEQ ID NO: 220864 - RNA, 22 nt, Human
cugaugcucuggauguagucaa

SEQ ID NO: 220865 - RNA, 22 nt, Human
cugaucuuaaguaacauuauuu

SEQ ID NO: 220866 - RNA, 22 nt, Human
cuucagagugacucagcaucuu

SEQ ID NO: 220867 - RNA, 22 nt, Human
cugauccuauauugguaugagg

SEQ ID NO: 220868 - RNA, 22 nt, Human
cuggagcucugggcaucucagg

SEQ ID NO: 220869 - RNA, 22 nt, Human
cuggagaucaguuggacaacag

SEQ ID NO: 220870 - RNA, 22 nt, Human
cuggagucagcaaggacgaggc

SEQ ID NO: 220871 - RNA, 22 nt, Human
cuggcgauugcgagagucgccu

SEQ ID NO: 220872 - RNA, 22 nt, Human
cuggcuaaugugcugauagcca

SEQ ID NO: 220873 - RNA, 22 nt, Human
cuggcggugaucccgauggugu

SEQ ID NO: 220874 - RNA, 22 nt, Human
cuuuucuuuucuucucuuccca

SEQ ID NO: 220875 - RNA, 21 nt, Human
cuggcucgccaugguucuuuu

SEQ ID NO: 220876 - RNA, 22 nt, Human
cugggaaggaagggaaaaacag

SEQ ID NO: 220877 - RNA, 22 nt, Human
cuggcuuucauggcgcaguuga

SEQ ID NO: 220878 - RNA, 22 nt, Human
cuggcgagcugggccuggggga

SEQ ID NO: 220879 - RNA, 22 nt, Human
cuuuuaccuuaauuucgacaca

SEQ ID NO: 220880 - RNA, 22 nt, Human
cuuuucaaacaggacagguccu

SEQ ID NO: 220881 - RNA, 22 nt, Human
cuuuucauuucauggaauacaa

SEQ ID NO: 220882 - RNA, 22 nt, Human
gaaaaagagaaggaguucagua

SEQ ID NO: 220883 - RNA, 22 nt, Human
gaaaaacucagugggggucuuu

SEQ ID NO: 220884 - RNA, 22 nt, Human
gaaaaaccacaauugguauuuu

SEQ ID NO: 220885 - RNA, 22 nt, Human
cugggugagcuggccagagggu

SEQ ID NO: 220886 - RNA, 22 nt, Human
cugggugugugugaacagagau

SEQ ID NO: 220887 - RNA, 22 nt, Human
cuuuuuuucuccauauuucugg

SEQ ID NO: 220888 - RNA, 22 nt, Human
cugggaguugacgaggcuugua

SEQ ID NO: 220889 - RNA, 22 nt, Human
cugggguaucugccacaacucu

SEQ ID NO: 220890 - RNA, 22 nt, Human
cuuuuugccuugaagugaccuc

SEQ ID NO: 220891 - RNA, 22 nt, Human
cuuuuucuugugguuaauaucu

SEQ ID NO: 220892 - RNA, 22 nt, Human
cuuuuucuuaucuuuuucuaug

SEQ ID NO: 220893 - RNA, 22 nt, Human
cuuuuucaugggugaugagugg

SEQ ID NO: 220894 - RNA, 22 nt, Human
cuuuuuaaaguaaauggcuaga

SEQ ID NO: 220895 - RNA, 19 nt, Human
cugggacaaugaaagcauc

SEQ ID NO: 220896 - RNA, 22 nt, Human
cugggacccagcccaagucuuu

SEQ ID NO: 220897 - RNA, 22 nt, Human
cugggagaugacucagagcagg

SEQ ID NO: 220898 - RNA, 22 nt, Human
cugggaggagacaggggauggg

SEQ ID NO: 220899 - RNA, 22 nt, Human
cuuuugcaauagugacacugau

SEQ ID NO: 220900 - RNA, 22 nt, Human
gaacauuucugcagaugucuga

SEQ ID NO: 220901 - RNA, 22 nt, Human
gaacaugaguuuuaugguauuu

SEQ ID NO: 220902 - RNA, 22 nt, Human
gaaccauuuaauggagaugcuc

SEQ ID NO: 220903 - RNA, 22 nt, Human
gaacugaauguguaauguuggc

SEQ ID NO: 220904 - RNA, 22 nt, Human
gaagaggaagaggagccagagc

SEQ ID NO: 220905 - RNA, 22 nt, Human
gaagaagagauaauggggagca

SEQ ID NO: 220906 - RNA, 22 nt, Human
gaagaaggaagaucaugcuuga

SEQ ID NO: 220907 - RNA, 22 nt, Human
gaacuugagugugcuauuucuu

SEQ ID NO: 220908 - RNA, 19 nt, Human
gaacuaaggggagcucugg

SEQ ID NO: 220909 - RNA, 22 nt, Human
cuguggcugcgcccugggggag

SEQ ID NO: 220910 - RNA, 22 nt, Human
gaaagagaugucguuugucuuc

SEQ ID NO: 220911 - RNA, 22 nt, Human
cugugguuuuauuuauuugaag

SEQ ID NO: 220912 - RNA, 22 nt, Human
cugugggcucucaugggaccug

SEQ ID NO: 220913 - RNA, 22 nt, Human
gaaaugaaacacacaugcagcu

SEQ ID NO: 220914 - RNA, 22 nt, Human
gaaaucuggugauuuucuguug

SEQ ID NO: 220915 - RNA, 22 nt, Human
cugugaaugguggccacgcguu

SEQ ID NO: 220916 - RNA, 22 nt, Human
gaaaccauggcaaccagguccu

SEQ ID NO: 220917 - RNA, 22 nt, Human
cuguccugauggugccacuggu

SEQ ID NO: 220918 - RNA, 22 nt, Human
gaaaaugcacacauacacaccc

SEQ ID NO: 220919 - RNA, 22 nt, Human
cuguauggaggaggugcuagcc

SEQ ID NO: 220920 - RNA, 22 nt, Human
cuguagaugucagguuaaugag

SEQ ID NO: 220921 - RNA, 22 nt, Human
cugucucugauaagcucgaggg

SEQ ID NO: 220922 - RNA, 22 nt, Human
gaaaauaguucaucacaaugau

SEQ ID NO: 220923 - RNA, 22 nt, Human
cugguuuuccaauguuuugacu

SEQ ID NO: 220924 - RNA, 22 nt, Human
gaaaaucaugaaaguguguugu

SEQ ID NO: 220925 - RNA, 22 nt, Human
gaaaagaaggcaggagcccaag

SEQ ID NO: 220926 - RNA, 22 nt, Human
gaaaagaaaggaugguaugugu

SEQ ID NO: 220927 - RNA, 20 nt, Human
cuggugccuucugcgauuua

SEQ ID NO: 220928 - RNA, 22 nt, Human
cugguuuauuucauaguuuguu

SEQ ID NO: 220929 - RNA, 22 nt, Human
cugguuacuucagaucaguagu

SEQ ID NO: 220930 - RNA, 22 nt, Human
cuggugggucacgugugggugg

SEQ ID NO: 220931 - RNA, 22 nt, Human
cugcgcgagcacugccggcggg

SEQ ID NO: 220932 - RNA, 22 nt, Human
cugcgcagaucugcuguucucu

SEQ ID NO: 220933 - RNA, 22 nt, Human
cugccuucaaaguaauauuuua

SEQ ID NO: 220934 - RNA, 22 nt, Human
cuacuguaguuaaaguuuugua

SEQ ID NO: 220935 - RNA, 22 nt, Human
cugccggcugcugcagagaggu

SEQ ID NO: 220936 - RNA, 22 nt, Human
cuaauuguaagcuccuugaggg

SEQ ID NO: 220937 - RNA, 22 nt, Human
cuaaugaaaugauggcuccuac

SEQ ID NO: 220938 - RNA, 22 nt, Human
cuaacuuugucuugguaauugc

SEQ ID NO: 220939 - RNA, 22 nt, Human
cuaaauuuuuuagugaaauagg

SEQ ID NO: 220940 - RNA, 22 nt, Human
cuaccagcacgccuuccucuac

SEQ ID NO: 220941 - RNA, 22 nt, Human
cuacugaagcaugcuuauaugu

SEQ ID NO: 220942 - RNA, 22 nt, Human
cugccaggagaggccagggccc

SEQ ID NO: 220943 - RNA, 22 nt, Human
cuacugacugaccauaguuuca

SEQ ID NO: 220944 - RNA, 22 nt, Human
cugcccgcaugcaggaaugcug

SEQ ID NO: 220945 - RNA, 22 nt, Human
cugcuguuuucugggcuucuua

SEQ ID NO: 220946 - RNA, 22 nt, Human
cugcuguuuuccccaccaucuc

SEQ ID NO: 220947 - RNA, 22 nt, Human
cugcugucuuuauuucacugcu

SEQ ID NO: 220948 - RNA, 22 nt, Human
cugcugugcagacagacucucu

SEQ ID NO: 220949 - RNA, 22 nt, Human
cuauguuuugcuagugaugggu

SEQ ID NO: 220950 - RNA, 22 nt, Human
cuauauucuggaauguccauuu

SEQ ID NO: 220951 - RNA, 22 nt, Human
cuaugguaguggcacaggagga

SEQ ID NO: 220952 - RNA, 21 nt, Human
cuauaaaaaugguucuuugcg

SEQ ID NO: 220953 - RNA, 22 nt, Human
cugcugcuugauugcaggaagu

SEQ ID NO: 220954 - RNA, 22 nt, Human
cuaggcuuucugugugacuaga

SEQ ID NO: 220955 - RNA, 22 nt, Human
cugcuacgguguccgguggggc

SEQ ID NO: 220956 - RNA, 22 nt, Human
cuaggucagaggacacagcuua

SEQ ID NO: 220957 - RNA, 22 nt, Human
cuaguauuaagugugaguaaaa

SEQ ID NO: 220958 - RNA, 22 nt, Human
cugcgguucuguuuaguggcga

SEQ ID NO: 220959 - RNA, 22 nt, Human
cuagcaggacucagcagauauu

SEQ ID NO: 220960 - RNA, 22 nt, Human
cuaguucugccauucaguguca

SEQ ID NO: 220961 - RNA, 22 nt, Human
cuaguuuucacaaaggaagggc

SEQ ID NO: 220962 - RNA, 21 nt, Human
cugcugaaggaaccccaugga

SEQ ID NO: 220963 - RNA, 22 nt, Human
cugagcuuuucucugcuucuua

SEQ ID NO: 220964 - RNA, 23 nt, Human
cugagggcuggucugaagucugc

SEQ ID NO: 220965 - RNA, 22 nt, Human
cgucauacagaugaacaaucuc

SEQ ID NO: 220966 - RNA, 22 nt, Human
cugagcugcucccgcugcagcg

SEQ ID NO: 220967 - RNA, 22 nt, Human
cgucagccacagcugccccggg

SEQ ID NO: 220968 - RNA, 22 nt, Human
cgguuuuuaaaagucucuucua

SEQ ID NO: 220969 - RNA, 22 nt, Human
cgugccugguggagagcgaggg

SEQ ID NO: 220970 - RNA, 22 nt, Human
cguggaggucgcauauuccucu

SEQ ID NO: 220971 - RNA, 22 nt, Human
cgugaagaaguaauagguggug

SEQ ID NO: 220972 - RNA, 22 nt, Human
cugagggagcugcuggccuugg

SEQ ID NO: 220973 - RNA, 21 nt, Human
cugauguaccucaagccuagu

SEQ ID NO: 220974 - RNA, 22 nt, Human
cuaaacuucauauguugcuuua

SEQ ID NO: 220975 - RNA, 20 nt, Human
cuaaaacaggugucuaguga

SEQ ID NO: 220976 - RNA, 16 nt, Human
cuaaaaugucuacuug

SEQ ID NO: 220977 - RNA, 22 nt, Human
cugccacuaccaugcuggauga

SEQ ID NO: 220978 - RNA, 22 nt, Human
cguuugagggaguuggaacugc

SEQ ID NO: 220979 - RNA, 22 nt, Human
cugcaguaacuauuuucaauaa

SEQ ID NO: 220980 - RNA, 22 nt, Human
cugauguuuaucucaagaguuc

SEQ ID NO: 220981 - RNA, 22 nt, Human
cugcagagaccuaggucagguu

SEQ ID NO: 220982 - RNA, 22 nt, Human
cugauuucaaauggugcuagau

SEQ ID NO: 220983 - RNA, 22 nt, Human
cguugguggguguguggucgga

SEQ ID NO: 220984 - RNA, 17 nt, Human
cguuccagaacaaauga

SEQ ID NO: 220985 - RNA, 22 nt, Human
cgugugcguauguguuuguaug

SEQ ID NO: 220986 - RNA, 22 nt, Human
cgugugugugcgugugcgugug

SEQ ID NO: 220987 - RNA, 22 nt, Human
cugagaucaugggucagguggu

SEQ ID NO: 220988 - RNA, 22 nt, Human
cugagcaucaaaugggcaauua

SEQ ID NO: 220989 - RNA, 20 nt, Human
cuguuugcuaucaugagcug

SEQ ID NO: 220990 - RNA, 22 nt, Human
cuguuucuuugcugucagagag

SEQ ID NO: 220991 - RNA, 22 nt, Human
cugagggagacagugcggacua

SEQ ID NO: 220992 - RNA, 22 nt, Human
cuguuguguuauuugcagugca

SEQ ID NO: 220993 - RNA, 20 nt, Human
cuguucucuugccacaugag

SEQ ID NO: 220994 - RNA, 22 nt, Human
cuguuguucacuuugcugguga

SEQ ID NO: 220995 - RNA, 22 nt, Human
cugaagaaagaaaauggccauc

SEQ ID NO: 220996 - RNA, 22 nt, Human
cugaaagacgaggggaagucgg

SEQ ID NO: 220997 - RNA, 22 nt, Human
cugaaagcaaaguaauucuuaa

SEQ ID NO: 220998 - RNA, 20 nt, Human
cugaaaggaaagaaauuuuu

SEQ ID NO: 220999 - RNA, 22 nt, Human
cugaaagacagccaggcaaagc

SEQ ID NO: 221000 - RNA, 22 nt, Human
cuguucagugcauauguauuga

SEQ ID NO: 221001 - RNA, 22 nt, Human
cucuuuuuuugucuuaagaacc

SEQ ID NO: 221002 - RNA, 22 nt, Human
cugugccagucagggggcaagu

SEQ ID NO: 221003 - RNA, 22 nt, Human
cugugcauguucucuagcugau

SEQ ID NO: 221004 - RNA, 20 nt, Human
cucuuucugcuuuaugccuc

SEQ ID NO: 221005 - RNA, 22 nt, Human
cugaaacucaagauaggaggaa

SEQ ID NO: 221006 - RNA, 22 nt, Human
cuguguuguuugaguagcuuga

SEQ ID NO: 221007 - RNA, 22 nt, Human
cuggugagaccgacuuccacuu

SEQ ID NO: 221008 - RNA, 22 nt, Human
cuggugaagccuucggagaccc

SEQ ID NO: 221009 - RNA, 22 nt, Human
cuggugcuguagccugauugag

SEQ ID NO: 221010 - RNA, 22 nt, Human
cugguacuggaggaguucagag

SEQ ID NO: 221011 - RNA, 22 nt, Human
cuguccauuuucgugccuccuu

SEQ ID NO: 221012 - RNA, 22 nt, Human
cugucagcaaaucagugucugg

SEQ ID NO: 221013 - RNA, 22 nt, Human
cuccgaaaugcaucccagggca

SEQ ID NO: 221014 - RNA, 22 nt, Human
cuggcuguguguuugugcaucu

SEQ ID NO: 221015 - RNA, 22 nt, Human
cuccacagccccuccaguggca

SEQ ID NO: 221016 - RNA, 22 nt, Human
cuggcggcccgaggcagaggag

SEQ ID NO: 221017 - RNA, 22 nt, Human
cuccaaaucugauugcuaccuu

SEQ ID NO: 221018 - RNA, 22 nt, Human
cuggguguggugggugcugccg

SEQ ID NO: 221019 - RNA, 22 nt, Human
cuggguaaggaaacuccuuugu

SEQ ID NO: 221020 - RNA, 22 nt, Human
cuggguaaauauguauuccuga

SEQ ID NO: 221021 - RNA, 22 nt, Human
cugggugggcacccagccuggg

SEQ ID NO: 221022 - RNA, 22 nt, Human
cuggguuuggcugugcuugaau

SEQ ID NO: 221023 - RNA, 22 nt, Human
cuggucaauaaucauguaguac

SEQ ID NO: 221024 - RNA, 22 nt, Human
cugggaugagcuguuuccuggu

SEQ ID NO: 221025 - RNA, 22 nt, Human
cugggcuuucaggcccuaaggc

SEQ ID NO: 221026 - RNA, 22 nt, Human
cuccuuuuccuacucauacuau

SEQ ID NO: 221027 - RNA, 22 nt, Human
cugggcaugggaacuucaaggc

SEQ ID NO: 221028 - RNA, 22 nt, Human
cugggguggugcaggccucaug

SEQ ID NO: 221029 - RNA, 22 nt, Human
cugggguaucuggugucuuggu

SEQ ID NO: 221030 - RNA, 22 nt, Human
cucaagugacucagccugguug

SEQ ID NO: 221031 - RNA, 22 nt, Human
cucacgguuugcaucaagagug

SEQ ID NO: 221032 - RNA, 22 nt, Human
cugcuucacccugccugagaac

SEQ ID NO: 221033 - RNA, 22 nt, Human
cucaaauggguuuguagaauau

SEQ ID NO: 221034 - RNA, 22 nt, Human
cuauuuucccauaugguugaca

SEQ ID NO: 221035 - RNA, 22 nt, Human
cucaugagucugucagagucau

SEQ ID NO: 221036 - RNA, 22 nt, Human
cuggcagcucugagucccuucu

SEQ ID NO: 221037 - RNA, 22 nt, Human
cucaguauugacgaaagagauu

SEQ ID NO: 221038 - RNA, 22 nt, Human
cucagaugaugucuucagggaa

SEQ ID NO: 221039 - RNA, 22 nt, Human
cucagaagaacaaaggcucuac

SEQ ID NO: 221040 - RNA, 22 nt, Human
cucacugugggcuaugaauggg

SEQ ID NO: 221041 - RNA, 22 nt, Human
cucagaugcacacaggugaggg

SEQ ID NO: 221042 - RNA, 22 nt, Human
cucagcaauuaccugugucucu

SEQ ID NO: 221043 - RNA, 22 nt, Human
cucagcaacccacacacggucu

SEQ ID NO: 221044 - RNA, 22 nt, Human
cucagcgagggaaagaggccgc

SEQ ID NO: 221045 - RNA, 22 nt, Human
cgcgcuuugggcaguguggcug

SEQ ID NO: 221046 - RNA, 22 nt, Human
cgcgcgguguuccgcauucugc

SEQ ID NO: 221047 - RNA, 22 nt, Human
cucagcacauuccuaagggaug

SEQ ID NO: 221048 - RNA, 22 nt, Human
cucaaagcagacuuuucccuuu

SEQ ID NO: 221049 - RNA, 22 nt, Human
cucaaaauccauaaaaucaggu

SEQ ID NO: 221050 - RNA, 22 nt, Human
cgccgugucuggucuguacguc

SEQ ID NO: 221051 - RNA, 22 nt, Human
cucaaugagcuauuuguuucau

SEQ ID NO: 221052 - RNA, 22 nt, Human
cuaggaugcuguaauggugucu

SEQ ID NO: 221053 - RNA, 22 nt, Human
cgcaucggguagaggagcugga

SEQ ID NO: 221054 - RNA, 22 nt, Human
cgcauugcaauucaggggauaa

SEQ ID NO: 221055 - RNA, 22 nt, Human
cgcccggcugagacgcucgccc

SEQ ID NO: 221056 - RNA, 22 nt, Human
cuauguuucagauauauauaua

SEQ ID NO: 221057 - RNA, 22 nt, Human
cggagggcccucaggacugggu

SEQ ID NO: 221058 - RNA, 22 nt, Human
cucucuuuuuuucccuuguuaa

SEQ ID NO: 221059 - RNA, 22 nt, Human
cucugagcucgugcaguacuuc

SEQ ID NO: 221060 - RNA, 22 nt, Human
cucugauuuuucuaauacuuca

SEQ ID NO: 221061 - RNA, 22 nt, Human
cggagcauacugccuggagaug

SEQ ID NO: 221062 - RNA, 22 nt, Human
cggagcgagaaggggaaagccc

SEQ ID NO: 221063 - RNA, 22 nt, Human
cucuaagcuuugguguuucacu

SEQ ID NO: 221064 - RNA, 22 nt, Human
cucccugagaugcaggagagag

SEQ ID NO: 221065 - RNA, 22 nt, Human
cucccuucaggggaggacuagg

SEQ ID NO: 221066 - RNA, 22 nt, Human
cuccgcagcugggguuggcgcu

SEQ ID NO: 221067 - RNA, 22 nt, Human
cuccagcagaaagggcgagugg

SEQ ID NO: 221068 - RNA, 22 nt, Human
cuccagcucgcgagcucugcuc

SEQ ID NO: 221069 - RNA, 22 nt, Human
cuccagauuugggggauauacu

SEQ ID NO: 221070 - RNA, 20 nt, Human
cucauugcuuucauuuucuu

SEQ ID NO: 221071 - RNA, 22 nt, Human
cgcugcugucaucgucuacggu

SEQ ID NO: 221072 - RNA, 22 nt, Human
cgcugggugguugauguacagc

SEQ ID NO: 221073 - RNA, 22 nt, Human
cucauugacagagcagcucuac

SEQ ID NO: 221074 - RNA, 22 nt, Human
cucaucuucuuccuucuuuucc

SEQ ID NO: 221075 - RNA, 22 nt, Human
cucaucagagcccuccucuggc

SEQ ID NO: 221076 - RNA, 22 nt, Human
cgcuggagagcaagugcgugca

SEQ ID NO: 221077 - RNA, 22 nt, Human
cucaugaauggcucuuugugcu

SEQ ID NO: 221078 - RNA, 22 nt, Human
ccuuuuuagaugugcgaauguu

SEQ ID NO: 221079 - RNA, 22 nt, Human
cgugaucuguuauauagugagc

SEQ ID NO: 221080 - RNA, 22 nt, Human
ccuuuuguuucccuuuauguuc

SEQ ID NO: 221081 - RNA, 22 nt, Human
cgugaaaugcagaaaguugugg

SEQ ID NO: 221082 - RNA, 22 nt, Human
cgucuaaggaacuccauucaca

SEQ ID NO: 221083 - RNA, 17 nt, Human
cgugaggaccaggcagc

SEQ ID NO: 221084 - RNA, 22 nt, Human
cgugcuaccugagcugacagcu

SEQ ID NO: 221085 - RNA, 22 nt, Human
cguggcaguagagcuggaacuu

SEQ ID NO: 221086 - RNA, 22 nt, Human
ccuuuccuggaaaugguaaguu

SEQ ID NO: 221087 - RNA, 23 nt, Human
ccuuguguaucuccagccacucc

SEQ ID NO: 221088 - RNA, 22 nt, Human
ccuuucucuuggauaccgauug

SEQ ID NO: 221089 - RNA, 22 nt, Human
ccuuugcccugagaaauguucc

SEQ ID NO: 221090 - RNA, 21 nt, Human
ccuuugaguguguuugaagua

SEQ ID NO: 221091 - RNA, 22 nt, Human
cgucauuuguaaaugaucaaga

SEQ ID NO: 221092 - RNA, 22 nt, Human
ccuuucuggucucugagagacu

SEQ ID NO: 221093 - RNA, 22 nt, Human
cgggaggcggagcuccgcgggg

SEQ ID NO: 221094 - RNA, 22 nt, Human
cgggagcagcucuggggcuggg

SEQ ID NO: 221095 - RNA, 22 nt, Human
ccuggccacagggcucugcauu

SEQ ID NO: 221096 - RNA, 22 nt, Human
ccuugcuucuagcauucccaug

SEQ ID NO: 221097 - RNA, 22 nt, Human
ccuucugcuggucaucccagug

SEQ ID NO: 221098 - RNA, 22 nt, Human
cgcacaggcacagacacuggga

SEQ ID NO: 221099 - RNA, 22 nt, Human
cgcacacaaaugcauacgccag

SEQ ID NO: 221100 - RNA, 22 nt, Human
cgcacuggagcuggaacgaguc

SEQ ID NO: 221101 - RNA, 22 nt, Human
cgcacuugugagcgacagggcu

SEQ ID NO: 221102 - RNA, 22 nt, Human
cuacuuucuucuucagaauugu

SEQ ID NO: 221103 - RNA, 22 nt, Human
cuagaaaguaugcuuuuauaau

SEQ ID NO: 221104 - RNA, 22 nt, Human
cgauuccugauaagugaauaag

SEQ ID NO: 221105 - RNA, 22 nt, Human
cgaguaauuggaaauuugcuau

SEQ ID NO: 221106 - RNA, 22 nt, Human
cgagugauuauucuggcugaga

SEQ ID NO: 221107 - RNA, 22 nt, Human
cgagguuuaugaguuuguguuc

SEQ ID NO: 221108 - RNA, 22 nt, Human
cgagguacuuacccuggucugu

SEQ ID NO: 221109 - RNA, 22 nt, Human
cuacuucuguggcucuaagaga

SEQ ID NO: 221110 - RNA, 22 nt, Human
cgugucauggcggcgcaggugg

SEQ ID NO: 221111 - RNA, 22 nt, Human
cuaaaacuuuuccaaauuaugu

SEQ ID NO: 221112 - RNA, 22 nt, Human
cuaaacacuauucuggaaauag

SEQ ID NO: 221113 - RNA, 22 nt, Human
cuaaagacagcaagacaucauc

SEQ ID NO: 221114 - RNA, 22 nt, Human
cgaggccgcuucauggcuggca

SEQ ID NO: 221115 - RNA, 22 nt, Human
cgaggcuugcaaggacgaggag

SEQ ID NO: 221116 - RNA, 22 nt, Human
cuacauuuacacaguuaggcuu

SEQ ID NO: 221117 - RNA, 18 nt, Human
cgauguguaugugauuug

SEQ ID NO: 221118 - RNA, 22 nt, Human
cgcccccgaucggggccgccgc

SEQ ID NO: 221119 - RNA, 22 nt, Human
cgagggcuggaggggagacaga

SEQ ID NO: 221120 - RNA, 22 nt, Human
cgaaggaaucacuuaacacuuu

SEQ ID NO: 221121 - RNA, 22 nt, Human
ccuccccugccugugcuguugg

SEQ ID NO: 221122 - RNA, 22 nt, Human
ccuccugggccuugcucuguga

SEQ ID NO: 221123 - RNA, 22 nt, Human
ccucccuucccggcauggcucu

SEQ ID NO: 221124 - RNA, 21 nt, Human
ccguuauucuucccaccccca

SEQ ID NO: 221125 - RNA, 22 nt, Human
ccgguguggguuucucgguagu

SEQ ID NO: 221126 - RNA, 22 nt, Human
ccgugcaguuucucacacacau

SEQ ID NO: 221127 - RNA, 22 nt, Human
cgaacggcagagagcccguccc

SEQ ID NO: 221128 - RNA, 22 nt, Human
cgaaaaagaagugcaccauguu

SEQ ID NO: 221129 - RNA, 22 nt, Human
ccuauuuucaaaauuguuuauc

SEQ ID NO: 221130 - RNA, 22 nt, Human
cggagagacaagucugcuuugg

SEQ ID NO: 221131 - RNA, 22 nt, Human
cggaggagcugcgcggaggggg

SEQ ID NO: 221132 - RNA, 22 nt, Human
ccugccugggcucacuugccag

SEQ ID NO: 221133 - RNA, 22 nt, Human
cggacugaccugcucggggaga

SEQ ID NO: 221134 - RNA, 22 nt, Human
cgcuuugguaauagggcagccu

SEQ ID NO: 221135 - RNA, 22 nt, Human
cgcuuugacuuuagaaggccaa

SEQ ID NO: 221136 - RNA, 22 nt, Human
cgggaaguaaacauuauuucag

SEQ ID NO: 221137 - RNA, 22 nt, Human
cgggagagacagaggaggcgcc

SEQ ID NO: 221138 - RNA, 22 nt, Human
cgggacaauagcagugcugaug

SEQ ID NO: 221139 - RNA, 22 nt, Human
cggcuucucgggucggauuccg

SEQ ID NO: 221140 - RNA, 22 nt, Human
cggcugcagcggagcaggcugg

SEQ ID NO: 221141 - RNA, 22 nt, Human
cggaggcugcuuucuguugcua

SEQ ID NO: 221142 - RNA, 22 nt, Human
ccugaggcccuggcugugcuga

SEQ ID NO: 221143 - RNA, 22 nt, Human
ccugacuugguuuaggagaugg

SEQ ID NO: 221144 - RNA, 22 nt, Human
cgcugcagcggcugagucccgc

SEQ ID NO: 221145 - RNA, 22 nt, Human
ccugaccauuugccacaugggu

SEQ ID NO: 221146 - RNA, 22 nt, Human
ccucucugcgaaugcugauagu

SEQ ID NO: 221147 - RNA, 22 nt, Human
cgccgccgccugcccgcgcccc

SEQ ID NO: 221148 - RNA, 22 nt, Human
cgcccguacuuugccggcauga

SEQ ID NO: 221149 - RNA, 22 nt, Human
cgccgugcagucagcccagaag

SEQ ID NO: 221150 - RNA, 22 nt, Human
ccuucgcuggcaucuccaggua

SEQ ID NO: 221151 - RNA, 22 nt, Human
ccuuccaguucuugguuguaau

SEQ ID NO: 221152 - RNA, 22 nt, Human
ccuucuuaaacaucauuuuggc

SEQ ID NO: 221153 - RNA, 22 nt, Human
ccgcgggcagggcuucaccuuu

SEQ ID NO: 221154 - RNA, 22 nt, Human
ccgcggcuguaguggaggugga

SEQ ID NO: 221155 - RNA, 22 nt, Human
ccuuucuaacagauuguggauc

SEQ ID NO: 221156 - RNA, 17 nt, Human
ccuuucugaucaucuga

SEQ ID NO: 221157 - RNA, 22 nt, Human
ccuuggcuuaccuucugugugg

SEQ ID NO: 221158 - RNA, 22 nt, Human
ccuugguuuagcaauuuuucuu

SEQ ID NO: 221159 - RNA, 22 nt, Human
ccgcuggaagcgaguggugggc

SEQ ID NO: 221160 - RNA, 22 nt, Human
ccgcucgggugcagagggcaga

SEQ ID NO: 221161 - RNA, 22 nt, Human
ccggaggaaauugcauugguug

SEQ ID NO: 221162 - RNA, 22 nt, Human
ccggcggaaacauggcggcgcc

SEQ ID NO: 221163 - RNA, 22 nt, Human
ccggcugagccucgccgcggcc

SEQ ID NO: 221164 - RNA, 20 nt, Human
ccuuuuguugcuguuuggau

SEQ ID NO: 221165 - RNA, 21 nt, Human
ccuuuggagacugcagcaaug

SEQ ID NO: 221166 - RNA, 22 nt, Human
ccagagcaccgaaacgagcuuu

SEQ ID NO: 221167 - RNA, 22 nt, Human
ccugcuggagucuaguuggucu

SEQ ID NO: 221168 - RNA, 22 nt, Human
ccgaaccacacgacagugcuca

SEQ ID NO: 221169 - RNA, 22 nt, Human
ccgaaaaacagaaucuuggaac

SEQ ID NO: 221170 - RNA, 22 nt, Human
ccagaauuugaacccacaaaug

SEQ ID NO: 221171 - RNA, 22 nt, Human
cccagagggcugaggauaugaa

SEQ ID NO: 221172 - RNA, 22 nt, Human
ccagacuggggcuccuugaggg

SEQ ID NO: 221173 - RNA, 22 nt, Human
ccgcgcccccggcugugccccc

SEQ ID NO: 221174 - RNA, 22 nt, Human
ccuggcauuagaaauuccguca

SEQ ID NO: 221175 - RNA, 19 nt, Human
ccgagcagauugauguuuc

SEQ ID NO: 221176 - RNA, 22 nt, Human
ccgcggcugcgcggugccccuc

SEQ ID NO: 221177 - RNA, 22 nt, Human
ccuggcccagcuggaagcggga

SEQ ID NO: 221178 - RNA, 22 nt, Human
ccugggcauuuguuucacaggu

SEQ ID NO: 221179 - RNA, 22 nt, Human
ccuggguccucacaaucccagg

SEQ ID NO: 221180 - RNA, 22 nt, Human
ccuuagaaaaucauggaauauu

SEQ ID NO: 221181 - RNA, 22 nt, Human
ccugugucaucagcuguggcua

SEQ ID NO: 221182 - RNA, 19 nt, Human
ccugugaguuaagcuaugu

SEQ ID NO: 221183 - RNA, 22 nt, Human
cauuacaagaaauagcauaaug

SEQ ID NO: 221184 - RNA, 22 nt, Human
cauuagugaggggcugccugcu

SEQ ID NO: 221185 - RNA, 22 nt, Human
ccaccucuaccuggccggccuu

SEQ ID NO: 221186 - RNA, 22 nt, Human
ccacucagaagaaacaagagag

SEQ ID NO: 221187 - RNA, 22 nt, Human
ccacagcauugaaaucuauaau

SEQ ID NO: 221188 - RNA, 21 nt, Human
ccacaauucuaguuacauaug

SEQ ID NO: 221189 - RNA, 22 nt, Human
ccaauuuuggaauuauuaggca

SEQ ID NO: 221190 - RNA, 22 nt, Human
cauguguuucuuaagccaggcc

SEQ ID NO: 221191 - RNA, 22 nt, Human
cauguggaaaugcaugcuuuuu

SEQ ID NO: 221192 - RNA, 22 nt, Human
caugugcaucagccaauuggag

SEQ ID NO: 221193 - RNA, 22 nt, Human
cauguaaguucacagucgaugu

SEQ ID NO: 221194 - RNA, 22 nt, Human
caugguacugccacagaagagu

SEQ ID NO: 221195 - RNA, 22 nt, Human
ccaauguuaggcucugguuuua

SEQ ID NO: 221196 - RNA, 22 nt, Human
caugcuggcacugaccagccua

SEQ ID NO: 221197 - RNA, 22 nt, Human
ccaaccaaagggccuaaggucu

SEQ ID NO: 221198 - RNA, 22 nt, Human
ccaaauuaccuucuuggauuca

SEQ ID NO: 221199 - RNA, 22 nt, Human
ccaaccaguuucuuggcuuuag

SEQ ID NO: 221200 - RNA, 19 nt, Human
cauggcgguaaagaggcug

SEQ ID NO: 221201 - RNA, 22 nt, Human
cauggcggcgcucucccugccu

SEQ ID NO: 221202 - RNA, 22 nt, Human
caugcuucccacauuccgauuu

SEQ ID NO: 221203 - RNA, 22 nt, Human
cauggcacuuuugugucuaaau

SEQ ID NO: 221204 - RNA, 22 nt, Human
cauggccaaagaauuauauuuu

SEQ ID NO: 221205 - RNA, 22 nt, Human
cauuuuuccucaggcaauuuga

SEQ ID NO: 221206 - RNA, 22 nt, Human
cauuuuuuuuccccuccuggua

SEQ ID NO: 221207 - RNA, 22 nt, Human
ccaaaauauuagugcuuaagua

SEQ ID NO: 221208 - RNA, 19 nt, Human
ccaacaguacugaagcacu

SEQ ID NO: 221209 - RNA, 22 nt, Human
ccaaauuguuguuguuguuguu

SEQ ID NO: 221210 - RNA, 22 nt, Human
ccaaagaauuuggaaaaucuga

SEQ ID NO: 221211 - RNA, 20 nt, Human
caugaugcaaacaguaacgu

SEQ ID NO: 221212 - RNA, 22 nt, Human
caugaugagaguaauaacacag

SEQ ID NO: 221213 - RNA, 22 nt, Human
caugccugaucagcggccagca

SEQ ID NO: 221214 - RNA, 22 nt, Human
cauuuugguaauguucguuugc

SEQ ID NO: 221215 - RNA, 22 nt, Human
caugagaguaaccuagagaaga

SEQ ID NO: 221216 - RNA, 22 nt, Human
cauuucuggccuggggagcggg

SEQ ID NO: 221217 - RNA, 22 nt, Human
cauuucuugugagccgcauccu

SEQ ID NO: 221218 - RNA, 22 nt, Human
caugaugacagcauuccuuuua

SEQ ID NO: 221219 - RNA, 22 nt, Human
cauuuuaucagcacacgucacu

SEQ ID NO: 221220 - RNA, 22 nt, Human
cauuuucugcaagucugcucaa

SEQ ID NO: 221221 - RNA, 22 nt, Human
cauuuacguaacaguaacgcug

SEQ ID NO: 221222 - RNA, 22 nt, Human
cauuucaaacaguuacagcugc

SEQ ID NO: 221223 - RNA, 22 nt, Human
cauuuaaccccuugguacugaa

SEQ ID NO: 221224 - RNA, 22 nt, Human
caucuccaagucuguaagcagu

SEQ ID NO: 221225 - RNA, 22 nt, Human
cauugguacaaaauguacuuug

SEQ ID NO: 221226 - RNA, 22 nt, Human
cauuggcacauguauucugggc

SEQ ID NO: 221227 - RNA, 22 nt, Human
cauugggcggggaccucggcug

SEQ ID NO: 221228 - RNA, 22 nt, Human
caucucagguuuguucugagac

SEQ ID NO: 221229 - RNA, 22 nt, Human
cauugcuguuaauugucucuag

SEQ ID NO: 221230 - RNA, 22 nt, Human
cauccagcuccugggggccacc

SEQ ID NO: 221231 - RNA, 22 nt, Human
cauccagagcugccugaccccg

SEQ ID NO: 221232 - RNA, 22 nt, Human
cauccagggguacccuggagcc

SEQ ID NO: 221233 - RNA, 22 nt, Human
cauugcugccaaggugagcugg

SEQ ID NO: 221234 - RNA, 22 nt, Human
cauugcugugggcauuugcugc

SEQ ID NO: 221235 - RNA, 22 nt, Human
cauugcaaccauuccaaauggc

SEQ ID NO: 221236 - RNA, 22 nt, Human
cauuccuucucagguacuggca

SEQ ID NO: 221237 - RNA, 22 nt, Human
caucaggcugggaacacagauc

SEQ ID NO: 221238 - RNA, 22 nt, Human
caucaguaaaguacuuuuaugu

SEQ ID NO: 221239 - RNA, 20 nt, Human
cauuccaugcaucuuggucc

SEQ ID NO: 221240 - RNA, 23 nt, Human
cagguuacacuuuaaaauaugca

SEQ ID NO: 221241 - RNA, 22 nt, Human
caucaacagucuacuuuuugcc

SEQ ID NO: 221242 - RNA, 22 nt, Human
caugugacuuagguuuuaucac

SEQ ID NO: 221243 - RNA, 22 nt, Human
cagguuuuuauuacaacuuuga

SEQ ID NO: 221244 - RNA, 22 nt, Human
caugugguauugugagauccac

SEQ ID NO: 221245 - RNA, 22 nt, Human
cauguguauuauucuuguggaa

SEQ ID NO: 221246 - RNA, 22 nt, Human
cauuauucaggcuuuggaauuu

SEQ ID NO: 221247 - RNA, 22 nt, Human
cauaucuuaaacaucaucucug

SEQ ID NO: 221248 - RNA, 22 nt, Human
cauauacauauacaugcauaca

SEQ ID NO: 221249 - RNA, 22 nt, Human
cagguugaaaguggaggagcua

SEQ ID NO: 221250 - RNA, 22 nt, Human
caucacggagcaugagaagaca

SEQ ID NO: 221251 - RNA, 22 nt, Human
cagguuuuccuuuuaaaaggaa

SEQ ID NO: 221252 - RNA, 22 nt, Human
caucagucugaaagccagggag

SEQ ID NO: 221253 - RNA, 22 nt, Human
cagguuuggaagucacgaagcu

SEQ ID NO: 221254 - RNA, 22 nt, Human
ccacccacuucucugcccucca

SEQ ID NO: 221255 - RNA, 22 nt, Human
ccaccacugaggcacaggagcc

SEQ ID NO: 221256 - RNA, 22 nt, Human
ccaucuuugcucuuuuauugca

SEQ ID NO: 221257 - RNA, 22 nt, Human
ccauggaaaagacgggcaggcc

SEQ ID NO: 221258 - RNA, 19 nt, Human
ccaguuuuuuaauauucaa

SEQ ID NO: 221259 - RNA, 22 nt, Human
ccaguuguggagaauuguuuga

SEQ ID NO: 221260 - RNA, 22 nt, Human
ccaccacauuugccuagacuuu

SEQ ID NO: 221261 - RNA, 22 nt, Human
ccacagugauucacuuuugaag

SEQ ID NO: 221262 - RNA, 22 nt, Human
cccacccuacugcuacccagga

SEQ ID NO: 221263 - RNA, 22 nt, Human
ccauuuuccuguauggacucga

SEQ ID NO: 221264 - RNA, 22 nt, Human
ccagaacgacgggcagaggcgc

SEQ ID NO: 221265 - RNA, 22 nt, Human
ccauggccaauugcaccuugcu

SEQ ID NO: 221266 - RNA, 22 nt, Human
ccacucucucccucuguagggg

SEQ ID NO: 221267 - RNA, 22 nt, Human
ccacuuugagaagcugaugaaa

SEQ ID NO: 221268 - RNA, 22 nt, Human
ccagggaggucauagugcuggu

SEQ ID NO: 221269 - RNA, 22 nt, Human
ccagggcggacaaggucuuuga

SEQ ID NO: 221270 - RNA, 22 nt, Human
ccaggcuccccaggaggcccuu

SEQ ID NO: 221271 - RNA, 22 nt, Human
ccagggcugcugccugggcugg

SEQ ID NO: 221272 - RNA, 22 nt, Human
ccagggcuggaggaggucagga

SEQ ID NO: 221273 - RNA, 22 nt, Human
ccagggcuggaccagugcuugg

SEQ ID NO: 221274 - RNA, 22 nt, Human
ccaagcguguuuaggaaaugcu

SEQ ID NO: 221275 - RNA, 22 nt, Human
ccaaggcuguggggcugugcag

SEQ ID NO: 221276 - RNA, 22 nt, Human
ccaaucaacuguguggcuuucu

SEQ ID NO: 221277 - RNA, 22 nt, Human
ccagugcuuccaggaauacggu

SEQ ID NO: 221278 - RNA, 22 nt, Human
ccaguguguuuuucucugacuc

SEQ ID NO: 221279 - RNA, 22 nt, Human
ccagguuggccaccuucacggg

SEQ ID NO: 221280 - RNA, 22 nt, Human
ccagucagccuaguucuucuuu

SEQ ID NO: 221281 - RNA, 22 nt, Human
ccaguccugucaggggagggga

SEQ ID NO: 221282 - RNA, 23 nt, Human
ccagucgagucccaaccuucacc

SEQ ID NO: 221283 - RNA, 22 nt, Human
ccagugacaaagucggaagucc

SEQ ID NO: 221284 - RNA, 22 nt, Human
ccagcugggucccugcuggggc

SEQ ID NO: 221285 - RNA, 23 nt, Human
ccagcugugccuggcccaggagc

SEQ ID NO: 221286 - RNA, 17 nt, Human
ccagcugcucccucaga

SEQ ID NO: 221287 - RNA, 22 nt, Human
ccaaagaagcaaugagaauagu

SEQ ID NO: 221288 - RNA, 22 nt, Human
ccaggcuaggaccgauuucccu

SEQ ID NO: 221289 - RNA, 22 nt, Human
ccagcagaagcucccgcugggu

SEQ ID NO: 221290 - RNA, 22 nt, Human
ccagcaaguaagucagugucag

SEQ ID NO: 221291 - RNA, 22 nt, Human
ccagccugccaagcccagcccu

SEQ ID NO: 221292 - RNA, 22 nt, Human
ccagcaugcucagucuaaauug

SEQ ID NO: 221293 - RNA, 22 nt, Human
cauuugacaauugggauagauc

SEQ ID NO: 221294 - RNA, 22 nt, Human
cauuugcuuaucacucuucuuu

SEQ ID NO: 221295 - RNA, 23 nt, Human
cauuugauccucacaauaaaugg

SEQ ID NO: 221296 - RNA, 22 nt, Human
cauuuuccucugcugguguuca

SEQ ID NO: 221297 - RNA, 22 nt, Human
cauuuaucacuugcuaaacaua

SEQ ID NO: 221298 - RNA, 22 nt, Human
cauuuacauaacaguaacgcug

SEQ ID NO: 221299 - RNA, 22 nt, Human
ccagagcacaccguuugccuuc

SEQ ID NO: 221300 - RNA, 22 nt, Human
cauugcaucuuuuauggguaag

SEQ ID NO: 221301 - RNA, 22 nt, Human
ccagauaaacauuccuuggccu

SEQ ID NO: 221302 - RNA, 22 nt, Human
ccagaacguuugugcgaggcag

SEQ ID NO: 221303 - RNA, 22 nt, Human
ccacuuucuaaauuggcgauuu

SEQ ID NO: 221304 - RNA, 20 nt, Human
ccagaagagaagaaaaggaa

SEQ ID NO: 221305 - RNA, 20 nt, Human
cagcagucagcucuccaaug

SEQ ID NO: 221306 - RNA, 22 nt, Human
cagcacaggugugaggccugau

SEQ ID NO: 221307 - RNA, 22 nt, Human
cacuuauuuuuccuuugugauu

SEQ ID NO: 221308 - RNA, 22 nt, Human
cagccccgcuggccucgccucc

SEQ ID NO: 221309 - RNA, 22 nt, Human
cagaccuggaaaacaggcuugc

SEQ ID NO: 221310 - RNA, 22 nt, Human
cagagagcguccauccggugcc

SEQ ID NO: 221311 - RNA, 22 nt, Human
cagcccuguugcgcuuccggcg

SEQ ID NO: 221312 - RNA, 22 nt, Human
cagcccuggccucuucgcuuuc

SEQ ID NO: 221313 - RNA, 22 nt, Human
cagcauucuacuuugugaacug

SEQ ID NO: 221314 - RNA, 22 nt, Human
cagaaugugacaucaaaggcuc

SEQ ID NO: 221315 - RNA, 22 nt, Human
cagccauucuaacacugccagu

SEQ ID NO: 221316 - RNA, 22 nt, Human
cagccagaucgccuuccgccuc

SEQ ID NO: 221317 - RNA, 22 nt, Human
cacccgacugaggacgccgccc

SEQ ID NO: 221318 - RNA, 20 nt, Human
cacccgguccucagcgacuc

SEQ ID NO: 221319 - RNA, 22 nt, Human
cacccccaggcuccccuucugg

SEQ ID NO: 221320 - RNA, 23 nt, Human
caccaugacaugccuauagggga

SEQ ID NO: 221321 - RNA, 22 nt, Human
caccaucugaauauucuccaag

SEQ ID NO: 221322 - RNA, 22 nt, Human
cacgggcgacgugaucuaggac

SEQ ID NO: 221323 - RNA, 22 nt, Human
cacuaaccauguucccaacagc

SEQ ID NO: 221324 - RNA, 22 nt, Human
cagaccagaaggaagccgacaa

SEQ ID NO: 221325 - RNA, 22 nt, Human
cacuauguacauaauagcugcu

SEQ ID NO: 221326 - RNA, 22 nt, Human
caccucagagcuccuucuucuc

SEQ ID NO: 221327 - RNA, 18 nt, Human
cacgcaacuguaaaaccc

SEQ ID NO: 221328 - RNA, 22 nt, Human
cagacgguuaaacgauuuugcu

SEQ ID NO: 221329 - RNA, 22 nt, Human
cagacuccugcuccucuggggc

SEQ ID NO: 221330 - RNA, 22 nt, Human
cagaccucuaugggguaaaucu

SEQ ID NO: 221331 - RNA, 22 nt, Human
cagagaggagcacaaagugaag

SEQ ID NO: 221332 - RNA, 22 nt, Human
cagagaagaggucuugaccccu

SEQ ID NO: 221333 - RNA, 22 nt, Human
cacucuucucucauuuuccuuu

SEQ ID NO: 221334 - RNA, 22 nt, Human
cacugcugaggcccguguuacu

SEQ ID NO: 221335 - RNA, 22 nt, Human
cacugugagugcaagcaggggu

SEQ ID NO: 221336 - RNA, 22 nt, Human
cagauacaacagcaggaaugaa

SEQ ID NO: 221337 - RNA, 22 nt, Human
cacuguugaagauacuuccucu

SEQ ID NO: 221338 - RNA, 21 nt, Human
cacuguauagcaggagaaaac

SEQ ID NO: 221339 - RNA, 22 nt, Human
caaugcacauggacaucaggcu

SEQ ID NO: 221340 - RNA, 22 nt, Human
caaugccaggaaccugggggaa

SEQ ID NO: 221341 - RNA, 22 nt, Human
caagcagauauuuuagucaaga

SEQ ID NO: 221342 - RNA, 22 nt, Human
cacugcaaccuccaccucccgg

SEQ ID NO: 221343 - RNA, 22 nt, Human
cacucaaacugaaauccuuuuu

SEQ ID NO: 221344 - RNA, 22 nt, Human
caaugaaaauuuaaguugcagc

SEQ ID NO: 221345 - RNA, 20 nt, Human
caauguuggcaguauagagc

SEQ ID NO: 221346 - RNA, 22 nt, Human
cacugguugccucuuucuguuc

SEQ ID NO: 221347 - RNA, 22 nt, Human
cacagcaggcagaacgugggca

SEQ ID NO: 221348 - RNA, 22 nt, Human
cacuguugagcaauguacagug

SEQ ID NO: 221349 - RNA, 22 nt, Human
cacacguuucuacugcugccaa

SEQ ID NO: 221350 - RNA, 22 nt, Human
cacacguuuagcuucuggcggc

SEQ ID NO: 221351 - RNA, 22 nt, Human
cacagauaaggcuuugucccca

SEQ ID NO: 221352 - RNA, 22 nt, Human
cacugcguaguggcccgaagcu

SEQ ID NO: 221353 - RNA, 23 nt, Human
cacuggugggguuuaaaagaagc

SEQ ID NO: 221354 - RNA, 22 nt, Human
cacugcacuccagccugggcaa

SEQ ID NO: 221355 - RNA, 22 nt, Human
cacauugguagaauuuagaaga

SEQ ID NO: 221356 - RNA, 22 nt, Human
caccaaaauaucccuuuguaca

SEQ ID NO: 221357 - RNA, 22 nt, Human
cacaugugggcacagggcugca

SEQ ID NO: 221358 - RNA, 22 nt, Human
cacaucugaaggcggcucuagg

SEQ ID NO: 221359 - RNA, 22 nt, Human
cacaucaaacuuacuaagauuu

SEQ ID NO: 221360 - RNA, 22 nt, Human
cagaacugaauaaagccaggau

SEQ ID NO: 221361 - RNA, 22 nt, Human
cagaaguugcuugagagagagc

SEQ ID NO: 221362 - RNA, 22 nt, Human
cagaaagugauuugcuauucca

SEQ ID NO: 221363 - RNA, 22 nt, Human
cagaaauuggcagagaagaccu

SEQ ID NO: 221364 - RNA, 22 nt, Human
cagacacgucccuguugaccug

SEQ ID NO: 221365 - RNA, 22 nt, Human
cagacaaauccuuaugagacug

SEQ ID NO: 221366 - RNA, 22 nt, Human
cagacagagcucacaagucuuu

SEQ ID NO: 221367 - RNA, 22 nt, Human
cacagccaagacuuggccccau

SEQ ID NO: 221368 - RNA, 22 nt, Human
cacuucaguacuagaggaugaa

SEQ ID NO: 221369 - RNA, 22 nt, Human
cagaaaaaaaugcagacuagca

SEQ ID NO: 221370 - RNA, 22 nt, Human
cacuuuuucccccuggugucau

SEQ ID NO: 221371 - RNA, 22 nt, Human
cacuugauugucagaaaaaugg

SEQ ID NO: 221372 - RNA, 22 nt, Human
cacauaaggacauuauugaaag

SEQ ID NO: 221373 - RNA, 22 nt, Human
cagaaaguauguucuaguaguu

SEQ ID NO: 221374 - RNA, 22 nt, Human
cagaaagaaguggggauagagg

SEQ ID NO: 221375 - RNA, 22 nt, Human
caggaggaaaguuccacucaac

SEQ ID NO: 221376 - RNA, 22 nt, Human
cagcuacuaccuguagacaaag

SEQ ID NO: 221377 - RNA, 22 nt, Human
caggaguggugagguuagcaga

SEQ ID NO: 221378 - RNA, 22 nt, Human
caggcacaagaucggcuagaua

SEQ ID NO: 221379 - RNA, 22 nt, Human
caggcgcugacgggaccgggcu

SEQ ID NO: 221380 - RNA, 22 nt, Human
cagggaaguauuacauguuucc

SEQ ID NO: 221381 - RNA, 22 nt, Human
cagggacgugagccaugucagu

SEQ ID NO: 221382 - RNA, 22 nt, Human
caggccgcccucuccuguuagc

SEQ ID NO: 221383 - RNA, 22 nt, Human
caggcgcauggugagcagauga

SEQ ID NO: 221384 - RNA, 22 nt, Human
cagcuucacuuaaaacaugcaa

SEQ ID NO: 221385 - RNA, 22 nt, Human
cagcuucaaaggcccugauggu

SEQ ID NO: 221386 - RNA, 22 nt, Human
caggugccucugccccacgcgg

SEQ ID NO: 221387 - RNA, 22 nt, Human
cagcugcugguguaucgggucc

SEQ ID NO: 221388 - RNA, 22 nt, Human
cagcucuggcuauugaggacca

SEQ ID NO: 221389 - RNA, 22 nt, Human
cagcugcgcagcgccgggccug

SEQ ID NO: 221390 - RNA, 22 nt, Human
cagcuguggagauggggugcau

SEQ ID NO: 221391 - RNA, 22 nt, Human
caggguuuuaguugcagguuau

SEQ ID NO: 221392 - RNA, 22 nt, Human
cagccuuuucuuaaaaugcaag

SEQ ID NO: 221393 - RNA, 22 nt, Human
cagcgguggcaaggugacugug

SEQ ID NO: 221394 - RNA, 22 nt, Human
cagaggagcgaguuggacgcca

SEQ ID NO: 221395 - RNA, 22 nt, Human
cagagcugucauuugccaguga

SEQ ID NO: 221396 - RNA, 22 nt, Human
cagagccagcuguccuuggcau

SEQ ID NO: 221397 - RNA, 22 nt, Human
cagagcagaaaccugggugauu

SEQ ID NO: 221398 - RNA, 22 nt, Human
cagagaugaggcuggcgugguu

SEQ ID NO: 221399 - RNA, 22 nt, Human
cagccuggccucuggauauuug

SEQ ID NO: 221400 - RNA, 22 nt, Human
cagagacuuuugcuccgauucu

SEQ ID NO: 221401 - RNA, 21 nt, Human
cagcccccauacccugcccag

SEQ ID NO: 221402 - RNA, 19 nt, Human
caggacaguuugccaagaa

SEQ ID NO: 221403 - RNA, 18 nt, Human
cagcauuagcagcuucca

SEQ ID NO: 221404 - RNA, 22 nt, Human
cagccccaguuuucauaagacu

SEQ ID NO: 221405 - RNA, 22 nt, Human
cagccccagcacuuagcugagu

SEQ ID NO: 221406 - RNA, 22 nt, Human
caggugcucugauauggggcug

SEQ ID NO: 221407 - RNA, 22 nt, Human
caggugauuuuguuuucaaaug

SEQ ID NO: 221408 - RNA, 22 nt, Human
caguuuuucaaaauuacaugau

SEQ ID NO: 221409 - RNA, 22 nt, Human
cauaucuccagguucugcugga

SEQ ID NO: 221410 - RNA, 22 nt, Human
caggugggauuuugcugcuuga

SEQ ID NO: 221411 - RNA, 22 nt, Human
cauauuaugcauguuguucuuu

SEQ ID NO: 221412 - RNA, 22 nt, Human
cauaguuuguucuuuuuuauug

SEQ ID NO: 221413 - RNA, 22 nt, Human
cauagcguuuacauguggauua

SEQ ID NO: 221414 - RNA, 22 nt, Human
cagugguaaaugucguuccugu

SEQ ID NO: 221415 - RNA, 22 nt, Human
caggggacacuccugcuugggc

SEQ ID NO: 221416 - RNA, 22 nt, Human
caguguuuagcacagugcuugg

SEQ ID NO: 221417 - RNA, 22 nt, Human
caguggagaccugccugcugga

SEQ ID NO: 221418 - RNA, 22 nt, Human
caguugcuauugagagaacaca

SEQ ID NO: 221419 - RNA, 22 nt, Human
caguucacggcugguaugaauu

SEQ ID NO: 221420 - RNA, 22 nt, Human
caguucaagauuguugcuuucu

SEQ ID NO: 221421 - RNA, 22 nt, Human
caggguugaugaauugucugua

SEQ ID NO: 221422 - RNA, 21 nt, Human
caguuugcuauuuuaguauga

SEQ ID NO: 221423 - RNA, 22 nt, Human
caguuuccagacauuauugaua

SEQ ID NO: 221424 - RNA, 22 nt, Human
caggauauguucaagguuuucu

SEQ ID NO: 221425 - RNA, 22 nt, Human
caggauuuaauaagauaguguu

SEQ ID NO: 221426 - RNA, 19 nt, Human
caggauuguuuaaagcuuu

SEQ ID NO: 221427 - RNA, 22 nt, Human
cagucucuggugaguugacagu

SEQ ID NO: 221428 - RNA, 22 nt, Human
cagucugcuggcuuuuucagca

SEQ ID NO: 221429 - RNA, 22 nt, Human
caggcacaaugagcgccaucuu

SEQ ID NO: 221430 - RNA, 22 nt, Human
cagugcucauagcuguuccucc

SEQ ID NO: 221431 - RNA, 22 nt, Human
caggaagagaacugcucagccu

SEQ ID NO: 221432 - RNA, 22 nt, Human
caggaacucuucugggugcuug

SEQ ID NO: 221433 - RNA, 22 nt, Human
caggaacagcaccaggagcuag

SEQ ID NO: 221434 - RNA, 22 nt, Human
cagguggauggcgagcccugca

SEQ ID NO: 221435 - RNA, 22 nt, Human
caggacccaacggugcaauguc

SEQ ID NO: 221436 - RNA, 22 nt, Human
caggaacucggagcccaucucu

SEQ ID NO: 221437 - RNA, 22 nt, Human
caggacagaaauaaggaauaua

SEQ ID NO: 221438 - RNA, 22 nt, Human
caggagaaauucacauuaguga

SEQ ID NO: 221439 - RNA, 20 nt, Human
cagguugcugcccccgccuc

SEQ ID NO: 221440 - RNA, 22 nt, Human
cagguugaagagguuaacgaua

SEQ ID NO: 221441 - RNA, 22 nt, Human
cagguggccggguaggaggugg

SEQ ID NO: 221442 - RNA, 22 nt, Human
cagguguugcaguugaagacug

SEQ ID NO: 221443 - RNA, 20 nt, Human
auggaaacacgcagccccaa

SEQ ID NO: 221444 - RNA, 22 nt, Human
augggaauggauugagugggug

SEQ ID NO: 221445 - RNA, 22 nt, Human
augggaggguagagugaacaga

SEQ ID NO: 221446 - RNA, 22 nt, Human
auggccguggccagggucaggg

SEQ ID NO: 221447 - RNA, 22 nt, Human
auggaacauuaaucuucaaaug

SEQ ID NO: 221448 - RNA, 22 nt, Human
auggaagagacaaugcuaucug

SEQ ID NO: 221449 - RNA, 22 nt, Human
augggcauggauggccgagucu

SEQ ID NO: 221450 - RNA, 22 nt, Human
auggauuggguugauggcauac

SEQ ID NO: 221451 - RNA, 22 nt, Human
auggauggaagcagccugaacu

SEQ ID NO: 221452 - RNA, 22 nt, Human
auggagggcagccccacuaaag

SEQ ID NO: 221453 - RNA, 22 nt, Human
auggagggguuguugcuugagu

SEQ ID NO: 221454 - RNA, 22 nt, Human
auggacguuuguguauuaugua

SEQ ID NO: 221455 - RNA, 22 nt, Human
augggggccagggacccuggca

SEQ ID NO: 221456 - RNA, 22 nt, Human
auggacagcucuuaugugggca

SEQ ID NO: 221457 - RNA, 22 nt, Human
augggcuuuacccucagagcuu

SEQ ID NO: 221458 - RNA, 22 nt, Human
auggggaucugcaguguugauc

SEQ ID NO: 221459 - RNA, 22 nt, Human
auggggaauugaccguggaucu

SEQ ID NO: 221460 - RNA, 22 nt, Human
augcccugggagugcuguacca

SEQ ID NO: 221461 - RNA, 22 nt, Human
auggaaggggagguagggagga

SEQ ID NO: 221462 - RNA, 22 nt, Human
auggaauuuaaauuuugguguc

SEQ ID NO: 221463 - RNA, 22 nt, Human
auggaacccgggcgucugcucu

SEQ ID NO: 221464 - RNA, 22 nt, Human
auggaguguggccaggcaguaa

SEQ ID NO: 221465 - RNA, 22 nt, Human
auggagcagagcugaugggccu

SEQ ID NO: 221466 - RNA, 22 nt, Human
auggagcgggaggauggaggag

SEQ ID NO: 221467 - RNA, 22 nt, Human
auggaggagcagaggguuucca

SEQ ID NO: 221468 - RNA, 22 nt, Human
auggaggaugugcagcaugggc

SEQ ID NO: 221469 - RNA, 22 nt, Human
augcauaugugugcaagugugu

SEQ ID NO: 221470 - RNA, 22 nt, Human
augccacuguuuaugucacuua

SEQ ID NO: 221471 - RNA, 22 nt, Human
augcugccuccucuucagccgc

SEQ ID NO: 221472 - RNA, 22 nt, Human
augauuauuugaaugaagagga

SEQ ID NO: 221473 - RNA, 22 nt, Human
augcccagaacccccuggaugg

SEQ ID NO: 221474 - RNA, 22 nt, Human
augccaccucuucugauuccag

SEQ ID NO: 221475 - RNA, 22 nt, Human
augcaugaucccgguaugugaa

SEQ ID NO: 221476 - RNA, 22 nt, Human
auguuugugauugcugaaaaga

SEQ ID NO: 221477 - RNA, 22 nt, Human
auguuuaauuugaaauuuuauu

SEQ ID NO: 221478 - RNA, 22 nt, Human
auguuuaaguguuuugccccaa

SEQ ID NO: 221479 - RNA, 20 nt, Human
augugcuaauauuaauaugu

SEQ ID NO: 221480 - RNA, 22 nt, Human
auguuuucauuuagaagcuaau

SEQ ID NO: 221481 - RNA, 22 nt, Human
auuaaaaaaagauaaugaguua

SEQ ID NO: 221482 - RNA, 22 nt, Human
auuaaagcaugaauaauaugua

SEQ ID NO: 221483 - RNA, 22 nt, Human
augugcacuggugugugcguuc

SEQ ID NO: 221484 - RNA, 22 nt, Human
augugauacuccuucuagugga

SEQ ID NO: 221485 - RNA, 22 nt, Human
augugagcuggaugaauuuaua

SEQ ID NO: 221486 - RNA, 22 nt, Human
augugaacuccagcugccaacc

SEQ ID NO: 221487 - RNA, 22 nt, Human
augugugugcgagcgugugugu

SEQ ID NO: 221488 - RNA, 22 nt, Human
auguaguccuuauuugacauaa

SEQ ID NO: 221489 - RNA, 22 nt, Human
augggcggugcauuugcacagu

SEQ ID NO: 221490 - RNA, 22 nt, Human
augggcauacaaaugcuacccu

SEQ ID NO: 221491 - RNA, 22 nt, Human
augggagugacagggccacugg

SEQ ID NO: 221492 - RNA, 22 nt, Human
auggugaugaugaugaugauaa

SEQ ID NO: 221493 - RNA, 19 nt, Human
augggaagcggccagcgga

SEQ ID NO: 221494 - RNA, 22 nt, Human
auggugugugugugugugugug

SEQ ID NO: 221495 - RNA, 22 nt, Human
auggcagcggagcuggaaauga

SEQ ID NO: 221496 - RNA, 22 nt, Human
auggugaaaugauuugauguca

SEQ ID NO: 221497 - RNA, 22 nt, Human
augguguaagacuguauuucuu

SEQ ID NO: 221498 - RNA, 19 nt, Human
augguauugcuggguuuuu

SEQ ID NO: 221499 - RNA, 22 nt, Human
augggugggagugaaggggcuc

SEQ ID NO: 221500 - RNA, 22 nt, Human
augugcucaggucuauaucuca

SEQ ID NO: 221501 - RNA, 22 nt, Human
auguaccgccuuggagaaaugc

SEQ ID NO: 221502 - RNA, 22 nt, Human
auguacugacuguacuuuuaaa

SEQ ID NO: 221503 - RNA, 22 nt, Human
auguaaugucaaucuucagugg

SEQ ID NO: 221504 - RNA, 22 nt, Human
augguuacgcccucacccuacc

SEQ ID NO: 221505 - RNA, 22 nt, Human
augauuaagguacgucauuucu

SEQ ID NO: 221506 - RNA, 22 nt, Human
augcaguuagguaauagucuca

SEQ ID NO: 221507 - RNA, 22 nt, Human
augaggccacaguuauagauuu

SEQ ID NO: 221508 - RNA, 21 nt, Human
augagguggcuacuaaagagu

SEQ ID NO: 221509 - RNA, 22 nt, Human
augaggagucaaggagucggag

SEQ ID NO: 221510 - RNA, 22 nt, Human
augaggauuagcaucugcaaau

SEQ ID NO: 221511 - RNA, 19 nt, Human
augaaauagcauuuucuga

SEQ ID NO: 221512 - RNA, 23 nt, Human
augaaaugauacuuuauucacug

SEQ ID NO: 221513 - RNA, 22 nt, Human
augaaaacggaccagagcuauu

SEQ ID NO: 221514 - RNA, 22 nt, Human
aucuuuguaaguaaucaaagcu

SEQ ID NO: 221515 - RNA, 22 nt, Human
augauaccacucaauagggcau

SEQ ID NO: 221516 - RNA, 22 nt, Human
augaguuaaguagcccuucaug

SEQ ID NO: 221517 - RNA, 22 nt, Human
augcaaaaucuuauuuuuucua

SEQ ID NO: 221518 - RNA, 18 nt, Human
augauaauguuugcauca

SEQ ID NO: 221519 - RNA, 22 nt, Human
augaacuaagagucauuagugu

SEQ ID NO: 221520 - RNA, 22 nt, Human
augaacugcaguauaaacuugg

SEQ ID NO: 221521 - RNA, 22 nt, Human
aucuguggguaaggauaagcau

SEQ ID NO: 221522 - RNA, 22 nt, Human
aucuguuccccuaugcucucua

SEQ ID NO: 221523 - RNA, 22 nt, Human
aucugugauuuuggcaagauuu

SEQ ID NO: 221524 - RNA, 22 nt, Human
augaaugccggucucgggggaa

SEQ ID NO: 221525 - RNA, 22 nt, Human
augaagguggacagauuuuuuu

SEQ ID NO: 221526 - RNA, 22 nt, Human
augaaggauagggcaaaauuuu

SEQ ID NO: 221527 - RNA, 22 nt, Human
aucuuuuuucacaauuuauuuu

SEQ ID NO: 221528 - RNA, 22 nt, Human
augaguaaguucugauuagauu

SEQ ID NO: 221529 - RNA, 22 nt, Human
aucuuggccuucuccuggagug

SEQ ID NO: 221530 - RNA, 22 nt, Human
augaggguggggaaugggccau

SEQ ID NO: 221531 - RNA, 22 nt, Human
augagugugugguucuaaauga

SEQ ID NO: 221532 - RNA, 22 nt, Human
aucuuugauuuuggcuuuuagg

SEQ ID NO: 221533 - RNA, 19 nt, Human
aucuuucagcagcuccccu

SEQ ID NO: 221534 - RNA, 22 nt, Human
augacagcucuagcacacagua

SEQ ID NO: 221535 - RNA, 22 nt, Human
augacugaugcugacucauggg

SEQ ID NO: 221536 - RNA, 22 nt, Human
augaccuucuuuccuuaaauuu

SEQ ID NO: 221537 - RNA, 22 nt, Human
augacagcuaaggaauguguag

SEQ ID NO: 221538 - RNA, 22 nt, Human
augaagugcccugggggccaga

SEQ ID NO: 221539 - RNA, 22 nt, Human
aucguggcacgucgccgcagcg

SEQ ID NO: 221540 - RNA, 22 nt, Human
aucggggaaugaccuuuucauu

SEQ ID NO: 221541 - RNA, 21 nt, Human
aucugugucauuagguggcag

SEQ ID NO: 221542 - RNA, 22 nt, Human
aucuuagagagucguguuuugu

SEQ ID NO: 221543 - RNA, 20 nt, Human
aucuuaucuaucuuuuguuc

SEQ ID NO: 221544 - RNA, 22 nt, Human
aucuacuuugggaguuucucuu

SEQ ID NO: 221545 - RNA, 22 nt, Human
aucuucaaggacgccaagaucc

SEQ ID NO: 221546 - RNA, 22 nt, Human
aucuucucucucaucaggauca

SEQ ID NO: 221547 - RNA, 22 nt, Human
aucuugaaacauauaugcauuu

SEQ ID NO: 221548 - RNA, 22 nt, Human
aucucaaagauaugcugguaaa

SEQ ID NO: 221549 - RNA, 22 nt, Human
aucuccagcagugcuuuugagc

SEQ ID NO: 221550 - RNA, 22 nt, Human
aucuuugccuuuaugccucuag

SEQ ID NO: 221551 - RNA, 22 nt, Human
aucuuguuagaaggcaguaggu

SEQ ID NO: 221552 - RNA, 22 nt, Human
aucucuguaaaccauaaauuga

SEQ ID NO: 221553 - RNA, 22 nt, Human
aucuuggauccuuugccagcuu

SEQ ID NO: 221554 - RNA, 20 nt, Human
aucugugaugagaacgguuu

SEQ ID NO: 221555 - RNA, 22 nt, Human
aucugugguacaugacggcugc

SEQ ID NO: 221556 - RNA, 22 nt, Human
aucugcuguaguuggugccagu

SEQ ID NO: 221557 - RNA, 18 nt, Human
auccuuugaucaucuguc

SEQ ID NO: 221558 - RNA, 18 nt, Human
auccuucggccuagugga

SEQ ID NO: 221559 - RNA, 22 nt, Human
auccuugacuguagugauauua

SEQ ID NO: 221560 - RNA, 22 nt, Human
aucugacaaccuauugacuuga

SEQ ID NO: 221561 - RNA, 22 nt, Human
aucugcauguggcagguggauu

SEQ ID NO: 221562 - RNA, 22 nt, Human
aucugcugccuaggguuugucu

SEQ ID NO: 221563 - RNA, 22 nt, Human
auccugugggguauugcugcau

SEQ ID NO: 221564 - RNA, 22 nt, Human
auccuggcuuuccugauuuacu

SEQ ID NO: 221565 - RNA, 20 nt, Human
auccuggucuuuggaagcuu

SEQ ID NO: 221566 - RNA, 22 nt, Human
aucuccaguuagcaguacugau

SEQ ID NO: 221567 - RNA, 21 nt, Human
aucucaguccugggaaugauu

SEQ ID NO: 221568 - RNA, 22 nt, Human
auuuuuagagugaaagaauuaa

SEQ ID NO: 221569 - RNA, 22 nt, Human
auuuuguugaaacccuuguugu

SEQ ID NO: 221570 - RNA, 22 nt, Human
caaaauuguugaugcugcuuug

SEQ ID NO: 221571 - RNA, 22 nt, Human
caaaugcaguggucgugcugga

SEQ ID NO: 221572 - RNA, 22 nt, Human
caaaugaugcauggcuagugag

SEQ ID NO: 221573 - RNA, 22 nt, Human
caaauacguuuggcuggagcac

SEQ ID NO: 221574 - RNA, 22 nt, Human
caaaguauuuagcugacucgcu

SEQ ID NO: 221575 - RNA, 22 nt, Human
caaaaauacuugccuguaucug

SEQ ID NO: 221576 - RNA, 22 nt, Human
caaaaaauccauagaaagaggu

SEQ ID NO: 221577 - RNA, 22 nt, Human
auuuuugguuauaaaauaguuu

SEQ ID NO: 221578 - RNA, 22 nt, Human
caaauuuuuauuuaccaucugc

SEQ ID NO: 221579 - RNA, 22 nt, Human
caaccucuaucggucaggaagc

SEQ ID NO: 221580 - RNA, 22 nt, Human
caaauggggaauagaugauggg

SEQ ID NO: 221581 - RNA, 22 nt, Human
caaaucuguuaauuucaaguug

SEQ ID NO: 221582 - RNA, 22 nt, Human
auuuuugguuucaccugcacgc

SEQ ID NO: 221583 - RNA, 19 nt, Human
auuuugguucuuuccauuc

SEQ ID NO: 221584 - RNA, 23 nt, Human
auuuuuccacacacagacucagu

SEQ ID NO: 221585 - RNA, 22 nt, Human
auuuuuucaugugugguugaga

SEQ ID NO: 221586 - RNA, 22 nt, Human
auuuuuaucuaaaauccacuuu

SEQ ID NO: 221587 - RNA, 22 nt, Human
auuuuuagucuugcugcaauca

SEQ ID NO: 221588 - RNA, 22 nt, Human
auuuugcuuuucuaguggguuu

SEQ ID NO: 221589 - RNA, 22 nt, Human
auuuuucacauuuugggggaca

SEQ ID NO: 221590 - RNA, 22 nt, Human
auuuucgcaccucgcgaguugc

SEQ ID NO: 221591 - RNA, 22 nt, Human
auuuucauauggguuauuugua

SEQ ID NO: 221592 - RNA, 22 nt, Human
auuuuauuuugggaucuuuuua

SEQ ID NO: 221593 - RNA, 22 nt, Human
auuuuagagaaacaaacguagg

SEQ ID NO: 221594 - RNA, 22 nt, Human
auuuccugugaacuuuucugau

SEQ ID NO: 221595 - RNA, 19 nt, Human
auuuccuggcauauaucac

SEQ ID NO: 221596 - RNA, 22 nt, Human
auuuucuucauuuugauuguau

SEQ ID NO: 221597 - RNA, 22 nt, Human
auugacagaaaauuggauggca

SEQ ID NO: 221598 - RNA, 22 nt, Human
auuguuuccccggaauuauuca

SEQ ID NO: 221599 - RNA, 22 nt, Human
auugaaguguacguuugaucua

SEQ ID NO: 221600 - RNA, 19 nt, Human
auugguuugcucgggaaug

SEQ ID NO: 221601 - RNA, 22 nt, Human
auugaagcauggagaugaggca

SEQ ID NO: 221602 - RNA, 19 nt, Human
auucuucucuuccugcugu

SEQ ID NO: 221603 - RNA, 20 nt, Human
auucuuguuccauuucccag

SEQ ID NO: 221604 - RNA, 22 nt, Human
auuggccaguggacagcgccgu

SEQ ID NO: 221605 - RNA, 22 nt, Human
auugguuucuuguggguuaucc

SEQ ID NO: 221606 - RNA, 22 nt, Human
auugccauaauagagccaugua

SEQ ID NO: 221607 - RNA, 22 nt, Human
auuuauccuugggguagagcca

SEQ ID NO: 221608 - RNA, 22 nt, Human
auugcaggucguguggaaguga

SEQ ID NO: 221609 - RNA, 22 nt, Human
auugaugccugaaaaauaugua

SEQ ID NO: 221610 - RNA, 22 nt, Human
auugaguauuguaaauaaaaca

SEQ ID NO: 221611 - RNA, 22 nt, Human
auuuaagugagucuuuaaaaua

SEQ ID NO: 221612 - RNA, 18 nt, Human
auugagcaugacagaccu

SEQ ID NO: 221613 - RNA, 22 nt, Human
auugagaugcuuaaaucuucac

SEQ ID NO: 221614 - RNA, 22 nt, Human
auugagaaaauucgagcaaguu

SEQ ID NO: 221615 - RNA, 22 nt, Human
auugacuuucccuucuccucau

SEQ ID NO: 221616 - RNA, 22 nt, Human
auuugccaguuacucacaccac

SEQ ID NO: 221617 - RNA, 22 nt, Human
auuugcaucagugagcgaugug

SEQ ID NO: 221618 - RNA, 22 nt, Human
auuguucuagaauuuuuuuucc

SEQ ID NO: 221619 - RNA, 22 nt, Human
auuugaaguauaaguaauugcu

SEQ ID NO: 221620 - RNA, 22 nt, Human
auuguagucuggacuuuuggga

SEQ ID NO: 221621 - RNA, 22 nt, Human
auuuauauauuuuguucuggua

SEQ ID NO: 221622 - RNA, 22 nt, Human
auuuagacaacaagccuucucc

SEQ ID NO: 221623 - RNA, 22 nt, Human
auuuaaguuacuucucuuuccu

SEQ ID NO: 221624 - RNA, 22 nt, Human
auuuaagacuguggugcaguuu

SEQ ID NO: 221625 - RNA, 22 nt, Human
auuuggucuguaauuacaugga

SEQ ID NO: 221626 - RNA, 22 nt, Human
auuuccagcagcauauuugucu

SEQ ID NO: 221627 - RNA, 22 nt, Human
auuucccugcagugcuuaggaa

SEQ ID NO: 221628 - RNA, 22 nt, Human
auucuaugaaugacuguuagau

SEQ ID NO: 221629 - RNA, 20 nt, Human
auucucaccaugugacaugg

SEQ ID NO: 221630 - RNA, 17 nt, Human
auucuaguuggcuuuuu

SEQ ID NO: 221631 - RNA, 22 nt, Human
auucucauguuaccaaauucua

SEQ ID NO: 221632 - RNA, 22 nt, Human
auucucauguuuuaaaaaaguu

SEQ ID NO: 221633 - RNA, 22 nt, Human
auucucugaugcagguggaaga

SEQ ID NO: 221634 - RNA, 22 nt, Human
auuaugugagggacuuaaucau

SEQ ID NO: 221635 - RNA, 22 nt, Human
auuaugcagcugccuccaaggu

SEQ ID NO: 221636 - RNA, 22 nt, Human
auuaugaauuguguuacgaaga

SEQ ID NO: 221637 - RNA, 23 nt, Human
auuaugaagaagacucgccuguu

SEQ ID NO: 221638 - RNA, 22 nt, Human
auuaucuauccgccaacaguaa

SEQ ID NO: 221639 - RNA, 22 nt, Human
auucgcggcuugaucugcuugc

SEQ ID NO: 221640 - RNA, 22 nt, Human
auucuaauaagcguuuugucgc

SEQ ID NO: 221641 - RNA, 22 nt, Human
auuccuguggcuggguaaagua

SEQ ID NO: 221642 - RNA, 22 nt, Human
auucccuuugacgaucccuagg

SEQ ID NO: 221643 - RNA, 21 nt, Human
auuaagacaauggcaaugggu

SEQ ID NO: 221644 - RNA, 22 nt, Human
auuaacaggcucuguucuaguu

SEQ ID NO: 221645 - RNA, 22 nt, Human
auguuguugaacucuuugcaug

SEQ ID NO: 221646 - RNA, 22 nt, Human
auguugcugauccuguggcugu

SEQ ID NO: 221647 - RNA, 22 nt, Human
auguuguuuauggguuaucaag

SEQ ID NO: 221648 - RNA, 23 nt, Human
auuauuucaggguuuugacuugc

SEQ ID NO: 221649 - RNA, 22 nt, Human
auuauugcaagcagugaaggga

SEQ ID NO: 221650 - RNA, 22 nt, Human
auucaagauaagggucugggag

SEQ ID NO: 221651 - RNA, 21 nt, Human
auucugaguugucagucuuca

SEQ ID NO: 221652 - RNA, 22 nt, Human
auucugaagcagaaaaggcaga

SEQ ID NO: 221653 - RNA, 22 nt, Human
auucugcauuucuaaccagguc

SEQ ID NO: 221654 - RNA, 22 nt, Human
auucugcaauaaucaguccuua

SEQ ID NO: 221655 - RNA, 22 nt, Human
auucuguaggcuuuuguuaaaa

SEQ ID NO: 221656 - RNA, 22 nt, Human
auucuguuuaauacacgaaagg

SEQ ID NO: 221657 - RNA, 22 nt, Human
auucuguugguuuaauagucaa

SEQ ID NO: 221658 - RNA, 22 nt, Human
auucuuauaaaaaguguugacu

SEQ ID NO: 221659 - RNA, 22 nt, Human
auucauuuuuacaucaccaaua

SEQ ID NO: 221660 - RNA, 18 nt, Human
auucauuugcguuuggcu

SEQ ID NO: 221661 - RNA, 22 nt, Human
auucucuauugguaaauuugac

SEQ ID NO: 221662 - RNA, 22 nt, Human
auugacagagguguaguugaga

SEQ ID NO: 221663 - RNA, 22 nt, Human
auugaauuagauguuguagucc

SEQ ID NO: 221664 - RNA, 22 nt, Human
auugaaauuugcuuccucacug

SEQ ID NO: 221665 - RNA, 22 nt, Human
auucguguauauacacauccac

SEQ ID NO: 221666 - RNA, 22 nt, Human
auucgaucacugccgaggaccu

SEQ ID NO: 221667 - RNA, 22 nt, Human
auucuucauguugaagcuguca

SEQ ID NO: 221668 - RNA, 22 nt, Human
auuccccagcaggccuuuuguu

SEQ ID NO: 221669 - RNA, 22 nt, Human
auucccucaagagacccacagc

SEQ ID NO: 221670 - RNA, 22 nt, Human
auuccguuuuaaaaccuuaagc

SEQ ID NO: 221671 - RNA, 22 nt, Human
auucuuuucucuaaaugaugaa

SEQ ID NO: 221672 - RNA, 22 nt, Human
auucuacgcuccgucucuauca

SEQ ID NO: 221673 - RNA, 22 nt, Human
auucuacucuccuacaggucua

SEQ ID NO: 221674 - RNA, 22 nt, Human
auucuuuagaguccuucaaaua

SEQ ID NO: 221675 - RNA, 22 nt, Human
auucuugauauagauaguuaau

SEQ ID NO: 221676 - RNA, 23 nt, Human
auugccuguagaucuucacuuuc

SEQ ID NO: 221677 - RNA, 21 nt, Human
auuggcagaucucuggauugu

SEQ ID NO: 221678 - RNA, 22 nt, Human
auuggaagacgcuggaggcacu

SEQ ID NO: 221679 - RNA, 22 nt, Human
auugaaauuaauuucugcuuuc

SEQ ID NO: 221680 - RNA, 17 nt, Human
auucuuauacucuguga

SEQ ID NO: 221681 - RNA, 22 nt, Human
auugaugaaaauaguuauuuua

SEQ ID NO: 221682 - RNA, 22 nt, Human
auugaguucaccucuuucagaa

SEQ ID NO: 221683 - RNA, 22 nt, Human
auugauuuugugcuuuccuacg

SEQ ID NO: 221684 - RNA, 19 nt, Human
auugcaguguaaaacuauu

SEQ ID NO: 221685 - RNA, 22 nt, Human
auucugagaucucuucuaggcc

SEQ ID NO: 221686 - RNA, 22 nt, Human
auucucuguacagaagguaccg

SEQ ID NO: 221687 - RNA, 21 nt, Human
auucugauguuucuauuguuu

SEQ ID NO: 221688 - RNA, 22 nt, Human
auucugcugccuaguuuaugaa

SEQ ID NO: 221689 - RNA, 20 nt, Human
auucuguguaaauguccugu

SEQ ID NO: 221690 - RNA, 22 nt, Human
auucuguuuuaccauuuucuuu

SEQ ID NO: 221691 - RNA, 22 nt, Human
auugagacugaaauuacugaag

SEQ ID NO: 221692 - RNA, 22 nt, Human
auugagcuguugaagucccaca

SEQ ID NO: 221693 - RNA, 22 nt, Human
uuuguguuacaguccuagaacu

SEQ ID NO: 221694 - RNA, 22 nt, Human
uuuguggaaaagagcccaggag

SEQ ID NO: 221695 - RNA, 22 nt, Human
uuucuuccuucuugaucauuug

SEQ ID NO: 221696 - RNA, 22 nt, Human
uuucugugguggguaguucaga

SEQ ID NO: 221697 - RNA, 22 nt, Human
uuucugguuuuauucugggguu

SEQ ID NO: 221698 - RNA, 22 nt, Human
uuucuguugugaccugacucuu

SEQ ID NO: 221699 - RNA, 22 nt, Human
uuucuuugcugguuggcucucc

SEQ ID NO: 221700 - RNA, 18 nt, Human
uuucuuuuauuccagguc

SEQ ID NO: 221701 - RNA, 22 nt, Human
uuucuggaaacuguaaagagga

SEQ ID NO: 221702 - RNA, 22 nt, Human
uuucuggauaagcagggucucu

SEQ ID NO: 221703 - RNA, 23 nt, Human
uuucugaguuuuuuaaaagucca

SEQ ID NO: 221704 - RNA, 22 nt, Human
uuucugcauuuguauuggaaaa

SEQ ID NO: 221705 - RNA, 17 nt, Human
uuucugcaugauuggac

SEQ ID NO: 221706 - RNA, 20 nt, Human
uuucucccacaaugacccuc

SEQ ID NO: 221707 - RNA, 22 nt, Human
uuucuauuuacagugcuaggua

SEQ ID NO: 221708 - RNA, 19 nt, Human
uuucucacugagucguuug

SEQ ID NO: 221709 - RNA, 22 nt, Human
uuucucuuguauuugaaucacu

SEQ ID NO: 221710 - RNA, 22 nt, Human
uuucucuuucaaucugcaguac

SEQ ID NO: 221711 - RNA, 22 nt, Human
uuuccuuuguuuugguauaugu

SEQ ID NO: 221712 - RNA, 22 nt, Human
uuuccuuacuuauaaaaugggg

SEQ ID NO: 221713 - RNA, 22 nt, Human
uuuccuguccugguacuuggca

SEQ ID NO: 221714 - RNA, 22 nt, Human
uuuccugcagacaguuuaagca

SEQ ID NO: 221715 - RNA, 18 nt, Human
uuuccucauuugcagacu

SEQ ID NO: 221716 - RNA, 22 nt, Human
uuucuaaguuugaggcgaagca

SEQ ID NO: 221717 - RNA, 22 nt, Human
uuucuaacacccuccuuccaga

SEQ ID NO: 221718 - RNA, 21 nt, Human
uuucauuaguacaucaauuug

SEQ ID NO: 221719 - RNA, 22 nt, Human
uuuccaguuguucuagaaagcu

SEQ ID NO: 221720 - RNA, 21 nt, Human
uuuccagaggcagccggacuc

SEQ ID NO: 221721 - RNA, 22 nt, Human
uuuccaguaaguggcaaggagc

SEQ ID NO: 221722 - RNA, 22 nt, Human
uuucagauuauguucauggguu

SEQ ID NO: 221723 - RNA, 22 nt, Human
uuucacagcgucuuucucuugc

SEQ ID NO: 221724 - RNA, 22 nt, Human
uuucagacugcccauguuugcc

SEQ ID NO: 221725 - RNA, 22 nt, Human
uuucagcaugacuguuaucuuu

SEQ ID NO: 221726 - RNA, 22 nt, Human
uuucagguggaaguuuuagaug

SEQ ID NO: 221727 - RNA, 22 nt, Human
uuucaucccugucagugaaggc

SEQ ID NO: 221728 - RNA, 22 nt, Human
uuucauagaggcagcggcggau

SEQ ID NO: 221729 - RNA, 22 nt, Human
uuugcuuugacuuugggaguau

SEQ ID NO: 221730 - RNA, 22 nt, Human
uuuggaugcugucauaugcugc

SEQ ID NO: 221731 - RNA, 22 nt, Human
uuuggcuacucuucauugguga

SEQ ID NO: 221732 - RNA, 22 nt, Human
uuuggcuccccaggaucugaaa

SEQ ID NO: 221733 - RNA, 22 nt, Human
uuuggcugucauuugaaaaugu

SEQ ID NO: 221734 - RNA, 22 nt, Human
uuugggcuuuguuuuaagguau

SEQ ID NO: 221735 - RNA, 22 nt, Human
uuugggguuuuuuggugaaauc

SEQ ID NO: 221736 - RNA, 22 nt, Human
uuugucaggaauugaaaaguuu

SEQ ID NO: 221737 - RNA, 22 nt, Human
uuuguauuucaaggcacucuca

SEQ ID NO: 221738 - RNA, 22 nt, Human
uuuguauuguuuauuucauuuu

SEQ ID NO: 221739 - RNA, 23 nt, Human
uuugucaucccucucacuuucug

SEQ ID NO: 221740 - RNA, 22 nt, Human
uuuggucaucaaagacaaguaa

SEQ ID NO: 221741 - RNA, 22 nt, Human
uuuggguauuaguuuagcuaga

SEQ ID NO: 221742 - RNA, 22 nt, Human
uuugguaccucucgucacaaug

SEQ ID NO: 221743 - RNA, 20 nt, Human
uuugguuggcuaggggaagc

SEQ ID NO: 221744 - RNA, 22 nt, Human
uuuggugacuguaggaaaggau

SEQ ID NO: 221745 - RNA, 20 nt, Human
uuugauugccccucugacuu

SEQ ID NO: 221746 - RNA, 22 nt, Human
uuugauuuuguuuauagugccg

SEQ ID NO: 221747 - RNA, 22 nt, Human
uuugcauuaguuuagauuucaa

SEQ ID NO: 221748 - RNA, 22 nt, Human
uuugcaaaguccauugaaguua

SEQ ID NO: 221749 - RNA, 23 nt, Human
uuugccuaaugaagacuauguca

SEQ ID NO: 221750 - RNA, 19 nt, Human
uuugccugugguucagaag

SEQ ID NO: 221751 - RNA, 22 nt, Human
uuugcugaaaaaccacuugagu

SEQ ID NO: 221752 - RNA, 22 nt, Human
uuugaauauuaugucccacuuu

SEQ ID NO: 221753 - RNA, 22 nt, Human
uuugacaccaggagagaaaaca

SEQ ID NO: 221754 - RNA, 22 nt, Human
uuugaagauaaauauggagaaa

SEQ ID NO: 221755 - RNA, 22 nt, Human
uuugagaagauaggggaauacu

SEQ ID NO: 221756 - RNA, 22 nt, Human
uuugaguaagauguugauacug

SEQ ID NO: 221757 - RNA, 22 nt, Human
uuugaguacagcugccuuuuug

SEQ ID NO: 221758 - RNA, 22 nt, Human
uuugaugauuuucuagagugua

SEQ ID NO: 221759 - RNA, 22 nt, Human
uuugaugagaaaugacuuaagu

SEQ ID NO: 221760 - RNA, 22 nt, Human
uuuaauuauaucugggcaguua

SEQ ID NO: 221761 - RNA, 22 nt, Human
uuuacaagucuguugaucccaa

SEQ ID NO: 221762 - RNA, 22 nt, Human
uuguugcuguugaacccugcug

SEQ ID NO: 221763 - RNA, 22 nt, Human
uuguuguuguuguuauuuaguu

SEQ ID NO: 221764 - RNA, 22 nt, Human
uuguuuaaagaacuucugacuu

SEQ ID NO: 221765 - RNA, 22 nt, Human
uuguuccuuucuucuguagucg

SEQ ID NO: 221766 - RNA, 22 nt, Human
uuguuauuauuauuuucguucu

SEQ ID NO: 221767 - RNA, 23 nt, Human
uugugguuauauuugcccauuuu

SEQ ID NO: 221768 - RNA, 22 nt, Human
uuguuauaggaucagugucacu

SEQ ID NO: 221769 - RNA, 22 nt, Human
uuguguuuaaucuguuccacua

SEQ ID NO: 221770 - RNA, 22 nt, Human
uuuaccuuauguaaauaagagu

SEQ ID NO: 221771 - RNA, 22 nt, Human
uuuagaugcuguauguuauuuc

SEQ ID NO: 221772 - RNA, 19 nt, Human
uuuagcuacugugguauua

SEQ ID NO: 221773 - RNA, 22 nt, Human
uuuagcaaaaaagcucugcgua

SEQ ID NO: 221774 - RNA, 20 nt, Human
uuuagcacauuguacaaaac

SEQ ID NO: 221775 - RNA, 22 nt, Human
uuuauauauauguaggagcaca

SEQ ID NO: 221776 - RNA, 22 nt, Human
uuuauaaacacaagaugggcuc

SEQ ID NO: 221777 - RNA, 22 nt, Human
uuuauguuuguuuuugaaauaa

SEQ ID NO: 221778 - RNA, 22 nt, Human
uuuauucacuuaucaggaacga

SEQ ID NO: 221779 - RNA, 22 nt, Human
uuuaugguacaggaaugcuguu

SEQ ID NO: 221780 - RNA, 22 nt, Human
uuuaugauguagccuagagcug

SEQ ID NO: 221781 - RNA, 22 nt, Human
uuuauuuagguaaacaugaguu

SEQ ID NO: 221782 - RNA, 22 nt, Human
uuuauuuggugguguuacuguu

SEQ ID NO: 221783 - RNA, 22 nt, Human
uuuauugaccugaguaucagca

SEQ ID NO: 221784 - RNA, 22 nt, Human
uuuauuuacuuucgguucugcu

SEQ ID NO: 221785 - RNA, 22 nt, Human
uuucacuucgaucagaguuuuu

SEQ ID NO: 221786 - RNA, 22 nt, Human
uuucacauacaguguauaguag

SEQ ID NO: 221787 - RNA, 22 nt, Human
uuuauuuuccaugucucuaggu

SEQ ID NO: 221788 - RNA, 22 nt, Human
uuucaaguagagggaucgcuag

SEQ ID NO: 221789 - RNA, 22 nt, Human
uugucaugauccuucuguuagg

SEQ ID NO: 221790 - RNA, 23 nt, Human
uugugcggugcuuuggguuuaca

SEQ ID NO: 221791 - RNA, 22 nt, Human
uugugccuuaauauaggcgcug

SEQ ID NO: 221792 - RNA, 22 nt, Human
uugugcauuugcuaugggccau

SEQ ID NO: 221793 - RNA, 22 nt, Human
uuguggagaggaagcaaggagg

SEQ ID NO: 221794 - RNA, 22 nt, Human
uugugauuaauaacuuuucucu

SEQ ID NO: 221795 - RNA, 22 nt, Human
uugugcauuuuguuuuacuuau

SEQ ID NO: 221796 - RNA, 22 nt, Human
uuggggaggaagauagggugaa

SEQ ID NO: 221797 - RNA, 22 nt, Human
uugguuaccuucagaaaugagu

SEQ ID NO: 221798 - RNA, 22 nt, Human
uugguguaauacaagcaauuug

SEQ ID NO: 221799 - RNA, 22 nt, Human
uuggugauugggaauggauggg

SEQ ID NO: 221800 - RNA, 22 nt, Human
uuguaagacuguagaaugcaaa

SEQ ID NO: 221801 - RNA, 22 nt, Human
uugguuuuuugguguaucuuau

SEQ ID NO: 221802 - RNA, 22 nt, Human
uuggggaauuuggggccguccg

SEQ ID NO: 221803 - RNA, 22 nt, Human
uugggcuagaaacaacgugggu

SEQ ID NO: 221804 - RNA, 22 nt, Human
uuggcuucuugcuaggaagcug

SEQ ID NO: 221805 - RNA, 22 nt, Human
uugggaaauuugaaaauaaaag

SEQ ID NO: 221806 - RNA, 20 nt, Human
uugggaagccuacaccauuc

SEQ ID NO: 221807 - RNA, 22 nt, Human
uuggccguuucacugggcaguu

SEQ ID NO: 221808 - RNA, 22 nt, Human
uuggcgcuauuauuaccacauu

SEQ ID NO: 221809 - RNA, 22 nt, Human
uuggcguuuccuguucugggug

SEQ ID NO: 221810 - RNA, 22 nt, Human
uuggcuguguugaaaacgugga

SEQ ID NO: 221811 - RNA, 22 nt, Human
uuggauguggggauggaguggg

SEQ ID NO: 221812 - RNA, 22 nt, Human
uuggauugugaaaguauucucu

SEQ ID NO: 221813 - RNA, 22 nt, Human
uuggccauuacugagccuggag

SEQ ID NO: 221814 - RNA, 22 nt, Human
uugauuggguauaaugacagga

SEQ ID NO: 221815 - RNA, 21 nt, Human
uugauuuagcagaucuagcug

SEQ ID NO: 221816 - RNA, 22 nt, Human
uugauuugcagaagguguagag

SEQ ID NO: 221817 - RNA, 22 nt, Human
uugaccagaaaaguuaguaauu

SEQ ID NO: 221818 - RNA, 22 nt, Human
uuuuuugucuugaagaaauggu

SEQ ID NO: 221819 - RNA, 22 nt, Human
uuuuuuuccaguuauucauuuu

SEQ ID NO: 221820 - RNA, 22 nt, Human
uugauaacuuagcugggcugcu

SEQ ID NO: 221821 - RNA, 22 nt, Human
uugagacucgagucucucagac

SEQ ID NO: 221822 - RNA, 22 nt, Human
uugagauggccuuuuuuauacu

SEQ ID NO: 221823 - RNA, 22 nt, Human
uugaugacauuuagcauaauug

SEQ ID NO: 221824 - RNA, 22 nt, Human
uugaugagucacuuucuguaaa

SEQ ID NO: 221825 - RNA, 22 nt, Human
uugaugacuaaagaaagcugcu

SEQ ID NO: 221826 - RNA, 22 nt, Human
uugaauaaggcauaaagauacu

SEQ ID NO: 221827 - RNA, 22 nt, Human
uugaauaguuuuggauagcaua

SEQ ID NO: 221828 - RNA, 20 nt, Human
uuuuuuaaauagagcuguug

SEQ ID NO: 221829 - RNA, 22 nt, Human
uugaauuuagguuuaugugaaa

SEQ ID NO: 221830 - RNA, 22 nt, Human
uuuuuuccugguuacagauugu

SEQ ID NO: 221831 - RNA, 22 nt, Human
uugaacaguuuugucagguuca

SEQ ID NO: 221832 - RNA, 22 nt, Human
uuuuuggacccaucuucuuuuu

SEQ ID NO: 221833 - RNA, 22 nt, Human
uuuuuguaaaugaaguuuuauu

SEQ ID NO: 221834 - RNA, 22 nt, Human
uugaaggugggaggauuuauau

SEQ ID NO: 221835 - RNA, 21 nt, Human
uugaaguggguagcuggcggg

SEQ ID NO: 221836 - RNA, 22 nt, Human
uuuuugaauaagugcaucauca

SEQ ID NO: 221837 - RNA, 22 nt, Human
uuuuucuuugcuuuccacuggc

SEQ ID NO: 221838 - RNA, 22 nt, Human
uucuuugcccauguuuccuaag

SEQ ID NO: 221839 - RNA, 22 nt, Human
uugaaaaaaucugaggaggacc

SEQ ID NO: 221840 - RNA, 22 nt, Human
uucuuuuaauuucugucugcag

SEQ ID NO: 221841 - RNA, 22 nt, Human
uuuuugcccuaaagaagucauu

SEQ ID NO: 221842 - RNA, 22 nt, Human
uucuuuuaauagagauccugug

SEQ ID NO: 221843 - RNA, 22 nt, Human
uucuucauucccuuacuuccga

SEQ ID NO: 221844 - RNA, 22 nt, Human
uucuucuguuggcagagcauac

SEQ ID NO: 221845 - RNA, 22 nt, Human
uuuuguggacugauccgaggac

SEQ ID NO: 221846 - RNA, 22 nt, Human
uuuugucuguggaaagcugcua

SEQ ID NO: 221847 - RNA, 22 nt, Human
uucuucuucuuccucauccuca

SEQ ID NO: 221848 - RNA, 22 nt, Human
uucuugcuucucugucugccuc

SEQ ID NO: 221849 - RNA, 22 nt, Human
uucuuggcacagaugagauucu

SEQ ID NO: 221850 - RNA, 22 nt, Human
uuuuccuucuuccugccuugcc

SEQ ID NO: 221851 - RNA, 22 nt, Human
uuuucuacaaaucuggacuuuu

SEQ ID NO: 221852 - RNA, 22 nt, Human
uuuucucacugagagccuugau

SEQ ID NO: 221853 - RNA, 22 nt, Human
uuuucuacaaucacucuggaag

SEQ ID NO: 221854 - RNA, 22 nt, Human
uuuugggugcaaauuguuuguu

SEQ ID NO: 221855 - RNA, 22 nt, Human
uuuugguauggcuugauagagu

SEQ ID NO: 221856 - RNA, 22 nt, Human
uucuguuuauaauuugcaguug

SEQ ID NO: 221857 - RNA, 22 nt, Human
uucugugacuccucagagauuu

SEQ ID NO: 221858 - RNA, 22 nt, Human
uuuugcaaauuacuaaauuucu

SEQ ID NO: 221859 - RNA, 22 nt, Human
uuuugccuauuguaucaucgua

SEQ ID NO: 221860 - RNA, 22 nt, Human
uucugugacgcaaagcugggaa

SEQ ID NO: 221861 - RNA, 22 nt, Human
uuuuacuuuucccacuuacagc

SEQ ID NO: 221862 - RNA, 22 nt, Human
uuuuagccagaguuuaucacag

SEQ ID NO: 221863 - RNA, 22 nt, Human
uuuuagagacagcauggagaaa

SEQ ID NO: 221864 - RNA, 23 nt, Human
uuuuacaagagugcauuugucuc

SEQ ID NO: 221865 - RNA, 22 nt, Human
uuuuaaucagguauuugaguau

SEQ ID NO: 221866 - RNA, 22 nt, Human
uucgucauuaugcagccuguga

SEQ ID NO: 221867 - RNA, 22 nt, Human
uuuuccuuccugucucuuuauu

SEQ ID NO: 221868 - RNA, 22 nt, Human
uuuucauuguuaguuucuccuu

SEQ ID NO: 221869 - RNA, 22 nt, Human
uuuuccgaccuuaggaaggaac

SEQ ID NO: 221870 - RNA, 22 nt, Human
uuuuaucagagcuugcagugug

SEQ ID NO: 221871 - RNA, 22 nt, Human
uuuuaucuuacauggaaucucc

SEQ ID NO: 221872 - RNA, 21 nt, Human
uucuauauugagaauuggcua

SEQ ID NO: 221873 - RNA, 21 nt, Human
uucgaaugggucguugcugcc

SEQ ID NO: 221874 - RNA, 23 nt, Human
uuuuaauaguaugacaugagcug

SEQ ID NO: 221875 - RNA, 22 nt, Human
uuuuaacuuuggguucucuuua

SEQ ID NO: 221876 - RNA, 22 nt, Human
uuuuaaauaaacuacacugauu

SEQ ID NO: 221877 - RNA, 22 nt, Human
uuuuaaaguaauugaagcuugu

SEQ ID NO: 221878 - RNA, 22 nt, Human
uuccuucccccuucuuugccuu

SEQ ID NO: 221879 - RNA, 22 nt, Human
uuccuuuuuaauuaaucuaauu

SEQ ID NO: 221880 - RNA, 21 nt, Human
uuccuggaggcagaaacguga

SEQ ID NO: 221881 - RNA, 22 nt, Human
uuccuggaguggagggagguga

SEQ ID NO: 221882 - RNA, 22 nt, Human
uuuguuuccagccuuuugucuu

SEQ ID NO: 221883 - RNA, 17 nt, Human
uuuguuucauacuucau

SEQ ID NO: 221884 - RNA, 22 nt, Human
uuuguuuauuuacuuugggccu

SEQ ID NO: 221885 - RNA, 22 nt, Human
uuuguuugcugagugaauucaa

SEQ ID NO: 221886 - RNA, 22 nt, Human
uuuguuuuggugucaugcguga

SEQ ID NO: 221887 - RNA, 22 nt, Human
uuccugcuggucaaaguugccu

SEQ ID NO: 221888 - RNA, 20 nt, Human
uuccucaaaagucugaugcu

SEQ ID NO: 221889 - RNA, 22 nt, Human
uuccucauuuggcacaucugag

SEQ ID NO: 221890 - RNA, 22 nt, Human
uuccucauucuggggcauguug

SEQ ID NO: 221891 - RNA, 22 nt, Human
uuccucauuuauaggaaagaga

SEQ ID NO: 221892 - RNA, 22 nt, Human
uuugugguuuugagagaguugc

SEQ ID NO: 221893 - RNA, 22 nt, Human
uuuguccuguuggcaugaaaau

SEQ ID NO: 221894 - RNA, 22 nt, Human
uuccacaugaucauuguaauaa

SEQ ID NO: 221895 - RNA, 22 nt, Human
uucaugucuuugauucugauaa

SEQ ID NO: 221896 - RNA, 22 nt, Human
uuccauggggcuguugcgcaga

SEQ ID NO: 221897 - RNA, 22 nt, Human
uuuguguuggaagaaaugcuac

SEQ ID NO: 221898 - RNA, 21 nt, Human
uuuguucaggggcaaaguuaa

SEQ ID NO: 221899 - RNA, 21 nt, Human
uuccauggacccugucagugu

SEQ ID NO: 221900 - RNA, 22 nt, Human
uucccaggugugagugagguga

SEQ ID NO: 221901 - RNA, 18 nt, Human
uuccauuuuucagucuuc

SEQ ID NO: 221902 - RNA, 22 nt, Human
uuccccgagccuggggaagcug

SEQ ID NO: 221903 - RNA, 21 nt, Human
uuuguucacacacagggcagc

SEQ ID NO: 221904 - RNA, 22 nt, Human
uuuguucaguuuguugugggug

SEQ ID NO: 221905 - RNA, 22 nt, Human
uuuguugguugcacuggugggu

SEQ ID NO: 221906 - RNA, 23 nt, Human
uuuguugguuuaagaguagcaga

SEQ ID NO: 221907 - RNA, 22 nt, Human
uuuguuguauuaacccagggua

SEQ ID NO: 221908 - RNA, 22 nt, Human
uucauauuuaauuggucaucaa

SEQ ID NO: 221909 - RNA, 22 nt, Human
uucauaugaauuggguuuuuuu

SEQ ID NO: 221910 - RNA, 22 nt, Human
uucaucauuuuccauuccucuu

SEQ ID NO: 221911 - RNA, 22 nt, Human
uucauacuguuuaaguucuguu

SEQ ID NO: 221912 - RNA, 22 nt, Human
uucaggugguuuaagaauugga

SEQ ID NO: 221913 - RNA, 22 nt, Human
uuuggcuuugauccuaggauuc

SEQ ID NO: 221914 - RNA, 22 nt, Human
uucaggacuauccaguggucuc

SEQ ID NO: 221915 - RNA, 22 nt, Human
uuuggcgucucucaggagcuca

SEQ ID NO: 221916 - RNA, 22 nt, Human
uuugcugggaagccuucacucu

SEQ ID NO: 221917 - RNA, 22 nt, Human
uuugccggaucugucuccagcu

SEQ ID NO: 221918 - RNA, 22 nt, Human
uuugcuguccaauauucagggu

SEQ ID NO: 221919 - RNA, 22 nt, Human
uuugcuguaaugcaugucagag

SEQ ID NO: 221920 - RNA, 22 nt, Human
uucagcugcuugccugaaguca

SEQ ID NO: 221921 - RNA, 23 nt, Human
uucagcucuccugaagcaucugu

SEQ ID NO: 221922 - RNA, 22 nt, Human
uucagcauaggcugcucuucaa

SEQ ID NO: 221923 - RNA, 22 nt, Human
uuagugucugacgcaggcgcca

SEQ ID NO: 221924 - RNA, 22 nt, Human
uuuauuugggauuucucaucug

SEQ ID NO: 221925 - RNA, 22 nt, Human
uuuauguugagcaaaauaccac

SEQ ID NO: 221926 - RNA, 22 nt, Human
uuaguuacuugacucaagaccc

SEQ ID NO: 221927 - RNA, 22 nt, Human
uucacaauuuuaaaaaguggaa

SEQ ID NO: 221928 - RNA, 20 nt, Human
uucacagaggacucagguca

SEQ ID NO: 221929 - RNA, 22 nt, Human
uucaaugcaagggaggucugaa

SEQ ID NO: 221930 - RNA, 22 nt, Human
uucaauuacaucagaaucuaaa

SEQ ID NO: 221931 - RNA, 22 nt, Human
uuugauuuuuugagcaguguau

SEQ ID NO: 221932 - RNA, 22 nt, Human
uuugccaucagaugugguaggu

SEQ ID NO: 221933 - RNA, 22 nt, Human
uucagaauguacugauagaaca

SEQ ID NO: 221934 - RNA, 22 nt, Human
uucagaagguaggaaugucccu

SEQ ID NO: 221935 - RNA, 22 nt, Human
uucacugacaguauugaggagg

SEQ ID NO: 221936 - RNA, 22 nt, Human
uucacguuguugaagaaaauac

SEQ ID NO: 221937 - RNA, 22 nt, Human
uucacccaaaucaagcuggccu

SEQ ID NO: 221938 - RNA, 22 nt, Human
uuggguguugguuccugggagg

SEQ ID NO: 221939 - RNA, 22 nt, Human
uguucuuaacuuuuguguauau

SEQ ID NO: 221940 - RNA, 22 nt, Human
uugggucagcuuucagguagua

SEQ ID NO: 221941 - RNA, 22 nt, Human
uuggggaugccccuacgggcua

SEQ ID NO: 221942 - RNA, 22 nt, Human
uuggggauugggugcaagggac

SEQ ID NO: 221943 - RNA, 19 nt, Human
uugguuuguugcuuaggug

SEQ ID NO: 221944 - RNA, 22 nt, Human
uugguuuuauucguauuuguau

SEQ ID NO: 221945 - RNA, 22 nt, Human
uugguugcugaugagcuuugag

SEQ ID NO: 221946 - RNA, 22 nt, Human
uugguuuacucuggggauaucu

SEQ ID NO: 221947 - RNA, 22 nt, Human
uugguauucaguuggauuugga

SEQ ID NO: 221948 - RNA, 22 nt, Human
uuguauuaauacacuccuuuuc

SEQ ID NO: 221949 - RNA, 22 nt, Human
uuguauguuucugugcacauga

SEQ ID NO: 221950 - RNA, 22 nt, Human
uuguaaguuuuagguguuucaa

SEQ ID NO: 221951 - RNA, 22 nt, Human
uugucaggaacuaugauuaugc

SEQ ID NO: 221952 - RNA, 22 nt, Human
uguuuguaugauggcacaucca

SEQ ID NO: 221953 - RNA, 22 nt, Human
uuguauuguuugcgucuguguu

SEQ ID NO: 221954 - RNA, 22 nt, Human
uugucagcuagugaugcuguuc

SEQ ID NO: 221955 - RNA, 22 nt, Human
uguuguucuuuuucuucuuguu

SEQ ID NO: 221956 - RNA, 22 nt, Human
uguuuaucaguagacucaaguu

SEQ ID NO: 221957 - RNA, 22 nt, Human
uguuuuuagcuguuuuuuggau

SEQ ID NO: 221958 - RNA, 22 nt, Human
uguuuuuauucuuaauguuuca

SEQ ID NO: 221959 - RNA, 18 nt, Human
uugugccugagaaggugg

SEQ ID NO: 221960 - RNA, 22 nt, Human
uugugcacauuucauugaccug

SEQ ID NO: 221961 - RNA, 22 nt, Human
uugugacuauuuuucauugaag

SEQ ID NO: 221962 - RNA, 22 nt, Human
uuguggcaggauggacagcaga

SEQ ID NO: 221963 - RNA, 22 nt, Human
uugugcucaguuguggucuauu

SEQ ID NO: 221964 - RNA, 22 nt, Human
uguuuuucaagcauuuauuaau

SEQ ID NO: 221965 - RNA, 22 nt, Human
uguuuucuauuaccugagauug

SEQ ID NO: 221966 - RNA, 22 nt, Human
uguuuucuuuccccuucuuuuc

SEQ ID NO: 221967 - RNA, 21 nt, Human
uguuuuguaauagauacuaug

SEQ ID NO: 221968 - RNA, 22 nt, Human
uguuuucccacugguuuguaca

SEQ ID NO: 221969 - RNA, 22 nt, Human
uguuuuguuuagguuuguuuuu

SEQ ID NO: 221970 - RNA, 19 nt, Human
uugucuuagcugcauaaga

SEQ ID NO: 221971 - RNA, 22 nt, Human
uugucaguggccugaggacaga

SEQ ID NO: 221972 - RNA, 22 nt, Human
uugucucuacagagaguaguag

SEQ ID NO: 221973 - RNA, 22 nt, Human
uugucuuggcauaccguuauau

SEQ ID NO: 221974 - RNA, 22 nt, Human
uugugaggaugugcuuuuuagu

SEQ ID NO: 221975 - RNA, 21 nt, Human
uugugaaaguccaggaacaac

SEQ ID NO: 221976 - RNA, 22 nt, Human
uugucuuucguauggaacacua

SEQ ID NO: 221977 - RNA, 22 nt, Human
uguguuccugucuuauucuuau

SEQ ID NO: 221978 - RNA, 21 nt, Human
uguguuuauauguguuuauau

SEQ ID NO: 221979 - RNA, 22 nt, Human
uguguuuuucauuuuaaguccu

SEQ ID NO: 221980 - RNA, 22 nt, Human
uguguuuaaacuauaugccugc

SEQ ID NO: 221981 - RNA, 22 nt, Human
uuggcaggcugcauguuuaugu

SEQ ID NO: 221982 - RNA, 22 nt, Human
uuggcagagaacagaaugauuu

SEQ ID NO: 221983 - RNA, 22 nt, Human
uuggcaaagagaugcauaagga

SEQ ID NO: 221984 - RNA, 22 nt, Human
uuggcaaaagauuggguacuua

SEQ ID NO: 221985 - RNA, 20 nt, Human
uuggggacaggagugugaug

SEQ ID NO: 221986 - RNA, 22 nt, Human
uuggggagaagagcuggucagg

SEQ ID NO: 221987 - RNA, 22 nt, Human
uugggagaaaguuaacuuucua

SEQ ID NO: 221988 - RNA, 22 nt, Human
uguucugauggauuacaugucu

SEQ ID NO: 221989 - RNA, 22 nt, Human
uguuccuggggaccugccuucc

SEQ ID NO: 221990 - RNA, 22 nt, Human
uguucggaaaagggcaagcuau

SEQ ID NO: 221991 - RNA, 23 nt, Human
uguuccugaugccucguccuguc

SEQ ID NO: 221992 - RNA, 22 nt, Human
uguucaguuugcuaucauaauc

SEQ ID NO: 221993 - RNA, 22 nt, Human
uguuaguauuggcaaauuuguu

SEQ ID NO: 221994 - RNA, 22 nt, Human
uuggaauuugagaccaagaaaa

SEQ ID NO: 221995 - RNA, 22 nt, Human
uuggacugguuuacauuucaag

SEQ ID NO: 221996 - RNA, 22 nt, Human
uugcggaucuucauggccucag

SEQ ID NO: 221997 - RNA, 22 nt, Human
uugccuguuugagagcuguguu

SEQ ID NO: 221998 - RNA, 22 nt, Human
uuggaagacagccgucuuuauu

SEQ ID NO: 221999 - RNA, 22 nt, Human
uguguguucauccccucaacau

SEQ ID NO: 222000 - RNA, 22 nt, Human
ugugugugugugugugugugug

SEQ ID NO: 222001 - RNA, 22 nt, Human
uguguguguuguaugaaauuuu

SEQ ID NO: 222002 - RNA, 22 nt, Human
uguguguguguguguguuugug

SEQ ID NO: 222003 - RNA, 22 nt, Human
uguguguguguguguaauauau

SEQ ID NO: 222004 - RNA, 22 nt, Human
ugugucgccaacaauugugucu

SEQ ID NO: 222005 - RNA, 22 nt, Human
ugugucauuugagaggagacga

SEQ ID NO: 222006 - RNA, 22 nt, Human
ugugucuuuggcgaugucugga

SEQ ID NO: 222007 - RNA, 22 nt, Human
uguguguguguguaugugcgug

SEQ ID NO: 222008 - RNA, 22 nt, Human
uuguuuuaguagaaguuacaug

SEQ ID NO: 222009 - RNA, 22 nt, Human
uuaaucuauuucauauaaggga

SEQ ID NO: 222010 - RNA, 22 nt, Human
uuuaaaacagcauuuaaaaggu

SEQ ID NO: 222011 - RNA, 22 nt, Human
uuaauauuaagauauugagugg

SEQ ID NO: 222012 - RNA, 22 nt, Human
uuaaucagacauucucaaguuu

SEQ ID NO: 222013 - RNA, 22 nt, Human
uuaauauuuauugguaaucacu

SEQ ID NO: 222014 - RNA, 22 nt, Human
uuguuuuaaaaagaauaacuac

SEQ ID NO: 222015 - RNA, 22 nt, Human
uuguuuguaaggcucuuagaau

SEQ ID NO: 222016 - RNA, 22 nt, Human
uuaaugcagguacuguuacaau

SEQ ID NO: 222017 - RNA, 22 nt, Human
uuaaugcauguaaaugugcaaa

SEQ ID NO: 222018 - RNA, 21 nt, Human
uuaaugcuaugcagaaaaucu

SEQ ID NO: 222019 - RNA, 22 nt, Human
uuuaaaccuaucuaagaaauag

SEQ ID NO: 222020 - RNA, 22 nt, Human
uuuaaauuucugaaucuugagg

SEQ ID NO: 222021 - RNA, 22 nt, Human
uuguuuggcaaaugugugugug

SEQ ID NO: 222022 - RNA, 22 nt, Human
uuguuucagcuuccuccuccau

SEQ ID NO: 222023 - RNA, 22 nt, Human
uuguugcaagccuggaaucugg

SEQ ID NO: 222024 - RNA, 22 nt, Human
uuguuccuaguuguccaucaca

SEQ ID NO: 222025 - RNA, 22 nt, Human
uuguuccuucuuuuuguaucag

SEQ ID NO: 222026 - RNA, 22 nt, Human
uuaaggcauagcuuguguugac

SEQ ID NO: 222027 - RNA, 22 nt, Human
uuguucacuaugaagagguugg

SEQ ID NO: 222028 - RNA, 22 nt, Human
uuaauaaauugugguaccagag

SEQ ID NO: 222029 - RNA, 22 nt, Human
uuaaguauauccauuugacugg

SEQ ID NO: 222030 - RNA, 22 nt, Human
uuguguugaagugguuagggcg

SEQ ID NO: 222031 - RNA, 20 nt, Human
uuguuagguucaguguuucc

SEQ ID NO: 222032 - RNA, 22 nt, Human
uuaaaucaggcaucauuucagu

SEQ ID NO: 222033 - RNA, 22 nt, Human
uuaacgaauugugcauaauucc

SEQ ID NO: 222034 - RNA, 22 nt, Human
uuaacauuguccuuagcagauu

SEQ ID NO: 222035 - RNA, 22 nt, Human
uuaacccagccauuuucaauuu

SEQ ID NO: 222036 - RNA, 22 nt, Human
uuacuguguguaaaauaucuuu

SEQ ID NO: 222037 - RNA, 22 nt, Human
uuacuuaucugaugugauuuuu

SEQ ID NO: 222038 - RNA, 22 nt, Human
uuuacuauuaguauuucauuuu

SEQ ID NO: 222039 - RNA, 18 nt, Human
uuuacgaacucacuugag

SEQ ID NO: 222040 - RNA, 22 nt, Human
uuuacuuguuuugcucuuuucc

SEQ ID NO: 222041 - RNA, 22 nt, Human
uuuagaaugaaugcaagagaau

SEQ ID NO: 222042 - RNA, 22 nt, Human
uuuaccucguuguguccuuguu

SEQ ID NO: 222043 - RNA, 22 nt, Human
uuuaccugucuguagaacauaa

SEQ ID NO: 222044 - RNA, 19 nt, Human
uuuaaugugugcugcaauc

SEQ ID NO: 222045 - RNA, 22 nt, Human
uuuaaugucuuggaaaaagacu

SEQ ID NO: 222046 - RNA, 22 nt, Human
uuuaauauuacacuuaccuugu

SEQ ID NO: 222047 - RNA, 22 nt, Human
uuuaacauaugaaagaauauuu

SEQ ID NO: 222048 - RNA, 18 nt, Human
uuuaauaagccuguuaug

SEQ ID NO: 222049 - RNA, 22 nt, Human
uuaauuguuagauagauuauag

SEQ ID NO: 222050 - RNA, 22 nt, Human
uuacaacgcacacagauuucac

SEQ ID NO: 222051 - RNA, 22 nt, Human
uuacaucacuuuacuuaauaau

SEQ ID NO: 222052 - RNA, 22 nt, Human
uuuaaucaauaaccuccugggu

SEQ ID NO: 222053 - RNA, 22 nt, Human
uuuaaugaugucuaugccuguu

SEQ ID NO: 222054 - RNA, 22 nt, Human
uuuaguauaguaugugcucaaa

SEQ ID NO: 222055 - RNA, 22 nt, Human
uuuagguuguguucuggcaugu

SEQ ID NO: 222056 - RNA, 22 nt, Human
uuuaggugucugcucauugaag

SEQ ID NO: 222057 - RNA, 22 nt, Human
uuagaugaaaaucggaacaugu

SEQ ID NO: 222058 - RNA, 22 nt, Human
uuagaaaaaggcuguggucuua

SEQ ID NO: 222059 - RNA, 22 nt, Human
uuacuguaggugggugaauuug

SEQ ID NO: 222060 - RNA, 22 nt, Human
uuacuuacagggggucaggcug

SEQ ID NO: 222061 - RNA, 22 nt, Human
uuagguuuaugaggucugcauu

SEQ ID NO: 222062 - RNA, 22 nt, Human
uuagucauucccucuugauauu

SEQ ID NO: 222063 - RNA, 22 nt, Human
uuuaugucaaaaguaaaaugaa

SEQ ID NO: 222064 - RNA, 22 nt, Human
uuaggcuaauagagauggaaug

SEQ ID NO: 222065 - RNA, 22 nt, Human
uuagaugcugugauuuuucaaa

SEQ ID NO: 222066 - RNA, 22 nt, Human
uuaggcugcuuuggaaaacugu

SEQ ID NO: 222067 - RNA, 22 nt, Human
uuaggcuuuauugaaaacaaua

SEQ ID NO: 222068 - RNA, 22 nt, Human
uuuagugaagcuuugcauuuca

SEQ ID NO: 222069 - RNA, 22 nt, Human
uuuagugagugugaaucaaaug

SEQ ID NO: 222070 - RNA, 22 nt, Human
uugaaagucuaagaauagguau

SEQ ID NO: 222071 - RNA, 22 nt, Human
uguauaaaauggaaugucagaa

SEQ ID NO: 222072 - RNA, 22 nt, Human
uguagugaaauuaaaccaaagc

SEQ ID NO: 222073 - RNA, 22 nt, Human
uguacauacauagauauacaca

SEQ ID NO: 222074 - RNA, 22 nt, Human
uguaaauucuauacacuuaaaa

SEQ ID NO: 222075 - RNA, 22 nt, Human
ugguucugccacuuuccccuug

SEQ ID NO: 222076 - RNA, 22 nt, Human
ugguugagguugacucuauaua

SEQ ID NO: 222077 - RNA, 22 nt, Human
ugguugauuaauuuugccaagc

SEQ ID NO: 222078 - RNA, 23 nt, Human
ugguuuucagaagaccuuguuag

SEQ ID NO: 222079 - RNA, 22 nt, Human
ugguuuuuuguaggauaaacau

SEQ ID NO: 222080 - RNA, 21 nt, Human
uucuuugcugcuguuuuugua

SEQ ID NO: 222081 - RNA, 22 nt, Human
uucuuuguccuagcauucuaca

SEQ ID NO: 222082 - RNA, 22 nt, Human
uguaagaagaaaaccguaugga

SEQ ID NO: 222083 - RNA, 22 nt, Human
uugaaaaaauguguuuaaggag

SEQ ID NO: 222084 - RNA, 22 nt, Human
uucuugcgaaagaaugagcuga

SEQ ID NO: 222085 - RNA, 22 nt, Human
uucuucuuuccuauaauuaauu

SEQ ID NO: 222086 - RNA, 22 nt, Human
uucuugcuuccggugcuccagg

SEQ ID NO: 222087 - RNA, 22 nt, Human
ugguuauauaaggauuaaauac

SEQ ID NO: 222088 - RNA, 22 nt, Human
ugguuauggaacuggcuauggc

SEQ ID NO: 222089 - RNA, 22 nt, Human
uucuuugcucaccugccgcucc

SEQ ID NO: 222090 - RNA, 22 nt, Human
ugguucuagaugagaugaugag

SEQ ID NO: 222091 - RNA, 19 nt, Human
uggugcgcuguuccugagc

SEQ ID NO: 222092 - RNA, 22 nt, Human
uggugccuuccgagagcuguga

SEQ ID NO: 222093 - RNA, 20 nt, Human
uucuguggcccguuuaagug

SEQ ID NO: 222094 - RNA, 22 nt, Human
uggugcucuugauauauaaggc

SEQ ID NO: 222095 - RNA, 22 nt, Human
uucuguuuuuauucuaucucug

SEQ ID NO: 222096 - RNA, 22 nt, Human
uggucugauggucccaccaccg

SEQ ID NO: 222097 - RNA, 22 nt, Human
uggucugggaagaucacaauua

SEQ ID NO: 222098 - RNA, 22 nt, Human
uggugaggacccagauuuuccu

SEQ ID NO: 222099 - RNA, 22 nt, Human
ugucuucauuccccaugaaguc

SEQ ID NO: 222100 - RNA, 22 nt, Human
uugcagcuguugcaaagucucu

SEQ ID NO: 222101 - RNA, 22 nt, Human
uugcauauguccagccaugcau

SEQ ID NO: 222102 - RNA, 22 nt, Human
uugcagugucaucuagacgugg

SEQ ID NO: 222103 - RNA, 22 nt, Human
uugcaugauuuaagaauaucug

SEQ ID NO: 222104 - RNA, 22 nt, Human
ugugauugucuucugaaaguca

SEQ ID NO: 222105 - RNA, 22 nt, Human
uugcaucaaauauguaccacag

SEQ ID NO: 222106 - RNA, 22 nt, Human
uugcaucagcaggcauaauugg

SEQ ID NO: 222107 - RNA, 22 nt, Human
uugccgacuggccaaggaguaa

SEQ ID NO: 222108 - RNA, 22 nt, Human
ugugccuguugguguagacaua

SEQ ID NO: 222109 - RNA, 22 nt, Human
uugccaggagacaucuggagcc

SEQ ID NO: 222110 - RNA, 22 nt, Human
uugccccugcccucuguggucc

SEQ ID NO: 222111 - RNA, 22 nt, Human
ugucuguauuugaggacauugu

SEQ ID NO: 222112 - RNA, 22 nt, Human
uugauuuggcguuuuccuccug

SEQ ID NO: 222113 - RNA, 20 nt, Human
uugcaaagugaauagcaauu

SEQ ID NO: 222114 - RNA, 22 nt, Human
ugucugggauguuggcagccac

SEQ ID NO: 222115 - RNA, 20 nt, Human
ugucugguaagacgcccauc

SEQ ID NO: 222116 - RNA, 22 nt, Human
ugucucuuccuccucuugguac

SEQ ID NO: 222117 - RNA, 22 nt, Human
uugauucauuuguucccauuuu

SEQ ID NO: 222118 - RNA, 21 nt, Human
uugagcuuuuaguacagacag

SEQ ID NO: 222119 - RNA, 22 nt, Human
uugaggguggauugucagggga

SEQ ID NO: 222120 - RNA, 20 nt, Human
uugaggagauauugaauacu

SEQ ID NO: 222121 - RNA, 22 nt, Human
uugauagauuuuagaggcaggc

SEQ ID NO: 222122 - RNA, 22 nt, Human
ugucagccacggugugaccggc

SEQ ID NO: 222123 - RNA, 23 nt, Human
uugaucuggaaaauacuuguuug

SEQ ID NO: 222124 - RNA, 22 nt, Human
uguccagcuauauguguaugug

SEQ ID NO: 222125 - RNA, 20 nt, Human
uugauucacaaaaagcuuag

SEQ ID NO: 222126 - RNA, 22 nt, Human
uugacacauuagagcuuguaaa

SEQ ID NO: 222127 - RNA, 22 nt, Human
uugaccauguggcccaggccaa

SEQ ID NO: 222128 - RNA, 22 nt, Human
uugacuauacucuggcggaaaa

SEQ ID NO: 222129 - RNA, 22 nt, Human
uugacucuuucauuuauuauuu

SEQ ID NO: 222130 - RNA, 22 nt, Human
uugacacauggcuucaauugca

SEQ ID NO: 222131 - RNA, 20 nt, Human
uugagccucauggauugucu

SEQ ID NO: 222132 - RNA, 22 nt, Human
uugagcagccauuagcuggggu

SEQ ID NO: 222133 - RNA, 22 nt, Human
uugagauuuggagguaauuccc

SEQ ID NO: 222134 - RNA, 22 nt, Human
uugagaugacuuaaaucacugu

SEQ ID NO: 222135 - RNA, 19 nt, Human
uugaauguuugauagucuc

SEQ ID NO: 222136 - RNA, 22 nt, Human
uuccucuugaaucugucugacu

SEQ ID NO: 222137 - RNA, 22 nt, Human
uuccugacacuggcaggcuucu

SEQ ID NO: 222138 - RNA, 22 nt, Human
uuccugaucuuuucccagaguu

SEQ ID NO: 222139 - RNA, 22 nt, Human
ugggagagaaauuuaaguuuuu

SEQ ID NO: 222140 - RNA, 19 nt, Human
uuccucaggugugaguuag

SEQ ID NO: 222141 - RNA, 22 nt, Human
uucccuacuagccuuaauguuu

SEQ ID NO: 222142 - RNA, 22 nt, Human
uuccccuucuaauacucaauuu

SEQ ID NO: 222143 - RNA, 22 nt, Human
uuccuaauguccaccuaguccu

SEQ ID NO: 222144 - RNA, 22 nt, Human
uggggcauacgugaaauaauuu

SEQ ID NO: 222145 - RNA, 19 nt, Human
uuccuuucuauccugggua

SEQ ID NO: 222146 - RNA, 20 nt, Human
uuccuuucuuucuuuuuuuu

SEQ ID NO: 222147 - RNA, 22 nt, Human
uuccuuuucuucuaccacaugu

SEQ ID NO: 222148 - RNA, 22 nt, Human
uuccuguggggugucaucauag

SEQ ID NO: 222149 - RNA, 22 nt, Human
uggggccaggcuguuggcuucc

SEQ ID NO: 222150 - RNA, 22 nt, Human
uucgcggccaggcggggaggcc

SEQ ID NO: 222151 - RNA, 22 nt, Human
uucgcucuucacacagugcuga

SEQ ID NO: 222152 - RNA, 22 nt, Human
uucggcagaaagucauuugucu

SEQ ID NO: 222153 - RNA, 22 nt, Human
uucggugagcugcgggcgagga

SEQ ID NO: 222154 - RNA, 22 nt, Human
uggcugagugaacauguccauu

SEQ ID NO: 222155 - RNA, 22 nt, Human
uggcugaugucuguucuguuau

SEQ ID NO: 222156 - RNA, 22 nt, Human
uggcuuuuuauuccuaugugau

SEQ ID NO: 222157 - RNA, 22 nt, Human
ugggaagcugagccucgaugug

SEQ ID NO: 222158 - RNA, 22 nt, Human
ugggaagccaguaucagacuaa

SEQ ID NO: 222159 - RNA, 22 nt, Human
ugggaagaguuagagacagcug

SEQ ID NO: 222160 - RNA, 22 nt, Human
ugggaaggggagcuggaaagga

SEQ ID NO: 222161 - RNA, 22 nt, Human
uuccauuacuaaugccugcaau

SEQ ID NO: 222162 - RNA, 22 nt, Human
ugggaagaggaggcagggggca

SEQ ID NO: 222163 - RNA, 22 nt, Human
ugggaaaauugugauucuuucu

SEQ ID NO: 222164 - RNA, 22 nt, Human
ugggaaaauagcuauuuugaaa

SEQ ID NO: 222165 - RNA, 22 nt, Human
uggagcugaaguacucucacua

SEQ ID NO: 222166 - RNA, 22 nt, Human
uggagcuggcuuguggaaguug

SEQ ID NO: 222167 - RNA, 22 nt, Human
uuaugccuguuaggcagcaucu

SEQ ID NO: 222168 - RNA, 22 nt, Human
uuaugcaaaggggccucuuccu

SEQ ID NO: 222169 - RNA, 22 nt, Human
uuaugggcgaugcaaaccugau

SEQ ID NO: 222170 - RNA, 22 nt, Human
uuccaugccuaagagccugaag

SEQ ID NO: 222171 - RNA, 22 nt, Human
uucauuuuauauuagagcuguu

SEQ ID NO: 222172 - RNA, 22 nt, Human
uucauuuccauuuuauagauaa

SEQ ID NO: 222173 - RNA, 22 nt, Human
uuaugugcuacacauaauuugu

SEQ ID NO: 222174 - RNA, 22 nt, Human
uucuggaguuugaagaucaggu

SEQ ID NO: 222175 - RNA, 22 nt, Human
ugguauaaaaaaaugaguauaa

SEQ ID NO: 222176 - RNA, 22 nt, Human
uucugggguaagcacugaggau

SEQ ID NO: 222177 - RNA, 22 nt, Human
uucuggggccgugacgaggggc

SEQ ID NO: 222178 - RNA, 19 nt, Human
uucugguacauacugccug

SEQ ID NO: 222179 - RNA, 22 nt, Human
uucuggugauuugccucuuuag

SEQ ID NO: 222180 - RNA, 22 nt, Human
uucugucaguguugguggaaau

SEQ ID NO: 222181 - RNA, 22 nt, Human
ugguauauuugaccauaugugu

SEQ ID NO: 222182 - RNA, 22 nt, Human
uucuggucucucugaccuagga

SEQ ID NO: 222183 - RNA, 22 nt, Human
uggucacgucgggguauugcca

SEQ ID NO: 222184 - RNA, 22 nt, Human
ugguaugaaggaggccggcagc

SEQ ID NO: 222185 - RNA, 22 nt, Human
uggucaaauccuagauccuuug

SEQ ID NO: 222186 - RNA, 22 nt, Human
ugguccaugcuccaggcacauu

SEQ ID NO: 222187 - RNA, 22 nt, Human
uucuggagucuauuuugaaaag

SEQ ID NO: 222188 - RNA, 22 nt, Human
ugguauaaaaauuugugaaugu

SEQ ID NO: 222189 - RNA, 22 nt, Human
ugguagcaggugcuaaaggccu

SEQ ID NO: 222190 - RNA, 22 nt, Human
uggguuuauuguauuucccuua

SEQ ID NO: 222191 - RNA, 22 nt, Human
ugguagacaacagcagugggac

SEQ ID NO: 222192 - RNA, 22 nt, Human
ugguaauuuaacaaaauuguca

SEQ ID NO: 222193 - RNA, 21 nt, Human
ugguaaggggauccuguuacu

SEQ ID NO: 222194 - RNA, 22 nt, Human
ugguaaaguguacugaauauga

SEQ ID NO: 222195 - RNA, 18 nt, Human
uucugcggugacagauau

SEQ ID NO: 222196 - RNA, 22 nt, Human
uucugcuagugguauauguuga

SEQ ID NO: 222197 - RNA, 21 nt, Human
uucugcuguucaccaccaccc

SEQ ID NO: 222198 - RNA, 22 nt, Human
uggguuugcuuguucagguucu

SEQ ID NO: 222199 - RNA, 22 nt, Human
uggguuuaccaguguuucuucc

SEQ ID NO: 222200 - RNA, 22 nt, Human
uucuccccacuccucccucuga

SEQ ID NO: 222201 - RNA, 22 nt, Human
uucucuauuugcugcaccucuc

SEQ ID NO: 222202 - RNA, 22 nt, Human
ugggugaugagguccccagccc

SEQ ID NO: 222203 - RNA, 22 nt, Human
ugggugccgcaucuugcuguuc

SEQ ID NO: 222204 - RNA, 22 nt, Human
uggguguggaagcagcgugggg

SEQ ID NO: 222205 - RNA, 22 nt, Human
uggguguuccuggggugcaagg

SEQ ID NO: 222206 - RNA, 22 nt, Human
uucuccugacuggccauucagu

SEQ ID NO: 222207 - RNA, 22 nt, Human
uucuccucuuugucacugcuuu

SEQ ID NO: 222208 - RNA, 22 nt, Human
uggguauauauguugcuacaga

SEQ ID NO: 222209 - RNA, 22 nt, Human
ugggguuuuagagcaggcagag

SEQ ID NO: 222210 - RNA, 22 nt, Human
uggggcuggccaggaggagucu

SEQ ID NO: 222211 - RNA, 22 nt, Human
uucuaguuacagaagccuugcu

SEQ ID NO: 222212 - RNA, 22 nt, Human
uucuauaagagaugaauacagu

SEQ ID NO: 222213 - RNA, 22 nt, Human
uggacagugguggggaggagga

SEQ ID NO: 222214 - RNA, 22 nt, Human
uggaagugucagcaggcugguu

SEQ ID NO: 222215 - RNA, 22 nt, Human
uggaagugggcaucaccaucca

SEQ ID NO: 222216 - RNA, 23 nt, Human
uggaaguugagagucugcuuugu

SEQ ID NO: 222217 - RNA, 22 nt, Human
uggaaugaaagaaaaauuguag

SEQ ID NO: 222218 - RNA, 22 nt, Human
uggaaugccgggccaggcuccg

SEQ ID NO: 222219 - RNA, 22 nt, Human
uggaauuaucugaagugauuug

SEQ ID NO: 222220 - RNA, 21 nt, Human
uggaauuggaaaccauucuau

SEQ ID NO: 222221 - RNA, 22 nt, Human
uggagaaauaacauuuggauuc

SEQ ID NO: 222222 - RNA, 22 nt, Human
uggacuguucauugauacugga

SEQ ID NO: 222223 - RNA, 22 nt, Human
uuauauuuuauuuaauuaaaua

SEQ ID NO: 222224 - RNA, 22 nt, Human
uggagaugcacgagcaggugga

SEQ ID NO: 222225 - RNA, 22 nt, Human
uuaucuguuuuaaugaauaauu

SEQ ID NO: 222226 - RNA, 22 nt, Human
uuaucugugcuuuacugacaga

SEQ ID NO: 222227 - RNA, 22 nt, Human
uuaucugcccauuguagaauug

SEQ ID NO: 222228 - RNA, 20 nt, Human
uggaaggaaagguguaucuu

SEQ ID NO: 222229 - RNA, 22 nt, Human
uggaaggaaauguguaucauaa

SEQ ID NO: 222230 - RNA, 22 nt, Human
uggaagggagcuggaauuugga

SEQ ID NO: 222231 - RNA, 22 nt, Human
uggaagucuucucucccaugga

SEQ ID NO: 222232 - RNA, 19 nt, Human
uggaagugauaguauagua

SEQ ID NO: 222233 - RNA, 22 nt, Human
uggaagggguuacgcagcagga

SEQ ID NO: 222234 - RNA, 22 nt, Human
uggaaguggcaggggagacgua

SEQ ID NO: 222235 - RNA, 22 nt, Human
uuaguuaccacugcagaucuuu

SEQ ID NO: 222236 - RNA, 20 nt, Human
uuaguuacuuagugagaguc

SEQ ID NO: 222237 - RNA, 22 nt, Human
uuaguuaauaaauauugagugu

SEQ ID NO: 222238 - RNA, 22 nt, Human
uuagugaagaagcaucuuuagu

SEQ ID NO: 222239 - RNA, 22 nt, Human
uuaguccucaugaccaccaagu

SEQ ID NO: 222240 - RNA, 22 nt, Human
uggaagaagcuacaagcgguga

SEQ ID NO: 222241 - RNA, 22 nt, Human
uuaguauuuuuugaaugaugaa

SEQ ID NO: 222242 - RNA, 23 nt, Human
uuagcccaggcuggagguagccc

SEQ ID NO: 222243 - RNA, 22 nt, Human
uuaggacucuauuuggguaucu

SEQ ID NO: 222244 - RNA, 22 nt, Human
uuaguauuuucaccauaugagg

SEQ ID NO: 222245 - RNA, 22 nt, Human
uuagauaaaucagcccugagua

SEQ ID NO: 222246 - RNA, 22 nt, Human
uggaaauaguugugagucaggc

SEQ ID NO: 222247 - RNA, 22 nt, Human
uggaaaugcuuagaggugaucu

SEQ ID NO: 222248 - RNA, 22 nt, Human
uuagaauggaaucauuugcauu

SEQ ID NO: 222249 - RNA, 22 nt, Human
ugcuucuuugggggugaagaga

SEQ ID NO: 222250 - RNA, 22 nt, Human
uggaaaggaguucuguuuauuu

SEQ ID NO: 222251 - RNA, 22 nt, Human
uggaaaguuggaagucucagga

SEQ ID NO: 222252 - RNA, 22 nt, Human
uuacuuucugggauaucaaaug

SEQ ID NO: 222253 - RNA, 22 nt, Human
uuacuuuuuucccccuuagaug

SEQ ID NO: 222254 - RNA, 22 nt, Human
uggaaagcagcccugcucccca

SEQ ID NO: 222255 - RNA, 22 nt, Human
uggaaagaagacugugguugag

SEQ ID NO: 222256 - RNA, 19 nt, Human
uuacaugacauaugaagga

SEQ ID NO: 222257 - RNA, 22 nt, Human
uuacaguuuacauaagaauugu

SEQ ID NO: 222258 - RNA, 22 nt, Human
uuacacaugaagguccaauguu

SEQ ID NO: 222259 - RNA, 22 nt, Human
ugcuuguuuguuuucuuccauu

SEQ ID NO: 222260 - RNA, 22 nt, Human
uuacaagaucuuugaaggcaag

SEQ ID NO: 222261 - RNA, 22 nt, Human
ugcuuucaaugaauuguauacu

SEQ ID NO: 222262 - RNA, 22 nt, Human
ugcuuuaccuuccauuuaagga

SEQ ID NO: 222263 - RNA, 21 nt, Human
ugcuuucugugcuuuuucugc

SEQ ID NO: 222264 - RNA, 22 nt, Human
uuaccgagaacaugacuggaau

SEQ ID NO: 222265 - RNA, 22 nt, Human
ugcuuuuguaucagaguauuca

SEQ ID NO: 222266 - RNA, 23 nt, Human
ugcuuugauuauuauucccaccu

SEQ ID NO: 222267 - RNA, 21 nt, Human
uuacuggcagcagaaaccuga

SEQ ID NO: 222268 - RNA, 22 nt, Human
uuacuggaauauaaagauaaga

SEQ ID NO: 222269 - RNA, 22 nt, Human
ugcuuuuggcagcaguguuuau

SEQ ID NO: 222270 - RNA, 22 nt, Human
uuaccugcagagacguggaggc

SEQ ID NO: 222271 - RNA, 22 nt, Human
uuaccugccucaaacacgaaug

SEQ ID NO: 222272 - RNA, 22 nt, Human
uuaccuuggaccggguaucaga

SEQ ID NO: 222273 - RNA, 22 nt, Human
uuaccuuuucuuguuuacaagu

SEQ ID NO: 222274 - RNA, 22 nt, Human
ugcuuaucuccuuaguuuuugc

SEQ ID NO: 222275 - RNA, 22 nt, Human
ugcuucucucuaggaagacgcu

SEQ ID NO: 222276 - RNA, 22 nt, Human
ugcuguugacuuuguuguucuu

SEQ ID NO: 222277 - RNA, 22 nt, Human
uuaaugauuaauguggacccaa

SEQ ID NO: 222278 - RNA, 22 nt, Human
uuaauaaggaccugugacaugc

SEQ ID NO: 222279 - RNA, 22 nt, Human
uuaauacugugucuuuuuuaau

SEQ ID NO: 222280 - RNA, 20 nt, Human
ugcuguggguaagcuuuaua

SEQ ID NO: 222281 - RNA, 20 nt, Human
ugcugugugucuacuguggg

SEQ ID NO: 222282 - RNA, 22 nt, Human
ugcuucuuuaggauguaguuau

SEQ ID NO: 222283 - RNA, 22 nt, Human
uuaauguuuuagaaugagagug

SEQ ID NO: 222284 - RNA, 22 nt, Human
uuaauucuugagcugucuuucc

SEQ ID NO: 222285 - RNA, 22 nt, Human
uuaauguggaagaguuuggcua

SEQ ID NO: 222286 - RNA, 22 nt, Human
uuaauguugacacacuagcaca

SEQ ID NO: 222287 - RNA, 22 nt, Human
ugcuugacucagcaucggcaau

SEQ ID NO: 222288 - RNA, 22 nt, Human
ugcuguacaagacccucuguuu

SEQ ID NO: 222289 - RNA, 20 nt, Human
ugcugggccaucuugcaugc

SEQ ID NO: 222290 - RNA, 22 nt, Human
ugcugugagaccauuuguugag

SEQ ID NO: 222291 - RNA, 23 nt, Human
uuaaggugccguguaauucaugc

SEQ ID NO: 222292 - RNA, 22 nt, Human
uuaacggugagacgccccaaau

SEQ ID NO: 222293 - RNA, 22 nt, Human
uuaacuaguauuuuuaguccug

SEQ ID NO: 222294 - RNA, 23 nt, Human
uuaagacuggcugaacuuaguag

SEQ ID NO: 222295 - RNA, 22 nt, Human
ugcuggaguggcacuguguggc

SEQ ID NO: 222296 - RNA, 22 nt, Human
uuaaaagaauccuguuauccuc

SEQ ID NO: 222297 - RNA, 22 nt, Human
uguuuuuucccccccuucuaaa

SEQ ID NO: 222298 - RNA, 22 nt, Human
ugcugcggcgcaggcacuccag

SEQ ID NO: 222299 - RNA, 22 nt, Human
ugcugcucuucaccauggccuc

SEQ ID NO: 222300 - RNA, 22 nt, Human
ugcugcucaagcugcagcaaaa

SEQ ID NO: 222301 - RNA, 22 nt, Human
ugcuggaaggguaguauuaacu

SEQ ID NO: 222302 - RNA, 22 nt, Human
ugcugcuguuuccuacaucuca

SEQ ID NO: 222303 - RNA, 22 nt, Human
ugcugccucccaucccucccga

SEQ ID NO: 222304 - RNA, 22 nt, Human
uuaaagguacuccuaagcgggg

SEQ ID NO: 222305 - RNA, 22 nt, Human
uuaaaauuguuaacuuugguga

SEQ ID NO: 222306 - RNA, 22 nt, Human
uuaaacauuuccacuugccagu

SEQ ID NO: 222307 - RNA, 22 nt, Human
ugcugcggauauacaggaucug

SEQ ID NO: 222308 - RNA, 22 nt, Human
uguuuuuuagagugauacuuuu

SEQ ID NO: 222309 - RNA, 22 nt, Human
uguuuguuuuguauuuuuaauu

SEQ ID NO: 222310 - RNA, 22 nt, Human
uguuuucaucucucacccagaa

SEQ ID NO: 222311 - RNA, 23 nt, Human
uguuugggcuaucuuuuguucuc

SEQ ID NO: 222312 - RNA, 22 nt, Human
ugcugcacccuucauuuuccca

SEQ ID NO: 222313 - RNA, 22 nt, Human
uguuucaguaugauuuucccuc

SEQ ID NO: 222314 - RNA, 22 nt, Human
uguuucaugcagcccccuguca

SEQ ID NO: 222315 - RNA, 22 nt, Human
uguuuccuaagugucucugaag

SEQ ID NO: 222316 - RNA, 22 nt, Human
uguuuaguuuugcaccaauaaa

SEQ ID NO: 222317 - RNA, 19 nt, Human
ugcugcaggaauucucaag

SEQ ID NO: 222318 - RNA, 22 nt, Human
ugcugccgccgccaccgccgcc

SEQ ID NO: 222319 - RNA, 22 nt, Human
uguuugagaauuugcugauguu

SEQ ID NO: 222320 - RNA, 22 nt, Human
ugcugcacucacaggaagaguu

SEQ ID NO: 222321 - RNA, 22 nt, Human
ugcucuuuguagcugcuuugcu

SEQ ID NO: 222322 - RNA, 22 nt, Human
ugccuguguauuuccggccugc

SEQ ID NO: 222323 - RNA, 22 nt, Human
uguguguguauacauguauaua

SEQ ID NO: 222324 - RNA, 20 nt, Human
ugcuccaggaacacuggccg

SEQ ID NO: 222325 - RNA, 22 nt, Human
uguguguguccucauuugcaga

SEQ ID NO: 222326 - RNA, 22 nt, Human
uguuggaaucuucuagucuucc

SEQ ID NO: 222327 - RNA, 22 nt, Human
ugcuccucugcaugucugcggc

SEQ ID NO: 222328 - RNA, 22 nt, Human
ugcuccguucuucugcuucuug

SEQ ID NO: 222329 - RNA, 21 nt, Human
uguugguugugggaaggagga

SEQ ID NO: 222330 - RNA, 22 nt, Human
uguugucaugcagucaguggua

SEQ ID NO: 222331 - RNA, 19 nt, Human
uguugugggccacuaacua

SEQ ID NO: 222332 - RNA, 23 nt, Human
uguuguccaacugaucuccaggc

SEQ ID NO: 222333 - RNA, 22 nt, Human
uguuguaaacagaggagccauu

SEQ ID NO: 222334 - RNA, 17 nt, Human
uguuguguggauuuucc

SEQ ID NO: 222335 - RNA, 22 nt, Human
uguuuaaauagaacauacugca

SEQ ID NO: 222336 - RNA, 22 nt, Human
uguuguuguuguuguuguuguu

SEQ ID NO: 222337 - RNA, 22 nt, Human
ugcucgggcuccuuugagugag

SEQ ID NO: 222338 - RNA, 22 nt, Human
ugcucugguccucccucggcgc

SEQ ID NO: 222339 - RNA, 22 nt, Human
ugcucuguuuuaacucuuucaa

SEQ ID NO: 222340 - RNA, 23 nt, Human
ugcucgccuucaggacuugggcu

SEQ ID NO: 222341 - RNA, 22 nt, Human
ugcuccugaacacagcccuaug

SEQ ID NO: 222342 - RNA, 22 nt, Human
ugagaacuguuuugguuugggu

SEQ ID NO: 222343 - RNA, 20 nt, Human
ugagaaacaagggcuggucu

SEQ ID NO: 222344 - RNA, 22 nt, Human
uggguucugaucccaggacugc

SEQ ID NO: 222345 - RNA, 20 nt, Human
uggguucaguuguuucuggc

SEQ ID NO: 222346 - RNA, 23 nt, Human
uggguuucagugccaaugcugcc

SEQ ID NO: 222347 - RNA, 22 nt, Human
ugagaaaacaguuuguaauaau

SEQ ID NO: 222348 - RNA, 22 nt, Human
ugguacaaaaaagauuuuggac

SEQ ID NO: 222349 - RNA, 22 nt, Human
ugguaacgguuuccuugccauu

SEQ ID NO: 222350 - RNA, 22 nt, Human
ugguaaaugucuaacaaucacu

SEQ ID NO: 222351 - RNA, 22 nt, Human
ugagaagucagucuauugugaa

SEQ ID NO: 222352 - RNA, 22 nt, Human
uggucacagauuuacaggaaug

SEQ ID NO: 222353 - RNA, 22 nt, Human
uggucccuagugugggagcuug

SEQ ID NO: 222354 - RNA, 22 nt, Human
ugagagguagaacuuguagugu

SEQ ID NO: 222355 - RNA, 23 nt, Human
ugagacacuggaaggcaagaaaa

SEQ ID NO: 222356 - RNA, 22 nt, Human
ugagacugaguuugguuuuguu

SEQ ID NO: 222357 - RNA, 22 nt, Human
ugacugaggaaggugggguggg

SEQ ID NO: 222358 - RNA, 22 nt, Human
uggguggugaaauggaugggaa

SEQ ID NO: 222359 - RNA, 22 nt, Human
ugggugugcaccuacgaucucu

SEQ ID NO: 222360 - RNA, 22 nt, Human
ugacguuugcgccgcgcacgac

SEQ ID NO: 222361 - RNA, 22 nt, Human
uggguggauucgggaacuuguu

SEQ ID NO: 222362 - RNA, 22 nt, Human
ugggugggcagagucuaagaua

SEQ ID NO: 222363 - RNA, 22 nt, Human
uggguuaaaaguugaaugaauu

SEQ ID NO: 222364 - RNA, 22 nt, Human
uggguuaaaguuugucacugac

SEQ ID NO: 222365 - RNA, 22 nt, Human
ugggugugggguaggguaagag

SEQ ID NO: 222366 - RNA, 22 nt, Human
ugacuuauuaaaaguuuuuauu

SEQ ID NO: 222367 - RNA, 22 nt, Human
uggcggcuggacuggggggcca

SEQ ID NO: 222368 - RNA, 22 nt, Human
ugaccuacauuuauagcuguca

SEQ ID NO: 222369 - RNA, 22 nt, Human
ugacgggacacaggugccaaca

SEQ ID NO: 222370 - RNA, 22 nt, Human
ugaccuuuuuaaauuauuuuua

SEQ ID NO: 222371 - RNA, 22 nt, Human
ugggugaagaggcuaugcuacu

SEQ ID NO: 222372 - RNA, 22 nt, Human
ucuuuugugauuuucugaagca

SEQ ID NO: 222373 - RNA, 22 nt, Human
ucuuuuuaugucaaaaucgaug

SEQ ID NO: 222374 - RNA, 22 nt, Human
ucuuuugaacauccaggauguc

SEQ ID NO: 222375 - RNA, 22 nt, Human
uguaaucaugguagaggcaaag

SEQ ID NO: 222376 - RNA, 22 nt, Human
ugauaugguaauaagauauucu

SEQ ID NO: 222377 - RNA, 20 nt, Human
ugauaugcgguacagagagg

SEQ ID NO: 222378 - RNA, 22 nt, Human
ugagugggaggugggaagggua

SEQ ID NO: 222379 - RNA, 20 nt, Human
ugauccacucucauugcucu

SEQ ID NO: 222380 - RNA, 22 nt, Human
ugaucauugaacaucgaguuaa

SEQ ID NO: 222381 - RNA, 22 nt, Human
ugaugaaguuggaaggaaaguu

SEQ ID NO: 222382 - RNA, 22 nt, Human
uguacuguuuucuaggcaaaaa

SEQ ID NO: 222383 - RNA, 22 nt, Human
uguacuuguaauaucagugaaa

SEQ ID NO: 222384 - RNA, 23 nt, Human
uguacugucuuucagguucuuau

SEQ ID NO: 222385 - RNA, 22 nt, Human
ugagugccagugcuugcucuac

SEQ ID NO: 222386 - RNA, 19 nt, Human
ugaguacuaaugagauuga

SEQ ID NO: 222387 - RNA, 20 nt, Human
ugagucagcugcaugggugg

SEQ ID NO: 222388 - RNA, 22 nt, Human
ugagucaccucucagaagccac

SEQ ID NO: 222389 - RNA, 22 nt, Human
ugagguugggaggacugccuaa

SEQ ID NO: 222390 - RNA, 22 nt, Human
ugaguacauuugauuaucagag

SEQ ID NO: 222391 - RNA, 22 nt, Human
ugagucugaagagagaauaagg

SEQ ID NO: 222392 - RNA, 22 nt, Human
ugguuucagacagacucgaacu

SEQ ID NO: 222393 - RNA, 22 nt, Human
ugguuuccugauggacacuugg

SEQ ID NO: 222394 - RNA, 22 nt, Human
ugguuuguauauguuugugaga

SEQ ID NO: 222395 - RNA, 22 nt, Human
ugguuuucuuaauuagcaguca

SEQ ID NO: 222396 - RNA, 22 nt, Human
uggucggugguguggggaggca

SEQ ID NO: 222397 - RNA, 22 nt, Human
uggucuccucuuaauugccuac

SEQ ID NO: 222398 - RNA, 22 nt, Human
uggugcucucgauauauaaggc

SEQ ID NO: 222399 - RNA, 22 nt, Human
ugguccgagaacuguccugguu

SEQ ID NO: 222400 - RNA, 22 nt, Human
ugagcagccagucauucaaaaa

SEQ ID NO: 222401 - RNA, 22 nt, Human
ugagauucuguucagaaaaaug

SEQ ID NO: 222402 - RNA, 22 nt, Human
ugagcaaacacagauaggcuua

SEQ ID NO: 222403 - RNA, 22 nt, Human
ugagauuuagaacuggauuuca

SEQ ID NO: 222404 - RNA, 22 nt, Human
ugguuacagaugaagaucggcc

SEQ ID NO: 222405 - RNA, 22 nt, Human
ugguucggcuguaaguauaucu

SEQ ID NO: 222406 - RNA, 22 nt, Human
ugagggaggggaaugugugcag

SEQ ID NO: 222407 - RNA, 22 nt, Human
ugagggaagguugauaauguuc

SEQ ID NO: 222408 - RNA, 20 nt, Human
ugguuaaagugggugagcgg

SEQ ID NO: 222409 - RNA, 22 nt, Human
ugguuagucaugguacugcagc

SEQ ID NO: 222410 - RNA, 22 nt, Human
ugaggaugagaaggaagagaag

SEQ ID NO: 222411 - RNA, 22 nt, Human
ugaggaggugggcacacagagu

SEQ ID NO: 222412 - RNA, 20 nt, Human
ugguguacauuuccauaguu

SEQ ID NO: 222413 - RNA, 21 nt, Human
ugguguacauuuccauaguuu

SEQ ID NO: 222414 - RNA, 22 nt, Human
ugucugaauuguaauguugcgu

SEQ ID NO: 222415 - RNA, 22 nt, Human
ugucugauccuucaggagcccc

SEQ ID NO: 222416 - RNA, 21 nt, Human
ugcaaugcauugacagcagca

SEQ ID NO: 222417 - RNA, 22 nt, Human
ugucuucuuuucccuuagcccu

SEQ ID NO: 222418 - RNA, 22 nt, Human
ugucuuugaccuuaagaaguuu

SEQ ID NO: 222419 - RNA, 22 nt, Human
ugcagaggagcuggaaggcugg

SEQ ID NO: 222420 - RNA, 22 nt, Human
ugcagaacacaguagacagaac

SEQ ID NO: 222421 - RNA, 22 nt, Human
ugcagcaucuccuugugccaug

SEQ ID NO: 222422 - RNA, 22 nt, Human
ugcagccucacgcauccgcauu

SEQ ID NO: 222423 - RNA, 22 nt, Human
ugcagcagaauauggcugcagg

SEQ ID NO: 222424 - RNA, 22 nt, Human
ugugagucuugcaggucgcuca

SEQ ID NO: 222425 - RNA, 22 nt, Human
ugugaaggaaaguaggagggac

SEQ ID NO: 222426 - RNA, 19 nt, Human
ugugaagaccucagugcgg

SEQ ID NO: 222427 - RNA, 22 nt, Human
ugugaaugacuguguucuuugc

SEQ ID NO: 222428 - RNA, 22 nt, Human
ugugaagugaugggugaccgag

SEQ ID NO: 222429 - RNA, 22 nt, Human
ugugaaugacuuuguucuuugc

SEQ ID NO: 222430 - RNA, 22 nt, Human
ugucacagugcacagcuaagaa

SEQ ID NO: 222431 - RNA, 22 nt, Human
ugucacaccuggcgauaauggg

SEQ ID NO: 222432 - RNA, 22 nt, Human
ugauggaguauaauaaaaugac

SEQ ID NO: 222433 - RNA, 22 nt, Human
ugauugguauguauguuuguca

SEQ ID NO: 222434 - RNA, 22 nt, Human
ugauuucauaugacagcuuuuu

SEQ ID NO: 222435 - RNA, 22 nt, Human
uguaauucuaauccagagcugg

SEQ ID NO: 222436 - RNA, 22 nt, Human
ugaugcuagaacuuccaagaua

SEQ ID NO: 222437 - RNA, 22 nt, Human
ugaugaugccaaaauuuggcau

SEQ ID NO: 222438 - RNA, 22 nt, Human
ugcaaugagcuucuuugauaaa

SEQ ID NO: 222439 - RNA, 22 nt, Human
ugucauuggugaucugaugccu

SEQ ID NO: 222440 - RNA, 21 nt, Human
ugucagaaagccugugacuuu

SEQ ID NO: 222441 - RNA, 22 nt, Human
ugcaaauuuuuuuauuuuuccu

SEQ ID NO: 222442 - RNA, 22 nt, Human
ugucaguuugucaaauacccca

SEQ ID NO: 222443 - RNA, 22 nt, Human
ugcagugcagcuggaaguuggc

SEQ ID NO: 222444 - RNA, 22 nt, Human
uguggcaauauggaauguguuu

SEQ ID NO: 222445 - RNA, 22 nt, Human
ugugcuugucguggagccaggc

SEQ ID NO: 222446 - RNA, 22 nt, Human
ugcaucugagcacuacggugga

SEQ ID NO: 222447 - RNA, 22 nt, Human
ugcaugaucucacuuacaggug

SEQ ID NO: 222448 - RNA, 17 nt, Human
ugcaugcgucugugaua

SEQ ID NO: 222449 - RNA, 22 nt, Human
ugugauaaaggcccgcagaucc

SEQ ID NO: 222450 - RNA, 20 nt, Human
ugcagcucccccgcaguuuc

SEQ ID NO: 222451 - RNA, 22 nt, Human
ugugauaauauuauuagagcuc

SEQ ID NO: 222452 - RNA, 22 nt, Human
ugugauugcauugcagauuacu

SEQ ID NO: 222453 - RNA, 19 nt, Human
ugcagcuguaugagcuuaa

SEQ ID NO: 222454 - RNA, 22 nt, Human
ugcagcuucucugcaacaggag

SEQ ID NO: 222455 - RNA, 22 nt, Human
ugugcuauuuuugcauaugugu

SEQ ID NO: 222456 - RNA, 22 nt, Human
ugugauuucaaagggugucuuu

SEQ ID NO: 222457 - RNA, 17 nt, Human
uguguauucuccaggug

SEQ ID NO: 222458 - RNA, 22 nt, Human
uguguggaggugggugaugucu

SEQ ID NO: 222459 - RNA, 22 nt, Human
uguguggccuccauaggguacu

SEQ ID NO: 222460 - RNA, 22 nt, Human
ugccgccccggggcccccagcc

SEQ ID NO: 222461 - RNA, 22 nt, Human
ugcauuacuuugauaagcgucu

SEQ ID NO: 222462 - RNA, 22 nt, Human
ugccaaugauuccacaauggaa

SEQ ID NO: 222463 - RNA, 22 nt, Human
ugcauguuuuaagugaagcuga

SEQ ID NO: 222464 - RNA, 22 nt, Human
ugcauguuucuguauguuaaug

SEQ ID NO: 222465 - RNA, 22 nt, Human
ugcaugguuauauacuacuagu

SEQ ID NO: 222466 - RNA, 22 nt, Human
ugccaauuaccuauuucugaga

SEQ ID NO: 222467 - RNA, 22 nt, Human
ugccccuggaggagagcaaugg

SEQ ID NO: 222468 - RNA, 22 nt, Human
ugcccagcagggagcuaccugg

SEQ ID NO: 222469 - RNA, 22 nt, Human
ugauucaguacuuucucuaacu

SEQ ID NO: 222470 - RNA, 22 nt, Human
ugauucacgcuucucuuuaaac

SEQ ID NO: 222471 - RNA, 22 nt, Human
ugauugauaaugaagacaguca

SEQ ID NO: 222472 - RNA, 22 nt, Human
ugauugaauaauguuaugugaa

SEQ ID NO: 222473 - RNA, 22 nt, Human
ugauugcucgacacucugcuug

SEQ ID NO: 222474 - RNA, 22 nt, Human
ugauuagccguccuuuuauuaa

SEQ ID NO: 222475 - RNA, 22 nt, Human
ugauuagauacuucagaugaca

SEQ ID NO: 222476 - RNA, 22 nt, Human
ugaugugugaauucuuaaaugu

SEQ ID NO: 222477 - RNA, 22 nt, Human
uccaagcgcuucuggagcuccu

SEQ ID NO: 222478 - RNA, 18 nt, Human
ugauggcuaagagccggg

SEQ ID NO: 222479 - RNA, 22 nt, Human
ugauguaggacauuauuauuuc

SEQ ID NO: 222480 - RNA, 22 nt, Human
ugauguaaaauaggaaguucua

SEQ ID NO: 222481 - RNA, 22 nt, Human
ugauggugagaugucccguguu

SEQ ID NO: 222482 - RNA, 22 nt, Human
ugaucauguucuccaaaagcgu

SEQ ID NO: 222483 - RNA, 22 nt, Human
ugaugaugauacauuucuucag

SEQ ID NO: 222484 - RNA, 22 nt, Human
ugaucaacagggcuggaaagag

SEQ ID NO: 222485 - RNA, 22 nt, Human
ucaucauccuuuuuugaagagu

SEQ ID NO: 222486 - RNA, 21 nt, Human
ucauccagguccugcuucuuc

SEQ ID NO: 222487 - RNA, 22 nt, Human
ucaucccuuccugcacuauuag

SEQ ID NO: 222488 - RNA, 22 nt, Human
ucauccucguccucuggugccc

SEQ ID NO: 222489 - RNA, 22 nt, Human
ucauccgcaaccacuuuagccu

SEQ ID NO: 222490 - RNA, 22 nt, Human
ucauauugguagagauguguaa

SEQ ID NO: 222491 - RNA, 22 nt, Human
ucaucagccaaagaguccuuca

SEQ ID NO: 222492 - RNA, 22 nt, Human
ugaggcaguucuuacuuguauu

SEQ ID NO: 222493 - RNA, 21 nt, Human
ucauaauaauuacaugggggg

SEQ ID NO: 222494 - RNA, 22 nt, Human
ucauaagucucauauaugucca

SEQ ID NO: 222495 - RNA, 22 nt, Human
ucauaaaaucaguguccauugu

SEQ ID NO: 222496 - RNA, 22 nt, Human
ucaguuuaucuagcugggggaa

SEQ ID NO: 222497 - RNA, 19 nt, Human
ugaggauugagguccagua

SEQ ID NO: 222498 - RNA, 20 nt, Human
ucaucuuucaaauuugugac

SEQ ID NO: 222499 - RNA, 22 nt, Human
ucaucgauggggagcucuacaa

SEQ ID NO: 222500 - RNA, 22 nt, Human
ucauccugaagaaccugcuucc

SEQ ID NO: 222501 - RNA, 22 nt, Human
ucaguuccccaaagccuccuag

SEQ ID NO: 222502 - RNA, 22 nt, Human
ucauggcucuaaagacauagau

SEQ ID NO: 222503 - RNA, 22 nt, Human
ucaugccugcgauugucccugg

SEQ ID NO: 222504 - RNA, 22 nt, Human
ugauauaaaagauucuuauuga

SEQ ID NO: 222505 - RNA, 22 nt, Human
ucaugacaacuugcacaguuuu

SEQ ID NO: 222506 - RNA, 22 nt, Human
ucagugguuaaguucuguccac

SEQ ID NO: 222507 - RNA, 22 nt, Human
ucaguguccuucguucuuguug

SEQ ID NO: 222508 - RNA, 22 nt, Human
ucaguuguuggaaguagaugua

SEQ ID NO: 222509 - RNA, 22 nt, Human
ugaggaugaggaagaagaagaa

SEQ ID NO: 222510 - RNA, 22 nt, Human
ugaggaacaugggagaaauguc

SEQ ID NO: 222511 - RNA, 22 nt, Human
ugaggaagugguuguaugguuu

SEQ ID NO: 222512 - RNA, 22 nt, Human
ugagcuuugguaccuucauuug

SEQ ID NO: 222513 - RNA, 22 nt, Human
ugagcagagcacuugggaacga

SEQ ID NO: 222514 - RNA, 22 nt, Human
ucaguggaacacacagaguggg

SEQ ID NO: 222515 - RNA, 19 nt, Human
ugagauuguaugaggagau

SEQ ID NO: 222516 - RNA, 20 nt, Human
ucaguggcauaguugcuaag

SEQ ID NO: 222517 - RNA, 23 nt, Human
ucagugaaggaacaacuaaauag

SEQ ID NO: 222518 - RNA, 22 nt, Human
ucagucugguggaugcucauug

SEQ ID NO: 222519 - RNA, 22 nt, Human
ucagugagauuuuuagcaguag

SEQ ID NO: 222520 - RNA, 22 nt, Human
ugagagggagacagcucuagca

SEQ ID NO: 222521 - RNA, 22 nt, Human
ucagucucuggggcuucuguuu

SEQ ID NO: 222522 - RNA, 22 nt, Human
ucagucugcuauagguauuugu

SEQ ID NO: 222523 - RNA, 22 nt, Human
ugagagacggagccccggcucg

SEQ ID NO: 222524 - RNA, 21 nt, Human
ugagagucuguguauuuuuag

SEQ ID NO: 222525 - RNA, 22 nt, Human
ugagaaauauacaccagacaca

SEQ ID NO: 222526 - RNA, 22 nt, Human
ucagguuuaagcuacuggaauc

SEQ ID NO: 222527 - RNA, 22 nt, Human
ugagaauuuaacuugauuagga

SEQ ID NO: 222528 - RNA, 22 nt, Human
ugagaagaggucuuuugggaug

SEQ ID NO: 222529 - RNA, 22 nt, Human
ucagguuugcaaccucgggcaa

SEQ ID NO: 222530 - RNA, 23 nt, Human
ucagggaucgucagaaaaugaaa

SEQ ID NO: 222531 - RNA, 22 nt, Human
ucaggcuagcccagugcuuggg

SEQ ID NO: 222532 - RNA, 22 nt, Human
ucagucacugucucagacagga

SEQ ID NO: 222533 - RNA, 22 nt, Human
ugagacuuggggggcugagggc

SEQ ID NO: 222534 - RNA, 22 nt, Human
ugagaggaagggaaagaugauu

SEQ ID NO: 222535 - RNA, 22 nt, Human
ugagagaauuacuaaagggcuu

SEQ ID NO: 222536 - RNA, 22 nt, Human
ugagagaggugaaaugacuuuc

SEQ ID NO: 222537 - RNA, 22 nt, Human
ucaguauuagugcauuaucagg

SEQ ID NO: 222538 - RNA, 22 nt, Human
ucagucacugugaaaugaauuu

SEQ ID NO: 222539 - RNA, 22 nt, Human
ugagacaaaguuguuggauguu

SEQ ID NO: 222540 - RNA, 22 nt, Human
ucagguuuuuaaggagcuagga

SEQ ID NO: 222541 - RNA, 22 nt, Human
ugagacuugaacuccagugcca

SEQ ID NO: 222542 - RNA, 22 nt, Human
uccaggagucagacagauggug

SEQ ID NO: 222543 - RNA, 22 nt, Human
uccaggacgccgacgugucggc

SEQ ID NO: 222544 - RNA, 22 nt, Human
uccagccugaacuuuguccaga

SEQ ID NO: 222545 - RNA, 22 nt, Human
uccagcuccugaguucacugcu

SEQ ID NO: 222546 - RNA, 22 nt, Human
ugauuugaaaccuuuggcaaga

SEQ ID NO: 222547 - RNA, 22 nt, Human
ucccaaaacuugaagcaagccu

SEQ ID NO: 222548 - RNA, 22 nt, Human
ugauuguauuuauccucuguuc

SEQ ID NO: 222549 - RNA, 22 nt, Human
ucccguuucacuccuugccagc

SEQ ID NO: 222550 - RNA, 22 nt, Human
uccccucucugcgcucccaggu

SEQ ID NO: 222551 - RNA, 22 nt, Human
uccccgcuccguagagaaagag

SEQ ID NO: 222552 - RNA, 22 nt, Human
ucccagccugacagugcaucaa

SEQ ID NO: 222553 - RNA, 22 nt, Human
uccccaugaacuuguggcugcu

SEQ ID NO: 222554 - RNA, 22 nt, Human
ucccccuugucguuugagguuu

SEQ ID NO: 222555 - RNA, 22 nt, Human
uccccaccuaagauacccaucu

SEQ ID NO: 222556 - RNA, 22 nt, Human
ucccagcaggcaccgcuucugc

SEQ ID NO: 222557 - RNA, 22 nt, Human
ucccacugucuucucgugcucg

SEQ ID NO: 222558 - RNA, 22 nt, Human
ugcacacaguucucaggaaaga

SEQ ID NO: 222559 - RNA, 22 nt, Human
ugcaauggauaucugaacgugg

SEQ ID NO: 222560 - RNA, 22 nt, Human
ugcauaaauauuguugggagua

SEQ ID NO: 222561 - RNA, 22 nt, Human
ugcagugcagcuggaauaucuu

SEQ ID NO: 222562 - RNA, 22 nt, Human
ugcagguuuucagauguguguu

SEQ ID NO: 222563 - RNA, 22 nt, Human
ugcagugaugcuucuggcucag

SEQ ID NO: 222564 - RNA, 22 nt, Human
ugcaggucuggacccccacuuu

SEQ ID NO: 222565 - RNA, 18 nt, Human
uccggaggucagaguaaa

SEQ ID NO: 222566 - RNA, 22 nt, Human
ugcaggagcaccagcucacccu

SEQ ID NO: 222567 - RNA, 22 nt, Human
uccgcguugguuagagagggcu

SEQ ID NO: 222568 - RNA, 22 nt, Human
uccgggagcccccggaggagga

SEQ ID NO: 222569 - RNA, 22 nt, Human
uccggcgaccuccagauguucc

SEQ ID NO: 222570 - RNA, 22 nt, Human
ugcaggaacucgaaaacuauag

SEQ ID NO: 222571 - RNA, 22 nt, Human
ucccuuuuuccugaucugugaa

SEQ ID NO: 222572 - RNA, 22 nt, Human
ugcaggagaaaguacggagcgu

SEQ ID NO: 222573 - RNA, 22 nt, Human
ugcagcuuuugguuucuagaug

SEQ ID NO: 222574 - RNA, 22 nt, Human
ucccugcgugagaaagcacuua

SEQ ID NO: 222575 - RNA, 22 nt, Human
ucccugcugggcgaucuucucu

SEQ ID NO: 222576 - RNA, 22 nt, Human
ugcgccucugucacucagcauc

SEQ ID NO: 222577 - RNA, 22 nt, Human
ucgacguuguuuuuucucuguc

SEQ ID NO: 222578 - RNA, 22 nt, Human
ugccuucugccaaggacggugc

SEQ ID NO: 222579 - RNA, 19 nt, Human
ugccuggcaccagcuccac

SEQ ID NO: 222580 - RNA, 17 nt, Human
ugccuucgucuucaguu

SEQ ID NO: 222581 - RNA, 22 nt, Human
ugccuguguuugggguggggaa

SEQ ID NO: 222582 - RNA, 20 nt, Human
ugccuuccgccccgggcacc

SEQ ID NO: 222583 - RNA, 22 nt, Human
ugccugaagccugccccugggu

SEQ ID NO: 222584 - RNA, 20 nt, Human
ugccugagcgcagcuccagg

SEQ ID NO: 222585 - RNA, 22 nt, Human
ugccucucucugucauuaugcu

SEQ ID NO: 222586 - RNA, 19 nt, Human
uccuugacuguauucagag

SEQ ID NO: 222587 - RNA, 22 nt, Human
ugccgggcugagcaagugcugc

SEQ ID NO: 222588 - RNA, 22 nt, Human
uccuggcgugggcuggcugcag

SEQ ID NO: 222589 - RNA, 22 nt, Human
uccuggccuuggggagagaagu

SEQ ID NO: 222590 - RNA, 22 nt, Human
uccuggccucugagucaagaac

SEQ ID NO: 222591 - RNA, 22 nt, Human
ugcccuagaucacauuacaggu

SEQ ID NO: 222592 - RNA, 21 nt, Human
uccugccuggccuucugacua

SEQ ID NO: 222593 - RNA, 22 nt, Human
ugcauuuucuaccacacccacu

SEQ ID NO: 222594 - RNA, 22 nt, Human
ugcauguuauuguggcaagaau

SEQ ID NO: 222595 - RNA, 22 nt, Human
ugcauuguuuauggaauaaaau

SEQ ID NO: 222596 - RNA, 22 nt, Human
uccucaaauccuagccucaucg

SEQ ID NO: 222597 - RNA, 22 nt, Human
ugcaucauuaagguacaguugg

SEQ ID NO: 222598 - RNA, 22 nt, Human
ugcaucccaaacaugguuuccu

SEQ ID NO: 222599 - RNA, 22 nt, Human
ugcccacuucaaaaucuucauu

SEQ ID NO: 222600 - RNA, 22 nt, Human
ugcccaaucaauuguagcuauu

SEQ ID NO: 222601 - RNA, 22 nt, Human
ugccccagcacauuuacuaucc

SEQ ID NO: 222602 - RNA, 22 nt, Human
ugcccagagccucuuaccucca

SEQ ID NO: 222603 - RNA, 22 nt, Human
ugcccccggcugcccaggggaa

SEQ ID NO: 222604 - RNA, 21 nt, Human
ugccccucuuuucuuuccuuc

SEQ ID NO: 222605 - RNA, 23 nt, Human
ugccaggaagaaugaccucugcu

SEQ ID NO: 222606 - RNA, 22 nt, Human
uccuccucgccacgacucugcu

SEQ ID NO: 222607 - RNA, 22 nt, Human
uccuccuggagacuuucucucu

SEQ ID NO: 222608 - RNA, 22 nt, Human
uccucgccgucacgcagccucu

SEQ ID NO: 222609 - RNA, 22 nt, Human
ugcauuugcaauggguacacaa

SEQ ID NO: 222610 - RNA, 22 nt, Human
ucuaugcuacguuccucugaaa

SEQ ID NO: 222611 - RNA, 22 nt, Human
ucuauuauauuuacacgagagu

SEQ ID NO: 222612 - RNA, 22 nt, Human
ucucaccuagucuuggaggucu

SEQ ID NO: 222613 - RNA, 22 nt, Human
ugcugcuguuaucauuuuacca

SEQ ID NO: 222614 - RNA, 23 nt, Human
ugcugcuggaguaucuacaaugc

SEQ ID NO: 222615 - RNA, 23 nt, Human
ugcugcgggacccgagcgcgcgc

SEQ ID NO: 222616 - RNA, 22 nt, Human
ucgcuauuauuuuagguucuca

SEQ ID NO: 222617 - RNA, 22 nt, Human
ucgcgcgugccacgcgccgcgg

SEQ ID NO: 222618 - RNA, 22 nt, Human
ucgccuccucccagaucaacaa

SEQ ID NO: 222619 - RNA, 21 nt, Human
ucuagaugggaugaaaggugc

SEQ ID NO: 222620 - RNA, 22 nt, Human
ucuaggcugugugugggcaggg

SEQ ID NO: 222621 - RNA, 22 nt, Human
ucgcuucugaguuggugacccc

SEQ ID NO: 222622 - RNA, 22 nt, Human
ucucccgcuuccugcuggcugc

SEQ ID NO: 222623 - RNA, 22 nt, Human
ucuccagcugaggccuucuucc

SEQ ID NO: 222624 - RNA, 22 nt, Human
ucucccaaaucuuucuagcaca

SEQ ID NO: 222625 - RNA, 22 nt, Human
ucucccuuuggauuuguuuugg

SEQ ID NO: 222626 - RNA, 22 nt, Human
ugcugguuucugaguaaccaca

SEQ ID NO: 222627 - RNA, 22 nt, Human
ugcuuaaagcauuucucuuuaa

SEQ ID NO: 222628 - RNA, 22 nt, Human
ugcugugcuggcggcagaggcc

SEQ ID NO: 222629 - RNA, 22 nt, Human
ugcuggagucucuugacccugg

SEQ ID NO: 222630 - RNA, 22 nt, Human
ugcuggagccauguuuucucua

SEQ ID NO: 222631 - RNA, 22 nt, Human
ugcuggugauuaaauccugaag

SEQ ID NO: 222632 - RNA, 22 nt, Human
ugcugggagcugggccucgaca

SEQ ID NO: 222633 - RNA, 22 nt, Human
ucucaggcuuccuggugcugug

SEQ ID NO: 222634 - RNA, 20 nt, Human
ucucauuuugauuucgcauu

SEQ ID NO: 222635 - RNA, 22 nt, Human
ucucuucggagagaccuuugga

SEQ ID NO: 222636 - RNA, 22 nt, Human
ucucugugaauggcgucaccug

SEQ ID NO: 222637 - RNA, 22 nt, Human
ugcuuuauucgacaucugguag

SEQ ID NO: 222638 - RNA, 22 nt, Human
ugcuuucaaaacucagaggaau

SEQ ID NO: 222639 - RNA, 22 nt, Human
ugcuuucagauaucuguuucaa

SEQ ID NO: 222640 - RNA, 22 nt, Human
ugcuuuccuucccuauguugag

SEQ ID NO: 222641 - RNA, 22 nt, Human
ucugaagagaacucuuaguguu

SEQ ID NO: 222642 - RNA, 18 nt, Human
ucugaaggaaugauucca

SEQ ID NO: 222643 - RNA, 22 nt, Human
ucucuuuuuuuaaaacucuaug

SEQ ID NO: 222644 - RNA, 22 nt, Human
ugcuuuggcccaacauugaugc

SEQ ID NO: 222645 - RNA, 22 nt, Human
ucugacuucuuuuauuaucauu

SEQ ID NO: 222646 - RNA, 22 nt, Human
ucugaggaauaagaugucuaaa

SEQ ID NO: 222647 - RNA, 22 nt, Human
ucugaggacagugcugugccug

SEQ ID NO: 222648 - RNA, 22 nt, Human
ucugagucgcucccuggaucca

SEQ ID NO: 222649 - RNA, 22 nt, Human
ucugaguuaaaauuccagaggu

SEQ ID NO: 222650 - RNA, 22 nt, Human
ucugagugggaacucucaugac

SEQ ID NO: 222651 - RNA, 22 nt, Human
uggaaaacgcaguuuaauuuuu

SEQ ID NO: 222652 - RNA, 22 nt, Human
uggaaaagaugucuuccugaau

SEQ ID NO: 222653 - RNA, 17 nt, Human
ucugaccuuuacuccug

SEQ ID NO: 222654 - RNA, 22 nt, Human
uggaaaauuuagaaagauuuau

SEQ ID NO: 222655 - RNA, 21 nt, Human
ugcuuuuguugucagcugcug

SEQ ID NO: 222656 - RNA, 22 nt, Human
ugcuuacgcaaccuguguuugg

SEQ ID NO: 222657 - RNA, 22 nt, Human
ucucuacugcuucugugaguga

SEQ ID NO: 222658 - RNA, 22 nt, Human
ucucgcuguuccugcuucaggu

SEQ ID NO: 222659 - RNA, 22 nt, Human
ucucucagauuguuuccauuuu

SEQ ID NO: 222660 - RNA, 20 nt, Human
ucucucacccuugcugugca

SEQ ID NO: 222661 - RNA, 22 nt, Human
ugcuucucacuucuugguuucc

SEQ ID NO: 222662 - RNA, 22 nt, Human
ucucucugcuguccagcguuau

SEQ ID NO: 222663 - RNA, 22 nt, Human
ucucucucucuuccagcauguu

SEQ ID NO: 222664 - RNA, 22 nt, Human
ugcuugaacccaggaaguggag

SEQ ID NO: 222665 - RNA, 22 nt, Human
ugcuuguuuuguggcuucagcu

SEQ ID NO: 222666 - RNA, 22 nt, Human
ucucugguagcucugugcucug

SEQ ID NO: 222667 - RNA, 23 nt, Human
uggcaaacgggaauaaaggaauu

SEQ ID NO: 222668 - RNA, 22 nt, Human
ucuucaggaaaaccaaaguugu

SEQ ID NO: 222669 - RNA, 20 nt, Human
ucuucagcuccaagucuggc

SEQ ID NO: 222670 - RNA, 22 nt, Human
ucuuauuucuuucuuuuccugu

SEQ ID NO: 222671 - RNA, 22 nt, Human
ucuucacagaugcauauacuuc

SEQ ID NO: 222672 - RNA, 22 nt, Human
uggcaaaaccugcaauuacuuu

SEQ ID NO: 222673 - RNA, 22 nt, Human
ucuucccgggcaucucugcuca

SEQ ID NO: 222674 - RNA, 22 nt, Human
ucuuccauuccccuccuacgcc

SEQ ID NO: 222675 - RNA, 22 nt, Human
ucuucuguguguagugguugug

SEQ ID NO: 222676 - RNA, 22 nt, Human
ucuucuuaggaaagucaggagg

SEQ ID NO: 222677 - RNA, 22 nt, Human
ucuucuauaucuacauaugcaa

SEQ ID NO: 222678 - RNA, 22 nt, Human
ucuucaucucuaaaaugggaac

SEQ ID NO: 222679 - RNA, 22 nt, Human
uggcaagcuguuggcagauagc

SEQ ID NO: 222680 - RNA, 22 nt, Human
uggcaaggccacaggugcaguu

SEQ ID NO: 222681 - RNA, 19 nt, Human
ucuuccaucuauccuccuc

SEQ ID NO: 222682 - RNA, 22 nt, Human
ucuuccacuugaaccuucuguc

SEQ ID NO: 222683 - RNA, 22 nt, Human
uggcucaggccuacgacgccuu

SEQ ID NO: 222684 - RNA, 22 nt, Human
uggcuacauuuauacucucauu

SEQ ID NO: 222685 - RNA, 22 nt, Human
uggcgugaagcuggaaggcgga

SEQ ID NO: 222686 - RNA, 22 nt, Human
ucuuucugaugggaagggucaa

SEQ ID NO: 222687 - RNA, 22 nt, Human
uggcgcucacccugcggcccug

SEQ ID NO: 222688 - RNA, 22 nt, Human
uggcggcggggagguaggcaga

SEQ ID NO: 222689 - RNA, 22 nt, Human
uggcggagacauggacuucaga

SEQ ID NO: 222690 - RNA, 22 nt, Human
ucuuuaucugugagcagucucc

SEQ ID NO: 222691 - RNA, 22 nt, Human
uggcgcgcagccugcuggugcu

SEQ ID NO: 222692 - RNA, 22 nt, Human
uggcgacuggaauuaaucuuuu

SEQ ID NO: 222693 - RNA, 22 nt, Human
ucuugcuggagucaaggcuaca

SEQ ID NO: 222694 - RNA, 22 nt, Human
ucuugccuuuucuagcuucuag

SEQ ID NO: 222695 - RNA, 22 nt, Human
uggcaguugcaguaacuuguau

SEQ ID NO: 222696 - RNA, 22 nt, Human
uggcagugagauuucucuucug

SEQ ID NO: 222697 - RNA, 22 nt, Human
ucuucuuauuuuaugaucgcuu

SEQ ID NO: 222698 - RNA, 22 nt, Human
uggcaucacagacaaggcagca

SEQ ID NO: 222699 - RNA, 22 nt, Human
uggcccugaaucaaggccagca

SEQ ID NO: 222700 - RNA, 20 nt, Human
uggccgacccugaggaguug

SEQ ID NO: 222701 - RNA, 22 nt, Human
uggcauuugagcuggaaggaug

SEQ ID NO: 222702 - RNA, 22 nt, Human
uggcauuuuguagcuguguauc

SEQ ID NO: 222703 - RNA, 21 nt, Human
ucugucuaguuaccaccgccc

SEQ ID NO: 222704 - RNA, 22 nt, Human
ucugucucugucaggcugcugc

SEQ ID NO: 222705 - RNA, 22 nt, Human
ucugugcuggacugauuucaua

SEQ ID NO: 222706 - RNA, 22 nt, Human
uggagucagaaugcgacaggcc

SEQ ID NO: 222707 - RNA, 22 nt, Human
ucuguaguaugguacuuauuua

SEQ ID NO: 222708 - RNA, 22 nt, Human
ucugucaguguccucguguggu

SEQ ID NO: 222709 - RNA, 22 nt, Human
ucuguagcuaauucucuuuaaa

SEQ ID NO: 222710 - RNA, 19 nt, Human
ucuguugcuuuguguccuc

SEQ ID NO: 222711 - RNA, 22 nt, Human
ucuguuguauggcugucuaauu

SEQ ID NO: 222712 - RNA, 22 nt, Human
ucuguuuuccaggaaucucaua

SEQ ID NO: 222713 - RNA, 22 nt, Human
ucuguuuugugcuuuguuuucu

SEQ ID NO: 222714 - RNA, 20 nt, Human
uggaucaccauccuguugcu

SEQ ID NO: 222715 - RNA, 22 nt, Human
ucuguuuuuaucuauucuguua

SEQ ID NO: 222716 - RNA, 22 nt, Human
ucuguucagaagaggugaaagu

SEQ ID NO: 222717 - RNA, 22 nt, Human
uggauauuuuguaugugcguuu

SEQ ID NO: 222718 - RNA, 22 nt, Human
ucuguucacaauuacacacacu

SEQ ID NO: 222719 - RNA, 22 nt, Human
ucuguguguguggcuaaacaag

SEQ ID NO: 222720 - RNA, 22 nt, Human
uggaaggugauucucugguuaa

SEQ ID NO: 222721 - RNA, 22 nt, Human
ucuggcucaggagcuguguuca

SEQ ID NO: 222722 - RNA, 22 nt, Human
ucuggguaacugaggcuaauau

SEQ ID NO: 222723 - RNA, 22 nt, Human
ucuggucugccgagauccauuu

SEQ ID NO: 222724 - RNA, 22 nt, Human
ucugggucuaucccaugccuuu

SEQ ID NO: 222725 - RNA, 22 nt, Human
ucuggguuuccuucacaagcac

SEQ ID NO: 222726 - RNA, 22 nt, Human
ucugguuucccaguuccuccgu

SEQ ID NO: 222727 - RNA, 22 nt, Human
ucugguuccugcauucauucaa

SEQ ID NO: 222728 - RNA, 22 nt, Human
ucuggugcacucugauauuuga

SEQ ID NO: 222729 - RNA, 22 nt, Human
ucugcguggcgugguucugugc

SEQ ID NO: 222730 - RNA, 22 nt, Human
uggaagcuggcugaucugacuu

SEQ ID NO: 222731 - RNA, 20 nt, Human
ucugcuugucuucagguucc

SEQ ID NO: 222732 - RNA, 22 nt, Human
ucuggcacuugccaguuucuau

SEQ ID NO: 222733 - RNA, 21 nt, Human
ucuggccuauaaaguagucgc

SEQ ID NO: 222734 - RNA, 22 nt, Human
uggaagaaaacuuggaaggcau

SEQ ID NO: 222735 - RNA, 23 nt, Human
uggaagaaaaugguuuggcugug

SEQ ID NO: 222736 - RNA, 22 nt, Human
ucugauaaggaaggauuaaaag

SEQ ID NO: 222737 - RNA, 22 nt, Human
ucugaucagaagacaaaugagg

SEQ ID NO: 222738 - RNA, 22 nt, Human
ucugauucauucugguaaaugg

SEQ ID NO: 222739 - RNA, 22 nt, Human
uaguuuucaagugaguuggaag

SEQ ID NO: 222740 - RNA, 22 nt, Human
uaguuuucuuuuguguuauucu

SEQ ID NO: 222741 - RNA, 22 nt, Human
ucucauaauuguuucccagcua

SEQ ID NO: 222742 - RNA, 22 nt, Human
uaguugguggagcgauuugucu

SEQ ID NO: 222743 - RNA, 22 nt, Human
uauaaagaccuuauccuucaua

SEQ ID NO: 222744 - RNA, 21 nt, Human
ucucauuuuaacacagaguug

SEQ ID NO: 222745 - RNA, 22 nt, Human
ucucauugugcuuuuuguacug

SEQ ID NO: 222746 - RNA, 22 nt, Human
ucuccaggaaagacacuggacu

SEQ ID NO: 222747 - RNA, 22 nt, Human
ucuccaccccugggaggcagaa

SEQ ID NO: 222748 - RNA, 22 nt, Human
ucuccaggggcagggucuggag

SEQ ID NO: 222749 - RNA, 22 nt, Human
uauacucaauaaauauuuggag

SEQ ID NO: 222750 - RNA, 22 nt, Human
uauagccuuacaagauauuaua

SEQ ID NO: 222751 - RNA, 22 nt, Human
uauagcaagagaaccauuacca

SEQ ID NO: 222752 - RNA, 22 nt, Human
uauaagaaaagucauuaucaaa

SEQ ID NO: 222753 - RNA, 23 nt, Human
ucucccagaaguucucggggacu

SEQ ID NO: 222754 - RNA, 22 nt, Human
ucucccuggccagcccuuuccc

SEQ ID NO: 222755 - RNA, 16 nt, Human
ucucccuguucuccaa

SEQ ID NO: 222756 - RNA, 17 nt, Human
ucuccuggcucuaucag

SEQ ID NO: 222757 - RNA, 22 nt, Human
uauaggaugaugucauguugcu

SEQ ID NO: 222758 - RNA, 22 nt, Human
uaguuauuucugcacuuaauga

SEQ ID NO: 222759 - RNA, 22 nt, Human
uaggauaacaauuuguaguuuc

SEQ ID NO: 222760 - RNA, 22 nt, Human
ucgagcgcucccugugcucucg

SEQ ID NO: 222761 - RNA, 22 nt, Human
uaggagcagauggcagcaggug

SEQ ID NO: 222762 - RNA, 22 nt, Human
uaggaaugcagaugcauaauaa

SEQ ID NO: 222763 - RNA, 22 nt, Human
uaggaagagauuuucacauggc

SEQ ID NO: 222764 - RNA, 22 nt, Human
ucucagaaaugacaggagguac

SEQ ID NO: 222765 - RNA, 23 nt, Human
ucucaccaggauaugacugucac

SEQ ID NO: 222766 - RNA, 21 nt, Human
ucucaagguaacauuuaagau

SEQ ID NO: 222767 - RNA, 22 nt, Human
ucuauauucuauguucuucuuu

SEQ ID NO: 222768 - RNA, 22 nt, Human
uaguugaauuuaucaguagcau

SEQ ID NO: 222769 - RNA, 22 nt, Human
ucuaugaagucuuccuuuccuc

SEQ ID NO: 222770 - RNA, 22 nt, Human
ucuagguuguaauuuguaguaa

SEQ ID NO: 222771 - RNA, 22 nt, Human
uaucugaugcaggcucccagga

SEQ ID NO: 222772 - RNA, 22 nt, Human
ucugacguugguucugcccuuu

SEQ ID NO: 222773 - RNA, 22 nt, Human
ucugacugucccguagaggaac

SEQ ID NO: 222774 - RNA, 22 nt, Human
uaucuguagucucaugguuccu

SEQ ID NO: 222775 - RNA, 22 nt, Human
uaucuucaauagcccagaugug

SEQ ID NO: 222776 - RNA, 22 nt, Human
uaucuuugccuuggguuuuguu

SEQ ID NO: 222777 - RNA, 22 nt, Human
ucugaguaauacucuugccuug

SEQ ID NO: 222778 - RNA, 21 nt, Human
ucugaggagaaacucuuggug

SEQ ID NO: 222779 - RNA, 22 nt, Human
ucugagcaggaaagagcagaga

SEQ ID NO: 222780 - RNA, 22 nt, Human
uaugaaggauacaccucugauu

SEQ ID NO: 222781 - RNA, 22 nt, Human
uaugaaagguuuuuucuugaaa

SEQ ID NO: 222782 - RNA, 21 nt, Human
uaucauuuuuuccccugagau

SEQ ID NO: 222783 - RNA, 22 nt, Human
uauccuaaaggguaguguggga

SEQ ID NO: 222784 - RNA, 22 nt, Human
ucucuugcuauugcgaacaggu

SEQ ID NO: 222785 - RNA, 22 nt, Human
ucugaauauguuuaucaucucu

SEQ ID NO: 222786 - RNA, 22 nt, Human
ucugaaaggagaguagggcaga

SEQ ID NO: 222787 - RNA, 22 nt, Human
ucugaccccccuugccuccacu

SEQ ID NO: 222788 - RNA, 22 nt, Human
ucugaccaggcucuuguagccu

SEQ ID NO: 222789 - RNA, 22 nt, Human
ucugaaauuuuaguuauagaaa

SEQ ID NO: 222790 - RNA, 20 nt, Human
ucucuuuuucuucuuuucuc

SEQ ID NO: 222791 - RNA, 22 nt, Human
uaucaguagaacaauggacauu

SEQ ID NO: 222792 - RNA, 22 nt, Human
uaucauuuuacugugacauuuu

SEQ ID NO: 222793 - RNA, 22 nt, Human
uaucauuaggagugcugcucgg

SEQ ID NO: 222794 - RNA, 22 nt, Human
uaucacauaaaugaggaauauu

SEQ ID NO: 222795 - RNA, 22 nt, Human
ucucuguaguugggcagcugcu

SEQ ID NO: 222796 - RNA, 22 nt, Human
uauauauaugcaccacaugugu

SEQ ID NO: 222797 - RNA, 19 nt, Human
ucucugguggcuccaucag

SEQ ID NO: 222798 - RNA, 22 nt, Human
ucucuguacauagugaagcccg

SEQ ID NO: 222799 - RNA, 22 nt, Human
uauaugcagauuuucaucaucg

SEQ ID NO: 222800 - RNA, 22 nt, Human
uauaugcacucagguguaugug

SEQ ID NO: 222801 - RNA, 22 nt, Human
ucucugguggcuccaucaguag

SEQ ID NO: 222802 - RNA, 22 nt, Human
ucucuggcuuuuuuuccauuuu

SEQ ID NO: 222803 - RNA, 22 nt, Human
ucucuggacggacauuuaaggu

SEQ ID NO: 222804 - RNA, 22 nt, Human
ucucugcguucaucccaucaca

SEQ ID NO: 222805 - RNA, 20 nt, Human
ucucugccaaccaccuccuc

SEQ ID NO: 222806 - RNA, 22 nt, Human
ucucucgguacagcuggcugga

SEQ ID NO: 222807 - RNA, 22 nt, Human
ucucucguuuuuugcagauaaa

SEQ ID NO: 222808 - RNA, 22 nt, Human
ucucucggagcuaccggaaguu

SEQ ID NO: 222809 - RNA, 22 nt, Human
ucucuccuccacaccgggugcu

SEQ ID NO: 222810 - RNA, 22 nt, Human
uauauauacauauagaauaugu

SEQ ID NO: 222811 - RNA, 20 nt, Human
ucucuaacaugaaugcuauc

SEQ ID NO: 222812 - RNA, 22 nt, Human
uaugauuuucaugguagaguua

SEQ ID NO: 222813 - RNA, 22 nt, Human
uaugaucuuaggauggaacuuc

SEQ ID NO: 222814 - RNA, 22 nt, Human
ucugcagggcccuuggcuccug

SEQ ID NO: 222815 - RNA, 22 nt, Human
uaugcagauaguuugccauuca

SEQ ID NO: 222816 - RNA, 22 nt, Human
uaugccaccagucuggaacucu

SEQ ID NO: 222817 - RNA, 22 nt, Human
uaugcaucaguaugguuggaaa

SEQ ID NO: 222818 - RNA, 22 nt, Human
ucugcggccuagcgcccggcgc

SEQ ID NO: 222819 - RNA, 22 nt, Human
uaugcgguccaucaggggcacu

SEQ ID NO: 222820 - RNA, 22 nt, Human
ucugcccaggaggucccauggg

SEQ ID NO: 222821 - RNA, 22 nt, Human
ucugcccguucaaauccuuguu

SEQ ID NO: 222822 - RNA, 17 nt, Human
ucugccaguuuuagaau

SEQ ID NO: 222823 - RNA, 22 nt, Human
uaugaauauaccacaauuuagg

SEQ ID NO: 222824 - RNA, 22 nt, Human
ucugagugacguccugacagga

SEQ ID NO: 222825 - RNA, 22 nt, Human
uaugacugcucagugaauggaa

SEQ ID NO: 222826 - RNA, 22 nt, Human
uaugagugccaaguuaccuggg

SEQ ID NO: 222827 - RNA, 22 nt, Human
ucugaugaccacaugugggacu

SEQ ID NO: 222828 - RNA, 22 nt, Human
ucugauucucuuguugaccuag

SEQ ID NO: 222829 - RNA, 22 nt, Human
uaugugaaauggaauauagaaa

SEQ ID NO: 222830 - RNA, 20 nt, Human
uaugugcaguuugguuuauc

SEQ ID NO: 222831 - RNA, 22 nt, Human
ucugggccacccgccuccaggg

SEQ ID NO: 222832 - RNA, 22 nt, Human
ucuggcuucaguaggguucacu

SEQ ID NO: 222833 - RNA, 22 nt, Human
ucuggcucuccagugcucuuag

SEQ ID NO: 222834 - RNA, 22 nt, Human
uauguauguauguauguauaug

SEQ ID NO: 222835 - RNA, 22 nt, Human
uauguauauccagguaagggcu

SEQ ID NO: 222836 - RNA, 22 nt, Human
ucuggcaguugccgcuucaguc

SEQ ID NO: 222837 - RNA, 22 nt, Human
ucugcuggugucauuuuugcua

SEQ ID NO: 222838 - RNA, 22 nt, Human
ucugcgggccuggcucccagcg

SEQ ID NO: 222839 - RNA, 22 nt, Human
uaugcuguauucuguauguuag

SEQ ID NO: 222840 - RNA, 22 nt, Human
uauggacagcuuucuuuguguu

SEQ ID NO: 222841 - RNA, 22 nt, Human
uauggcuucucagucaugaaaa

SEQ ID NO: 222842 - RNA, 22 nt, Human
ucugcuuuucuuaaggggauca

SEQ ID NO: 222843 - RNA, 22 nt, Human
ucugcuguugaucaugacuagc

SEQ ID NO: 222844 - RNA, 22 nt, Human
uaugguuucuccugcagauuug

SEQ ID NO: 222845 - RNA, 22 nt, Human
uauguacauauauguguauaua

SEQ ID NO: 222846 - RNA, 22 nt, Human
ucuucagacuguuguucuuuug

SEQ ID NO: 222847 - RNA, 22 nt, Human
ucuucaaauacagucauauuga

SEQ ID NO: 222848 - RNA, 22 nt, Human
ucuucacugaagcuuugcaucu

SEQ ID NO: 222849 - RNA, 22 nt, Human
ucuuauugugaugaugaagaac

SEQ ID NO: 222850 - RNA, 22 nt, Human
ucuuauugguaaugauggcauu

SEQ ID NO: 222851 - RNA, 22 nt, Human
ucuuaaguuccaggugugcuca

SEQ ID NO: 222852 - RNA, 22 nt, Human
ucuuagacagagaagacuauug

SEQ ID NO: 222853 - RNA, 22 nt, Human
ucuuaaauaugaaaaggauuau

SEQ ID NO: 222854 - RNA, 22 nt, Human
ucuguuucaggggucuggaaug

SEQ ID NO: 222855 - RNA, 22 nt, Human
ucuguguuccuggcaccaaacu

SEQ ID NO: 222856 - RNA, 22 nt, Human
uauucccacuccucagcaauuu

SEQ ID NO: 222857 - RNA, 22 nt, Human
uauucauuuuuauuugugacug

SEQ ID NO: 222858 - RNA, 22 nt, Human
uauuauggguuuuuguguaaau

SEQ ID NO: 222859 - RNA, 22 nt, Human
ucuguaccuuauguucagagug

SEQ ID NO: 222860 - RNA, 22 nt, Human
uauuagggaacugcaagacuaa

SEQ ID NO: 222861 - RNA, 22 nt, Human
ucugugugugugcauaugcaug

SEQ ID NO: 222862 - RNA, 22 nt, Human
uauuaugguuguagguuaacaa

SEQ ID NO: 222863 - RNA, 22 nt, Human
ucuguuauaaaucacacugcau

SEQ ID NO: 222864 - RNA, 22 nt, Human
ucuguuuacaugucagcagcaa

SEQ ID NO: 222865 - RNA, 21 nt, Human
ucuguuguguguugaggacuu

SEQ ID NO: 222866 - RNA, 20 nt, Human
ucuguggcagguggcgcuug

SEQ ID NO: 222867 - RNA, 19 nt, Human
ucuguggccuucccugaug

SEQ ID NO: 222868 - RNA, 22 nt, Human
ucuguggcaaacacagugacca

SEQ ID NO: 222869 - RNA, 17 nt, Human
ucuguguccgcucaguc

SEQ ID NO: 222870 - RNA, 22 nt, Human
ucugugugugcauguguguaua

SEQ ID NO: 222871 - RNA, 20 nt, Human
ucugugugccaucaccuaac

SEQ ID NO: 222872 - RNA, 22 nt, Human
uauguuugcaguucuaggucuu

SEQ ID NO: 222873 - RNA, 19 nt, Human
uauuagccucaucccagcc

SEQ ID NO: 222874 - RNA, 22 nt, Human
uauuaauugugguuauuguauu

SEQ ID NO: 222875 - RNA, 22 nt, Human
ucuguagcuuuagaggacagga

SEQ ID NO: 222876 - RNA, 22 nt, Human
ucuguauuuuuuacacacaugc

SEQ ID NO: 222877 - RNA, 22 nt, Human
ucuguaauccacacagguggau

SEQ ID NO: 222878 - RNA, 22 nt, Human
ucugguagauuauuuagaguac

SEQ ID NO: 222879 - RNA, 22 nt, Human
ucugguuaggcuugugaggucc

SEQ ID NO: 222880 - RNA, 22 nt, Human
ucuguaaaugcaaguuuuccuc

SEQ ID NO: 222881 - RNA, 17 nt, Human
ucuggguuucugauuua

SEQ ID NO: 222882 - RNA, 22 nt, Human
ucugggagaguagauaaaggaa

SEQ ID NO: 222883 - RNA, 22 nt, Human
ucuggggaugagugaugucgua

SEQ ID NO: 222884 - RNA, 22 nt, Human
uauguuaaauguuugauguuua

SEQ ID NO: 222885 - RNA, 22 nt, Human
ucaucuauaaguagcaucuggg

SEQ ID NO: 222886 - RNA, 22 nt, Human
ucaucggcugucaucuucacgu

SEQ ID NO: 222887 - RNA, 21 nt, Human
uaagcuaaacauucaguuaac

SEQ ID NO: 222888 - RNA, 22 nt, Human
ucauaaaggugccacucaguuu

SEQ ID NO: 222889 - RNA, 22 nt, Human
ucaguugagguggucuauugcg

SEQ ID NO: 222890 - RNA, 22 nt, Human
ucaguuacucugauguccugug

SEQ ID NO: 222891 - RNA, 17 nt, Human
ucaguugugcgagcagc

SEQ ID NO: 222892 - RNA, 22 nt, Human
uaagagauuuauugaggacuuc

SEQ ID NO: 222893 - RNA, 20 nt, Human
ucaguuucccuauuagguug

SEQ ID NO: 222894 - RNA, 22 nt, Human
ucauuagaccucucugguucag

SEQ ID NO: 222895 - RNA, 22 nt, Human
ucauggguauaauuuuagaugu

SEQ ID NO: 222896 - RNA, 22 nt, Human
ucauuagucuuuaauacauaau

SEQ ID NO: 222897 - RNA, 22 nt, Human
ucauuauuuggaauaugggacu

SEQ ID NO: 222898 - RNA, 22 nt, Human
uaagucaagagcuagaaaaagc

SEQ ID NO: 222899 - RNA, 22 nt, Human
uaaggaaaugcaaauuuaagaa

SEQ ID NO: 222900 - RNA, 22 nt, Human
uaaggagagaauuuagagguuu

SEQ ID NO: 222901 - RNA, 22 nt, Human
ucaugagcacaggugcagggac

SEQ ID NO: 222902 - RNA, 21 nt, Human
uaaggaagagcauuuuagguc

SEQ ID NO: 222903 - RNA, 22 nt, Human
ucaugggcaaacuuggggauca

SEQ ID NO: 222904 - RNA, 22 nt, Human
ucaugcagaguagaaagggcaa

SEQ ID NO: 222905 - RNA, 22 nt, Human
ucaugcagauaagaauaaguaa

SEQ ID NO: 222906 - RNA, 23 nt, Human
uacagccaugucgcugauuuaac

SEQ ID NO: 222907 - RNA, 22 nt, Human
uccaagacagauaccuagaaga

SEQ ID NO: 222908 - RNA, 17 nt, Human
ucauuuauccucuuugg

SEQ ID NO: 222909 - RNA, 22 nt, Human
ucauuuguauucuacaaagcac

SEQ ID NO: 222910 - RNA, 22 nt, Human
ucauuuuaucaggaauggaauc

SEQ ID NO: 222911 - RNA, 22 nt, Human
uaauauccaguuauuucccuca

SEQ ID NO: 222912 - RNA, 22 nt, Human
uaauaguugaaggucaucacua

SEQ ID NO: 222913 - RNA, 22 nt, Human
uaagugcuagaauuccagguuu

SEQ ID NO: 222914 - RNA, 22 nt, Human
uacaaaauucaaauaauguuug

SEQ ID NO: 222915 - RNA, 22 nt, Human
ucauugugugugcuucuugggc

SEQ ID NO: 222916 - RNA, 22 nt, Human
uaauuugauuucucccuggaaa

SEQ ID NO: 222917 - RNA, 22 nt, Human
uaauuucauuuugcaaugaucu

SEQ ID NO: 222918 - RNA, 22 nt, Human
uaacuguuuugaauauuguggu

SEQ ID NO: 222919 - RNA, 22 nt, Human
uaacccuucauaacuagaugaa

SEQ ID NO: 222920 - RNA, 22 nt, Human
uaaccaggaaaaagauaugcau

SEQ ID NO: 222921 - RNA, 22 nt, Human
uaacacauagauauuuuaacuu

SEQ ID NO: 222922 - RNA, 22 nt, Human
uaacaguauacuacaucauauu

SEQ ID NO: 222923 - RNA, 22 nt, Human
uaacaguggucugugguaucug

SEQ ID NO: 222924 - RNA, 22 nt, Human
ucagucauacuuuaugauugaa

SEQ ID NO: 222925 - RNA, 22 nt, Human
ucagucuucaggacuaugaaaa

SEQ ID NO: 222926 - RNA, 22 nt, Human
ucagugauccagauauuugagc

SEQ ID NO: 222927 - RNA, 23 nt, Human
ucagugccaaggagaacuuggug

SEQ ID NO: 222928 - RNA, 23 nt, Human
uaacacaguccuggucuuuggcc

SEQ ID NO: 222929 - RNA, 23 nt, Human
uaaauuuuauucugauaacacag

SEQ ID NO: 222930 - RNA, 22 nt, Human
ucagucauguuuaccagacgua

SEQ ID NO: 222931 - RNA, 22 nt, Human
uaaauuugugaauuagcuauca

SEQ ID NO: 222932 - RNA, 22 nt, Human
uaaaugcucuuuaaaagugcuu

SEQ ID NO: 222933 - RNA, 22 nt, Human
uaaauuagauucccagcgcuau

SEQ ID NO: 222934 - RNA, 22 nt, Human
ucaggagaguguucaguggagg

SEQ ID NO: 222935 - RNA, 19 nt, Human
ucaggaggucgaccuggca

SEQ ID NO: 222936 - RNA, 22 nt, Human
ucagggaggagaggcaggggga

SEQ ID NO: 222937 - RNA, 18 nt, Human
ucagggaaacuuugccug

SEQ ID NO: 222938 - RNA, 22 nt, Human
ucaggguacuuguggccaaagu

SEQ ID NO: 222939 - RNA, 22 nt, Human
uaaaggaguguauaauuguagu

SEQ ID NO: 222940 - RNA, 22 nt, Human
ucaggacacuuaauaggaacag

SEQ ID NO: 222941 - RNA, 22 nt, Human
guugguggaggcgagagaagaa

SEQ ID NO: 222942 - RNA, 22 nt, Human
ucaagcuggaaaugaagaaucu

SEQ ID NO: 222943 - RNA, 22 nt, Human
ucaagagauauaugcugguuua

SEQ ID NO: 222944 - RNA, 22 nt, Human
uaaaugaaaugaagugaaagcu

SEQ ID NO: 222945 - RNA, 22 nt, Human
uaaauaugcaugugguauucau

SEQ ID NO: 222946 - RNA, 22 nt, Human
uaaaugauaguauugaagguag

SEQ ID NO: 222947 - RNA, 22 nt, Human
ucaguagcauuuaauguucagu

SEQ ID NO: 222948 - RNA, 22 nt, Human
ucagguuuaagugacuggaauc

SEQ ID NO: 222949 - RNA, 22 nt, Human
ucaggucacugauaaaguggaa

SEQ ID NO: 222950 - RNA, 22 nt, Human
uccugcuucaaucugcugcugg

SEQ ID NO: 222951 - RNA, 22 nt, Human
uccugcucucuccauuccuucc

SEQ ID NO: 222952 - RNA, 22 nt, Human
uccuggaagggaugguugagga

SEQ ID NO: 222953 - RNA, 22 nt, Human
uccugguaaagaguaucagauu

SEQ ID NO: 222954 - RNA, 22 nt, Human
uagccaaguuuucuuugaaagu

SEQ ID NO: 222955 - RNA, 22 nt, Human
uccuucagaggacggcagccag

SEQ ID NO: 222956 - RNA, 22 nt, Human
uccuuacuccuggagauucuga

SEQ ID NO: 222957 - RNA, 22 nt, Human
uccuucuguuguuuauuuuaaa

SEQ ID NO: 222958 - RNA, 22 nt, Human
uccuucuuuucgccggaguuga

SEQ ID NO: 222959 - RNA, 21 nt, Human
uccugccuuaguccagagcag

SEQ ID NO: 222960 - RNA, 22 nt, Human
uccugaaggccugaguuccacc

SEQ ID NO: 222961 - RNA, 20 nt, Human
uccugaaauuacgugauuca

SEQ ID NO: 222962 - RNA, 22 nt, Human
uagcagcacuauuuguuguagu

SEQ ID NO: 222963 - RNA, 22 nt, Human
uagcagaacaauagucaaugau

SEQ ID NO: 222964 - RNA, 22 nt, Human
uccucccugcacucagugaagu

SEQ ID NO: 222965 - RNA, 22 nt, Human
ucccuuuggagguguccagcac

SEQ ID NO: 222966 - RNA, 22 nt, Human
uagaagagcaugucaaacuaua

SEQ ID NO: 222967 - RNA, 22 nt, Human
uccgacacacgugcucgcagcg

SEQ ID NO: 222968 - RNA, 22 nt, Human
uagaguaagugugugcugagcu

SEQ ID NO: 222969 - RNA, 22 nt, Human
uagaggccguagguggcugguu

SEQ ID NO: 222970 - RNA, 22 nt, Human
uccgaccuuuacuucuugucuc

SEQ ID NO: 222971 - RNA, 22 nt, Human
uccgggcagcuccuggagcugu

SEQ ID NO: 222972 - RNA, 22 nt, Human
uccguccacacuuagagaguuu

SEQ ID NO: 222973 - RNA, 22 nt, Human
uccgugguguuggcucuccggc

SEQ ID NO: 222974 - RNA, 21 nt, Human
uccuaaaggaaauacucaauu

SEQ ID NO: 222975 - RNA, 22 nt, Human
uacuuuaauugcaaaaauaaau

SEQ ID NO: 222976 - RNA, 22 nt, Human
ucccgcccugcguucucccaug

SEQ ID NO: 222977 - RNA, 22 nt, Human
ucccggcaccgggagccccugc

SEQ ID NO: 222978 - RNA, 22 nt, Human
ucccucacacagcugggagaac

SEQ ID NO: 222979 - RNA, 22 nt, Human
ucccugcagggccauugugcag

SEQ ID NO: 222980 - RNA, 22 nt, Human
ucccucugccugcaguccugcu

SEQ ID NO: 222981 - RNA, 22 nt, Human
ucccugcaggcauguacucuga

SEQ ID NO: 222982 - RNA, 22 nt, Human
ucccugagcucacauggcagga

SEQ ID NO: 222983 - RNA, 22 nt, Human
uacugcaguuccugcugucucc

SEQ ID NO: 222984 - RNA, 22 nt, Human
uacugaauuacugcugguaaau

SEQ ID NO: 222985 - RNA, 22 nt, Human
uacugagcauaaaacccauacu

SEQ ID NO: 222986 - RNA, 22 nt, Human
uacugacguaguagaguugcuu

SEQ ID NO: 222987 - RNA, 22 nt, Human
uccccgcugcgcccgcugcugc

SEQ ID NO: 222988 - RNA, 22 nt, Human
uacaggaggaugugcagccagg

SEQ ID NO: 222989 - RNA, 22 nt, Human
uccacaaagucuaugagaguug

SEQ ID NO: 222990 - RNA, 21 nt, Human
uccaggagcacgggacuagga

SEQ ID NO: 222991 - RNA, 22 nt, Human
uccagcuucugccugcugcugc

SEQ ID NO: 222992 - RNA, 22 nt, Human
uccagcugugcuccaggaggug

SEQ ID NO: 222993 - RNA, 22 nt, Human
uacuaccugcaggaacaauuag

SEQ ID NO: 222994 - RNA, 22 nt, Human
uccaucauucagaaauuuuuga

SEQ ID NO: 222995 - RNA, 22 nt, Human
uccaugcgcgauggccuggcuu

SEQ ID NO: 222996 - RNA, 22 nt, Human
uacguaauagcuuuauuuuggg

SEQ ID NO: 222997 - RNA, 22 nt, Human
uaccugguuucuuaaacccaaa

SEQ ID NO: 222998 - RNA, 22 nt, Human
uaccuggauaaauguacaaccg

SEQ ID NO: 222999 - RNA, 22 nt, Human
uacuaaacugcauuucuaucua

SEQ ID NO: 223000 - RNA, 22 nt, Human
uacuaaagaaugaguuaaguuu

SEQ ID NO: 223001 - RNA, 22 nt, Human
guggagaaagcuggaaucugag

SEQ ID NO: 223002 - RNA, 22 nt, Human
guggacuagaguaggaguugca

SEQ ID NO: 223003 - RNA, 22 nt, Human
guggaagauauuucugguccag

SEQ ID NO: 223004 - RNA, 22 nt, Human
guggaaauaugggcaacaaaga

SEQ ID NO: 223005 - RNA, 22 nt, Human
guggaaauuuuaggaucaucuu

SEQ ID NO: 223006 - RNA, 22 nt, Human
gugcugggaggcccaggaugga

SEQ ID NO: 223007 - RNA, 22 nt, Human
gugcuugcgcauaacuggggcc

SEQ ID NO: 223008 - RNA, 22 nt, Human
gugcugcaugagcaucacguag

SEQ ID NO: 223009 - RNA, 22 nt, Human
gugcuggcaaagagaacaucuu

SEQ ID NO: 223010 - RNA, 22 nt, Human
guggagaaauauguucagcuuc

SEQ ID NO: 223011 - RNA, 22 nt, Human
uagcuucccagcuaaccauguc

SEQ ID NO: 223012 - RNA, 22 nt, Human
guggauaaguuguuugaccuac

SEQ ID NO: 223013 - RNA, 22 nt, Human
guggauuguaccacgaaaagug

SEQ ID NO: 223014 - RNA, 22 nt, Human
guggauuucaggcuccccucag

SEQ ID NO: 223015 - RNA, 22 nt, Human
uaggagccagaauugcauuagu

SEQ ID NO: 223016 - RNA, 22 nt, Human
uaggauauuuuagaaugguaca

SEQ ID NO: 223017 - RNA, 22 nt, Human
uagccuguuuuuaugagaauuu

SEQ ID NO: 223018 - RNA, 22 nt, Human
uagccguugggguaacuggaca

SEQ ID NO: 223019 - RNA, 22 nt, Human
uagccaucaugaguaagggcuu

SEQ ID NO: 223020 - RNA, 22 nt, Human
uagcauuucacugaucuucacu

SEQ ID NO: 223021 - RNA, 22 nt, Human
uagaagaugccuuaaaguugaa

SEQ ID NO: 223022 - RNA, 22 nt, Human
uagaagaacaugucaaacuaua

SEQ ID NO: 223023 - RNA, 22 nt, Human
gugagagugguuuauguccaug

SEQ ID NO: 223024 - RNA, 22 nt, Human
uagaacaaacagcauguuugau

SEQ ID NO: 223025 - RNA, 22 nt, Human
uagaacuguaaauuaucucucc

SEQ ID NO: 223026 - RNA, 22 nt, Human
uagaacugcucucauacuugcu

SEQ ID NO: 223027 - RNA, 22 nt, Human
uagcugacagcagaagaguauu

SEQ ID NO: 223028 - RNA, 19 nt, Human
uagcuguucuugaguguga

SEQ ID NO: 223029 - RNA, 22 nt, Human
uagcuggaggggcaggaugcug

SEQ ID NO: 223030 - RNA, 22 nt, Human
uagcguaugcugugugaugaau

SEQ ID NO: 223031 - RNA, 22 nt, Human
gugcucuagaaauugucagugg

SEQ ID NO: 223032 - RNA, 21 nt, Human
uagcuugaucauuuuauuucc

SEQ ID NO: 223033 - RNA, 22 nt, Human
uagcugucauuggaucagaagg

SEQ ID NO: 223034 - RNA, 22 nt, Human
uaguaugaaaauuagcgggagg

SEQ ID NO: 223035 - RNA, 22 nt, Human
gugggggcagaagcgagugcag

SEQ ID NO: 223036 - RNA, 22 nt, Human
gugggggauggcgugugggucu

SEQ ID NO: 223037 - RNA, 22 nt, Human
gugggagggaguccugggagca

SEQ ID NO: 223038 - RNA, 22 nt, Human
gugggagaaugggaggaguaau

SEQ ID NO: 223039 - RNA, 22 nt, Human
gugggaaacagccuugcuucua

SEQ ID NO: 223040 - RNA, 18 nt, Human
gugggcacacacucuguu

SEQ ID NO: 223041 - RNA, 22 nt, Human
gugggccaguuccucacaggua

SEQ ID NO: 223042 - RNA, 22 nt, Human
uaguggcccagcauuucucaau

SEQ ID NO: 223043 - RNA, 22 nt, Human
uaguggaaacagacugagcccg

SEQ ID NO: 223044 - RNA, 22 nt, Human
uagugucuuccaggacauggua

SEQ ID NO: 223045 - RNA, 22 nt, Human
gugggugaguggggccgccuga

SEQ ID NO: 223046 - RNA, 22 nt, Human
uagucauaauucuugcugccuu

SEQ ID NO: 223047 - RNA, 22 nt, Human
uagucggcuaggagggccuucu

SEQ ID NO: 223048 - RNA, 22 nt, Human
guggcagagccuugcggcuuug

SEQ ID NO: 223049 - RNA, 22 nt, Human
guggcagagagcaagugucuga

SEQ ID NO: 223050 - RNA, 22 nt, Human
guggcaaguuuucugacaagga

SEQ ID NO: 223051 - RNA, 22 nt, Human
uagguauguuaacugugcaauu

SEQ ID NO: 223052 - RNA, 22 nt, Human
guggcauggggagcagcuagaa

SEQ ID NO: 223053 - RNA, 22 nt, Human
guggcaguaaagcuggaaaagu

SEQ ID NO: 223054 - RNA, 22 nt, Human
uaggcaauauuagacuuugucu

SEQ ID NO: 223055 - RNA, 22 nt, Human
uaggcaguagcuuuggauguca

SEQ ID NO: 223056 - RNA, 22 nt, Human
uaggcauguaaaagugaguucg

SEQ ID NO: 223057 - RNA, 22 nt, Human
uagguaauacuuagaccugauu

SEQ ID NO: 223058 - RNA, 22 nt, Human
uagguuguuguggggauuaagu

SEQ ID NO: 223059 - RNA, 22 nt, Human
uaggucugaggcugcaucuugg

SEQ ID NO: 223060 - RNA, 23 nt, Human
uaggucacacauugggugguugc

SEQ ID NO: 223061 - RNA, 22 nt, Human
uagguuuugugucagaguagaa

SEQ ID NO: 223062 - RNA, 22 nt, Human
guggcuuuguuuccaaaugaaa

SEQ ID NO: 223063 - RNA, 22 nt, Human
guggcuugguauuaaggugcca

SEQ ID NO: 223064 - RNA, 22 nt, Human
guggccugacagaucggaacag

SEQ ID NO: 223065 - RNA, 22 nt, Human
guggccuuccuguuccuuugaa

SEQ ID NO: 223066 - RNA, 22 nt, Human
guggcuggguggaacugagucu

SEQ ID NO: 223067 - RNA, 22 nt, Human
guugggugccagaggcuucacg

SEQ ID NO: 223068 - RNA, 22 nt, Human
guuggggccuggagucucuugg

SEQ ID NO: 223069 - RNA, 21 nt, Human
ucaaccagguguugaaggcac

SEQ ID NO: 223070 - RNA, 22 nt, Human
ucaagaagauaaugucuagggu

SEQ ID NO: 223071 - RNA, 22 nt, Human
ucaaauaugggccagaggaaau

SEQ ID NO: 223072 - RNA, 22 nt, Human
ucaacagaagugauagcuauua

SEQ ID NO: 223073 - RNA, 22 nt, Human
guugggcugaagugugugcuua

SEQ ID NO: 223074 - RNA, 22 nt, Human
ucaacauguuuuuuaaaagaaa

SEQ ID NO: 223075 - RNA, 22 nt, Human
ucaaaucuuuuuuccuucccug

SEQ ID NO: 223076 - RNA, 22 nt, Human
uauuuuuuuaacauuuauugua

SEQ ID NO: 223077 - RNA, 22 nt, Human
guugccugguuucaaaaggaau

SEQ ID NO: 223078 - RNA, 22 nt, Human
uauuuuauuuagguuuaguugu

SEQ ID NO: 223079 - RNA, 22 nt, Human
uauuuuagccaacagaaugaug

SEQ ID NO: 223080 - RNA, 22 nt, Human
guuggcgaaggaccuggaggag

SEQ ID NO: 223081 - RNA, 22 nt, Human
ucaaaaauaagauauucuggac

SEQ ID NO: 223082 - RNA, 22 nt, Human
guugcggaguguagcgaugcuu

SEQ ID NO: 223083 - RNA, 22 nt, Human
guugcuggggcugaguccccag

SEQ ID NO: 223084 - RNA, 22 nt, Human
guucuggaggagagccuggugu

SEQ ID NO: 223085 - RNA, 22 nt, Human
guucuguucuucacagguuugu

SEQ ID NO: 223086 - RNA, 22 nt, Human
guucucuuaauccuaguuggua

SEQ ID NO: 223087 - RNA, 22 nt, Human
guucuccaggggcuguucaucu

SEQ ID NO: 223088 - RNA, 22 nt, Human
guucucauugugaugcuuaguu

SEQ ID NO: 223089 - RNA, 22 nt, Human
guucuucagauuccauuucagu

SEQ ID NO: 223090 - RNA, 22 nt, Human
uauuuuaaaagcauuaauucuu

SEQ ID NO: 223091 - RNA, 22 nt, Human
uauuuuagaagauuuggagaaa

SEQ ID NO: 223092 - RNA, 22 nt, Human
guucgucuguggugugaggugc

SEQ ID NO: 223093 - RNA, 22 nt, Human
guuccucugugguggaggaagg

SEQ ID NO: 223094 - RNA, 22 nt, Human
guucggcuuccuaugucaugag

SEQ ID NO: 223095 - RNA, 22 nt, Human
guuauuaaauauuuuggugauu

SEQ ID NO: 223096 - RNA, 22 nt, Human
uauucagugcugguucuuuuuc

SEQ ID NO: 223097 - RNA, 22 nt, Human
guucaaggagcagcuugcuaca

SEQ ID NO: 223098 - RNA, 22 nt, Human
guucaaccaugauuaggaacug

SEQ ID NO: 223099 - RNA, 23 nt, Human
gugugccuuuaucuucuguacuc

SEQ ID NO: 223100 - RNA, 22 nt, Human
guguuggugagcucauuuccac

SEQ ID NO: 223101 - RNA, 22 nt, Human
guguugcaggaagauauagcug

SEQ ID NO: 223102 - RNA, 22 nt, Human
uauguauaacuugauaggauga

SEQ ID NO: 223103 - RNA, 22 nt, Human
guguuuguauccuccauauaac

SEQ ID NO: 223104 - RNA, 22 nt, Human
guguuucccuggcacaagaacc

SEQ ID NO: 223105 - RNA, 22 nt, Human
guuaggcagugugguauagcag

SEQ ID NO: 223106 - RNA, 22 nt, Human
uauguuaauuaccagcacugau

SEQ ID NO: 223107 - RNA, 22 nt, Human
uauguugucuuguucagccaua

SEQ ID NO: 223108 - RNA, 22 nt, Human
uaugugaguaccugucaugugc

SEQ ID NO: 223109 - RNA, 22 nt, Human
guuaaaggaagccauauguucg

SEQ ID NO: 223110 - RNA, 22 nt, Human
uaugugguuugucauuuaauau

SEQ ID NO: 223111 - RNA, 22 nt, Human
uauguggcaggugggagaucag

SEQ ID NO: 223112 - RNA, 22 nt, Human
guguagugugcuguucaguguu

SEQ ID NO: 223113 - RNA, 22 nt, Human
guguauaguggugucgguagaa

SEQ ID NO: 223114 - RNA, 22 nt, Human
uauccaucuucuuugagaaugg

SEQ ID NO: 223115 - RNA, 22 nt, Human
uauccauaccuucaaguuugcu

SEQ ID NO: 223116 - RNA, 22 nt, Human
guguucucagcacccacuucau

SEQ ID NO: 223117 - RNA, 20 nt, Human
uaugcgaagccuuucuggac

SEQ ID NO: 223118 - RNA, 22 nt, Human
uaugcauaauuggauaaguaga

SEQ ID NO: 223119 - RNA, 22 nt, Human
gugguggugaggcaaggggugu

SEQ ID NO: 223120 - RNA, 22 nt, Human
gugguuuagccuucauuaaccu

SEQ ID NO: 223121 - RNA, 22 nt, Human
uaucaguccaggguuuugugac

SEQ ID NO: 223122 - RNA, 22 nt, Human
gugguccugguugucugagaga

SEQ ID NO: 223123 - RNA, 22 nt, Human
gugggugauacugccgugggag

SEQ ID NO: 223124 - RNA, 22 nt, Human
guggguuggguuuuugaaggga

SEQ ID NO: 223125 - RNA, 22 nt, Human
guggucaagaccgggaauagga

SEQ ID NO: 223126 - RNA, 22 nt, Human
guagaaaauagauugucucuug

SEQ ID NO: 223127 - RNA, 22 nt, Human
guacuuccauccacauauaugu

SEQ ID NO: 223128 - RNA, 22 nt, Human
guacugguuuucuuacucuggc

SEQ ID NO: 223129 - RNA, 22 nt, Human
guauugauuguuuuaaaagauu

SEQ ID NO: 223130 - RNA, 21 nt, Human
uaagaacauuaucuucuuccu

SEQ ID NO: 223131 - RNA, 22 nt, Human
guaugucuuaggguucaguaac

SEQ ID NO: 223132 - RNA, 22 nt, Human
guauuggcaguauacauagcac

SEQ ID NO: 223133 - RNA, 22 nt, Human
uaagauuuuuacaaauagagug

SEQ ID NO: 223134 - RNA, 22 nt, Human
uaagcacuuuauaugcuuuauc

SEQ ID NO: 223135 - RNA, 22 nt, Human
uaaggcuguuaggaggauuaaa

SEQ ID NO: 223136 - RNA, 22 nt, Human
guauuugacaccagugaauggu

SEQ ID NO: 223137 - RNA, 22 nt, Human
uaagggagcagaagcugugaaa

SEQ ID NO: 223138 - RNA, 20 nt, Human
gucaucucagggacugucug

SEQ ID NO: 223139 - RNA, 22 nt, Human
gucagugcuuuaguucaggaug

SEQ ID NO: 223140 - RNA, 22 nt, Human
gucaggugcaccuccaccaaca

SEQ ID NO: 223141 - RNA, 22 nt, Human
gucacgucgggacagacugggg

SEQ ID NO: 223142 - RNA, 22 nt, Human
uaauauauuuuuuaagggaugu

SEQ ID NO: 223143 - RNA, 22 nt, Human
uaauauaacugccaguuaaggu

SEQ ID NO: 223144 - RNA, 22 nt, Human
gucccagaggacagggucacau

SEQ ID NO: 223145 - RNA, 22 nt, Human
guccccugcuguggaucugugg

SEQ ID NO: 223146 - RNA, 22 nt, Human
uaagugguagaaagagaaaggu

SEQ ID NO: 223147 - RNA, 22 nt, Human
guccacauaggaacccagcuuc

SEQ ID NO: 223148 - RNA, 22 nt, Human
guccuggagcagcuggaagaug

SEQ ID NO: 223149 - RNA, 22 nt, Human
uaauggagggucugagucuggg

SEQ ID NO: 223150 - RNA, 22 nt, Human
guccuuuauuugaacaugacau

SEQ ID NO: 223151 - RNA, 22 nt, Human
guccuguguaaguacuugcuca

SEQ ID NO: 223152 - RNA, 22 nt, Human
guccuuuuuuuauacccaggcc

SEQ ID NO: 223153 - RNA, 22 nt, Human
uaauugagauuucuggcugcuu

SEQ ID NO: 223154 - RNA, 22 nt, Human
uaauugaacguucauuuuuaau

SEQ ID NO: 223155 - RNA, 22 nt, Human
uaauucuucaauccaguguuca

SEQ ID NO: 223156 - RNA, 22 nt, Human
uaauuauuaauuuuagguugcu

SEQ ID NO: 223157 - RNA, 22 nt, Human
gugacugagcuggcaaaguaug

SEQ ID NO: 223158 - RNA, 22 nt, Human
gugacuaugguggagaucagua

SEQ ID NO: 223159 - RNA, 22 nt, Human
gugaagguccugauuugugacc

SEQ ID NO: 223160 - RNA, 22 nt, Human
uacuuuuuucacuucuagcccc

SEQ ID NO: 223161 - RNA, 23 nt, Human
gugagaccagagccuauucucag

SEQ ID NO: 223162 - RNA, 22 nt, Human
gugacugagugaagguugggua

SEQ ID NO: 223163 - RNA, 22 nt, Human
uacuugcaaggcucuuggaaua

SEQ ID NO: 223164 - RNA, 22 nt, Human
uacuugaacaucacuaagagaa

SEQ ID NO: 223165 - RNA, 22 nt, Human
uacuugaaaugggcaucaagag

SEQ ID NO: 223166 - RNA, 22 nt, Human
uaccgcagagucauugugagga

SEQ ID NO: 223167 - RNA, 22 nt, Human
uaccuuuuuauucuuaaggccg

SEQ ID NO: 223168 - RNA, 22 nt, Human
uacguuuuauaucuuuuggaau

SEQ ID NO: 223169 - RNA, 22 nt, Human
uacugggugagcugggcuggga

SEQ ID NO: 223170 - RNA, 22 nt, Human
gugaaaauaguaaccuggcuag

SEQ ID NO: 223171 - RNA, 22 nt, Human
gugaaaugaagugacuggauau

SEQ ID NO: 223172 - RNA, 22 nt, Human
gugaaauuguacacucaguacc

SEQ ID NO: 223173 - RNA, 22 nt, Human
uacuggguguucugagaaaaua

SEQ ID NO: 223174 - RNA, 22 nt, Human
uacugguguauuucuucuuauu

SEQ ID NO: 223175 - RNA, 23 nt, Human
gugaacaaugcuccaggagauac

SEQ ID NO: 223176 - RNA, 22 nt, Human
uacuucuuuuguaaaguauuga

SEQ ID NO: 223177 - RNA, 22 nt, Human
gucuguacugccguuauucaga

SEQ ID NO: 223178 - RNA, 22 nt, Human
uacauggauguuauccuuacug

SEQ ID NO: 223179 - RNA, 22 nt, Human
uacaugggcguguucaguuagu

SEQ ID NO: 223180 - RNA, 22 nt, Human
uacagauaaaaaugcuguucuu

SEQ ID NO: 223181 - RNA, 22 nt, Human
uacauaauagcaaggugcuguc

SEQ ID NO: 223182 - RNA, 22 nt, Human
uacagaccaguaguucucagcg

SEQ ID NO: 223183 - RNA, 22 nt, Human
uacaccuuaagccgcggcuccc

SEQ ID NO: 223184 - RNA, 22 nt, Human
gucuucugacacuguuaggagg

SEQ ID NO: 223185 - RNA, 22 nt, Human
gucuucuauuuggcaugacaga

SEQ ID NO: 223186 - RNA, 18 nt, Human
gucuguuccuuuaauguc

SEQ ID NO: 223187 - RNA, 22 nt, Human
gugaaaaauggccaucaggaca

SEQ ID NO: 223188 - RNA, 22 nt, Human
uaccgaagcugcuuuugcaugu

SEQ ID NO: 223189 - RNA, 22 nt, Human
gucuuuguaguuuuaauuugag

SEQ ID NO: 223190 - RNA, 22 nt, Human
uaauuuugucacagugacaugc

SEQ ID NO: 223191 - RNA, 22 nt, Human
gucugguggaguuguauauacu

SEQ ID NO: 223192 - RNA, 22 nt, Human
gucuggagccacugcugcugcu

SEQ ID NO: 223193 - RNA, 22 nt, Human
gucugugguccaaaauugccuc

SEQ ID NO: 223194 - RNA, 22 nt, Human
gucgagaacauucauuaugcaa

SEQ ID NO: 223195 - RNA, 22 nt, Human
gucgguacuaguacugguguug

SEQ ID NO: 223196 - RNA, 22 nt, Human
uaaaugaaaggguuuaauuuau

SEQ ID NO: 223197 - RNA, 22 nt, Human
guaaaucccucucuuuguagau

SEQ ID NO: 223198 - RNA, 22 nt, Human
guaaggcaggagucuuaaaccu

SEQ ID NO: 223199 - RNA, 22 nt, Human
uaaauguugcuugugcugcuca

SEQ ID NO: 223200 - RNA, 22 nt, Human
guaaccacuaugguuauugauu

SEQ ID NO: 223201 - RNA, 22 nt, Human
guaaauuaugucugggucaguu

SEQ ID NO: 223202 - RNA, 22 nt, Human
guaaauaucucacgaaugauuc

SEQ ID NO: 223203 - RNA, 22 nt, Human
guaauugcucauauggcaccug

SEQ ID NO: 223204 - RNA, 22 nt, Human
guacauauccuuuacguuuugu

SEQ ID NO: 223205 - RNA, 22 nt, Human
guacugggaauggagccugggc

SEQ ID NO: 223206 - RNA, 22 nt, Human
gguuuguggagcuggaaacacu

SEQ ID NO: 223207 - RNA, 22 nt, Human
gguuucuuuccucucugugccu

SEQ ID NO: 223208 - RNA, 22 nt, Human
uaaagugaaguucagaauggcu

SEQ ID NO: 223209 - RNA, 22 nt, Human
gguuugauauguuugugauucu

SEQ ID NO: 223210 - RNA, 22 nt, Human
uaaaccuuauuugaauaccaac

SEQ ID NO: 223211 - RNA, 22 nt, Human
uaaacgaagcuucaugcuugaa

SEQ ID NO: 223212 - RNA, 22 nt, Human
ggugugaauagagccuggagca

SEQ ID NO: 223213 - RNA, 22 nt, Human
gguguggcaguggaccugugaa

SEQ ID NO: 223214 - RNA, 22 nt, Human
gguguguaggugaaggccaaga

SEQ ID NO: 223215 - RNA, 22 nt, Human
ggugucagccacuuugucggag

SEQ ID NO: 223216 - RNA, 22 nt, Human
gguugaagcuacuuucuggaug

SEQ ID NO: 223217 - RNA, 22 nt, Human
uaaaaccauucauugaccuaug

SEQ ID NO: 223218 - RNA, 22 nt, Human
ggugugugugugugugugugug

SEQ ID NO: 223219 - RNA, 23 nt, Human
guuuuugcugcagcugaagaagg

SEQ ID NO: 223220 - RNA, 22 nt, Human
uaaaaauuagauauguauuuag

SEQ ID NO: 223221 - RNA, 22 nt, Human
ggugacuucugaaccuggagug

SEQ ID NO: 223222 - RNA, 22 nt, Human
guuuguuugccagcuuaguaaa

SEQ ID NO: 223223 - RNA, 22 nt, Human
guuuguguauauguguauuuuu

SEQ ID NO: 223224 - RNA, 22 nt, Human
gguguacgaagaggcgggaguc

SEQ ID NO: 223225 - RNA, 22 nt, Human
gguguaaucacaagcuggaauu

SEQ ID NO: 223226 - RNA, 22 nt, Human
ggugguucagugguuagggcca

SEQ ID NO: 223227 - RNA, 22 nt, Human
gguguaaggaagauggaagaug

SEQ ID NO: 223228 - RNA, 22 nt, Human
ggugccugggcacggaaagcau

SEQ ID NO: 223229 - RNA, 22 nt, Human
ggugcaaagauggcaguugcaa

SEQ ID NO: 223230 - RNA, 22 nt, Human
guuggugagaguuagggauuua

SEQ ID NO: 223231 - RNA, 22 nt, Human
guugucuggcucugaccauucu

SEQ ID NO: 223232 - RNA, 19 nt, Human
gguccguuacaggcuuucc

SEQ ID NO: 223233 - RNA, 22 nt, Human
ggucgucuguccugucgccgcu

SEQ ID NO: 223234 - RNA, 22 nt, Human
guugugcaaaacaggaaggucu

SEQ ID NO: 223235 - RNA, 22 nt, Human
guuguuuucagcccagcauuag

SEQ ID NO: 223236 - RNA, 22 nt, Human
guuguugcuauguuauuguuau

SEQ ID NO: 223237 - RNA, 22 nt, Human
guuguuaagugcugguuguuag

SEQ ID NO: 223238 - RNA, 22 nt, Human
gugcuguuagcgguuuauaaca

SEQ ID NO: 223239 - RNA, 22 nt, Human
gugcugucguggaacugggcug

SEQ ID NO: 223240 - RNA, 22 nt, Human
gugcuugaguaaaaauagucuu

SEQ ID NO: 223241 - RNA, 22 nt, Human
guugcuucuuggcuuuuccaac

SEQ ID NO: 223242 - RNA, 22 nt, Human
guuggaaauaucagucacguga

SEQ ID NO: 223243 - RNA, 22 nt, Human
guugggguuucaguggcaguca

SEQ ID NO: 223244 - RNA, 22 nt, Human
guuggguaauuaagcacagaaa

SEQ ID NO: 223245 - RNA, 20 nt, Human
guugggagaagugucagcug

SEQ ID NO: 223246 - RNA, 22 nt, Human
guugggauugaaggugccucua

SEQ ID NO: 223247 - RNA, 22 nt, Human
guuggaggaaggacaggaacag

SEQ ID NO: 223248 - RNA, 22 nt, Human
guuuaagcagauugcuguggug

SEQ ID NO: 223249 - RNA, 22 nt, Human
guuuauucuuuuauuugugaga

SEQ ID NO: 223250 - RNA, 22 nt, Human
guuuauuucuuaucaucacuau

SEQ ID NO: 223251 - RNA, 22 nt, Human
guuuaucagagagcagaggugg

SEQ ID NO: 223252 - RNA, 22 nt, Human
guuuaaaagcaaccaacaggcu

SEQ ID NO: 223253 - RNA, 22 nt, Human
ggucugcaaugauuugaaaaac

SEQ ID NO: 223254 - RNA, 22 nt, Human
ggucuuauaauuaauuuaggcu

SEQ ID NO: 223255 - RNA, 19 nt, Human
ggucugcggggugaccgug

SEQ ID NO: 223256 - RNA, 22 nt, Human
guuugaacagaaggguugauca

SEQ ID NO: 223257 - RNA, 22 nt, Human
ggugaucucuggcucugcuugu

SEQ ID NO: 223258 - RNA, 22 nt, Human
guuucuguguugauugugcccu

SEQ ID NO: 223259 - RNA, 22 nt, Human
guuucuguggacucugcuuagg

SEQ ID NO: 223260 - RNA, 22 nt, Human
guuuccuuuugugguuuuucua

SEQ ID NO: 223261 - RNA, 22 nt, Human
ggugaguaguggaaaugaauga

SEQ ID NO: 223262 - RNA, 23 nt, Human
ggugagccuuucuaguagucuug

SEQ ID NO: 223263 - RNA, 22 nt, Human
ggugaggggauccuguuaccau

SEQ ID NO: 223264 - RNA, 22 nt, Human
ggugagagaaaagaaacacugu

SEQ ID NO: 223265 - RNA, 22 nt, Human
ggugaaggaucccucuuggccu

SEQ ID NO: 223266 - RNA, 22 nt, Human
gucugaaauaucuuuugucuug

SEQ ID NO: 223267 - RNA, 22 nt, Human
gucugcacgugccagggagggg

SEQ ID NO: 223268 - RNA, 22 nt, Human
gucugcccuuggccugggacuu

SEQ ID NO: 223269 - RNA, 22 nt, Human
gucuauuuauagacagauccua

SEQ ID NO: 223270 - RNA, 22 nt, Human
gucuccugcccacccugguccc

SEQ ID NO: 223271 - RNA, 22 nt, Human
gucuccuucauuuacuguuucc

SEQ ID NO: 223272 - RNA, 22 nt, Human
ggcuggacuuucugcugggcuc

SEQ ID NO: 223273 - RNA, 22 nt, Human
ggcugggaggcggaggcugaga

SEQ ID NO: 223274 - RNA, 22 nt, Human
gucugcuuuuaucacaugucau

SEQ ID NO: 223275 - RNA, 22 nt, Human
gucugcucauguuugguuugug

SEQ ID NO: 223276 - RNA, 22 nt, Human
gucuggugguggguguagggca

SEQ ID NO: 223277 - RNA, 22 nt, Human
gucgcuuuccugaggggucuca

SEQ ID NO: 223278 - RNA, 22 nt, Human
gucggagcggcugcacaggggg

SEQ ID NO: 223279 - RNA, 22 nt, Human
ggcugcagugcaacucuuucua

SEQ ID NO: 223280 - RNA, 17 nt, Human
ggcugccaggcaacaua

SEQ ID NO: 223281 - RNA, 22 nt, Human
ggcugcuugggcuguuucuuuu

SEQ ID NO: 223282 - RNA, 22 nt, Human
ggcugcuggaguugggucucuc

SEQ ID NO: 223283 - RNA, 22 nt, Human
ggcugcugcccaccccugcaug

SEQ ID NO: 223284 - RNA, 22 nt, Human
gucguucugcuauucuaugagg

SEQ ID NO: 223285 - RNA, 22 nt, Human
gucguuugucaauuuugaugug

SEQ ID NO: 223286 - RNA, 22 nt, Human
gucgucgcucccaccuuccgcu

SEQ ID NO: 223287 - RNA, 22 nt, Human
guccaggucauuuaaaaagucc

SEQ ID NO: 223288 - RNA, 22 nt, Human
guccaguaguguuugcaugugg

SEQ ID NO: 223289 - RNA, 19 nt, Human
guccaugguaaagaaggau

SEQ ID NO: 223290 - RNA, 22 nt, Human
gucaucugagggacgagauuuc

SEQ ID NO: 223291 - RNA, 22 nt, Human
ggcuccaggguaccccuggaug

SEQ ID NO: 223292 - RNA, 22 nt, Human
gucaugaugauacagguggagg

SEQ ID NO: 223293 - RNA, 23 nt, Human
gucauuacuguuaccuuauucuu

SEQ ID NO: 223294 - RNA, 22 nt, Human
ggcuagggagacagagggcaug

SEQ ID NO: 223295 - RNA, 23 nt, Human
ggcgugcugggcugacccuuggc

SEQ ID NO: 223296 - RNA, 22 nt, Human
ggcuaaggacgggcaaguccca

SEQ ID NO: 223297 - RNA, 22 nt, Human
ggcgggucuagggcccuggagu

SEQ ID NO: 223298 - RNA, 22 nt, Human
ggcugcaagacguuauuagcgu

SEQ ID NO: 223299 - RNA, 22 nt, Human
ggcucuggcgagcuuuaguaca

SEQ ID NO: 223300 - RNA, 22 nt, Human
ggcucuccacuauggaugagaa

SEQ ID NO: 223301 - RNA, 22 nt, Human
ggcuccugggcgucuucgaaca

SEQ ID NO: 223302 - RNA, 22 nt, Human
ggcuccucaggcugggguaagg

SEQ ID NO: 223303 - RNA, 22 nt, Human
guccuggugccaccugcgggau

SEQ ID NO: 223304 - RNA, 22 nt, Human
gucccuggucuaccguggcuuc

SEQ ID NO: 223305 - RNA, 22 nt, Human
guauuaagaaaugccugugaaa

SEQ ID NO: 223306 - RNA, 22 nt, Human
guauuaugaaugccgaggcggc

SEQ ID NO: 223307 - RNA, 22 nt, Human
guauuugcaaucacaaacaaaa

SEQ ID NO: 223308 - RNA, 22 nt, Human
guauucugugugaucaagugau

SEQ ID NO: 223309 - RNA, 22 nt, Human
gucaaugcuuaguuugccugaa

SEQ ID NO: 223310 - RNA, 22 nt, Human
gucaagaugcuacauaauggga

SEQ ID NO: 223311 - RNA, 22 nt, Human
gucacaaaugauuuagcaauca

SEQ ID NO: 223312 - RNA, 22 nt, Human
gucaccgguuuuuagguaaaca

SEQ ID NO: 223313 - RNA, 22 nt, Human
gucagacugaguuccuggguac

SEQ ID NO: 223314 - RNA, 22 nt, Human
gucaggaugagggaugaggagu

SEQ ID NO: 223315 - RNA, 22 nt, Human
gucaguccugugccuuuccgga

SEQ ID NO: 223316 - RNA, 22 nt, Human
gucagugaaccuucaccaaacc

SEQ ID NO: 223317 - RNA, 22 nt, Human
gucacuccuucccagagggagc

SEQ ID NO: 223318 - RNA, 20 nt, Human
gucagaggacccuagagcga

SEQ ID NO: 223319 - RNA, 22 nt, Human
ggcggcaagggaauggagaaga

SEQ ID NO: 223320 - RNA, 22 nt, Human
ggcggcugcuccuugcccucgg

SEQ ID NO: 223321 - RNA, 22 nt, Human
ggcggugcgaggaugcagggcu

SEQ ID NO: 223322 - RNA, 22 nt, Human
guauaaauaucuauauuguuac

SEQ ID NO: 223323 - RNA, 22 nt, Human
guauaaagaugccauacuuacu

SEQ ID NO: 223324 - RNA, 22 nt, Human
ggcgacuacugaaugcuugaaa

SEQ ID NO: 223325 - RNA, 22 nt, Human
ggccccagggauuaggccaacc

SEQ ID NO: 223326 - RNA, 22 nt, Human
ggccagcuuugagcugcaggaa

SEQ ID NO: 223327 - RNA, 22 nt, Human
gguuuucagaaugcaguccugu

SEQ ID NO: 223328 - RNA, 22 nt, Human
gguuugggaagaacuauucccu

SEQ ID NO: 223329 - RNA, 22 nt, Human
gguuuucacgauccucccuuuu

SEQ ID NO: 223330 - RNA, 22 nt, Human
gguuugccagugcuggaaugca

SEQ ID NO: 223331 - RNA, 22 nt, Human
ggcgaugaggucuuagaaucua

SEQ ID NO: 223332 - RNA, 22 nt, Human
ggcgcaguguucgcccucucgc

SEQ ID NO: 223333 - RNA, 22 nt, Human
ggcgauuggccgggaggaggca

SEQ ID NO: 223334 - RNA, 22 nt, Human
guaucaggacuaaauuauggau

SEQ ID NO: 223335 - RNA, 22 nt, Human
guauauccaauaggugaugaaa

SEQ ID NO: 223336 - RNA, 22 nt, Human
ggcgccugguauucuuccucuc

SEQ ID NO: 223337 - RNA, 22 nt, Human
ggcgccuuguggaaugagagcu

SEQ ID NO: 223338 - RNA, 22 nt, Human
guauggaguuuuguugcacuuc

SEQ ID NO: 223339 - RNA, 22 nt, Human
guaugaguggauagauguaucu

SEQ ID NO: 223340 - RNA, 22 nt, Human
gugauggggagagcgcagcuuu

SEQ ID NO: 223341 - RNA, 22 nt, Human
gugaucagaagaaccugccgaa

SEQ ID NO: 223342 - RNA, 22 nt, Human
gugaugugugaaggucugcagg

SEQ ID NO: 223343 - RNA, 19 nt, Human
gugaugaugccacuccaac

SEQ ID NO: 223344 - RNA, 20 nt, Human
gggaauggauggauugcucc

SEQ ID NO: 223345 - RNA, 22 nt, Human
gggaaguugguaagaggcuguu

SEQ ID NO: 223346 - RNA, 22 nt, Human
gggacucugaaucuagauuccu

SEQ ID NO: 223347 - RNA, 22 nt, Human
gugcaaugaguguggcaaagcc

SEQ ID NO: 223348 - RNA, 22 nt, Human
gugauuucagguuuuucauacu

SEQ ID NO: 223349 - RNA, 22 nt, Human
gugcagcugggcgcugaccuuc

SEQ ID NO: 223350 - RNA, 22 nt, Human
gugcacuugaucuagacagauu

SEQ ID NO: 223351 - RNA, 22 nt, Human
gugcauauguguguauacaaac

SEQ ID NO: 223352 - RNA, 22 nt, Human
gggagaguagcuggaagguucu

SEQ ID NO: 223353 - RNA, 22 nt, Human
gggagcuggagcuggaagacuc

SEQ ID NO: 223354 - RNA, 22 nt, Human
gggaggaagaguaggaauuuga

SEQ ID NO: 223355 - RNA, 21 nt, Human
gggagccucauuuucuucauc

SEQ ID NO: 223356 - RNA, 22 nt, Human
gggagcccuggacgggcgguau

SEQ ID NO: 223357 - RNA, 22 nt, Human
gggagcucaccaugcucugcau

SEQ ID NO: 223358 - RNA, 21 nt, Human
gggagugaguaaugauggggg

SEQ ID NO: 223359 - RNA, 22 nt, Human
gggaguggagagugaagcuaau

SEQ ID NO: 223360 - RNA, 22 nt, Human
gggagguaaugggggugcaggg

SEQ ID NO: 223361 - RNA, 22 nt, Human
gugccugcucauucucaauauu

SEQ ID NO: 223362 - RNA, 21 nt, Human
gggagugucuguugcaaggug

SEQ ID NO: 223363 - RNA, 22 nt, Human
gugccuuuuucccaguucauug

SEQ ID NO: 223364 - RNA, 22 nt, Human
gugccuggaaucuuuucuucac

SEQ ID NO: 223365 - RNA, 22 nt, Human
gugccgcuggagcuggaauuga

SEQ ID NO: 223366 - RNA, 22 nt, Human
gugccaccagaugcuguugcua

SEQ ID NO: 223367 - RNA, 22 nt, Human
gggagggaggagccccggccau

SEQ ID NO: 223368 - RNA, 22 nt, Human
gggagggcuuggacccagaugu

SEQ ID NO: 223369 - RNA, 22 nt, Human
gugccgggcugcggcaaggugu

SEQ ID NO: 223370 - RNA, 22 nt, Human
gugcucaucuucuguaacuguu

SEQ ID NO: 223371 - RNA, 22 nt, Human
gugcucgagcugugcgcgcugc

SEQ ID NO: 223372 - RNA, 22 nt, Human
gggauguauguuuguguggaga

SEQ ID NO: 223373 - RNA, 19 nt, Human
gggauuccuggcuuuagaa

SEQ ID NO: 223374 - RNA, 22 nt, Human
gggcaagaagcuggaagcauuc

SEQ ID NO: 223375 - RNA, 22 nt, Human
gggcaagagaggaagagauggc

SEQ ID NO: 223376 - RNA, 22 nt, Human
gugcugcaaggauggagaggca

SEQ ID NO: 223377 - RNA, 22 nt, Human
gugacucuacuuaagauuaagc

SEQ ID NO: 223378 - RNA, 22 nt, Human
gggaaaucugcuuccuagggcu

SEQ ID NO: 223379 - RNA, 22 nt, Human
gggaacuguaguuuacgcugcc

SEQ ID NO: 223380 - RNA, 21 nt, Human
gugaccuguuaugcaaaggca

SEQ ID NO: 223381 - RNA, 22 nt, Human
gugaccagacagagucuagccc

SEQ ID NO: 223382 - RNA, 22 nt, Human
gugaaggggaagcagggagagg

SEQ ID NO: 223383 - RNA, 20 nt, Human
gugaaguuuucugaagacag

SEQ ID NO: 223384 - RNA, 22 nt, Human
ggcuuuuucccuaggguaagag

SEQ ID NO: 223385 - RNA, 22 nt, Human
gugaaggcaugugugcugugcu

SEQ ID NO: 223386 - RNA, 22 nt, Human
gugaagcacaugggcguugggu

SEQ ID NO: 223387 - RNA, 22 nt, Human
gugauauaacaauuuagggaau

SEQ ID NO: 223388 - RNA, 22 nt, Human
gugaggugauugcugguguuug

SEQ ID NO: 223389 - RNA, 22 nt, Human
gggaagaaccucugcuaccaau

SEQ ID NO: 223390 - RNA, 22 nt, Human
gugagaggaggcagcuuuuaca

SEQ ID NO: 223391 - RNA, 22 nt, Human
gggaagugcaguuuucuuuugg

SEQ ID NO: 223392 - RNA, 22 nt, Human
gggaagagggagcuggaaugau

SEQ ID NO: 223393 - RNA, 22 nt, Human
gggaagaagaaaagagguggga

SEQ ID NO: 223394 - RNA, 22 nt, Human
gggaagaacugauuucacacca

SEQ ID NO: 223395 - RNA, 19 nt, Human
gugauauuuauuauuuauu

SEQ ID NO: 223396 - RNA, 22 nt, Human
ggcuucaaaacacaugucaaga

SEQ ID NO: 223397 - RNA, 22 nt, Human
gugaaacuggaugugaaaacaa

SEQ ID NO: 223398 - RNA, 22 nt, Human
ggcuuguaggugauggagaacu

SEQ ID NO: 223399 - RNA, 22 nt, Human
ggcuuuuguuauaaucaggccu

SEQ ID NO: 223400 - RNA, 22 nt, Human
ggcuucucuuggccaugguccc

SEQ ID NO: 223401 - RNA, 20 nt, Human
gugaacuggagaacugaugu

SEQ ID NO: 223402 - RNA, 21 nt, Human
ggcuguuaauagugauuagaa

SEQ ID NO: 223403 - RNA, 22 nt, Human
ggcugugguggacgcgggaaac

SEQ ID NO: 223404 - RNA, 22 nt, Human
ggcuguggcagcuggaaguggu

SEQ ID NO: 223405 - RNA, 22 nt, Human
gucuuugagccucaguuuccuc

SEQ ID NO: 223406 - RNA, 22 nt, Human
ggcugguggcgggcagcacaga

SEQ ID NO: 223407 - RNA, 22 nt, Human
gucuuucuuuuacauauuugug

SEQ ID NO: 223408 - RNA, 22 nt, Human
gggaaaugugucuuggcauucu

SEQ ID NO: 223409 - RNA, 22 nt, Human
gcuuagaugcugucauucacca

SEQ ID NO: 223410 - RNA, 22 nt, Human
gcuuacuguuccuguuggugcu

SEQ ID NO: 223411 - RNA, 22 nt, Human
gggaaaauguuucugagacaaa

SEQ ID NO: 223412 - RNA, 22 nt, Human
gggaaauagagcuggaaccuug

SEQ ID NO: 223413 - RNA, 23 nt, Human
gggaaaucaaaagauauuucuuc

SEQ ID NO: 223414 - RNA, 22 nt, Human
gggaaaaaggaguuagagauaa

SEQ ID NO: 223415 - RNA, 22 nt, Human
gcuuacagauaaugaggagacu

SEQ ID NO: 223416 - RNA, 22 nt, Human
gcuguuucuuuggcaaacugau

SEQ ID NO: 223417 - RNA, 22 nt, Human
gcuguugagucagacaaguuuu

SEQ ID NO: 223418 - RNA, 22 nt, Human
gcuguuggaggaguucagugcu

SEQ ID NO: 223419 - RNA, 19 nt, Human
ggcuuugcccuucgcuccg

SEQ ID NO: 223420 - RNA, 22 nt, Human
ggcuucuuaacauuuggacacc

SEQ ID NO: 223421 - RNA, 22 nt, Human
gggaaaaaggaaccuuauuacu

SEQ ID NO: 223422 - RNA, 22 nt, Human
ggcuuugggaggaugaggcggu

SEQ ID NO: 223423 - RNA, 21 nt, Human
ggccagauucucccauagcug

SEQ ID NO: 223424 - RNA, 22 nt, Human
ggccaccuaagguugugcauca

SEQ ID NO: 223425 - RNA, 20 nt, Human
ggcauuuuuuaguugagcuu

SEQ ID NO: 223426 - RNA, 22 nt, Human
ggccaauuuccuagacauuagu

SEQ ID NO: 223427 - RNA, 22 nt, Human
gcuugcuuuguaaauaucugug

SEQ ID NO: 223428 - RNA, 22 nt, Human
gggaagugagcuggaaucaagg

SEQ ID NO: 223429 - RNA, 22 nt, Human
gcuugcaucaggggcuggggcc

SEQ ID NO: 223430 - RNA, 22 nt, Human
gggacgggcuagcugccguggc

SEQ ID NO: 223431 - RNA, 22 nt, Human
gggaauguuaaccuuucuauuu

SEQ ID NO: 223432 - RNA, 22 nt, Human
gggaauuuuaggaugacuccua

SEQ ID NO: 223433 - RNA, 22 nt, Human
gggacaggacuccuggggccug

SEQ ID NO: 223434 - RNA, 22 nt, Human
gcuugggcugaaggccuggguc

SEQ ID NO: 223435 - RNA, 22 nt, Human
gcuuguuuagcauaggucacug

SEQ ID NO: 223436 - RNA, 21 nt, Human
gcuucaauucauccaccucuc

SEQ ID NO: 223437 - RNA, 22 nt, Human
gcuuccuccaucuggggcuugc

SEQ ID NO: 223438 - RNA, 22 nt, Human
gcuuccuuagcuuaccaaguau

SEQ ID NO: 223439 - RNA, 18 nt, Human
gggaagaugccacaguga

SEQ ID NO: 223440 - RNA, 22 nt, Human
gcuucucacccuuacuaucucu

SEQ ID NO: 223441 - RNA, 21 nt, Human
gggaagagaagagaaaggagg

SEQ ID NO: 223442 - RNA, 22 nt, Human
ggaauuauuuuaaauagacauu

SEQ ID NO: 223443 - RNA, 22 nt, Human
gggcuguuugcauauguuuaua

SEQ ID NO: 223444 - RNA, 22 nt, Human
ggaaugcuuggcaugagaaccu

SEQ ID NO: 223445 - RNA, 23 nt, Human
ggacgugaggcgcccuuuuuccc

SEQ ID NO: 223446 - RNA, 22 nt, Human
ggacggcuagcagcagaauuca

SEQ ID NO: 223447 - RNA, 21 nt, Human
ggacccuuagauuuuaucuga

SEQ ID NO: 223448 - RNA, 22 nt, Human
ggaaguggauucagggcugcua

SEQ ID NO: 223449 - RNA, 22 nt, Human
ggaagcugucugcccggcgcuc

SEQ ID NO: 223450 - RNA, 22 nt, Human
gggccuguccccccaggagaac

SEQ ID NO: 223451 - RNA, 22 nt, Human
ggaaucuucagccaugccaaga

SEQ ID NO: 223452 - RNA, 22 nt, Human
ggaauauaaaucagaugcuccg

SEQ ID NO: 223453 - RNA, 22 nt, Human
ggaauaauauuacagauacagu

SEQ ID NO: 223454 - RNA, 22 nt, Human
gggccgcagccucuccggccug

SEQ ID NO: 223455 - RNA, 22 nt, Human
gggccaggaugugguucauuuu

SEQ ID NO: 223456 - RNA, 22 nt, Human
ggaagauagaaguucaaaaguu

SEQ ID NO: 223457 - RNA, 22 nt, Human
ggaagaagagggagcuguggga

SEQ ID NO: 223458 - RNA, 22 nt, Human
ggaaauauaagcaguuugugug

SEQ ID NO: 223459 - RNA, 22 nt, Human
ggaaaggggaaaauacagagag

SEQ ID NO: 223460 - RNA, 22 nt, Human
ggaaaggaagggaaggagaugc

SEQ ID NO: 223461 - RNA, 22 nt, Human
gggcagagggcgagcugggaga

SEQ ID NO: 223462 - RNA, 22 nt, Human
gggagauuuguguaggaaaacu

SEQ ID NO: 223463 - RNA, 22 nt, Human
gggagaaccagccagugcaagg

SEQ ID NO: 223464 - RNA, 22 nt, Human
gggacugguuguguguggugug

SEQ ID NO: 223465 - RNA, 19 nt, Human
gggagaaaaucuuuauccu

SEQ ID NO: 223466 - RNA, 22 nt, Human
gcuuuugagaaaguguuuuccc

SEQ ID NO: 223467 - RNA, 22 nt, Human
gcuuuuuaauuugcuucccugg

SEQ ID NO: 223468 - RNA, 22 nt, Human
gcuuuugcaaagcuggagaauu

SEQ ID NO: 223469 - RNA, 22 nt, Human
gggauacuuuguuucccugcca

SEQ ID NO: 223470 - RNA, 22 nt, Human
ggguuuguuccuacuucuacuc

SEQ ID NO: 223471 - RNA, 22 nt, Human
ggaugauacuuggagaaauauu

SEQ ID NO: 223472 - RNA, 22 nt, Human
gguaagcacuucauguacauga

SEQ ID NO: 223473 - RNA, 22 nt, Human
gguaagguugggugucagaggg

SEQ ID NO: 223474 - RNA, 22 nt, Human
ggaucccaucgagcuggcuguc

SEQ ID NO: 223475 - RNA, 22 nt, Human
ggaucaccagguuuguuguugg

SEQ ID NO: 223476 - RNA, 22 nt, Human
ggaucgauuccaaauguagauc

SEQ ID NO: 223477 - RNA, 22 nt, Human
ggaucguauuucaguuuuuugg

SEQ ID NO: 223478 - RNA, 22 nt, Human
ggguuggaggcauugaaacaga

SEQ ID NO: 223479 - RNA, 22 nt, Human
ggguggcaagucuuucugcaac

SEQ ID NO: 223480 - RNA, 22 nt, Human
ggguuaaauggauggcauuugc

SEQ ID NO: 223481 - RNA, 22 nt, Human
ggguggugagagaacuuugcag

SEQ ID NO: 223482 - RNA, 22 nt, Human
gggugcuucauaggugaugcug

SEQ ID NO: 223483 - RNA, 22 nt, Human
ggaguguaagugacucaccugg

SEQ ID NO: 223484 - RNA, 22 nt, Human
ggagucguguuugggaucggag

SEQ ID NO: 223485 - RNA, 22 nt, Human
ggagucugugucuugaagcagu

SEQ ID NO: 223486 - RNA, 22 nt, Human
ggaggguggaggagggaauuga

SEQ ID NO: 223487 - RNA, 22 nt, Human
gggugcuuaagcuuguuuguaa

SEQ ID NO: 223488 - RNA, 22 nt, Human
gggcuuuuccauuccaggguuc

SEQ ID NO: 223489 - RNA, 20 nt, Human
gggcuuugagcucagggcuu

SEQ ID NO: 223490 - RNA, 22 nt, Human
ggagcagaggaaagaguagcau

SEQ ID NO: 223491 - RNA, 22 nt, Human
ggagaugacaucccagcccggc

SEQ ID NO: 223492 - RNA, 22 nt, Human
ggagauggucacagguaaacau

SEQ ID NO: 223493 - RNA, 22 nt, Human
gggggagaauaugugaaggggg

SEQ ID NO: 223494 - RNA, 22 nt, Human
ggggcugggaggccggcgcgca

SEQ ID NO: 223495 - RNA, 22 nt, Human
ggggcuuggguagagcagaaac

SEQ ID NO: 223496 - RNA, 19 nt, Human
ggagcagauaaacauacuu

SEQ ID NO: 223497 - RNA, 22 nt, Human
gggugcauggcagcccuucugg

SEQ ID NO: 223498 - RNA, 22 nt, Human
ggaggaugaggguggugguguu

SEQ ID NO: 223499 - RNA, 22 nt, Human
ggaggaggggcggggaggggag

SEQ ID NO: 223500 - RNA, 22 nt, Human
ggaggccagagaagagccaggc

SEQ ID NO: 223501 - RNA, 21 nt, Human
gggguuuuguucuuauaaugu

SEQ ID NO: 223502 - RNA, 22 nt, Human
ggaggagggaguucaggaguau

SEQ ID NO: 223503 - RNA, 22 nt, Human
gggggcgcguggagggccgugg

SEQ ID NO: 223504 - RNA, 22 nt, Human
ggagcaucuaccauuucuagau

SEQ ID NO: 223505 - RNA, 22 nt, Human
ggagcauggcuucuuggggcug

SEQ ID NO: 223506 - RNA, 22 nt, Human
ggaggaaauccuuaguaaggca

SEQ ID NO: 223507 - RNA, 22 nt, Human
ggagcuaagagaauggacaagg

SEQ ID NO: 223508 - RNA, 23 nt, Human
ggauggacauacguaugcacagg

SEQ ID NO: 223509 - RNA, 22 nt, Human
ggaugauuuucaguuguguggg

SEQ ID NO: 223510 - RNA, 22 nt, Human
ggaugcagcagagaccuggagu

SEQ ID NO: 223511 - RNA, 22 nt, Human
ggauggaugugaucugccuccu

SEQ ID NO: 223512 - RNA, 22 nt, Human
gguaaucuccucauugacguua

SEQ ID NO: 223513 - RNA, 22 nt, Human
ggcaagcacugggugucuuagc

SEQ ID NO: 223514 - RNA, 22 nt, Human
ggaugcguuugaauguguuugu

SEQ ID NO: 223515 - RNA, 20 nt, Human
ggucagccaagaaguuaccu

SEQ ID NO: 223516 - RNA, 22 nt, Human
ggucaaucaugggucauugucu

SEQ ID NO: 223517 - RNA, 22 nt, Human
ggucaucacugagagcagaucc

SEQ ID NO: 223518 - RNA, 22 nt, Human
ggcagauaaacaauguuguaua

SEQ ID NO: 223519 - RNA, 22 nt, Human
ggcagagcugugcgcccaccca

SEQ ID NO: 223520 - RNA, 22 nt, Human
ggcagaggaagcuggaaguggg

SEQ ID NO: 223521 - RNA, 20 nt, Human
ggcagagcuaugucuguugc

SEQ ID NO: 223522 - RNA, 22 nt, Human
ggugaggagaaacucugccccu

SEQ ID NO: 223523 - RNA, 18 nt, Human
ggugagggagcuggaagc

SEQ ID NO: 223524 - RNA, 22 nt, Human
ggcacagcgacuaccaucgaaa

SEQ ID NO: 223525 - RNA, 22 nt, Human
ggcaaggaagaaagcagaaguu

SEQ ID NO: 223526 - RNA, 22 nt, Human
gguguggguguuaguuugcuua

SEQ ID NO: 223527 - RNA, 22 nt, Human
ggugucguuucacaugacccag

SEQ ID NO: 223528 - RNA, 22 nt, Human
ggugucuuugauguugggcuga

SEQ ID NO: 223529 - RNA, 22 nt, Human
ggcauugauggggucuugggga

SEQ ID NO: 223530 - RNA, 22 nt, Human
gguguuccgguucugcucuggg

SEQ ID NO: 223531 - RNA, 22 nt, Human
gguuauuucugauuauaugaua

SEQ ID NO: 223532 - RNA, 22 nt, Human
ggccaaagagcacaaugaauag

SEQ ID NO: 223533 - RNA, 22 nt, Human
ggccacauuccagagggcugaa

SEQ ID NO: 223534 - RNA, 19 nt, Human
ggccacacuauuaaaagau

SEQ ID NO: 223535 - RNA, 22 nt, Human
ggccacgggguuugcugaaacu

SEQ ID NO: 223536 - RNA, 22 nt, Human
gguugcggaccagcugggcugc

SEQ ID NO: 223537 - RNA, 22 nt, Human
ggugauaaaaagcauuuaaauu

SEQ ID NO: 223538 - RNA, 22 nt, Human
ggugcuggggaaauuaggguag

SEQ ID NO: 223539 - RNA, 22 nt, Human
ggugaucucagucuagaugguu

SEQ ID NO: 223540 - RNA, 22 nt, Human
gguggcagaggaggcgggagag

SEQ ID NO: 223541 - RNA, 22 nt, Human
ggugcuuuucacaagcauggga

SEQ ID NO: 223542 - RNA, 20 nt, Human
ggcaucugacaacuaguugc

SEQ ID NO: 223543 - RNA, 22 nt, Human
gguggcauucaguaaguauaua

SEQ ID NO: 223544 - RNA, 22 nt, Human
gguggccggcaccccacccucg

SEQ ID NO: 223545 - RNA, 22 nt, Human
ggcauuccucucuguucaugga

SEQ ID NO: 223546 - RNA, 22 nt, Human
ggcaucuuuaaugaacaugaau

SEQ ID NO: 223547 - RNA, 22 nt, Human
ggcauggugggggaggacuugg

SEQ ID NO: 223548 - RNA, 22 nt, Human
gauguaucugagcugcuuaggu

SEQ ID NO: 223549 - RNA, 22 nt, Human
gauguuggugcauucacuucug

SEQ ID NO: 223550 - RNA, 22 nt, Human
gauguuaauauguuucaccaaa

SEQ ID NO: 223551 - RNA, 22 nt, Human
gcccuggagauggaaguucuga

SEQ ID NO: 223552 - RNA, 22 nt, Human
gauguuuugaaagaagaauaca

SEQ ID NO: 223553 - RNA, 22 nt, Human
gcccugccauugaucggcccag

SEQ ID NO: 223554 - RNA, 20 nt, Human
gcccuucccccuccgcgagc

SEQ ID NO: 223555 - RNA, 22 nt, Human
gcccuguguguuugcacugauu

SEQ ID NO: 223556 - RNA, 22 nt, Human
gcccauggagaccucaggcugg

SEQ ID NO: 223557 - RNA, 22 nt, Human
gauggggaaaaaauggaucuuu

SEQ ID NO: 223558 - RNA, 22 nt, Human
gauggugcaauuaucgugcaug

SEQ ID NO: 223559 - RNA, 22 nt, Human
gaugguaucugcuggcuuucag

SEQ ID NO: 223560 - RNA, 22 nt, Human
gccaguuuguuuacugaugguu

SEQ ID NO: 223561 - RNA, 23 nt, Human
gccaucugcugggugccccggcc

SEQ ID NO: 223562 - RNA, 22 nt, Human
gcccagcucucuggccugucuu

SEQ ID NO: 223563 - RNA, 22 nt, Human
gcccagcuuuuugaggcaggca

SEQ ID NO: 223564 - RNA, 22 nt, Human
gaucccagaggcggggauagga

SEQ ID NO: 223565 - RNA, 21 nt, Human
gaucgcaaugugggaaucaug

SEQ ID NO: 223566 - RNA, 22 nt, Human
gaucuguccuggcaguuaacac

SEQ ID NO: 223567 - RNA, 18 nt, Human
gccagcccuccaaccucc

SEQ ID NO: 223568 - RNA, 22 nt, Human
gccagccggugaguggaagcgg

SEQ ID NO: 223569 - RNA, 22 nt, Human
gccaggagaaaaggcgaaugau

SEQ ID NO: 223570 - RNA, 22 nt, Human
gccaggcggcccaggagauggc

SEQ ID NO: 223571 - RNA, 22 nt, Human
gccaaucaggaggcuguacauc

SEQ ID NO: 223572 - RNA, 23 nt, Human
gccaaacugcccguucucucugc

SEQ ID NO: 223573 - RNA, 22 nt, Human
gccaaccagucgguccaggaag

SEQ ID NO: 223574 - RNA, 20 nt, Human
gccaccucugcucuuucccg

SEQ ID NO: 223575 - RNA, 19 nt, Human
gccacguuggcuaguugcc

SEQ ID NO: 223576 - RNA, 22 nt, Human
gcauccugacuauggugguggu

SEQ ID NO: 223577 - RNA, 22 nt, Human
gcaugaauggaacccccugagu

SEQ ID NO: 223578 - RNA, 22 nt, Human
gcaucuguuagagugugcaugc

SEQ ID NO: 223579 - RNA, 22 nt, Human
gaguuauuuuuccuguuuuuua

SEQ ID NO: 223580 - RNA, 22 nt, Human
gaguucaaagaucuaggaagag

SEQ ID NO: 223581 - RNA, 22 nt, Human
gaguucuagauguauuauuaau

SEQ ID NO: 223582 - RNA, 22 nt, Human
gcaguuugugauguggcaguca

SEQ ID NO: 223583 - RNA, 22 nt, Human
gagucaaugugcagugcagccc

SEQ ID NO: 223584 - RNA, 22 nt, Human
gaguauuacuaaaauucgccua

SEQ ID NO: 223585 - RNA, 22 nt, Human
gaguauuuaccacuaaaugguu

SEQ ID NO: 223586 - RNA, 19 nt, Human
gcaguuauggcccacuucc

SEQ ID NO: 223587 - RNA, 22 nt, Human
gcaguugguccagccucggcug

SEQ ID NO: 223588 - RNA, 22 nt, Human
gcaguuguagcuguuucuacuc

SEQ ID NO: 223589 - RNA, 22 nt, Human
gcagugccauguggaggaucuc

SEQ ID NO: 223590 - RNA, 22 nt, Human
gcagugucacuaguaauagucu

SEQ ID NO: 223591 - RNA, 22 nt, Human
gcaguuaccuauuuuguagaaa

SEQ ID NO: 223592 - RNA, 21 nt, Human
gcauccucguacucuucaggu

SEQ ID NO: 223593 - RNA, 22 nt, Human
gagugguaaaguguacugaaua

SEQ ID NO: 223594 - RNA, 22 nt, Human
gaguggccugccccagccaggc

SEQ ID NO: 223595 - RNA, 19 nt, Human
gagugaggagcaucguuua

SEQ ID NO: 223596 - RNA, 22 nt, Human
gcaucacacgcacauacacaca

SEQ ID NO: 223597 - RNA, 22 nt, Human
gcauagauauguaaugcaucau

SEQ ID NO: 223598 - RNA, 22 nt, Human
gcauaaaggacuauaaggauca

SEQ ID NO: 223599 - RNA, 22 nt, Human
gcaguugugguuucguuuccuu

SEQ ID NO: 223600 - RNA, 22 nt, Human
gcauaacaacagacucuguguu

SEQ ID NO: 223601 - RNA, 22 nt, Human
gcagucuacuuaagaaucucag

SEQ ID NO: 223602 - RNA, 23 nt, Human
gcagugacugggauggaaguaga

SEQ ID NO: 223603 - RNA, 22 nt, Human
gcagucauggguagaacucaag

SEQ ID NO: 223604 - RNA, 22 nt, Human
gcaguagauccagcagccugca

SEQ ID NO: 223605 - RNA, 22 nt, Human
gcaguaaauugagagucauguu

SEQ ID NO: 223606 - RNA, 22 nt, Human
gaguacagaagauaaaggcaca

SEQ ID NO: 223607 - RNA, 22 nt, Human
gaguaaggaaguguuggccaca

SEQ ID NO: 223608 - RNA, 22 nt, Human
gaugaaguaguccacuggaagg

SEQ ID NO: 223609 - RNA, 22 nt, Human
gaucuuacucacuucagcuggc

SEQ ID NO: 223610 - RNA, 22 nt, Human
gaugaagaaacucaaccaagaa

SEQ ID NO: 223611 - RNA, 22 nt, Human
gaucugguuccaggacauugca

SEQ ID NO: 223612 - RNA, 22 nt, Human
gagaagucaggaguggagaaca

SEQ ID NO: 223613 - RNA, 22 nt, Human
gcaggucacagcugauuggcca

SEQ ID NO: 223614 - RNA, 21 nt, Human
gcaggggugugugagcugggg

SEQ ID NO: 223615 - RNA, 22 nt, Human
gauccucagacccuccucuggu

SEQ ID NO: 223616 - RNA, 22 nt, Human
gcaggccuccccugcuggagcu

SEQ ID NO: 223617 - RNA, 22 nt, Human
gcagggcucagccgcucccacc

SEQ ID NO: 223618 - RNA, 22 nt, Human
gauuaagugaauuggagaaaag

SEQ ID NO: 223619 - RNA, 22 nt, Human
gauuaagauuacauauuuaagu

SEQ ID NO: 223620 - RNA, 22 nt, Human
gcccuguuuucuggguuccuug

SEQ ID NO: 223621 - RNA, 22 nt, Human
gccucuuugcucuuugguuguu

SEQ ID NO: 223622 - RNA, 22 nt, Human
gauuuugaaccuuauuuggaaa

SEQ ID NO: 223623 - RNA, 18 nt, Human
gccucuguugacagaguu

SEQ ID NO: 223624 - RNA, 22 nt, Human
gcaccgagaaggaagcaugccu

SEQ ID NO: 223625 - RNA, 22 nt, Human
gccugccucugacuggggcuga

SEQ ID NO: 223626 - RNA, 22 nt, Human
gcacauaugcuguaagcacaug

SEQ ID NO: 223627 - RNA, 22 nt, Human
gcacaggcugcacgaccccagc

SEQ ID NO: 223628 - RNA, 22 nt, Human
gcaauuguauugucaagacaug

SEQ ID NO: 223629 - RNA, 22 nt, Human
gcaauuggaaugaauucuauuu

SEQ ID NO: 223630 - RNA, 22 nt, Human
gccugcaggaaggugugccugu

SEQ ID NO: 223631 - RNA, 22 nt, Human
gcagaugagagugugaucuggg

SEQ ID NO: 223632 - RNA, 22 nt, Human
gcagcaaucuucacagugucau

SEQ ID NO: 223633 - RNA, 22 nt, Human
gcagcauuaccaagacauggca

SEQ ID NO: 223634 - RNA, 22 nt, Human
gcgccgacccucccugccggac

SEQ ID NO: 223635 - RNA, 22 nt, Human
gcgcgcucugcgaggacacgcu

SEQ ID NO: 223636 - RNA, 22 nt, Human
gcagagcacccugcagugguau

SEQ ID NO: 223637 - RNA, 22 nt, Human
gcagauaguaggagcuaaucuu

SEQ ID NO: 223638 - RNA, 22 nt, Human
gcgauugguuuggggccagagu

SEQ ID NO: 223639 - RNA, 22 nt, Human
gcacucugggucaucugcugcc

SEQ ID NO: 223640 - RNA, 21 nt, Human
gcagaacuaggacuugaacau

SEQ ID NO: 223641 - RNA, 22 nt, Human
gcagaaguauuguacgguggga

SEQ ID NO: 223642 - RNA, 22 nt, Human
gcagagaaugucagauuuuguu

SEQ ID NO: 223643 - RNA, 22 nt, Human
gcagacuaacuuuugucagccu

SEQ ID NO: 223644 - RNA, 21 nt, Human
gcagcucaggauauagacuug

SEQ ID NO: 223645 - RNA, 20 nt, Human
gcgcuucccuacgcucugcu

SEQ ID NO: 223646 - RNA, 22 nt, Human
gcgcucuccugcagacagccuc

SEQ ID NO: 223647 - RNA, 22 nt, Human
gcgcgggugagucacgggcgga

SEQ ID NO: 223648 - RNA, 22 nt, Human
gcgggcuuggcuccagggccca

SEQ ID NO: 223649 - RNA, 22 nt, Human
gcgggcgcuguggccccggccu

SEQ ID NO: 223650 - RNA, 22 nt, Human
gcgguuauggcagagauuacag

SEQ ID NO: 223651 - RNA, 22 nt, Human
gcagggcucuggagucaggcug

SEQ ID NO: 223652 - RNA, 22 nt, Human
gcaggguaggugacagguaguc

SEQ ID NO: 223653 - RNA, 22 nt, Human
gcagguuguuuaaauuaggauu

SEQ ID NO: 223654 - RNA, 22 nt, Human
gcagguggaagcagcagacuca

SEQ ID NO: 223655 - RNA, 22 nt, Human
gcaguauuguguguggucaugg

SEQ ID NO: 223656 - RNA, 22 nt, Human
gcaguaaggaggggaaggguuu

SEQ ID NO: 223657 - RNA, 22 nt, Human
gcagugacagacaacuguuuga

SEQ ID NO: 223658 - RNA, 22 nt, Human
gcaguccuguagcgacuuuuuu

SEQ ID NO: 223659 - RNA, 22 nt, Human
gcaugcaggaagggcuugggga

SEQ ID NO: 223660 - RNA, 20 nt, Human
gcucuucuccgggucugccu

SEQ ID NO: 223661 - RNA, 23 nt, Human
gcugaagcccacucccugggucu

SEQ ID NO: 223662 - RNA, 18 nt, Human
gcugaaauucuaaacaaa

SEQ ID NO: 223663 - RNA, 22 nt, Human
gcucaugggcccagagcagccc

SEQ ID NO: 223664 - RNA, 23 nt, Human
gcaucgcaggucuaagauuagcu

SEQ ID NO: 223665 - RNA, 22 nt, Human
gcucagcuggagagggacgggu

SEQ ID NO: 223666 - RNA, 22 nt, Human
gcauauuuuaaaguguaaccug

SEQ ID NO: 223667 - RNA, 22 nt, Human
gcaucccagaagauucugauuu

SEQ ID NO: 223668 - RNA, 22 nt, Human
gcauaauauugagaaauuauua

SEQ ID NO: 223669 - RNA, 22 nt, Human
gcuaguaagugauagagcugag

SEQ ID NO: 223670 - RNA, 22 nt, Human
gcagugcugcgacagucgggug

SEQ ID NO: 223671 - RNA, 22 nt, Human
gcuacauuagcuucaauggcua

SEQ ID NO: 223672 - RNA, 22 nt, Human
gcuuggagaacguuuucuagaa

SEQ ID NO: 223673 - RNA, 22 nt, Human
gcuuguauguguauauauacau

SEQ ID NO: 223674 - RNA, 22 nt, Human
gcuuucccaaccuucuugguau

SEQ ID NO: 223675 - RNA, 22 nt, Human
gcuuucauuauguuguguuuuu

SEQ ID NO: 223676 - RNA, 22 nt, Human
gcuuucacugcaauagaugaau

SEQ ID NO: 223677 - RNA, 22 nt, Human
gcuuucagggucacugucaaca

SEQ ID NO: 223678 - RNA, 22 nt, Human
gcccuuuuaucaacuccuagaa

SEQ ID NO: 223679 - RNA, 22 nt, Human
gccgcgggucugggucuggcuc

SEQ ID NO: 223680 - RNA, 22 nt, Human
gcuucuguuaggauguggcuua

SEQ ID NO: 223681 - RNA, 22 nt, Human
gcuugcugaacaggaaccuggc

SEQ ID NO: 223682 - RNA, 20 nt, Human
gcuugcgugggaggaggggg

SEQ ID NO: 223683 - RNA, 20 nt, Human
gcuugaauuugauggccaga

SEQ ID NO: 223684 - RNA, 20 nt, Human
gcuugcggacagguggcuca

SEQ ID NO: 223685 - RNA, 22 nt, Human
gcuuuguucauuuaguuuuuuu

SEQ ID NO: 223686 - RNA, 22 nt, Human
gcuuuggcuucuccuggcagga

SEQ ID NO: 223687 - RNA, 22 nt, Human
gcuuuucucccugcuuucuucc

SEQ ID NO: 223688 - RNA, 22 nt, Human
gcuuuugaauacuacaggaguu

SEQ ID NO: 223689 - RNA, 22 nt, Human
ggaaaagccauauuauaggcaa

SEQ ID NO: 223690 - RNA, 22 nt, Human
gccggagagccaacaccacgga

SEQ ID NO: 223691 - RNA, 22 nt, Human
ggaaaaauggguggugauauga

SEQ ID NO: 223692 - RNA, 22 nt, Human
gccucucuggcaaagcggugau

SEQ ID NO: 223693 - RNA, 22 nt, Human
ggaaaaugcugaagcaucugaa

SEQ ID NO: 223694 - RNA, 20 nt, Human
gccuccuccaaguuucauca

SEQ ID NO: 223695 - RNA, 22 nt, Human
gccuccgccuuccugucucccc

SEQ ID NO: 223696 - RNA, 22 nt, Human
gcuuccucaccucaaauuuccg

SEQ ID NO: 223697 - RNA, 20 nt, Human
gccggggcauaggggccguc

SEQ ID NO: 223698 - RNA, 22 nt, Human
gccuagaagaaugagcgcaggg

SEQ ID NO: 223699 - RNA, 21 nt, Human
gccgugcgccuccaggcgcgc

SEQ ID NO: 223700 - RNA, 22 nt, Human
gccguuccuacucucucugugu

SEQ ID NO: 223701 - RNA, 22 nt, Human
gccgcguggcagucuuggugac

SEQ ID NO: 223702 - RNA, 22 nt, Human
gccgggagaggcggcgcagggg

SEQ ID NO: 223703 - RNA, 22 nt, Human
gccgggagugcagcgggcgcgc

SEQ ID NO: 223704 - RNA, 22 nt, Human
gccggcugggggcggagggcag

SEQ ID NO: 223705 - RNA, 18 nt, Human
gccugccagccgagggac

SEQ ID NO: 223706 - RNA, 22 nt, Human
gccugcagccagggaguucucu

SEQ ID NO: 223707 - RNA, 22 nt, Human
gccugcacucaaacacucucuu

SEQ ID NO: 223708 - RNA, 22 nt, Human
ggaacuaagcacauuaucugau

SEQ ID NO: 223709 - RNA, 22 nt, Human
ggaaaggacuggagcccagcgc

SEQ ID NO: 223710 - RNA, 22 nt, Human
gcuuaugauguuuacauaaaag

SEQ ID NO: 223711 - RNA, 22 nt, Human
gcuuauuagguuauuucaagga

SEQ ID NO: 223712 - RNA, 22 nt, Human
gcuucacucugagacuuggagc

SEQ ID NO: 223713 - RNA, 22 nt, Human
gcuucccacagcuggacugggg

SEQ ID NO: 223714 - RNA, 22 nt, Human
gcuuauugcuuauagauaggaa

SEQ ID NO: 223715 - RNA, 22 nt, Human
gcuucugugagugcagaugcug

SEQ ID NO: 223716 - RNA, 22 nt, Human
gcuucucauguuuauuuuuaca

SEQ ID NO: 223717 - RNA, 21 nt, Human
gccgaugugacucuacguagu

SEQ ID NO: 223718 - RNA, 22 nt, Human
gccgccgccgccuuuguugcgg

SEQ ID NO: 223719 - RNA, 22 nt, Human
gccgccgcucaccugggcgccg

SEQ ID NO: 223720 - RNA, 22 nt, Human
gccgcaacggacccugggaguc

SEQ ID NO: 223721 - RNA, 20 nt, Human
gcugugccaugacccucgag

SEQ ID NO: 223722 - RNA, 22 nt, Human
gcuguggagaagcugccuaugg

SEQ ID NO: 223723 - RNA, 22 nt, Human
gcugugacaagaggcugcuucu

SEQ ID NO: 223724 - RNA, 22 nt, Human
gcuguccugggaacaggcacua

SEQ ID NO: 223725 - RNA, 22 nt, Human
gcuguguaugaugcaggcaccu

SEQ ID NO: 223726 - RNA, 22 nt, Human
gcuguguucauccugcccaggu

SEQ ID NO: 223727 - RNA, 22 nt, Human
gcuguggcuccaauggugagcc

SEQ ID NO: 223728 - RNA, 22 nt, Human
gcuguggguuccuccccugucc

SEQ ID NO: 223729 - RNA, 22 nt, Human
gcuguugcaaucaaggccaugg

SEQ ID NO: 223730 - RNA, 22 nt, Human
gcuguugugaggaucagcauau

SEQ ID NO: 223731 - RNA, 22 nt, Human
gcuguuguugcacggaaggugg

SEQ ID NO: 223732 - RNA, 22 nt, Human
gcuguuuaaguggaauuuguuu

SEQ ID NO: 223733 - RNA, 22 nt, Human
gcuggugugagauucucgaggg

SEQ ID NO: 223734 - RNA, 22 nt, Human
gcugguggcagagcuccgcggc

SEQ ID NO: 223735 - RNA, 22 nt, Human
gcugucauggacaugucuguuu

SEQ ID NO: 223736 - RNA, 22 nt, Human
gcccuggucguggagggcaaca

SEQ ID NO: 223737 - RNA, 22 nt, Human
gcccuggcauuucuauucaugu

SEQ ID NO: 223738 - RNA, 22 nt, Human
gcccugucagcucucauggaca

SEQ ID NO: 223739 - RNA, 22 nt, Human
gcccuguuauagucugaggccu

SEQ ID NO: 223740 - RNA, 22 nt, Human
gcauugcuauuucuguuagugu

SEQ ID NO: 223741 - RNA, 22 nt, Human
gcauuuaaauuugaacuucaga

SEQ ID NO: 223742 - RNA, 22 nt, Human
gcugacuuauuagaaaaggaca

SEQ ID NO: 223743 - RNA, 22 nt, Human
gccccgcgcgcguagcgccgcu

SEQ ID NO: 223744 - RNA, 22 nt, Human
gcccccagcuggcuugaggauu

SEQ ID NO: 223745 - RNA, 22 nt, Human
gcugacuauaaggcugcucugu

SEQ ID NO: 223746 - RNA, 22 nt, Human
gcugacucugcuuuuagccucc

SEQ ID NO: 223747 - RNA, 22 nt, Human
gcugacuguagcugggggaaga

SEQ ID NO: 223748 - RNA, 22 nt, Human
gcaugguuagacaucaauguga

SEQ ID NO: 223749 - RNA, 22 nt, Human
gcucucuggccugggaggagga

SEQ ID NO: 223750 - RNA, 22 nt, Human
gcugagcaaugcacugccgcau

SEQ ID NO: 223751 - RNA, 23 nt, Human
gcugagcaccagccauaucuuuu

SEQ ID NO: 223752 - RNA, 22 nt, Human
gcugagcagaacaauuagaaau

SEQ ID NO: 223753 - RNA, 22 nt, Human
ggcaguguggauccuggagaag

SEQ ID NO: 223754 - RNA, 22 nt, Human
ggcaugcaaaugugggugaccu

SEQ ID NO: 223755 - RNA, 22 nt, Human
gcucagagaugucugcugccuu

SEQ ID NO: 223756 - RNA, 22 nt, Human
gcucacuuguaaccccuuccuc

SEQ ID NO: 223757 - RNA, 22 nt, Human
gcucaagaccaagggagcgggg

SEQ ID NO: 223758 - RNA, 22 nt, Human
gcuccggggguuccagaucauc

SEQ ID NO: 223759 - RNA, 22 nt, Human
gcuagcugugcuuggaaguuug

SEQ ID NO: 223760 - RNA, 22 nt, Human
gcuagauugucacuugaguguc

SEQ ID NO: 223761 - RNA, 22 nt, Human
gcuaguguuccacgaugugugu

SEQ ID NO: 223762 - RNA, 22 nt, Human
gcgguuggacguucgccucggg

SEQ ID NO: 223763 - RNA, 22 nt, Human
gcgucucugggcugacccaggu

SEQ ID NO: 223764 - RNA, 22 nt, Human
gcguggccugcugaaggacuuc

SEQ ID NO: 223765 - RNA, 22 nt, Human
gcguggaugauuuugagucggu

SEQ ID NO: 223766 - RNA, 20 nt, Human
ggcagcaaccauaugcuaca

SEQ ID NO: 223767 - RNA, 22 nt, Human
ggcagcagaaccaacuguggcu

SEQ ID NO: 223768 - RNA, 22 nt, Human
gcuagaaacuguuuaaucucuu

SEQ ID NO: 223769 - RNA, 22 nt, Human
ggcacuggguugcagagagaga

SEQ ID NO: 223770 - RNA, 22 nt, Human
ggcacaggcugguaccaguuca

SEQ ID NO: 223771 - RNA, 22 nt, Human
ggcacccugcauuggcuugagu

SEQ ID NO: 223772 - RNA, 22 nt, Human
ggcaauauuauaagggcauuua

SEQ ID NO: 223773 - RNA, 22 nt, Human
ggcaauuacguauuagucaugu

SEQ ID NO: 223774 - RNA, 19 nt, Human
ggauaagguuggagugauc

SEQ ID NO: 223775 - RNA, 22 nt, Human
ggagugaagacagagugaacuu

SEQ ID NO: 223776 - RNA, 22 nt, Human
ggagugaguauguucugaugca

SEQ ID NO: 223777 - RNA, 22 nt, Human
ggagugauuugucuugucuggu

SEQ ID NO: 223778 - RNA, 22 nt, Human
ggaguucaaaucuggaccuugc

SEQ ID NO: 223779 - RNA, 19 nt, Human
ggaguugccaggagaagga

SEQ ID NO: 223780 - RNA, 22 nt, Human
ggaguuucugucaucccguccc

SEQ ID NO: 223781 - RNA, 22 nt, Human
gcggagaggcagagacuccgcg

SEQ ID NO: 223782 - RNA, 22 nt, Human
gcggagcuaaagauuggcuccu

SEQ ID NO: 223783 - RNA, 22 nt, Human
gcgcugagcuuuucuuauugaa

SEQ ID NO: 223784 - RNA, 22 nt, Human
ggagcucaggaguugauuauuu

SEQ ID NO: 223785 - RNA, 22 nt, Human
ggagcucacuacgaaauaagcu

SEQ ID NO: 223786 - RNA, 22 nt, Human
ggagaccaauuaaugaaggaau

SEQ ID NO: 223787 - RNA, 22 nt, Human
ggagacuaagaaaauagagucc

SEQ ID NO: 223788 - RNA, 22 nt, Human
ggagagaacguaaucuaguauu

SEQ ID NO: 223789 - RNA, 22 nt, Human
gcgcggcgcggguccucggccu

SEQ ID NO: 223790 - RNA, 21 nt, Human
gcgcgcucgugcucgacgcgc

SEQ ID NO: 223791 - RNA, 22 nt, Human
ggagguggagcuggaaguucca

SEQ ID NO: 223792 - RNA, 22 nt, Human
ggagguaagaggcccugggccg

SEQ ID NO: 223793 - RNA, 22 nt, Human
ggagugaaugguggccguguuu

SEQ ID NO: 223794 - RNA, 22 nt, Human
ggagggagugcaggcaggcaga

SEQ ID NO: 223795 - RNA, 22 nt, Human
ggaggggaguuugccucugggg

SEQ ID NO: 223796 - RNA, 19 nt, Human
ggaggguguccucaguguc

SEQ ID NO: 223797 - RNA, 22 nt, Human
ggaggccgugcugugcugccag

SEQ ID NO: 223798 - RNA, 22 nt, Human
ggagcugaacccuuaacuggcu

SEQ ID NO: 223799 - RNA, 18 nt, Human
ggacaguuguagaggacu

SEQ ID NO: 223800 - RNA, 22 nt, Human
ggacagagcaacccuacgcagc

SEQ ID NO: 223801 - RNA, 22 nt, Human
gccuucauuggaaucuagcuuc

SEQ ID NO: 223802 - RNA, 22 nt, Human
ggacauugaagcuggaaaggga

SEQ ID NO: 223803 - RNA, 23 nt, Human
ggacaugucucuggguauuuuga

SEQ ID NO: 223804 - RNA, 22 nt, Human
ggacauuguuguuggauccuug

SEQ ID NO: 223805 - RNA, 22 nt, Human
ggacauggccguaguccccacg

SEQ ID NO: 223806 - RNA, 22 nt, Human
gccuuucuugguuugucaggca

SEQ ID NO: 223807 - RNA, 22 nt, Human
ggacuuuggauuuuauucuaaa

SEQ ID NO: 223808 - RNA, 22 nt, Human
ggacuugaaguaguuauggccu

SEQ ID NO: 223809 - RNA, 22 nt, Human
ggacuuucuccugcacaaagug

SEQ ID NO: 223810 - RNA, 22 nt, Human
ggacuggugaagccuucggaga

SEQ ID NO: 223811 - RNA, 22 nt, Human
ggaauguuuuccagaccuagau

SEQ ID NO: 223812 - RNA, 22 nt, Human
ggaauuaagaggcuggacaggg

SEQ ID NO: 223813 - RNA, 22 nt, Human
ggaaugcagugagcauuagaua

SEQ ID NO: 223814 - RNA, 22 nt, Human
gccugggauuggggauuuuuug

SEQ ID NO: 223815 - RNA, 22 nt, Human
gccuggccaaucgccgucuagg

SEQ ID NO: 223816 - RNA, 21 nt, Human
ggaauagcuuaaagugagggg

SEQ ID NO: 223817 - RNA, 22 nt, Human
ggaagacuuagaguagcaucag

SEQ ID NO: 223818 - RNA, 22 nt, Human
uuugcaggaaauguacugaaug

SEQ ID NO: 223819 - RNA, 22 nt, Human
cuuucuuucaaguucugcuuua

SEQ ID NO: 223820 - RNA, 22 nt, Human
gcuggccugcgagggcaggcug

SEQ ID NO: 223821 - RNA, 22 nt, Human
uauuucuagggcaugaaaauaa

SEQ ID NO: 223822 - RNA, 20 nt, Human
uuguacuuaugugagaagga

SEQ ID NO: 223823 - RNA, 22 nt, Human
aggcaguguggagggcuguugc

SEQ ID NO: 223824 - RNA, 22 nt, Human
uacauuugauuuuugcuucuuu

SEQ ID NO: 223825 - RNA, 22 nt, Human
uuuuaaaagguugcuguuauaa

SEQ ID NO: 223826 - RNA, 22 nt, Human
ugggcagggagcuggaaccaca

SEQ ID NO: 223827 - RNA, 22 nt, Human
ucaguggaacacacagaguggg

SEQ ID NO: 223828 - RNA, 23 nt, Human
ucagaccaaccucuugcuggaac

SEQ ID NO: 223829 - RNA, 20 nt, Human
cauuccaugcaucuuggucc

SEQ ID NO: 223830 - RNA, 22 nt, Human
augaaaacgugugugugugugu

SEQ ID NO: 223831 - RNA, 22 nt, Human
ucccuugacauuacuugggagg

SEQ ID NO: 223832 - RNA, 22 nt, Human
uuuuaaauggcuuuuacuuuuc

SEQ ID NO: 223833 - RNA, 22 nt, Human
auagggaggcggagggagcugg

SEQ ID NO: 223834 - RNA, 22 nt, Human
guuuucuccugcuauacagugc

SEQ ID NO: 223835 - RNA, 22 nt, Human
uugcaagcccugaagggcugga

SEQ ID NO: 223836 - RNA, 22 nt, Human
ggcucacuguaccugccgccgc

SEQ ID NO: 223837 - RNA, 22 nt, Human
gggggcugugugcccgcucccc

SEQ ID NO: 223838 - RNA, 22 nt, Human
ggagugaguauguucugaugca

SEQ ID NO: 223839 - RNA, 22 nt, Human
gagggugguggcggccggcacc

SEQ ID NO: 223840 - RNA, 22 nt, Human
auagagcuggggaagaagcugg

SEQ ID NO: 223841 - RNA, 22 nt, Human
uuauuuaagaucuuaauauaua

SEQ ID NO: 223842 - RNA, 22 nt, Human
uagggaggguuugggguggagg

SEQ ID NO: 223843 - RNA, 22 nt, Human
uuuauuuuccaugucucuaggu

SEQ ID NO: 223844 - RNA, 22 nt, Human
cauggcggcgcucucccugccu

SEQ ID NO: 223845 - RNA, 22 nt, Human
uucugcuuuaaagcucauguuu

SEQ ID NO: 223846 - RNA, 22 nt, Human
agagacuguaaugagagguaca

SEQ ID NO: 223847 - RNA, 19 nt, Human
agcucaggcccaucguccc

SEQ ID NO: 223848 - RNA, 22 nt, Human
ggagacagauggcgucucaguu

SEQ ID NO: 223849 - RNA, 22 nt, Human
augaagguggacagauuuuuuu

SEQ ID NO: 223850 - RNA, 22 nt, Human
ggugaguagaaguaguuggcuu

SEQ ID NO: 223851 - RNA, 20 nt, Human
uugauucacaaaaagcuuag

SEQ ID NO: 223852 - RNA, 22 nt, Human
uccuuucaaauuuauuugacau

SEQ ID NO: 223853 - RNA, 23 nt, Human
agagggaagagcuuagaugggga

SEQ ID NO: 223854 - RNA, 22 nt, Human
uugucuuucguauggaacacua

SEQ ID NO: 223855 - RNA, 22 nt, Human
caggccccagggacugggcgcu

SEQ ID NO: 223856 - RNA, 22 nt, Human
uaguuucuucaacugucccagc

SEQ ID NO: 223857 - RNA, 22 nt, Human
uuuauaauuacguaaaauauuu

SEQ ID NO: 223858 - RNA, 22 nt, Human
agggggaauccugcuuauggau

SEQ ID NO: 223859 - RNA, 20 nt, Human
ugcugugugucuacuguggg

SEQ ID NO: 223860 - RNA, 22 nt, Human
agauggaggaaagcaguuagaa

SEQ ID NO: 223861 - RNA, 22 nt, Human
auucuuuucucuaaaugaugaa

SEQ ID NO: 223862 - RNA, 22 nt, Human
ugcuuggauuuccaaaugguuu

SEQ ID NO: 223863 - RNA, 22 nt, Human
ugaauucaaacuuuuuaacaag

SEQ ID NO: 223864 - RNA, 22 nt, Human
uccauuuacuauucucauaucg

SEQ ID NO: 223865 - RNA, 23 nt, Human
ucucacucauucuccucugucca

SEQ ID NO: 223866 - RNA, 22 nt, Human
uuauauuuuauuuaauuaaaua

SEQ ID NO: 223867 - RNA, 22 nt, Human
acauaaaccccccuuccccagg

SEQ ID NO: 223868 - RNA, 20 nt, Human
aggggcuguaguuagaugac

SEQ ID NO: 223869 - RNA, 22 nt, Human
ggcucagaggagcuggaacggu

SEQ ID NO: 223870 - RNA, 16 nt, Human
gaauuccauugcucug

SEQ ID NO: 223871 - RNA, 22 nt, Human
uguccuuuauauguuuuuuagu

SEQ ID NO: 223872 - RNA, 22 nt, Human
ugaguucugacugagcaugggg

SEQ ID NO: 223873 - RNA, 22 nt, Human
augaggaacagcaagaauauuu

SEQ ID NO: 223874 - RNA, 22 nt, Human
gaggagcugggucagggagaca

SEQ ID NO: 223875 - RNA, 22 nt, Human
uuacuuuuuucccccuuagaug

SEQ ID NO: 223876 - RNA, 22 nt, Human
uauuuucucugccacacuucca

SEQ ID NO: 223877 - RNA, 22 nt, Human
acuguugagggaagcagaugaa

SEQ ID NO: 223878 - RNA, 22 nt, Human
uuucucuuguauuugaaucacu

SEQ ID NO: 223879 - RNA, 22 nt, Human
aauaucuugaguuauaaauuca

SEQ ID NO: 223880 - RNA, 20 nt, Human
uggguucaguuguuucuggc

SEQ ID NO: 223881 - RNA, 19 nt, Human
agcaucuccacagaaaaag

SEQ ID NO: 223882 - RNA, 22 nt, Human
ggcagaggagcuggaaacaugg

SEQ ID NO: 223883 - RNA, 22 nt, Human
aaaacauuuaggguuuuuuuua

SEQ ID NO: 223884 - RNA, 22 nt, Human
gucuuucuuuuacauauuugug

SEQ ID NO: 223885 - RNA, 22 nt, Human
agcugaggccccgcagcagggu

SEQ ID NO: 223886 - RNA, 22 nt, Human
cugguuuauuucauaguuuguu

SEQ ID NO: 223887 - RNA, 22 nt, Human
aauguaaauaauuguaaaauuu

SEQ ID NO: 223888 - RNA, 22 nt, Human
cuguguguauaauguuugauaa

SEQ ID NO: 223889 - RNA, 22 nt, Human
gaauauuuaucucagcugcaga

SEQ ID NO: 223890 - RNA, 22 nt, Human
acucauuuggauuuuggaguuu

SEQ ID NO: 223891 - RNA, 22 nt, Human
gcccugucagcucucauggaca

SEQ ID NO: 223892 - RNA, 23 nt, Human
uuuuccaaaucgacucucuaguu

SEQ ID NO: 223893 - RNA, 21 nt, Human
aggugaaggcgagggggacag

SEQ ID NO: 223894 - RNA, 23 nt, Human
ucugccuccuaauuguugguguc

SEQ ID NO: 223895 - RNA, 22 nt, Human
auucauucugaccucaagagaa

SEQ ID NO: 223896 - RNA, 22 nt, Human
uuguuuuaguagaaguuacaug

SEQ ID NO: 223897 - RNA, 22 nt, Human
ugcuuucaaaacucagaggaau

SEQ ID NO: 223898 - RNA, 22 nt, Human
ccaggcucaccuggagccccug

SEQ ID NO: 223899 - RNA, 22 nt, Human
uugucaggaacuaugauuaugc

SEQ ID NO: 223900 - RNA, 22 nt, Human
uacugcaguuccugcugucucc

SEQ ID NO: 223901 - RNA, 22 nt, Human
uggggggacagauggagaggac

SEQ ID NO: 223902 - RNA, 22 nt, Human
auauauguauauaugugugugu

SEQ ID NO: 223903 - RNA, 22 nt, Human
aaggucuucgaaccuuauguua

SEQ ID NO: 223904 - RNA, 22 nt, Human
ggggcaucguugauugcauggu

SEQ ID NO: 223905 - RNA, 22 nt, Human
uauauaauacacaaauauguac

SEQ ID NO: 223906 - RNA, 18 nt, Human
acaaaaauagugcuuugg

SEQ ID NO: 223907 - RNA, 22 nt, Human
aacccugaacuuaguucuagga

SEQ ID NO: 223908 - RNA, 22 nt, Human
auuuuucuuucacauuuucuua

SEQ ID NO: 223909 - RNA, 22 nt, Human
ucacaucugugugauugucauu

SEQ ID NO: 223910 - RNA, 22 nt, Human
uucauggauuugugaaauuuag

SEQ ID NO: 223911 - RNA, 22 nt, Human
aucguuaugauagagaaagaga

SEQ ID NO: 223912 - RNA, 22 nt, Human
auuuucuucauuuugauuguau

SEQ ID NO: 223913 - RNA, 22 nt, Human
ggcugcagggaacaggaugggu

SEQ ID NO: 223914 - RNA, 22 nt, Human
cauaaauuuuaccuuguaagug

SEQ ID NO: 223915 - RNA, 22 nt, Human
auuuuuuuggucauaugagaua

SEQ ID NO: 223916 - RNA, 22 nt, Human
gggcugagagcuggaaucugag

SEQ ID NO: 223917 - RNA, 22 nt, Human
ucacucuuuaucuuuuaugucu

SEQ ID NO: 223918 - RNA, 18 nt, Human
auucauuugcguuuggcu

SEQ ID NO: 223919 - RNA, 22 nt, Human
aggauggaaguaacuggauaau

SEQ ID NO: 223920 - RNA, 22 nt, Human
uggccccauuuuucuggagccu

SEQ ID NO: 223921 - RNA, 22 nt, Human
gucugcagcacugugcacgguc

SEQ ID NO: 223922 - RNA, 22 nt, Human
cauuuugguaauguucguuugc

SEQ ID NO: 223923 - RNA, 22 nt, Human
aggcaguggagcuggaauaggc

SEQ ID NO: 223924 - RNA, 22 nt, Human
cuaaauucuauauccuugcuuc

SEQ ID NO: 223925 - RNA, 23 nt, Human
cagagaaaauagaauaugcugug

SEQ ID NO: 223926 - RNA, 22 nt, Human
ugugaagaauuaaugugaauca

SEQ ID NO: 223927 - RNA, 22 nt, Human
cugggggacagagagaggcggu

SEQ ID NO: 223928 - RNA, 19 nt, Human
ucaggaggucgaccuggca

SEQ ID NO: 223929 - RNA, 22 nt, Human
ucauuguuucugcuuuucauga

SEQ ID NO: 223930 - RNA, 22 nt, Human
auuugcuuguucaccaguacuu

SEQ ID NO: 223931 - RNA, 22 nt, Human
guuauuuugucuuguucaugaa

SEQ ID NO: 223932 - RNA, 22 nt, Human
cuguuaauugugaauuuuacau

SEQ ID NO: 223933 - RNA, 23 nt, Human
cuuauauaaucauuagaaaccau

SEQ ID NO: 223934 - RNA, 22 nt, Human
uuaaacauuuccacuugccagu

SEQ ID NO: 223935 - RNA, 22 nt, Human
uuucagaaauggcacugaaauc

SEQ ID NO: 223936 - RNA, 22 nt, Human
uuuucauuguuaguuucuccuu

SEQ ID NO: 223937 - RNA, 22 nt, Human
uuuucacugacuuggucuggaa

SEQ ID NO: 223938 - RNA, 22 nt, Human
ugaaguuuagaaaaagugccuu

SEQ ID NO: 223939 - RNA, 22 nt, Human
uucacugugauugggguggauu

SEQ ID NO: 223940 - RNA, 22 nt, Human
ucacuuccuugcagcuguagaa

SEQ ID NO: 223941 - RNA, 22 nt, Human
agcaagggucucucauggcuug

SEQ ID NO: 223942 - RNA, 22 nt, Human
gggagguaaugggggugcaggg

SEQ ID NO: 223943 - RNA, 22 nt, Human
ggggaggguuuggaugagaguc

SEQ ID NO: 223944 - RNA, 22 nt, Human
agauggggccugaggacacugu

SEQ ID NO: 223945 - RNA, 22 nt, Human
cagagcugucauuugccaguga

SEQ ID NO: 223946 - RNA, 22 nt, Human
guuauuguuauugcguugucga

SEQ ID NO: 223947 - RNA, 22 nt, Human
uggggagacauggaguaaaaga

SEQ ID NO: 223948 - RNA, 22 nt, Human
ucccaaguguuuggcgaggaga

SEQ ID NO: 223949 - RNA, 23 nt, Human
uggaaguugagagucugcuuugu

SEQ ID NO: 223950 - RNA, 22 nt, Human
ucaaauaugggccagaggaaau

SEQ ID NO: 223951 - RNA, 22 nt, Human
ccuaggcuggcugucuucaggu

SEQ ID NO: 223952 - RNA, 22 nt, Human
gucacuuugcuugcgaugcucc

SEQ ID NO: 223953 - RNA, 22 nt, Human
uuuaaaauguuuuauuuauuua

SEQ ID NO: 223954 - RNA, 22 nt, Human
uauuuaaagucagcaacuuuuc

SEQ ID NO: 223955 - RNA, 22 nt, Human
gcucagccuuuuguucuauuca

SEQ ID NO: 223956 - RNA, 20 nt, Human
acuagaaagucacugggggg

SEQ ID NO: 223957 - RNA, 22 nt, Human
caaaucuguuaauuucaaguug

SEQ ID NO: 223958 - RNA, 22 nt, Human
auauuuuacagcucucguugaa

SEQ ID NO: 223959 - RNA, 22 nt, Human
uucuaauauuaugauuucuaag

SEQ ID NO: 223960 - RNA, 22 nt, Human
aggcucagcaucugauucauau

SEQ ID NO: 223961 - RNA, 22 nt, Human
aggggaggcugcgggcugccgu

SEQ ID NO: 223962 - RNA, 22 nt, Human
uccaugaguuuuuuaguuucac

SEQ ID NO: 223963 - RNA, 22 nt, Human
uguguuguuggggauguuuuca

SEQ ID NO: 223964 - RNA, 22 nt, Human
gggagccucccacugggggaag

SEQ ID NO: 223965 - RNA, 22 nt, Human
aauuauguugaaauaugagaac

SEQ ID NO: 223966 - RNA, 22 nt, Human
gcuggaaauaacuuguguagaa

SEQ ID NO: 223967 - RNA, 22 nt, Human
aagcucuuuccacuaaaccacu

SEQ ID NO: 223968 - RNA, 22 nt, Human
cauuucaaacaguuacagcugc

SEQ ID NO: 223969 - RNA, 22 nt, Human
augcuuucucuucuauuucuca

SEQ ID NO: 223970 - RNA, 22 nt, Human
augggagggagcagugaguguu

SEQ ID NO: 223971 - RNA, 20 nt, Human
cuccuccccucggccccacc

SEQ ID NO: 223972 - RNA, 22 nt, Human
ugaaauuuuuuggagauaauuu

SEQ ID NO: 223973 - RNA, 22 nt, Human
auuucacucuuaauugcuuccu

SEQ ID NO: 223974 - RNA, 22 nt, Human
gggggacagugugccuggugug

SEQ ID NO: 223975 - RNA, 22 nt, Human
caauggagccaagaggaggaaa

SEQ ID NO: 223976 - RNA, 22 nt, Human
guuuucuuguuaauuuugaacg

SEQ ID NO: 223977 - RNA, 22 nt, Human
ggcugugaaguacguugaaggu

SEQ ID NO: 223978 - RNA, 22 nt, Human
aaaauaauauuauaccacugcu

SEQ ID NO: 223979 - RNA, 22 nt, Human
uuucuaaaaccagaguuuauaa

SEQ ID NO: 223980 - RNA, 22 nt, Human
uuuugcuucuaguauauuuuuu

SEQ ID NO: 223981 - RNA, 22 nt, Human
cuccaugagccaggagggcuac

SEQ ID NO: 223982 - RNA, 22 nt, Human
gggauggggagcuggaaagggg

SEQ ID NO: 223983 - RNA, 22 nt, Human
auggugaugaugaugaugauaa

SEQ ID NO: 223984 - RNA, 22 nt, Human
auuuuacuaugauaguugagaa

SEQ ID NO: 223985 - RNA, 22 nt, Human
gcagguggaagcagcagacuca

SEQ ID NO: 223986 - RNA, 22 nt, Human
uggaagugggcaucaccaucca

SEQ ID NO: 223987 - RNA, 21 nt, Human
uggcaggcagcuggaagcuug

SEQ ID NO: 223988 - RNA, 22 nt, Human
gccucucuggcaaagcggugau

SEQ ID NO: 223989 - RNA, 22 nt, Human
ccaaggcuguggggcugugcag

SEQ ID NO: 223990 - RNA, 22 nt, Human
uuauuucauguaaaauuuaugu

SEQ ID NO: 223991 - RNA, 22 nt, Human
uuucacuucgaucagaguuuuu

SEQ ID NO: 223992 - RNA, 22 nt, Human
ggcagagcugugcgcccaccca

SEQ ID NO: 223993 - RNA, 20 nt, Human
uucacagaucucuaacugag

SEQ ID NO: 223994 - RNA, 22 nt, Human
uuuuccuucuuccugccuugcc

SEQ ID NO: 223995 - RNA, 22 nt, Human
uuuaucaggccaucuuaugucu

SEQ ID NO: 223996 - RNA, 22 nt, Human
augugugugcgagcgugugugu

SEQ ID NO: 223997 - RNA, 23 nt, Human
uccuccccaccuuuguccccucc

SEQ ID NO: 223998 - RNA, 22 nt, Human
agggcaggguuggugcuggugc

SEQ ID NO: 223999 - RNA, 22 nt, Human
uauuuuuuuaacauuuauugua

SEQ ID NO: 224000 - RNA, 22 nt, Human
gcugucccccaaagaugcuccu

SEQ ID NO: 224001 - RNA, 22 nt, Human
aguuauuuuucacuauuaggcu

SEQ ID NO: 224002 - RNA, 22 nt, Human
aagagaggcccaaguggcuggc

SEQ ID NO: 224003 - RNA, 17 nt, Human
uuagagcuacauguuga

SEQ ID NO: 224004 - RNA, 22 nt, Human
agggcaguuaugaaugucucca

SEQ ID NO: 224005 - RNA, 22 nt, Human
ucgagcucagcagggaggugcg

SEQ ID NO: 224006 - RNA, 22 nt, Human
uaagggagcagaagcugugaaa

SEQ ID NO: 224007 - RNA, 22 nt, Human
uuuuauuuguauguugaaugua

SEQ ID NO: 224008 - RNA, 22 nt, Human
agucugugguccucuguaucuc

SEQ ID NO: 224009 - RNA, 22 nt, Human
uuuuccuuccugucucuuuauu

SEQ ID NO: 224010 - RNA, 22 nt, Human
acagagcucccagccaucuccu

SEQ ID NO: 224011 - RNA, 22 nt, Human
cacauuuuccagaagaaucaga

SEQ ID NO: 224012 - RNA, 22 nt, Human
uggcagccugcgugaaggagcu

SEQ ID NO: 224013 - RNA, 22 nt, Human
uggagccugauggauaggaacg

SEQ ID NO: 224014 - RNA, 22 nt, Human
gggggcagguuccaggccagcu

SEQ ID NO: 224015 - RNA, 22 nt, Human
aaaauacuaggaaaauaaauca

SEQ ID NO: 224016 - RNA, 22 nt, Human
ucuucaugaaauugauugcuua

SEQ ID NO: 224017 - RNA, 22 nt, Human
cggggcuggcguuagggaggca

SEQ ID NO: 224018 - RNA, 22 nt, Human
aggauagacuucagaaggcaua

SEQ ID NO: 224019 - RNA, 22 nt, Human
cagagagcguccauccggugcc

SEQ ID NO: 224020 - RNA, 22 nt, Human
ucagcucucucuuggugaucuc

SEQ ID NO: 224021 - RNA, 18 nt, Human
uucucucuggauaguagu

SEQ ID NO: 224022 - RNA, 22 nt, Human
aguuuccacuggagacacugug

SEQ ID NO: 224023 - RNA, 22 nt, Human
cagggcagaguuaagaugcugg

SEQ ID NO: 224024 - RNA, 22 nt, Human
ucauuguuuacugucuuuuuuc

SEQ ID NO: 224025 - RNA, 22 nt, Human
aggcauauaguguuuaaaaaaa

SEQ ID NO: 224026 - RNA, 22 nt, Human
cuuuuuuucuccauauuucugg

SEQ ID NO: 224027 - RNA, 22 nt, Human
ccagaugggggcugugggaggg

SEQ ID NO: 224028 - RNA, 22 nt, Human
ccauuuggccauucaguuguuc

SEQ ID NO: 224029 - RNA, 22 nt, Human
gaggggaacaggcauucuuaag

SEQ ID NO: 224030 - RNA, 19 nt, Human
acuggggcaggcugggcuu

SEQ ID NO: 224031 - RNA, 22 nt, Human
ggcuggagcaggcugcacagug

SEQ ID NO: 224032 - RNA, 22 nt, Human
ucagucucuggggcuucuguuu

SEQ ID NO: 224033 - RNA, 22 nt, Human
gcuguugugaggaucagcauau

SEQ ID NO: 224034 - RNA, 22 nt, Human
agcgcucauuuuccuccugcuc

SEQ ID NO: 224035 - RNA, 22 nt, Human
aaauauagugacacuuauaguc

SEQ ID NO: 224036 - RNA, 22 nt, Human
uucacugugauguuuaagagaa

SEQ ID NO: 224037 - RNA, 22 nt, Human
gcucagagaaaacuggggcuug

SEQ ID NO: 224038 - RNA, 22 nt, Human
agggcaguuuuacugaaaggug

SEQ ID NO: 224039 - RNA, 22 nt, Human
ugggggagggagaguugauggg

SEQ ID NO: 224040 - RNA, 22 nt, Human
uguugaaacagcuauugacuuu

SEQ ID NO: 224041 - RNA, 22 nt, Human
agcaaggguugguuuucugaca

SEQ ID NO: 224042 - RNA, 22 nt, Human
cucucugcugucuuucgggaaa

SEQ ID NO: 224043 - RNA, 22 nt, Human
aggguggaggacaggccaguga

SEQ ID NO: 224044 - RNA, 22 nt, Human
ggaggaagagaccagggggcuu

SEQ ID NO: 224045 - RNA, 20 nt, Human
aauaaauauaacccauaauu

SEQ ID NO: 224046 - RNA, 22 nt, Human
uuucacugaguaggagagcacu

SEQ ID NO: 224047 - RNA, 22 nt, Human
cuuuuuaaaguaaauggcuaga

SEQ ID NO: 224048 - RNA, 20 nt, Human
ccugggcuccaggagccccg

SEQ ID NO: 224049 - RNA, 22 nt, Human
ggaaggggagcuggaaagggua

SEQ ID NO: 224050 - RNA, 22 nt, Human
cuuggggauuuuaaagaccucu

SEQ ID NO: 224051 - RNA, 22 nt, Human
uuuuacaaugcaaauucuugcu

SEQ ID NO: 224052 - RNA, 22 nt, Human
uguuuagcucugacuaugugau

SEQ ID NO: 224053 - RNA, 22 nt, Human
aaggugggacugagaggggaca

SEQ ID NO: 224054 - RNA, 22 nt, Human
cuccccuuauuccucaacauga

SEQ ID NO: 224055 - RNA, 22 nt, Human
uggagccuugugagaccacaau

SEQ ID NO: 224056 - RNA, 22 nt, Human
ggacggggagcuggaaagggga

SEQ ID NO: 224057 - RNA, 22 nt, Human
gcacaaaagguacuucauguag

SEQ ID NO: 224058 - RNA, 23 nt, Human
aaggugaagccaccaggugagga

SEQ ID NO: 224059 - RNA, 22 nt, Human
acauuuuaaaaacaguaccugg

SEQ ID NO: 224060 - RNA, 22 nt, Human
gcauaauauugagaaauuauua

SEQ ID NO: 224061 - RNA, 22 nt, Human
cucugcuuguaucacauuugcu

SEQ ID NO: 224062 - RNA, 22 nt, Human
uagcacauaguaggcacaggcu

SEQ ID NO: 224063 - RNA, 22 nt, Human
agccccaauuacagcugugcug

SEQ ID NO: 224064 - RNA, 22 nt, Human
aacgagcugggggggccggggg

SEQ ID NO: 224065 - RNA, 22 nt, Human
uugaaaauuaauagguguacaa

SEQ ID NO: 224066 - RNA, 22 nt, Human
aggcaggggagcuggaagggua

SEQ ID NO: 224067 - RNA, 22 nt, Human
uuuuuaaaagaugauuuaauga

SEQ ID NO: 224068 - RNA, 17 nt, Human
ucuuuuacuuucucucc

SEQ ID NO: 224069 - RNA, 22 nt, Human
ugagggaggggaaugugugcag

SEQ ID NO: 224070 - RNA, 22 nt, Human
uuuuucuccucucucuuucauu

SEQ ID NO: 224071 - RNA, 22 nt, Human
agagcuccaggguuuuguagug

SEQ ID NO: 224072 - RNA, 20 nt, Human
ucugugugccaucaccuaac

SEQ ID NO: 224073 - RNA, 22 nt, Human
uuucauguuggauacuguuuca

SEQ ID NO: 224074 - RNA, 22 nt, Human
uucuuuuaauagagauccugug

SEQ ID NO: 224075 - RNA, 22 nt, Human
auagaaauagacaaugcaaaga

SEQ ID NO: 224076 - RNA, 21 nt, Human
gcagcucaggauauagacuug

SEQ ID NO: 224077 - RNA, 17 nt, Human
auucaugaacauguccu

SEQ ID NO: 224078 - RNA, 22 nt, Human
gcaggggguaaggggcagggcu

SEQ ID NO: 224079 - RNA, 22 nt, Human
uuauuuaaaauguagguuggga

SEQ ID NO: 224080 - RNA, 18 nt, Human
uucaggcucuugcaugaa

SEQ ID NO: 224081 - RNA, 23 nt, Human
uucuuuccuuaucccauuuacuu

SEQ ID NO: 224082 - RNA, 17 nt, Human
ccacuagauagguugug

SEQ ID NO: 224083 - RNA, 22 nt, Human
uuuucaauuuucauuugcaaga

SEQ ID NO: 224084 - RNA, 22 nt, Human
gagcagcucgagaaggaagcag

SEQ ID NO: 224085 - RNA, 22 nt, Human
gcucagcuggagagggacgggu

SEQ ID NO: 224086 - RNA, 20 nt, Human
ucacuguaauugccuacauu

SEQ ID NO: 224087 - RNA, 22 nt, Human
uucacuuuuucucugcuugaga

SEQ ID NO: 224088 - RNA, 22 nt, Human
cuaaaccaauauauuuucuucc

SEQ ID NO: 224089 - RNA, 22 nt, Human
auguaugagagauucuuuuauu

SEQ ID NO: 224090 - RNA, 22 nt, Human
uggcucaguaaucgagucuccu

SEQ ID NO: 224091 - RNA, 22 nt, Human
aucacuagaguuacauugccag

SEQ ID NO: 224092 - RNA, 22 nt, Human
aagugauuuucccaccaucuac

SEQ ID NO: 224093 - RNA, 22 nt, Human
gaaccauuuaauggagaugcuc

SEQ ID NO: 224094 - RNA, 22 nt, Human
uuuucauagccagaaacugaaa

SEQ ID NO: 224095 - RNA, 22 nt, Human
ugcagcuuuugguuucuagaug

SEQ ID NO: 224096 - RNA, 22 nt, Human
aaauguuucauucuauuuuuag

SEQ ID NO: 224097 - RNA, 22 nt, Human
uaauuccacacucccgcaagcg

SEQ ID NO: 224098 - RNA, 22 nt, Human
ugucuuugaccuuaagaaguuu

SEQ ID NO: 224099 - RNA, 22 nt, Human
ggagaggaaguuuaaagaauug

SEQ ID NO: 224100 - RNA, 22 nt, Human
cuauguuucagauauauauaua

SEQ ID NO: 224101 - RNA, 22 nt, Human
guguucuuuguagaggaucuug

SEQ ID NO: 224102 - RNA, 22 nt, Human
aaauguauuagccuaugugaga

SEQ ID NO: 224103 - RNA, 22 nt, Human
cacagcuggggaagcugaggcc

SEQ ID NO: 224104 - RNA, 22 nt, Human
uuuauguuuguuuuugaaauaa

SEQ ID NO: 224105 - RNA, 22 nt, Human
auuuuagagaaacaaacguagg

SEQ ID NO: 224106 - RNA, 21 nt, Human
gggagugaguaaugauggggg

SEQ ID NO: 224107 - RNA, 22 nt, Human
uucaaacaguguagaauauaug

SEQ ID NO: 224108 - RNA, 22 nt, Human
guucuacaugacacucaacauu

SEQ ID NO: 224109 - RNA, 22 nt, Human
auaaaucaagggcaguauuucc

SEQ ID NO: 224110 - RNA, 22 nt, Human
uaaaacuaugcaaccuacuacc

SEQ ID NO: 224111 - RNA, 22 nt, Human
cugguacuggaggaguucagag

SEQ ID NO: 224112 - RNA, 22 nt, Human
gacuggggcauuagaguagcuu

SEQ ID NO: 224113 - RNA, 22 nt, Human
agggagucuggccgucggcugg

SEQ ID NO: 224114 - RNA, 22 nt, Human
uauuuuuaccuaauuuaugaga

SEQ ID NO: 224115 - RNA, 22 nt, Human
cuccuugguuccggcguuggag

SEQ ID NO: 224116 - RNA, 22 nt, Human
gggagggucugagagcugcacc

SEQ ID NO: 224117 - RNA, 22 nt, Human
uacuuacacugaagcaaagaua

SEQ ID NO: 224118 - RNA, 22 nt, Human
cuucuucaucuuuuggaggaac

SEQ ID NO: 224119 - RNA, 22 nt, Human
uggucuuuccuucauuguccag

SEQ ID NO: 224120 - RNA, 22 nt, Human
gugguuuagccuucauuaaccu

SEQ ID NO: 224121 - RNA, 22 nt, Human
uucuuuuaauuucugucugcag

SEQ ID NO: 224122 - RNA, 22 nt, Human
aaauguuugguggauaaaagga

SEQ ID NO: 224123 - RNA, 18 nt, Human
aggcuggggaucacaggg

SEQ ID NO: 224124 - RNA, 22 nt, Human
ugucccaucacagaggagacua

SEQ ID NO: 224125 - RNA, 22 nt, Human
cucuuucauucuguccuuguuu

SEQ ID NO: 224126 - RNA, 22 nt, Human
agugccaucuuuaacuguccca

SEQ ID NO: 224127 - RNA, 22 nt, Human
aaauucuuccaggaggaaauac

SEQ ID NO: 224128 - RNA, 22 nt, Human
gcugcaggaggugguagggucu

SEQ ID NO: 224129 - RNA, 22 nt, Human
gaguucuagauguauuauuaau

SEQ ID NO: 224130 - RNA, 20 nt, Human
uaguggaccuugaaggccuc

SEQ ID NO: 224131 - RNA, 22 nt, Human
gggggagcuacaggucccuugg

SEQ ID NO: 224132 - RNA, 22 nt, Human
auuaaaaaaagauaaugaguua

SEQ ID NO: 224133 - RNA, 22 nt, Human
gagggggaaaagggcagcagag

SEQ ID NO: 224134 - RNA, 22 nt, Human
gaggcucagagggacuuucaag

SEQ ID NO: 224135 - RNA, 22 nt, Human
uuggugaugcccaccuuuucau

SEQ ID NO: 224136 - RNA, 22 nt, Human
aaaucauagccaugaacauuug

SEQ ID NO: 224137 - RNA, 22 nt, Human
uuguuuucuaguguuuugaaua

SEQ ID NO: 224138 - RNA, 22 nt, Human
cagcucugcugggaggaugcag

SEQ ID NO: 224139 - RNA, 22 nt, Human
gaggagggagcuggaagcucuu

SEQ ID NO: 224140 - RNA, 22 nt, Human
gucuugugaagacggcagaaag

SEQ ID NO: 224141 - RNA, 22 nt, Human
augcggcugugggggaauggga

SEQ ID NO: 224142 - RNA, 20 nt, Human
ugccagagagcucauacccu

SEQ ID NO: 224143 - RNA, 22 nt, Human
augaaaacggaccagagcuauu

SEQ ID NO: 224144 - RNA, 22 nt, Human
auucuuuauuuucuguacuugc

SEQ ID NO: 224145 - RNA, 20 nt, Human
ugauuauuccaacaagaaug

SEQ ID NO: 224146 - RNA, 22 nt, Human
gcuggggaucgaaggcagagcc

SEQ ID NO: 224147 - RNA, 22 nt, Human
uuuaaauuucugaaucuugagg

SEQ ID NO: 224148 - RNA, 22 nt, Human
ucucugaccuccaccccaggag

SEQ ID NO: 224149 - RNA, 22 nt, Human
aacacuaaaggucaguuagaag

SEQ ID NO: 224150 - RNA, 22 nt, Human
gaggaggcuggagaggccagga

SEQ ID NO: 224151 - RNA, 22 nt, Human
cuccuuugagcaaaucuuugau

SEQ ID NO: 224152 - RNA, 22 nt, Human
uugccaggagacaucuggagcc

SEQ ID NO: 224153 - RNA, 22 nt, Human
ucugagugacguccugacagga

SEQ ID NO: 224154 - RNA, 22 nt, Human
cagcuccagcccaggcagcucc

SEQ ID NO: 224155 - RNA, 22 nt, Human
uuguuauaggaucagugucacu

SEQ ID NO: 224156 - RNA, 22 nt, Human
aagugaggagaccucuucuuca

SEQ ID NO: 224157 - RNA, 22 nt, Human
cuggagaacucugugcuucacu

SEQ ID NO: 224158 - RNA, 22 nt, Human
gcuuucagggucacugucaaca

SEQ ID NO: 224159 - RNA, 22 nt, Human
uccucccugcacucagugaagu

SEQ ID NO: 224160 - RNA, 20 nt, Human
agugauuuguuaguacauug

SEQ ID NO: 224161 - RNA, 22 nt, Human
aagagaggaaagggugugaggu

SEQ ID NO: 224162 - RNA, 22 nt, Human
acugucuuguuguaugugagcu

SEQ ID NO: 224163 - RNA, 21 nt, Human
ugcuuucugugcuuuuucugc

SEQ ID NO: 224164 - RNA, 22 nt, Human
cccuguccuucccuccaucuga

SEQ ID NO: 224165 - RNA, 22 nt, Human
auauguuaugccauuuucaagg

SEQ ID NO: 224166 - RNA, 22 nt, Human
uauuuuaaaagcauuaauucuu

SEQ ID NO: 224167 - RNA, 22 nt, Human
ggagccucuaaacaguuaucaa

SEQ ID NO: 224168 - RNA, 22 nt, Human
cuccugcuuuuucuucuuccga

SEQ ID NO: 224169 - RNA, 22 nt, Human
ucacuguuucaccgucugaagg

SEQ ID NO: 224170 - RNA, 21 nt, Human
uuucauuaguacaucaauuug

SEQ ID NO: 224171 - RNA, 22 nt, Human
ggcucccgugggaugguggagc

SEQ ID NO: 224172 - RNA, 22 nt, Human
cacuguugagcaauguacagug

SEQ ID NO: 224173 - RNA, 22 nt, Human
aaaauauaaaggauguggguuu

SEQ ID NO: 224174 - RNA, 22 nt, Human
aauauuuugggacugaggaauu

SEQ ID NO: 224175 - RNA, 22 nt, Human
augcaaaaucuuauuuuuucua

SEQ ID NO: 224176 - RNA, 22 nt, Human
ggaggcccagaaggaagcccag

SEQ ID NO: 224177 - RNA, 20 nt, Human
uuuuuuaaauagagcuguug

SEQ ID NO: 224178 - RNA, 22 nt, Human
uugugugugcccaccuguggcc

SEQ ID NO: 224179 - RNA, 22 nt, Human
uaaaugauaguauugaagguag

SEQ ID NO: 224180 - RNA, 22 nt, Human
uggcaaggccacaggugcaguu

SEQ ID NO: 224181 - RNA, 22 nt, Human
gaggcaggaagggaggguugug

SEQ ID NO: 224182 - RNA, 22 nt, Human
aagugugugugcgcaugugcau

SEQ ID NO: 224183 - RNA, 22 nt, Human
uuuuuuaaucaaguaggaaaca

SEQ ID NO: 224184 - RNA, 22 nt, Human
uauuuuuacuguuugaugauuc

SEQ ID NO: 224185 - RNA, 22 nt, Human
cccagagggcugaggauaugaa

SEQ ID NO: 224186 - RNA, 22 nt, Human
auauaguacauguauauauaua

SEQ ID NO: 224187 - RNA, 22 nt, Human
gccaguggucagugggagggug

SEQ ID NO: 224188 - RNA, 22 nt, Human
ucccuguggauuaaggagaugu

SEQ ID NO: 224189 - RNA, 22 nt, Human
caauaccucuuggugauugggc

SEQ ID NO: 224190 - RNA, 22 nt, Human
ugguucuagaugagaugaugag

SEQ ID NO: 224191 - RNA, 22 nt, Human
acauuccugaagguaaugagaa

SEQ ID NO: 224192 - RNA, 22 nt, Human
auggagugggaggacaugaagg

SEQ ID NO: 224193 - RNA, 22 nt, Human
agggcucacuacaacccuggga

SEQ ID NO: 224194 - RNA, 22 nt, Human
uaugggcaagagauaggugguc

SEQ ID NO: 224195 - RNA, 22 nt, Human
gaggagcuucagaggaaucuua

SEQ ID NO: 224196 - RNA, 22 nt, Human
uuuuagaagcauuuaugagauu

SEQ ID NO: 224197 - RNA, 22 nt, Human
guggaaggaauuaacagacuag

SEQ ID NO: 224198 - RNA, 22 nt, Human
agagggagagaccuccgugccu

SEQ ID NO: 224199 - RNA, 22 nt, Human
uggguucaaauccugguuccac

SEQ ID NO: 224200 - RNA, 22 nt, Human
uuuuucuuugcuuuccacuggc

SEQ ID NO: 224201 - RNA, 22 nt, Human
uagacugugagcuccuugaggg

SEQ ID NO: 224202 - RNA, 22 nt, Human
aagggagagggagaagguggga

SEQ ID NO: 224203 - RNA, 22 nt, Human
gugcugggaggcccaggaugga

SEQ ID NO: 224204 - RNA, 22 nt, Human
uaguggaaccuucuaaaugacg

SEQ ID NO: 224205 - RNA, 22 nt, Human
aaaauauucuauaucaaagaua

SEQ ID NO: 224206 - RNA, 22 nt, Human
gaauuagguaauagaacuagua

SEQ ID NO: 224207 - RNA, 22 nt, Human
ucuucacagaugcauauacuuc

SEQ ID NO: 224208 - RNA, 22 nt, Human
uguaaauucuauacacuuaaaa

SEQ ID NO: 224209 - RNA, 22 nt, Human
ggggaaggaaggggagggcacg

SEQ ID NO: 224210 - RNA, 22 nt, Human
uucacauucauuucuuauguuu

SEQ ID NO: 224211 - RNA, 22 nt, Human
aggggcugagaguuugaugugg

SEQ ID NO: 224212 - RNA, 22 nt, Human
aauucuguugguuagaguugga

SEQ ID NO: 224213 - RNA, 22 nt, Human
cuuuaaaaauguauuuuugugg

SEQ ID NO: 224214 - RNA, 20 nt, Human
uuggagaucacguguccagg

SEQ ID NO: 224215 - RNA, 22 nt, Human
uauaagaaaagucauuaucaaa

SEQ ID NO: 224216 - RNA, 22 nt, Human
guuguuuucagcccagcauuag

SEQ ID NO: 224217 - RNA, 22 nt, Human
uuauuuucgugugugugugugu

SEQ ID NO: 224218 - RNA, 23 nt, Human
uugcuuuugccccaaaagaguua

SEQ ID NO: 224219 - RNA, 22 nt, Human
ccccauggaaaacccaccuagg

SEQ ID NO: 224220 - RNA, 22 nt, Human
gugauggucgagcgcuuguugu

SEQ ID NO: 224221 - RNA, 22 nt, Human
aacugcauaagcuucgggaccu

SEQ ID NO: 224222 - RNA, 22 nt, Human
uuuugaauaauucagaaacagc

SEQ ID NO: 224223 - RNA, 22 nt, Human
uggguauauauguugcuacaga

SEQ ID NO: 224224 - RNA, 21 nt, Human
uccccugugccuggcauacag

SEQ ID NO: 224225 - RNA, 22 nt, Human
uucacuguucuuagagaagacc

SEQ ID NO: 224226 - RNA, 17 nt, Human
auuguuuuuaauuugca

SEQ ID NO: 224227 - RNA, 22 nt, Human
uguacauacauagauauacaca

SEQ ID NO: 224228 - RNA, 22 nt, Human
aaauguaaacuguauuuauaaa

SEQ ID NO: 224229 - RNA, 22 nt, Human
gcagggcucuggagucaggcug

SEQ ID NO: 224230 - RNA, 22 nt, Human
agauggaguccugaagccagaa

SEQ ID NO: 224231 - RNA, 22 nt, Human
auuuuguugaaacccuuguugu

SEQ ID NO: 224232 - RNA, 22 nt, Human
ggagagcuagugagcuggaggu

SEQ ID NO: 224233 - RNA, 18 nt, Human
guucaagcauuuugcucu

SEQ ID NO: 224234 - RNA, 22 nt, Human
cagcuguggagauggggugcau

SEQ ID NO: 224235 - RNA, 22 nt, Human
uuuuauaauacccuugacuaau

SEQ ID NO: 224236 - RNA, 22 nt, Human
ggcucccccauggcugacagac

SEQ ID NO: 224237 - RNA, 22 nt, Human
uucauaugaauuggguuuuuuu

SEQ ID NO: 224238 - RNA, 22 nt, Human
guuuaaaagcaaccaacaggcu

SEQ ID NO: 224239 - RNA, 22 nt, Human
guccuguguaaguacuugcuca

SEQ ID NO: 224240 - RNA, 22 nt, Human
ucgcccagguuggagugcagug

SEQ ID NO: 224241 - RNA, 22 nt, Human
uguugaagcaccucugucuuuc

SEQ ID NO: 224242 - RNA, 22 nt, Human
gaggggacugucuggcuccgag

SEQ ID NO: 224243 - RNA, 22 nt, Human
ggcuagggagacagagggcaug

SEQ ID NO: 224244 - RNA, 22 nt, Human
uaauaaaaauuuaauucacauu

SEQ ID NO: 224245 - RNA, 22 nt, Human
uggcucaggccuacgacgccuu

SEQ ID NO: 224246 - RNA, 22 nt, Human
agcggccucgcugccugcucag

SEQ ID NO: 224247 - RNA, 22 nt, Human
ucuuuuaucuguuguguaacaa

SEQ ID NO: 224248 - RNA, 22 nt, Human
aguaggaauucaaagagacaaa

SEQ ID NO: 224249 - RNA, 22 nt, Human
gcagggcucagccgcucccacc

SEQ ID NO: 224250 - RNA, 22 nt, Human
uuuguacuuucuaauguauuua

SEQ ID NO: 224251 - RNA, 22 nt, Human
ucucucucucuuccagcauguu

SEQ ID NO: 224252 - RNA, 22 nt, Human
auggaguguggccaggcaguaa

SEQ ID NO: 224253 - RNA, 22 nt, Human
ggcagggagagcgccgccaugc

SEQ ID NO: 224254 - RNA, 22 nt, Human
acuggagcccguggaggcgcag

SEQ ID NO: 224255 - RNA, 22 nt, Human
uuucuugugauuuugaugaacu

SEQ ID NO: 224256 - RNA, 22 nt, Human
aggcgaagggaccagacgguag

SEQ ID NO: 224257 - RNA, 22 nt, Human
aaauuuuguugaaaaauauuuu

SEQ ID NO: 224258 - RNA, 22 nt, Human
augcugugccuggaaagcggcu

SEQ ID NO: 224259 - RNA, 22 nt, Human
guucuucagauuccauuucagu

SEQ ID NO: 224260 - RNA, 22 nt, Human
ccugccagaaaagagggaguuc

SEQ ID NO: 224261 - RNA, 22 nt, Human
gucuuuguaguuuuaauuugag

SEQ ID NO: 224262 - RNA, 22 nt, Human
ucuugugguggaucccucauuu

SEQ ID NO: 224263 - RNA, 22 nt, Human
auguacugacuguacuuuuaaa

SEQ ID NO: 224264 - RNA, 22 nt, Human
uugguuuacucuggggauaucu

SEQ ID NO: 224265 - RNA, 20 nt, Human
agaaggagagaugaggcaaa

SEQ ID NO: 224266 - RNA, 22 nt, Human
cggcugcagcggagcaggcugg

SEQ ID NO: 224267 - RNA, 22 nt, Human
uucuccaccugcuccucccacc

SEQ ID NO: 224268 - RNA, 22 nt, Human
caguggacacuuccucuacaau

SEQ ID NO: 224269 - RNA, 22 nt, Human
uguguuguuuggggauguccau

SEQ ID NO: 224270 - RNA, 22 nt, Human
cucagcgagggaaagaggccgc

SEQ ID NO: 224271 - RNA, 22 nt, Human
gaggugauuccucccauguaau

SEQ ID NO: 224272 - RNA, 22 nt, Human
gaggccagcacccagaugcaug

SEQ ID NO: 224273 - RNA, 22 nt, Human
ccauuucacaucccugacaugu

SEQ ID NO: 224274 - RNA, 22 nt, Human
ccagcaggagacuagcaacaua

SEQ ID NO: 224275 - RNA, 22 nt, Human
uguuuuuauucuuaauguuuca

SEQ ID NO: 224276 - RNA, 22 nt, Human
cuguggcugcgcccugggggag

SEQ ID NO: 224277 - RNA, 22 nt, Human
caaaaaauccauagaaagaggu

SEQ ID NO: 224278 - RNA, 22 nt, Human
gcuguggacacagcucucuuca

SEQ ID NO: 224279 - RNA, 22 nt, Human
ggcuagggaucuagaccaggac

SEQ ID NO: 224280 - RNA, 22 nt, Human
gagggaggugacaaggacauag

SEQ ID NO: 224281 - RNA, 22 nt, Human
uguuuucuuuccccuucuuuuc

SEQ ID NO: 224282 - RNA, 22 nt, Human
uuuguuugcugagugaauucaa

SEQ ID NO: 224283 - RNA, 22 nt, Human
uuaucaaaaaauaguacuuuga

SEQ ID NO: 224284 - RNA, 22 nt, Human
aaugaaaaucugucaguucaag

SEQ ID NO: 224285 - RNA, 22 nt, Human
ucuucaucucuaaaaugggaac

SEQ ID NO: 224286 - RNA, 22 nt, Human
guuuauucuuuuauuugugaga

SEQ ID NO: 224287 - RNA, 22 nt, Human
ccagucuuggugucuguagcac

SEQ ID NO: 224288 - RNA, 22 nt, Human
uauaaagaccuuauccuucaua

SEQ ID NO: 224289 - RNA, 22 nt, Human
uucaaaaugcagaauaguuugg

SEQ ID NO: 224290 - RNA, 22 nt, Human
gaagaaggaagaucaugcuuga

SEQ ID NO: 224291 - RNA, 22 nt, Human
uuaaaagaauccuguuauccuc

SEQ ID NO: 224292 - RNA, 22 nt, Human
uuaucuuuuaaaaacacuugug

SEQ ID NO: 224293 - RNA, 22 nt, Human
ucccuucccaccccugccuuuu

SEQ ID NO: 224294 - RNA, 22 nt, Human
guuuauuucuuaucaucacuau

SEQ ID NO: 224295 - RNA, 22 nt, Human
guuuccaggcuuugguaugguu

SEQ ID NO: 224296 - RNA, 22 nt, Human
agauucucccuccuggcgcugu

SEQ ID NO: 224297 - RNA, 22 nt, Human
ggacauaguugcuauggagagu

SEQ ID NO: 224298 - RNA, 22 nt, Human
uggaaaauuuagaaagauuuau

SEQ ID NO: 224299 - RNA, 22 nt, Human
acauauaugugcauacaacuau

SEQ ID NO: 224300 - RNA, 22 nt, Human
guggguauauauaugugugcug

SEQ ID NO: 224301 - RNA, 22 nt, Human
acgugugugugcacguguguau

SEQ ID NO: 224302 - RNA, 22 nt, Human
aggcuccucugggggccccgga

SEQ ID NO: 224303 - RNA, 22 nt, Human
uauuuuauuuagguuuaguugu

SEQ ID NO: 224304 - RNA, 22 nt, Human
gagaaaaauuucuuugcugcac

SEQ ID NO: 224305 - RNA, 22 nt, Human
cagaccagaaggaagccgacaa

SEQ ID NO: 224306 - RNA, 19 nt, Human
ccaguuuuuuaauauucaa

SEQ ID NO: 224307 - RNA, 22 nt, Human
cucacugucagcugcagggcuu

SEQ ID NO: 224308 - RNA, 22 nt, Human
agggcugggcuuggcaggcugg

SEQ ID NO: 224309 - RNA, 22 nt, Human
ucagccuugguuuugguguugg

SEQ ID NO: 224310 - RNA, 22 nt, Human
uuuccuaggaaaugauugaagu

SEQ ID NO: 224311 - RNA, 22 nt, Human
uggggcauacgugaaauaauuu

SEQ ID NO: 224312 - RNA, 22 nt, Human
uggaguuuuaaucuguacagaa

SEQ ID NO: 224313 - RNA, 20 nt, Human
cuggaguguagcaguggcug

SEQ ID NO: 224314 - RNA, 22 nt, Human
uggcucagcgcggccuggucuu

SEQ ID NO: 224315 - RNA, 17 nt, Human
ucuguguccgcucaguc

SEQ ID NO: 224316 - RNA, 22 nt, Human
aaaugcuuuaauugaguucaug

SEQ ID NO: 224317 - RNA, 22 nt, Human
ggcagucuuucccuugagcucu

SEQ ID NO: 224318 - RNA, 22 nt, Human
agggcugcugcuccgggcccag

SEQ ID NO: 224319 - RNA, 22 nt, Human
guuuggguggcuagagaaagaa

SEQ ID NO: 224320 - RNA, 22 nt, Human
gagcagcugagcuggaaugaga

SEQ ID NO: 224321 - RNA, 22 nt, Human
agguggucccaauggcugggca

SEQ ID NO: 224322 - RNA, 19 nt, Human
uagaggagaauggcaaaga

SEQ ID NO: 224323 - RNA, 22 nt, Human
acucacuguuuugaaauugaac

SEQ ID NO: 224324 - RNA, 22 nt, Human
aaugauuuucugcaaacaguga

SEQ ID NO: 224325 - RNA, 22 nt, Human
uccauguauugcuaacaaauag

SEQ ID NO: 224326 - RNA, 22 nt, Human
cacugguugccucuuucuguuc

SEQ ID NO: 224327 - RNA, 19 nt, Human
ggaggguguccucaguguc

SEQ ID NO: 224328 - RNA, 22 nt, Human
accuccauggcccacaucuagu

SEQ ID NO: 224329 - RNA, 22 nt, Human
gaaacauuuguugaguacuugc

SEQ ID NO: 224330 - RNA, 18 nt, Human
ggccucagccuggccgga

SEQ ID NO: 224331 - RNA, 22 nt, Human
ccuuuuaucgcgaagaacucca

SEQ ID NO: 224332 - RNA, 22 nt, Human
gugucacuuucaggagcucuaa

SEQ ID NO: 224333 - RNA, 22 nt, Human
uugccaggggacaucuggagcc

SEQ ID NO: 224334 - RNA, 22 nt, Human
augggagggugaggaggcagcu

SEQ ID NO: 224335 - RNA, 22 nt, Human
uuuacaaggcaguuauuuuccu

SEQ ID NO: 224336 - RNA, 22 nt, Human
aguaggauguuuagcccuucuu

SEQ ID NO: 224337 - RNA, 22 nt, Human
uggacacugguggauauggaau

SEQ ID NO: 224338 - RNA, 22 nt, Human
uucucugcgcuccggcccaguu

SEQ ID NO: 224339 - RNA, 22 nt, Human
ggcuggggccuguugaagaugc

SEQ ID NO: 224340 - RNA, 21 nt, Human
guucuuaguuauauucucaau

SEQ ID NO: 224341 - RNA, 20 nt, Human
gaacauaaauaacucuuuac

SEQ ID NO: 224342 - RNA, 22 nt, Human
cagaccuggaaaacaggcuugc

SEQ ID NO: 224343 - RNA, 22 nt, Human
ggcugugguggacgcgggaaac

SEQ ID NO: 224344 - RNA, 22 nt, Human
ugcccacuucaaaaucuucauu

SEQ ID NO: 224345 - RNA, 22 nt, Human
ggaggaugaggguggugguguu

SEQ ID NO: 224346 - RNA, 22 nt, Human
gcccagccucagggcaucagcu

SEQ ID NO: 224347 - RNA, 22 nt, Human
uauuucaugagugaauaucuag

SEQ ID NO: 224348 - RNA, 22 nt, Human
uuucuggacuaaagggagagau

SEQ ID NO: 224349 - RNA, 22 nt, Human
ggcuguggcagcuggaaguggu

SEQ ID NO: 224350 - RNA, 22 nt, Human
uaguauuuguaauuaucaaagc

SEQ ID NO: 224351 - RNA, 20 nt, Human
ggcagagcuaugucuguugc

SEQ ID NO: 224352 - RNA, 22 nt, Human
ugccagcuccgaggagcugcag

SEQ ID NO: 224353 - RNA, 22 nt, Human
aucauguauauuuuugcuauua

SEQ ID NO: 224354 - RNA, 22 nt, Human
ugcuuucaaugaauuguauacu

SEQ ID NO: 224355 - RNA, 22 nt, Human
cuguggcuaggaagcuguggga

SEQ ID NO: 224356 - RNA, 22 nt, Human
gcucucuggccugggaggagga

SEQ ID NO: 224357 - RNA, 22 nt, Human
agauuuucuuuuccaucuuugu

SEQ ID NO: 224358 - RNA, 22 nt, Human
uccuuuauuuaugggcagugua

SEQ ID NO: 224359 - RNA, 22 nt, Human
ggcaaggaagaaagcagaaguu

SEQ ID NO: 224360 - RNA, 22 nt, Human
uuuuaaaacaugucaaaaugug

SEQ ID NO: 224361 - RNA, 22 nt, Human
auuuaaaaacugguacaacagg

SEQ ID NO: 224362 - RNA, 22 nt, Human
cucuugugucaccauggauaaa

SEQ ID NO: 224363 - RNA, 22 nt, Human
aaucacuucuuugucuucuuca

SEQ ID NO: 224364 - RNA, 22 nt, Human
gcagaggcugccgugggcagga

SEQ ID NO: 224365 - RNA, 22 nt, Human
cuccacagccccuccaguggca

SEQ ID NO: 224366 - RNA, 22 nt, Human
ggugucuuugauguugggcuga

SEQ ID NO: 224367 - RNA, 22 nt, Human
auuuucauauggguuauuugua

SEQ ID NO: 224368 - RNA, 22 nt, Human
acucugcaguaaggaauuguuu

SEQ ID NO: 224369 - RNA, 22 nt, Human
guacauauccuuuacguuuugu

SEQ ID NO: 224370 - RNA, 22 nt, Human
gaauuccaggugagagaaggua

SEQ ID NO: 224371 - RNA, 21 nt, Human
cuauaaaaaugguucuuugcg

SEQ ID NO: 224372 - RNA, 22 nt, Human
gguagacugagcuccuugagga

SEQ ID NO: 224373 - RNA, 22 nt, Human
gcuguguaugaugcaggcaccu

SEQ ID NO: 224374 - RNA, 22 nt, Human
uagcugucauuggaucagaagg

SEQ ID NO: 224375 - RNA, 22 nt, Human
ugcuuucagauaucuguuucaa

SEQ ID NO: 224376 - RNA, 22 nt, Human
aggcagagaggucuuccuggaa

SEQ ID NO: 224377 - RNA, 22 nt, Human
ucccugcugggcgaucuucucu

SEQ ID NO: 224378 - RNA, 22 nt, Human
uccagcugugcuccaggaggug

SEQ ID NO: 224379 - RNA, 22 nt, Human
ccucaggaauuuauucuucugu

SEQ ID NO: 224380 - RNA, 22 nt, Human
uggaggcccagcugggggccgg

SEQ ID NO: 224381 - RNA, 22 nt, Human
ugagguauuuggauuuauauuu

SEQ ID NO: 224382 - RNA, 22 nt, Human
guaaauaucucacgaaugauuc

SEQ ID NO: 224383 - RNA, 22 nt, Human
cuguuucucugccugcacacau

SEQ ID NO: 224384 - RNA, 22 nt, Human
auuguuuugugaaacauaguga

SEQ ID NO: 224385 - RNA, 22 nt, Human
aguaaaugaaagcaauuuuaga

SEQ ID NO: 224386 - RNA, 22 nt, Human
ugggggaggaggagacagacug

SEQ ID NO: 224387 - RNA, 22 nt, Human
gaaggagaggauugugaggcug

SEQ ID NO: 224388 - RNA, 22 nt, Human
aaugcuuuuugcgaaaugugca

SEQ ID NO: 224389 - RNA, 22 nt, Human
cagcuuguucugaccugugauu

SEQ ID NO: 224390 - RNA, 22 nt, Human
uuuucucaguuuuuuucaaaag

SEQ ID NO: 224391 - RNA, 22 nt, Human
uggagucuugcuuugggagugc

SEQ ID NO: 224392 - RNA, 22 nt, Human
aaggcuguuugagcacuggagc

SEQ ID NO: 224393 - RNA, 22 nt, Human
cugcugugcagacagacucucu

SEQ ID NO: 224394 - RNA, 22 nt, Human
cagcuggggagagacauggcag

SEQ ID NO: 224395 - RNA, 19 nt, Human
agagucuccacuccacuug

SEQ ID NO: 224396 - RNA, 22 nt, Human
gccagggcucgagcaggccagc

SEQ ID NO: 224397 - RNA, 22 nt, Human
auguguguaugacugaaucuau

SEQ ID NO: 224398 - RNA, 22 nt, Human
cagguggauggcgagcccugca

SEQ ID NO: 224399 - RNA, 22 nt, Human
ucuucaaauacagucauauuga

SEQ ID NO: 224400 - RNA, 22 nt, Human
gagccucaggguuuuguugaca

SEQ ID NO: 224401 - RNA, 22 nt, Human
cagcuccaucuugcuuauacca

SEQ ID NO: 224402 - RNA, 22 nt, Human
uggaugccuugggggaggagga

SEQ ID NO: 224403 - RNA, 22 nt, Human
cuguccauuuucgugccuccuu

SEQ ID NO: 224404 - RNA, 22 nt, Human
ugugucuuuggcgaugucugga

SEQ ID NO: 224405 - RNA, 22 nt, Human
aggccccacaaacucgccuuug

SEQ ID NO: 224406 - RNA, 22 nt, Human
gcuuauuagguuauuucaagga

SEQ ID NO: 224407 - RNA, 22 nt, Human
auuuuuauuugccuaugauaua

SEQ ID NO: 224408 - RNA, 22 nt, Human
guuuuguagucuggagacuguc

SEQ ID NO: 224409 - RNA, 22 nt, Human
cacugcacuccagccugggcaa

SEQ ID NO: 224410 - RNA, 22 nt, Human
cuagcacagugcuuggcacaca

SEQ ID NO: 224411 - RNA, 22 nt, Human
uucuuuucuucccuguuuauua

SEQ ID NO: 224412 - RNA, 22 nt, Human
uuauuuuauaaagagaagacuu

SEQ ID NO: 224413 - RNA, 22 nt, Human
ucuuuuucccugguuccuuuuu

SEQ ID NO: 224414 - RNA, 22 nt, Human
agaucugucaccauccuggagc

SEQ ID NO: 224415 - RNA, 22 nt, Human
gaggcaggcggggcccaggugg

SEQ ID NO: 224416 - RNA, 22 nt, Human
agggaguuccgaucugugcacc

SEQ ID NO: 224417 - RNA, 22 nt, Human
auacaucuuaacgcgcucuugg

SEQ ID NO: 224418 - RNA, 22 nt, Human
uuauuucaggcauuuguaaaug

SEQ ID NO: 224419 - RNA, 22 nt, Human
uuggugauguagcagcaauugu

SEQ ID NO: 224420 - RNA, 22 nt, Human
aaauauuugaaugguguaagau

SEQ ID NO: 224421 - RNA, 19 nt, Human
gauauugagcugagaauuc

SEQ ID NO: 224422 - RNA, 22 nt, Human
uuauuuuuguuuguuaagccua

SEQ ID NO: 224423 - RNA, 22 nt, Human
uucccugugcaguauguuccaa

SEQ ID NO: 224424 - RNA, 22 nt, Human
aggggaggcugggcuggggggc

SEQ ID NO: 224425 - RNA, 22 nt, Human
agucccugauggacuggaugag

SEQ ID NO: 224426 - RNA, 22 nt, Human
gccugggguuugcggggcugca

SEQ ID NO: 224427 - RNA, 22 nt, Human
uguauuuuuucccugaaauaaa

SEQ ID NO: 224428 - RNA, 22 nt, Human
ucuccucucugaucuugcuccg

SEQ ID NO: 224429 - RNA, 22 nt, Human
gauuuuaaaagauguauaaggu

SEQ ID NO: 224430 - RNA, 22 nt, Human
agcacagugccugacauauaug

SEQ ID NO: 224431 - RNA, 22 nt, Human
uucuucuucuuccucauccuca

SEQ ID NO: 224432 - RNA, 22 nt, Human
cacugcaaccuccaccucccgg

SEQ ID NO: 224433 - RNA, 22 nt, Human
uuaggggcuuaggcagaguuug

SEQ ID NO: 224434 - RNA, 22 nt, Human
gcuuucacugcaauagaugaau

SEQ ID NO: 224435 - RNA, 22 nt, Human
guccccugcguguucauccugg

SEQ ID NO: 224436 - RNA, 22 nt, Human
uuauaucagaaggugagauuga

SEQ ID NO: 224437 - RNA, 22 nt, Human
gugugugucuacuuucaucucu

SEQ ID NO: 224438 - RNA, 22 nt, Human
ugcuuggagaaucagucccagc

SEQ ID NO: 224439 - RNA, 22 nt, Human
cugucucugauaagcucgaggg

SEQ ID NO: 224440 - RNA, 22 nt, Human
gcuguggagaagcugccuaugg

SEQ ID NO: 224441 - RNA, 22 nt, Human
cucuguguguuugugugugugu

SEQ ID NO: 224442 - RNA, 22 nt, Human
cuggaagcgucggaggaagggc

SEQ ID NO: 224443 - RNA, 22 nt, Human
guuuuucuuugauuuagaacca

SEQ ID NO: 224444 - RNA, 20 nt, Human
ucucuuuuucuucuuuucuc

SEQ ID NO: 224445 - RNA, 19 nt, Human
augaaauagcauuuucuga

SEQ ID NO: 224446 - RNA, 22 nt, Human
gcuucuguuaggauguggcuua

SEQ ID NO: 224447 - RNA, 22 nt, Human
uucuugucuuuguuauguagga

SEQ ID NO: 224448 - RNA, 22 nt, Human
ugcauucugaacguaaauguga

SEQ ID NO: 224449 - RNA, 22 nt, Human
agggaggagggacagaaagagg

SEQ ID NO: 224450 - RNA, 22 nt, Human
auucuucauguugaagcuguca

SEQ ID NO: 224451 - RNA, 22 nt, Human
agagauacugcaggccauaaau

SEQ ID NO: 224452 - RNA, 22 nt, Human
gagggagugggcccgugggcac

SEQ ID NO: 224453 - RNA, 20 nt, Human
uucacagaggacucagguca

SEQ ID NO: 224454 - RNA, 23 nt, Human
ccagcugugccuggcccaggagc

SEQ ID NO: 224455 - RNA, 22 nt, Human
uucucuugccuucucuuuuauc

SEQ ID NO: 224456 - RNA, 22 nt, Human
uuauuugcccauguuuagcaga

SEQ ID NO: 224457 - RNA, 22 nt, Human
gcagagcugucuaagucacuuc

SEQ ID NO: 224458 - RNA, 22 nt, Human
ucuuucugaugggaagggucaa

SEQ ID NO: 224459 - RNA, 22 nt, Human
uacuuuaauugcaaaaauaaau

SEQ ID NO: 224460 - RNA, 22 nt, Human
cugcaucacagcaggaggcaca

SEQ ID NO: 224461 - RNA, 22 nt, Human
uuuaacauaugaaagaauauuu

SEQ ID NO: 224462 - RNA, 22 nt, Human
uuauuuaaguauuuauugaagu

SEQ ID NO: 224463 - RNA, 22 nt, Human
caguagcuuuuugcagacaaga

SEQ ID NO: 224464 - RNA, 22 nt, Human
guuaaaaugauuugugauuuau

SEQ ID NO: 224465 - RNA, 22 nt, Human
cucugugucugauucugggaag

SEQ ID NO: 224466 - RNA, 22 nt, Human
uuuuuuccuguuugucuuuggg

SEQ ID NO: 224467 - RNA, 22 nt, Human
aggcaguguguagcuggaagag

SEQ ID NO: 224468 - RNA, 22 nt, Human
ugugugcuaguuuugucaguau

SEQ ID NO: 224469 - RNA, 18 nt, Human
cccagaggaaugccugga

SEQ ID NO: 224470 - RNA, 22 nt, Human
uuuucucuuugcuucucuaaaa

SEQ ID NO: 224471 - RNA, 22 nt, Human
gugaucagaagaaccugccgaa

SEQ ID NO: 224472 - RNA, 22 nt, Human
uacaagcucuuguagggggaaa

SEQ ID NO: 224473 - RNA, 22 nt, Human
auuuucuugucucuguuguagg

SEQ ID NO: 224474 - RNA, 22 nt, Human
uacuauuuugacaugaaauuga

SEQ ID NO: 224475 - RNA, 20 nt, Human
ucagugggaaagugagagug

SEQ ID NO: 224476 - RNA, 19 nt, Human
caggucuucuuggaggacu

SEQ ID NO: 224477 - RNA, 22 nt, Human
ugagggaguguggauacaguag

SEQ ID NO: 224478 - RNA, 22 nt, Human
uauuuguauugucuuaucacuu

SEQ ID NO: 224479 - RNA, 22 nt, Human
cauaggcucuucagagaacuga

SEQ ID NO: 224480 - RNA, 22 nt, Human
uugcuuucuuuguagguuuucc

SEQ ID NO: 224481 - RNA, 22 nt, Human
ccagggcuggaggaggucagga

SEQ ID NO: 224482 - RNA, 22 nt, Human
uuuuccuuagaaauacauugau

SEQ ID NO: 224483 - RNA, 19 nt, Human
uccuacaugagacagagag

SEQ ID NO: 224484 - RNA, 22 nt, Human
agagacaggguuuugucguguu

SEQ ID NO: 224485 - RNA, 22 nt, Human
gaggcuugccacuguccauggc

SEQ ID NO: 224486 - RNA, 22 nt, Human
uaggauugguguauguagguuu

SEQ ID NO: 224487 - RNA, 22 nt, Human
uucuucuuuccuauaauuaauu

SEQ ID NO: 224488 - RNA, 22 nt, Human
uuccgcuuucaauggcuuggcu

SEQ ID NO: 224489 - RNA, 22 nt, Human
ucucucugcuguccagcguuau

SEQ ID NO: 224490 - RNA, 22 nt, Human
uacagaccaguaguucucagcg

SEQ ID NO: 224491 - RNA, 22 nt, Human
uauauuaaagugcuuugcagug

SEQ ID NO: 224492 - RNA, 22 nt, Human
guucuucagcccucagguccua

SEQ ID NO: 224493 - RNA, 22 nt, Human
uguuggaaucuucuagucuucc

SEQ ID NO: 224494 - RNA, 23 nt, Human
uuucugaguuuuuuaaaagucca

SEQ ID NO: 224495 - RNA, 22 nt, Human
uggggcugguaccguaauauau

SEQ ID NO: 224496 - RNA, 22 nt, Human
cuccucccagcccaggcgccac

SEQ ID NO: 224497 - RNA, 22 nt, Human
ccaggcuccccaggaggcccuu

SEQ ID NO: 224498 - RNA, 22 nt, Human
gggcaagaagcuggaagcauuc

SEQ ID NO: 224499 - RNA, 22 nt, Human
gcuucucacccuuacuaucucu

SEQ ID NO: 224500 - RNA, 21 nt, Human
caguucuaagugucaucuuuu

SEQ ID NO: 224501 - RNA, 20 nt, Human
gacaugagggagcaaagagc

SEQ ID NO: 224502 - RNA, 22 nt, Human
guguugaugugucuguauucua

SEQ ID NO: 224503 - RNA, 22 nt, Human
aucuaaaacuacgaauacuacc

SEQ ID NO: 224504 - RNA, 22 nt, Human
uucauuagcacauuuccuuggu

SEQ ID NO: 224505 - RNA, 22 nt, Human
uuuguuuccagccuuuugucuu

SEQ ID NO: 224506 - RNA, 22 nt, Human
ucauuauuuugauguauuuccu

SEQ ID NO: 224507 - RNA, 22 nt, Human
aucuguuccccuaugcucucua

SEQ ID NO: 224508 - RNA, 22 nt, Human
cccuguccugcuaggcccuggu

SEQ ID NO: 224509 - RNA, 22 nt, Human
agucaccuacagcucaugcuuc

SEQ ID NO: 224510 - RNA, 22 nt, Human
uaauauaacugccaguuaaggu

SEQ ID NO: 224511 - RNA, 22 nt, Human
ugggcagggauuuggggaaacu

SEQ ID NO: 224512 - RNA, 22 nt, Human
auuuuuuuuccugucucuuuca

SEQ ID NO: 224513 - RNA, 22 nt, Human
cagggggacuuguuagguuuua

SEQ ID NO: 224514 - RNA, 22 nt, Human
uuuuguuuacauuaaauuuuga

SEQ ID NO: 224515 - RNA, 22 nt, Human
uuagaaauguccuacuaauaug

SEQ ID NO: 224516 - RNA, 22 nt, Human
agcuuucuauauaugaguugcu

SEQ ID NO: 224517 - RNA, 22 nt, Human
cguuuugaguagauagccauau

SEQ ID NO: 224518 - RNA, 22 nt, Human
ggccugcuaccagcugugaccu

SEQ ID NO: 224519 - RNA, 20 nt, Human
ccuuguggaugucuuuuuug

SEQ ID NO: 224520 - RNA, 21 nt, Human
agaugaggauacugaggccua

SEQ ID NO: 224521 - RNA, 22 nt, Human
caagaaaaaacaugaugagugu

SEQ ID NO: 224522 - RNA, 22 nt, Human
cuucuuuucuacuggccuagaa

SEQ ID NO: 224523 - RNA, 22 nt, Human
uuauuuuuaggaauguagaggu

SEQ ID NO: 224524 - RNA, 22 nt, Human
aggugagaacguggaggggcgg

SEQ ID NO: 224525 - RNA, 22 nt, Human
ggggcucauuugcaggggggag

SEQ ID NO: 224526 - RNA, 22 nt, Human
aagaaggaaggcaagagauggg

SEQ ID NO: 224527 - RNA, 22 nt, Human
aaugaauaaauuuuaaagacag

SEQ ID NO: 224528 - RNA, 22 nt, Human
ggcagagguagcuggaaccagg

SEQ ID NO: 224529 - RNA, 22 nt, Human
ccuccuuuccuguuuuccugag

SEQ ID NO: 224530 - RNA, 22 nt, Human
gucucacuucauuuucuuagcc

SEQ ID NO: 224531 - RNA, 22 nt, Human
aagcucagcugguggugauugc

SEQ ID NO: 224532 - RNA, 23 nt, Human
caggggacaggugaccugggcuc

SEQ ID NO: 224533 - RNA, 22 nt, Human
aggaaauaggaccagacaaagc

SEQ ID NO: 224534 - RNA, 22 nt, Human
gaauucuaguucuguaucucug

SEQ ID NO: 224535 - RNA, 22 nt, Human
uaaaaucaugacagauugacau

SEQ ID NO: 224536 - RNA, 22 nt, Human
guugagaaucucuagcuuagga

SEQ ID NO: 224537 - RNA, 23 nt, Human
aaguggugacugugcuacugaga

SEQ ID NO: 224538 - RNA, 22 nt, Human
uuguuauuauuauuuucguucu

SEQ ID NO: 224539 - RNA, 22 nt, Human
uuaacauuguccuuagcagauu

SEQ ID NO: 224540 - RNA, 22 nt, Human
uauauacacgcacauauacaua

SEQ ID NO: 224541 - RNA, 22 nt, Human
caguggagaccugccugcugga

SEQ ID NO: 224542 - RNA, 22 nt, Human
cauggcaggugcagauucugug

SEQ ID NO: 224543 - RNA, 22 nt, Human
ugucuuuuaaaaauguguaaaa

SEQ ID NO: 224544 - RNA, 22 nt, Human
gcuguggaaaaugggucuccaa

SEQ ID NO: 224545 - RNA, 22 nt, Human
auggauggaagcagccugaacu

SEQ ID NO: 224546 - RNA, 22 nt, Human
ugguugauuaauuuugccaagc

SEQ ID NO: 224547 - RNA, 22 nt, Human
uuuuuaaaauuaggacggcacg

SEQ ID NO: 224548 - RNA, 22 nt, Human
cuucuuucuuuucuucuucucu

SEQ ID NO: 224549 - RNA, 22 nt, Human
uacaaaugaucaucucuuugaa

SEQ ID NO: 224550 - RNA, 22 nt, Human
caaauguuugguggcauuuugu

SEQ ID NO: 224551 - RNA, 20 nt, Human
uucucugcagcaggcggccc

SEQ ID NO: 224552 - RNA, 22 nt, Human
agcagggagacagugcagcauu

SEQ ID NO: 224553 - RNA, 22 nt, Human
auccugugggguauugcugcau

SEQ ID NO: 224554 - RNA, 22 nt, Human
uucauagaagggaguuuuuccu

SEQ ID NO: 224555 - RNA, 22 nt, Human
gugaaauuguacacucaguacc

SEQ ID NO: 224556 - RNA, 22 nt, Human
gggcuguggggccugcagaagg

SEQ ID NO: 224557 - RNA, 22 nt, Human
uucacccuucucuggcuuucag

SEQ ID NO: 224558 - RNA, 22 nt, Human
agagggagagauuggcaaucag

SEQ ID NO: 224559 - RNA, 22 nt, Human
ccagggaggucauagugcuggu

SEQ ID NO: 224560 - RNA, 22 nt, Human
ggggaggugugcaggacaccuc

SEQ ID NO: 224561 - RNA, 23 nt, Human
aggcugcagaagaauagggucau

SEQ ID NO: 224562 - RNA, 22 nt, Human
cugcagagaccuaggucagguu

SEQ ID NO: 224563 - RNA, 21 nt, Human
uuccuggaggcagaaacguga

SEQ ID NO: 224564 - RNA, 22 nt, Human
uuuacuguuuacagcuaaugca

SEQ ID NO: 224565 - RNA, 17 nt, Human
ugucuuuuuccuccucc

SEQ ID NO: 224566 - RNA, 22 nt, Human
guucaaucucucaugcauuuuc

SEQ ID NO: 224567 - RNA, 19 nt, Human
agugaacuccauaucaggu

SEQ ID NO: 224568 - RNA, 21 nt, Human
ugagcccaaagcuguauuggu

SEQ ID NO: 224569 - RNA, 22 nt, Human
uauuaaaagagaaaaagccacc

SEQ ID NO: 224570 - RNA, 22 nt, Human
uggggcuggccaggaggagucu

SEQ ID NO: 224571 - RNA, 22 nt, Human
aucucacuucugucauguggca

SEQ ID NO: 224572 - RNA, 22 nt, Human
agcaaaauuccaaaaugcuaau

SEQ ID NO: 224573 - RNA, 22 nt, Human
cugccucucaugccugcuugcu

SEQ ID NO: 224574 - RNA, 22 nt, Human
caauccccaggucccagaacag

SEQ ID NO: 224575 - RNA, 22 nt, Human
ggaggccagagaagagccaggc

SEQ ID NO: 224576 - RNA, 22 nt, Human
ugauucacagacuucacaaggc

SEQ ID NO: 224577 - RNA, 22 nt, Human
aagccucaugccagauccaggu

SEQ ID NO: 224578 - RNA, 22 nt, Human
ggcuccaggguaccccuggaug

SEQ ID NO: 224579 - RNA, 22 nt, Human
ugagauguaauguaguacuuug

SEQ ID NO: 224580 - RNA, 22 nt, Human
auauuuuugcagaauuuuucgu

SEQ ID NO: 224581 - RNA, 22 nt, Human
aggggaggggaguaucaggauu

SEQ ID NO: 224582 - RNA, 22 nt, Human
ucugcaugccucaggaggccug

SEQ ID NO: 224583 - RNA, 22 nt, Human
uuuaaaacagcauuuaaaaggu

SEQ ID NO: 224584 - RNA, 22 nt, Human
uucaugucuuugauucugauaa

SEQ ID NO: 224585 - RNA, 22 nt, Human
guuguuuuuguuaaaacaguga

SEQ ID NO: 224586 - RNA, 22 nt, Human
auuuuugguuucaccugcacgc

SEQ ID NO: 224587 - RNA, 22 nt, Human
auaaaaauguuuuuguguggua

SEQ ID NO: 224588 - RNA, 20 nt, Human
cuuauuuuggagaacuuuuc

SEQ ID NO: 224589 - RNA, 22 nt, Human
aagaggcuacagcccugugucu

SEQ ID NO: 224590 - RNA, 22 nt, Human
ccucccuucccggcauggcucu

SEQ ID NO: 224591 - RNA, 21 nt, Human
gggagaguagcgguagggagg

SEQ ID NO: 224592 - RNA, 21 nt, Human
acugggcuagccugacuucug

SEQ ID NO: 224593 - RNA, 22 nt, Human
uuuaaucaguugguaauauuga

SEQ ID NO: 224594 - RNA, 22 nt, Human
uuauuguuuggguauaauuuga

SEQ ID NO: 224595 - RNA, 22 nt, Human
uuuuuuuaaguuuugauuuuag

SEQ ID NO: 224596 - RNA, 22 nt, Human
agugagaguauuaaugugaacu

SEQ ID NO: 224597 - RNA, 22 nt, Human
gagggcugccacguugggcgag

SEQ ID NO: 224598 - RNA, 22 nt, Human
acuuuauacuagugauaguuug

SEQ ID NO: 224599 - RNA, 22 nt, Human
ccuucugcuggucaucccagug

SEQ ID NO: 224600 - RNA, 22 nt, Human
aaucauaacaaaagcaauuaua

SEQ ID NO: 224601 - RNA, 22 nt, Human
ggaggccgugcugugcugccag

SEQ ID NO: 224602 - RNA, 22 nt, Human
auuuccagcagcauauuugucu

SEQ ID NO: 224603 - RNA, 22 nt, Human
auuagugguguauuuggcacua

SEQ ID NO: 224604 - RNA, 22 nt, Human
uggggcuccuccuggcaggagg

SEQ ID NO: 224605 - RNA, 22 nt, Human
guuuuaucuauguaauuauaaa

SEQ ID NO: 224606 - RNA, 22 nt, Human
aggauggauagcaaggaagccg

SEQ ID NO: 224607 - RNA, 22 nt, Human
uuauuuuuguaacacuguauag

SEQ ID NO: 224608 - RNA, 22 nt, Human
caagggcagaggcagggccccg

SEQ ID NO: 224609 - RNA, 21 nt, Human
auauuguugggguuuucuuuu

SEQ ID NO: 224610 - RNA, 22 nt, Human
uucuugugugaauauaauuaca

SEQ ID NO: 224611 - RNA, 22 nt, Human
uucuagcucauggugacagauc

SEQ ID NO: 224612 - RNA, 22 nt, Human
ggcugggagguggcgaggaggc

SEQ ID NO: 224613 - RNA, 22 nt, Human
uuuuuuuuacuccggacagcuc

SEQ ID NO: 224614 - RNA, 22 nt, Human
ugcucacugcuuguguucaguu

SEQ ID NO: 224615 - RNA, 22 nt, Human
agugaggggagaaugaggugga

SEQ ID NO: 224616 - RNA, 22 nt, Human
gggcagagagcuggaacuccuu

SEQ ID NO: 224617 - RNA, 22 nt, Human
agucacuguucugucaugucaa

SEQ ID NO: 224618 - RNA, 22 nt, Human
cuucuuuuggggaugaaaaugg

SEQ ID NO: 224619 - RNA, 22 nt, Human
gugucccaaagauuagaaauca

SEQ ID NO: 224620 - RNA, 22 nt, Human
uguuuuuuagagugauacuuuu

SEQ ID NO: 224621 - RNA, 22 nt, Human
acuuuuccuggguagcuccugg

SEQ ID NO: 224622 - RNA, 22 nt, Human
aaauuaaaguuuuauuuagagc

SEQ ID NO: 224623 - RNA, 22 nt, Human
uauuguuuuaagguguauuaau

SEQ ID NO: 224624 - RNA, 22 nt, Human
ugagagggagacagcucuagca

SEQ ID NO: 224625 - RNA, 22 nt, Human
uuuuaaaguaauugaagcuugu

SEQ ID NO: 224626 - RNA, 22 nt, Human
gugugucucaguugcuccgaag

SEQ ID NO: 224627 - RNA, 22 nt, Human
uauuuuagccaacagaaugaug

SEQ ID NO: 224628 - RNA, 22 nt, Human
gguuuucacgauccucccuuuu

SEQ ID NO: 224629 - RNA, 22 nt, Human
cuacuucucccuagaucagaaa

SEQ ID NO: 224630 - RNA, 22 nt, Human
aauguugaaccuuuuuggccug

SEQ ID NO: 224631 - RNA, 22 nt, Human
uaccuggauaaauguacaaccg

SEQ ID NO: 224632 - RNA, 22 nt, Human
aggggcugugucauuuguccua

SEQ ID NO: 224633 - RNA, 22 nt, Human
auuaauaucaauauauuauaug

SEQ ID NO: 224634 - RNA, 22 nt, Human
uucauuuccauuuuauagauaa

SEQ ID NO: 224635 - RNA, 22 nt, Human
aaagggagauaaaguaauuuua

SEQ ID NO: 224636 - RNA, 22 nt, Human
ugaggaagugguuguaugguuu

SEQ ID NO: 224637 - RNA, 22 nt, Human
auuuuauuuugggaucuuuuua

SEQ ID NO: 224638 - RNA, 22 nt, Human
ggagcucacuacgaaauaagcu

SEQ ID NO: 224639 - RNA, 22 nt, Human
ugaaaaauauuuuuagaaauaa

SEQ ID NO: 224640 - RNA, 22 nt, Human
ucugaggacagugcugugccug

SEQ ID NO: 224641 - RNA, 22 nt, Human
uuuuuaagguuuguuuauauau

SEQ ID NO: 224642 - RNA, 22 nt, Human
ucauacuuuuuugacccuugug

SEQ ID NO: 224643 - RNA, 22 nt, Human
aucuucuuucaucagccccuca

SEQ ID NO: 224644 - RNA, 22 nt, Human
auauucaaugaggucauauaag

SEQ ID NO: 224645 - RNA, 22 nt, Human
uugauagauuuuagaggcaggc

SEQ ID NO: 224646 - RNA, 22 nt, Human
cuucuuaaaguugucacagcug

SEQ ID NO: 224647 - RNA, 22 nt, Human
cccagaggcugaguugggagca

SEQ ID NO: 224648 - RNA, 22 nt, Human
auguuccaugacuaugcaugaa

SEQ ID NO: 224649 - RNA, 22 nt, Human
auacauauaugcacauuaauau

SEQ ID NO: 224650 - RNA, 22 nt, Human
uggaagcccagaaggaagcaga

SEQ ID NO: 224651 - RNA, 22 nt, Human
ccagcugggucccugcuggggc

SEQ ID NO: 224652 - RNA, 22 nt, Human
uuuuaaauaaacuacacugauu

SEQ ID NO: 224653 - RNA, 22 nt, Shigella flexneri 2a str. 2457T
ucaauaagcgcaggcuguugag

SEQ ID NO: 224654 - RNA, 22 nt, Shigella flexneri 2a str. 2457T
augcgucucugaacaggcggcc

SEQ ID NO: 224655 - RNA, 22 nt, Shigella flexneri 2a str. 2457T
aggaauugcaggguaaaauuca

SEQ ID NO: 224656 - RNA, 18 nt, Shigella flexneri 2a str. 2457T
gaugauacuauguaucac

SEQ ID NO: 224657 - RNA, 22 nt, Shigella flexneri 2a str. 2457T
ugauggucaggauugugaacgc

SEQ ID NO: 224658 - RNA, 22 nt, Shigella flexneri 2a str. 2457T
augccgcuuacucaagaagaaa

SEQ ID NO: 224659 - RNA, 22 nt, Shigella flexneri 2a str. 2457T
ugccggaugucuggagcuggcu

SEQ ID NO: 224660 - RNA, 22 nt, Shigella flexneri 2a str. 2457T
cgguggucggcauucugcuggc

SEQ ID NO: 224661 - RNA, 22 nt, Shigella flexneri 2a str. 2457T
caggccuacaugauuucugcaa

SEQ ID NO: 224662 - RNA, 22 nt, Shigella flexneri 2a str. 2457T
ucagauugucgauaugaacggu

SEQ ID NO: 224663 - RNA, 22 nt, Shigella flexneri 2a str. 2457T
gccggucaaucgcauucugggg

SEQ ID NO: 224664 - RNA, 22 nt, Shigella flexneri 2a str. 2457T
caucggcuacagcagcagccug

SEQ ID NO: 224665 - RNA, 22 nt, Shigella flexneri 2a str. 2457T
ucgguugauaccaggccgcaag

SEQ ID NO: 224666 - RNA, 22 nt, Shigella flexneri 2a str. 2457T
gggccagaaaaucugugucuug

SEQ ID NO: 224667 - RNA, 23 nt, Shigella flexneri 2a str. 2457T
uuaccgacaaaaugaccagcgcc

SEQ ID NO: 224668 - RNA, 22 nt, Shigella flexneri 2a str. 2457T
ggcagugcguagaauuuaccuu

SEQ ID NO: 224669 - RNA, 22 nt, Shigella flexneri 2a str. 2457T
ggcacugaaaccguggguguua

SEQ ID NO: 224670 - RNA, 22 nt, Shigella flexneri 2a str. 2457T
cuacgcaucuuucauuuauaaa

SEQ ID NO: 224671 - RNA, 22 nt, Shigella flexneri 2a str. 2457T
aacgcuuuaauaucuuucggau

SEQ ID NO: 224672 - RNA, 22 nt, Shigella flexneri 2a str. 2457T
ucauguaggcggugaugagcug

SEQ ID NO: 224673 - RNA, 22 nt, Shigella flexneri 2a str. 2457T
cugaugcgucuuaucaggccua

SEQ ID NO: 224674 - RNA, 22 nt, Shigella flexneri 2a str. 2457T
agcugcugacgcaccaguucua

SEQ ID NO: 224675 - RNA, 22 nt, Shigella flexneri 2a str. 2457T
uggugaaguuauuaacucagca

SEQ ID NO: 224676 - RNA, 20 nt, Shigella flexneri 2a str. 2457T
auaguugucagacguuuagc

SEQ ID NO: 224677 - RNA, 22 nt, Shigella flexneri 2a str. 2457T
cggugcuggcugcugacaucgu

SEQ ID NO: 224678 - RNA, 22 nt, Shigella flexneri 2a str. 2457T
agcgcaggcagaacggaauuac

SEQ ID NO: 224679 - RNA, 22 nt, Shigella flexneri 2a str. 2457T
gugcggaugagaucgugaaacu

SEQ ID NO: 224680 - RNA, 22 nt, Shigella flexneri 2a str. 2457T
ugcccgucagguccguguggua

SEQ ID NO: 224681 - RNA, 22 nt, Shigella flexneri 2a str. 2457T
cgcguuggucaucgcuucacua

SEQ ID NO: 224682 - RNA, 22 nt, Shigella flexneri 2a str. 2457T
accagcgcagauagcccggaua

SEQ ID NO: 224683 - RNA, 20 nt, Shigella flexneri 2a str. 2457T
acugaccgacucagggcaga

SEQ ID NO: 224684 - RNA, 22 nt, Shigella flexneri 2a str. 2457T
agcucaauaagacagguucuac

SEQ ID NO: 224685 - RNA, 22 nt, Shigella flexneri 2a str. 2457T
cccacgauucauaauggcgaug

SEQ ID NO: 224686 - RNA, 22 nt, Shigella flexneri 2a str. 2457T
gacuggccgacaacgcuugcug

SEQ ID NO: 224687 - RNA, 22 nt, Shigella flexneri 2a str. 2457T
auggcaaucgcaucuaucuggu

SEQ ID NO: 224688 - RNA, 19 nt, Shigella flexneri 2a str. 2457T
uacggcuguuucugacggu

SEQ ID NO: 224689 - RNA, 22 nt, Shigella flexneri 2a str. 2457T
gccgaucauccgcagaagaaaa

SEQ ID NO: 224690 - RNA, 22 nt, Shigella flexneri 2a str. 2457T
gcucuggcacaguaucgugaac

SEQ ID NO: 224691 - RNA, 22 nt, Shigella flexneri 2a str. 2457T
aggagcgcuccagccccuucga

SEQ ID NO: 224692 - RNA, 22 nt, Shigella flexneri 2a str. 2457T
guggcugaugccauguagcuca

SEQ ID NO: 224693 - RNA, 22 nt, Shigella flexneri 2a str. 2457T
gcugaagauccguaaaauugag

SEQ ID NO: 224694 - RNA, 22 nt, Shigella flexneri 2a str. 2457T
ugccaaugcacagcauuuugcu

SEQ ID NO: 224695 - RNA, 22 nt, Shigella flexneri 2a str. 2457T
augcaguguaaacgucuuaucc

SEQ ID NO: 224696 - RNA, 22 nt, Shigella flexneri 2a str. 2457T
uuugacgauggcuuucaggucg

SEQ ID NO: 224697 - RNA, 22 nt, Shigella flexneri 2a str. 2457T
cauugcgcagguuuggagugau

SEQ ID NO: 224698 - RNA, 22 nt, Shigella flexneri 2a str. 2457T
gugaacguguaggccugauaag

SEQ ID NO: 224699 - RNA, 22 nt, Shigella flexneri 2a str. 2457T
ccugccacuguuucaccauccc

SEQ ID NO: 224700 - RNA, 22 nt, Shigella flexneri 2a str. 2457T
augcgcuuaagcgucuggaugu

SEQ ID NO: 224701 - RNA, 22 nt, Shigella flexneri 2a str. 2457T
cuccagcuuacgguuaccagac

SEQ ID NO: 224702 - RNA, 22 nt, Shigella flexneri 2a str. 2457T
agcaggcuucauggauuggcag

SEQ ID NO: 224703 - RNA, 22 nt, Shigella flexneri 2a str. 2457T
uaucaggcuugggcaguguuag

SEQ ID NO: 224704 - RNA, 22 nt, Shigella flexneri 2a str. 2457T
gucuggauuuaguacgucgcug

SEQ ID NO: 224705 - RNA, 22 nt, Shigella flexneri 2a str. 2457T
ucugaaugaagccaguaauguu

SEQ ID NO: 224706 - RNA, 22 nt, Shigella flexneri 2a str. 2457T
ucaaacucccuuuacuuaccuu

SEQ ID NO: 224707 - RNA, 22 nt, Shigella flexneri 2a str. 2457T
ucaguugauacuccaccugcga

SEQ ID NO: 224708 - RNA, 22 nt, Shigella flexneri 2a str. 2457T
ggcaaccgugggccgaugaauu

SEQ ID NO: 224709 - RNA, 22 nt, Shigella flexneri 2a str. 2457T
cgaguaggcgggauaaggcguu

SEQ ID NO: 224710 - RNA, 22 nt, Shigella flexneri 2a str. 2457T
ccgauaguuaagucaaaaccga

SEQ ID NO: 224711 - RNA, 22 nt, Shigella flexneri 2a str. 2457T
uuuaucggguacuaaaguucug

SEQ ID NO: 224712 - RNA, 22 nt, Shigella flexneri 2a str. 2457T
gcuguucaacuccaaacucucu

SEQ ID NO: 224713 - RNA, 19 nt, Shigella flexneri 2a str. 2457T
auggugaugaucgauuucc

SEQ ID NO: 224714 - RNA, 22 nt, Shigella flexneri 2a str. 2457T
uucauugaaaagugugaaccgg

SEQ ID NO: 224715 - RNA, 22 nt, Shigella flexneri 2a str. 2457T
ugauggcugccgccgucugcgc

SEQ ID NO: 224716 - RNA, 22 nt, Shigella flexneri 2a str. 2457T
aucgcaaucgaaacaaucggug

SEQ ID NO: 224717 - RNA, 22 nt, Shigella flexneri 2a str. 2457T
uggcaggccauuggguugagaa

SEQ ID NO: 224718 - RNA, 22 nt, Shigella flexneri 2a str. 2457T
cugggcgaggauuacauccgca

SEQ ID NO: 224719 - RNA, 22 nt, Shigella flexneri 2a str. 2457T
uauccggcauacgauuuuauuc

SEQ ID NO: 224720 - RNA, 22 nt, Shigella flexneri 2a str. 2457T
uuggccugaauaucuccacugg

SEQ ID NO: 224721 - RNA, 22 nt, Shigella flexneri 2a str. 2457T
uccggccuacaugaucucugca

SEQ ID NO: 224722 - RNA, 22 nt, Shigella flexneri 2a str. 2457T
cacguuaaugaugcucgcacuu

SEQ ID NO: 224723 - RNA, 22 nt, Shigella flexneri 2a str. 2457T
uugacuuucugacccacuucga

SEQ ID NO: 224724 - RNA, 22 nt, Shigella flexneri 2a str. 2457T
ucaccauuugccgaugcguuuu

SEQ ID NO: 224725 - RNA, 22 nt, Shigella flexneri 2a str. 2457T
uggcagcgauguuccauaauca

SEQ ID NO: 224726 - RNA, 22 nt, Shigella flexneri 2a str. 2457T
acgaaacuggacggcacggcga

SEQ ID NO: 224727 - RNA, 22 nt, Shigella flexneri 2a str. 2457T
gcccgucugcuggugcaaucau

SEQ ID NO: 224728 - RNA, 22 nt, Shigella flexneri 2a str. 2457T
cugcguacgccauuagcggugc

SEQ ID NO: 224729 - RNA, 22 nt, Shigella flexneri 2a str. 2457T
cguaauguuaacuggggcuuuu

SEQ ID NO: 224730 - RNA, 22 nt, Shigella flexneri 2a str. 2457T
agaacgcggcgagcagguggca

SEQ ID NO: 224731 - RNA, 21 nt, Shigella flexneri 2a str. 2457T
uccugauuauaaauuucgcca

SEQ ID NO: 224732 - RNA, 22 nt, Shigella flexneri 2a str. 2457T
aagugccgcuguuuggucgugc

SEQ ID NO: 224733 - RNA, 22 nt, Shigella flexneri 2a str. 2457T
uugcggaaguuuaucuggcgau

SEQ ID NO: 224734 - RNA, 23 nt, Shigella flexneri 2a str. 2457T
ggguauauaaaugcacgcucugc

SEQ ID NO: 224735 - RNA, 22 nt, Shigella flexneri 2a str. 2457T
aaagaugucgaucuugaaaacu

SEQ ID NO: 224736 - RNA, 22 nt, Shigella flexneri 2a str. 2457T
uacguuauccaucaccagaauc

SEQ ID NO: 224737 - RNA, 23 nt, Shigella flexneri 2a str. 2457T
cugaccguaaaggucgucgugaa

SEQ ID NO: 224738 - RNA, 22 nt, Shigella flexneri 2a str. 2457T
caucugucugauaaaaaacccg

SEQ ID NO: 224739 - RNA, 22 nt, Shigella flexneri 2a str. 2457T
cugguauagguauggagcuuau

SEQ ID NO: 224740 - RNA, 22 nt, Shigella flexneri 2a str. 2457T
gguaugcguggcgcgcguguuc

SEQ ID NO: 224741 - RNA, 22 nt, Shigella flexneri 2a str. 2457T
gaacgcgugcuucaggaagcgg

SEQ ID NO: 224742 - RNA, 22 nt, Shigella flexneri 2a str. 2457T
cgggcuauuuuucaccgaguuc

SEQ ID NO: 224743 - RNA, 22 nt, Shigella flexneri 2a str. 2457T
ucacgauaaacagcccugcguu

SEQ ID NO: 224744 - RNA, 22 nt, Shigella flexneri 2a str. 2457T
cugggcugacaccguacaggag

SEQ ID NO: 224745 - RNA, 22 nt, Shigella flexneri 2a str. 2457T
uguuaugacuuacgcuuuccag

SEQ ID NO: 224746 - RNA, 22 nt, Shigella flexneri 2a str. 2457T
ggcguuaggaucguauggugag

SEQ ID NO: 224747 - RNA, 22 nt, Shigella flexneri 2a str. 2457T
aguguaaaagguauguaacaga

SEQ ID NO: 224748 - RNA, 22 nt, Shigella flexneri 2a str. 2457T
ugcaggaagggcaacagccguc

SEQ ID NO: 224749 - RNA, 22 nt, Shigella flexneri 2a str. 2457T
aggugcguaauaagcugguggc

SEQ ID NO: 224750 - RNA, 22 nt, Shigella flexneri 2a str. 2457T
guaccugcguucacacccaacu

SEQ ID NO: 224751 - RNA, 22 nt, Shigella flexneri 2a str. 2457T
cagcgucuggaaaaccgcgaau

SEQ ID NO: 224752 - RNA, 22 nt, Shigella flexneri 2a str. 2457T
ucaucgguuucaaugacuuuug

SEQ ID NO: 224753 - RNA, 22 nt, Shigella flexneri 2a str. 2457T
acgauuguuuagauuguguaua

SEQ ID NO: 224754 - RNA, 22 nt, Shigella flexneri 2a str. 2457T
agaaauuguugcacgccggagg

SEQ ID NO: 224755 - RNA, 22 nt, Shigella flexneri 2a str. 2457T
aacuguccauuaagaagacgcu

SEQ ID NO: 224756 - RNA, 22 nt, Shigella flexneri 2a str. 2457T
auaucacgcguaacggcggcuu

SEQ ID NO: 224757 - RNA, 22 nt, Shigella flexneri 2a str. 2457T
uugcaccguauacguuugauuu

SEQ ID NO: 224758 - RNA, 22 nt, Shigella flexneri 2a str. 2457T
acgcggcagcaccgucaggcca

SEQ ID NO: 224759 - RNA, 22 nt, Shigella flexneri 2a str. 2457T
gguucugcgggaauacgguuuu

SEQ ID NO: 224760 - RNA, 22 nt, Shigella flexneri 2a str. 2457T
cuggcauuaggcguugcuggcu

SEQ ID NO: 224761 - RNA, 19 nt, Shigella flexneri 2a str. 2457T
uaccggacaugauuacugc

SEQ ID NO: 224762 - RNA, 22 nt, Shigella flexneri 2a str. 2457T
gcucugccuauuuugaaaacgc

SEQ ID NO: 224763 - RNA, 22 nt, Shigella flexneri 2a str. 2457T
caugagaaagaguaucugguga

SEQ ID NO: 224764 - RNA, 22 nt, Shigella flexneri 2a str. 2457T
cugcgacaauggcguuuuuucg

SEQ ID NO: 224765 - RNA, 22 nt, Shigella flexneri 2a str. 2457T
gcgcuuuguuuaugccagaugc

SEQ ID NO: 224766 - RNA, 22 nt, Shigella flexneri 2a str. 2457T
agcguucugaucugucugcgga

SEQ ID NO: 224767 - RNA, 22 nt, Shigella flexneri 2a str. 2457T
cgccacuuucuucugcgguucc

SEQ ID NO: 224768 - RNA, 22 nt, Shigella flexneri 2a str. 2457T
gcccuuuguaggccagauaaga

SEQ ID NO: 224769 - RNA, 22 nt, Shigella flexneri 2a str. 2457T
aaugccagcgccacagcgauaa

SEQ ID NO: 224770 - RNA, 22 nt, Shigella flexneri 2a str. 2457T
gcaguacgugccuaaaaugcug

SEQ ID NO: 224771 - RNA, 22 nt, Shigella flexneri 2a str. 2457T
uucucgguuugcuggucacgau

SEQ ID NO: 224772 - RNA, 22 nt, Shigella flexneri 2a str. 2457T
uacgcuuguugaguggugccga

SEQ ID NO: 224773 - RNA, 22 nt, Shigella flexneri 2a str. 2457T
agaagcugaaaucauacgguuu

SEQ ID NO: 224774 - RNA, 22 nt, Shigella flexneri 2a str. 2457T
augacguaggccugauaagcgu

SEQ ID NO: 224775 - RNA, 22 nt, Shigella flexneri 2a str. 2457T
ccaaagcggcaaacuucgcggu

SEQ ID NO: 224776 - RNA, 22 nt, Shigella flexneri 2a str. 2457T
ucacccguuagcacuaucugaa

SEQ ID NO: 224777 - RNA, 22 nt, Shigella flexneri 2a str. 2457T
aggcgcucuggcggcgaacuga

SEQ ID NO: 224778 - RNA, 22 nt, Shigella flexneri 2a str. 2457T
ugaguuuaucuuguuauggauu

SEQ ID NO: 224779 - RNA, 22 nt, Shigella flexneri 2a str. 2457T
uacaugccaaagauguuuugau

SEQ ID NO: 224780 - RNA, 22 nt, Shigella flexneri 2a str. 2457T
gccauauuuugucgcacgggau

SEQ ID NO: 224781 - RNA, 22 nt, Shigella flexneri 2a str. 2457T
ggcaugaccaucgaucucggcu

SEQ ID NO: 224782 - RNA, 22 nt, Shigella flexneri 2a str. 2457T
auaacagucaugaugaugaggu

SEQ ID NO: 224783 - RNA, 22 nt, Shigella flexneri 2a str. 2457T
cauggaguucguuggaccgggc

SEQ ID NO: 224784 - RNA, 22 nt, Shigella flexneri 2a str. 2457T
caccgcuguuagucagaacugu

SEQ ID NO: 224785 - RNA, 22 nt, Shigella flexneri 2a str. 2457T
augucguucggcgaggugguga

SEQ ID NO: 224786 - RNA, 22 nt, Shigella flexneri 2a str. 2457T
ucugcggcaaauacagcgguga

SEQ ID NO: 224787 - RNA, 22 nt, Shigella flexneri 2a str. 2457T
aaugcccugauguauuugaagu

SEQ ID NO: 224788 - RNA, 22 nt, Shigella flexneri 2a str. 2457T
auaagacgcuuccgcgucgcau

SEQ ID NO: 224789 - RNA, 22 nt, Shigella flexneri 2a str. 2457T
gcagcagaucaccacggcugau

SEQ ID NO: 224790 - RNA, 22 nt, Shigella flexneri 2a str. 2457T
ggcaucguuacgcgugucagca

SEQ ID NO: 224791 - RNA, 22 nt, Shigella flexneri 2a str. 2457T
ucgauaaagcgauggccgacca

SEQ ID NO: 224792 - RNA, 22 nt, Shigella flexneri 2a str. 2457T
uaggccggacaaggcguucacg

SEQ ID NO: 224793 - RNA, 22 nt, Shigella flexneri 2a str. 2457T
ccagucaacgguaauucaggcc

SEQ ID NO: 224794 - RNA, 19 nt, Shigella flexneri 2a str. 2457T
agcucaaucugguacagcu

SEQ ID NO: 224795 - RNA, 22 nt, Shigella flexneri 2a str. 2457T
uucgaacuggcgcuggcggcag

SEQ ID NO: 224796 - RNA, 22 nt, Shigella flexneri 2a str. 2457T
auggccgccccgguuggggacg

SEQ ID NO: 224797 - RNA, 22 nt, Shigella flexneri 2a str. 2457T
aguuugcuauugaccaggaaaa

SEQ ID NO: 224798 - RNA, 22 nt, Shigella flexneri 2a str. 2457T
gugcgcuggguaucagaaaugg

SEQ ID NO: 224799 - RNA, 22 nt, Shigella flexneri 2a str. 2457T
guaguaaucaucaaucugcugc

SEQ ID NO: 224800 - RNA, 22 nt, Shigella flexneri 2a str. 2457T
caagcgcgcuuaacgccguuuu

SEQ ID NO: 224801 - RNA, 22 nt, Shigella flexneri 2a str. 2457T
ucaugcgcgaagcgguagcgau

SEQ ID NO: 224802 - RNA, 22 nt, Shigella flexneri 2a str. 2457T
ccgguaucaaaguuaucgaccu

SEQ ID NO: 224803 - RNA, 22 nt, Shigella flexneri 2a str. 2457T
aacgucuugcgauugauguggc

SEQ ID NO: 224804 - RNA, 21 nt, Shigella flexneri 2a str. 2457T
gcguuaccaucauuaaagauc

SEQ ID NO: 224805 - RNA, 22 nt, Shigella flexneri 2a str. 2457T
ugcagacguugauugaacagcu

SEQ ID NO: 224806 - RNA, 22 nt, Shigella flexneri 2a str. 2457T
gcguuuccacaacguuacagcu

SEQ ID NO: 224807 - RNA, 22 nt, Shigella flexneri 2a str. 2457T
gagcuugaugaugagcgucgcg

SEQ ID NO: 224808 - RNA, 22 nt, Shigella flexneri 2a str. 2457T
aagcauuacuggucauugcaga

SEQ ID NO: 224809 - RNA, 22 nt, Shigella flexneri 2a str. 2457T
acggcguuuacccugagccagc

SEQ ID NO: 224810 - RNA, 22 nt, Shigella flexneri 2a str. 2457T
agaucuuuaaugaugguaacgc

SEQ ID NO: 224811 - RNA, 17 nt, Shigella flexneri 2a str. 2457T
aaauggugaagaguacc

SEQ ID NO: 224812 - RNA, 22 nt, Shigella flexneri 2a str. 2457T
auaucuguugaugccaacguau

SEQ ID NO: 224813 - RNA, 22 nt, Shigella flexneri 2a str. 2457T
aguuugaucgcaaagguauggu

SEQ ID NO: 224814 - RNA, 22 nt, Shigella flexneri 2a str. 2457T
aauaccguggaauaugccgggg

SEQ ID NO: 224815 - RNA, 22 nt, Shigella flexneri 2a str. 2457T
cgcuucaaaggugucgucagga

SEQ ID NO: 224816 - RNA, 23 nt, Shigella flexneri 2a str. 2457T
ugacuuucagcaguugcugacgg

SEQ ID NO: 224817 - RNA, 20 nt, Shigella flexneri 2a str. 2457T
aaguccugggaucagcgagg

SEQ ID NO: 224818 - RNA, 22 nt, Shigella flexneri 2a str. 2457T
uuacccgaccgagccgcgccau

SEQ ID NO: 224819 - RNA, 22 nt, Shigella flexneri 2a str. 2457T
agaugcugugcuaucgcuaacg

SEQ ID NO: 224820 - RNA, 22 nt, Shigella flexneri 2a str. 2457T
ggagaucagcagccccauucca

SEQ ID NO: 224821 - RNA, 22 nt, Shigella flexneri 2a str. 2457T
gugggcgacgccaggcugaaug

SEQ ID NO: 224822 - RNA, 22 nt, Shigella flexneri 2a str. 2457T
aagcgacaucuugccuguggau

SEQ ID NO: 224823 - RNA, 22 nt, Shigella flexneri 2a str. 2457T
augucgaccuauguugauuaua

SEQ ID NO: 224824 - RNA, 22 nt, Shigella flexneri 2a str. 2457T
uccggccuacaaaaucgugcaa

SEQ ID NO: 224825 - RNA, 22 nt, Shigella flexneri 2a str. 2457T
gaugagcguuucccgcauccgc

SEQ ID NO: 224826 - RNA, 22 nt, Shigella flexneri 2a str. 2457T
uccgguuuugggaucaccugau

SEQ ID NO: 224827 - RNA, 22 nt, Shigella flexneri 2a str. 2457T
ccggauucuuuuaugcacauug

SEQ ID NO: 224828 - RNA, 22 nt, Shigella flexneri 2a str. 2457T
aucgcugauauuaaagccacaa

SEQ ID NO: 224829 - RNA, 22 nt, Shigella flexneri 2a str. 2457T
augcgcggauauugguggugcg

SEQ ID NO: 224830 - RNA, 22 nt, Shigella flexneri 2a str. 2457T
gcuucugcacugugguuuuucu

SEQ ID NO: 224831 - RNA, 22 nt, Shigella flexneri 2a str. 2457T
ucugcugccugacguugcagcu

SEQ ID NO: 224832 - RNA, 20 nt, Shigella flexneri 2a str. 2457T
accugauuaaaaauaucggc

SEQ ID NO: 224833 - RNA, 22 nt, Shigella flexneri 2a str. 2457T
uaagauugugaaugacggccgg

SEQ ID NO: 224834 - RNA, 22 nt, Shigella flexneri 2a str. 2457T
auccggccuacauaaucacgca

SEQ ID NO: 224835 - RNA, 22 nt, Shigella flexneri 2a str. 2457T
ggcgcuugccugcuccccucac

SEQ ID NO: 224836 - RNA, 22 nt, Shigella flexneri 2a str. 2457T
ugcaaucuccguguaggccuga

SEQ ID NO: 224837 - RNA, 19 nt, Shigella flexneri 2a str. 2457T
ugaucgagaagauugcgga

SEQ ID NO: 224838 - RNA, 22 nt, Shigella flexneri 2a str. 2457T
acuuccuguuccgaggaggcga

SEQ ID NO: 224839 - RNA, 22 nt, Shigella flexneri 2a str. 2457T
uguaggcgggauaaggcguuca

SEQ ID NO: 224840 - RNA, 22 nt, Shigella flexneri 2a str. 2457T
ucgccgcaccacaacugucagc

SEQ ID NO: 224841 - RNA, 22 nt, Shigella flexneri 2a str. 2457T
cagcaugauggauguuccggua

SEQ ID NO: 224842 - RNA, 22 nt, Shigella flexneri 2a str. 2457T
gaucgacgccguucgcgcugaa

SEQ ID NO: 224843 - RNA, 22 nt, Shigella flexneri 2a str. 2457T
accgggugauggcguugaccau

SEQ ID NO: 224844 - RNA, 22 nt, Shigella flexneri 2a str. 2457T
aucgcuggaagguuggcgcauu

SEQ ID NO: 224845 - RNA, 22 nt, Shigella flexneri 2a str. 2457T
auuguucacgcuugauccacac

SEQ ID NO: 224846 - RNA, 22 nt, Shigella flexneri 2a str. 2457T
gauagguguugucgucaucuuu

SEQ ID NO: 224847 - RNA, 22 nt, Shigella flexneri 2a str. 2457T
uccaucguggcggauuauugug

SEQ ID NO: 224848 - RNA, 21 nt, Shigella flexneri 2a str. 2457T
cggcagcaacuucaucacgga

SEQ ID NO: 224849 - RNA, 18 nt, Shigella flexneri 2a str. 2457T
aucggcauggcauucgcc

SEQ ID NO: 224850 - RNA, 22 nt, Shigella flexneri 2a str. 2457T
gcgugcugggcgacuggucgca

SEQ ID NO: 224851 - RNA, 22 nt, Shigella flexneri 2a str. 2457T
aucgccucuuccugaucguggg

SEQ ID NO: 224852 - RNA, 22 nt, Shigella flexneri 2a str. 2457T
gauagauuggauaagaaacgcg

SEQ ID NO: 224853 - RNA, 22 nt, Shigella flexneri 2a str. 2457T
uauuucugccccgcaggucugg

SEQ ID NO: 224854 - RNA, 22 nt, Shigella flexneri 2a str. 2457T
uugcaggcgcgacuggaagcgu

SEQ ID NO: 224855 - RNA, 22 nt, Shigella flexneri 2a str. 2457T
gaugcggcguaaaugccuuauc

SEQ ID NO: 224856 - RNA, 22 nt, Shigella flexneri 2a str. 2457T
aagucacugacaucguuacgau

SEQ ID NO: 224857 - RNA, 22 nt, Shigella flexneri 2a str. 2457T
gaccgcuuccgccagcgauuuu

SEQ ID NO: 224858 - RNA, 20 nt, Shigella flexneri 2a str. 2457T
ccgguaaacgacaguuugcg

SEQ ID NO: 224859 - RNA, 22 nt, Shigella flexneri 2a str. 2457T
agcggauaauaaaucaucgguu

SEQ ID NO: 224860 - RNA, 22 nt, Shigella flexneri 2a str. 2457T
uaucgucggguaugggcgcugc

SEQ ID NO: 224861 - RNA, 22 nt, Shigella flexneri 2a str. 2457T
ucccgguaaucgaugacgacga

SEQ ID NO: 224862 - RNA, 20 nt, Shigella flexneri 2a str. 2457T
guagcggguacggugcugug

SEQ ID NO: 224863 - RNA, 22 nt, Shigella flexneri 2a str. 2457T
uccggagccauuaaagucuguu

SEQ ID NO: 224864 - RNA, 22 nt, Shigella flexneri 2a str. 2457T
auggccuuucgcuugauuugau

SEQ ID NO: 224865 - RNA, 22 nt, Shigella flexneri 2a str. 2457T
aaccuguuuguuaccaggcugg

SEQ ID NO: 224866 - RNA, 23 nt, Shigella flexneri 2a str. 2457T
agccguaacccugcugcaucaga

SEQ ID NO: 224867 - RNA, 22 nt, Shigella flexneri 2a str. 2457T
auaaacugccuggugcgguucu

SEQ ID NO: 224868 - RNA, 22 nt, Shigella flexneri 2a str. 2457T
uuucaccgucggccaguauuug

SEQ ID NO: 224869 - RNA, 22 nt, Shigella flexneri 2a str. 2457T
cgcugcuggcaacccacgcgga

SEQ ID NO: 224870 - RNA, 22 nt, Shigella flexneri 2a str. 2457T
accaucugcggcauacuuucgc

SEQ ID NO: 224871 - RNA, 22 nt, Shigella flexneri 2a str. 2457T
uaucaggccuacagcaggcauu

SEQ ID NO: 224872 - RNA, 23 nt, Shigella flexneri 2a str. 2457T
gccauuccggauauugcagaccu

SEQ ID NO: 224873 - RNA, 22 nt, Shigella flexneri 2a str. 2457T
ugccggucuggucaucggcagu

SEQ ID NO: 224874 - RNA, 22 nt, Shigella flexneri 2a str. 2457T
ggcguggauguucgucaguuaa

SEQ ID NO: 224875 - RNA, 22 nt, Shigella flexneri 2a str. 2457T
gagaauguagaugccgcauugc

SEQ ID NO: 224876 - RNA, 22 nt, Shigella flexneri 2a str. 2457T
aacgacgaacgcaaacugaaug

SEQ ID NO: 224877 - RNA, 22 nt, Shigella flexneri 2a str. 2457T
ccggugcugaugggcguggcga

SEQ ID NO: 224878 - RNA, 23 nt, Shigella flexneri 2a str. 2457T
guuuacccaaugaagaugcgccg

SEQ ID NO: 224879 - RNA, 22 nt, Shigella flexneri 2a str. 2457T
ccgguaagaccaccacuuucua

SEQ ID NO: 224880 - RNA, 22 nt, Shigella flexneri 2a str. 2457T
ucaccguauucuggaaagcaug

SEQ ID NO: 224881 - RNA, 22 nt, Shigella flexneri 2a str. 2457T
aagcgguuugcgccaggugagc

SEQ ID NO: 224882 - RNA, 22 nt, Shigella flexneri 2a str. 2457T
aaugcaguagucgcagcggaag

SEQ ID NO: 224883 - RNA, 22 nt, Shigella flexneri 2a str. 2457T
auccggccuuugucgauaaaga

SEQ ID NO: 224884 - RNA, 22 nt, Shigella flexneri 2a str. 2457T
cuaugauuaugaggcgaaguau

SEQ ID NO: 224885 - RNA, 22 nt, Shigella flexneri 2a str. 2457T
ucaggcugagguugaucgcgcu

SEQ ID NO: 224886 - RNA, 22 nt, Shigella flexneri 2a str. 2457T
gaacgugugccagguaccauug

SEQ ID NO: 224887 - RNA, 22 nt, Shigella flexneri 2a str. 2457T
aaucuccagcucgcgcaguuca

SEQ ID NO: 224888 - RNA, 20 nt, Shigella flexneri 2a str. 2457T
gcgacgcaaucacaggucuu

SEQ ID NO: 224889 - RNA, 22 nt, Shigella flexneri 2a str. 2457T
agcgucagcguauugcuaucgc

SEQ ID NO: 224890 - RNA, 22 nt, Shigella flexneri 2a str. 2457T
augaguauuuagacuaaagagu

SEQ ID NO: 224891 - RNA, 22 nt, Shigella flexneri 2a str. 2457T
gacaggcagaacuugaugguau

SEQ ID NO: 224892 - RNA, 23 nt, Shigella flexneri 2a str. 2457T
gccuacuguuaggucaugccagc

SEQ ID NO: 224893 - RNA, 22 nt, Shigella flexneri 2a str. 2457T
aaggugguguuccugccggauu

SEQ ID NO: 224894 - RNA, 22 nt, Shigella flexneri 2a str. 2457T
aaauggguuauaccgaaccgga

SEQ ID NO: 224895 - RNA, 22 nt, Shigella flexneri 2a str. 2457T
cugccggacugaaaauugauga

SEQ ID NO: 224896 - RNA, 22 nt, Shigella flexneri 2a str. 2457T
uuggaagaauuuguaggccgga

SEQ ID NO: 224897 - RNA, 22 nt, Shigella flexneri 2a str. 2457T
aucuugcaauaaauauuucagu

SEQ ID NO: 224898 - RNA, 22 nt, Shigella flexneri 2a str. 2457T
ugugaccugcuggaagagaacu

SEQ ID NO: 224899 - RNA, 22 nt, Shigella flexneri 2a str. 2457T
gauaaggcguucacgcugcauc

SEQ ID NO: 224900 - RNA, 22 nt, Shigella flexneri 2a str. 2457T
guuccguuggcgauugcuuguc

SEQ ID NO: 224901 - RNA, 22 nt, Shigella flexneri 2a str. 2457T
cuaucgguggucgucgagcaac

SEQ ID NO: 224902 - RNA, 22 nt, Shigella flexneri 2a str. 2457T
cuuauggcucgccauccaguga

SEQ ID NO: 224903 - RNA, 22 nt, Shigella flexneri 2a str. 2457T
ccgaaggggcgaaaacuaaauc

SEQ ID NO: 224904 - RNA, 22 nt, Shigella flexneri 2a str. 2457T
caggccuacaagaugauugcaa

SEQ ID NO: 224905 - RNA, 22 nt, Shigella flexneri 2a str. 2457T
ucaggccuacacggagauugca

SEQ ID NO: 224906 - RNA, 22 nt, Shigella flexneri 2a str. 2457T
uauaucgacguuggugcgacgu

SEQ ID NO: 224907 - RNA, 22 nt, Shigella flexneri 2a str. 2457T
aaggccggugucauuugaugug

SEQ ID NO: 224908 - RNA, 22 nt, Shigella flexneri 2a str. 2457T
gguaaucugaucggugucccgc

SEQ ID NO: 224909 - RNA, 22 nt, Shigella flexneri 2a str. 2457T
aaucggucacuuaugauauugc

SEQ ID NO: 224910 - RNA, 19 nt, Shigella flexneri 2a str. 2457T
ucggugcuaaaucacguca

SEQ ID NO: 224911 - RNA, 22 nt, Shigella flexneri 2a str. 2457T
cggugaucaacauccacuuauc

SEQ ID NO: 224912 - RNA, 22 nt, Shigella flexneri 2a str. 2457T
acugucguggggaagaauuugc

SEQ ID NO: 224913 - RNA, 22 nt, Shigella flexneri 2a str. 2457T
ucugcguauuuaucuuuugcaa

SEQ ID NO: 224914 - RNA, 22 nt, Shigella flexneri 2a str. 2457T
caagccuuccauuacgcugacc

SEQ ID NO: 224915 - RNA, 22 nt, Shigella flexneri 2a str. 2457T
auugcaggaacgcuaucaccgu

SEQ ID NO: 224916 - RNA, 22 nt, Shigella flexneri 2a str. 2457T
cgaagcgagguugcugcggaaa

SEQ ID NO: 224917 - RNA, 22 nt, Shigella flexneri 2a str. 2457T
acugauguagccauauuauccc

SEQ ID NO: 224918 - RNA, 22 nt, Shigella flexneri 2a str. 2457T
caaagugugucgucggcauggu

SEQ ID NO: 224919 - RNA, 22 nt, Shigella flexneri 2a str. 2457T
aucaucaauucaaacugaguau

SEQ ID NO: 224920 - RNA, 22 nt, Shigella flexneri 2a str. 2457T
ugggugccgacacugcgugggu

SEQ ID NO: 224921 - RNA, 22 nt, Shigella flexneri 2a str. 2457T
uucaguaugcaguggauguacu

SEQ ID NO: 224922 - RNA, 22 nt, Shigella flexneri 2a str. 2457T
uccguuuauucuguugaucagg

SEQ ID NO: 224923 - RNA, 22 nt, Shigella flexneri 2a str. 2457T
guugugaaguaauacaaaacag

SEQ ID NO: 224924 - RNA, 17 nt, Shigella flexneri 2a str. 2457T
aagcggcgaugacuuaa

SEQ ID NO: 224925 - RNA, 22 nt, Shigella flexneri 2a str. 2457T
uugcaaugaacuguaggccgga

SEQ ID NO: 224926 - RNA, 22 nt, Shigella flexneri 2a str. 2457T
cugcgagcgaagaaagugauca

SEQ ID NO: 224927 - RNA, 22 nt, Shigella flexneri 2a str. 2457T
gagcagaucgaaaaaguggcga

SEQ ID NO: 224928 - RNA, 17 nt, Shigella flexneri 2a str. 2457T
cguugcaggcgcugaac

SEQ ID NO: 224929 - RNA, 22 nt, Shigella flexneri 2a str. 2457T
cacaggcgacgaaccguuucca

SEQ ID NO: 224930 - RNA, 22 nt, Shigella flexneri 2a str. 2457T
uaacggcagugaagauucgugg

SEQ ID NO: 224931 - RNA, 22 nt, Shigella flexneri 2a str. 2457T
cggcugaaccugcucugccagg

SEQ ID NO: 224932 - RNA, 22 nt, Shigella flexneri 2a str. 2457T
cgcggucuucguuggcguaggc

SEQ ID NO: 224933 - RNA, 22 nt, Shigella flexneri 2a str. 2457T
ugagucugcaucuggguuugca

SEQ ID NO: 224934 - RNA, 22 nt, Shigella flexneri 2a str. 2457T
cguaccagcagaaagccugcca

SEQ ID NO: 224935 - RNA, 22 nt, Shigella flexneri 2a str. 2457T
gccgacagaucguuaaccugca

SEQ ID NO: 224936 - RNA, 22 nt, Shigella flexneri 2a str. 2457T
ucgcuucgguuaaaaaaaggca

SEQ ID NO: 224937 - RNA, 22 nt, Shigella flexneri 2a str. 2457T
cguuccugcuccugcuccaucc

SEQ ID NO: 224938 - RNA, 22 nt, Shigella flexneri 2a str. 2457T
gacuucggucagggugucguuc

SEQ ID NO: 224939 - RNA, 22 nt, Shigella flexneri 2a str. 2457T
gugcugccgaauccguuuuauc

SEQ ID NO: 224940 - RNA, 22 nt, Shigella flexneri 2a str. 2457T
auuagcgacaacauucgugcca

SEQ ID NO: 224941 - RNA, 22 nt, Shigella flexneri 2a str. 2457T
gcucgccaagcagugggaagcg

SEQ ID NO: 224942 - RNA, 22 nt, Shigella flexneri 2a str. 2457T
gcauucugguugaugacucagu

SEQ ID NO: 224943 - RNA, 22 nt, Shigella flexneri 2a str. 2457T
gguucgaggccgagcauuuuca

SEQ ID NO: 224944 - RNA, 22 nt, Shigella flexneri 2a str. 2457T
uggacgcugauuuucugcgccc

SEQ ID NO: 224945 - RNA, 22 nt, Shigella flexneri 2a str. 2457T
cgugauaacuaucgucugguug

SEQ ID NO: 224946 - RNA, 22 nt, Shigella flexneri 2a str. 2457T
gcugccaggccucaaaguuaac

SEQ ID NO: 224947 - RNA, 22 nt, Shigella flexneri 2a str. 2457T
guuugcgcugaugugggcagua

SEQ ID NO: 224948 - RNA, 22 nt, Shigella flexneri 2a str. 2457T
ggaaguguuacagcgauugcga

SEQ ID NO: 224949 - RNA, 22 nt, Shigella flexneri 2a str. 2457T
aacuggaagaacuggcgacgcg

SEQ ID NO: 224950 - RNA, 22 nt, Shigella flexneri 2a str. 2457T
acuuugcgauccgccucgcgcc

SEQ ID NO: 224951 - RNA, 22 nt, Shigella flexneri 2a str. 2457T
gccuguccgacaugagagagca

SEQ ID NO: 224952 - RNA, 22 nt, Shigella flexneri 2a str. 2457T
ccggaagacgaacuugccagcg

SEQ ID NO: 224953 - RNA, 22 nt, Shigella flexneri 2a str. 2457T
uagcugaaauggcaucgcgugc

SEQ ID NO: 224954 - RNA, 22 nt, Shigella flexneri 2a str. 2457T
gaugucuguuugguuucaggcg

SEQ ID NO: 224955 - RNA, 22 nt, Shigella flexneri 2a str. 2457T
cgggugcaguaauaucgcccug

SEQ ID NO: 224956 - RNA, 22 nt, Shigella flexneri 2a str. 2457T
ucaccugaucgucgccguacug

SEQ ID NO: 224957 - RNA, 22 nt, Shigella flexneri 2a str. 2457T
ggaaguccccgucaccaucgca

SEQ ID NO: 224958 - RNA, 22 nt, Shigella flexneri 2a str. 2457T
ugauaucacugucaaugcgacc

SEQ ID NO: 224959 - RNA, 22 nt, Shigella flexneri 2a str. 2457T
cgcguucuuuaagccauggcga

SEQ ID NO: 224960 - RNA, 22 nt, Shigella flexneri 2a str. 2457T
uuacgugaucgccuugcucaau

SEQ ID NO: 224961 - RNA, 22 nt, Shigella flexneri 2a str. 2457T
cguagcgucugauuagcggaaa

SEQ ID NO: 224962 - RNA, 22 nt, Shigella flexneri 2a str. 2457T
uugcagggacuauguaggccug

SEQ ID NO: 224963 - RNA, 22 nt, Shigella flexneri 2a str. 2457T
gaaacuuugucgcguggaccca

SEQ ID NO: 224964 - RNA, 23 nt, Shigella flexneri 2a str. 2457T
ucaccgguauuugaggcuguuuc

SEQ ID NO: 224965 - RNA, 22 nt, Shigella flexneri 2a str. 2457T
uugguaucguugggcugguguu

SEQ ID NO: 224966 - RNA, 22 nt, Shigella flexneri 2a str. 2457T
acgcacguuuugcacgccaguu

SEQ ID NO: 224967 - RNA, 22 nt, Shigella flexneri 2a str. 2457T
accuggucuuuuccaucuugcg

SEQ ID NO: 224968 - RNA, 20 nt, Shigella flexneri 2a str. 2457T
cgugccacaucaacgaucuc

SEQ ID NO: 224969 - RNA, 22 nt, Shigella flexneri 2a str. 2457T
ugaugggcaaggcuuccugugg

SEQ ID NO: 224970 - RNA, 23 nt, Shigella flexneri 2a str. 2457T
gcguuauagccgccaaauucugc

SEQ ID NO: 224971 - RNA, 19 nt, Shigella flexneri 2a str. 2457T
gcgaacacuucaucuuuac

SEQ ID NO: 224972 - RNA, 22 nt, Shigella flexneri 2a str. 2457T
agagccugcauuacuuucuggc

SEQ ID NO: 224973 - RNA, 22 nt, Shigella flexneri 2a str. 2457T
uugaugauaucgaucucaaccu

SEQ ID NO: 224974 - RNA, 22 nt, Shigella flexneri 2a str. 2457T
aaaggccaucaucgcagucaua

SEQ ID NO: 224975 - RNA, 22 nt, Shigella flexneri 2a str. 2457T
acuaugugacccaucaacacgc

SEQ ID NO: 224976 - RNA, 19 nt, Shigella flexneri 2a str. 2457T
auucgcuuaaaaccgcguu

SEQ ID NO: 224977 - RNA, 22 nt, Shigella flexneri 2a str. 2457T
ggcgaccugaugagccguccga

SEQ ID NO: 224978 - RNA, 19 nt, Shigella flexneri 2a str. 2457T
uaucuggccuacaaagggc

SEQ ID NO: 224979 - RNA, 22 nt, Shigella flexneri 2a str. 2457T
gggagucauugcaucgucaacu

SEQ ID NO: 224980 - RNA, 22 nt, Shigella flexneri 2a str. 2457T
gcggaaauacucgccacggaac

SEQ ID NO: 224981 - RNA, 22 nt, Shigella flexneri 2a str. 2457T
ugucgaauaugauuaucggcgc

SEQ ID NO: 224982 - RNA, 22 nt, Shigella flexneri 2a str. 2457T
guguuaaaugcucauuguuugc

SEQ ID NO: 224983 - RNA, 22 nt, Shigella flexneri 2a str. 2457T
uacgugcguucggaaaugcagg

SEQ ID NO: 224984 - RNA, 22 nt, Shigella flexneri 2a str. 2457T
ucugccaucaaauaugcccgcg

SEQ ID NO: 224985 - RNA, 22 nt, Shigella flexneri 2a str. 2457T
cuggagccuguugggugacacg

SEQ ID NO: 224986 - RNA, 22 nt, Shigella flexneri 2a str. 2457T
ugcaugugggugaagcgccaaa

SEQ ID NO: 224987 - RNA, 22 nt, Shigella flexneri 2a str. 2457T
cgcguugaaaucugccgacgua

SEQ ID NO: 224988 - RNA, 22 nt, Shigella flexneri 2a str. 2457T
ccgcugguuauuguuauugccg

SEQ ID NO: 224989 - RNA, 22 nt, Shigella flexneri 2a str. 2457T
guucgauucaccgauaugcauc

SEQ ID NO: 224990 - RNA, 22 nt, Shigella flexneri 2a str. 2457T
gaugcgaagcagggcggcgguu

SEQ ID NO: 224991 - RNA, 22 nt, Shigella flexneri 2a str. 2457T
auugauguguauucuugcaguu

SEQ ID NO: 224992 - RNA, 22 nt, Shigella flexneri 2a str. 2457T
gcuggaaagcaccugcgcggcg

SEQ ID NO: 224993 - RNA, 22 nt, Shigella flexneri 2a str. 2457T
ccaguaaucaagacaguaccag

SEQ ID NO: 224994 - RNA, 19 nt, Shigella flexneri 2a str. 2457T
cagccugucaggucugggc

SEQ ID NO: 224995 - RNA, 22 nt, Shigella flexneri 2a str. 2457T
acgcgaaguauauuuguucggc

SEQ ID NO: 224996 - RNA, 22 nt, Shigella flexneri 2a str. 2457T
uagccggugaacuugcgccagu

SEQ ID NO: 224997 - RNA, 22 nt, Shigella flexneri 2a str. 2457T
cauaagagauggaaugagcauc

SEQ ID NO: 224998 - RNA, 22 nt, Shigella flexneri 2a str. 2457T
gcguacaccaucaacauugaaa

SEQ ID NO: 224999 - RNA, 22 nt, Shigella flexneri 2a str. 2457T
ugacugcguaauacagcccguc

SEQ ID NO: 225000 - RNA, 22 nt, Shigella flexneri 2a str. 2457T
cgcguuaacuggaaccggguga

SEQ ID NO: 225001 - RNA, 18 nt, Shigella flexneri 2a str. 2457T
gucuugccauugaccugg

SEQ ID NO: 225002 - RNA, 22 nt, Shigella flexneri 2a str. 2457T
gcaacucucuacuguuucucca

SEQ ID NO: 225003 - RNA, 22 nt, Shigella flexneri 2a str. 2457T
uugcucauauugaaguugacgc

SEQ ID NO: 225004 - RNA, 22 nt, Shigella flexneri 2a str. 2457T
acgcagacgcuguuccaguucg

SEQ ID NO: 225005 - RNA, 22 nt, Shigella flexneri 2a str. 2457T
ccacguagucuuuaccgcuguc

SEQ ID NO: 225006 - RNA, 22 nt, Shigella flexneri 2a str. 2457T
gcugaccguugauauuguugcc

SEQ ID NO: 225007 - RNA, 22 nt, Shigella flexneri 2a str. 2457T
gugagcagugcaguggugcucu

SEQ ID NO: 225008 - RNA, 22 nt, Shigella flexneri 2a str. 2457T
gcacauaacucauacugagcaa

SEQ ID NO: 225009 - RNA, 22 nt, Shigella flexneri 2a str. 2457T
aacgccuuauccggccuacaaa

SEQ ID NO: 225010 - RNA, 22 nt, Shigella flexneri 2a str. 2457T
ugcguuaacgcauauguucccg

SEQ ID NO: 225011 - RNA, 22 nt, Shigella flexneri 2a str. 2457T
uuacugcgucagggaaaaccag

SEQ ID NO: 225012 - RNA, 22 nt, Shigella flexneri 2a str. 2457T
auuggcaucugguacaacaauu

SEQ ID NO: 225013 - RNA, 22 nt, Shigella flexneri 2a str. 2457T
gcugacgcaaauugguuauguu

SEQ ID NO: 225014 - RNA, 20 nt, Shigella flexneri 2a str. 2457T
gcaauggcagcgaaagggga

SEQ ID NO: 225015 - RNA, 22 nt, Shigella flexneri 2a str. 2457T
ucaccgccucucgcguggcagg

SEQ ID NO: 225016 - RNA, 21 nt, Shigella flexneri 2a str. 2457T
uauuccggccuguucaauaug

SEQ ID NO: 225017 - RNA, 22 nt, Shigella flexneri 2a str. 2457T
cacgcucaauaucggcaucuuc

SEQ ID NO: 225018 - RNA, 21 nt, Shigella flexneri 2a str. 2457T
ucgguggcugaccaguuuggu

SEQ ID NO: 225019 - RNA, 22 nt, Shigella flexneri 2a str. 2457T
gcgucaugcagucacgguugaa

SEQ ID NO: 225020 - RNA, 22 nt, Shigella flexneri 2a str. 2457T
ggcugguagaacgcgccaauca

SEQ ID NO: 225021 - RNA, 19 nt, Shigella flexneri 2a str. 2457T
gccguuugcgucaguuuuu

SEQ ID NO: 225022 - RNA, 22 nt, Shigella flexneri 2a str. 2457T
ggaguacaucgugcgcggcagu

SEQ ID NO: 225023 - RNA, 22 nt, Shigella flexneri 2a str. 2457T
uagcgucaggcgcauugccugc

SEQ ID NO: 225024 - RNA, 22 nt, Shigella flexneri 2a str. 2457T
uggcucucccccauuuacggau

SEQ ID NO: 225025 - RNA, 22 nt, Shigella flexneri 2a str. 2457T
uauucucguuccgcgcaacacg

SEQ ID NO: 225026 - RNA, 22 nt, Shigella flexneri 2a str. 2457T
cgguacgccggacgauuugaaa

SEQ ID NO: 225027 - RNA, 22 nt, Shigella flexneri 2a str. 2457T
ucacugcgaucugaaagacaac

SEQ ID NO: 225028 - RNA, 22 nt, Shigella flexneri 2a str. 2457T
gcgucuuaucuggccuacgaag

SEQ ID NO: 225029 - RNA, 22 nt, Shigella flexneri 2a str. 2457T
gucgagaaaacgggauagcacc

SEQ ID NO: 225030 - RNA, 22 nt, Shigella flexneri 2a str. 2457T
caggucgauaaauauaccuggc

SEQ ID NO: 225031 - RNA, 22 nt, Shigella flexneri 2a str. 2457T
cgcggaugguauggcuguuggu

SEQ ID NO: 225032 - RNA, 18 nt, Shigella flexneri 2a str. 2457T
ugcacacgauaaacaggc

SEQ ID NO: 225033 - RNA, 22 nt, Shigella flexneri 2a str. 2457T
uuguaggccggauaaggcguuu

SEQ ID NO: 225034 - RNA, 22 nt, Shigella flexneri 2a str. 2457T
ucccagguaguggucagcggcu

SEQ ID NO: 225035 - RNA, 22 nt, Shigella flexneri 2a str. 2457T
gauugcgggugaaaaacugacg

SEQ ID NO: 225036 - RNA, 22 nt, Shigella flexneri 2a str. 2457T
cgaaaccguugagcgacagcaa

SEQ ID NO: 225037 - RNA, 21 nt, Shigella flexneri 2a str. 2457T
ucgucugguguucgaucugca

SEQ ID NO: 225038 - RNA, 22 nt, Shigella flexneri 2a str. 2457T
agcggcuuuccggcgagguggc

SEQ ID NO: 225039 - RNA, 22 nt, Shigella flexneri 2a str. 2457T
uugccgagugcgaccgugacag

SEQ ID NO: 225040 - RNA, 22 nt, Shigella flexneri 2a str. 2457T
ugucguuaucaauugcuccggu

SEQ ID NO: 225041 - RNA, 22 nt, Shigella flexneri 2a str. 2457T
cagauugauuaucaacuggaug

SEQ ID NO: 225042 - RNA, 22 nt, Shigella flexneri 2a str. 2457T
agucgcgauagugcuuuuucag

SEQ ID NO: 225043 - RNA, 22 nt, Shigella flexneri 2a str. 2457T
agcgcugggccugucgcagccg

SEQ ID NO: 225044 - RNA, 22 nt, Shigella flexneri 2a str. 2457T
agcaacugacgcuucggauccc

SEQ ID NO: 225045 - RNA, 22 nt, Shigella flexneri 2a str. 2457T
acggccauuuuaugugcuaugu

SEQ ID NO: 225046 - RNA, 22 nt, Shigella flexneri 2a str. 2457T
uugcuuaauuugcggcuuccug

SEQ ID NO: 225047 - RNA, 22 nt, Shigella flexneri 2a str. 2457T
ugccaggcccaacccuuucaua

SEQ ID NO: 225048 - RNA, 22 nt, Shigella flexneri 2a str. 2457T
auccggcauauuaguuuacgcc

SEQ ID NO: 225049 - RNA, 22 nt, Shigella flexneri 2a str. 2457T
ugcaccuuuaacagguuagcuc

SEQ ID NO: 225050 - RNA, 22 nt, Shigella flexneri 2a str. 2457T
cuugaaguaugacgaguauagc

SEQ ID NO: 225051 - RNA, 22 nt, Shigella flexneri 2a str. 2457T
cgauuaucgaucuggcgcugca

SEQ ID NO: 225052 - RNA, 22 nt, Shigella flexneri 2a str. 2457T
gcguaucaucaacccgaugcgc

SEQ ID NO: 225053 - RNA, 22 nt, Shigella flexneri 2a str. 2457T
caggccuacaucgugcauugaa

SEQ ID NO: 225054 - RNA, 22 nt, Shigella flexneri 2a str. 2457T
gauggcggugguucuguucguc

SEQ ID NO: 225055 - RNA, 22 nt, Shigella flexneri 2a str. 2457T
cacggcugagagcaccaccaga

SEQ ID NO: 225056 - RNA, 22 nt, Shigella flexneri 2a str. 2457T
acaacggagaacaguauccugu

SEQ ID NO: 225057 - RNA, 22 nt, Shigella flexneri 2a str. 2457T
ucauaaugggaguuuugauacu

SEQ ID NO: 225058 - RNA, 19 nt, Shigella flexneri 2a str. 2457T
caauagugaagaacggcug

SEQ ID NO: 225059 - RNA, 22 nt, Shigella flexneri 2a str. 2457T
auacgucacuucaacuaugcug

SEQ ID NO: 225060 - RNA, 22 nt, Shigella flexneri 2a str. 2457T
cugugcgccaaauccacugacc

SEQ ID NO: 225061 - RNA, 22 nt, Shigella flexneri 2a str. 2457T
cugcgucauuccggaguuuaug

SEQ ID NO: 225062 - RNA, 19 nt, Shigella flexneri 2a str. 2457T
auucugccguaugaccagu

SEQ ID NO: 225063 - RNA, 22 nt, Shigella flexneri 2a str. 2457T
cggcaauuucacacaccaguug

SEQ ID NO: 225064 - RNA, 22 nt, Shigella flexneri 2a str. 2457T
auuccaggagugaguauucagg

SEQ ID NO: 225065 - RNA, 22 nt, Shigella flexneri 2a str. 2457T
cggcggauuuauuacugcaucc

SEQ ID NO: 225066 - RNA, 22 nt, Shigella flexneri 2a str. 2457T
ugaauacuuacuggcgacgucg

SEQ ID NO: 225067 - RNA, 22 nt, Shigella flexneri 2a str. 2457T
gacaccugacgauacuguguug

SEQ ID NO: 225068 - RNA, 22 nt, Shigella flexneri 2a str. 2457T
cagaaguaaucccucauucccg

SEQ ID NO: 225069 - RNA, 22 nt, Shigella flexneri 2a str. 2457T
cggucgugcaacaccggcuguc

SEQ ID NO: 225070 - RNA, 22 nt, Shigella flexneri 2a str. 2457T
aaauacgguuuaugaaaauagg

SEQ ID NO: 225071 - RNA, 20 nt, Shigella flexneri 2a str. 2457T
uugucaagcauucagcuuga

SEQ ID NO: 225072 - RNA, 22 nt, Shigella flexneri 2a str. 2457T
caaauaggccaguugaugcuuu

SEQ ID NO: 225073 - RNA, 19 nt, Shigella flexneri 2a str. 2457T
ccaugcucguucuucugcu

SEQ ID NO: 225074 - RNA, 22 nt, Shigella flexneri 2a str. 2457T
aucacucaucaauaaauauuau

SEQ ID NO: 225075 - RNA, 22 nt, Shigella flexneri 2a str. 2457T
aggcuuuccgccugccgauaac

SEQ ID NO: 225076 - RNA, 22 nt, Shigella flexneri 2a str. 2457T
aggccguugcuguuggucaagc

SEQ ID NO: 225077 - RNA, 22 nt, Shigella flexneri 2a str. 2457T
cagucauuugcuggcuuuuacu

SEQ ID NO: 225078 - RNA, 19 nt, Shigella flexneri 2a str. 2457T
gucaggcuuccuugcgguc

SEQ ID NO: 225079 - RNA, 19 nt, Shigella flexneri 2a str. 2457T
ggcaaauccacauuguuga

SEQ ID NO: 225080 - RNA, 22 nt, Shigella flexneri 2a str. 2457T
caucaggcaauguugcguuugu

SEQ ID NO: 225081 - RNA, 22 nt, Shigella flexneri 2a str. 2457T
ucgauaccuugugcacgcaguu

SEQ ID NO: 225082 - RNA, 22 nt, Shigella flexneri 2a str. 2457T
gcguugauacuauguauggggu

SEQ ID NO: 225083 - RNA, 22 nt, Shigella flexneri 2a str. 2457T
ucacugaugagccagguucugg

SEQ ID NO: 225084 - RNA, 22 nt, Shigella flexneri 2a str. 2457T
ugcacgcugggugagaaacugc

SEQ ID NO: 225085 - RNA, 22 nt, Shigella flexneri 2a str. 2457T
uggcggcaaucggugcugcgau

SEQ ID NO: 225086 - RNA, 22 nt, Shigella flexneri 2a str. 2457T
cguuuacagauggguaaugugu

SEQ ID NO: 225087 - RNA, 22 nt, Shigella flexneri 2a str. 2457T
aggcgcauuuccgguauccaua

SEQ ID NO: 225088 - RNA, 22 nt, Shigella flexneri 2a str. 2457T
uugcacgaacuuguaggccgga

SEQ ID NO: 225089 - RNA, 22 nt, Shigella flexneri 2a str. 2457T
ucuggcgcauuccgggcugucu

SEQ ID NO: 225090 - RNA, 19 nt, Shigella flexneri 2a str. 2457T
aaucagaacguggaagaac

SEQ ID NO: 225091 - RNA, 22 nt, Shigella flexneri 2a str. 2457T
ugaucaacagaauaaacggaag

SEQ ID NO: 225092 - RNA, 22 nt, Shigella flexneri 2a str. 2457T
gaucaugaaaaaacuguccggu

SEQ ID NO: 225093 - RNA, 22 nt, Shigella flexneri 2a str. 2457T
gcaggcugguaucgaacgguuu

SEQ ID NO: 225094 - RNA, 22 nt, Shigella flexneri 2a str. 2457T
ugaccauuggugcaauauaccu

SEQ ID NO: 225095 - RNA, 22 nt, Shigella flexneri 2a str. 2457T
augugugcguuaccacuacuga

SEQ ID NO: 225096 - RNA, 20 nt, Shigella flexneri 2a str. 2457T
agcggcguugaugaugccgg

SEQ ID NO: 225097 - RNA, 22 nt, Shigella flexneri 2a str. 2457T
cagccgguaagccugcuuuuca

SEQ ID NO: 225098 - RNA, 22 nt, Shigella flexneri 2a str. 2457T
ucggaaggcuguaaucaccgcu

SEQ ID NO: 225099 - RNA, 22 nt, Shigella flexneri 2a str. 2457T
gauucgcaugaugccgauggaa

SEQ ID NO: 225100 - RNA, 22 nt, Shigella flexneri 2a str. 2457T
gcaggcgagugaaacauagaga

SEQ ID NO: 225101 - RNA, 22 nt, Shigella flexneri 2a str. 2457T
gcuggcguucgcuuaguugaug

SEQ ID NO: 225102 - RNA, 22 nt, Shigella flexneri 2a str. 2457T
ucugauauaaaauugaacauug

SEQ ID NO: 225103 - RNA, 22 nt, Shigella flexneri 2a str. 2457T
uauggcaccaacgcguuacugg

SEQ ID NO: 225104 - RNA, 23 nt, Shigella flexneri 2a str. 2457T
gugauagcccgauucugauucug

SEQ ID NO: 225105 - RNA, 22 nt, Shigella flexneri 2a str. 2457T
uagucauucacaccgaccugaa

SEQ ID NO: 225106 - RNA, 22 nt, Shigella flexneri 2a str. 2457T
ucgcgccugacgauuauucgua

SEQ ID NO: 225107 - RNA, 22 nt, Shigella flexneri 2a str. 2457T
ugcaggucuugucuaaaagcga

SEQ ID NO: 225108 - RNA, 23 nt, Shigella flexneri 2a str. 2457T
gcuggucaacgaagguuacuaug

SEQ ID NO: 225109 - RNA, 22 nt, Shigella flexneri 2a str. 2457T
aaucgguagcaguuguuugcuc

SEQ ID NO: 225110 - RNA, 22 nt, Shigella flexneri 2a str. 2457T
aguuacacgcccguauccgcgc

SEQ ID NO: 225111 - RNA, 22 nt, Shigella flexneri 2a str. 2457T
gccggacaaagacgaucugcug

SEQ ID NO: 225112 - RNA, 22 nt, Shigella flexneri 2a str. 2457T
cauucgcugcugcuuugcuucc

SEQ ID NO: 225113 - RNA, 22 nt, Shigella flexneri 2a str. 2457T
uaaauggugggagugcgcuucc

SEQ ID NO: 225114 - RNA, 20 nt, Shigella flexneri 2a str. 2457T
ugccgugggacaguuugcug

SEQ ID NO: 225115 - RNA, 22 nt, Shigella flexneri 2a str. 2457T
gguagcuuaugcccuugcacca

SEQ ID NO: 225116 - RNA, 22 nt, Shigella flexneri 2a str. 2457T
cugggcuaacgccgaugaaagc

SEQ ID NO: 225117 - RNA, 20 nt, Shigella flexneri 2a str. 2457T
ugaacuggaucucaucggua

SEQ ID NO: 225118 - RNA, 23 nt, Shigella flexneri 2a str. 2457T
acccaucgacggacgcgcggcga

SEQ ID NO: 225119 - RNA, 22 nt, Shigella flexneri 2a str. 2457T
ucuggaguaguguagucaaugg

SEQ ID NO: 225120 - RNA, 22 nt, Shigella flexneri 2a str. 2457T
ugguaaugacaagccgcgucuc

SEQ ID NO: 225121 - RNA, 22 nt, Shigella flexneri 2a str. 2457T
agcuguaauuucccgcguuugu

SEQ ID NO: 225122 - RNA, 22 nt, Shigella flexneri 2a str. 2457T
ucacguuaucgcccaguucaac

SEQ ID NO: 225123 - RNA, 22 nt, Shigella flexneri 2a str. 2457T
ugcgcuuuguuuaugucggaug

SEQ ID NO: 225124 - RNA, 22 nt, Shigella flexneri 2a str. 2457T
aacggcgaugaagugucgauca

SEQ ID NO: 225125 - RNA, 22 nt, Shigella flexneri 2a str. 2457T
cgaggccuguaugcucggcggg

SEQ ID NO: 225126 - RNA, 22 nt, Shigella flexneri 2a str. 2457T
caaggcauggaagggagcguua

SEQ ID NO: 225127 - RNA, 22 nt, Shigella flexneri 2a str. 2457T
gcgucuggaagaagaacgccgu

SEQ ID NO: 225128 - RNA, 22 nt, Shigella flexneri 2a str. 2457T
gacgcgguuuaaccgacgcgga

SEQ ID NO: 225129 - RNA, 22 nt, Shigella flexneri 2a str. 2457T
cuguugcaggaaggcuucaucg

SEQ ID NO: 225130 - RNA, 22 nt, Shigella flexneri 2a str. 2457T
uauuggccccgauaauggaaca

SEQ ID NO: 225131 - RNA, 22 nt, Shigella flexneri 2a str. 2457T
uccgcgaccguggcagguuggg

SEQ ID NO: 225132 - RNA, 22 nt, Shigella flexneri 2a str. 2457T
ugcacgguaaauucgccaggac

SEQ ID NO: 225133 - RNA, 22 nt, Shigella flexneri 2a str. 2457T
ugaaccgguuguacggccugaa

SEQ ID NO: 225134 - RNA, 22 nt, Shigella flexneri 2a str. 2457T
gcgucuuaucaggccuacgaag

SEQ ID NO: 225135 - RNA, 22 nt, Shigella flexneri 2a str. 2457T
accggaaagaauaugcgccagc

SEQ ID NO: 225136 - RNA, 22 nt, Shigella flexneri 2a str. 2457T
gcuuugcggccuucaggcagaa

SEQ ID NO: 225137 - RNA, 23 nt, Shigella flexneri 2a str. 2457T
uuguuaccggcgcgaugcauacc

SEQ ID NO: 225138 - RNA, 22 nt, Shigella flexneri 2a str. 2457T
gaucccggcggcggauaucucc

SEQ ID NO: 225139 - RNA, 22 nt, Shigella flexneri 2a str. 2457T
gugggcacaaaaaauggcguug

SEQ ID NO: 225140 - RNA, 23 nt, Shigella flexneri 2a str. 2457T
gacauuacaggguuugcgucagc

SEQ ID NO: 225141 - RNA, 22 nt, Shigella flexneri 2a str. 2457T
agguggcaaaauuugggacaaa

SEQ ID NO: 225142 - RNA, 22 nt, Shigella flexneri 2a str. 2457T
ccgauaucacgcacuuuuccca

SEQ ID NO: 225143 - RNA, 22 nt, Shigella flexneri 2a str. 2457T
aguagccagggcaaucagcagg

SEQ ID NO: 225144 - RNA, 22 nt, Shigella flexneri 2a str. 2457T
acguggacguagcggaauaucg

SEQ ID NO: 225145 - RNA, 22 nt, Shigella flexneri 2a str. 2457T
uacucaaacauuagcugggccu

SEQ ID NO: 225146 - RNA, 22 nt, Shigella flexneri 2a str. 2457T
gaaaugaccagcguuaccggua

SEQ ID NO: 225147 - RNA, 20 nt, Shigella flexneri 2a str. 2457T
uggcagcauauuguguucac

SEQ ID NO: 225148 - RNA, 22 nt, Shigella flexneri 2a str. 2457T
cgcaucgugguguggguuaucg

SEQ ID NO: 225149 - RNA, 22 nt, Shigella flexneri 2a str. 2457T
gucgccugaaguugaggaggau

SEQ ID NO: 225150 - RNA, 22 nt, Shigella flexneri 2a str. 2457T
aucggauggucgaacggcggca

SEQ ID NO: 225151 - RNA, 22 nt, Shigella flexneri 2a str. 2457T
gacuggaaacccgugccaugcu

SEQ ID NO: 225152 - RNA, 22 nt, Shigella flexneri 2a str. 2457T
ucgugauguucgcacuggaccc

SEQ ID NO: 225153 - RNA, 22 nt, Shigella flexneri 2a str. 2457T
accgucaggguacggaauguac

SEQ ID NO: 225154 - RNA, 22 nt, Shigella flexneri 2a str. 2457T
gccguuuauuuguuguaacucg

SEQ ID NO: 225155 - RNA, 22 nt, Shigella flexneri 2a str. 2457T
uuaucggcaggcggaaagccuu

SEQ ID NO: 225156 - RNA, 22 nt, Shigella flexneri 2a str. 2457T
guuugaucagaauacgaucguu

SEQ ID NO: 225157 - RNA, 22 nt, Shigella flexneri 2a str. 2457T
ggcagugaauuucuacguuauu

SEQ ID NO: 225158 - RNA, 22 nt, Shigella flexneri 2a str. 2457T
uaggccggauaaggcguuuacg

SEQ ID NO: 225159 - RNA, 22 nt, Shigella flexneri 2a str. 2457T
uugugccgauaacgccagcuuc

SEQ ID NO: 225160 - RNA, 22 nt, Shigella flexneri 2a str. 2457T
guggauacaguaucugcugagc

SEQ ID NO: 225161 - RNA, 22 nt, Shigella flexneri 2a str. 2457T
agugaucaggacgauauuuggu

SEQ ID NO: 225162 - RNA, 22 nt, Shigella flexneri 2a str. 2457T
uuacuguacgauuucagucaaa

SEQ ID NO: 225163 - RNA, 18 nt, Shigella flexneri 2a str. 2457T
gugaauggaaaaugcugg

SEQ ID NO: 225164 - RNA, 22 nt, Shigella flexneri 2a str. 2457T
auaggucagugacacauuauga

SEQ ID NO: 225165 - RNA, 22 nt, Shigella flexneri 2a str. 2457T
agcaucgcucaucaugaugucg

SEQ ID NO: 225166 - RNA, 22 nt, Shigella flexneri 2a str. 2457T
gcgcacuugaaucgcgggauug

SEQ ID NO: 225167 - RNA, 22 nt, Shigella flexneri 2a str. 2457T
aaccggauacaucuuguuccau

SEQ ID NO: 225168 - RNA, 22 nt, Shigella flexneri 2a str. 2457T
aucggcguggcggucaugauca

SEQ ID NO: 225169 - RNA, 22 nt, Shigella flexneri 2a str. 2457T
gccguuggcaccaacaccauug

SEQ ID NO: 225170 - RNA, 18 nt, Shigella flexneri 2a str. 2457T
uguacggugucagcccag

SEQ ID NO: 225171 - RNA, 22 nt, Shigella flexneri 2a str. 2457T
ccucgcugaucccaggacuucu

SEQ ID NO: 225172 - RNA, 23 nt, Shigella flexneri 2a str. 2457T
uaccgcuaucagcgucgccgcag

SEQ ID NO: 225173 - RNA, 22 nt, Shigella flexneri 2a str. 2457T
aguacacgcaucccgcccacca

SEQ ID NO: 225174 - RNA, 22 nt, Shigella flexneri 2a str. 2457T
gcauaagaagcuuucauuucag

SEQ ID NO: 225175 - RNA, 23 nt, Shigella flexneri 2a str. 2457T
ccagcuauuugauguccgaucug

SEQ ID NO: 225176 - RNA, 22 nt, Shigella flexneri 2a str. 2457T
uaaccgugauagaagaugccgg

SEQ ID NO: 225177 - RNA, 22 nt, Shigella flexneri 2a str. 2457T
aguuaacguuagcgaaugaagu

SEQ ID NO: 225178 - RNA, 22 nt, Shigella flexneri 2a str. 2457T
gcuauaccuuacgcucuggcag

SEQ ID NO: 225179 - RNA, 22 nt, Shigella flexneri 2a str. 2457T
uuugccagccgguuuucaccca

SEQ ID NO: 225180 - RNA, 22 nt, Shigella flexneri 2a str. 2457T
ccaguaauagcgcguugauccc

SEQ ID NO: 225181 - RNA, 22 nt, Shigella flexneri 2a str. 2457T
aucguuugugaccacagucagu

SEQ ID NO: 225182 - RNA, 21 nt, Shigella flexneri 2a str. 2457T
gauagucgaggaucugccguu

SEQ ID NO: 225183 - RNA, 22 nt, Shigella flexneri 2a str. 2457T
agugaccgggguggagaaacgc

SEQ ID NO: 225184 - RNA, 22 nt, Shigella flexneri 2a str. 2457T
gugcgcuguauauuaccuuuau

SEQ ID NO: 225185 - RNA, 22 nt, Shigella flexneri 2a str. 2457T
aucgcgggccugucgguggcga

SEQ ID NO: 225186 - RNA, 22 nt, Shigella flexneri 2a str. 2457T
caggcgguagcagcgaccauuc

SEQ ID NO: 225187 - RNA, 22 nt, Shigella flexneri 2a str. 2457T
cgucgccaauguucagcggcuc

SEQ ID NO: 225188 - RNA, 22 nt, Shigella flexneri 2a str. 2457T
aaagcgcauuuguagccagggc

SEQ ID NO: 225189 - RNA, 22 nt, Shigella flexneri 2a str. 2457T
aucugguaucgacgcagguaug

SEQ ID NO: 225190 - RNA, 22 nt, Shigella flexneri 2a str. 2457T
ugauugauccuugcgcgcggca

SEQ ID NO: 225191 - RNA, 22 nt, Shigella flexneri 2a str. 2457T
acucaauugcucuggagacauu

SEQ ID NO: 225192 - RNA, 22 nt, Shigella flexneri 2a str. 2457T
ugcaagauuuuguaggccugag

SEQ ID NO: 225193 - RNA, 22 nt, Shigella flexneri 2a str. 2457T
ggccgguaaaucuucacucugu

SEQ ID NO: 225194 - RNA, 22 nt, Shigella flexneri 2a str. 2457T
cuggagauuaugcguaaagcca

SEQ ID NO: 225195 - RNA, 22 nt, Shigella flexneri 2a str. 2457T
uucuguacagcacgcuucauag

SEQ ID NO: 225196 - RNA, 22 nt, Shigella flexneri 2a str. 2457T
ugguaagcgcggcaugacguau

SEQ ID NO: 225197 - RNA, 22 nt, Shigella flexneri 2a str. 2457T
gaugcgacgcuggcgcgucuua

SEQ ID NO: 225198 - RNA, 22 nt, Shigella flexneri 2a str. 2457T
agggucgguugugcaguugcau

SEQ ID NO: 225199 - RNA, 22 nt, Shigella flexneri 2a str. 2457T
caguguuucggucugauaugga

SEQ ID NO: 225200 - RNA, 22 nt, Shigella flexneri 2a str. 2457T
agcaggccacaguuccgguggu

SEQ ID NO: 225201 - RNA, 22 nt, Shigella flexneri 2a str. 2457T
cuacgcauacaaccagagcaag

SEQ ID NO: 225202 - RNA, 22 nt, Shigella flexneri 2a str. 2457T
uugcccgcuuacugauuauugg

SEQ ID NO: 225203 - RNA, 22 nt, Shigella flexneri 2a str. 2457T
gguucguaguugcucugaacuu

SEQ ID NO: 225204 - RNA, 22 nt, Shigella flexneri 2a str. 2457T
gcgaguauccagauuagugacc

SEQ ID NO: 225205 - RNA, 22 nt, Shigella flexneri 2a str. 2457T
aaugguuuacccaugcagguag

SEQ ID NO: 225206 - RNA, 22 nt, Shigella flexneri 2a str. 2457T
uauacccuggcgcugcaucguu

SEQ ID NO: 225207 - RNA, 22 nt, Shigella flexneri 2a str. 2457T
aucgcagauagcaaaaaagcgc

SEQ ID NO: 225208 - RNA, 22 nt, Shigella flexneri 2a str. 2457T
aacgagaucugcggcuugucgu

SEQ ID NO: 225209 - RNA, 22 nt, Shigella flexneri 2a str. 2457T
ucgcgugauuaugguugaccau

SEQ ID NO: 225210 - RNA, 22 nt, Shigella flexneri 2a str. 2457T
cauggcggaaguccgaccuuca

SEQ ID NO: 225211 - RNA, 22 nt, Shigella flexneri 2a str. 2457T
aagcggcguuacagauauucgg

SEQ ID NO: 225212 - RNA, 22 nt, Shigella flexneri 2a str. 2457T
gcaguggcguuaauugugguua

SEQ ID NO: 225213 - RNA, 22 nt, Shigella flexneri 2a str. 2457T
acagagccugucucagcaauga

SEQ ID NO: 225214 - RNA, 22 nt, Shigella flexneri 2a str. 2457T
uuuaucgacaaaggccggauug

SEQ ID NO: 225215 - RNA, 18 nt, Shigella flexneri 2a str. 2457T
agcagcggcgcaauggca

SEQ ID NO: 225216 - RNA, 22 nt, Shigella flexneri 2a str. 2457T
ggcggaguguugucguuaaugu

SEQ ID NO: 225217 - RNA, 22 nt, Shigella flexneri 2a str. 2457T
aucgauaaaguaaugacccgcc

SEQ ID NO: 225218 - RNA, 22 nt, Shigella flexneri 2a str. 2457T
uggcguauuucuaucuucuauu

SEQ ID NO: 225219 - RNA, 22 nt, Shigella flexneri 2a str. 2457T
acggugacagaacgcuaagauu

SEQ ID NO: 225220 - RNA, 22 nt, Shigella flexneri 2a str. 2457T
aaagcggugaccgcuaugucga

SEQ ID NO: 225221 - RNA, 22 nt, Shigella flexneri 2a str. 2457T
gcugguauuuucaaucgguacg

SEQ ID NO: 225222 - RNA, 22 nt, Shigella flexneri 2a str. 2457T
cgccugauuaacguuuuuguac

SEQ ID NO: 225223 - RNA, 22 nt, Shigella flexneri 2a str. 2457T
ugcgacagcguuguccucgcgg

SEQ ID NO: 225224 - RNA, 22 nt, Shigella flexneri 2a str. 2457T
agccacgcgcaguugcccaaag

SEQ ID NO: 225225 - RNA, 22 nt, Shigella flexneri 2a str. 2457T
acugcauccagaggcgaaugca

SEQ ID NO: 225226 - RNA, 22 nt, Shigella flexneri 2a str. 2457T
ugcuggauaugaccaucgaaga

SEQ ID NO: 225227 - RNA, 22 nt, Shigella flexneri 2a str. 2457T
gugaguucaccauuacgcugga

SEQ ID NO: 225228 - RNA, 22 nt, Shigella flexneri 2a str. 2457T
gcugacaugauggaugguaugc

SEQ ID NO: 225229 - RNA, 22 nt, Shigella flexneri 2a str. 2457T
aaguuugccguggcaguggcga

SEQ ID NO: 225230 - RNA, 22 nt, Shigella flexneri 2a str. 2457T
aguuuacaacgcauuguuaaag

SEQ ID NO: 225231 - RNA, 22 nt, Shigella flexneri 2a str. 2457T
cgacgguggugucauuguccag

SEQ ID NO: 225232 - RNA, 22 nt, Shigella flexneri 2a str. 2457T
ggcaaagugcauagcgucgcaa

SEQ ID NO: 225233 - RNA, 22 nt, Shigella flexneri 2a str. 2457T
augccauugcugaauuugagaa

SEQ ID NO: 225234 - RNA, 22 nt, Shigella flexneri 2a str. 2457T
gauaggcuaacaauuaccggau

SEQ ID NO: 225235 - RNA, 19 nt, Shigella flexneri 2a str. 2457T
ugaaagcgguugcaggcgg

SEQ ID NO: 225236 - RNA, 22 nt, Shigella flexneri 2a str. 2457T
uuaacgccauuugcgccauuga

SEQ ID NO: 225237 - RNA, 22 nt, Shigella flexneri 2a str. 2457T
ucggcucgcccagcggaguuuc

SEQ ID NO: 225238 - RNA, 22 nt, Shigella flexneri 2a str. 2457T
augccgguuaacugacuauauu

SEQ ID NO: 225239 - RNA, 22 nt, Shigella flexneri 2a str. 2457T
gugauccgauucgcguuaaugc

SEQ ID NO: 225240 - RNA, 22 nt, Shigella flexneri 2a str. 2457T
uuaacugcugagccggugcguu

SEQ ID NO: 225241 - RNA, 22 nt, Shigella flexneri 2a str. 2457T
ucauugacagaaagcagcggag

SEQ ID NO: 225242 - RNA, 20 nt, Shigella flexneri 2a str. 2457T
cgccguucuggcggauguug

SEQ ID NO: 225243 - RNA, 22 nt, Shigella flexneri 2a str. 2457T
ucgcguguuccaaaggucgcau

SEQ ID NO: 225244 - RNA, 23 nt, Shigella flexneri 2a str. 2457T
uaacugaggugauuaugggcuuc

SEQ ID NO: 225245 - RNA, 22 nt, Shigella flexneri 2a str. 2457T
ugcugaugaagaaggucauauc

SEQ ID NO: 225246 - RNA, 22 nt, Shigella flexneri 2a str. 2457T
uugcacgauuuuguaggccgga

SEQ ID NO: 225247 - RNA, 22 nt, Shigella flexneri 2a str. 2457T
cgagguuucaugggcgugauua

SEQ ID NO: 225248 - RNA, 22 nt, Shigella flexneri 2a str. 2457T
cauugcaccaauauggugcuua

SEQ ID NO: 225249 - RNA, 22 nt, Shigella flexneri 2a str. 2457T
cgacgcagcagagcaaggaguu

SEQ ID NO: 225250 - RNA, 22 nt, Shigella flexneri 2a str. 2457T
gcgcugguggcgauggucgggg

SEQ ID NO: 225251 - RNA, 22 nt, Shigella flexneri 2a str. 2457T
uuuaccgacggugauuuacgcc

SEQ ID NO: 225252 - RNA, 23 nt, Shigella flexneri 2a str. 2457T
auccuaucguugguguggacuuu

SEQ ID NO: 225253 - RNA, 23 nt, Shigella flexneri 2a str. 2457T
ucuggcuuguuucugcucaccgu

SEQ ID NO: 225254 - RNA, 22 nt, Shigella flexneri 2a str. 2457T
agucaauauuuauucauggaau

SEQ ID NO: 225255 - RNA, 22 nt, Shigella flexneri 2a str. 2457T
gguaguucuucacugaaauuug

SEQ ID NO: 225256 - RNA, 22 nt, Shigella flexneri 2a str. 2457T
cagcucgauaaacccuuuuuca

SEQ ID NO: 225257 - RNA, 22 nt, Shigella flexneri 2a str. 2457T
caucggugcugacggguugauu

SEQ ID NO: 225258 - RNA, 22 nt, Shigella flexneri 2a str. 2457T
uaucugugaugccagcgaugau

SEQ ID NO: 225259 - RNA, 22 nt, Shigella flexneri 2a str. 2457T
guguuaucgauauuggugaguu

SEQ ID NO: 225260 - RNA, 18 nt, Shigella flexneri 2a str. 2457T
ugcaggucagccaucggg

SEQ ID NO: 225261 - RNA, 22 nt, Shigella flexneri 2a str. 2457T
uggcuggcaauacuggcagcag

SEQ ID NO: 225262 - RNA, 22 nt, Shigella flexneri 2a str. 2457T
aaugcguugguagugcguaaca

SEQ ID NO: 225263 - RNA, 21 nt, Shigella flexneri 2a str. 2457T
uugaugcgcgagcgacguucc

SEQ ID NO: 225264 - RNA, 22 nt, Shigella flexneri 2a str. 2457T
aaccauugcaggucaauaucac

SEQ ID NO: 225265 - RNA, 22 nt, Shigella flexneri 2a str. 2457T
cuggaaccugucccauugaacu

SEQ ID NO: 225266 - RNA, 22 nt, Shigella flexneri 2a str. 2457T
gaugaacccguuuugugugguu

SEQ ID NO: 225267 - RNA, 22 nt, Shigella flexneri 2a str. 2457T
ggccuggacguugcagggcagc

SEQ ID NO: 225268 - RNA, 22 nt, Shigella flexneri 2a str. 2457T
ccuggcgagcaucccccacaau

SEQ ID NO: 225269 - RNA, 22 nt, Shigella flexneri 2a str. 2457T
cagaacuggugauacagcggcu

SEQ ID NO: 225270 - RNA, 22 nt, Shigella flexneri 2a str. 2457T
ugcuacgcgcuguuguugcagu

SEQ ID NO: 225271 - RNA, 22 nt, Shigella flexneri 2a str. 2457T
gaguaagugugaaguugccgga

SEQ ID NO: 225272 - RNA, 22 nt, Shigella flexneri 2a str. 2457T
ccgggcuuaccacggguuuccc

SEQ ID NO: 225273 - RNA, 22 nt, Shigella flexneri 2a str. 2457T
uggcaugguguggaguauucgu

SEQ ID NO: 225274 - RNA, 22 nt, Shigella flexneri 2a str. 2457T
ugacgcauacguggcagggaau

SEQ ID NO: 225275 - RNA, 22 nt, Shigella flexneri 2a str. 2457T
agcguguuacugaauaccugac

SEQ ID NO: 225276 - RNA, 22 nt, Shigella flexneri 2a str. 2457T
auaaacucucaauaccgauacu

SEQ ID NO: 225277 - RNA, 22 nt, Shigella flexneri 2a str. 2457T
uuguccgguacuggagccaacc

SEQ ID NO: 225278 - RNA, 22 nt, Shigella flexneri 2a str. 2457T
cagucagugguuugcccuucuu

SEQ ID NO: 225279 - RNA, 22 nt, Shigella flexneri 2a str. 2457T
uccggccuacaaaguccugcag

SEQ ID NO: 225280 - RNA, 22 nt, Shigella flexneri 2a str. 2457T
ggauuaacgucugggaacugau

SEQ ID NO: 225281 - RNA, 22 nt, Shigella flexneri 2a str. 2457T
aucgcccaguucaccgcgaaga

SEQ ID NO: 225282 - RNA, 22 nt, Shigella flexneri 2a str. 2457T
ugcgcugcgcuuaucaggccua

SEQ ID NO: 225283 - RNA, 22 nt, Shigella flexneri 2a str. 2457T
cgucugcuuaccauugcgugcc

SEQ ID NO: 225284 - RNA, 22 nt, Shigella flexneri 2a str. 2457T
cuggaugucggugccgaugacu

SEQ ID NO: 225285 - RNA, 22 nt, Shigella flexneri 2a str. 2457T
ugucaguggcgguucaaugcgg

SEQ ID NO: 225286 - RNA, 22 nt, Shigella flexneri 2a str. 2457T
gaagguuucgguguuuauacaa

SEQ ID NO: 225287 - RNA, 22 nt, Shigella flexneri 2a str. 2457T
aaagguuagaaugauagcuuug

SEQ ID NO: 225288 - RNA, 22 nt, Shigella flexneri 2a str. 2457T
gccgagaaagauggcugguucu

SEQ ID NO: 225289 - RNA, 22 nt, Shigella flexneri 2a str. 2457T
cuuucagagcaaugcaucgcgu

SEQ ID NO: 225290 - RNA, 22 nt, Shigella flexneri 2a str. 2457T
ugauauagcacaugaacguaau

SEQ ID NO: 225291 - RNA, 22 nt, Shigella flexneri 2a str. 2457T
ugggcgaagcguuaaccggcau

SEQ ID NO: 225292 - RNA, 22 nt, Shigella flexneri 2a str. 2457T
uuucgguauuaccuguucgacg

SEQ ID NO: 225293 - RNA, 22 nt, Shigella flexneri 2a str. 2457T
cucgccauuuucgucuggaccg

SEQ ID NO: 225294 - RNA, 19 nt, Shigella flexneri 2a str. 2457T
ugagugaagguacgaguaa

SEQ ID NO: 225295 - RNA, 22 nt, Shigella flexneri 2a str. 2457T
uuguaggcuggauaaggcguuc

SEQ ID NO: 225296 - RNA, 22 nt, Shigella flexneri 2a str. 2457T
agcgggauuaucucaagcuggu

SEQ ID NO: 225297 - RNA, 22 nt, Shigella flexneri 2a str. 2457T
ccauuaccuuuaacggacuguc

SEQ ID NO: 225298 - RNA, 22 nt, Shigella flexneri 2a str. 2457T
accugcauuuccgaacgcacgu

SEQ ID NO: 225299 - RNA, 22 nt, Shigella flexneri 2a str. 2457T
uuagcgacccauuuugccgguu

SEQ ID NO: 225300 - RNA, 21 nt, Shigella flexneri 2a str. 2457T
agccgcuggaugaaauuggcg

SEQ ID NO: 225301 - RNA, 22 nt, Shigella flexneri 2a str. 2457T
ucaggcugaugguggcacucgu

SEQ ID NO: 225302 - RNA, 22 nt, Shigella flexneri 2a str. 2457T
accuggcauucauucuucugca

SEQ ID NO: 225303 - RNA, 22 nt, Shigella flexneri 2a str. 2457T
cgcucuuauccaucugcuugcu

SEQ ID NO: 225304 - RNA, 22 nt, Shigella flexneri 2a str. 2457T
gcaguaucaaaacgucgggcaa

SEQ ID NO: 225305 - RNA, 22 nt, Shigella flexneri 2a str. 2457T
acacgcgguugcuuuugcccaa

SEQ ID NO: 225306 - RNA, 22 nt, Shigella flexneri 2a str. 2457T
ugcccuggaacuucucgucugu

SEQ ID NO: 225307 - RNA, 22 nt, Shigella flexneri 2a str. 2457T
ugcgagcgaugucugccggguu

SEQ ID NO: 225308 - RNA, 22 nt, Shigella flexneri 2a str. 2457T
uaaggcguuuacgccgcauccg

SEQ ID NO: 225309 - RNA, 22 nt, Shigella flexneri 2a str. 2457T
gugccguuguugcgugacgacg

SEQ ID NO: 225310 - RNA, 22 nt, Shigella flexneri 2a str. 2457T
uaaaccgaugguggugaugacc

SEQ ID NO: 225311 - RNA, 22 nt, Shigella flexneri 2a str. 2457T
acugaaaggcgaaggcuucaag

SEQ ID NO: 225312 - RNA, 22 nt, Shigella flexneri 2a str. 2457T
auccgguaucguggcuuauuca

SEQ ID NO: 225313 - RNA, 22 nt, Shigella flexneri 2a str. 2457T
uaaaguuccgcgcauugcguuc

SEQ ID NO: 225314 - RNA, 22 nt, Shigella flexneri 2a str. 2457T
aaugaccaguaaugcuuugccc

SEQ ID NO: 225315 - RNA, 22 nt, Shigella flexneri 2a str. 2457T
aguauucuuauuuuaacaacag

SEQ ID NO: 225316 - RNA, 22 nt, Shigella flexneri 2a str. 2457T
gccagacaacagggagaguaga

SEQ ID NO: 225317 - RNA, 22 nt, Shigella flexneri 2a str. 2457T
uauugcagccguuuuugaggau

SEQ ID NO: 225318 - RNA, 22 nt, Shigella flexneri 2a str. 2457T
uggcgucguguagcgaugacca

SEQ ID NO: 225319 - RNA, 22 nt, Shigella flexneri 2a str. 2457T
uucguugcgugagguugcuggc

SEQ ID NO: 225320 - RNA, 22 nt, Shigella flexneri 2a str. 2457T
uguuggcaaucugcugcgccgu

SEQ ID NO: 225321 - RNA, 22 nt, Shigella flexneri 2a str. 2457T
ucgacgccaacguacgcuuucg

SEQ ID NO: 225322 - RNA, 22 nt, Shigella flexneri 2a str. 2457T
cguagccgguggugugcuggcu

SEQ ID NO: 225323 - RNA, 22 nt, Shigella flexneri 2a str. 2457T
accauacggucgaugccaaucc

SEQ ID NO: 225324 - RNA, 22 nt, Shigella flexneri 2a str. 2457T
uaacccgcugcauugccaccgc

SEQ ID NO: 225325 - RNA, 22 nt, Shigella flexneri 2a str. 2457T
caagagauugcaggugcgguug

SEQ ID NO: 225326 - RNA, 22 nt, Shigella flexneri 2a str. 2457T
ucaggccuacaaaaucuugcaa

SEQ ID NO: 225327 - RNA, 22 nt, Shigella flexneri 2a str. 2457T
ugcaucacaaaccugaaaagaa

SEQ ID NO: 225328 - RNA, 21 nt, Shigella flexneri 2a str. 2457T
uuguccgcuaucuggcggcac

SEQ ID NO: 225329 - RNA, 22 nt, Shigella flexneri 2a str. 2457T
uucgcgaacgucgaggaucugg

SEQ ID NO: 225330 - RNA, 23 nt, Shigella flexneri 2a str. 2457T
uuaccgaugaauuuauucguggu

SEQ ID NO: 225331 - RNA, 22 nt, Shigella flexneri 2a str. 2457T
gugauagcggguuuacucauua

SEQ ID NO: 225332 - RNA, 22 nt, Shigella flexneri 2a str. 2457T
gugcaacucaggcaucauggcg

SEQ ID NO: 225333 - RNA, 22 nt, Shigella flexneri 2a str. 2457T
acagcgcgugauguuugucaga

SEQ ID NO: 225334 - RNA, 22 nt, Shigella flexneri 2a str. 2457T
gcgcgaucacagugagcaagaa

SEQ ID NO: 225335 - RNA, 22 nt, Shigella flexneri 2a str. 2457T
gucugcugauuuugcuguuuac

SEQ ID NO: 225336 - RNA, 22 nt, Shigella flexneri 2a str. 2457T
uaugcauaaaaagcagcggcug

SEQ ID NO: 225337 - RNA, 22 nt, Shigella flexneri 2a str. 2457T
cagcgacgcgccagcaggaaag

SEQ ID NO: 225338 - RNA, 22 nt, Shigella flexneri 2a str. 2457T
ugccacaaauacugaaagccgc

SEQ ID NO: 225339 - RNA, 22 nt, Shigella flexneri 2a str. 2457T
cgcacguuggcaugagcgaugg

SEQ ID NO: 225340 - RNA, 22 nt, Shigella flexneri 2a str. 2457T
uucuugaucaacaccugcggau

SEQ ID NO: 225341 - RNA, 22 nt, Shigella flexneri 2a str. 2457T
aggucagauaagcgaaacgcau

SEQ ID NO: 225342 - RNA, 22 nt, Shigella flexneri 2a str. 2457T
uaccguuacgcugcggugccag

SEQ ID NO: 225343 - RNA, 22 nt, Shigella flexneri 2a str. 2457T
cggcugguuaaguauuucguuu

SEQ ID NO: 225344 - RNA, 22 nt, Shigella flexneri 2a str. 2457T
cgcuguugccaacgccgcaaag

SEQ ID NO: 225345 - RNA, 22 nt, Shigella flexneri 2a str. 2457T
ugagaucauguuguagcgcccg

SEQ ID NO: 225346 - RNA, 22 nt, Shigella flexneri 2a str. 2457T
cgccaguugauuuugacaccgc

SEQ ID NO: 225347 - RNA, 22 nt, Shigella flexneri 2a str. 2457T
gccauucaggauggcgugcgca

SEQ ID NO: 225348 - RNA, 22 nt, Shigella flexneri 2a str. 2457T
gccaacaucauaggcguggugu

SEQ ID NO: 225349 - RNA, 22 nt, Shigella flexneri 2a str. 2457T
guugcacuucaauuaauuguaa

SEQ ID NO: 225350 - RNA, 22 nt, Shigella flexneri 2a str. 2457T
aucaggucaucgaucacuuucu

SEQ ID NO: 225351 - RNA, 22 nt, Shigella flexneri 2a str. 2457T
cugguagcgcuggggcugcaaa

SEQ ID NO: 225352 - RNA, 22 nt, Shigella flexneri 2a str. 2457T
cagauuucauucacuacgccau

SEQ ID NO: 225353 - RNA, 22 nt, Shigella flexneri 2a str. 2457T
accuguuuaacguuaacgccgg

SEQ ID NO: 225354 - RNA, 22 nt, Shigella flexneri 2a str. 2457T
aagccucaguuucuaugcaaau

SEQ ID NO: 225355 - RNA, 22 nt, Shigella flexneri 2a str. 2457T
uacuggagguggaagggaugaa

SEQ ID NO: 225356 - RNA, 19 nt, Shigella flexneri 2a str. 2457T
uuaacgccgaucgcaucgg

SEQ ID NO: 225357 - RNA, 22 nt, Shigella flexneri 2a str. 2457T
cggguagagcacauugaugccg

SEQ ID NO: 225358 - RNA, 22 nt, Shigella flexneri 2a str. 2457T
acggugaucguuaaugugcagg

SEQ ID NO: 225359 - RNA, 22 nt, Shigella flexneri 2a str. 2457T
ucguugaaaaauacgcgcuggu

SEQ ID NO: 225360 - RNA, 22 nt, Shigella flexneri 2a str. 2457T
gugucgauaaccagacuguuac

SEQ ID NO: 225361 - RNA, 22 nt, Shigella flexneri 2a str. 2457T
gcagcacguugcggcugcguuu

SEQ ID NO: 225362 - RNA, 22 nt, Shigella flexneri 2a str. 2457T
accaugauaccuuguuccgaca

SEQ ID NO: 225363 - RNA, 22 nt, Shigella flexneri 2a str. 2457T
gcgcuguucugcgcuuuuucug

SEQ ID NO: 225364 - RNA, 22 nt, Shigella flexneri 2a str. 2457T
agcguaucaggauaucuauaca

SEQ ID NO: 225365 - RNA, 22 nt, Shigella flexneri 2a str. 2457T
accgaagaguaccgcggcggca

SEQ ID NO: 225366 - RNA, 22 nt, Shigella flexneri 2a str. 2457T
accauugccgcagcaauagcug

SEQ ID NO: 225367 - RNA, 22 nt, Shigella flexneri 2a str. 2457T
gucgagaaagaagagaauggcg

SEQ ID NO: 225368 - RNA, 22 nt, Shigella flexneri 2a str. 2457T
uugcugucggaacaagguauca

SEQ ID NO: 225369 - RNA, 22 nt, Shigella flexneri 2a str. 2457T
ucuuugaugcggugccagcucu

SEQ ID NO: 225370 - RNA, 18 nt, Shigella flexneri 2a str. 2457T
gucaccgaugcagaaggg

SEQ ID NO: 225371 - RNA, 22 nt, Shigella flexneri 2a str. 2457T
gugucgcggguagcaggguguu

SEQ ID NO: 225372 - RNA, 18 nt, Shigella flexneri 2a str. 2457T
ggcaaucaguuugaaucc

SEQ ID NO: 225373 - RNA, 22 nt, Shigella flexneri 2a str. 2457T
cagcccguuauguacgaaggcc

SEQ ID NO: 225374 - RNA, 22 nt, Shigella flexneri 2a str. 2457T
ucgauauggugcagucgcugac

SEQ ID NO: 225375 - RNA, 22 nt, Shigella flexneri 2a str. 2457T
uucgucagucaggacaaacugc

SEQ ID NO: 225376 - RNA, 22 nt, Shigella flexneri 2a str. 2457T
caucgcuggggauugguauuuu

SEQ ID NO: 225377 - RNA, 22 nt, Shigella flexneri 2a str. 2457T
gauugaugaccugagcuucucg

SEQ ID NO: 225378 - RNA, 22 nt, Shigella flexneri 2a str. 2457T
ugcacgcgguggaagcuuucuu

SEQ ID NO: 225379 - RNA, 22 nt, Shigella flexneri 2a str. 2457T
agugugaccuucaguagccagc

SEQ ID NO: 225380 - RNA, 22 nt, Shigella flexneri 2a str. 2457T
ucauugcugagacaggcucugu

SEQ ID NO: 225381 - RNA, 21 nt, Shigella flexneri 2a str. 2457T
ggcguugagaagaguuucgau

SEQ ID NO: 225382 - RNA, 22 nt, Shigella flexneri 2a str. 2457T
guucagcagauuuggcgcaacu

SEQ ID NO: 225383 - RNA, 22 nt, Shigella flexneri 2a str. 2457T
aaacgucgauggcuuuugcgau

SEQ ID NO: 225384 - RNA, 22 nt, Shigella flexneri 2a str. 2457T
cugaugcgacgcugacgcgucu

SEQ ID NO: 225385 - RNA, 18 nt, Shigella flexneri 2a str. 2457T
agcugcugcgcaucaaca

SEQ ID NO: 225386 - RNA, 22 nt, Shigella flexneri 2a str. 2457T
aacaggcuuaagacgcucgaac

SEQ ID NO: 225387 - RNA, 22 nt, Shigella flexneri 2a str. 2457T
uaacggcgaucgcgccagcgga

SEQ ID NO: 225388 - RNA, 22 nt, Shigella flexneri 2a str. 2457T
agaagugugguuuuguagauau

SEQ ID NO: 225389 - RNA, 22 nt, Shigella flexneri 2a str. 2457T
ccugcgacaaucauucgucagg

SEQ ID NO: 225390 - RNA, 22 nt, Shigella flexneri 2a str. 2457T
auaugguaaucaacaauggccg

SEQ ID NO: 225391 - RNA, 22 nt, Shigella flexneri 2a str. 2457T
caauccgcagguguugaucaag

SEQ ID NO: 225392 - RNA, 22 nt, Shigella flexneri 2a str. 2457T
gcgaacuuacgucugguuauuu

SEQ ID NO: 225393 - RNA, 22 nt, Shigella flexneri 2a str. 2457T
ggugagccugcugguaagcgcc

SEQ ID NO: 225394 - RNA, 22 nt, Shigella flexneri 2a str. 2457T
gagccggugacguuggugcguu

SEQ ID NO: 225395 - RNA, 22 nt, Shigella flexneri 2a str. 2457T
agcaacguugaucugcugguga

SEQ ID NO: 225396 - RNA, 23 nt, Shigella flexneri 2a str. 2457T
aacgucagaagacagcugaucga

SEQ ID NO: 225397 - RNA, 22 nt, Shigella flexneri 2a str. 2457T
ccggccuacaaacccuugcuaa

SEQ ID NO: 225398 - RNA, 22 nt, Shigella flexneri 2a str. 2457T
accgcaucggccugguguaccg

SEQ ID NO: 225399 - RNA, 22 nt, Shigella flexneri 2a str. 2457T
cgucuggcugagccgcaucgaa

SEQ ID NO: 225400 - RNA, 22 nt, Shigella flexneri 2a str. 2457T
accagcagcagcguauucaguu

SEQ ID NO: 225401 - RNA, 22 nt, Shigella flexneri 2a str. 2457T
ugcgugauuauguaggccggau

SEQ ID NO: 225402 - RNA, 22 nt, Shigella flexneri 2a str. 2457T
uggaaagucacagcccgcgccg

SEQ ID NO: 225403 - RNA, 22 nt, Shigella flexneri 2a str. 2457T
auaaccgaagccguuaccgcgc

SEQ ID NO: 225404 - RNA, 22 nt, Shigella flexneri 2a str. 2457T
cggauaaagcguguugcauuug

SEQ ID NO: 225405 - RNA, 22 nt, Shigella flexneri 2a str. 2457T
gggcgguaaaguuggucuguuc

SEQ ID NO: 225406 - RNA, 21 nt, Shigella flexneri 2a str. 2457T
gagcgcaggcggaauggcggc

SEQ ID NO: 225407 - RNA, 20 nt, Shigella flexneri 2a str. 2457T
uuguucaguugaaggugugc

SEQ ID NO: 225408 - RNA, 22 nt, Shigella flexneri 2a str. 2457T
uuggcacuacgcuuucuggcua

SEQ ID NO: 225409 - RNA, 22 nt, Shigella flexneri 2a str. 2457T
acacgguagcgcgaccugcaac

SEQ ID NO: 225410 - RNA, 20 nt, Shigella flexneri 2a str. 2457T
aacugggcggcgagcguauc

SEQ ID NO: 225411 - RNA, 22 nt, Shigella flexneri 2a str. 2457T
gcuggcuuugcgcacuggcggc

SEQ ID NO: 225412 - RNA, 22 nt, Shigella flexneri 2a str. 2457T
augaccggacgccuggcgcugg

SEQ ID NO: 225413 - RNA, 22 nt, Shigella flexneri 2a str. 2457T
cagaauauuugccauaagggaa

SEQ ID NO: 225414 - RNA, 22 nt, Shigella flexneri 2a str. 2457T
cuuacauuaaugaagcuauccg

SEQ ID NO: 225415 - RNA, 22 nt, Shigella flexneri 2a str. 2457T
ggcagugccuucagcauggaag

SEQ ID NO: 225416 - RNA, 22 nt, Shigella flexneri 2a str. 2457T
auuacagacugcccgcuugugg

SEQ ID NO: 225417 - RNA, 22 nt, Shigella flexneri 2a str. 2457T
cggugccaguucgcgcagggua

SEQ ID NO: 225418 - RNA, 19 nt, Shigella flexneri 2a str. 2457T
aggugauugaaaccgaucu

SEQ ID NO: 225419 - RNA, 22 nt, Shigella flexneri 2a str. 2457T
uagcagauuuggcugaaggcac

SEQ ID NO: 225420 - RNA, 21 nt, Shigella flexneri 2a str. 2457T
gaaugcugaaaaugccgcgcu

SEQ ID NO: 225421 - RNA, 22 nt, Shigella flexneri 2a str. 2457T
uagcucugcuacgucgcaugga

SEQ ID NO: 225422 - RNA, 22 nt, Shigella flexneri 2a str. 2457T
uuaaacugaacauugaagcuaa

SEQ ID NO: 225423 - RNA, 22 nt, Shigella flexneri 2a str. 2457T
gucaauuuuuaauugaggugga

SEQ ID NO: 225424 - RNA, 19 nt, Shigella flexneri 2a str. 2457T
ggucgugacaaguuagcgc

SEQ ID NO: 225425 - RNA, 22 nt, Shigella flexneri 2a str. 2457T
ugauguagguauauucgccauu

SEQ ID NO: 225426 - RNA, 22 nt, Shigella flexneri 2a str. 2457T
ggagacauucucgccaccgcgu

SEQ ID NO: 225427 - RNA, 22 nt, Shigella flexneri 2a str. 2457T
aucuaugugaauaaacaugacg

SEQ ID NO: 225428 - RNA, 22 nt, Shigella flexneri 2a str. 2457T
aggguucuacuguuauagggau

SEQ ID NO: 225429 - RNA, 22 nt, Shigella flexneri 2a str. 2457T
ggcagcaagugcagcucgcugg

SEQ ID NO: 225430 - RNA, 22 nt, Shigella flexneri 2a str. 2457T
uccggccuuuuuuaucucuuac

SEQ ID NO: 225431 - RNA, 21 nt, Shigella flexneri 2a str. 2457T
ucucugcgucgucuggagcaa

SEQ ID NO: 225432 - RNA, 23 nt, Shigella flexneri 2a str. 2457T
uauccgaccuacaaaaccgugca

SEQ ID NO: 225433 - RNA, 23 nt, Shigella flexneri 2a str. 2457T
gucggcagcguuaucaucggaua

SEQ ID NO: 225434 - RNA, 19 nt, Shigella flexneri 2a str. 2457T
uuucaggauaggugugcgc

SEQ ID NO: 225435 - RNA, 23 nt, Shigella flexneri 2a str. 2457T
aaugcgccaaccuuccagcgaug

SEQ ID NO: 225436 - RNA, 22 nt, Shigella flexneri 2a str. 2457T
caucagcguguaccagucuuuu

SEQ ID NO: 225437 - RNA, 20 nt, Shigella flexneri 2a str. 2457T
uaucgugauuuguaaucgcc

SEQ ID NO: 225438 - RNA, 22 nt, Shigella flexneri 2a str. 2457T
gugacgaaguugagaauaccgc

SEQ ID NO: 225439 - RNA, 22 nt, Shigella flexneri 2a str. 2457T
aucggucgcuucgucaucaacc

SEQ ID NO: 225440 - RNA, 22 nt, Shigella flexneri 2a str. 2457T
ccacgcugacgcaucaguucac

SEQ ID NO: 225441 - RNA, 17 nt, Shigella flexneri 2a str. 2457T
ucguaucuucguugcgc

SEQ ID NO: 225442 - RNA, 23 nt, Shigella flexneri 2a str. 2457T
ugagaaugcgcgggcuggcgugc

SEQ ID NO: 225443 - RNA, 22 nt, Shigella flexneri 2a str. 2457T
auuccgugcgccaaagugugcc

SEQ ID NO: 225444 - RNA, 22 nt, Shigella flexneri 2a str. 2457T
accguuuggcuguuucacgccg

SEQ ID NO: 225445 - RNA, 22 nt, Shigella flexneri 2a str. 2457T
guuucacuccaaccuguucaag

SEQ ID NO: 225446 - RNA, 22 nt, Shigella flexneri 2a str. 2457T
augcaaugaaaguaccguucua

SEQ ID NO: 225447 - RNA, 22 nt, Shigella flexneri 2a str. 2457T
cgguuaaaggcaaugugauuaa

SEQ ID NO: 225448 - RNA, 22 nt, Shigella flexneri 2a str. 2457T
gaugaacuguaggcugcugcgg

SEQ ID NO: 225449 - RNA, 22 nt, Shigella flexneri 2a str. 2457T
cacggugugcguuucgccagug

SEQ ID NO: 225450 - RNA, 22 nt, Shigella flexneri 2a str. 2457T
uccauacugaaggcgcguauca

SEQ ID NO: 225451 - RNA, 22 nt, Shigella flexneri 2a str. 2457T
gaugcgccaugaguuuauuuua

SEQ ID NO: 225452 - RNA, 22 nt, Shigella flexneri 2a str. 2457T
uagugcgguuaaccagcgccgc

SEQ ID NO: 225453 - RNA, 22 nt, Shigella flexneri 2a str. 2457T
ugcuccggcacguaaggcuaac

SEQ ID NO: 225454 - RNA, 22 nt, Shigella flexneri 2a str. 2457T
ugccgcaggaaagcacuuugcc

SEQ ID NO: 225455 - RNA, 22 nt, Shigella flexneri 2a str. 2457T
auaguuacuggugucugcuucu

SEQ ID NO: 225456 - RNA, 22 nt, Shigella flexneri 2a str. 2457T
guuccggcaguuauuguggcga

SEQ ID NO: 225457 - RNA, 22 nt, Shigella flexneri 2a str. 2457T
cagcacuuuuugcugauugcca

SEQ ID NO: 225458 - RNA, 22 nt, Shigella flexneri 2a str. 2457T
uuuggcagcuucaugcauuaca

SEQ ID NO: 225459 - RNA, 22 nt, Shigella flexneri 2a str. 2457T
gugaagguuaaggcugauuuaa

SEQ ID NO: 225460 - RNA, 22 nt, Shigella flexneri 2a str. 2457T
guucucaucgcucuuaccgggg

SEQ ID NO: 225461 - RNA, 22 nt, Shigella flexneri 2a str. 2457T
uccgacagccagaccagccgcg

SEQ ID NO: 225462 - RNA, 22 nt, Shigella flexneri 2a str. 2457T
gccgcuucgcugauuuuuccgg

SEQ ID NO: 225463 - RNA, 22 nt, Shigella flexneri 2a str. 2457T
ucugguauggauguggcgcgua

SEQ ID NO: 225464 - RNA, 22 nt, Shigella flexneri 2a str. 2457T
aucguuguagaguuugaucagg

SEQ ID NO: 225465 - RNA, 22 nt, Shigella flexneri 2a str. 2457T
ucaucuacaucgguuguuuaaa

SEQ ID NO: 225466 - RNA, 22 nt, Shigella flexneri 2a str. 2457T
aacgaugaacuuuuuugccauu

SEQ ID NO: 225467 - RNA, 22 nt, Shigella flexneri 2a str. 2457T
cagcggaucacccaccguuuug

SEQ ID NO: 225468 - RNA, 22 nt, Shigella flexneri 2a str. 2457T
acguuccuccccaccagcuugu

SEQ ID NO: 225469 - RNA, 22 nt, Shigella flexneri 2a str. 2457T
gguucguagucgcucugaacuu

SEQ ID NO: 225470 - RNA, 22 nt, Shigella flexneri 2a str. 2457T
ugccgacaggguggcugugcga

SEQ ID NO: 225471 - RNA, 22 nt, Shigella flexneri 2a str. 2457T
uggcucuggaagcgggguugcu

SEQ ID NO: 225472 - RNA, 22 nt, Shigella flexneri 2a str. 2457T
uccuggauuucagucugguuuu

SEQ ID NO: 225473 - RNA, 22 nt, Shigella flexneri 2a str. 2457T
aacugaaaggcugggccauguu

SEQ ID NO: 225474 - RNA, 22 nt, Shigella flexneri 2a str. 2457T
ugaugacgcugcggcaguucgc

SEQ ID NO: 225475 - RNA, 22 nt, Shigella flexneri 2a str. 2457T
agcuuguucgacaaagcuuugc

SEQ ID NO: 225476 - RNA, 23 nt, Shigella flexneri 2a str. 2457T
cguaauguuaacuggggcuuuuc

SEQ ID NO: 225477 - RNA, 22 nt, Shigella flexneri 2a str. 2457T
uccggccuacaaaaucgugcua

SEQ ID NO: 225478 - RNA, 22 nt, Shigella flexneri 2a str. 2457T
agucauuaccuaagauuaagau

SEQ ID NO: 225479 - RNA, 22 nt, Shigella flexneri 2a str. 2457T
uggcgcguggccacaucaucaa

SEQ ID NO: 225480 - RNA, 22 nt, Shigella flexneri 2a str. 2457T
gugcaggcggucguuaugacgg

SEQ ID NO: 225481 - RNA, 22 nt, Shigella flexneri 2a str. 2457T
accggucguuguuccugccggc

SEQ ID NO: 225482 - RNA, 22 nt, Shigella flexneri 2a str. 2457T
uacgcuguggaagcauugccag

SEQ ID NO: 225483 - RNA, 22 nt, Shigella flexneri 2a str. 2457T
cgguucgaugauuggucugaau

SEQ ID NO: 225484 - RNA, 22 nt, Shigella flexneri 2a str. 2457T
cgaugcuggcggaagugggccu

SEQ ID NO: 225485 - RNA, 22 nt, Shigella flexneri 2a str. 2457T
uuaaggaauugcugcccggaaa

SEQ ID NO: 225486 - RNA, 22 nt, Shigella flexneri 2a str. 2457T
uacggcaggcgaggcggaucau

SEQ ID NO: 225487 - RNA, 22 nt, Shigella flexneri 2a str. 2457T
uugcauggucuuguaggccaga

SEQ ID NO: 225488 - RNA, 22 nt, Shigella flexneri 2a str. 2457T
caggaguuggcgaugaaugacc

SEQ ID NO: 225489 - RNA, 22 nt, Shigella flexneri 2a str. 2457T
cugguagguauaacguuggcgu

SEQ ID NO: 225490 - RNA, 22 nt, Shigella flexneri 2a str. 2457T
aucacgaauauuaucgacguaa

SEQ ID NO: 225491 - RNA, 22 nt, Shigella flexneri 2a str. 2457T
ugcaggacgcacagauucugca

SEQ ID NO: 225492 - RNA, 22 nt, Shigella flexneri 2a str. 2457T
cuagauccgggcugauuugcug

SEQ ID NO: 225493 - RNA, 22 nt, Shigella flexneri 2a str. 2457T
ucgcagacgcugaaugaucugu

SEQ ID NO: 225494 - RNA, 22 nt, Shigella flexneri 2a str. 2457T
uccggaugauuaauguuggccg

SEQ ID NO: 225495 - RNA, 22 nt, Shigella flexneri 2a str. 2457T
cagccuuaaaauaggccggaug

SEQ ID NO: 225496 - RNA, 22 nt, Shigella flexneri 2a str. 2457T
cgauggaucgcugggaucaugg

SEQ ID NO: 225497 - RNA, 22 nt, Shigella flexneri 2a str. 2457T
gaucguuaaagaugcuaacggc

SEQ ID NO: 225498 - RNA, 22 nt, Shigella flexneri 2a str. 2457T
auuugcucgucagccaguuuca

SEQ ID NO: 225499 - RNA, 22 nt, Shigella flexneri 2a str. 2457T
ucccaggaacugccgugauguu

SEQ ID NO: 225500 - RNA, 22 nt, Shigella flexneri 2a str. 2457T
cgcacaauuuucagcgcaaucu

SEQ ID NO: 225501 - RNA, 22 nt, Shigella flexneri 2a str. 2457T
acuuggcugguuaaguacguag

SEQ ID NO: 225502 - RNA, 21 nt, Shigella flexneri 2a str. 2457T
ugcgccaccauucugaaagcc

SEQ ID NO: 225503 - RNA, 22 nt, Shigella flexneri 2a str. 2457T
aucugaguuuaugggaauaaau

SEQ ID NO: 225504 - RNA, 22 nt, Shigella flexneri 2a str. 2457T
uucaccagcgccagcgcuucug

SEQ ID NO: 225505 - RNA, 22 nt, Shigella flexneri 2a str. 2457T
gccgcuucuuccagcaggaucu

SEQ ID NO: 225506 - RNA, 22 nt, Shigella flexneri 2a str. 2457T
uuacguucggcgagcaguuguu

SEQ ID NO: 225507 - RNA, 21 nt, Shigella flexneri 2a str. 2457T
cgaucgucgggaucaucgguc

SEQ ID NO: 225508 - RNA, 22 nt, Shigella flexneri 2a str. 2457T
ucagcgacaacucuugcugagc

SEQ ID NO: 225509 - RNA, 22 nt, Shigella flexneri 2a str. 2457T
ccgagaucuuucgcugcuuuua

SEQ ID NO: 225510 - RNA, 22 nt, Shigella flexneri 2a str. 2457T
uuacugauguugcgaaaacgcu

SEQ ID NO: 225511 - RNA, 21 nt, Shigella flexneri 2a str. 2457T
acgguucuggucuggcuguug

SEQ ID NO: 225512 - RNA, 21 nt, Shigella flexneri 2a str. 2457T
cugcauguugcucauagugug

SEQ ID NO: 225513 - RNA, 22 nt, Shigella flexneri 2a str. 2457T
ucucaccguauaagagaauugg

SEQ ID NO: 225514 - RNA, 22 nt, Shigella flexneri 2a str. 2457T
ucgaacagccgagcgacuucug

SEQ ID NO: 225515 - RNA, 21 nt, Shigella flexneri 2a str. 2457T
uccuggcuugccagccaugag

SEQ ID NO: 225516 - RNA, 22 nt, Shigella flexneri 2a str. 2457T
caagcgccaguugucaucuucc

SEQ ID NO: 225517 - RNA, 22 nt, Shigella flexneri 2a str. 2457T
cuggcuacucaggcgauacagu

SEQ ID NO: 225518 - RNA, 22 nt, Shigella flexneri 2a str. 2457T
gugguuacauuguuaucguccc

SEQ ID NO: 225519 - RNA, 22 nt, Shigella flexneri 2a str. 2457T
agugauuaacgucucuuucaga

SEQ ID NO: 225520 - RNA, 22 nt, Shigella flexneri 2a str. 2457T
auggcgauguagucuuucacgc

SEQ ID NO: 225521 - RNA, 22 nt, Shigella flexneri 2a str. 2457T
uuacugaugcgucugguagugg

SEQ ID NO: 225522 - RNA, 22 nt, Shigella flexneri 2a str. 2457T
aucaggccuacauagucccugc

SEQ ID NO: 225523 - RNA, 19 nt, Shigella flexneri 2a str. 2457T
gcgcggauugaugccgccc

SEQ ID NO: 225524 - RNA, 22 nt, Shigella flexneri 2a str. 2457T
auuaucaggucaugcguaccga

SEQ ID NO: 225525 - RNA, 22 nt, Shigella flexneri 2a str. 2457T
uggcgauggagcuaaugaccug

SEQ ID NO: 225526 - RNA, 22 nt, Shigella flexneri 2a str. 2457T
uucagucauuggcgugcaucag

SEQ ID NO: 225527 - RNA, 22 nt, Shigella flexneri 2a str. 2457T
agcagacaacccacacauuucu

SEQ ID NO: 225528 - RNA, 22 nt, Shigella flexneri 2a str. 2457T
guucaguuuugacgaugcgcuu

SEQ ID NO: 225529 - RNA, 19 nt, Shigella flexneri 2a str. 2457T
ucaacuggcgcaaaacugg

SEQ ID NO: 225530 - RNA, 22 nt, Shigella flexneri 2a str. 2457T
uggaaugauauaaaagaucgcc

SEQ ID NO: 225531 - RNA, 20 nt, Shigella flexneri 2a str. 2457T
guaggccgcauccggcagga

SEQ ID NO: 225532 - RNA, 22 nt, Shigella flexneri 2a str. 2457T
gcuucgucauuccgaaaggcua

SEQ ID NO: 225533 - RNA, 22 nt, Shigella flexneri 2a str. 2457T
guuagcgccaaucgauacguug

SEQ ID NO: 225534 - RNA, 22 nt, Shigella flexneri 2a str. 2457T
cugaaugcagaauaggccagac

SEQ ID NO: 225535 - RNA, 22 nt, Shigella flexneri 2a str. 2457T
accucguuuauuauuaccgaag

SEQ ID NO: 225536 - RNA, 22 nt, Shigella flexneri 2a str. 2457T
aaauuggcuuuuaccaguccau

SEQ ID NO: 225537 - RNA, 22 nt, Shigella flexneri 2a str. 2457T
gaugugauugucugcgcugaaa

SEQ ID NO: 225538 - RNA, 22 nt, Shigella flexneri 2a str. 2457T
uugccgcguuuucgacgagguu

SEQ ID NO: 225539 - RNA, 23 nt, Shigella flexneri 2a str. 2457T
cuucaacgcagcguugccacuuc

SEQ ID NO: 225540 - RNA, 22 nt, Shigella flexneri 2a str. 2457T
ucugccagagcuucaaugcguu

SEQ ID NO: 225541 - RNA, 22 nt, Shigella flexneri 2a str. 2457T
auggaauaugccuucuggaugg

SEQ ID NO: 225542 - RNA, 22 nt, Shigella flexneri 2a str. 2457T
uucgcguaaacgccaggcgugu

SEQ ID NO: 225543 - RNA, 22 nt, Shigella flexneri 2a str. 2457T
uagcgaacugucgcugcuggaa

SEQ ID NO: 225544 - RNA, 22 nt, Shigella flexneri 2a str. 2457T
uauuccguagcuauaucgacga

SEQ ID NO: 225545 - RNA, 22 nt, Shigella flexneri 2a str. 2457T
cucguaggccugauaagcgcag

SEQ ID NO: 225546 - RNA, 22 nt, Shigella flexneri 2a str. 2457T
gaugccugcaaacgucuggcag

SEQ ID NO: 225547 - RNA, 23 nt, Shigella flexneri 2a str. 2457T
gagcguggaucuggaguucagca

SEQ ID NO: 225548 - RNA, 22 nt, Shigella flexneri 2a str. 2457T
uaaagcaccgcggccuuuuuug

SEQ ID NO: 225549 - RNA, 22 nt, Shigella flexneri 2a str. 2457T
cacaacguagaagucgccaauc

SEQ ID NO: 225550 - RNA, 22 nt, Shigella flexneri 2a str. 2457T
acgccuuauccggccuacaagu

SEQ ID NO: 225551 - RNA, 22 nt, Shigella flexneri 2a str. 2457T
gauuuagucagugcaucucauu

SEQ ID NO: 225552 - RNA, 22 nt, Shigella flexneri 2a str. 2457T
cagcaguucgcgaauacgcugc

SEQ ID NO: 225553 - RNA, 23 nt, Shigella flexneri 2a str. 2457T
ggcuuccgucagggguggauggu

SEQ ID NO: 225554 - RNA, 22 nt, Shigella flexneri 2a str. 2457T
ugcugucgguauuaaaagccaa

SEQ ID NO: 225555 - RNA, 22 nt, Shigella flexneri 2a str. 2457T
uuugcgauucaaaaggcguuau

SEQ ID NO: 225556 - RNA, 22 nt, Shigella flexneri 2a str. 2457T
acuacuucauuaugagcaaacu

SEQ ID NO: 225557 - RNA, 22 nt, Shigella flexneri 2a str. 2457T
auuggcaaucaucacgucguuu

SEQ ID NO: 225558 - RNA, 22 nt, Shigella flexneri 2a str. 2457T
aucuuggcgguucugcggguau

SEQ ID NO: 225559 - RNA, 22 nt, Shigella flexneri 2a str. 2457T
uuguagccaucauuuagcgcuu

SEQ ID NO: 225560 - RNA, 22 nt, Shigella flexneri 2a str. 2457T
uuagcaucuuuuguucagcugg

SEQ ID NO: 225561 - RNA, 22 nt, Shigella flexneri 2a str. 2457T
aacagguuacggucgccguaaa

SEQ ID NO: 225562 - RNA, 22 nt, Shigella flexneri 2a str. 2457T
cggaugucuuccuguugccauc

SEQ ID NO: 225563 - RNA, 22 nt, Shigella flexneri 2a str. 2457T
guucgaaaagcaaaaaggccau

SEQ ID NO: 225564 - RNA, 22 nt, Shigella flexneri 2a str. 2457T
ucagccgcaggaguugccguug

SEQ ID NO: 225565 - RNA, 22 nt, Shigella flexneri 2a str. 2457T
ucucugcgauaaaaccgccugu

SEQ ID NO: 225566 - RNA, 22 nt, Shigella flexneri 2a str. 2457T
uucgguauuggucuggcgaaug

SEQ ID NO: 225567 - RNA, 22 nt, Shigella flexneri 2a str. 2457T
uacaucaacaaacuccgacgcc

SEQ ID NO: 225568 - RNA, 22 nt, Shigella flexneri 2a str. 2457T
ugauuaugucuggaacacggug

SEQ ID NO: 225569 - RNA, 22 nt, Shigella flexneri 2a str. 2457T
ugcaagugaaaaagagcggcau

SEQ ID NO: 225570 - RNA, 22 nt, Shigella flexneri 2a str. 2457T
cgguuaaagauauucgcguguu

SEQ ID NO: 225571 - RNA, 22 nt, Shigella flexneri 2a str. 2457T
ucaucgucgaguugcagguuca

SEQ ID NO: 225572 - RNA, 22 nt, Shigella flexneri 2a str. 2457T
uacgcgucuuaucaggccuacg

SEQ ID NO: 225573 - RNA, 22 nt, Shigella flexneri 2a str. 2457T
gugagcguauuggugaauugca

SEQ ID NO: 225574 - RNA, 22 nt, Shigella flexneri 2a str. 2457T
aagcgucgaucccgcucggugg

SEQ ID NO: 225575 - RNA, 22 nt, Shigella flexneri 2a str. 2457T
cucgcguaauuuauccggcagg

SEQ ID NO: 225576 - RNA, 22 nt, Shigella flexneri 2a str. 2457T
uacuggauuggcccgccgggcg

SEQ ID NO: 225577 - RNA, 22 nt, Shigella flexneri 2a str. 2457T
ccgcugauugaaaggaugcguu

SEQ ID NO: 225578 - RNA, 22 nt, Shigella flexneri 2a str. 2457T
ccauccgcugacugacggcgac

SEQ ID NO: 225579 - RNA, 22 nt, Shigella flexneri 2a str. 2457T
ugcucaaauccgcguucaagga

SEQ ID NO: 225580 - RNA, 21 nt, Shigella flexneri 2a str. 2457T
acguauugauacuugaggggc

SEQ ID NO: 225581 - RNA, 22 nt, Shigella flexneri 2a str. 2457T
augcuggcugaaaacaccgcgg

SEQ ID NO: 225582 - RNA, 20 nt, Shigella flexneri 2a str. 2457T
gguaagugaagggaguguga

SEQ ID NO: 225583 - RNA, 22 nt, Shigella flexneri 2a str. 2457T
acccgucagaaugccgggcgau

SEQ ID NO: 225584 - RNA, 22 nt, Shigella flexneri 2a str. 2457T
uugcuaccaaaccucaugggug

SEQ ID NO: 225585 - RNA, 22 nt, Shigella flexneri 2a str. 2457T
aaucagcgguaucguuuccuuc

SEQ ID NO: 225586 - RNA, 22 nt, Shigella flexneri 2a str. 2457T
aagguguuaaacuggaaaaccg

SEQ ID NO: 225587 - RNA, 22 nt, Shigella flexneri 2a str. 2457T
agaauggcguaucggagcggug

SEQ ID NO: 225588 - RNA, 22 nt, Shigella flexneri 2a str. 2457T
ucgguucugguucuuuaaccgg

SEQ ID NO: 225589 - RNA, 22 nt, Shigella flexneri 2a str. 2457T
ugcggugauugaacguaguauc

SEQ ID NO: 225590 - RNA, 22 nt, Shigella flexneri 2a str. 2457T
ggugacuguacuggaaggucug

SEQ ID NO: 225591 - RNA, 19 nt, Shigella flexneri 2a str. 2457T
uuguucgcgcgguaaucgc

SEQ ID NO: 225592 - RNA, 22 nt, Shigella flexneri 2a str. 2457T
uuugccgaaaguggacgguaaa

SEQ ID NO: 225593 - RNA, 22 nt, Shigella flexneri 2a str. 2457T
cggauuuacgcguggugcagau

SEQ ID NO: 225594 - RNA, 22 nt, Shigella flexneri 2a str. 2457T
cagcagugccaguucauggcau

SEQ ID NO: 225595 - RNA, 22 nt, Shigella flexneri 2a str. 2457T
agaugguuccggcguucgauaa

SEQ ID NO: 225596 - RNA, 22 nt, Shigella flexneri 2a str. 2457T
ucgccaaccugcaguuuauagu

SEQ ID NO: 225597 - RNA, 22 nt, Shigella flexneri 2a str. 2457T
aggucaaugcguuugagaaugu

SEQ ID NO: 225598 - RNA, 22 nt, Shigella flexneri 2a str. 2457T
auccggcaugaagcaacguauu

SEQ ID NO: 225599 - RNA, 22 nt, Shigella flexneri 2a str. 2457T
aaucguguaaaccggucguuac

SEQ ID NO: 225600 - RNA, 22 nt, Shigella flexneri 2a str. 2457T
accaggaccaaaacgaaaagag

SEQ ID NO: 225601 - RNA, 21 nt, Shigella flexneri 2a str. 2457T
uuaucgacgagcagaaagccu

SEQ ID NO: 225602 - RNA, 22 nt, Shigella flexneri 2a str. 2457T
gcgcacugcucgaaggcuuucg

SEQ ID NO: 225603 - RNA, 22 nt, Shigella flexneri 2a str. 2457T
gccgaucgacaguggcguuauu

SEQ ID NO: 225604 - RNA, 22 nt, Shigella flexneri 2a str. 2457T
uauccacugugcgccagccuuc

SEQ ID NO: 225605 - RNA, 22 nt, Shigella flexneri 2a str. 2457T
gagguaaucugaaaaaggugca

SEQ ID NO: 225606 - RNA, 22 nt, Shigella flexneri 2a str. 2457T
cgcaugauaucccgcagguggc

SEQ ID NO: 225607 - RNA, 21 nt, Shigella flexneri 2a str. 2457T
gucgcgucuucucgcggauga

SEQ ID NO: 225608 - RNA, 22 nt, Shigella flexneri 2a str. 2457T
gaauuucauugcuuucuucugu

SEQ ID NO: 225609 - RNA, 22 nt, Shigella flexneri 2a str. 2457T
gcagguuugcaaaaaugguacg

SEQ ID NO: 225610 - RNA, 23 nt, Shigella flexneri 2a str. 2457T
ugcuggcgagagagugucagguu

SEQ ID NO: 225611 - RNA, 22 nt, Shigella flexneri 2a str. 2457T
uugcgcuccugucaugugcauu

SEQ ID NO: 225612 - RNA, 22 nt, Shigella flexneri 2a str. 2457T
gcgauuauucaccccacguuug

SEQ ID NO: 225613 - RNA, 22 nt, Shigella flexneri 2a str. 2457T
agcaguuucguggcggcaccga

SEQ ID NO: 225614 - RNA, 22 nt, Shigella flexneri 2a str. 2457T
ggugauagcguuccugcaauuc

SEQ ID NO: 225615 - RNA, 19 nt, Shigella flexneri 2a str. 2457T
agguaaacgucgucugguu

SEQ ID NO: 225616 - RNA, 22 nt, Shigella flexneri 2a str. 2457T
gagacgugcaaucucgguagac

SEQ ID NO: 225617 - RNA, 21 nt, Shigella flexneri 2a str. 2457T
aucacgauccgcgcguugcag

SEQ ID NO: 225618 - RNA, 22 nt, Shigella flexneri 2a str. 2457T
gguauucgcuuugccuuuacga

SEQ ID NO: 225619 - RNA, 22 nt, Shigella flexneri 2a str. 2457T
cgugcgugcaggugacaucguu

SEQ ID NO: 225620 - RNA, 22 nt, Shigella flexneri 2a str. 2457T
cugccaguagugccauuguggu

SEQ ID NO: 225621 - RNA, 22 nt, Shigella flexneri 2a str. 2457T
aguggcgcagggcgaugauguu

SEQ ID NO: 225622 - RNA, 22 nt, Shigella flexneri 2a str. 2457T
caggcuuucugcucgucgauaa

SEQ ID NO: 225623 - RNA, 22 nt, Shigella flexneri 2a str. 2457T
gacggcaccugguccaccggcg

SEQ ID NO: 225624 - RNA, 22 nt, Shigella flexneri 2a str. 2457T
gauaaucccugauucgcaguca

SEQ ID NO: 225625 - RNA, 22 nt, Shigella flexneri 2a str. 2457T
accguuucuugauggcgaguau

SEQ ID NO: 225626 - RNA, 22 nt, Shigella flexneri 2a str. 2457T
ucauaauggcgucagcacguuu

SEQ ID NO: 225627 - RNA, 22 nt, Shigella flexneri 2a str. 2457T
ugccucugauaauuagcuaagu

SEQ ID NO: 225628 - RNA, 22 nt, Shigella flexneri 2a str. 2457T
uuaaucagcgucuguuuacccu

SEQ ID NO: 225629 - RNA, 22 nt, Shigella flexneri 2a str. 2457T
aauggcggcaaucuggcuuuuc

SEQ ID NO: 225630 - RNA, 22 nt, Shigella flexneri 2a str. 2457T
uugcagcgucuuaucaggccua

SEQ ID NO: 225631 - RNA, 22 nt, Shigella flexneri 2a str. 2457T
gcggaucugcggaggcgcgguu

SEQ ID NO: 225632 - RNA, 22 nt, Shigella flexneri 2a str. 2457T
ggcacgguggauuuccggcagc

SEQ ID NO: 225633 - RNA, 18 nt, Shigella flexneri 2a str. 2457T
gaaaccgcaaugaaagcc

SEQ ID NO: 225634 - RNA, 22 nt, Shigella flexneri 2a str. 2457T
uagcaacuuccgcuuccaugac

SEQ ID NO: 225635 - RNA, 22 nt, Shigella flexneri 2a str. 2457T
uguaccuucaccguuggcggca

SEQ ID NO: 225636 - RNA, 22 nt, Shigella flexneri 2a str. 2457T
acugcaggacaacaguaaaauc

SEQ ID NO: 225637 - RNA, 22 nt, Shigella flexneri 2a str. 2457T
ugccgcucuucuuuaccgguug

SEQ ID NO: 225638 - RNA, 23 nt, Shigella flexneri 2a str. 2457T
gccgugcagucuuugcggcggaa

SEQ ID NO: 225639 - RNA, 22 nt, Shigella flexneri 2a str. 2457T
auuggcgcucagcggcugggca

SEQ ID NO: 225640 - RNA, 22 nt, Shigella flexneri 2a str. 2457T
uacgccuuauccggccuacggg

SEQ ID NO: 225641 - RNA, 22 nt, Shigella flexneri 2a str. 2457T
ggaauaccaucaauaucgugag

SEQ ID NO: 225642 - RNA, 21 nt, Shigella flexneri 2a str. 2457T
gccuggacagcagcugucugc

SEQ ID NO: 225643 - RNA, 21 nt, Shigella flexneri 2a str. 2457T
ugcucacgcagcacgucacgc

SEQ ID NO: 225644 - RNA, 23 nt, Shigella flexneri 2a str. 2457T
ucggcggugcgacggucgaauuu

SEQ ID NO: 225645 - RNA, 22 nt, Shigella flexneri 2a str. 2457T
cugccguuuacgggccugagcg

SEQ ID NO: 225646 - RNA, 22 nt, Shigella flexneri 2a str. 2457T
guaccagcgaagaacaacugcu

SEQ ID NO: 225647 - RNA, 22 nt, Shigella flexneri 2a str. 2457T
accggugcuuuaaaguguucuu

SEQ ID NO: 225648 - RNA, 22 nt, Shigella flexneri 2a str. 2457T
cuacgcuuaucaggccuacgca

SEQ ID NO: 225649 - RNA, 22 nt, Shigella flexneri 2a str. 2457T
cgaaagacggcugguuauucac

SEQ ID NO: 225650 - RNA, 23 nt, Shigella flexneri 2a str. 2457T
ggcuggagagcggguagucguau

SEQ ID NO: 225651 - RNA, 22 nt, Shigella flexneri 2a str. 2457T
gcguuaccggcuucgagaggca

SEQ ID NO: 225652 - RNA, 22 nt, Shigella flexneri 2a str. 2457T
augugcggacggccuucaugca

SEQ ID NO: 225653 - RNA, 22 nt, Shigella flexneri 2a str. 2457T
aaugcuugagaauuuguaggcc

SEQ ID NO: 225654 - RNA, 22 nt, Shigella flexneri 2a str. 2457T
cgguuacuggaagaaguggugu

SEQ ID NO: 225655 - RNA, 22 nt, Shigella flexneri 2a str. 2457T
cagauaagagugcauucccagc

SEQ ID NO: 225656 - RNA, 22 nt, Shigella flexneri 2a str. 2457T
ggcuuuccaguucaccagauug

SEQ ID NO: 225657 - RNA, 22 nt, Shigella flexneri 2a str. 2457T
cagcgaggcaccaucauugaga

SEQ ID NO: 225658 - RNA, 22 nt, Shigella flexneri 2a str. 2457T
uaucgagaucggcauacgccgu

SEQ ID NO: 225659 - RNA, 22 nt, Shigella flexneri 2a str. 2457T
ucaggcaaaugccaguaaaaac

SEQ ID NO: 225660 - RNA, 22 nt, Shigella flexneri 2a str. 2457T
ugcuagaacgucaucggcuacu

SEQ ID NO: 225661 - RNA, 22 nt, Shigella flexneri 2a str. 2457T
agauuggugucaaucauguguu

SEQ ID NO: 225662 - RNA, 22 nt, Shigella flexneri 2a str. 2457T
uaugcacugugaagauccgggc

SEQ ID NO: 225663 - RNA, 22 nt, Shigella flexneri 2a str. 2457T
gcguaaucggcaagcgaggaau

SEQ ID NO: 225664 - RNA, 22 nt, Shigella flexneri 2a str. 2457T
aagugcaacggcuugcagauca

SEQ ID NO: 225665 - RNA, 20 nt, Shigella flexneri 2a str. 2457T
aauugccugagaaucagcaa

SEQ ID NO: 225666 - RNA, 22 nt, Shigella flexneri 2a str. 2457T
uaccgguacucuguuacugcug

SEQ ID NO: 225667 - RNA, 22 nt, Shigella flexneri 2a str. 2457T
cugccaguuccgcugauuuacg

SEQ ID NO: 225668 - RNA, 22 nt, Shigella flexneri 2a str. 2457T
gcgcagugcgacgcuugagaau

SEQ ID NO: 225669 - RNA, 22 nt, Shigella flexneri 2a str. 2457T
ggauaucacgcugauuuacgcc

SEQ ID NO: 225670 - RNA, 22 nt, Shigella flexneri 2a str. 2457T
uuccgucgcacuggguguggcu

SEQ ID NO: 225671 - RNA, 22 nt, Shigella flexneri 2a str. 2457T
gagccggacuuuauugauauac

SEQ ID NO: 225672 - RNA, 22 nt, Shigella flexneri 2a str. 2457T
ugccgcuggcagcagguuuuuc

SEQ ID NO: 225673 - RNA, 22 nt, Shigella flexneri 2a str. 2457T
ggcaguggguacgcagcgccag

SEQ ID NO: 225674 - RNA, 20 nt, Shigella flexneri 2a str. 2457T
ugcugcugugacaguucgau

SEQ ID NO: 225675 - RNA, 22 nt, Shigella flexneri 2a str. 2457T
uacgugcccaauaucggcgcgg

SEQ ID NO: 225676 - RNA, 22 nt, Shigella flexneri 2a str. 2457T
aauggcgauuacauuguugauu

SEQ ID NO: 225677 - RNA, 22 nt, Shigella flexneri 2a str. 2457T
aggcucaguacgcagcugaaga

SEQ ID NO: 225678 - RNA, 22 nt, Shigella flexneri 2a str. 2457T
gagcgacguuugucacccaccg

SEQ ID NO: 225679 - RNA, 19 nt, Shigella flexneri 2a str. 2457T
ugcaggguuuuuaaucgga

SEQ ID NO: 225680 - RNA, 20 nt, Shigella flexneri 2a str. 2457T
uugcuaaccaacauauucgc

SEQ ID NO: 225681 - RNA, 22 nt, Shigella flexneri 2a str. 2457T
cucgacagaagccgugaagaga

SEQ ID NO: 225682 - RNA, 22 nt, Shigella flexneri 2a str. 2457T
ggaacuguucgccgugcaaauc

SEQ ID NO: 225683 - RNA, 23 nt, Shigella flexneri 2a str. 2457T
ugguugaccgcaguuuugccgcc

SEQ ID NO: 225684 - RNA, 22 nt, Shigella flexneri 2a str. 2457T
aauuacucauuguuuaaaaaga

SEQ ID NO: 225685 - RNA, 22 nt, Shigella flexneri 2a str. 2457T
gccgcagaucauuaucuggcag

SEQ ID NO: 225686 - RNA, 22 nt, Shigella flexneri 2a str. 2457T
uuucaucgcggucagcugcugu

SEQ ID NO: 225687 - RNA, 22 nt, Shigella flexneri 2a str. 2457T
gcauucaucaugguucucgguu

SEQ ID NO: 225688 - RNA, 22 nt, Shigella flexneri 2a str. 2457T
gaucaggaauugcuuacuuggu

SEQ ID NO: 225689 - RNA, 22 nt, Shigella flexneri 2a str. 2457T
auugcuguuaacgcuggugcug

SEQ ID NO: 225690 - RNA, 22 nt, Shigella flexneri 2a str. 2457T
cgcuaucaggggaugguagggc

SEQ ID NO: 225691 - RNA, 22 nt, Shigella flexneri 2a str. 2457T
ugauagcgcggcuggucgaugg

SEQ ID NO: 225692 - RNA, 22 nt, Shigella flexneri 2a str. 2457T
gugauugaagagcaagaacgga

SEQ ID NO: 225693 - RNA, 22 nt, Shigella flexneri 2a str. 2457T
gugauuauggaugaaccgacuu

SEQ ID NO: 225694 - RNA, 22 nt, Shigella flexneri 2a str. 2457T
ggcuggauauuauggcgcuggu

SEQ ID NO: 225695 - RNA, 16 nt, Shigella flexneri 2a str. 2457T
agccggauggucgcgu

SEQ ID NO: 225696 - RNA, 22 nt, Shigella flexneri 2a str. 2457T
auucucugccaguacguugaau

SEQ ID NO: 225697 - RNA, 22 nt, Shigella flexneri 2a str. 2457T
agucaugaauucacuacguccg

SEQ ID NO: 225698 - RNA, 22 nt, Shigella flexneri 2a str. 2457T
auacaccgggccugcauaugga

SEQ ID NO: 225699 - RNA, 22 nt, Shigella flexneri 2a str. 2457T
gaguuuaucuucuacuacguga

SEQ ID NO: 225700 - RNA, 22 nt, Shigella flexneri 2a str. 2457T
agugacgugauaaucgcuggaa

SEQ ID NO: 225701 - RNA, 22 nt, Shigella flexneri 2a str. 2457T
gugggaauacgugucagcgauc

SEQ ID NO: 225702 - RNA, 23 nt, Shigella flexneri 2a str. 2457T
ggccauugacgcaucgcccgguu

SEQ ID NO: 225703 - RNA, 22 nt, Shigella flexneri 2a str. 2457T
ccugaucuuuaccaugguguac

SEQ ID NO: 225704 - RNA, 21 nt, Shigella flexneri 2a str. 2457T
agcguuauggcguacgucugc

SEQ ID NO: 225705 - RNA, 22 nt, Shigella flexneri 2a str. 2457T
gcgauacaacuggucgaauaau

SEQ ID NO: 225706 - RNA, 22 nt, Shigella flexneri 2a str. 2457T
aaacugcaaaaaugcccggcgg

SEQ ID NO: 225707 - RNA, 22 nt, Shigella flexneri 2a str. 2457T
uacgugccugaaaugcgcgaga

SEQ ID NO: 225708 - RNA, 22 nt, Shigella flexneri 2a str. 2457T
gggacauaaccacgggcauuac

SEQ ID NO: 225709 - RNA, 22 nt, Shigella flexneri 2a str. 2457T
ccauugucagguauaucgaugu

SEQ ID NO: 225710 - RNA, 18 nt, Shigella flexneri 2a str. 2457T
gagauuguugaagaauuc

SEQ ID NO: 225711 - RNA, 22 nt, Shigella flexneri 2a str. 2457T
gcuuugcugaaaucgauacgga

SEQ ID NO: 225712 - RNA, 18 nt, Shigella flexneri 2a str. 2457T
accgaccugcgcugacgc

SEQ ID NO: 225713 - RNA, 22 nt, Shigella flexneri 2a str. 2457T
ggcuuucaguauuuguggcaau

SEQ ID NO: 225714 - RNA, 22 nt, Shigella flexneri 2a str. 2457T
ugaaguauagccaagacaaccc

SEQ ID NO: 225715 - RNA, 18 nt, Shigella flexneri 2a str. 2457T
uucugggcggcgauuucu

SEQ ID NO: 225716 - RNA, 22 nt, Shigella flexneri 2a str. 2457T
cugcgcaaaugcagguuguuga

SEQ ID NO: 225717 - RNA, 22 nt, Shigella flexneri 2a str. 2457T
auccaauggcaguagauaaacu

SEQ ID NO: 225718 - RNA, 22 nt, Shigella flexneri 2a str. 2457T
aucaguaaguuggagucauuac

SEQ ID NO: 225719 - RNA, 22 nt, Shigella flexneri 2a str. 2457T
augcuggcagucacuggugggc

SEQ ID NO: 225720 - RNA, 22 nt, Shigella flexneri 2a str. 2457T
aaucacuggcgcaaggagcgcg

SEQ ID NO: 225721 - RNA, 22 nt, Shigella flexneri 2a str. 2457T
agacgcgaugcauugcucugaa

SEQ ID NO: 225722 - RNA, 22 nt, Shigella flexneri 2a str. 2457T
uugcucugguuguaugcguagu

SEQ ID NO: 225723 - RNA, 22 nt, Shigella flexneri 2a str. 2457T
caguuaguguuucgcguugaga

SEQ ID NO: 225724 - RNA, 22 nt, Shigella flexneri 2a str. 2457T
cuggcgauggucggugauggua

SEQ ID NO: 225725 - RNA, 22 nt, Shigella flexneri 2a str. 2457T
ugagaacggacguuugucgcgc

SEQ ID NO: 225726 - RNA, 22 nt, Shigella flexneri 2a str. 2457T
gagcacggcuugcgcugcuuca

SEQ ID NO: 225727 - RNA, 22 nt, Shigella flexneri 2a str. 2457T
acuccagcaccuguuugaucug

SEQ ID NO: 225728 - RNA, 22 nt, Shigella flexneri 2a str. 2457T
gcgaugggcaaaaagcaucuga

SEQ ID NO: 225729 - RNA, 22 nt, Shigella flexneri 2a str. 2457T
gcugcgcuuaucaggccuacag

SEQ ID NO: 225730 - RNA, 22 nt, Shigella flexneri 2a str. 2457T
cggaaggcgauaaagcgauuga

SEQ ID NO: 225731 - RNA, 22 nt, Shigella flexneri 2a str. 2457T
cgucacgcugguggaucagggc

SEQ ID NO: 225732 - RNA, 22 nt, Shigella flexneri 2a str. 2457T
augcaacugcacagccagauca

SEQ ID NO: 225733 - RNA, 22 nt, Shigella flexneri 2a str. 2457T
aggcuuugugcucuucugugaa

SEQ ID NO: 225734 - RNA, 22 nt, Shigella flexneri 2a str. 2457T
caguauuugccgccagagauga

SEQ ID NO: 225735 - RNA, 22 nt, Shigella flexneri 2a str. 2457T
cauccugagaagcuugcaguga

SEQ ID NO: 225736 - RNA, 22 nt, Shigella flexneri 2a str. 2457T
ugcugaguuuccgcgcuuaucu

SEQ ID NO: 225737 - RNA, 22 nt, Shigella flexneri 2a str. 2457T
ucauggcgaucaggugcuggcg

SEQ ID NO: 225738 - RNA, 22 nt, Shigella flexneri 2a str. 2457T
ucaggucguucugccacgaacu

SEQ ID NO: 225739 - RNA, 22 nt, Shigella flexneri 2a str. 2457T
guugcagcguuuucggcaacgc

SEQ ID NO: 225740 - RNA, 22 nt, Shigella flexneri 2a str. 2457T
auuacugaugaccagugcgccc

SEQ ID NO: 225741 - RNA, 21 nt, Shigella flexneri 2a str. 2457T
aaacucucggggucagcgagg

SEQ ID NO: 225742 - RNA, 22 nt, Shigella flexneri 2a str. 2457T
cugagaagugaugcugucagca

SEQ ID NO: 225743 - RNA, 19 nt, Shigella flexneri 2a str. 2457T
cuugcggugaagaagaggu

SEQ ID NO: 225744 - RNA, 22 nt, Shigella flexneri 2a str. 2457T
auggcgaucagaucauguauau

SEQ ID NO: 225745 - RNA, 22 nt, Shigella flexneri 2a str. 2457T
ccgcguacuggcgcuggauaug

SEQ ID NO: 225746 - RNA, 22 nt, Shigella flexneri 2a str. 2457T
caagauacgaaacgggugcuga

SEQ ID NO: 225747 - RNA, 22 nt, Shigella flexneri 2a str. 2457T
gugagcaaacgcaaaaagccgu

SEQ ID NO: 225748 - RNA, 20 nt, Shigella flexneri 2a str. 2457T
auucgccgucuguugcuggu

SEQ ID NO: 225749 - RNA, 21 nt, Shigella flexneri 2a str. 2457T
caucuugcuggcgcgcgauau

SEQ ID NO: 225750 - RNA, 22 nt, Shigella flexneri 2a str. 2457T
caucguuuccgauggaagcaua

SEQ ID NO: 225751 - RNA, 23 nt, Shigella flexneri 2a str. 2457T
accagccgggauucagcgcagga

SEQ ID NO: 225752 - RNA, 22 nt, Shigella flexneri 2a str. 2457T
cggucaccuggauccagccugc

SEQ ID NO: 225753 - RNA, 20 nt, Shigella flexneri 2a str. 2457T
gaguggcaucuuccugcuga

SEQ ID NO: 225754 - RNA, 22 nt, Shigella flexneri 2a str. 2457T
cgguugcuuucgucgagaaugu

SEQ ID NO: 225755 - RNA, 20 nt, Shigella flexneri 2a str. 2457T
gaugauggacggcaacagcg

SEQ ID NO: 225756 - RNA, 22 nt, Shigella flexneri 2a str. 2457T
uucugaaaacaaccgaugguaa

SEQ ID NO: 225757 - RNA, 22 nt, Shigella flexneri 2a str. 2457T
gggucgcuacaaccugcaucuu

SEQ ID NO: 225758 - RNA, 22 nt, Shigella flexneri 2a str. 2457T
aucuuugcacugcuuaaccaug

SEQ ID NO: 225759 - RNA, 22 nt, Shigella flexneri 2a str. 2457T
uucgcggaauguguucgcugau

SEQ ID NO: 225760 - RNA, 22 nt, Shigella flexneri 2a str. 2457T
aucgguaaauuagccgcgcgug

SEQ ID NO: 225761 - RNA, 22 nt, Shigella flexneri 2a str. 2457T
accgggugaugcaaaaguagcc

SEQ ID NO: 225762 - RNA, 22 nt, Shigella flexneri 2a str. 2457T
ugcauugcugguacuuucacag

SEQ ID NO: 225763 - RNA, 22 nt, Shigella flexneri 2a str. 2457T
cguguugccugccgcgucggua

SEQ ID NO: 225764 - RNA, 22 nt, Shigella flexneri 2a str. 2457T
gagcauucccauaaacucagau

SEQ ID NO: 225765 - RNA, 22 nt, Shigella flexneri 2a str. 2457T
aacgucggcaucgcggaaggcu

SEQ ID NO: 225766 - RNA, 22 nt, Shigella flexneri 2a str. 2457T
ucaccacguuucaggacaaacg

SEQ ID NO: 225767 - RNA, 22 nt, Shigella flexneri 2a str. 2457T
ccuggcugcaggaacaccaugu

SEQ ID NO: 225768 - RNA, 23 nt, Shigella flexneri 2a str. 2457T
uugcagaauuuucguaggccuga

SEQ ID NO: 225769 - RNA, 22 nt, Shigella flexneri 2a str. 2457T
cggaaugcuggacuuguugugu

SEQ ID NO: 225770 - RNA, 23 nt, Shigella flexneri 2a str. 2457T
acgaugaagccuuccugcaacag

SEQ ID NO: 225771 - RNA, 22 nt, Shigella flexneri 2a str. 2457T
aucugacggauaaaaaucgcga

SEQ ID NO: 225772 - RNA, 22 nt, Shigella flexneri 2a str. 2457T
ggccguugagauccuuuacaac

SEQ ID NO: 225773 - RNA, 23 nt, Shigella flexneri 2a str. 2457T
uggagugaaacgauggcgauugc

SEQ ID NO: 225774 - RNA, 22 nt, Shigella flexneri 2a str. 2457T
auccaguucgauuucccgcgga

SEQ ID NO: 225775 - RNA, 22 nt, Shigella flexneri 2a str. 2457T
ugcuccauggugggaucggguu

SEQ ID NO: 225776 - RNA, 22 nt, Shigella flexneri 2a str. 2457T
aaaggcguuauuauuaauugcc

SEQ ID NO: 225777 - RNA, 20 nt, Shigella flexneri 2a str. 2457T
acugcacgugucucaggaug

SEQ ID NO: 225778 - RNA, 22 nt, Shigella flexneri 2a str. 2457T
aagaugauguuaagcugcuaaa

SEQ ID NO: 225779 - RNA, 22 nt, Shigella flexneri 2a str. 2457T
uauugcuggugugaaggucugg

SEQ ID NO: 225780 - RNA, 22 nt, Shigella flexneri 2a str. 2457T
cggagcgaaacggcacaaccau

SEQ ID NO: 225781 - RNA, 22 nt, Shigella flexneri 2a str. 2457T
guuaucgacguauuccagacgg

SEQ ID NO: 225782 - RNA, 22 nt, Shigella flexneri 2a str. 2457T
acagagauguuuaauccuggcg

SEQ ID NO: 225783 - RNA, 22 nt, Shigella flexneri 2a str. 2457T
aggccgcaucaucgcuugcgau

SEQ ID NO: 225784 - RNA, 22 nt, Shigella flexneri 2a str. 2457T
uucgcaagugacaucuuuuggc

SEQ ID NO: 225785 - RNA, 20 nt, Shigella flexneri 2a str. 2457T
acgucgauaauauuauuuuc

SEQ ID NO: 225786 - RNA, 22 nt, Shigella flexneri 2a str. 2457T
cucguucacguaucaccgcauc

SEQ ID NO: 225787 - RNA, 17 nt, Shigella flexneri 2a str. 2457T
augguugcuuuuugcug

SEQ ID NO: 225788 - RNA, 22 nt, Shigella flexneri 2a str. 2457T
cgaacuggagcgggcguugagu

SEQ ID NO: 225789 - RNA, 22 nt, Shigella flexneri 2a str. 2457T
cgcuguaugccaucugcgcauc

SEQ ID NO: 225790 - RNA, 22 nt, Shigella flexneri 2a str. 2457T
ugcugcacgccggucauaauga

SEQ ID NO: 225791 - RNA, 22 nt, Shigella flexneri 2a str. 2457T
ccgguuagaagaaugcuauucg

SEQ ID NO: 225792 - RNA, 22 nt, Shigella flexneri 2a str. 2457T
agcgugugaaugccgauaucgu

SEQ ID NO: 225793 - RNA, 22 nt, Shigella flexneri 2a str. 2457T
ucggugcuaaaucacgucagcg

SEQ ID NO: 225794 - RNA, 22 nt, Shigella flexneri 2a str. 2457T
ucgcuuugauggcugcggcauu

SEQ ID NO: 225795 - RNA, 22 nt, Shigella flexneri 2a str. 2457T
cgcggcaaugaaaucagcuauu

SEQ ID NO: 225796 - RNA, 22 nt, Shigella flexneri 2a str. 2457T
uaaucccgauugaagagaaguu

SEQ ID NO: 225797 - RNA, 22 nt, Shigella flexneri 2a str. 2457T
gcaagcugguucagguucgucg

SEQ ID NO: 225798 - RNA, 22 nt, Shigella flexneri 2a str. 2457T
acggcgguauacaucgcgguga

SEQ ID NO: 225799 - RNA, 22 nt, Shigella flexneri 2a str. 2457T
gcugccguaugccguggcuccc

SEQ ID NO: 225800 - RNA, 20 nt, Shigella flexneri 2a str. 2457T
uguggcgcaguauuccgcac

SEQ ID NO: 225801 - RNA, 22 nt, Shigella flexneri 2a str. 2457T
uccagcaaauugugauagcgca

SEQ ID NO: 225802 - RNA, 22 nt, Shigella flexneri 2a str. 2457T
agcagcacggugaauaucagcg

SEQ ID NO: 225803 - RNA, 22 nt, Shigella flexneri 2a str. 2457T
ucguuauucuucgguaucggca

SEQ ID NO: 225804 - RNA, 22 nt, Shigella flexneri 2a str. 2457T
aggaauauucaggcucugacug

SEQ ID NO: 225805 - RNA, 22 nt, Shigella flexneri 2a str. 2457T
gcgucuggcauuaggaacgcug

SEQ ID NO: 225806 - RNA, 19 nt, Shigella flexneri 2a str. 2457T
ccagguuggcguccagcug

SEQ ID NO: 225807 - RNA, 22 nt, Shigella flexneri 2a str. 2457T
cggcugauuguguaaugcacag

SEQ ID NO: 225808 - RNA, 22 nt, Shigella flexneri 2a str. 2457T
ucgaucucuauuccgacguuga

SEQ ID NO: 225809 - RNA, 22 nt, Shigella flexneri 2a str. 2457T
ucguuaaucgccaguuucugcc

SEQ ID NO: 225810 - RNA, 22 nt, Shigella flexneri 2a str. 2457T
uacugccauuuucgccaaaugg

SEQ ID NO: 225811 - RNA, 21 nt, Shigella flexneri 2a str. 2457T
gcgauugcuuagugccugcgc

SEQ ID NO: 225812 - RNA, 22 nt, Shigella flexneri 2a str. 2457T
uacccgcgugcuggcagggaug

SEQ ID NO: 225813 - RNA, 22 nt, Shigella flexneri 2a str. 2457T
acgucagcgcuggcuguuuuac

SEQ ID NO: 225814 - RNA, 22 nt, Shigella flexneri 2a str. 2457T
aagcuggaucucugaaaggauu

SEQ ID NO: 225815 - RNA, 22 nt, Shigella flexneri 2a str. 2457T
ucugguaaucgcaacuuuggug

SEQ ID NO: 225816 - RNA, 22 nt, Shigella flexneri 2a str. 2457T
auggaugcuugucgggaaguga

SEQ ID NO: 225817 - RNA, 20 nt, Shigella flexneri 2a str. 2457T
ucgacggcaaauuugugcag

SEQ ID NO: 225818 - RNA, 22 nt, Shigella flexneri 2a str. 2457T
acuuccugcuguaaagucgguu

SEQ ID NO: 225819 - RNA, 22 nt, Shigella flexneri 2a str. 2457T
aguggcaacgcugcguugaagc

SEQ ID NO: 225820 - RNA, 20 nt, Shigella flexneri 2a str. 2457T
cucgcguccgcgauagcgua

SEQ ID NO: 225821 - RNA, 22 nt, Shigella flexneri 2a str. 2457T
uggcauuuugccuuuaggaugu

SEQ ID NO: 225822 - RNA, 20 nt, Shigella flexneri 2a str. 2457T
ugguuaccggcaaaacaauc

SEQ ID NO: 225823 - RNA, 22 nt, Shigella flexneri 2a str. 2457T
uuagccgaccagguggcgauga

SEQ ID NO: 225824 - RNA, 22 nt, Shigella flexneri 2a str. 2457T
aaaucgcauaccaaucacgggc

SEQ ID NO: 225825 - RNA, 22 nt, Shigella flexneri 2a str. 2457T
gauuaucaccuguugcccuuug

SEQ ID NO: 225826 - RNA, 22 nt, Shigella flexneri 2a str. 2457T
gcugcacguucagccgcugcac

SEQ ID NO: 225827 - RNA, 22 nt, Shigella flexneri 2a str. 2457T
cagcgaugaggaaccauccugg

SEQ ID NO: 225828 - RNA, 20 nt, Shigella flexneri 2a str. 2457T
uuucaucggcguuagcccag

SEQ ID NO: 225829 - RNA, 22 nt, Shigella flexneri 2a str. 2457T
uggcaauuggugagcuaagcgu

SEQ ID NO: 225830 - RNA, 22 nt, Shigella flexneri 2a str. 2457T
aaugcgcugguugaaguguuac

SEQ ID NO: 225831 - RNA, 22 nt, Shigella flexneri 2a str. 2457T
gcacggcagcauguugacccug

SEQ ID NO: 225832 - RNA, 22 nt, Shigella flexneri 2a str. 2457T
gucagcaccagggugaucgcuu

SEQ ID NO: 225833 - RNA, 22 nt, Shigella flexneri 2a str. 2457T
caagaauuuauuucugguuauu

SEQ ID NO: 225834 - RNA, 22 nt, Shigella flexneri 2a str. 2457T
ugucguucugccgucaguaucu

SEQ ID NO: 225835 - RNA, 22 nt, Shigella flexneri 2a str. 2457T
ggaaugaugugauacgccccgg

SEQ ID NO: 225836 - RNA, 22 nt, Shigella flexneri 2a str. 2457T
auugucaucgcagguggccagg

SEQ ID NO: 225837 - RNA, 22 nt, Shigella flexneri 2a str. 2457T
agcagacaaacagcgucgaggu

SEQ ID NO: 225838 - RNA, 22 nt, Shigella flexneri 2a str. 2457T
ccagauggcgauggcgcuagcg

SEQ ID NO: 225839 - RNA, 22 nt, Shigella flexneri 2a str. 2457T
ccguauugauggcaacgcacga

SEQ ID NO: 225840 - RNA, 22 nt, Shigella flexneri 2a str. 2457T
cgucuggagguguuguaucagu

SEQ ID NO: 225841 - RNA, 22 nt, Shigella flexneri 2a str. 2457T
aacgcgguaauaaguuugucgg

SEQ ID NO: 225842 - RNA, 23 nt, Shigella flexneri 2a str. 2457T
uacucggcagcauuuuuaaccgg

SEQ ID NO: 225843 - RNA, 21 nt, Shigella flexneri 2a str. 2457T
aacugcuccauucguuguuga

SEQ ID NO: 225844 - RNA, 22 nt, Shigella flexneri 2a str. 2457T
gcuucgucaaaauguacgguau

SEQ ID NO: 225845 - RNA, 22 nt, Shigella flexneri 2a str. 2457T
cgucgaguacuucguggaaggc

SEQ ID NO: 225846 - RNA, 21 nt, Shigella flexneri 2a str. 2457T
cgggaacaucguuaccucuga

SEQ ID NO: 225847 - RNA, 22 nt, Shigella flexneri 2a str. 2457T
gugucgaugauaugcagcggca

SEQ ID NO: 225848 - RNA, 22 nt, Shigella flexneri 2a str. 2457T
ugucugucucugggccuugaua

SEQ ID NO: 225849 - RNA, 22 nt, Shigella flexneri 2a str. 2457T
ucgcgccauuauggaacgcuug

SEQ ID NO: 225850 - RNA, 22 nt, Shigella flexneri 2a str. 2457T
caaacguggggugaauaaucgc

SEQ ID NO: 225851 - RNA, 22 nt, Shigella flexneri 2a str. 2457T
aucacgaugguggaaaucgaug

SEQ ID NO: 225852 - RNA, 22 nt, Shigella flexneri 2a str. 2457T
uucgagagucagugguacgucu

SEQ ID NO: 225853 - RNA, 22 nt, Shigella flexneri 2a str. 2457T
augcgacgcggaagcgucuuau

SEQ ID NO: 225854 - RNA, 17 nt, Shigella flexneri 2a str. 2457T
gcaccgugcagcucuug

SEQ ID NO: 225855 - RNA, 22 nt, Shigella flexneri 2a str. 2457T
gcuccagucuucacuuuucgac

SEQ ID NO: 225856 - RNA, 22 nt, Shigella flexneri 2a str. 2457T
uccggcauggcauuuuuauuug

SEQ ID NO: 225857 - RNA, 22 nt, Shigella flexneri 2a str. 2457T
ggcauguucccaagccagaugu

SEQ ID NO: 225858 - RNA, 22 nt, Shigella flexneri 2a str. 2457T
gaucaucugucaacugacguga

SEQ ID NO: 225859 - RNA, 22 nt, Shigella flexneri 2a str. 2457T
ucugagcguaccaaauauuauu

SEQ ID NO: 225860 - RNA, 22 nt, Shigella flexneri 2a str. 2457T
acaggcaguugcguagauuucu

SEQ ID NO: 225861 - RNA, 20 nt, Shigella flexneri 2a str. 2457T
aucuggcauaaacaaagcgc

SEQ ID NO: 225862 - RNA, 22 nt, Shigella flexneri 2a str. 2457T
aguaucgacuacacccugccgc

SEQ ID NO: 225863 - RNA, 22 nt, Shigella flexneri 2a str. 2457T
gcgggugaugacauucuugcug

SEQ ID NO: 225864 - RNA, 22 nt, Shigella flexneri 2a str. 2457T
gccguuagcaucuuuaacgauc

SEQ ID NO: 225865 - RNA, 22 nt, Shigella flexneri 2a str. 2457T
uguuugccagcgauaugaguaa

SEQ ID NO: 225866 - RNA, 22 nt, Shigella flexneri 2a str. 2457T
aggccggauaagcgaagcgcau

SEQ ID NO: 225867 - RNA, 22 nt, Shigella flexneri 2a str. 2457T
gcguuucuucgaaaaagaacug

SEQ ID NO: 225868 - RNA, 22 nt, Shigella flexneri 2a str. 2457T
cgacuacguuaacacucgccga

SEQ ID NO: 225869 - RNA, 22 nt, Shigella flexneri 2a str. 2457T
uuacccggcgcaggcggugaag

SEQ ID NO: 225870 - RNA, 22 nt, Shigella flexneri 2a str. 2457T
gucgaaauguguuuauaaagua

SEQ ID NO: 225871 - RNA, 22 nt, Shigella flexneri 2a str. 2457T
acgguaaaaaaugccgugcgca

SEQ ID NO: 225872 - RNA, 22 nt, Shigella flexneri 2a str. 2457T
gugugcaaagacugauagccgu

SEQ ID NO: 225873 - RNA, 22 nt, Shigella flexneri 2a str. 2457T
aucccuauaacaguagaacccu

SEQ ID NO: 225874 - RNA, 22 nt, Shigella flexneri 2a str. 2457T
ugaugucagccugauuuugcgu

SEQ ID NO: 225875 - RNA, 22 nt, Shigella flexneri 2a str. 2457T
cugacagauguggcacuucccg

SEQ ID NO: 225876 - RNA, 22 nt, Shigella flexneri 2a str. 2457T
ggucauugacaaugcugccgcu

SEQ ID NO: 225877 - RNA, 22 nt, Shigella flexneri 2a str. 2457T
cuugccgugacaaauaaugaug

SEQ ID NO: 225878 - RNA, 22 nt, Shigella flexneri 2a str. 2457T
ugccgccaucgggauugcuaug

SEQ ID NO: 225879 - RNA, 22 nt, Shigella flexneri 2a str. 2457T
uagaagacucggucacucaggu

SEQ ID NO: 225880 - RNA, 22 nt, Shigella flexneri 2a str. 2457T
ucgcggcuuuggugaagcggaa

SEQ ID NO: 225881 - RNA, 22 nt, Shigella flexneri 2a str. 2457T
uaccgugggaagucugcuuggc

SEQ ID NO: 225882 - RNA, 19 nt, Shigella flexneri 2a str. 2457T
uaaucugcguggaaaguau

SEQ ID NO: 225883 - RNA, 22 nt, Shigella flexneri 2a str. 2457T
uacgacgcacuuuaugaggucc

SEQ ID NO: 225884 - RNA, 22 nt, Shigella flexneri 2a str. 2457T
cgaccgauuucguaacgcggcu

SEQ ID NO: 225885 - RNA, 22 nt, Shigella flexneri 2a str. 2457T
cguccggucgggcaggugugcu

SEQ ID NO: 225886 - RNA, 22 nt, Shigella flexneri 2a str. 2457T
cguaccaucaccgacguguuug

SEQ ID NO: 225887 - RNA, 22 nt, Shigella flexneri 2a str. 2457T
gaugccguuuuagacgcgaucc

SEQ ID NO: 225888 - RNA, 22 nt, Shigella flexneri 2a str. 2457T
cuggcaagauggaagguacguu

SEQ ID NO: 225889 - RNA, 18 nt, Shigella flexneri 2a str. 2457T
ucggugcuaaaucacguc

SEQ ID NO: 225890 - RNA, 22 nt, Shigella flexneri 2a str. 2457T
cgguuuaagucggucaaguaau

SEQ ID NO: 225891 - RNA, 22 nt, Shigella flexneri 2a str. 2457T
gugccguuguucuacgccgaga

SEQ ID NO: 225892 - RNA, 22 nt, Shigella flexneri 2a str. 2457T
uggcuuaucgcgcggcagaaau

SEQ ID NO: 225893 - RNA, 22 nt, Shigella flexneri 2a str. 2457T
gcccggaucgccuacgggcuga

SEQ ID NO: 225894 - RNA, 22 nt, Shigella flexneri 2a str. 2457T
aacugcugguuguuggcugcua

SEQ ID NO: 225895 - RNA, 22 nt, Shigella flexneri 2a str. 2457T
caggugguuagagcgcaccccu

SEQ ID NO: 225896 - RNA, 22 nt, Shigella flexneri 2a str. 2457T
uugagucgaaagucaucauuau

SEQ ID NO: 225897 - RNA, 22 nt, Shigella flexneri 2a str. 2457T
gcgaugcccacgagcgguuuau

SEQ ID NO: 225898 - RNA, 22 nt, Shigella flexneri 2a str. 2457T
aauggcggaguguuggucaaaa

SEQ ID NO: 225899 - RNA, 22 nt, Shigella flexneri 2a str. 2457T
ugauggauauucuggccacacu

SEQ ID NO: 225900 - RNA, 22 nt, Shigella flexneri 2a str. 2457T
ucagcuggucaacuuuagcguu

SEQ ID NO: 225901 - RNA, 22 nt, Shigella flexneri 2a str. 2457T
gcguaaagcaaugauggcgcac

SEQ ID NO: 225902 - RNA, 22 nt, Shigella flexneri 2a str. 2457T
gcgcacguaauugauccagaag

SEQ ID NO: 225903 - RNA, 22 nt, Shigella flexneri 2a str. 2457T
uaggccagauaaggcguuuacg

SEQ ID NO: 225904 - RNA, 22 nt, Shigella flexneri 2a str. 2457T
ccagaucggaaccacggacgau

SEQ ID NO: 225905 - RNA, 22 nt, Shigella flexneri 2a str. 2457T
caucuuauccagcaaccagguc

SEQ ID NO: 225906 - RNA, 22 nt, Shigella flexneri 2a str. 2457T
augaugcuauacugugcaauau

SEQ ID NO: 225907 - RNA, 16 nt, Shigella flexneri 2a str. 2457T
aaacgcuguucuccag

SEQ ID NO: 225908 - RNA, 22 nt, Shigella flexneri 2a str. 2457T
gcgaugcaggcacaccgcuaug

SEQ ID NO: 225909 - RNA, 22 nt, Shigella flexneri 2a str. 2457T
uggagcauggcaauauuuugcc

SEQ ID NO: 225910 - RNA, 22 nt, Shigella flexneri 2a str. 2457T
cguaugguugaguuugaguggc

SEQ ID NO: 225911 - RNA, 18 nt, Shigella flexneri 2a str. 2457T
uuacugcgugcuuauccu

SEQ ID NO: 225912 - RNA, 22 nt, Shigella flexneri 2a str. 2457T
cgagaucgguaccgucacgcca

SEQ ID NO: 225913 - RNA, 22 nt, Shigella flexneri 2a str. 2457T
ggauaaucguuugcaugaugca

SEQ ID NO: 225914 - RNA, 22 nt, Shigella flexneri 2a str. 2457T
gcugaacaccagccagauugau

SEQ ID NO: 225915 - RNA, 22 nt, Shigella flexneri 2a str. 2457T
agcagcuggcugauggucggaa

SEQ ID NO: 225916 - RNA, 22 nt, Shigella flexneri 2a str. 2457T
agugaugaaaacgaaggccgga

SEQ ID NO: 225917 - RNA, 22 nt, Shigella flexneri 2a str. 2457T
gggaucgucuuaccgcguucga

SEQ ID NO: 225918 - RNA, 21 nt, Shigella flexneri 2a str. 2457T
uacguucuacaaaccugugcc

SEQ ID NO: 225919 - RNA, 22 nt, Shigella flexneri 2a str. 2457T
ucaaugucauugguuggcagua

SEQ ID NO: 225920 - RNA, 22 nt, Shigella flexneri 2a str. 2457T
uuuagcgcucgacacccuggga

SEQ ID NO: 225921 - RNA, 22 nt, Shigella flexneri 2a str. 2457T
aaggcguugcagugcauggaug

SEQ ID NO: 225922 - RNA, 22 nt, Shigella flexneri 2a str. 2457T
aucggaggaaaaaaugucucgu

SEQ ID NO: 225923 - RNA, 22 nt, Shigella flexneri 2a str. 2457T
uuagguaauaucucagcuuauc

SEQ ID NO: 225924 - RNA, 23 nt, Shigella flexneri 2a str. 2457T
auggcgauauggaaggcauuccg

SEQ ID NO: 225925 - RNA, 22 nt, Shigella flexneri 2a str. 2457T
ccgcuuugaucaccaguucaca

SEQ ID NO: 225926 - RNA, 22 nt, Shigella flexneri 2a str. 2457T
auacaucguggggugccaugga

SEQ ID NO: 225927 - RNA, 22 nt, Shigella flexneri 2a str. 2457T
gaagcguuggucaguaguuguu

SEQ ID NO: 225928 - RNA, 22 nt, Shigella flexneri 2a str. 2457T
gagaugcggguucgucaaaggu

SEQ ID NO: 225929 - RNA, 18 nt, Shigella flexneri 2a str. 2457T
ccugcugggguuacugcc

SEQ ID NO: 225930 - RNA, 21 nt, Shigella flexneri 2a str. 2457T
aggaaucacggcgcugaaagc

SEQ ID NO: 225931 - RNA, 22 nt, Shigella flexneri 2a str. 2457T
ucaaugauggugccucgcuguu

SEQ ID NO: 225932 - RNA, 22 nt, Shigella flexneri 2a str. 2457T
cgccauguggaugcagugcggg

SEQ ID NO: 225933 - RNA, 22 nt, Shigella flexneri 2a str. 2457T
aucgucgaaacgccggagcagg

SEQ ID NO: 225934 - RNA, 22 nt, Shigella flexneri 2a str. 2457T
uagcggacgucgacuacuggaa

SEQ ID NO: 225935 - RNA, 22 nt, Shigella flexneri 2a str. 2457T
agcauucaguugaugaaaucgc

SEQ ID NO: 225936 - RNA, 22 nt, Shigella flexneri 2a str. 2457T
aacgcgguuuuaagcgaaucga

SEQ ID NO: 225937 - RNA, 18 nt, Shigella flexneri 2a str. 2457T
cggcaacuaccagaccca

SEQ ID NO: 225938 - RNA, 22 nt, Shigella flexneri 2a str. 2457T
aucacgucaccucgacgcuguu

SEQ ID NO: 225939 - RNA, 22 nt, Shigella flexneri 2a str. 2457T
aggcgcugaacgugguggugcg

SEQ ID NO: 225940 - RNA, 22 nt, Shigella flexneri 2a str. 2457T
guuugcagguagagcagauuau

SEQ ID NO: 225941 - RNA, 22 nt, Shigella flexneri 2a str. 2457T
aagcgucccguuucgaucuuag

SEQ ID NO: 225942 - RNA, 21 nt, Shigella flexneri 2a str. 2457T
uucagccuggcgucgcccacu

SEQ ID NO: 225943 - RNA, 22 nt, Shigella flexneri 2a str. 2457T
acagggcgcacuggaagcgaug

SEQ ID NO: 225944 - RNA, 22 nt, Shigella flexneri 2a str. 2457T
gugacagugauugaacuggcgg

SEQ ID NO: 225945 - RNA, 22 nt, Shigella flexneri 2a str. 2457T
ucuucacgggcgauggcgucca

SEQ ID NO: 225946 - RNA, 22 nt, Shigella flexneri 2a str. 2457T
agucaucaggcucuuucuuaaa

SEQ ID NO: 225947 - RNA, 22 nt, Shigella flexneri 2a str. 2457T
ucgucgcuacgcauucucgguu

SEQ ID NO: 225948 - RNA, 21 nt, Shigella flexneri 2a str. 2457T
gugauugccgauuguggcugc

SEQ ID NO: 225949 - RNA, 22 nt, Shigella flexneri 2a str. 2457T
gcugccgucaaccagacgcugg

SEQ ID NO: 225950 - RNA, 22 nt, Shigella flexneri 2a str. 2457T
accgacguuagaaaucaaccau

SEQ ID NO: 225951 - RNA, 23 nt, Shigella flexneri 2a str. 2457T
acguaagcauuaucggccauuuc

SEQ ID NO: 225952 - RNA, 22 nt, Shigella flexneri 2a str. 2457T
ucagaccuucuucgauuucgcg

SEQ ID NO: 225953 - RNA, 23 nt, Shigella flexneri 2a str. 2457T
agcgcaccagcaccgacugagcg

SEQ ID NO: 225954 - RNA, 22 nt, Shigella flexneri 2a str. 2457T
cgcgcacuguuccauuaacugg

SEQ ID NO: 225955 - RNA, 22 nt, Shigella flexneri 2a str. 2457T
uugcagaauuuguaggccggau

SEQ ID NO: 225956 - RNA, 22 nt, Shigella flexneri 2a str. 2457T
agcaaaugguugaaaucgccaa

SEQ ID NO: 225957 - RNA, 22 nt, Shigella flexneri 2a str. 2457T
ggcguaggccgaaagcuggcaa

SEQ ID NO: 225958 - RNA, 22 nt, Shigella flexneri 2a str. 2457T
uuccguaaaacucgauacccag

SEQ ID NO: 225959 - RNA, 22 nt, Shigella flexneri 2a str. 2457T
ugaacuguucguccacuucggu

SEQ ID NO: 225960 - RNA, 22 nt, Shigella flexneri 2a str. 2457T
uuacggaacauagcacgaccca

SEQ ID NO: 225961 - RNA, 22 nt, Shigella flexneri 2a str. 2457T
uugccacgcaaaucgguuuugc

SEQ ID NO: 225962 - RNA, 22 nt, Shigella flexneri 2a str. 2457T
ugcgacgaugacccaugacgau

SEQ ID NO: 225963 - RNA, 22 nt, Shigella flexneri 2a str. 2457T
guauaucaauaaaguccggcuc

SEQ ID NO: 225964 - RNA, 22 nt, Shigella flexneri 2a str. 2457T
auaaacgccuggcuggcugguu

SEQ ID NO: 225965 - RNA, 22 nt, Shigella flexneri 2a str. 2457T
gaucugaguuuaugggaaugcu

SEQ ID NO: 225966 - RNA, 22 nt, Shigella flexneri 2a str. 2457T
ucaggccuacgucauauugcaa

SEQ ID NO: 225967 - RNA, 22 nt, Shigella flexneri 2a str. 2457T
guuggccgcaucagauuuauca

SEQ ID NO: 225968 - RNA, 22 nt, Shigella flexneri 2a str. 2457T
ggcgaauaguuucacgcuggaa

SEQ ID NO: 225969 - RNA, 22 nt, Shigella flexneri 2a str. 2457T
ggcuuucugcuggcgauagcca

SEQ ID NO: 225970 - RNA, 22 nt, Shigella flexneri 2a str. 2457T
ucugguuaaccgcgagcaggau

SEQ ID NO: 225971 - RNA, 22 nt, Shigella flexneri 2a str. 2457T
aagcgguuguacccgugccggu

SEQ ID NO: 225972 - RNA, 22 nt, Shigella flexneri 2a str. 2457T
aucaggcaauuuggcguuugcc

SEQ ID NO: 225973 - RNA, 22 nt, Shigella flexneri 2a str. 2457T
gugcaaccgguuguugcggcug

SEQ ID NO: 225974 - RNA, 22 nt, Shigella flexneri 2a str. 2457T
augcguuucagccacgcguuug

SEQ ID NO: 225975 - RNA, 22 nt, Shigella flexneri 2a str. 2457T
ucguuguaauauuucagggugu

SEQ ID NO: 225976 - RNA, 22 nt, Shigella flexneri 2a str. 2457T
aaacgcaucgguaugauugcgc

SEQ ID NO: 225977 - RNA, 22 nt, Shigella flexneri 2a str. 2457T
ugacgccauuuuugcuggugau

SEQ ID NO: 225978 - RNA, 22 nt, Shigella flexneri 2a str. 2457T
gcuaaugcagaauuucuccgau

SEQ ID NO: 225979 - RNA, 22 nt, Shigella flexneri 2a str. 2457T
aguguauaaaaaauggcgucaa

SEQ ID NO: 225980 - RNA, 22 nt, Shigella flexneri 2a str. 2457T
gaaggccagccggucaucagcg

SEQ ID NO: 225981 - RNA, 20 nt, Shigella flexneri 2a str. 2457T
ugugcugccccguggcuuuu

SEQ ID NO: 225982 - RNA, 22 nt, Shigella flexneri 2a str. 2457T
ugacgcugaccggcgacgucca

SEQ ID NO: 225983 - RNA, 22 nt, Shigella flexneri 2a str. 2457T
gcaggagccagcucacucgcug

SEQ ID NO: 225984 - RNA, 22 nt, Shigella flexneri 2a str. 2457T
cgugcgucuucuauucagggga

SEQ ID NO: 225985 - RNA, 22 nt, Shigella flexneri 2a str. 2457T
cuauguugagaugcuggcgcgu

SEQ ID NO: 225986 - RNA, 22 nt, Shigella flexneri 2a str. 2457T
uggcacaaugguuaacguguca

SEQ ID NO: 225987 - RNA, 18 nt, Shigella flexneri 2a str. 2457T
uggaucgcuacccguuug

SEQ ID NO: 225988 - RNA, 22 nt, Shigella flexneri 2a str. 2457T
agcguauuaagaaugagcugga

SEQ ID NO: 225989 - RNA, 22 nt, Shigella flexneri 2a str. 2457T
uugagcgugccgguggcgaaca

SEQ ID NO: 225990 - RNA, 22 nt, Shigella flexneri 2a str. 2457T
uggcauucgcgugauccagcug

SEQ ID NO: 225991 - RNA, 22 nt, Shigella flexneri 2a str. 2457T
aggguugacguaauagagguuu

SEQ ID NO: 225992 - RNA, 20 nt, Shigella flexneri 2a str. 2457T
aggacgguuguggcgcacgu

SEQ ID NO: 225993 - RNA, 22 nt, Shigella flexneri 2a str. 2457T
guccugcuugccagauacgaug

SEQ ID NO: 225994 - RNA, 22 nt, Shigella flexneri 2a str. 2457T
ugcauuauaugcuguaggccug

SEQ ID NO: 225995 - RNA, 22 nt, Shigella flexneri 2a str. 2457T
gcgaagauuuugguuauuacgc

SEQ ID NO: 225996 - RNA, 22 nt, Shigella flexneri 2a str. 2457T
ugacgauggcggaauugcugac

SEQ ID NO: 225997 - RNA, 22 nt, Shigella flexneri 2a str. 2457T
uggcagaugauuucgccaauug

SEQ ID NO: 225998 - RNA, 22 nt, Shigella flexneri 2a str. 2457T
acgcugaauguugaaaaugcgc

SEQ ID NO: 225999 - RNA, 22 nt, Shigella flexneri 2a str. 2457T
uguucgcuuuggucugccagcg

SEQ ID NO: 226000 - RNA, 22 nt, Shigella flexneri 2a str. 2457T
uucgcccguaugucauuccggu

SEQ ID NO: 226001 - RNA, 22 nt, Shigella flexneri 2a str. 2457T
ggcgauggaggauggauaauga

SEQ ID NO: 226002 - RNA, 17 nt, Shigella flexneri 2a str. 2457T
ucaccagcugguuauca

SEQ ID NO: 226003 - RNA, 22 nt, Shigella flexneri 2a str. 2457T
ucgcaaaccgggccugacgcug

SEQ ID NO: 226004 - RNA, 22 nt, Shigella flexneri 2a str. 2457T
agaucuauaugccggauuagcg

SEQ ID NO: 226005 - RNA, 22 nt, Shigella flexneri 2a str. 2457T
ggcggcuucuacggcaucugcg

SEQ ID NO: 226006 - RNA, 22 nt, Shigella flexneri 2a str. 2457T
uaucgucugauuaugaagagcg

SEQ ID NO: 226007 - RNA, 22 nt, Shigella flexneri 2a str. 2457T
uaggccggauaaggcguagacg

SEQ ID NO: 226008 - RNA, 22 nt, Shigella flexneri 2a str. 2457T
ugaaagacugagcguuuuguug

SEQ ID NO: 226009 - RNA, 22 nt, Shigella flexneri 2a str. 2457T
uucgcugggaaaucccugggcc

SEQ ID NO: 226010 - RNA, 22 nt, Shigella flexneri 2a str. 2457T
acgcgucuuaucaggccuacaa

SEQ ID NO: 226011 - RNA, 22 nt, Shigella flexneri 2a str. 2457T
guccggaagagaucaccgcuga

SEQ ID NO: 226012 - RNA, 22 nt, Shigella flexneri 2a str. 2457T
uccgggcucaugcuguccaggu

SEQ ID NO: 226013 - RNA, 22 nt, Shigella flexneri 2a str. 2457T
uugggucaauuugucugcuugc

SEQ ID NO: 226014 - RNA, 22 nt, Shigella flexneri 2a str. 2457T
gaguaugauggauguaccgacc

SEQ ID NO: 226015 - RNA, 22 nt, Shigella flexneri 2a str. 2457T
uugacuguuugucaaagaauga

SEQ ID NO: 226016 - RNA, 22 nt, Shigella flexneri 2a str. 2457T
ugcaauccaggcauuaggaaaa

SEQ ID NO: 226017 - RNA, 20 nt, Shigella flexneri 2a str. 2457T
uaaggccaaagucuucaguu

SEQ ID NO: 226018 - RNA, 22 nt, Shigella flexneri 2a str. 2457T
uuccaccguugcuguugcgucg

SEQ ID NO: 226019 - RNA, 22 nt, Shigella flexneri 2a str. 2457T
cugcuguacauggcugccgcug

SEQ ID NO: 226020 - RNA, 20 nt, Shigella flexneri 2a str. 2457T
uccguuaucuccacccgacc

SEQ ID NO: 226021 - RNA, 22 nt, Shigella flexneri 2a str. 2457T
gucgccgauaccgagguagcgg

SEQ ID NO: 226022 - RNA, 22 nt, Shigella flexneri 2a str. 2457T
cccaguccaauaccagcgggcg

SEQ ID NO: 226023 - RNA, 22 nt, Shigella flexneri 2a str. 2457T
caguacguuucuauuccgguug

SEQ ID NO: 226024 - RNA, 22 nt, Shigella flexneri 2a str. 2457T
accaaaugucgauaauuuuguu

SEQ ID NO: 226025 - RNA, 22 nt, Shigella flexneri 2a str. 2457T
uugagcaugaacccgguugagc

SEQ ID NO: 226026 - RNA, 20 nt, Shigella flexneri 2a str. 2457T
ggcacgcugauugaaaaccc

SEQ ID NO: 226027 - RNA, 21 nt, Shigella flexneri 2a str. 2457T
uccgcgguguuuucagccagc

SEQ ID NO: 226028 - RNA, 22 nt, Shigella flexneri 2a str. 2457T
ccgacgacgguuuacagcauua

SEQ ID NO: 226029 - RNA, 22 nt, Shigella flexneri 2a str. 2457T
uucagggcuucucccaguacau

SEQ ID NO: 226030 - RNA, 22 nt, Shigella flexneri 2a str. 2457T
augcgcuucgcuuauccggccu

SEQ ID NO: 226031 - RNA, 22 nt, Shigella flexneri 2a str. 2457T
uguugaaacuguagcccguucc

SEQ ID NO: 226032 - RNA, 22 nt, Shigella flexneri 2a str. 2457T
aaagcgucaauauuugcgccug

SEQ ID NO: 226033 - RNA, 23 nt, Shigella flexneri 2a str. 2457T
ugaaguaguuccgcuugugcacg

SEQ ID NO: 226034 - RNA, 22 nt, Shigella flexneri 2a str. 2457T
uacuauagggaguuggaguaaa

SEQ ID NO: 226035 - RNA, 22 nt, Shigella flexneri 2a str. 2457T
guucaggauaagaaauuuagcg

SEQ ID NO: 226036 - RNA, 22 nt, Shigella flexneri 2a str. 2457T
gcgcauggacgguacgacccca

SEQ ID NO: 226037 - RNA, 22 nt, Shigella flexneri 2a str. 2457T
gaugcaacauuugucgccgcag

SEQ ID NO: 226038 - RNA, 22 nt, Shigella flexneri 2a str. 2457T
cuggcgauguucuaugaagugg

SEQ ID NO: 226039 - RNA, 22 nt, Shigella flexneri 2a str. 2457T
cgggcguucgagaguguucuua

SEQ ID NO: 226040 - RNA, 22 nt, Shigella flexneri 2a str. 2457T
acuggcaauugccagccacggu

SEQ ID NO: 226041 - RNA, 20 nt, Shigella flexneri 2a str. 2457T
gugcgagucgccugaacagu

SEQ ID NO: 226042 - RNA, 22 nt, Shigella flexneri 2a str. 2457T
ucaugugaccaaacaggcggcg

SEQ ID NO: 226043 - RNA, 22 nt, Shigella flexneri 2a str. 2457T
ugaguaaauacuguauggccug

SEQ ID NO: 226044 - RNA, 18 nt, Shigella flexneri 2a str. 2457T
uugcuguaagcguucaac

SEQ ID NO: 226045 - RNA, 22 nt, Shigella flexneri 2a str. 2457T
uagaugcguuuucacccgcugg

SEQ ID NO: 226046 - RNA, 22 nt, Shigella flexneri 2a str. 2457T
cucaaugcuuucgcgggugcgu

SEQ ID NO: 226047 - RNA, 22 nt, Shigella flexneri 2a str. 2457T
gcggcuaaugagaggcuuuacc

SEQ ID NO: 226048 - RNA, 23 nt, Shigella flexneri 2a str. 2457T
gccugauguacaugucuucaacc

SEQ ID NO: 226049 - RNA, 22 nt, Shigella flexneri 2a str. 2457T
uccgcaucgguauugaaaugga

SEQ ID NO: 226050 - RNA, 22 nt, Shigella flexneri 2a str. 2457T
ccggaacaaucgugaauagcgc

SEQ ID NO: 226051 - RNA, 22 nt, Shigella flexneri 2a str. 2457T
gccgcagaaguggcgcuguuua

SEQ ID NO: 226052 - RNA, 22 nt, Shigella flexneri 2a str. 2457T
aucggcuuuacuaacgucgaua

SEQ ID NO: 226053 - RNA, 22 nt, Shigella flexneri 2a str. 2457T
acauagugaaaaaaggcgugga

SEQ ID NO: 226054 - RNA, 23 nt, Shigella flexneri 2a str. 2457T
cacgaugcaacguaaagauacgc

SEQ ID NO: 226055 - RNA, 22 nt, Shigella flexneri 2a str. 2457T
uggaagcgaucaaacugcuggc

SEQ ID NO: 226056 - RNA, 22 nt, Shigella flexneri 2a str. 2457T
ugaugugauugucugcgcugaa

SEQ ID NO: 226057 - RNA, 20 nt, Shigella flexneri 2a str. 2457T
cgggaacguccguuaaggua

SEQ ID NO: 226058 - RNA, 22 nt, Shigella flexneri 2a str. 2457T
agcauugaggaacagcguaauc

SEQ ID NO: 226059 - RNA, 22 nt, Shigella flexneri 2a str. 2457T
uacgaggucaacggagcggaca

SEQ ID NO: 226060 - RNA, 22 nt, Shigella flexneri 2a str. 2457T
agcaaacugcuuucuccggagu

SEQ ID NO: 226061 - RNA, 22 nt, Shigella flexneri 2a str. 2457T
cugcccugcaauguugucaguu

SEQ ID NO: 226062 - RNA, 22 nt, Shigella flexneri 2a str. 2457T
aggccggauaaggcguucacgc

SEQ ID NO: 226063 - RNA, 17 nt, Shigella flexneri 2a str. 2457T
aucgccgguaaagcggu

SEQ ID NO: 226064 - RNA, 22 nt, Shigella flexneri 2a str. 2457T
augaaacgcauauuuaccgcag

SEQ ID NO: 226065 - RNA, 22 nt, Shigella flexneri 2a str. 2457T
uacgcuuaucaggccuacagag

SEQ ID NO: 226066 - RNA, 22 nt, Shigella flexneri 2a str. 2457T
aaauugccgaugcacgcuggcg

SEQ ID NO: 226067 - RNA, 22 nt, Shigella flexneri 2a str. 2457T
auucuuugguguucgcaaacca

SEQ ID NO: 226068 - RNA, 23 nt, Shigella flexneri 2a str. 2457T
acgcuacguacuucucggggcgc

SEQ ID NO: 226069 - RNA, 22 nt, Shigella flexneri 2a str. 2457T
ccugugggaaucucgcaucauu

SEQ ID NO: 226070 - RNA, 22 nt, Shigella flexneri 2a str. 2457T
cuucgcgcuccagcugacggca

SEQ ID NO: 226071 - RNA, 22 nt, Shigella flexneri 2a str. 2457T
guaauagcacaugacaaaaaug

SEQ ID NO: 226072 - RNA, 22 nt, Shigella flexneri 2a str. 2457T
ucgccaugaucccaccgcacau

SEQ ID NO: 226073 - RNA, 23 nt, Shigella flexneri 2a str. 2457T
ugacgcgcgaaagaucaacuccg

SEQ ID NO: 226074 - RNA, 22 nt, Shigella flexneri 2a str. 2457T
gucgaaauggaagcguuaaccg

SEQ ID NO: 226075 - RNA, 21 nt, Shigella flexneri 2a str. 2457T
ugcggcaggguggucugguga

SEQ ID NO: 226076 - RNA, 22 nt, Shigella flexneri 2a str. 2457T
ggccgcaugcgcacuggccuac

SEQ ID NO: 226077 - RNA, 22 nt, Shigella flexneri 2a str. 2457T
uuaugcaauuuuuccgcgugcg

SEQ ID NO: 226078 - RNA, 22 nt, Shigella flexneri 2a str. 2457T
caacgcgcggugaugaugcagg

SEQ ID NO: 226079 - RNA, 22 nt, Shigella flexneri 2a str. 2457T
ggaguugaucuuucgcgcguca

SEQ ID NO: 226080 - RNA, 22 nt, Shigella flexneri 2a str. 2457T
acucugcuggcuugaugaauuu

SEQ ID NO: 226081 - RNA, 22 nt, Shigella flexneri 2a str. 2457T
aaggguauuuucgcaaaucagg

SEQ ID NO: 226082 - RNA, 22 nt, Shigella flexneri 2a str. 2457T
cauccugagacacgugcagugg

SEQ ID NO: 226083 - RNA, 22 nt, Shigella flexneri 2a str. 2457T
augcguuucgcuuaucugaccu

SEQ ID NO: 226084 - RNA, 22 nt, Shigella flexneri 2a str. 2457T
gauauguuuaccaucaucggug

SEQ ID NO: 226085 - RNA, 22 nt, Shigella flexneri 2a str. 2457T
ucgcgguaauuauuccuugcug

SEQ ID NO: 226086 - RNA, 22 nt, Shigella flexneri 2a str. 2457T
gcuggcguugcgcggaguacgu

SEQ ID NO: 226087 - RNA, 17 nt, Shigella flexneri 2a str. 2457T
uggcauuuauuuuuacc

SEQ ID NO: 226088 - RNA, 22 nt, Shigella flexneri 2a str. 2457T
gaugcguaucccgaucuugauc

SEQ ID NO: 226089 - RNA, 22 nt, Shigella flexneri 2a str. 2457T
ggucagcgucaguugcugugcu

SEQ ID NO: 226090 - RNA, 22 nt, Shigella flexneri 2a str. 2457T
cgacggcaauauuguacugagu

SEQ ID NO: 226091 - RNA, 22 nt, Shigella flexneri 2a str. 2457T
uugcaggccguaaaacgccgcu

SEQ ID NO: 226092 - RNA, 22 nt, Shigella flexneri 2a str. 2457T
ccugggaaaaaaucgcuggcgg

SEQ ID NO: 226093 - RNA, 22 nt, Shigella flexneri 2a str. 2457T
gccguggugggaucgccaguug

SEQ ID NO: 226094 - RNA, 22 nt, Shigella flexneri 2a str. 2457T
augggcggauucuugcgacagg

SEQ ID NO: 226095 - RNA, 22 nt, Shigella flexneri 2a str. 2457T
cgcugguuccugcgccauuucc

SEQ ID NO: 226096 - RNA, 23 nt, Shigella flexneri 2a str. 2457T
cugccguuagcgacugcgacguu

SEQ ID NO: 226097 - RNA, 22 nt, Shigella flexneri 2a str. 2457T
cuuuggcaaaccgccagcuagg

SEQ ID NO: 226098 - RNA, 22 nt, Shigella flexneri 2a str. 2457T
ucacggcguuccuaucgcaugc

SEQ ID NO: 226099 - RNA, 22 nt, Shigella flexneri 2a str. 2457T
auggcuuccugaaacaguuugg

SEQ ID NO: 226100 - RNA, 22 nt, Shigella flexneri 2a str. 2457T
ugaagcggcgagcauuguugau

SEQ ID NO: 226101 - RNA, 22 nt, Shigella flexneri 2a str. 2457T
cuucacaguauauuugaaaaag

SEQ ID NO: 226102 - RNA, 22 nt, Shigella flexneri 2a str. 2457T
ugaagcacuauauuggugcaac

SEQ ID NO: 226103 - RNA, 22 nt, Shigella flexneri 2a str. 2457T
acguugguagguuugugcauuu

SEQ ID NO: 226104 - RNA, 22 nt, Shigella flexneri 2a str. 2457T
gcacccguaacauggcgguaau

SEQ ID NO: 226105 - RNA, 22 nt, Shigella flexneri 2a str. 2457T
ggcgauuucugugcuuuuaucg

SEQ ID NO: 226106 - RNA, 22 nt, Shigella flexneri 2a str. 2457T
ucggucacccggaucuggugau

SEQ ID NO: 226107 - RNA, 20 nt, Shigella flexneri 2a str. 2457T
ccacagcgaucuuuccacca

SEQ ID NO: 226108 - RNA, 22 nt, Shigella flexneri 2a str. 2457T
cagcgauuguugccguagaggu

SEQ ID NO: 226109 - RNA, 22 nt, Shigella flexneri 2a str. 2457T
cugccgugucaccacuguucag

SEQ ID NO: 226110 - RNA, 22 nt, Shigella flexneri 2a str. 2457T
aggucggugguucaaguccacu

SEQ ID NO: 226111 - RNA, 22 nt, Shigella flexneri 2a str. 2457T
cgccggaagagagauugcggua

SEQ ID NO: 226112 - RNA, 19 nt, Shigella flexneri 2a str. 2457T
ucucgaucuggugcagaaa

SEQ ID NO: 226113 - RNA, 22 nt, Shigella flexneri 2a str. 2457T
guugagcuguuuuagcgaaaca

SEQ ID NO: 226114 - RNA, 22 nt, Shigella flexneri 2a str. 2457T
aaacguugcugaugggugacga

SEQ ID NO: 226115 - RNA, 22 nt, Shigella flexneri 2a str. 2457T
ccagcgcuucgguauggcgggu

SEQ ID NO: 226116 - RNA, 22 nt, Shigella flexneri 2a str. 2457T
auucgcuuggguauuguaaaac

SEQ ID NO: 226117 - RNA, 22 nt, Shigella flexneri 2a str. 2457T
augcugaccaugggcgauucgg

SEQ ID NO: 226118 - RNA, 22 nt, Shigella flexneri 2a str. 2457T
aaguugccagcccgcagccauu

SEQ ID NO: 226119 - RNA, 20 nt, Shigella flexneri 2a str. 2457T
aaaucguccggggaaaccuu

SEQ ID NO: 226120 - RNA, 22 nt, Shigella flexneri 2a str. 2457T
cugugccagcagagcgagaugc

SEQ ID NO: 226121 - RNA, 22 nt, Shigella flexneri 2a str. 2457T
guacuguucagcagauuaucag

SEQ ID NO: 226122 - RNA, 22 nt, Shigella flexneri 2a str. 2457T
uucagggucuggauugccugca

SEQ ID NO: 226123 - RNA, 22 nt, Shigella flexneri 2a str. 2457T
cguacgcucuccaacgccaugu

SEQ ID NO: 226124 - RNA, 22 nt, Shigella flexneri 2a str. 2457T
aaaggccaucaucgcagucaua

SEQ ID NO: 226125 - RNA, 22 nt, Shigella flexneri 2a str. 2457T
aaacugcaaaaaugcccggcgg

SEQ ID NO: 226126 - RNA, 22 nt, Shigella flexneri 2a str. 2457T
aagcgucccguuucgaucuuag

SEQ ID NO: 226127 - RNA, 22 nt, Shigella flexneri 2a str. 2457T
aagcuggaucucugaaaggauu

SEQ ID NO: 226128 - RNA, 22 nt, Shigella flexneri 2a str. 2457T
acagagcugauuuccgggaugg

SEQ ID NO: 226129 - RNA, 22 nt, Shigella flexneri 2a str. 2457T
acugcauccagaggcgaaugca

SEQ ID NO: 226130 - RNA, 22 nt, Shigella flexneri 2a str. 2457T
aggcuuugugcucuucugugaa

SEQ ID NO: 226131 - RNA, 22 nt, Shigella flexneri 2a str. 2457T
aggcucaguacgcagcugaaga

SEQ ID NO: 226132 - RNA, 22 nt, Shigella flexneri 2a str. 2457T
agugauuaacgucucuuucaga

SEQ ID NO: 226133 - RNA, 22 nt, Shigella flexneri 2a str. 2457T
aguggcgcagggcgaugauguu

SEQ ID NO: 226134 - RNA, 22 nt, Shigella flexneri 2a str. 2457T
agucaugaauucacuacguccg

SEQ ID NO: 226135 - RNA, 22 nt, Shigella flexneri 2a str. 2457T
auacaucguggggugccaugga

SEQ ID NO: 226136 - RNA, 20 nt, Shigella flexneri 2a str. 2457T
auaguugucagacguuuagc

SEQ ID NO: 226137 - RNA, 22 nt, Shigella flexneri 2a str. 2457T
cagaaguaaucccucauucccg

SEQ ID NO: 226138 - RNA, 22 nt, Shigella flexneri 2a str. 2457T
auuccgugcgccaaagugugcc

SEQ ID NO: 226139 - RNA, 22 nt, Shigella flexneri 2a str. 2457T
auugcaggaacgcuaucaccgu

SEQ ID NO: 226140 - RNA, 22 nt, Shigella flexneri 2a str. 2457T
uccagcaaauugugauagcgca

SEQ ID NO: 226141 - RNA, 22 nt, Shigella flexneri 2a str. 2457T
ucugguaaucgcaacuuuggug

SEQ ID NO: 226142 - RNA, 22 nt, Shigella flexneri 2a str. 2457T
ucuggaguaguguagucaaugg

SEQ ID NO: 226143 - RNA, 22 nt, Shigella flexneri 2a str. 2457T
ucugcugccugacguugcagcu

SEQ ID NO: 226144 - RNA, 22 nt, Shigella flexneri 2a str. 2457T
ugagccucagauuaauguuaag

SEQ ID NO: 226145 - RNA, 22 nt, Shigella flexneri 2a str. 2457T
ugugaccugcuggaagagaacu

SEQ ID NO: 226146 - RNA, 20 nt, Shigella flexneri 2a str. 2457T
uaaggccaaagucuucaguu

SEQ ID NO: 226147 - RNA, 22 nt, Shigella flexneri 2a str. 2457T
ucaggcugagguugaucgcgcu

SEQ ID NO: 226148 - RNA, 22 nt, Shigella flexneri 2a str. 2457T
ucaggcugaugguggcacucgu

SEQ ID NO: 226149 - RNA, 22 nt, Shigella flexneri 2a str. 2457T
ucagcuggucaacuuuagcguu

SEQ ID NO: 226150 - RNA, 22 nt, Shigella flexneri 2a str. 2457T
ggcuuucugcuggcgauagcca

SEQ ID NO: 226151 - RNA, 23 nt, Shigella flexneri 2a str. 2457T
ggcuggagagcggguagucguau

SEQ ID NO: 226152 - RNA, 22 nt, Shigella flexneri 2a str. 2457T
ggcuuuccaguucaccagauug

SEQ ID NO: 226153 - RNA, 22 nt, Shigella flexneri 2a str. 2457T
gggccagaaaaucugugucuug

SEQ ID NO: 226154 - RNA, 22 nt, Shigella flexneri 2a str. 2457T
gcuucugcacugugguuuuucu

SEQ ID NO: 226155 - RNA, 22 nt, Shigella flexneri 2a str. 2457T
gcuguucaacuccaaacucucu

SEQ ID NO: 226156 - RNA, 22 nt, Shigella flexneri 2a str. 2457T
gcuggaaagcaccugcgcggcg

SEQ ID NO: 226157 - RNA, 22 nt, Shigella flexneri 2a str. 2457T
gcuggcuuugcgcacuggcggc

SEQ ID NO: 226158 - RNA, 22 nt, Shigella flexneri 2a str. 2457T
ggcagugccuucagcauggaag

SEQ ID NO: 226159 - RNA, 22 nt, Shigella flexneri 2a str. 2457T
gcaggcugguaucgaacgguuu

SEQ ID NO: 226160 - RNA, 22 nt, Shigella flexneri 2a str. 2457T
gaauuucauugcuuucuucugu

SEQ ID NO: 226161 - RNA, 22 nt, Shigella flexneri 2a str. 2457T
gcauucaucaugguucucgguu

SEQ ID NO: 226162 - RNA, 22 nt, Shigella flexneri 2a str. 2457T
gcauaucuuugguuugcaucgg

SEQ ID NO: 226163 - RNA, 22 nt, Shigella flexneri 2a str. 2457T
gaaggccagccggucaucagcg

SEQ ID NO: 226164 - RNA, 22 nt, Shigella flexneri 2a str. 2457T
cuacgcauacaaccagagcaag

SEQ ID NO: 226165 - RNA, 22 nt, Shigella flexneri 2a str. 2457T
cucgacagaagccgugaagaga

SEQ ID NO: 226166 - RNA, 22 nt, Shigella flexneri 2a str. 2457T
cguuccugcuccugcuccaucc

SEQ ID NO: 226167 - RNA, 22 nt, Shigella flexneri 2a str. 2457T
caguauuugccgccagagauga

SEQ ID NO: 226168 - RNA, 22 nt, Shigella flexneri 2a str. 2457T
uuagcaucuuuuguucagcugg

SEQ ID NO: 226169 - RNA, 22 nt, Shigella flexneri 2a str. 2457T
uguugaaacuguagcccguucc

SEQ ID NO: 226170 - RNA, 22 nt, Shigella flexneri 2a str. 2457T
aagccucaguuucuaugcaaau

SEQ ID NO: 226171 - RNA, 22 nt, Shigella flexneri 2a str. 2457T
agagcggcggucugaucacccg

SEQ ID NO: 226172 - RNA, 22 nt, Shigella flexneri 2a str. 2457T
aaugccagcgccacagcgauaa

SEQ ID NO: 226173 - RNA, 18 nt, Shigella flexneri 2a str. 2457T
uugcuguaagcguucaac

SEQ ID NO: 226174 - RNA, 22 nt, Shigella flexneri 2a str. 2457T
uugggucaauuugucugcuugc

SEQ ID NO: 226175 - RNA, 21 nt, Shigella flexneri 2a str. 2457T
uucagccuggcgucgcccacu

SEQ ID NO: 226176 - RNA, 22 nt, Shigella flexneri 2a str. 2457T
gccuguccgacaugagagagca

SEQ ID NO: 226177 - RNA, 22 nt, Shigella flexneri 2a str. 2457T
gaugucuguuugguuucaggcg

SEQ ID NO: 226178 - RNA, 22 nt, Shigella flexneri 2a str. 2457T
gaugagcguuucccgcauccgc

SEQ ID NO: 226179 - RNA, 22 nt, Shigella flexneri 2a str. 2457T
cugugccagcagagcgagaugc

SEQ ID NO: 226180 - RNA, 22 nt, Shigella flexneri 2a str. 2457T
cuggagauuaugcguaaagcca

SEQ ID NO: 226181 - RNA, 22 nt, Shigella flexneri 2a str. 2457T
cuggagccuguugggugacacg

SEQ ID NO: 226182 - RNA, 22 nt, Shigella flexneri 2a str. 2457T
gaucguuaaagaugcuaacggc

SEQ ID NO: 226183 - RNA, 22 nt, Shigella flexneri 2a str. 2457T
ccagauggcgauggcgcuagcg

SEQ ID NO: 226184 - RNA, 22 nt, Shigella flexneri 2a str. 2457T
aggccggauaaggcguucacgc

SEQ ID NO: 226185 - RNA, 22 nt, Shigella flexneri 2a str. 2457T
aggccggauaagcgaagcgcau

SEQ ID NO: 226186 - RNA, 22 nt, Shigella flexneri 2a str. 2457T
ccgaacggauaaagcgcuccgu

SEQ ID NO: 226187 - RNA, 22 nt, Shigella flexneri 2a str. 2457T
ccgggcuuaccacggguuuccc

SEQ ID NO: 226188 - RNA, 22 nt, Shigella flexneri 2a str. 2457T
cggaaggcgauaaagcgauuga

SEQ ID NO: 226189 - RNA, 22 nt, Shigella flexneri 2a str. 2457T
ggugacuguacuggaaggucug

SEQ ID NO: 226190 - RNA, 20 nt, Shigella flexneri 2a str. 2457T
guaggccgcauccggcagga

SEQ ID NO: 226191 - RNA, 19 nt, Shigella flexneri 2a str. 2457T
gucaggcuuccuugcgguc

SEQ ID NO: 226192 - RNA, 22 nt, Shigella flexneri 2a str. 2457T
guucagcagauuuggcgcaacu

SEQ ID NO: 226193 - RNA, 22 nt, Shigella flexneri 2a str. 2457T
guuucacuccaaccuguucaag

SEQ ID NO: 226194 - RNA, 22 nt, Shigella flexneri 2a str. 2457T
uaggccagauaaggcguuuacg

SEQ ID NO: 226195 - RNA, 22 nt, Shigella flexneri 2a str. 2457T
ugcucaaauccgcguucaagga

SEQ ID NO: 226196 - RNA, 22 nt, Shigella flexneri 2a str. 2457T
ugaaguauagccaagacaaccc

SEQ ID NO: 226197 - RNA, 22 nt, Shigella flexneri 2a str. 2457T
ucguuauucuucgguaucggca

SEQ ID NO: 226198 - RNA, 22 nt, Human
aaaaauuucuggugaaaugccu

SEQ ID NO: 226199 - RNA, 22 nt, Human
aaaaaaacuaauuuuaaaugug

SEQ ID NO: 226200 - RNA, 22 nt, Human
aaaagaaugaugggagcugggu

SEQ ID NO: 226201 - RNA, 22 nt, Human
aaaagacaaggaucuggaguga

SEQ ID NO: 226202 - RNA, 20 nt, Human
aaaaauguguuuauggagau

SEQ ID NO: 226203 - RNA, 22 nt, Human
aaaaccugcaagaugaaaucag

SEQ ID NO: 226204 - RNA, 22 nt, Human
aaaaacuuaccccagggcaagg

SEQ ID NO: 226205 - RNA, 20 nt, Human
aaaaacaguaaugcugaaga

SEQ ID NO: 226206 - RNA, 22 nt, Human
aaaaaguaccacuuggacacuu

SEQ ID NO: 226207 - RNA, 22 nt, Human
aaaaaauugcuggcagagcugu

SEQ ID NO: 226208 - RNA, 21 nt, Human
aaacaugcagccugccaauuc

SEQ ID NO: 226209 - RNA, 22 nt, Human
aaacauguagugcaugaggauc

SEQ ID NO: 226210 - RNA, 18 nt, Human
aaacauggcuuaaaggcu

SEQ ID NO: 226211 - RNA, 22 nt, Human
aaacauaugccuucuuuuguaa

SEQ ID NO: 226212 - RNA, 22 nt, Human
aaacagguuugaacuucuuaac

SEQ ID NO: 226213 - RNA, 22 nt, Human
aaacccuagcguuguuuauuga

SEQ ID NO: 226214 - RNA, 22 nt, Human
aaacaauaauaauuaggaagga

SEQ ID NO: 226215 - RNA, 22 nt, Human
aaaauauaaaggauguggguuu

SEQ ID NO: 226216 - RNA, 22 nt, Human
aaaauacuaggaaaauaaauca

SEQ ID NO: 226217 - RNA, 22 nt, Human
aaaauaauauuauaccacugcu

SEQ ID NO: 226218 - RNA, 22 nt, Human
aaaauaaccuucauuugcauug

SEQ ID NO: 226219 - RNA, 22 nt, Human
aaaagcgaagagaacugaaguu

SEQ ID NO: 226220 - RNA, 22 nt, Human
aaaagcucucuucuucggcuuu

SEQ ID NO: 226221 - RNA, 22 nt, Human
aaacugacugaugugaucuuau

SEQ ID NO: 226222 - RNA, 22 nt, Human
aaacucaugccagagaacuuaa

SEQ ID NO: 226223 - RNA, 22 nt, Human
aaacugcuuucucugccuuucc

SEQ ID NO: 226224 - RNA, 21 nt, Human
aaagaaguuaguucagugguu

SEQ ID NO: 226225 - RNA, 20 nt, Human
aaacucucugaucuuacagu

SEQ ID NO: 226226 - RNA, 22 nt, Human
aaacucaucaguuuagaaaccu

SEQ ID NO: 226227 - RNA, 22 nt, Human
aaacuuuaucaaguacucuuca

SEQ ID NO: 226228 - RNA, 21 nt, Human
aaagaagagcucagagguaga

SEQ ID NO: 226229 - RNA, 22 nt, Human
aaagagacaacaacaacuucua

SEQ ID NO: 226230 - RNA, 22 nt, Human
aaagaagugucuuacucccucu

SEQ ID NO: 226231 - RNA, 22 nt, Human
aaagagccaacuaccgcaaauu

SEQ ID NO: 226232 - RNA, 22 nt, Human
aaacuuuaggcacauggaucua

SEQ ID NO: 226233 - RNA, 22 nt, Human
aaacugugcagucacauaagga

SEQ ID NO: 226234 - RNA, 22 nt, Human
aaagaccaagagccccaaguuu

SEQ ID NO: 226235 - RNA, 22 nt, Human
aaagacuaaccaguugucaaaa

SEQ ID NO: 226236 - RNA, 22 nt, Human
aacacaucagcacacuaacgga

SEQ ID NO: 226237 - RNA, 22 nt, Human
aaauuugggagaaaugggucau

SEQ ID NO: 226238 - RNA, 22 nt, Human
aaauuuuguugaaaaauauuuu

SEQ ID NO: 226239 - RNA, 21 nt, Human
aaauuucauauggccaaccua

SEQ ID NO: 226240 - RNA, 22 nt, Human
aacaaaacauuuuacgaauaua

SEQ ID NO: 226241 - RNA, 22 nt, Human
aaauugcauuuuaaagguagau

SEQ ID NO: 226242 - RNA, 22 nt, Human
aaauuuauaacuuaaagugaau

SEQ ID NO: 226243 - RNA, 22 nt, Human
aacacuaaaggucaguuagaag

SEQ ID NO: 226244 - RNA, 22 nt, Human
aacagagauucuucccuucuuu

SEQ ID NO: 226245 - RNA, 22 nt, Human
aacaggcuaaauuguccauuuc

SEQ ID NO: 226246 - RNA, 22 nt, Human
aacacuguaucagucuucaaua

SEQ ID NO: 226247 - RNA, 22 nt, Human
aacagaauaucaaaagauuaug

SEQ ID NO: 226248 - RNA, 22 nt, Human
aacagaaaucauuuagggcucu

SEQ ID NO: 226249 - RNA, 22 nt, Human
aacacguuuauccuaagaacuc

SEQ ID NO: 226250 - RNA, 22 nt, Human
aacaguguaggagcugguuuau

SEQ ID NO: 226251 - RNA, 21 nt, Human
aacaaaagggaagaacagcug

SEQ ID NO: 226252 - RNA, 22 nt, Human
aacaucugagagcccuugugca

SEQ ID NO: 226253 - RNA, 22 nt, Human
aacaguaugugagauuuacaca

SEQ ID NO: 226254 - RNA, 22 nt, Human
aacaguuaagaggaggcagaga

SEQ ID NO: 226255 - RNA, 22 nt, Human
aacagguucaucuuggaagcag

SEQ ID NO: 226256 - RNA, 22 nt, Human
aaaugucugagacuucugaacu

SEQ ID NO: 226257 - RNA, 22 nt, Human
aaauguuucauucuauuuuuag

SEQ ID NO: 226258 - RNA, 22 nt, Human
aaauggaaguuuguucucagcc

SEQ ID NO: 226259 - RNA, 22 nt, Human
aaauguauuagccuaugugaga

SEQ ID NO: 226260 - RNA, 22 nt, Human
aaauucggggaguuuugaggau

SEQ ID NO: 226261 - RNA, 22 nt, Human
aaauguguagaggggagagccg

SEQ ID NO: 226262 - RNA, 22 nt, Human
aaauguuugguggauaaaagga

SEQ ID NO: 226263 - RNA, 22 nt, Human
aaauucagauggcuuucuuuuc

SEQ ID NO: 226264 - RNA, 22 nt, Human
aaauucuuccaggaggaaauac

SEQ ID NO: 226265 - RNA, 20 nt, Human
aaauucgacuaaaaccagaa

SEQ ID NO: 226266 - RNA, 22 nt, Human
aaauucagcagguuucaaaagc

SEQ ID NO: 226267 - RNA, 22 nt, Human
aaauggauaaucaagauaauca

SEQ ID NO: 226268 - RNA, 17 nt, Human
aaaugguccuagggauu

SEQ ID NO: 226269 - RNA, 22 nt, Human
aaaugcuuuaauugaguucaug

SEQ ID NO: 226270 - RNA, 20 nt, Human
aaagauacuuuuuguaaugg

SEQ ID NO: 226271 - RNA, 22 nt, Human
aaagaccuucacuuucuggcug

SEQ ID NO: 226272 - RNA, 22 nt, Human
aaagaggacgugcuauuuuuua

SEQ ID NO: 226273 - RNA, 22 nt, Human
aaccuuucucccugcacacugg

SEQ ID NO: 226274 - RNA, 22 nt, Human
aacuacucugggguggcagguu

SEQ ID NO: 226275 - RNA, 22 nt, Human
aaccuggguguacauuaugguc

SEQ ID NO: 226276 - RNA, 22 nt, Human
aacgggguugauuauuggaaga

SEQ ID NO: 226277 - RNA, 19 nt, Human
aacuacagcgcacuguccu

SEQ ID NO: 226278 - RNA, 22 nt, Human
aacuaaggccacaagaggcaaa

SEQ ID NO: 226279 - RNA, 22 nt, Human
aacgauuugaguuaguuuuuag

SEQ ID NO: 226280 - RNA, 22 nt, Human
aacgaugauaaauuguucucug

SEQ ID NO: 226281 - RNA, 22 nt, Human
aacgagcugggggggccggggg

SEQ ID NO: 226282 - RNA, 22 nt, Human
aaccauggauuucaguucaccu

SEQ ID NO: 226283 - RNA, 22 nt, Human
aacccacuaugauuguccucau

SEQ ID NO: 226284 - RNA, 22 nt, Human
aacccugaacuuaguucuagga

SEQ ID NO: 226285 - RNA, 22 nt, Human
aaccggauugauccuucuuuga

SEQ ID NO: 226286 - RNA, 22 nt, Human
aaccguguucgggaacacuugu

SEQ ID NO: 226287 - RNA, 22 nt, Human
aacccuguuguguacaugcaua

SEQ ID NO: 226288 - RNA, 22 nt, Human
aacgcaacaacuggagcuguag

SEQ ID NO: 226289 - RNA, 22 nt, Human
aacagguucaagccuugcagca

SEQ ID NO: 226290 - RNA, 22 nt, Human
aacagggcgugaauaaugaaga

SEQ ID NO: 226291 - RNA, 22 nt, Human
aacaguacaucaugaggucauc

SEQ ID NO: 226292 - RNA, 22 nt, Human
aacaucaaaggaagaaugauau

SEQ ID NO: 226293 - RNA, 22 nt, Human
aacccguagaucaguucuaggu

SEQ ID NO: 226294 - RNA, 22 nt, Human
aacaugggcaacuucuuuucag

SEQ ID NO: 226295 - RNA, 22 nt, Human
aaccaguacuucucuauucagu

SEQ ID NO: 226296 - RNA, 22 nt, Human
aaccaauaagaggaugccauuu

SEQ ID NO: 226297 - RNA, 22 nt, Human
aacauuuccggccuuuuguucu

SEQ ID NO: 226298 - RNA, 20 nt, Human
aaccuauuguaauauucuaa

SEQ ID NO: 226299 - RNA, 22 nt, Human
aaccaggcgagagagcggucag

SEQ ID NO: 226300 - RNA, 22 nt, Human
aaccagaagucaucagagcuga

SEQ ID NO: 226301 - RNA, 22 nt, Human
aaccugaggguagacaaguuca

SEQ ID NO: 226302 - RNA, 22 nt, Human
aaccuggaggaccuuaugcuaa

SEQ ID NO: 226303 - RNA, 22 nt, Human
aaccucuuugugaaugucauga

SEQ ID NO: 226304 - RNA, 22 nt, Human
aagaaugaaaugaaagaacuaa

SEQ ID NO: 226305 - RNA, 22 nt, Human
aagaagcuacugucacuaucag

SEQ ID NO: 226306 - RNA, 22 nt, Human
aagaaggaaggcaagagauggg

SEQ ID NO: 226307 - RNA, 22 nt, Human
aagaagagaauauauuuacguc

SEQ ID NO: 226308 - RNA, 22 nt, Human
aagacacuuucuaaauagaagu

SEQ ID NO: 226309 - RNA, 20 nt, Human
aagacacuguccccacugga

SEQ ID NO: 226310 - RNA, 22 nt, Human
aagaaaagaaacauggguaugc

SEQ ID NO: 226311 - RNA, 22 nt, Human
aagagaaaugcuuuaacuuuau

SEQ ID NO: 226312 - RNA, 22 nt, Human
aagagaggaaagggugugaggu

SEQ ID NO: 226313 - RNA, 22 nt, Human
aagaggcagcuugguaggcauc

SEQ ID NO: 226314 - RNA, 22 nt, Human
aagaggauuuuaguuugccaga

SEQ ID NO: 226315 - RNA, 22 nt, Human
aagaggaggacgguucccagaa

SEQ ID NO: 226316 - RNA, 22 nt, Human
aagagcuuguuaugcugcucuu

SEQ ID NO: 226317 - RNA, 22 nt, Human
aagagaaagggaaaaugguaaa

SEQ ID NO: 226318 - RNA, 21 nt, Human
aagacguaguuggguggacca

SEQ ID NO: 226319 - RNA, 22 nt, Human
aagaguggagcuggaaaguggg

SEQ ID NO: 226320 - RNA, 22 nt, Human
aagagugaguagcuugguuggu

SEQ ID NO: 226321 - RNA, 22 nt, Human
aagauguuguagauuagugaga

SEQ ID NO: 226322 - RNA, 22 nt, Human
aagaugcuucaugagaguuggg

SEQ ID NO: 226323 - RNA, 22 nt, Human
aagcacuaauauuuuggcaccu

SEQ ID NO: 226324 - RNA, 22 nt, Human
aagcagaaaaacugagcuccaa

SEQ ID NO: 226325 - RNA, 22 nt, Human
aagcaauucacaguucacuuaa

SEQ ID NO: 226326 - RNA, 22 nt, Human
aagcacagggacucaggaccgg

SEQ ID NO: 226327 - RNA, 22 nt, Human
aagcaaguucuaaaguaauucu

SEQ ID NO: 226328 - RNA, 22 nt, Human
aagcaacccagugcuuguauag

SEQ ID NO: 226329 - RNA, 21 nt, Human
aagagcgccgggcagggcuga

SEQ ID NO: 226330 - RNA, 22 nt, Human
aagaggaauaauaaaaauugca

SEQ ID NO: 226331 - RNA, 22 nt, Human
aagcaaaagguuacacuucugg

SEQ ID NO: 226332 - RNA, 22 nt, Human
aagauuugaaaguggugcauuu

SEQ ID NO: 226333 - RNA, 22 nt, Human
aagauucaguugguuuuggaaa

SEQ ID NO: 226334 - RNA, 22 nt, Human
aagauuuaccacuuuauucaag

SEQ ID NO: 226335 - RNA, 22 nt, Human
aagcaugagguggugagugaca

SEQ ID NO: 226336 - RNA, 22 nt, Human
aagcauaucaaguuuuaugugc

SEQ ID NO: 226337 - RNA, 22 nt, Human
aagcagaacuguuuuguuuucu

SEQ ID NO: 226338 - RNA, 22 nt, Human
aagccgagggaggugauggaga

SEQ ID NO: 226339 - RNA, 22 nt, Human
aagcagcauaugacagcaucca

SEQ ID NO: 226340 - RNA, 22 nt, Human
aagccagccaguuccagcagcu

SEQ ID NO: 226341 - RNA, 22 nt, Human
aacucugacgcugucaaauaca

SEQ ID NO: 226342 - RNA, 22 nt, Human
aacuuucagaauccuaugcauu

SEQ ID NO: 226343 - RNA, 22 nt, Human
aacuuucuuugcaucuaaguuu

SEQ ID NO: 226344 - RNA, 22 nt, Human
aacuuucugaaaagcuugauca

SEQ ID NO: 226345 - RNA, 22 nt, Human
aacuuuuaugaaggaaaucaua

SEQ ID NO: 226346 - RNA, 23 nt, Human
aacugcaagguugcugggaagua

SEQ ID NO: 226347 - RNA, 22 nt, Human
aacugggugauucaggcuguuu

SEQ ID NO: 226348 - RNA, 22 nt, Human
aacugcauaagcuucgggaccu

SEQ ID NO: 226349 - RNA, 20 nt, Human
aacuuugagugcaugacuuu

SEQ ID NO: 226350 - RNA, 19 nt, Human
aagaacaguucuaauuuca

SEQ ID NO: 226351 - RNA, 22 nt, Human
aagaacaacugcuuuaaaagca

SEQ ID NO: 226352 - RNA, 22 nt, Human
aagaaauagauagaggaauacu

SEQ ID NO: 226353 - RNA, 22 nt, Human
aagaaauacagaaauggcagua

SEQ ID NO: 226354 - RNA, 22 nt, Human
aagaaagaucugaaagaagcga

SEQ ID NO: 226355 - RNA, 22 nt, Human
aagaaaggagauauucuuuuag

SEQ ID NO: 226356 - RNA, 22 nt, Human
aacucugagaaacuugcaguug

SEQ ID NO: 226357 - RNA, 22 nt, Human
aacucgaugcaauucacuuugu

SEQ ID NO: 226358 - RNA, 22 nt, Human
aacucaggagagaguaacaggg

SEQ ID NO: 226359 - RNA, 22 nt, Human
aacucugcaaugaaaucauguu

SEQ ID NO: 226360 - RNA, 21 nt, Human
aacuauuaauaccauuagcaa

SEQ ID NO: 226361 - RNA, 22 nt, Human
aacuguugucacgaauguggcu

SEQ ID NO: 226362 - RNA, 22 nt, Human
aacuggguuuaucuaaugugua

SEQ ID NO: 226363 - RNA, 22 nt, Human
aacuuaacucugcaauccagcu

SEQ ID NO: 226364 - RNA, 22 nt, Human
aacugguaauuuaguauuacug

SEQ ID NO: 226365 - RNA, 22 nt, Human
aacuugaagacaccccacauuc

SEQ ID NO: 226366 - RNA, 22 nt, Human
aacuucuggaaacuuccaugug

SEQ ID NO: 226367 - RNA, 22 nt, Human
aacuuauacccagggcagaaau

SEQ ID NO: 226368 - RNA, 22 nt, Human
aacgcugugcacuggguccagg

SEQ ID NO: 226369 - RNA, 22 nt, Human
aacgccgggacucgcagggagc

SEQ ID NO: 226370 - RNA, 22 nt, Human
aacgcagagaguaaugcugaac

SEQ ID NO: 226371 - RNA, 22 nt, Human
aacugaaguuuucagauuuugc

SEQ ID NO: 226372 - RNA, 23 nt, Human
aacucuggcuagcauagaauaga

SEQ ID NO: 226373 - RNA, 19 nt, Human
aacucugccgaggcaagcc

SEQ ID NO: 226374 - RNA, 22 nt, Human
aacguaauuuguggaaggggua

SEQ ID NO: 226375 - RNA, 22 nt, Human
aacgugcuuuacaaaugaccuu

SEQ ID NO: 226376 - RNA, 21 nt, Human
aacuaaugacugcagcaggaa

SEQ ID NO: 226377 - RNA, 22 nt, Human
aacgggcacuuuauuuaaaaaa

SEQ ID NO: 226378 - RNA, 22 nt, Human
aagccuguugacagcugucagu

SEQ ID NO: 226379 - RNA, 22 nt, Human
aagccuccgugcugcuggaucu

SEQ ID NO: 226380 - RNA, 22 nt, Human
aagcaguuuagucaucgggauu

SEQ ID NO: 226381 - RNA, 22 nt, Human
aagcagugacucucagaggcag

SEQ ID NO: 226382 - RNA, 22 nt, Human
aaggaggaugaauugucugcaa

SEQ ID NO: 226383 - RNA, 22 nt, Human
aaggaugguaacaguuucauuu

SEQ ID NO: 226384 - RNA, 22 nt, Human
aaggcuuugugcugaguugucg

SEQ ID NO: 226385 - RNA, 22 nt, Human
aaggcuguuugagcacuggagc

SEQ ID NO: 226386 - RNA, 22 nt, Human
aaggcugaccaguuuacacuuu

SEQ ID NO: 226387 - RNA, 22 nt, Human
aaggcgccacagugauugcaaa

SEQ ID NO: 226388 - RNA, 22 nt, Human
aaggcggcggcggcggcugcgg

SEQ ID NO: 226389 - RNA, 22 nt, Human
aaggcacuugcccagagcugca

SEQ ID NO: 226390 - RNA, 22 nt, Human
aaggccacacuugcuggccagc

SEQ ID NO: 226391 - RNA, 22 nt, Human
aaggccuaggaguugacauggg

SEQ ID NO: 226392 - RNA, 22 nt, Human
aagggaaaagcugaaugagaug

SEQ ID NO: 226393 - RNA, 23 nt, Human
aagggcgauuaacauucgcucga

SEQ ID NO: 226394 - RNA, 22 nt, Human
aagggaaacagccaggcccugu

SEQ ID NO: 226395 - RNA, 22 nt, Human
aagggaaggaugggcauuuaca

SEQ ID NO: 226396 - RNA, 22 nt, Human
aagggggacaagcauuggcuua

SEQ ID NO: 226397 - RNA, 22 nt, Human
aagggaaguuugacacuuuuua

SEQ ID NO: 226398 - RNA, 22 nt, Human
aagggaauagagcagcaaaaau

SEQ ID NO: 226399 - RNA, 22 nt, Human
aaggucaggggcuuuugaaaca

SEQ ID NO: 226400 - RNA, 22 nt, Human
aagguaaugcaucaggcaggga

SEQ ID NO: 226401 - RNA, 22 nt, Human
aagguauaucuuuaaaagugaa

SEQ ID NO: 226402 - RNA, 22 nt, Human
aaggggggcaccugcaugcccg

SEQ ID NO: 226403 - RNA, 22 nt, Human
aaguaaaucuuaugucagggag

SEQ ID NO: 226404 - RNA, 22 nt, Human
aagguuuuguaugaaaucucug

SEQ ID NO: 226405 - RNA, 21 nt, Human
aaguaaauuuuuacuuaggcc

SEQ ID NO: 226406 - RNA, 22 nt, Human
aagguuuuguuuucgguuuuuu

SEQ ID NO: 226407 - RNA, 22 nt, Human
aagguguaaguagcugguucau

SEQ ID NO: 226408 - RNA, 22 nt, Human
aaguaacuggguggccccaguu

SEQ ID NO: 226409 - RNA, 22 nt, Human
aaguaacuggggagggagggug

SEQ ID NO: 226410 - RNA, 21 nt, Human
aaguacccuuuugcuacucag

SEQ ID NO: 226411 - RNA, 22 nt, Human
aauauauaugggugcaugucug

SEQ ID NO: 226412 - RNA, 22 nt, Human
aauaucuugaguuauaaauuca

SEQ ID NO: 226413 - RNA, 22 nt, Human
aauaguggcuuggacuaaauau

SEQ ID NO: 226414 - RNA, 22 nt, Human
aauagguaaaugaguaagaaau

SEQ ID NO: 226415 - RNA, 22 nt, Human
aauaggguccuuuguguuauau

SEQ ID NO: 226416 - RNA, 22 nt, Human
aauagagacaguuuaacaauau

SEQ ID NO: 226417 - RNA, 22 nt, Human
aauacagauggcaugugaagau

SEQ ID NO: 226418 - RNA, 22 nt, Human
aauacagcacucacaccucccu

SEQ ID NO: 226419 - RNA, 22 nt, Human
aauaagaguuaagaaguauauu

SEQ ID NO: 226420 - RNA, 21 nt, Human
aaguuucucccuaauuguugc

SEQ ID NO: 226421 - RNA, 22 nt, Human
aauaacuuaaugacuguguaca

SEQ ID NO: 226422 - RNA, 22 nt, Human
aauaacaguuuauuugagggcu

SEQ ID NO: 226423 - RNA, 22 nt, Human
aaguggcaggggaaggguugga

SEQ ID NO: 226424 - RNA, 23 nt, Human
aaguggucaucuaucccaugguu

SEQ ID NO: 226425 - RNA, 22 nt, Human
aaguggcccuaauugggccaaa

SEQ ID NO: 226426 - RNA, 17 nt, Human
aagugggcaaagugaga

SEQ ID NO: 226427 - RNA, 23 nt, Human
aaguggugacugugcuacugaga

SEQ ID NO: 226428 - RNA, 22 nt, Human
aaguggugagacccugcugaaa

SEQ ID NO: 226429 - RNA, 22 nt, Human
aaguagaaaaccgcacuggacu

SEQ ID NO: 226430 - RNA, 22 nt, Human
aagucauuaucucuucuaaucu

SEQ ID NO: 226431 - RNA, 22 nt, Human
aagugugugagaaggggucgca

SEQ ID NO: 226432 - RNA, 22 nt, Human
aagugugugugcgcaugugcau

SEQ ID NO: 226433 - RNA, 22 nt, Human
aaguccgggcagcaggaauucu

SEQ ID NO: 226434 - RNA, 22 nt, Human
aagugucucugggaggcccgga

SEQ ID NO: 226435 - RNA, 22 nt, Human
aaguuaugauuggcguggacaa

SEQ ID NO: 226436 - RNA, 22 nt, Human
aaguuccacuagugacccagaa

SEQ ID NO: 226437 - RNA, 22 nt, Human
aaguugacuguuuuacuuaugu

SEQ ID NO: 226438 - RNA, 22 nt, Human
aaguugaaugucuugcugaaug

SEQ ID NO: 226439 - RNA, 22 nt, Human
aaguuaaaaaagcuggguaaaa

SEQ ID NO: 226440 - RNA, 20 nt, Human
aaguugaaguuacuucaugg

SEQ ID NO: 226441 - RNA, 22 nt, Human
aaugaacuuucaguucagagag

SEQ ID NO: 226442 - RNA, 22 nt, Human
aaugaaacuaguagaaucuuug

SEQ ID NO: 226443 - RNA, 22 nt, Human
aaugaacuuugaagauggugaa

SEQ ID NO: 226444 - RNA, 22 nt, Human
aaugaaaaucugucaguucaag

SEQ ID NO: 226445 - RNA, 22 nt, Human
aaugagaauguaagugaagaga

SEQ ID NO: 226446 - RNA, 22 nt, Human
aaugaguucaucugaauucugg

SEQ ID NO: 226447 - RNA, 22 nt, Human
aaugacagccuauacugucugc

SEQ ID NO: 226448 - RNA, 22 nt, Human
aaugaaugaaugaaugauuaug

SEQ ID NO: 226449 - RNA, 22 nt, Human
aaugauuuucugcaaacaguga

SEQ ID NO: 226450 - RNA, 22 nt, Human
aaugaguuuguucuauuauuug

SEQ ID NO: 226451 - RNA, 22 nt, Human
aaugccuucauuggcgaagugc

SEQ ID NO: 226452 - RNA, 22 nt, Human
aaugagacgagagaacccauuu

SEQ ID NO: 226453 - RNA, 22 nt, Human
aaugagauggaggacucuuaau

SEQ ID NO: 226454 - RNA, 22 nt, Human
aaugagauaagaaaaccuuugc

SEQ ID NO: 226455 - RNA, 23 nt, Human
aaugaguugggcagcauacaggc

SEQ ID NO: 226456 - RNA, 22 nt, Human
aaugacaguggcacagucacuu

SEQ ID NO: 226457 - RNA, 22 nt, Human
aauccaaacaggauuaccuauc

SEQ ID NO: 226458 - RNA, 22 nt, Human
aaucgacuguagagacuuggcg

SEQ ID NO: 226459 - RNA, 22 nt, Human
aauccucguagugguuagaaag

SEQ ID NO: 226460 - RNA, 22 nt, Human
aaucugacaaaauauuuccagu

SEQ ID NO: 226461 - RNA, 22 nt, Human
aaucaagcugcuguuuguucua

SEQ ID NO: 226462 - RNA, 23 nt, Human
aaucacuggauuugagcaugagg

SEQ ID NO: 226463 - RNA, 22 nt, Human
aaucaugguacaaguaagcacg

SEQ ID NO: 226464 - RNA, 22 nt, Human
aauauuuaccuaccugucaucu

SEQ ID NO: 226465 - RNA, 22 nt, Human
aauauuuugggacugaggaauu

SEQ ID NO: 226466 - RNA, 22 nt, Human
aaucucguuaugaagaugguug

SEQ ID NO: 226467 - RNA, 22 nt, Human
aaucugugaggaauaaugaguu

SEQ ID NO: 226468 - RNA, 22 nt, Human
aaucuuguucaacauuaucugu

SEQ ID NO: 226469 - RNA, 22 nt, Human
aaucugugugugagaaauggca

SEQ ID NO: 226470 - RNA, 22 nt, Human
aaucuuuuugaaggaggagaga

SEQ ID NO: 226471 - RNA, 22 nt, Human
aaucugaccguggagaucucca

SEQ ID NO: 226472 - RNA, 22 nt, Human
aaucuguugucaggaauccaca

SEQ ID NO: 226473 - RNA, 22 nt, Human
aaugaauaaauuuuaaagacag

SEQ ID NO: 226474 - RNA, 22 nt, Human
aauggaccuuaaauugcuucag

SEQ ID NO: 226475 - RNA, 22 nt, Human
aauggacuucucugagccuguu

SEQ ID NO: 226476 - RNA, 22 nt, Human
aaugcauacguguuuguggcaa

SEQ ID NO: 226477 - RNA, 22 nt, Human
aaugcuaaagaagaaggaguag

SEQ ID NO: 226478 - RNA, 22 nt, Human
aaugcagaugugucuuuaauuu

SEQ ID NO: 226479 - RNA, 22 nt, Human
aauggagaaaagacaauguuga

SEQ ID NO: 226480 - RNA, 22 nt, Human
aauggagugguucuugcccucu

SEQ ID NO: 226481 - RNA, 22 nt, Human
aauguacucuguguuucucaug

SEQ ID NO: 226482 - RNA, 22 nt, Human
aauguaguuuacugugagugca

SEQ ID NO: 226483 - RNA, 22 nt, Human
aaugguuacuacccugggucuu

SEQ ID NO: 226484 - RNA, 22 nt, Human
aauguacucgaaugauguuaag

SEQ ID NO: 226485 - RNA, 22 nt, Human
aauguaaauaauuguaaaauuu

SEQ ID NO: 226486 - RNA, 23 nt, Human
aaugggcggaaguguuaaguugc

SEQ ID NO: 226487 - RNA, 22 nt, Human
aaugggauuaagaaagaucuug

SEQ ID NO: 226488 - RNA, 22 nt, Human
aaugggauaggucuucaggaau

SEQ ID NO: 226489 - RNA, 22 nt, Human
aaugguggaugucuguucugac

SEQ ID NO: 226490 - RNA, 22 nt, Human
aauguauuuuuaggcagaauau

SEQ ID NO: 226491 - RNA, 22 nt, Human
aauguucucuaaucuuucucuu

SEQ ID NO: 226492 - RNA, 22 nt, Human
aauguugaaccuuuuuggccug

SEQ ID NO: 226493 - RNA, 22 nt, Human
aauguugacguuggccagggcc

SEQ ID NO: 226494 - RNA, 23 nt, Human
aauguugaggguggguuuuuaac

SEQ ID NO: 226495 - RNA, 22 nt, Human
aauguuuaacuguggucagcag

SEQ ID NO: 226496 - RNA, 22 nt, Human
aauguuugaacuuugcauauuu

SEQ ID NO: 226497 - RNA, 22 nt, Human
aauguuuaagcuuuuauuuaca

SEQ ID NO: 226498 - RNA, 22 nt, Human
aauguuguaaauauucuuugag

SEQ ID NO: 226499 - RNA, 22 nt, Human
aauuacuuuaggaaaacuccuc

SEQ ID NO: 226500 - RNA, 22 nt, Human
aauuaaggccuuuaaaugucuu

SEQ ID NO: 226501 - RNA, 22 nt, Human
aauuauucuugccuagguuuaa

SEQ ID NO: 226502 - RNA, 22 nt, Human
aauuauguuugcuuuagaugga

SEQ ID NO: 226503 - RNA, 22 nt, Human
aauuagaagcuguuagcaaaau

SEQ ID NO: 226504 - RNA, 22 nt, Human
aauucaggacaaauguuuucaa

SEQ ID NO: 226505 - RNA, 22 nt, Human
aauucaacagucaguuaucuca

SEQ ID NO: 226506 - RNA, 22 nt, Human
aauuauugucuuuuuuaaaagc

SEQ ID NO: 226507 - RNA, 21 nt, Human
aauuauuugcauuuuucuugu

SEQ ID NO: 226508 - RNA, 21 nt, Human
acugccaugcaggagccucca

SEQ ID NO: 226509 - RNA, 22 nt, Human
acugagaacuuggggacagagg

SEQ ID NO: 226510 - RNA, 22 nt, Human
acugauuccaagcuuguggagg

SEQ ID NO: 226511 - RNA, 22 nt, Human
acuaauuguuuaaggauaggaa

SEQ ID NO: 226512 - RNA, 22 nt, Human
acuggcuuggaaauggguauuu

SEQ ID NO: 226513 - RNA, 19 nt, Human
acugggaugggcagugcca

SEQ ID NO: 226514 - RNA, 15 nt, Human
acugggaaggaguau

SEQ ID NO: 226515 - RNA, 22 nt, Human
acuggggauugguucuucaaca

SEQ ID NO: 226516 - RNA, 22 nt, Human
acugggcaaggauaugaugggu

SEQ ID NO: 226517 - RNA, 20 nt, Human
acugcaagagacagaugaaa

SEQ ID NO: 226518 - RNA, 22 nt, Human
acugugcccccucuacugcuga

SEQ ID NO: 226519 - RNA, 22 nt, Human
acuguggcugcuacccuggcuc

SEQ ID NO: 226520 - RNA, 22 nt, Human
acuguucacccagcacuagcag

SEQ ID NO: 226521 - RNA, 22 nt, Human
acuguugagggaagcagaugaa

SEQ ID NO: 226522 - RNA, 22 nt, Human
acugugauguaaagaaauaggc

SEQ ID NO: 226523 - RNA, 22 nt, Human
acugugauuuguuuuuguguuu

SEQ ID NO: 226524 - RNA, 22 nt, Human
acugugacugugucuucugggc

SEQ ID NO: 226525 - RNA, 22 nt, Human
acugucuuguuguaugugagcu

SEQ ID NO: 226526 - RNA, 22 nt, Human
acuggggaggucuggauggauc

SEQ ID NO: 226527 - RNA, 22 nt, Human
acugguuucaaguuggacugaa

SEQ ID NO: 226528 - RNA, 22 nt, Human
acuggugcucuggccaccgcug

SEQ ID NO: 226529 - RNA, 19 nt, Human
acuggggcaggcugggcuu

SEQ ID NO: 226530 - RNA, 22 nt, Human
acuggguuguuugucucaugag

SEQ ID NO: 226531 - RNA, 22 nt, Human
acuggcaugauagaccauaaca

SEQ ID NO: 226532 - RNA, 22 nt, Human
acuggcuuauuguuguggagcu

SEQ ID NO: 226533 - RNA, 22 nt, Human
acuggcgucugucuccccugcc

SEQ ID NO: 226534 - RNA, 22 nt, Human
acuggcauuccuaggggagggg

SEQ ID NO: 226535 - RNA, 22 nt, Human
acuggggcaggaaaguaugcug

SEQ ID NO: 226536 - RNA, 22 nt, Human
acugucaggauugagucucugg

SEQ ID NO: 226537 - RNA, 22 nt, Human
acugucauuaaugaauguaaua

SEQ ID NO: 226538 - RNA, 22 nt, Human
acugguagcugauuaaguauag

SEQ ID NO: 226539 - RNA, 21 nt, Human
acugggcuagccugacuucug

SEQ ID NO: 226540 - RNA, 22 nt, Human
acugauuuuauauauuaccccg

SEQ ID NO: 226541 - RNA, 22 nt, Human
acugugacucuguuucuuggau

SEQ ID NO: 226542 - RNA, 18 nt, Human
acuguggcucagaguugc

SEQ ID NO: 226543 - RNA, 22 nt, Human
acugugaagagcauucuggcug

SEQ ID NO: 226544 - RNA, 18 nt, Human
acuguccucaggacguug

SEQ ID NO: 226545 - RNA, 22 nt, Human
acuguuauugguguauguggca

SEQ ID NO: 226546 - RNA, 22 nt, Human
acuguccucgaaguaccugugc

SEQ ID NO: 226547 - RNA, 17 nt, Human
acuuaagacaguggaaa

SEQ ID NO: 226548 - RNA, 22 nt, Human
acuuacuuucuauucuuguagg

SEQ ID NO: 226549 - RNA, 22 nt, Human
acuucucuuuucauuaauuuug

SEQ ID NO: 226550 - RNA, 22 nt, Human
acuuuuaaggggccuugauuua

SEQ ID NO: 226551 - RNA, 22 nt, Human
acuugggaaaugaaaauacaga

SEQ ID NO: 226552 - RNA, 22 nt, Human
acuuugucuugaucaaaggugu

SEQ ID NO: 226553 - RNA, 22 nt, Human
acuucuuuugcaugauucuuua

SEQ ID NO: 226554 - RNA, 22 nt, Human
acuugauggaguuucacuguau

SEQ ID NO: 226555 - RNA, 19 nt, Human
agaaauagccuuccuuguc

SEQ ID NO: 226556 - RNA, 22 nt, Human
agaaagcacccugcacuuucug

SEQ ID NO: 226557 - RNA, 22 nt, Human
agaaacaagcccuagaaguccu

SEQ ID NO: 226558 - RNA, 22 nt, Human
agaagaucccugugguuacgac

SEQ ID NO: 226559 - RNA, 22 nt, Human
agaagcaauuggaaaguacagg

SEQ ID NO: 226560 - RNA, 22 nt, Human
agaaacacaaguaaagcuccca

SEQ ID NO: 226561 - RNA, 22 nt, Human
agaagauucagcaguagggugg

SEQ ID NO: 226562 - RNA, 22 nt, Human
agaagcaaagcaaacacauucu

SEQ ID NO: 226563 - RNA, 22 nt, Human
acuuugagaauuuuacuugugu

SEQ ID NO: 226564 - RNA, 22 nt, Human
acuuugccuucuuacuguguug

SEQ ID NO: 226565 - RNA, 22 nt, Human
acuuuggugcgaagucacuuua

SEQ ID NO: 226566 - RNA, 22 nt, Human
agaaaagagacaauguuuuugg

SEQ ID NO: 226567 - RNA, 22 nt, Human
acuuuuuugccaucccuccagc

SEQ ID NO: 226568 - RNA, 22 nt, Human
acuuuuccuggguagcuccugg

SEQ ID NO: 226569 - RNA, 22 nt, Human
agaaauggggugaagcaaaugg

SEQ ID NO: 226570 - RNA, 22 nt, Human
agaaauuguaauaaaucugguc

SEQ ID NO: 226571 - RNA, 22 nt, Human
agaacaagaaacccgaaaagug

SEQ ID NO: 226572 - RNA, 22 nt, Human
agaacauaucuguuuucuaacu

SEQ ID NO: 226573 - RNA, 22 nt, Human
agaauccugagggaaauuuggc

SEQ ID NO: 226574 - RNA, 22 nt, Human
agaaucaggaagacagccuggc

SEQ ID NO: 226575 - RNA, 22 nt, Human
agaaucagagcagaaucuucau

SEQ ID NO: 226576 - RNA, 22 nt, Human
agacagaaaaguugucaaucau

SEQ ID NO: 226577 - RNA, 22 nt, Human
agaaccauccugguuccagcuu

SEQ ID NO: 226578 - RNA, 22 nt, Human
agacacugacaggguccaugga

SEQ ID NO: 226579 - RNA, 22 nt, Human
agacagaacauaauuaguacug

SEQ ID NO: 226580 - RNA, 21 nt, Human
agaaugaagaagaggucuuug

SEQ ID NO: 226581 - RNA, 22 nt, Human
agacagcggugcaauaaauggu

SEQ ID NO: 226582 - RNA, 21 nt, Human
agacugaugggaagacucugu

SEQ ID NO: 226583 - RNA, 22 nt, Human
agacauauuggcuugcuuuaau

SEQ ID NO: 226584 - RNA, 22 nt, Human
agacgacucuuaaggcagaauu

SEQ ID NO: 226585 - RNA, 22 nt, Human
agacgcgcagaaggaagcggcc

SEQ ID NO: 226586 - RNA, 22 nt, Human
agacuaauaucccauuucugac

SEQ ID NO: 226587 - RNA, 22 nt, Human
agacuuugaaugaugacagcgu

SEQ ID NO: 226588 - RNA, 22 nt, Human
agagaacaggcagcuggugccg

SEQ ID NO: 226589 - RNA, 22 nt, Human
agagaaauguacuagucuaacu

SEQ ID NO: 226590 - RNA, 22 nt, Human
agaccccuggggaggauuauag

SEQ ID NO: 226591 - RNA, 22 nt, Human
agagagggaugguguccagaga

SEQ ID NO: 226592 - RNA, 22 nt, Human
agacuguuuucccaucucuugg

SEQ ID NO: 226593 - RNA, 22 nt, Human
agacuguuccgucagacucagu

SEQ ID NO: 226594 - RNA, 19 nt, Human
agacugaagggcccgaguc

SEQ ID NO: 226595 - RNA, 22 nt, Human
agacuggagucuccuuuggagc

SEQ ID NO: 226596 - RNA, 22 nt, Human
agacuauuuugugauaacuaau

SEQ ID NO: 226597 - RNA, 22 nt, Human
agagaaccauggcauccaggua

SEQ ID NO: 226598 - RNA, 22 nt, Human
agacuagguauagguaauaacu

SEQ ID NO: 226599 - RNA, 22 nt, Human
agagaguacuuucaucagggaa

SEQ ID NO: 226600 - RNA, 22 nt, Human
agacuucucuuggcuauauuau

SEQ ID NO: 226601 - RNA, 22 nt, Human
agagaaacauuaauugaugagg

SEQ ID NO: 226602 - RNA, 22 nt, Human
agacuuuggcagggccaguggu

SEQ ID NO: 226603 - RNA, 20 nt, Human
agagaacaguuuggucacag

SEQ ID NO: 226604 - RNA, 22 nt, Human
agagcacaggguuuugugccgg

SEQ ID NO: 226605 - RNA, 19 nt, Human
agagauuuucuguuuuagu

SEQ ID NO: 226606 - RNA, 22 nt, Human
agagaguagaagggacaguauu

SEQ ID NO: 226607 - RNA, 21 nt, Human
agagaccuaagcugagauucc

SEQ ID NO: 226608 - RNA, 22 nt, Human
agagacauagcacaguuuuucg

SEQ ID NO: 226609 - RNA, 22 nt, Human
agagacugauggaucaccaaau

SEQ ID NO: 226610 - RNA, 22 nt, Human
agagacaagggaccucuggaga

SEQ ID NO: 226611 - RNA, 22 nt, Human
agagaagaauccccugguggag

SEQ ID NO: 226612 - RNA, 22 nt, Human
agagcuagaaggaagcauuucu

SEQ ID NO: 226613 - RNA, 22 nt, Human
agagcccagaucccacccugga

SEQ ID NO: 226614 - RNA, 22 nt, Human
agagccaugcuugugcauauau

SEQ ID NO: 226615 - RNA, 22 nt, Human
agagccauuuaaauaguuguca

SEQ ID NO: 226616 - RNA, 22 nt, Human
agagcagcuuuucggaaccacu

SEQ ID NO: 226617 - RNA, 22 nt, Human
agagugagauaugugguuggua

SEQ ID NO: 226618 - RNA, 22 nt, Human
agaguguaauuaguauuuauau

SEQ ID NO: 226619 - RNA, 22 nt, Human
agagggagcuccaagaucaagg

SEQ ID NO: 226620 - RNA, 22 nt, Human
agaggggaaggaugugauguga

SEQ ID NO: 226621 - RNA, 22 nt, Human
agaguaauguggaguuugugcu

SEQ ID NO: 226622 - RNA, 23 nt, Human
agagggaagagcuuagaugggga

SEQ ID NO: 226623 - RNA, 22 nt, Human
agagggagagaccuccgugccu

SEQ ID NO: 226624 - RNA, 22 nt, Human
agaggcaugaacucccguagcc

SEQ ID NO: 226625 - RNA, 22 nt, Human
agaggcaggcagcagagaagau

SEQ ID NO: 226626 - RNA, 22 nt, Human
agagauugagcucagaagaccu

SEQ ID NO: 226627 - RNA, 22 nt, Human
agagauuagagaagaugauaaa

SEQ ID NO: 226628 - RNA, 22 nt, Human
agagcagauggagcuggaagag

SEQ ID NO: 226629 - RNA, 22 nt, Human
agaggcacccaguuaagcugca

SEQ ID NO: 226630 - RNA, 22 nt, Human
agagcagcaaucuuugaaauua

SEQ ID NO: 226631 - RNA, 22 nt, Human
agagcuuuggaguaaguuuuga

SEQ ID NO: 226632 - RNA, 22 nt, Human
agagcuccaggguuuuguagug

SEQ ID NO: 226633 - RNA, 22 nt, Human
agagcugggacuuggacucaau

SEQ ID NO: 226634 - RNA, 22 nt, Human
agaggaguagcugagcucugca

SEQ ID NO: 226635 - RNA, 22 nt, Human
agaggugcuuaugcucaugguu

SEQ ID NO: 226636 - RNA, 21 nt, Human
agaggacuuuuuugauguuuu

SEQ ID NO: 226637 - RNA, 22 nt, Human
agaggagaauguaaauuuguca

SEQ ID NO: 226638 - RNA, 22 nt, Human
acccccuuucuugaccucaugu

SEQ ID NO: 226639 - RNA, 22 nt, Human
acccaucauuagucuuucagga

SEQ ID NO: 226640 - RNA, 19 nt, Human
acccaugcucuguggacuu

SEQ ID NO: 226641 - RNA, 22 nt, Human
acccggccuacucagugcccag

SEQ ID NO: 226642 - RNA, 22 nt, Human
accaccacauaguaggcacuua

SEQ ID NO: 226643 - RNA, 22 nt, Human
accaggcagcaccaaagccggu

SEQ ID NO: 226644 - RNA, 17 nt, Human
accaggggcagcacugc

SEQ ID NO: 226645 - RNA, 22 nt, Human
accagccacccugccgcguccg

SEQ ID NO: 226646 - RNA, 20 nt, Human
accagacagcuguuggggug

SEQ ID NO: 226647 - RNA, 22 nt, Human
accacguccugguggcuguugg

SEQ ID NO: 226648 - RNA, 22 nt, Human
accauuuaucagaagagacacc

SEQ ID NO: 226649 - RNA, 22 nt, Human
accauuauagaggacauuaugu

SEQ ID NO: 226650 - RNA, 22 nt, Human
accaguuuuuugaccaugggug

SEQ ID NO: 226651 - RNA, 22 nt, Human
accaguucuauguagauaauga

SEQ ID NO: 226652 - RNA, 22 nt, Human
accaauaaaagcaauucacagu

SEQ ID NO: 226653 - RNA, 22 nt, Human
acauuuuguuuauggaaaagau

SEQ ID NO: 226654 - RNA, 22 nt, Human
acauguuuacaaaccucaagcc

SEQ ID NO: 226655 - RNA, 22 nt, Human
acauuauuguguagugugggca

SEQ ID NO: 226656 - RNA, 22 nt, Human
acauugcagcuccuaccuuguc

SEQ ID NO: 226657 - RNA, 22 nt, Human
acauucucuuuuagaaagcugu

SEQ ID NO: 226658 - RNA, 22 nt, Human
acauuuuuggguugaugucuga

SEQ ID NO: 226659 - RNA, 22 nt, Human
acauuuugggagaaaguuguua

SEQ ID NO: 226660 - RNA, 22 nt, Human
acaugguguggcacuaggggcu

SEQ ID NO: 226661 - RNA, 22 nt, Human
acaugugugucugugugugugu

SEQ ID NO: 226662 - RNA, 22 nt, Human
acaugucagaaaauucagaggg

SEQ ID NO: 226663 - RNA, 21 nt, Human
acauguacacauguaugcaca

SEQ ID NO: 226664 - RNA, 22 nt, Human
accaccacugacaccagcucgg

SEQ ID NO: 226665 - RNA, 22 nt, Human
acauugguauuaguguggcuga

SEQ ID NO: 226666 - RNA, 22 nt, Human
accaggaguuuugaccaggggc

SEQ ID NO: 226667 - RNA, 22 nt, Human
accagcgcguuuucaguuucau

SEQ ID NO: 226668 - RNA, 22 nt, Human
accagccacacacauuagucac

SEQ ID NO: 226669 - RNA, 22 nt, Human
acauuguuuuugugacuucuau

SEQ ID NO: 226670 - RNA, 22 nt, Human
acaucucacuucuuugaaggcu

SEQ ID NO: 226671 - RNA, 22 nt, Human
acaucuucuauggagguucgga

SEQ ID NO: 226672 - RNA, 22 nt, Human
acaugacagugacuuuauaaga

SEQ ID NO: 226673 - RNA, 22 nt, Human
acauuccugaagguaaugagaa

SEQ ID NO: 226674 - RNA, 22 nt, Human
acauccagcagauuguccagag

SEQ ID NO: 226675 - RNA, 22 nt, Human
acauguggaggaggcgagggua

SEQ ID NO: 226676 - RNA, 22 nt, Human
acaugggcaaucgcuuuauuca

SEQ ID NO: 226677 - RNA, 22 nt, Human
acaugggggugggacggcagag

SEQ ID NO: 226678 - RNA, 22 nt, Human
acauuuguuucucuagaguagg

SEQ ID NO: 226679 - RNA, 22 nt, Human
acauuuccaaagaugccaguca

SEQ ID NO: 226680 - RNA, 22 nt, Human
acauuucuccuacuuguuauuu

SEQ ID NO: 226681 - RNA, 22 nt, Human
acauuguuauuccucaggaguu

SEQ ID NO: 226682 - RNA, 22 nt, Human
acaugcuuucuagguccuucug

SEQ ID NO: 226683 - RNA, 22 nt, Human
acauggaaacacgcagccccaa

SEQ ID NO: 226684 - RNA, 22 nt, Human
acaugcuucauauuauaaccaa

SEQ ID NO: 226685 - RNA, 22 nt, Human
acauggaccucagauccuggcc

SEQ ID NO: 226686 - RNA, 22 nt, Human
acagugugcaagaaauggggga

SEQ ID NO: 226687 - RNA, 22 nt, Human
aauugauauuagauuugucuca

SEQ ID NO: 226688 - RNA, 21 nt, Human
aauucccagaaacagcacaag

SEQ ID NO: 226689 - RNA, 22 nt, Human
aauucugcagucguacuauaau

SEQ ID NO: 226690 - RNA, 22 nt, Human
aauucgcugcauuccaucuagg

SEQ ID NO: 226691 - RNA, 22 nt, Human
aauucugaggccauuuauuucc

SEQ ID NO: 226692 - RNA, 22 nt, Human
aauucagguuauauuugcaacu

SEQ ID NO: 226693 - RNA, 22 nt, Human
acaguuuucugagaaucacagg

SEQ ID NO: 226694 - RNA, 22 nt, Human
acauggaauuucagaagagcau

SEQ ID NO: 226695 - RNA, 22 nt, Human
acauaaauagcacugugaauuu

SEQ ID NO: 226696 - RNA, 22 nt, Human
acauggguuaaagaagauggaa

SEQ ID NO: 226697 - RNA, 22 nt, Human
acauauaugugcauacaacuau

SEQ ID NO: 226698 - RNA, 22 nt, Human
acauggcaugaauaauguguac

SEQ ID NO: 226699 - RNA, 22 nt, Human
acgaaugacaugugauuugaaa

SEQ ID NO: 226700 - RNA, 20 nt, Human
acgaacauauugcaggguuu

SEQ ID NO: 226701 - RNA, 22 nt, Human
acgauaacaauaguagcaugua

SEQ ID NO: 226702 - RNA, 22 nt, Human
acgaagggggcauggugagagu

SEQ ID NO: 226703 - RNA, 22 nt, Human
accuuguuguagguacaaaaga

SEQ ID NO: 226704 - RNA, 22 nt, Human
accuugauggagugaugaauga

SEQ ID NO: 226705 - RNA, 20 nt, Human
accuucuuugguagacggaa

SEQ ID NO: 226706 - RNA, 21 nt, Human
accugguuuacugaucccagg

SEQ ID NO: 226707 - RNA, 22 nt, Human
accuucguuuaguacucauuuu

SEQ ID NO: 226708 - RNA, 22 nt, Human
accuuaaacagauggcggcugg

SEQ ID NO: 226709 - RNA, 19 nt, Human
accuguucaaccucgugcu

SEQ ID NO: 226710 - RNA, 22 nt, Human
accugcagguguuuccacacuu

SEQ ID NO: 226711 - RNA, 22 nt, Human
acgcaacacugcuauuuuuuuc

SEQ ID NO: 226712 - RNA, 22 nt, Human
accugauuuuauggauuuugag

SEQ ID NO: 226713 - RNA, 22 nt, Human
accuguagcccaaucauggcag

SEQ ID NO: 226714 - RNA, 21 nt, Human
accuggugaugaaugggaggc

SEQ ID NO: 226715 - RNA, 22 nt, Human
accuggcccugggucuccugac

SEQ ID NO: 226716 - RNA, 22 nt, Human
accugguaaccugccugacuaa

SEQ ID NO: 226717 - RNA, 22 nt, Human
acggcuugaacgcgccuguggg

SEQ ID NO: 226718 - RNA, 23 nt, Human
acgggaggcggggcagggcugag

SEQ ID NO: 226719 - RNA, 22 nt, Human
acggcggguuccgggccagccc

SEQ ID NO: 226720 - RNA, 22 nt, Human
acgcuucacaggugcgcauugu

SEQ ID NO: 226721 - RNA, 22 nt, Human
acggagggagagagggaggaga

SEQ ID NO: 226722 - RNA, 22 nt, Human
acgcugagcucauggagaugca

SEQ ID NO: 226723 - RNA, 22 nt, Human
acgcgcuccagcaggugcuuca

SEQ ID NO: 226724 - RNA, 22 nt, Human
acgcacuuuaugcuuuuaacaa

SEQ ID NO: 226725 - RNA, 22 nt, Human
acgauuugguucagugaagaca

SEQ ID NO: 226726 - RNA, 22 nt, Human
acgaaauaaaauuaaagcccua

SEQ ID NO: 226727 - RNA, 22 nt, Human
accuuggauauucuuacucggu

SEQ ID NO: 226728 - RNA, 22 nt, Human
accuugggcccagaccggcacg

SEQ ID NO: 226729 - RNA, 22 nt, Human
acgaggauuuccuuagaugaaa

SEQ ID NO: 226730 - RNA, 22 nt, Human
acgugcauuacucaaaucucaa

SEQ ID NO: 226731 - RNA, 22 nt, Human
acuaaagcagcucagacgagaa

SEQ ID NO: 226732 - RNA, 22 nt, Human
acuaagcugugugguucacuca

SEQ ID NO: 226733 - RNA, 22 nt, Human
acuaaacauaucacugcuuuac

SEQ ID NO: 226734 - RNA, 22 nt, Human
acguuuuagccauguaguuucu

SEQ ID NO: 226735 - RNA, 22 nt, Human
acguuauagaugcuucaugaaa

SEQ ID NO: 226736 - RNA, 22 nt, Human
acgguguuucucguucaggguu

SEQ ID NO: 226737 - RNA, 22 nt, Human
acggugagacuggcgaaggaaa

SEQ ID NO: 226738 - RNA, 22 nt, Human
acggguuccuugagggcaggau

SEQ ID NO: 226739 - RNA, 22 nt, Human
acggggagcgucggccucuccc

SEQ ID NO: 226740 - RNA, 22 nt, Human
acgggugcuuguucccgcugcu

SEQ ID NO: 226741 - RNA, 22 nt, Human
accgauguggaaaauuucauuu

SEQ ID NO: 226742 - RNA, 22 nt, Human
accugaucugagaaguggaggg

SEQ ID NO: 226743 - RNA, 21 nt, Human
accgucaguacuaguauugac

SEQ ID NO: 226744 - RNA, 22 nt, Human
accugaccagguggcuucccaa

SEQ ID NO: 226745 - RNA, 22 nt, Human
accugcucucccucucgcaguc

SEQ ID NO: 226746 - RNA, 22 nt, Human
accuggacucugaucacuuuug

SEQ ID NO: 226747 - RNA, 22 nt, Human
accuggaccugccaccuaugag

SEQ ID NO: 226748 - RNA, 22 nt, Human
accuggauauuuucaguugcau

SEQ ID NO: 226749 - RNA, 23 nt, Human
accuggucccaugggugggccug

SEQ ID NO: 226750 - RNA, 22 nt, Human
accucauucugcauagaacuuu

SEQ ID NO: 226751 - RNA, 22 nt, Human
accuccauggcccacaucuagu

SEQ ID NO: 226752 - RNA, 22 nt, Human
accucuuuuugaauauagcauu

SEQ ID NO: 226753 - RNA, 22 nt, Human
accucuuucuauggauuuuuug

SEQ ID NO: 226754 - RNA, 22 nt, Human
accucccugaaaaagacagugc

SEQ ID NO: 226755 - RNA, 22 nt, Human
accgcuggcacuggggacgggg

SEQ ID NO: 226756 - RNA, 21 nt, Human
acccagaauggagccaagccu

SEQ ID NO: 226757 - RNA, 23 nt, Human
accgccgcugccgccgcccccgc

SEQ ID NO: 226758 - RNA, 22 nt, Human
accgauuucaaauggugcuaga

SEQ ID NO: 226759 - RNA, 22 nt, Human
accgagcaggguguuugcgcac

SEQ ID NO: 226760 - RNA, 22 nt, Human
accaugacugucacauuauuau

SEQ ID NO: 226761 - RNA, 22 nt, Human
accauccaaaagcuuuucauca

SEQ ID NO: 226762 - RNA, 22 nt, Human
acccugacggugggcagcuuga

SEQ ID NO: 226763 - RNA, 22 nt, Human
accgugcccauucauuuacaaa

SEQ ID NO: 226764 - RNA, 22 nt, Human
accuauuguccagagccaggcc

SEQ ID NO: 226765 - RNA, 22 nt, Human
accgggcagcucugccccugcc

SEQ ID NO: 226766 - RNA, 22 nt, Human
accuauuuauacaacugcacca

SEQ ID NO: 226767 - RNA, 22 nt, Human
acccugcacagagggcuuuaua

SEQ ID NO: 226768 - RNA, 22 nt, Human
accgguucccaucuggagaguu

SEQ ID NO: 226769 - RNA, 22 nt, Human
accgucagguuagaaugagcac

SEQ ID NO: 226770 - RNA, 22 nt, Human
acccauggcucucugggaugcu

SEQ ID NO: 226771 - RNA, 22 nt, Human
accccagcucugagccacacca

SEQ ID NO: 226772 - RNA, 22 nt, Human
acccccacuccgcaguagaacu

SEQ ID NO: 226773 - RNA, 22 nt, Human
accccgugucccugaggguccu

SEQ ID NO: 226774 - RNA, 21 nt, Human
agcagucugcggccggugcgg

SEQ ID NO: 226775 - RNA, 22 nt, Human
agcagucagaucguggggaaaa

SEQ ID NO: 226776 - RNA, 18 nt, Human
agcagugcggaucauuuu

SEQ ID NO: 226777 - RNA, 19 nt, Human
agcagugaaaucuggugag

SEQ ID NO: 226778 - RNA, 22 nt, Human
agcaguugcuuuguauauuaaa

SEQ ID NO: 226779 - RNA, 22 nt, Human
agcaguuagauccugguuagcg

SEQ ID NO: 226780 - RNA, 22 nt, Human
agcagggagaccaucucuuccu

SEQ ID NO: 226781 - RNA, 22 nt, Human
agcaggguggcaagucuuucug

SEQ ID NO: 226782 - RNA, 22 nt, Human
agcaggggcaggguuuugugcu

SEQ ID NO: 226783 - RNA, 22 nt, Human
agcaggauggaguaacgugaaa

SEQ ID NO: 226784 - RNA, 22 nt, Human
agcaggagaaagaguaugggcu

SEQ ID NO: 226785 - RNA, 22 nt, Human
agcaggaggagagccuggcggu

SEQ ID NO: 226786 - RNA, 22 nt, Human
agcaggagagacuggcccaaaa

SEQ ID NO: 226787 - RNA, 17 nt, Human
agcagcuggguugaucu

SEQ ID NO: 226788 - RNA, 22 nt, Human
agcacggugguuaagagagugg

SEQ ID NO: 226789 - RNA, 22 nt, Human
agcacgcccaccuccugcggcg

SEQ ID NO: 226790 - RNA, 16 nt, Human
agcagcgugggggugg

SEQ ID NO: 226791 - RNA, 22 nt, Human
agauagccagauauaaauaguc

SEQ ID NO: 226792 - RNA, 22 nt, Human
agcagcaggcugggaugagucu

SEQ ID NO: 226793 - RNA, 22 nt, Human
agcagcaccuguccucgcugcu

SEQ ID NO: 226794 - RNA, 22 nt, Human
agauagaaggauugugacacau

SEQ ID NO: 226795 - RNA, 22 nt, Human
agcaucuaucuucaaugugugu

SEQ ID NO: 226796 - RNA, 22 nt, Human
agcauacuaggauguuuucugg

SEQ ID NO: 226797 - RNA, 22 nt, Human
agcauauaugcaugagugugca

SEQ ID NO: 226798 - RNA, 22 nt, Human
agcaucggacggagcaccugcu

SEQ ID NO: 226799 - RNA, 22 nt, Human
agcaggaggguuuuguagaguc

SEQ ID NO: 226800 - RNA, 22 nt, Human
agcagggugugggugugagugu

SEQ ID NO: 226801 - RNA, 22 nt, Human
agcauucccuuugcagugucau

SEQ ID NO: 226802 - RNA, 22 nt, Human
agcaggucagugguaaucaaaa

SEQ ID NO: 226803 - RNA, 22 nt, Human
agcagguucaagggcaaagcug

SEQ ID NO: 226804 - RNA, 22 nt, Human
agcauuugcuguucuagaaagu

SEQ ID NO: 226805 - RNA, 22 nt, Human
agcauucuguggucuucuaugg

SEQ ID NO: 226806 - RNA, 22 nt, Human
agccacggcaaugauaggcugc

SEQ ID NO: 226807 - RNA, 18 nt, Human
agcaguugucucucucca

SEQ ID NO: 226808 - RNA, 21 nt, Human
agccagguuuccuuugaagag

SEQ ID NO: 226809 - RNA, 19 nt, Human
agcaucuccacagaaaaag

SEQ ID NO: 226810 - RNA, 21 nt, Human
agcaucugaggcaguuuccua

SEQ ID NO: 226811 - RNA, 22 nt, Human
agcaugaauugccauuuauuaa

SEQ ID NO: 226812 - RNA, 22 nt, Human
agcaguucucugucuagcuaga

SEQ ID NO: 226813 - RNA, 19 nt, Human
agcaguggagccaugccug

SEQ ID NO: 226814 - RNA, 22 nt, Human
agcccugaccuguccuguucug

SEQ ID NO: 226815 - RNA, 22 nt, Human
agccccuucuuuggggagcuga

SEQ ID NO: 226816 - RNA, 22 nt, Human
agcauuuuaaaacuaguuacca

SEQ ID NO: 226817 - RNA, 22 nt, Human
agccuggagcaggcucugcucu

SEQ ID NO: 226818 - RNA, 22 nt, Human
agccugggucgagagacgagaa

SEQ ID NO: 226819 - RNA, 22 nt, Human
agcauucagacaucugauggau

SEQ ID NO: 226820 - RNA, 22 nt, Human
agcauuucuacugugucagaaa

SEQ ID NO: 226821 - RNA, 22 nt, Human
agccgcgcagccucauuaagga

SEQ ID NO: 226822 - RNA, 18 nt, Human
agcccucuguuacuggaa

SEQ ID NO: 226823 - RNA, 22 nt, Human
agcccuuucuuguuuaacugca

SEQ ID NO: 226824 - RNA, 22 nt, Human
agccuguuacuguccugugcca

SEQ ID NO: 226825 - RNA, 22 nt, Human
agccuucccuuucaacaauuug

SEQ ID NO: 226826 - RNA, 22 nt, Human
agccugugcuguguuugcucca

SEQ ID NO: 226827 - RNA, 22 nt, Human
agccugugacucugugaaacca

SEQ ID NO: 226828 - RNA, 22 nt, Human
agcgcaguuaccgcgcggggcu

SEQ ID NO: 226829 - RNA, 22 nt, Human
agcgaaaagaauggaguggagu

SEQ ID NO: 226830 - RNA, 22 nt, Human
agcggugacauccuucugugcu

SEQ ID NO: 226831 - RNA, 22 nt, Human
agcggccucgcugccugcucag

SEQ ID NO: 226832 - RNA, 22 nt, Human
agcggcaggaagcgcgcaagcg

SEQ ID NO: 226833 - RNA, 22 nt, Human
agcggcgcgucuccgagcugga

SEQ ID NO: 226834 - RNA, 19 nt, Human
agcggccgccgcgggcgcc

SEQ ID NO: 226835 - RNA, 22 nt, Human
agcgcggccuuacacccagggg

SEQ ID NO: 226836 - RNA, 22 nt, Human
agcgcgcggggcugcggcaggg

SEQ ID NO: 226837 - RNA, 22 nt, Human
agcgggucaugucggccgccca

SEQ ID NO: 226838 - RNA, 22 nt, Human
agcgucaugugaccagcgcgcc

SEQ ID NO: 226839 - RNA, 22 nt, Human
agcuaaaaugagguuuuuggau

SEQ ID NO: 226840 - RNA, 22 nt, Human
agcuaauguauguugaaagcac

SEQ ID NO: 226841 - RNA, 22 nt, Human
agcguucuguuccaugcuaaca

SEQ ID NO: 226842 - RNA, 22 nt, Human
agcuagugcaguucucaaaugg

SEQ ID NO: 226843 - RNA, 22 nt, Human
agcuaaauauuuuuccugacac

SEQ ID NO: 226844 - RNA, 22 nt, Human
agcguaugaauauuugaagaga

SEQ ID NO: 226845 - RNA, 22 nt, Human
agcuccugcgcacggugcacac

SEQ ID NO: 226846 - RNA, 22 nt, Human
agcucggcuguccugugccccu

SEQ ID NO: 226847 - RNA, 22 nt, Human
agcucugcuucuugggaagaug

SEQ ID NO: 226848 - RNA, 20 nt, Human
agcugaauaguuuugugaaa

SEQ ID NO: 226849 - RNA, 22 nt, Human
agcucuuuggacuuuguuuuau

SEQ ID NO: 226850 - RNA, 19 nt, Human
agcucaggcccaucguccc

SEQ ID NO: 226851 - RNA, 22 nt, Human
agcucugauccuuuaaaggaga

SEQ ID NO: 226852 - RNA, 22 nt, Human
agcugcugcaaguggugcuaac

SEQ ID NO: 226853 - RNA, 22 nt, Human
agcugcuggcggauguuggacu

SEQ ID NO: 226854 - RNA, 22 nt, Human
agcugaccugauugcuuuucag

SEQ ID NO: 226855 - RNA, 22 nt, Human
agcucuguugcggucacaggag

SEQ ID NO: 226856 - RNA, 22 nt, Human
agcugauugucuuuuuaaaagu

SEQ ID NO: 226857 - RNA, 22 nt, Human
agcugaugucucaccuguuaga

SEQ ID NO: 226858 - RNA, 22 nt, Human
agcucugugcaggcagaggcau

SEQ ID NO: 226859 - RNA, 22 nt, Human
agcuuccaaagaccaggauuga

SEQ ID NO: 226860 - RNA, 22 nt, Human
agcuucuucugccuugucccug

SEQ ID NO: 226861 - RNA, 22 nt, Human
agcuugcccuuguaccagccag

SEQ ID NO: 226862 - RNA, 22 nt, Human
agcuugaaccuaaaacaauaau

SEQ ID NO: 226863 - RNA, 22 nt, Human
agcuugagauaauucaagcuga

SEQ ID NO: 226864 - RNA, 22 nt, Human
agcugugccuauucguggcaag

SEQ ID NO: 226865 - RNA, 22 nt, Human
agcugugaccuucaagagcuac

SEQ ID NO: 226866 - RNA, 22 nt, Human
agcugcuaagcugcauaacuua

SEQ ID NO: 226867 - RNA, 22 nt, Human
agcuguaacagguuaauaugga

SEQ ID NO: 226868 - RNA, 22 nt, Human
agcuggaaucucggcaaagcgu

SEQ ID NO: 226869 - RNA, 22 nt, Human
agcuggauuaaucacagugacu

SEQ ID NO: 226870 - RNA, 22 nt, Human
agcugcuuuacuggucggcugg

SEQ ID NO: 226871 - RNA, 19 nt, Human
agcugcugauugguggagg

SEQ ID NO: 226872 - RNA, 22 nt, Human
agcugcauguauauucuuaaca

SEQ ID NO: 226873 - RNA, 22 nt, Human
agcugaggccccgcagcagggu

SEQ ID NO: 226874 - RNA, 22 nt, Human
agcugcauucguaucauauugu

SEQ ID NO: 226875 - RNA, 20 nt, Human
agcuuucaccaguacuucca

SEQ ID NO: 226876 - RNA, 22 nt, Human
agcuuugcccaaugaguuaugu

SEQ ID NO: 226877 - RNA, 22 nt, Human
agcuuugucccaagugcucugg

SEQ ID NO: 226878 - RNA, 22 nt, Human
aggaaaaagaagaaaagaauca

SEQ ID NO: 226879 - RNA, 22 nt, Human
aggacuggucucuuuucuccaa

SEQ ID NO: 226880 - RNA, 22 nt, Human
aggacauuugcuuuuuuucuuu

SEQ ID NO: 226881 - RNA, 22 nt, Human
aggagacaguuuggacguguag

SEQ ID NO: 226882 - RNA, 22 nt, Human
aggauaaaggucauuauuccca

SEQ ID NO: 226883 - RNA, 22 nt, Human
aggaagucucucaaaacuggaa

SEQ ID NO: 226884 - RNA, 22 nt, Human
aggagaaagaccagccugccga

SEQ ID NO: 226885 - RNA, 22 nt, Human
aggacucagcgucugucucccg

SEQ ID NO: 226886 - RNA, 22 nt, Human
aggacacuuccugaguggacaa

SEQ ID NO: 226887 - RNA, 20 nt, Human
aggaaggagaaucugagcaa

SEQ ID NO: 226888 - RNA, 20 nt, Human
aggaagauccuuucuuuuaa

SEQ ID NO: 226889 - RNA, 22 nt, Human
aggaagaagggacagaauuuug

SEQ ID NO: 226890 - RNA, 22 nt, Human
aggaaaguugagcugucuguag

SEQ ID NO: 226891 - RNA, 22 nt, Human
aggaagagcuggaccagaggac

SEQ ID NO: 226892 - RNA, 22 nt, Human
aggaaaauggaccagaguuguu

SEQ ID NO: 226893 - RNA, 22 nt, Human
aggaaagacgcauuucuguagg

SEQ ID NO: 226894 - RNA, 22 nt, Human
aggaaaguugcuuguagugcug

SEQ ID NO: 226895 - RNA, 22 nt, Human
aggaaaggcucugugguuccua

SEQ ID NO: 226896 - RNA, 23 nt, Human
aggaagucugacacuacagcguu

SEQ ID NO: 226897 - RNA, 22 nt, Human
aggaagccuggaguccugccca

SEQ ID NO: 226898 - RNA, 19 nt, Human
aggaaggggauaaguaaca

SEQ ID NO: 226899 - RNA, 22 nt, Human
aggaacaguuucaaagagugaa

SEQ ID NO: 226900 - RNA, 22 nt, Human
agcuuugcugcuggagaagggu

SEQ ID NO: 226901 - RNA, 22 nt, Human
aggaaaaugaaggaagugggaa

SEQ ID NO: 226902 - RNA, 22 nt, Human
agcuuucuauauaugaguugcu

SEQ ID NO: 226903 - RNA, 22 nt, Human
agcuuucaagaaauugucacaa

SEQ ID NO: 226904 - RNA, 22 nt, Human
agcuuggcaagcacuguuugag

SEQ ID NO: 226905 - RNA, 22 nt, Human
agcuugauggauugcugaggca

SEQ ID NO: 226906 - RNA, 22 nt, Human
agcuugaugaaagugggugcuc

SEQ ID NO: 226907 - RNA, 22 nt, Human
aggaaauaguuuagucccaaaa

SEQ ID NO: 226908 - RNA, 20 nt, Human
agcuggcccccgguggccug

SEQ ID NO: 226909 - RNA, 22 nt, Human
aggaacaacagccuuuauaucc

SEQ ID NO: 226910 - RNA, 22 nt, Human
agcugugaccaguuacgaaauu

SEQ ID NO: 226911 - RNA, 19 nt, Human
agcuuauuuacugcaggac

SEQ ID NO: 226912 - RNA, 22 nt, Human
agcuguugaccuucccuuucag

SEQ ID NO: 226913 - RNA, 20 nt, Human
agcugucccugacacuagga

SEQ ID NO: 226914 - RNA, 22 nt, Human
agguauuuuaugucgugugaug

SEQ ID NO: 226915 - RNA, 22 nt, Human
aggucuacaugcuuaauauauc

SEQ ID NO: 226916 - RNA, 22 nt, Human
agguaagaagugagcaaguuua

SEQ ID NO: 226917 - RNA, 22 nt, Human
agguagcuggugcugggcuccu

SEQ ID NO: 226918 - RNA, 22 nt, Human
agguagaaggaccagaauuuau

SEQ ID NO: 226919 - RNA, 22 nt, Human
aggguuccugaaaaguauguca

SEQ ID NO: 226920 - RNA, 22 nt, Human
aggguuaugcuccuucaucuug

SEQ ID NO: 226921 - RNA, 22 nt, Human
aggguuugaauccucuuucuua

SEQ ID NO: 226922 - RNA, 22 nt, Human
aggggauggagcuggaaggcag

SEQ ID NO: 226923 - RNA, 22 nt, Human
aggggaggggaguaucaggauu

SEQ ID NO: 226924 - RNA, 22 nt, Human
aggggaggcugcgggcugccgu

SEQ ID NO: 226925 - RNA, 22 nt, Human
aggguuuucauauauuauuagu

SEQ ID NO: 226926 - RNA, 22 nt, Human
aggguuugugaagacuuggcca

SEQ ID NO: 226927 - RNA, 22 nt, Human
aggggcaagucuggccauuucu

SEQ ID NO: 226928 - RNA, 22 nt, Human
aggguggcacucugggggcucc

SEQ ID NO: 226929 - RNA, 21 nt, Human
agguagauagccccaggaagg

SEQ ID NO: 226930 - RNA, 22 nt, Human
aggggcagccucacaauccucu

SEQ ID NO: 226931 - RNA, 20 nt, Human
aggggcuguaguuagaugac

SEQ ID NO: 226932 - RNA, 22 nt, Human
aggggagaagcacuccuugccu

SEQ ID NO: 226933 - RNA, 22 nt, Human
aggggagaguuaaugugaaugu

SEQ ID NO: 226934 - RNA, 22 nt, Human
agggggaauccugcuuauggau

SEQ ID NO: 226935 - RNA, 22 nt, Human
agggggaaaauguggauuaugg

SEQ ID NO: 226936 - RNA, 22 nt, Human
aggggcugugucauuuguccua

SEQ ID NO: 226937 - RNA, 22 nt, Human
aggggcuuguggaguugcuggu

SEQ ID NO: 226938 - RNA, 22 nt, Human
aggggaguuauuagacagggag

SEQ ID NO: 226939 - RNA, 22 nt, Human
aggggagggcuggccuuuggau

SEQ ID NO: 226940 - RNA, 22 nt, Human
aggggaggcugggcuggggggc

SEQ ID NO: 226941 - RNA, 22 nt, Human
agggcuugggggccuugaaggc

SEQ ID NO: 226942 - RNA, 22 nt, Human
agggcuuaggcacacugugacu

SEQ ID NO: 226943 - RNA, 22 nt, Human
agggcuuacaucccacaguuag

SEQ ID NO: 226944 - RNA, 22 nt, Human
agggagcagcuagagggggucc

SEQ ID NO: 226945 - RNA, 22 nt, Human
agggacuugugucuguguuuuu

SEQ ID NO: 226946 - RNA, 17 nt, Human
agggaaguagggugggc

SEQ ID NO: 226947 - RNA, 22 nt, Human
agggaagccggagcgacggggg

SEQ ID NO: 226948 - RNA, 22 nt, Human
agggcaguguggugggacugac

SEQ ID NO: 226949 - RNA, 22 nt, Human
agggccagcagcuuggccaacc

SEQ ID NO: 226950 - RNA, 22 nt, Human
agggcguacuuucgccccuccu

SEQ ID NO: 226951 - RNA, 22 nt, Human
agggcggucccugagacucucc

SEQ ID NO: 226952 - RNA, 22 nt, Human
agggcgugguggugcuggagca

SEQ ID NO: 226953 - RNA, 22 nt, Human
aggcugggaaguguguccugag

SEQ ID NO: 226954 - RNA, 22 nt, Human
aggcugaagcacacucaugcag

SEQ ID NO: 226955 - RNA, 22 nt, Human
agggaagaggaccagagucucu

SEQ ID NO: 226956 - RNA, 22 nt, Human
aggccugaggaccagauaaaug

SEQ ID NO: 226957 - RNA, 22 nt, Human
aggccugcccuuggggagccuu

SEQ ID NO: 226958 - RNA, 22 nt, Human
aggcgaagggaccagacgguag

SEQ ID NO: 226959 - RNA, 22 nt, Human
aggccugcuccucuucucaucc

SEQ ID NO: 226960 - RNA, 22 nt, Human
agggaagagaaacaaagauuca

SEQ ID NO: 226961 - RNA, 22 nt, Human
agggaaauuaaugugagcaaug

SEQ ID NO: 226962 - RNA, 18 nt, Human
aggcuggggaucacaggg

SEQ ID NO: 226963 - RNA, 22 nt, Human
aggcugcucucgccggcggugu

SEQ ID NO: 226964 - RNA, 22 nt, Human
aggcugucucaccucaggaggg

SEQ ID NO: 226965 - RNA, 22 nt, Human
aggcugucucagccugcuugca

SEQ ID NO: 226966 - RNA, 22 nt, Human
aggcucucccacauucauuaca

SEQ ID NO: 226967 - RNA, 22 nt, Human
agggaaguucuagggagucugg

SEQ ID NO: 226968 - RNA, 22 nt, Human
agggaguagggagccaugggug

SEQ ID NO: 226969 - RNA, 22 nt, Human
aggcgagcgcggccggugcccc

SEQ ID NO: 226970 - RNA, 22 nt, Human
aggccgcgguggcgaaggcguu

SEQ ID NO: 226971 - RNA, 22 nt, Human
aggccgguggaggagguggagg

SEQ ID NO: 226972 - RNA, 23 nt, Human
aggcugcagaagaauagggucau

SEQ ID NO: 226973 - RNA, 22 nt, Human
aggcucagcaucugauucauau

SEQ ID NO: 226974 - RNA, 22 nt, Human
aggcguggcuucugcuggguug

SEQ ID NO: 226975 - RNA, 22 nt, Human
aggccgcuggggcagcgcccga

SEQ ID NO: 226976 - RNA, 22 nt, Human
aggcggguuuaggacaaugcuu

SEQ ID NO: 226977 - RNA, 22 nt, Human
aggcgguuggcuuugucugggu

SEQ ID NO: 226978 - RNA, 16 nt, Human
aggauauauucucuuc

SEQ ID NO: 226979 - RNA, 22 nt, Human
aggauggaaguaacuggauaau

SEQ ID NO: 226980 - RNA, 22 nt, Human
aggauggauagcaaggaagccg

SEQ ID NO: 226981 - RNA, 22 nt, Human
aggagagaacaagaguauccug

SEQ ID NO: 226982 - RNA, 22 nt, Human
aggcccagcaccagcggucuuc

SEQ ID NO: 226983 - RNA, 22 nt, Human
aggcccugcugaggccucccuc

SEQ ID NO: 226984 - RNA, 22 nt, Human
aggaggcguuugcuaaacgggc

SEQ ID NO: 226985 - RNA, 22 nt, Human
agguuguaucauaugaaacugu

SEQ ID NO: 226986 - RNA, 18 nt, Human
agguuguguaaaaagaag

SEQ ID NO: 226987 - RNA, 18 nt, Human
aggugagaauuuggcuuu

SEQ ID NO: 226988 - RNA, 22 nt, Human
agguuaaacuuccugcagggcu

SEQ ID NO: 226989 - RNA, 22 nt, Human
agguuaaaagagugaguggaua

SEQ ID NO: 226990 - RNA, 22 nt, Human
aguaacagguguacagacuauc

SEQ ID NO: 226991 - RNA, 22 nt, Human
agguuuuagagagccaggaugu

SEQ ID NO: 226992 - RNA, 22 nt, Human
aggugguauuuaaaauuauuug

SEQ ID NO: 226993 - RNA, 22 nt, Human
agguggggacuccaccgaugcu

SEQ ID NO: 226994 - RNA, 22 nt, Human
aggugcuuaaagaauguguggu

SEQ ID NO: 226995 - RNA, 22 nt, Human
aggugggaauaauaaucaaagc

SEQ ID NO: 226996 - RNA, 21 nt, Human
aggugguuccaauaaguaggu

SEQ ID NO: 226997 - RNA, 22 nt, Human
aggugggucgcaggcaucagug

SEQ ID NO: 226998 - RNA, 22 nt, Human
aggugagaaggacuguugcauu

SEQ ID NO: 226999 - RNA, 22 nt, Human
aggugcagcugguggagucugg

SEQ ID NO: 227000 - RNA, 22 nt, Human
aggugcauuuacuuggggcccu

SEQ ID NO: 227001 - RNA, 22 nt, Human
aggugcuugcauacugcuugac

SEQ ID NO: 227002 - RNA, 21 nt, Human
aggugaaggcgagggggacag

SEQ ID NO: 227003 - RNA, 22 nt, Human
agguaguggaaccaaggcauca

SEQ ID NO: 227004 - RNA, 22 nt, Human
agguccaucugaaucuuauucc

SEQ ID NO: 227005 - RNA, 22 nt, Human
aguaggauguuuagcccuucuu

SEQ ID NO: 227006 - RNA, 22 nt, Human
aguaauuucuuacggagaccuu

SEQ ID NO: 227007 - RNA, 22 nt, Human
aguaauaaacaacucauuuugg

SEQ ID NO: 227008 - RNA, 22 nt, Human
aguaagaaagaaugauaggccu

SEQ ID NO: 227009 - RNA, 22 nt, Human
aguauaagugaugcuaucuucu

SEQ ID NO: 227010 - RNA, 22 nt, Human
aguaucgcuuuguaucaugagg

SEQ ID NO: 227011 - RNA, 22 nt, Human
aguaucugccagaaucucaguu

SEQ ID NO: 227012 - RNA, 22 nt, Human
aguaucuuccucaugaacacgu

SEQ ID NO: 227013 - RNA, 22 nt, Human
aguaugcuggcaccuuugagug

SEQ ID NO: 227014 - RNA, 22 nt, Human
aguauggaauuuuuaaugacag

SEQ ID NO: 227015 - RNA, 22 nt, Human
aguaucuauaucaaaaauggcu

SEQ ID NO: 227016 - RNA, 22 nt, Human
aguauccauccugcuguuucua

SEQ ID NO: 227017 - RNA, 19 nt, Human
aguauuggcagguccugua

SEQ ID NO: 227018 - RNA, 22 nt, Human
aguauugguaaguguagcaaau

SEQ ID NO: 227019 - RNA, 22 nt, Human
aguauucaguuagugagcuaag

SEQ ID NO: 227020 - RNA, 22 nt, Human
agucaaaaaaccuagaaacacc

SEQ ID NO: 227021 - RNA, 22 nt, Human
aguauuuucuuuaguuuguuag

SEQ ID NO: 227022 - RNA, 22 nt, Human
aguauuuuaaaauacauuaucc

SEQ ID NO: 227023 - RNA, 22 nt, Human
aguauuggauauaaucuaggaa

SEQ ID NO: 227024 - RNA, 22 nt, Human
aguauuuaguauucuauauuag

SEQ ID NO: 227025 - RNA, 21 nt, Human
agucaagcugccugcuuggca

SEQ ID NO: 227026 - RNA, 22 nt, Human
agucaccuacagcucaugcuuc

SEQ ID NO: 227027 - RNA, 20 nt, Human
agucacagacccucagguag

SEQ ID NO: 227028 - RNA, 22 nt, Human
agucacuguuuaaucuagcuaa

SEQ ID NO: 227029 - RNA, 22 nt, Human
agucagaaggugucagaucuug

SEQ ID NO: 227030 - RNA, 22 nt, Human
agucaacauuugagaugcaaug

SEQ ID NO: 227031 - RNA, 22 nt, Human
agucagcuugucucuaggguug

SEQ ID NO: 227032 - RNA, 22 nt, Human
agucaagguggaccagaaaaau

SEQ ID NO: 227033 - RNA, 22 nt, Human
agucacuguucugucaugucaa

SEQ ID NO: 227034 - RNA, 22 nt, Human
agucauuugucauuuuuuugag

SEQ ID NO: 227035 - RNA, 22 nt, Human
agucauuugaggcaugauuaug

SEQ ID NO: 227036 - RNA, 22 nt, Human
agucccugauggacuggaugag

SEQ ID NO: 227037 - RNA, 22 nt, Human
agucaggacagauuuucugggg

SEQ ID NO: 227038 - RNA, 22 nt, Human
agucaguguagaaagcccaggc

SEQ ID NO: 227039 - RNA, 22 nt, Human
agucaguaugacuuauaguucu

SEQ ID NO: 227040 - RNA, 22 nt, Human
agucaggggaucuagacuugaa

SEQ ID NO: 227041 - RNA, 22 nt, Human
aguccucagauauggagaucug

SEQ ID NO: 227042 - RNA, 22 nt, Human
aguccagggcuuagucagcggg

SEQ ID NO: 227043 - RNA, 22 nt, Human
agucauuguguucaguaaaauc

SEQ ID NO: 227044 - RNA, 18 nt, Human
agucauguuuuagucacu

SEQ ID NO: 227045 - RNA, 22 nt, Human
agucuuuguuccugggaccuga

SEQ ID NO: 227046 - RNA, 19 nt, Human
agugaacuccauaucaggu

SEQ ID NO: 227047 - RNA, 18 nt, Human
agucugagugaaauguag

SEQ ID NO: 227048 - RNA, 22 nt, Human
agucuauacuucccaguugaca

SEQ ID NO: 227049 - RNA, 22 nt, Human
agucggauuucccagguuauug

SEQ ID NO: 227050 - RNA, 20 nt, Human
auacuuguuuucaggcuuuu

SEQ ID NO: 227051 - RNA, 23 nt, Human
auacuuuuuuucuacguuaucuc

SEQ ID NO: 227052 - RNA, 21 nt, Human
agugagugacagaagaagguu

SEQ ID NO: 227053 - RNA, 21 nt, Human
agugaguagagcacugaguca

SEQ ID NO: 227054 - RNA, 22 nt, Human
agugagcauuagugcuuauauu

SEQ ID NO: 227055 - RNA, 22 nt, Human
agugagcuuuuaaaauuuacca

SEQ ID NO: 227056 - RNA, 22 nt, Human
agugaaagaaaacuguuagaac

SEQ ID NO: 227057 - RNA, 22 nt, Human
auagaugacaguuaggaagcug

SEQ ID NO: 227058 - RNA, 22 nt, Human
auagauguauucauuguuuggc

SEQ ID NO: 227059 - RNA, 22 nt, Human
auagaugaggaaauucaggugc

SEQ ID NO: 227060 - RNA, 22 nt, Human
auagauuuuaucagauuuuauc

SEQ ID NO: 227061 - RNA, 22 nt, Human
auacaugacucacacauucugc

SEQ ID NO: 227062 - RNA, 22 nt, Human
auagaguguguguuauguguga

SEQ ID NO: 227063 - RNA, 20 nt, Human
auagaguggugugucacauu

SEQ ID NO: 227064 - RNA, 22 nt, Human
auagagcuggggaagaagcugg

SEQ ID NO: 227065 - RNA, 22 nt, Human
auacaggcaguaagauucucag

SEQ ID NO: 227066 - RNA, 22 nt, Human
auacuuccugcuucccugaucu

SEQ ID NO: 227067 - RNA, 22 nt, Human
auacuucaccuaacccaguuuc

SEQ ID NO: 227068 - RNA, 22 nt, Human
auacuagguggauauacaaaga

SEQ ID NO: 227069 - RNA, 22 nt, Human
auagaaauagacaaugcaaaga

SEQ ID NO: 227070 - RNA, 22 nt, Human
auagcacuuaauaugaaacagu

SEQ ID NO: 227071 - RNA, 22 nt, Human
auaccaaugacaggaguuaggg

SEQ ID NO: 227072 - RNA, 22 nt, Human
auaggcauaacacugauguccu

SEQ ID NO: 227073 - RNA, 22 nt, Human
auaggaguuauggaaugagccc

SEQ ID NO: 227074 - RNA, 22 nt, Human
auaggaguauaaggcaguaacu

SEQ ID NO: 227075 - RNA, 22 nt, Human
auagacacagcuaugauuugag

SEQ ID NO: 227076 - RNA, 18 nt, Human
auagacaggaaaaaugga

SEQ ID NO: 227077 - RNA, 22 nt, Human
auagaagugaaaagggaugacu

SEQ ID NO: 227078 - RNA, 22 nt, Human
auaguuaagguguacugaagau

SEQ ID NO: 227079 - RNA, 22 nt, Human
auaguugcugucauuauuugag

SEQ ID NO: 227080 - RNA, 22 nt, Human
auauaagauaauaacuuuuuua

SEQ ID NO: 227081 - RNA, 22 nt, Human
auauaaugcaguaggugauuaa

SEQ ID NO: 227082 - RNA, 22 nt, Human
auagaguucucuuuggaggagu

SEQ ID NO: 227083 - RNA, 22 nt, Human
auaguuuuagauacugagaaaa

SEQ ID NO: 227084 - RNA, 22 nt, Human
auauaacccaaggcaggcugug

SEQ ID NO: 227085 - RNA, 22 nt, Human
auaucuuguuuuugauuucuug

SEQ ID NO: 227086 - RNA, 22 nt, Human
auaugaagaaugaucugaagua

SEQ ID NO: 227087 - RNA, 22 nt, Human
auaugcacauguacauguauau

SEQ ID NO: 227088 - RNA, 23 nt, Human
auagucuuaaaccagacuucacc

SEQ ID NO: 227089 - RNA, 22 nt, Human
auaguaaauguuaacagcaaca

SEQ ID NO: 227090 - RNA, 23 nt, Human
auagucaggaacuguuggugugu

SEQ ID NO: 227091 - RNA, 22 nt, Human
auaguguguaaagugcagugau

SEQ ID NO: 227092 - RNA, 22 nt, Human
auaggcggagccauaucaucca

SEQ ID NO: 227093 - RNA, 22 nt, Human
auaggacuguacagaauacaag

SEQ ID NO: 227094 - RNA, 22 nt, Human
auagcaguauuaugagauaacu

SEQ ID NO: 227095 - RNA, 22 nt, Human
auauauguauauaugugugugu

SEQ ID NO: 227096 - RNA, 22 nt, Human
auauccugguucuaucaaaagg

SEQ ID NO: 227097 - RNA, 22 nt, Human
auauauguauauacacauauau

SEQ ID NO: 227098 - RNA, 22 nt, Human
auagauagaagggacguggugc

SEQ ID NO: 227099 - RNA, 22 nt, Human
auauaguacauguauauauaua

SEQ ID NO: 227100 - RNA, 22 nt, Human
auaugcagaaaauaaaggaauu

SEQ ID NO: 227101 - RNA, 22 nt, Human
auaugagaggaggagcaucagu

SEQ ID NO: 227102 - RNA, 22 nt, Human
auauugagagagugagguguag

SEQ ID NO: 227103 - RNA, 22 nt, Human
auaucugaugacgugacuaugu

SEQ ID NO: 227104 - RNA, 22 nt, Human
auauuguagcaucacugucuug

SEQ ID NO: 227105 - RNA, 21 nt, Human
auauuguugggguuuucuuuu

SEQ ID NO: 227106 - RNA, 23 nt, Human
auaugucaugcaccagcacuuua

SEQ ID NO: 227107 - RNA, 22 nt, Human
auauuuguuuggcagaguucag

SEQ ID NO: 227108 - RNA, 22 nt, Human
auauuuguuagcugcuuuggag

SEQ ID NO: 227109 - RNA, 22 nt, Human
auauuuguacagcuugugaguu

SEQ ID NO: 227110 - RNA, 22 nt, Human
auauguaguuucagaaguggaa

SEQ ID NO: 227111 - RNA, 22 nt, Human
auauaaugugugcuuuauugaa

SEQ ID NO: 227112 - RNA, 22 nt, Human
auauggugauuuuaugcaggaa

SEQ ID NO: 227113 - RNA, 21 nt, Human
auauggauauuauuuuguguc

SEQ ID NO: 227114 - RNA, 22 nt, Human
auauaguuggguuucauucuac

SEQ ID NO: 227115 - RNA, 22 nt, Human
auauaugcaacaagaaagcaua

SEQ ID NO: 227116 - RNA, 22 nt, Human
auauuauuaaaauagauggaua

SEQ ID NO: 227117 - RNA, 22 nt, Human
auauugcuuuauucuugaauau

SEQ ID NO: 227118 - RNA, 22 nt, Human
aucauuugaacagaauuuguuu

SEQ ID NO: 227119 - RNA, 22 nt, Human
aucauugcuaguaaggaucuug

SEQ ID NO: 227120 - RNA, 22 nt, Human
aucauuaacagugcagggguag

SEQ ID NO: 227121 - RNA, 22 nt, Human
aucaugugacuagguuuggcca

SEQ ID NO: 227122 - RNA, 22 nt, Human
auccucugcucaugagaaaugu

SEQ ID NO: 227123 - RNA, 19 nt, Human
auccucucuagaaguggga

SEQ ID NO: 227124 - RNA, 22 nt, Human
auccgugagcgagcgagcaccc

SEQ ID NO: 227125 - RNA, 22 nt, Human
auccucaaggaauuaaauaggg

SEQ ID NO: 227126 - RNA, 18 nt, Human
auccccagucccuggaau

SEQ ID NO: 227127 - RNA, 22 nt, Human
aucagugcacgcgaugggcaga

SEQ ID NO: 227128 - RNA, 22 nt, Human
aucauugaaaauuuaugcauuu

SEQ ID NO: 227129 - RNA, 20 nt, Human
aucaggagucgcggggagag

SEQ ID NO: 227130 - RNA, 22 nt, Human
aucauaugugauaccauaauga

SEQ ID NO: 227131 - RNA, 22 nt, Human
aucauccuagaaggaagcuagg

SEQ ID NO: 227132 - RNA, 22 nt, Human
auccacuagagggugaacucug

SEQ ID NO: 227133 - RNA, 22 nt, Human
aucaugcugacacaguuuaucu

SEQ ID NO: 227134 - RNA, 22 nt, Human
aucccuggccacgaagcugccc

SEQ ID NO: 227135 - RNA, 22 nt, Human
aucuaauguggcaaguugcuga

SEQ ID NO: 227136 - RNA, 22 nt, Human
aucgcagaguggaaauugauga

SEQ ID NO: 227137 - RNA, 22 nt, Human
aucggggaaugaccuuuucauu

SEQ ID NO: 227138 - RNA, 22 nt, Human
aucguuaugauagagaaagaga

SEQ ID NO: 227139 - RNA, 22 nt, Human
auccuccuuugcccugagauca

SEQ ID NO: 227140 - RNA, 22 nt, Human
auccucucugugacagggaacg

SEQ ID NO: 227141 - RNA, 19 nt, Human
auccuugcucacucacuga

SEQ ID NO: 227142 - RNA, 20 nt, Human
auccuggucuuuggaagcuu

SEQ ID NO: 227143 - RNA, 22 nt, Human
auccugugggguauugcugcau

SEQ ID NO: 227144 - RNA, 22 nt, Human
auccuggcuuuccugauuuacu

SEQ ID NO: 227145 - RNA, 22 nt, Human
auccugauggaaacugguauga

SEQ ID NO: 227146 - RNA, 22 nt, Human
aucauuuuuauuagcugggguu

SEQ ID NO: 227147 - RNA, 18 nt, Human
auccuucggccuagugga

SEQ ID NO: 227148 - RNA, 22 nt, Human
auccacccugcaggccaacucu

SEQ ID NO: 227149 - RNA, 22 nt, Human
auccaggggucugaauggauau

SEQ ID NO: 227150 - RNA, 22 nt, Human
auccaggguuggggucacgagu

SEQ ID NO: 227151 - RNA, 22 nt, Human
aucauguauauuuuugcuauua

SEQ ID NO: 227152 - RNA, 20 nt, Human
aucaugugcacugcugacag

SEQ ID NO: 227153 - RNA, 22 nt, Human
aucagcucuugaugccuuucuu

SEQ ID NO: 227154 - RNA, 21 nt, Human
aucagaggacaucucagggcc

SEQ ID NO: 227155 - RNA, 17 nt, Human
aucagaggauaggacaa

SEQ ID NO: 227156 - RNA, 22 nt, Human
aucagagcuaguacuugcaggu

SEQ ID NO: 227157 - RNA, 22 nt, Human
aucaugcgguuaaggagugugu

SEQ ID NO: 227158 - RNA, 22 nt, Human
aucauguauaugcagcguuugu

SEQ ID NO: 227159 - RNA, 22 nt, Human
aucaugggauagugggacgagc

SEQ ID NO: 227160 - RNA, 22 nt, Human
aucacauggauuuuaucuuuug

SEQ ID NO: 227161 - RNA, 22 nt, Human
aucauaccaguuuccaucagga

SEQ ID NO: 227162 - RNA, 22 nt, Human
aucaucccuuucucccagugaa

SEQ ID NO: 227163 - RNA, 22 nt, Human
aucaaguuauuaaguagcuuuc

SEQ ID NO: 227164 - RNA, 22 nt, Human
aucaaugggucaaagagaaggu

SEQ ID NO: 227165 - RNA, 22 nt, Human
aucaaacuaugguccaugggca

SEQ ID NO: 227166 - RNA, 22 nt, Human
aucacugcaggcauauaggggu

SEQ ID NO: 227167 - RNA, 19 nt, Human
aucagcaguuuugccugga

SEQ ID NO: 227168 - RNA, 22 nt, Human
aucaauaaccauagugguuaca

SEQ ID NO: 227169 - RNA, 22 nt, Human
aucagaagaaauggaugugacu

SEQ ID NO: 227170 - RNA, 21 nt, Human
aucagaaucucuagauuugga

SEQ ID NO: 227171 - RNA, 22 nt, Human
auauuugcccccaugcccuggc

SEQ ID NO: 227172 - RNA, 22 nt, Human
auauuucuacaggcugauuuua

SEQ ID NO: 227173 - RNA, 22 nt, Human
auauuugucuguuuuaguggca

SEQ ID NO: 227174 - RNA, 22 nt, Human
aucaaaauguguagucuugauc

SEQ ID NO: 227175 - RNA, 22 nt, Human
aucaaaauuuucagauacuaca

SEQ ID NO: 227176 - RNA, 22 nt, Human
auauuuuacagcucucguugaa

SEQ ID NO: 227177 - RNA, 22 nt, Human
auauuuuugcagaauuuuucgu

SEQ ID NO: 227178 - RNA, 22 nt, Human
aucaacucacagugugcuggca

SEQ ID NO: 227179 - RNA, 21 nt, Human
auauugguaucuuuuuaaauc

SEQ ID NO: 227180 - RNA, 22 nt, Human
auauucaaugaggucauauaag

SEQ ID NO: 227181 - RNA, 22 nt, Human
auauguuaugccauuuucaagg

SEQ ID NO: 227182 - RNA, 22 nt, Human
aucaacacuguuggcggggacc

SEQ ID NO: 227183 - RNA, 22 nt, Human
augugaaauuugggcucuggga

SEQ ID NO: 227184 - RNA, 22 nt, Human
augugaaccuggguccugggcc

SEQ ID NO: 227185 - RNA, 22 nt, Human
augguugggggaugucagcagg

SEQ ID NO: 227186 - RNA, 20 nt, Human
augucaggaagggagucagg

SEQ ID NO: 227187 - RNA, 22 nt, Human
auguauuuauguauguguuaua

SEQ ID NO: 227188 - RNA, 22 nt, Human
auguaugagagauucuuuuauu

SEQ ID NO: 227189 - RNA, 22 nt, Human
auguaacauaugugaucgcauu

SEQ ID NO: 227190 - RNA, 22 nt, Human
augguuuuguccucuuugguuc

SEQ ID NO: 227191 - RNA, 22 nt, Human
auggucugcucagucucuugac

SEQ ID NO: 227192 - RNA, 22 nt, Human
auggcucugcugggcaaagcaa

SEQ ID NO: 227193 - RNA, 22 nt, Human
augguuagauggaugagaugug

SEQ ID NO: 227194 - RNA, 22 nt, Human
augguuacgcccucacccuacc

SEQ ID NO: 227195 - RNA, 22 nt, Human
augguugccugagauaagacug

SEQ ID NO: 227196 - RNA, 18 nt, Human
auggcuccagugucuucc

SEQ ID NO: 227197 - RNA, 20 nt, Human
auggcgagucagcacaaaac

SEQ ID NO: 227198 - RNA, 22 nt, Human
auggcuucugucuuggaaauuu

SEQ ID NO: 227199 - RNA, 19 nt, Human
augggaagcggccagcgga

SEQ ID NO: 227200 - RNA, 22 nt, Human
auggccugaagcuaaccccccu

SEQ ID NO: 227201 - RNA, 22 nt, Human
auggccuuucucaguggugcuu

SEQ ID NO: 227202 - RNA, 22 nt, Human
auggcuguguuguuccucugaa

SEQ ID NO: 227203 - RNA, 22 nt, Human
auguguguaugacugaaucuau

SEQ ID NO: 227204 - RNA, 22 nt, Human
auguguguaugugugcauguau

SEQ ID NO: 227205 - RNA, 22 nt, Human
augugucauuauccagaauaac

SEQ ID NO: 227206 - RNA, 22 nt, Human
auguuuuaaaaaacaggcuacc

SEQ ID NO: 227207 - RNA, 22 nt, Human
auguugaguggaugaacaaaca

SEQ ID NO: 227208 - RNA, 22 nt, Human
auguuccuuaaugugcuuguag

SEQ ID NO: 227209 - RNA, 19 nt, Human
auguucugaauuacuguaa

SEQ ID NO: 227210 - RNA, 22 nt, Human
auguucucagguuguauuuauu

SEQ ID NO: 227211 - RNA, 23 nt, Human
augugaggcaaaggcaggcacuc

SEQ ID NO: 227212 - RNA, 22 nt, Human
augugcacuggugugugcguuc

SEQ ID NO: 227213 - RNA, 22 nt, Human
augguugugaaagagcaaagac

SEQ ID NO: 227214 - RNA, 22 nt, Human
augguuuugugaaaaugcuuug

SEQ ID NO: 227215 - RNA, 22 nt, Human
auguaaauauuuauauaugcau

SEQ ID NO: 227216 - RNA, 22 nt, Human
auguuagcaucuggcacuaugg

SEQ ID NO: 227217 - RNA, 22 nt, Human
auguuccaugacuaugcaugaa

SEQ ID NO: 227218 - RNA, 18 nt, Human
auguuccugcaguuauuu

SEQ ID NO: 227219 - RNA, 22 nt, Human
auguucccaaaaucccuguaga

SEQ ID NO: 227220 - RNA, 22 nt, Human
augugaaagagguguucagugg

SEQ ID NO: 227221 - RNA, 19 nt, Human
auguuuccauuucuggaua

SEQ ID NO: 227222 - RNA, 22 nt, Human
auguuuaauuugaaauuuuauu

SEQ ID NO: 227223 - RNA, 22 nt, Human
auuaagacugcccauguuuuua

SEQ ID NO: 227224 - RNA, 20 nt, Human
auuaauuuuuagggcucacc

SEQ ID NO: 227225 - RNA, 22 nt, Human
auuacagaagauaugcucaaca

SEQ ID NO: 227226 - RNA, 22 nt, Human
auuacagauuauaaauuugagc

SEQ ID NO: 227227 - RNA, 22 nt, Human
auuacugaggcaaaguaguuuu

SEQ ID NO: 227228 - RNA, 22 nt, Human
auuaauguguaugauauaaauu

SEQ ID NO: 227229 - RNA, 22 nt, Human
auguuuuuugaaaauguauuuu

SEQ ID NO: 227230 - RNA, 21 nt, Human
auuauagugacuaaauugaua

SEQ ID NO: 227231 - RNA, 22 nt, Human
auuaugaauuguguuacgaaga

SEQ ID NO: 227232 - RNA, 22 nt, Human
auguuuucauuuagaagcuaau

SEQ ID NO: 227233 - RNA, 22 nt, Human
auuauacauuaggagauugauu

SEQ ID NO: 227234 - RNA, 22 nt, Human
auuagugguguauuuggcacua

SEQ ID NO: 227235 - RNA, 22 nt, Human
auguuugugauugcugaaaaga

SEQ ID NO: 227236 - RNA, 22 nt, Human
auuagcaccccuggauguggga

SEQ ID NO: 227237 - RNA, 22 nt, Human
auucaagagcccauguuuccug

SEQ ID NO: 227238 - RNA, 19 nt, Human
auucaagugcuuagagauc

SEQ ID NO: 227239 - RNA, 22 nt, Human
auucaagauagaaggauuuuca

SEQ ID NO: 227240 - RNA, 22 nt, Human
auucaaugcacauguuuuggau

SEQ ID NO: 227241 - RNA, 22 nt, Human
auucaccaucuugauccccucu

SEQ ID NO: 227242 - RNA, 22 nt, Human
auucaggacucuuccuugaaga

SEQ ID NO: 227243 - RNA, 22 nt, Human
auuaaguuauuaagcuaaauau

SEQ ID NO: 227244 - RNA, 17 nt, Human
auucaugaacauguccu

SEQ ID NO: 227245 - RNA, 18 nt, Human
auucauuugcguuuggcu

SEQ ID NO: 227246 - RNA, 22 nt, Human
auuaaaaaugagaguagggauu

SEQ ID NO: 227247 - RNA, 22 nt, Human
auuaaacuaaauuaugaauugg

SEQ ID NO: 227248 - RNA, 22 nt, Human
auuaaagcaugaauaauaugua

SEQ ID NO: 227249 - RNA, 22 nt, Human
auuauuugcuuaagcuggucuc

SEQ ID NO: 227250 - RNA, 22 nt, Human
auuauugcaagcagugaaggga

SEQ ID NO: 227251 - RNA, 23 nt, Human
auuauuucaggguuuugacuugc

SEQ ID NO: 227252 - RNA, 22 nt, Human
auuaugcagcugccuccaaggu

SEQ ID NO: 227253 - RNA, 22 nt, Human
aucuggaacuucucugcauuga

SEQ ID NO: 227254 - RNA, 23 nt, Human
augaacgcacugagaucauaauu

SEQ ID NO: 227255 - RNA, 22 nt, Human
augaaacuggagcgccuggagg

SEQ ID NO: 227256 - RNA, 23 nt, Human
augaaaugauacuuuauucacug

SEQ ID NO: 227257 - RNA, 22 nt, Human
aucuauguaucucagaagcuag

SEQ ID NO: 227258 - RNA, 22 nt, Human
aucucaaagauaugcugguaaa

SEQ ID NO: 227259 - RNA, 22 nt, Human
augacugaugcugacucauggg

SEQ ID NO: 227260 - RNA, 22 nt, Human
augagcuaagcagaaagcacac

SEQ ID NO: 227261 - RNA, 22 nt, Human
augagaguuagccugcauaguu

SEQ ID NO: 227262 - RNA, 22 nt, Human
augacuguuaugaggugggugg

SEQ ID NO: 227263 - RNA, 22 nt, Human
aucuucaaagcacaucguuugu

SEQ ID NO: 227264 - RNA, 22 nt, Human
aucugggaaggggaaaaugcug

SEQ ID NO: 227265 - RNA, 22 nt, Human
aucugucagaccuuggucacag

SEQ ID NO: 227266 - RNA, 22 nt, Human
augagaaauaauuguguacuga

SEQ ID NO: 227267 - RNA, 14 nt, Human
augauuucugggaa

SEQ ID NO: 227268 - RNA, 22 nt, Human
augacagcucuagcacacagua

SEQ ID NO: 227269 - RNA, 22 nt, Human
augaccauccagaaguccagcu

SEQ ID NO: 227270 - RNA, 22 nt, Human
augauucuaccaaugccaucuu

SEQ ID NO: 227271 - RNA, 22 nt, Human
augauuauuugaaugaagagga

SEQ ID NO: 227272 - RNA, 22 nt, Human
augcacuccucagcuguucugg

SEQ ID NO: 227273 - RNA, 22 nt, Human
augcacuaugaugagcuagucu

SEQ ID NO: 227274 - RNA, 22 nt, Human
augcagaaucucuuuccugagg

SEQ ID NO: 227275 - RNA, 22 nt, Human
augauuuguuaacagacuuaau

SEQ ID NO: 227276 - RNA, 22 nt, Human
augauaccacucaauagggcau

SEQ ID NO: 227277 - RNA, 22 nt, Human
augagcucuaaguacaugccca

SEQ ID NO: 227278 - RNA, 22 nt, Human
augaggaacagcaagaauauuu

SEQ ID NO: 227279 - RNA, 22 nt, Human
augaauuugaacaccagguugg

SEQ ID NO: 227280 - RNA, 22 nt, Human
augaauuaucugguguuggaaa

SEQ ID NO: 227281 - RNA, 22 nt, Human
augauguuggaauuuuaacuua

SEQ ID NO: 227282 - RNA, 22 nt, Human
augauggagaacaaagaaaauc

SEQ ID NO: 227283 - RNA, 22 nt, Human
augauuacagcaugauguuuca

SEQ ID NO: 227284 - RNA, 22 nt, Human
augauuaagguacgucauuucu

SEQ ID NO: 227285 - RNA, 22 nt, Human
augaaugccggucucgggggaa

SEQ ID NO: 227286 - RNA, 22 nt, Human
augaagugcccugggggccaga

SEQ ID NO: 227287 - RNA, 22 nt, Human
augaucaagaauuuuguauucc

SEQ ID NO: 227288 - RNA, 22 nt, Human
augaggagucaaggagucggag

SEQ ID NO: 227289 - RNA, 22 nt, Human
augaugaugguuuaacuucagg

SEQ ID NO: 227290 - RNA, 22 nt, Human
augcggcugugggggaauggga

SEQ ID NO: 227291 - RNA, 21 nt, Human
augcgcgguggagugagcgaa

SEQ ID NO: 227292 - RNA, 22 nt, Human
augccucuugagagccagugcu

SEQ ID NO: 227293 - RNA, 22 nt, Human
augcuucuguugcuuaggaggu

SEQ ID NO: 227294 - RNA, 22 nt, Human
augcaggcuaagaguaaagacg

SEQ ID NO: 227295 - RNA, 18 nt, Human
augcugacacaaugugga

SEQ ID NO: 227296 - RNA, 22 nt, Human
augcugccuaaagcuacuuaca

SEQ ID NO: 227297 - RNA, 22 nt, Human
auggccuguuuccucugaaaga

SEQ ID NO: 227298 - RNA, 22 nt, Human
augcugcuuguccauuuauuug

SEQ ID NO: 227299 - RNA, 22 nt, Human
augcugcuccuuuucaggcauu

SEQ ID NO: 227300 - RNA, 22 nt, Human
augcugugccuggaaagcggcu

SEQ ID NO: 227301 - RNA, 22 nt, Human
augcuugaaaguuauuucauuu

SEQ ID NO: 227302 - RNA, 22 nt, Human
augcuugcccauguuucugaag

SEQ ID NO: 227303 - RNA, 22 nt, Human
augcuuuauuggagacagucau

SEQ ID NO: 227304 - RNA, 22 nt, Human
augcugacaacaaagaaggaag

SEQ ID NO: 227305 - RNA, 22 nt, Human
auggagugggaggacaugaagg

SEQ ID NO: 227306 - RNA, 22 nt, Human
augcucggcuuucuuucuuucu

SEQ ID NO: 227307 - RNA, 22 nt, Human
augcucuggucucuucuuuccu

SEQ ID NO: 227308 - RNA, 22 nt, Human
augcacaagguagauuauuauu

SEQ ID NO: 227309 - RNA, 22 nt, Human
augccgggguggcuccagcacc

SEQ ID NO: 227310 - RNA, 22 nt, Human
augcccugggagugcuguacca

SEQ ID NO: 227311 - RNA, 22 nt, Human
augccccuuuauauguuaaguc

SEQ ID NO: 227312 - RNA, 22 nt, Human
augccugcugucaggaacucuu

SEQ ID NO: 227313 - RNA, 22 nt, Human
augaucacagugucagucauua

SEQ ID NO: 227314 - RNA, 22 nt, Human
augaugauuauucauuuucugu

SEQ ID NO: 227315 - RNA, 22 nt, Human
augcagcggucagaggaacuca

SEQ ID NO: 227316 - RNA, 22 nt, Human
augcacuacuagaugcaaaagu

SEQ ID NO: 227317 - RNA, 22 nt, Human
augccugggcuuuaggguucuc

SEQ ID NO: 227318 - RNA, 22 nt, Human
augcgcugugcacacucuuaac

SEQ ID NO: 227319 - RNA, 19 nt, Human
augcacgugaaaugcauuu

SEQ ID NO: 227320 - RNA, 22 nt, Human
augcagagacugugggaaagca

SEQ ID NO: 227321 - RNA, 22 nt, Human
augcagauguagauucugaaau

SEQ ID NO: 227322 - RNA, 22 nt, Human
augcuaaucaaacuuucugcag

SEQ ID NO: 227323 - RNA, 22 nt, Human
augcuagaaaauuucauauuau

SEQ ID NO: 227324 - RNA, 22 nt, Human
caagagcucccagaccugggca

SEQ ID NO: 227325 - RNA, 22 nt, Human
cacagauaaggcuuugucccca

SEQ ID NO: 227326 - RNA, 22 nt, Human
caagaaguugacagccagguga

SEQ ID NO: 227327 - RNA, 22 nt, Human
caagaaaaaacaugaugagugu

SEQ ID NO: 227328 - RNA, 22 nt, Human
caacuucugcuuucuuccuugc

SEQ ID NO: 227329 - RNA, 22 nt, Human
cacagccaagacuuggccccau

SEQ ID NO: 227330 - RNA, 18 nt, Human
cacagcauccaaguuaug

SEQ ID NO: 227331 - RNA, 22 nt, Human
cacacagcuagugacaggagaa

SEQ ID NO: 227332 - RNA, 22 nt, Human
cacagaauuaagggagaaauau

SEQ ID NO: 227333 - RNA, 22 nt, Human
cacagcagcaucauuuaucugg

SEQ ID NO: 227334 - RNA, 22 nt, Human
cacaucugaaggcggcucuagg

SEQ ID NO: 227335 - RNA, 22 nt, Human
caagcgcgccgcuuccuuccgc

SEQ ID NO: 227336 - RNA, 22 nt, Human
caagaugcaagaccagucaggc

SEQ ID NO: 227337 - RNA, 22 nt, Human
cacaguuuuaucuuauacugau

SEQ ID NO: 227338 - RNA, 22 nt, Human
cacagcuggggaagcugaggcc

SEQ ID NO: 227339 - RNA, 23 nt, Human
cacaggcagaaaucaagacggua

SEQ ID NO: 227340 - RNA, 22 nt, Human
caagagcuuuagaaaugcucau

SEQ ID NO: 227341 - RNA, 22 nt, Human
cacauuguuuggucagagcaua

SEQ ID NO: 227342 - RNA, 22 nt, Human
cacauuuuccagaagaaucaga

SEQ ID NO: 227343 - RNA, 22 nt, Human
caaggaaaugucagaaaggcaa

SEQ ID NO: 227344 - RNA, 22 nt, Human
caccacauguccgaaauucagc

SEQ ID NO: 227345 - RNA, 22 nt, Human
caccaaaauaucccuuuguaca

SEQ ID NO: 227346 - RNA, 22 nt, Human
caaggguguacagauaugagag

SEQ ID NO: 227347 - RNA, 22 nt, Human
caagguauugaggccagugucc

SEQ ID NO: 227348 - RNA, 22 nt, Human
caccagcgacugugaccagcaa

SEQ ID NO: 227349 - RNA, 22 nt, Human
caccaucagacuucugggcagg

SEQ ID NO: 227350 - RNA, 22 nt, Human
caccaucugaauauucuccaag

SEQ ID NO: 227351 - RNA, 22 nt, Human
caauaauugcuuuccagaguua

SEQ ID NO: 227352 - RNA, 22 nt, Human
caauaguaaucaaugcaguuag

SEQ ID NO: 227353 - RNA, 22 nt, Human
caauaccucuuggugauugggc

SEQ ID NO: 227354 - RNA, 22 nt, Human
caaguauuuauugaggcccugu

SEQ ID NO: 227355 - RNA, 22 nt, Human
cacccccaggcuccccuucugg

SEQ ID NO: 227356 - RNA, 22 nt, Human
caccuggaggcagcaccgggcu

SEQ ID NO: 227357 - RNA, 22 nt, Human
caccuuccgcccacugaccgcc

SEQ ID NO: 227358 - RNA, 22 nt, Human
caccugcaaauuccagauuucu

SEQ ID NO: 227359 - RNA, 20 nt, Human
caccggguugcugguuucuu

SEQ ID NO: 227360 - RNA, 22 nt, Human
caauccccaggucccagaacag

SEQ ID NO: 227361 - RNA, 22 nt, Human
cacccgacugaggacgccgccc

SEQ ID NO: 227362 - RNA, 20 nt, Human
cacccgguccucagcgacuc

SEQ ID NO: 227363 - RNA, 22 nt, Human
caaggaaaacagaugaucaaca

SEQ ID NO: 227364 - RNA, 22 nt, Human
caagagguaugagccgggauga

SEQ ID NO: 227365 - RNA, 22 nt, Human
caaagaaccuucgagacagggc

SEQ ID NO: 227366 - RNA, 22 nt, Human
caagaaccuagcgaucagguaa

SEQ ID NO: 227367 - RNA, 22 nt, Human
caaaacauucagagagcucacu

SEQ ID NO: 227368 - RNA, 22 nt, Human
caagauauguccuguuacuaag

SEQ ID NO: 227369 - RNA, 22 nt, Human
caaggaagguugguugaaggua

SEQ ID NO: 227370 - RNA, 22 nt, Human
caaggggagcugguauggaugg

SEQ ID NO: 227371 - RNA, 22 nt, Human
caagggcagaggcagggccccg

SEQ ID NO: 227372 - RNA, 22 nt, Human
caaggucagacagccaggacag

SEQ ID NO: 227373 - RNA, 22 nt, Human
caaguugcaugugcuugaaaua

SEQ ID NO: 227374 - RNA, 22 nt, Human
caaaggaaagagaaaaagucuu

SEQ ID NO: 227375 - RNA, 22 nt, Human
caaaggagcccuuugccggguu

SEQ ID NO: 227376 - RNA, 22 nt, Human
caaugaaaauuuaaguugcagc

SEQ ID NO: 227377 - RNA, 22 nt, Human
caaugccaggaaccugggggaa

SEQ ID NO: 227378 - RNA, 22 nt, Human
caaauacaaauacgggcagcuu

SEQ ID NO: 227379 - RNA, 22 nt, Human
caaauacguuuggcuggagcac

SEQ ID NO: 227380 - RNA, 22 nt, Human
caaaucagaucagagacaggcu

SEQ ID NO: 227381 - RNA, 22 nt, Human
caaaucuguuaauuucaaguug

SEQ ID NO: 227382 - RNA, 22 nt, Human
caauggaguccucuuccucuuu

SEQ ID NO: 227383 - RNA, 22 nt, Human
caaugggagaugcagaacagcu

SEQ ID NO: 227384 - RNA, 22 nt, Human
caaauguuugguggcauuuugu

SEQ ID NO: 227385 - RNA, 22 nt, Human
caaauuuuuauuuaccaucugc

SEQ ID NO: 227386 - RNA, 22 nt, Human
caaaugcaguggucgugcugga

SEQ ID NO: 227387 - RNA, 22 nt, Human
caaaugaugcauggcuagugag

SEQ ID NO: 227388 - RNA, 22 nt, Human
caacaaguugauuucacgcugc

SEQ ID NO: 227389 - RNA, 22 nt, Human
caacauuucaaggucuuuagga

SEQ ID NO: 227390 - RNA, 22 nt, Human
caaccucuaucggucaggaagc

SEQ ID NO: 227391 - RNA, 22 nt, Human
caacuucuauucagucugcagu

SEQ ID NO: 227392 - RNA, 22 nt, Human
caacguggauucuuccaggggc

SEQ ID NO: 227393 - RNA, 22 nt, Human
caaccaguagcugaguucaaaa

SEQ ID NO: 227394 - RNA, 22 nt, Human
cacaauuuccauugagcagcag

SEQ ID NO: 227395 - RNA, 22 nt, Human
cacaaagugucaggggagagaa

SEQ ID NO: 227396 - RNA, 23 nt, Human
auuuuuccacacacagacucagu

SEQ ID NO: 227397 - RNA, 22 nt, Human
caacaagcgcucagagcaaagc

SEQ ID NO: 227398 - RNA, 22 nt, Human
caacacaucaguucagucuuga

SEQ ID NO: 227399 - RNA, 17 nt, Human
caaccaggaaaggaggg

SEQ ID NO: 227400 - RNA, 22 nt, Human
auuuuuuuaggcugucagccgc

SEQ ID NO: 227401 - RNA, 22 nt, Human
auuuuuuuuccugucucuuuca

SEQ ID NO: 227402 - RNA, 22 nt, Human
caaaaauacuugccuguaucug

SEQ ID NO: 227403 - RNA, 22 nt, Human
caaaaaauccauagaaagaggu

SEQ ID NO: 227404 - RNA, 22 nt, Human
auuuugcaguuuauugccaauc

SEQ ID NO: 227405 - RNA, 22 nt, Human
caaagaagagauuuacagagcu

SEQ ID NO: 227406 - RNA, 22 nt, Human
auuuucuugucucuguuguagg

SEQ ID NO: 227407 - RNA, 22 nt, Human
auuuugcuuuucuaguggguuu

SEQ ID NO: 227408 - RNA, 22 nt, Human
caaagagaugcaccauauuucu

SEQ ID NO: 227409 - RNA, 22 nt, Human
caaagccuggggagaguaagga

SEQ ID NO: 227410 - RNA, 22 nt, Human
caaagaugccaaaaggaagaca

SEQ ID NO: 227411 - RNA, 22 nt, Human
auuuuucucucaugugcaacua

SEQ ID NO: 227412 - RNA, 22 nt, Human
auuuuucuuucacauuuucuua

SEQ ID NO: 227413 - RNA, 18 nt, Human
auuuguggggguuauaga

SEQ ID NO: 227414 - RNA, 22 nt, Human
auuuggucuguaauuacaugga

SEQ ID NO: 227415 - RNA, 22 nt, Human
auuuggggacagagugggggua

SEQ ID NO: 227416 - RNA, 22 nt, Human
auuuucgcaccucgcgaguugc

SEQ ID NO: 227417 - RNA, 22 nt, Human
auuuuugugucacaucuaggaa

SEQ ID NO: 227418 - RNA, 22 nt, Human
auuuuugguuauaaaauaguuu

SEQ ID NO: 227419 - RNA, 22 nt, Human
auuugcaucagugagcgaugug

SEQ ID NO: 227420 - RNA, 23 nt, Human
auuugcugaucguagaugacuag

SEQ ID NO: 227421 - RNA, 22 nt, Human
auuugcuuguucaccaguacuu

SEQ ID NO: 227422 - RNA, 22 nt, Human
auuucagaguagaucguuauuu

SEQ ID NO: 227423 - RNA, 22 nt, Human
auuuuaccauuaguuuguaaua

SEQ ID NO: 227424 - RNA, 21 nt, Human
auuuguggugcaauuguggua

SEQ ID NO: 227425 - RNA, 22 nt, Human
auuuuacuaugauaguugagaa

SEQ ID NO: 227426 - RNA, 22 nt, Human
auuucauuuuagaaauaagugu

SEQ ID NO: 227427 - RNA, 22 nt, Human
auuaauaucaauauauuauaug

SEQ ID NO: 227428 - RNA, 22 nt, Human
auuagaagagcuuuuuacucuu

SEQ ID NO: 227429 - RNA, 22 nt, Human
auuagaaaugacaugugggaau

SEQ ID NO: 227430 - RNA, 22 nt, Human
auuagguaguauaaucuuuguu

SEQ ID NO: 227431 - RNA, 22 nt, Human
auuauaauucauuaggcuuagu

SEQ ID NO: 227432 - RNA, 22 nt, Human
auuguauugcguuugcgaaugu

SEQ ID NO: 227433 - RNA, 22 nt, Human
auugugaaugccugucagucuu

SEQ ID NO: 227434 - RNA, 22 nt, Human
auugaaauuaauuucugcuuuc

SEQ ID NO: 227435 - RNA, 22 nt, Human
auucuuuucucuaaaugaugaa

SEQ ID NO: 227436 - RNA, 22 nt, Human
auuuaaaaacugguacaacagg

SEQ ID NO: 227437 - RNA, 22 nt, Human
auugacagagguguaguugaga

SEQ ID NO: 227438 - RNA, 22 nt, Human
auuuacugagguaaauaaacug

SEQ ID NO: 227439 - RNA, 22 nt, Human
auugaguacuugcugggcucuc

SEQ ID NO: 227440 - RNA, 22 nt, Human
auuuauauauuuuguucuggua

SEQ ID NO: 227441 - RNA, 22 nt, Human
auuuauuuucccucaaguaccu

SEQ ID NO: 227442 - RNA, 22 nt, Human
auuucagaaugaaaggaaaaau

SEQ ID NO: 227443 - RNA, 22 nt, Human
auuucacucuuaauugcuuccu

SEQ ID NO: 227444 - RNA, 22 nt, Human
auuuauuugaagagccauugca

SEQ ID NO: 227445 - RNA, 22 nt, Human
auuuaaagaguaauacaaucca

SEQ ID NO: 227446 - RNA, 22 nt, Human
auuuaaaggaagugggugauaa

SEQ ID NO: 227447 - RNA, 22 nt, Human
auuuccugugaacuuuucugau

SEQ ID NO: 227448 - RNA, 22 nt, Human
auuuggaaacaugcugaccaug

SEQ ID NO: 227449 - RNA, 23 nt, Human
auuuccuaaaagauaaucauuac

SEQ ID NO: 227450 - RNA, 17 nt, Human
auuguuuuuaauuugca

SEQ ID NO: 227451 - RNA, 22 nt, Human
auuucaacagaguuugaaggca

SEQ ID NO: 227452 - RNA, 22 nt, Human
auuuaucugcucuucgcguuga

SEQ ID NO: 227453 - RNA, 22 nt, Human
auuuccacaaauuaagauugca

SEQ ID NO: 227454 - RNA, 22 nt, Human
auuucauccauuaagaguacuc

SEQ ID NO: 227455 - RNA, 22 nt, Human
cagugccggccaggaccuccug

SEQ ID NO: 227456 - RNA, 22 nt, Human
cagucugcuggcuuuuucagca

SEQ ID NO: 227457 - RNA, 22 nt, Human
cagucaaauuugaaaacuuuga

SEQ ID NO: 227458 - RNA, 22 nt, Human
caucagucugaaagccagggag

SEQ ID NO: 227459 - RNA, 22 nt, Human
caucugcagccucugcauuccc

SEQ ID NO: 227460 - RNA, 22 nt, Human
caucuuuguuuuggauauaauc

SEQ ID NO: 227461 - RNA, 22 nt, Human
caucucagguuuguucugagac

SEQ ID NO: 227462 - RNA, 22 nt, Human
caugaauaauucuuuuucuugg

SEQ ID NO: 227463 - RNA, 22 nt, Human
caugaagugaaaagguuaauuu

SEQ ID NO: 227464 - RNA, 22 nt, Human
caucuccaagucuguaagcagu

SEQ ID NO: 227465 - RNA, 20 nt, Human
caugaugcaaacaguaacgu

SEQ ID NO: 227466 - RNA, 22 nt, Human
caugaugaacugugcuguuagg

SEQ ID NO: 227467 - RNA, 22 nt, Human
caugaugacagcauuccuuuua

SEQ ID NO: 227468 - RNA, 22 nt, Human
caugauaacacuucuguuuaau

SEQ ID NO: 227469 - RNA, 22 nt, Human
caguuaaugauaggaauucggu

SEQ ID NO: 227470 - RNA, 20 nt, Human
caugaguccgugaguggccc

SEQ ID NO: 227471 - RNA, 22 nt, Human
caguggagaccugccugcugga

SEQ ID NO: 227472 - RNA, 22 nt, Human
caguguuuagcacagugcuugg

SEQ ID NO: 227473 - RNA, 22 nt, Human
cagugguaaaugucguuccugu

SEQ ID NO: 227474 - RNA, 22 nt, Human
caguucacggcugguaugaauu

SEQ ID NO: 227475 - RNA, 22 nt, Human
caguugcagagugauguguuug

SEQ ID NO: 227476 - RNA, 22 nt, Human
caguugcuauugagagaacaca

SEQ ID NO: 227477 - RNA, 22 nt, Human
caguuuccagacauuauugaua

SEQ ID NO: 227478 - RNA, 22 nt, Human
caugcagcagaauaaugacuau

SEQ ID NO: 227479 - RNA, 22 nt, Human
caguuuuucaaaauuacaugau

SEQ ID NO: 227480 - RNA, 22 nt, Human
caguuuuggaagaaacaaggaa

SEQ ID NO: 227481 - RNA, 22 nt, Human
cauaagaauauuuaguggcagc

SEQ ID NO: 227482 - RNA, 22 nt, Human
cauggcggcgcucucccugccu

SEQ ID NO: 227483 - RNA, 22 nt, Human
cauagcguuuacauguggauua

SEQ ID NO: 227484 - RNA, 22 nt, Human
cauaacuugguguuggaaacug

SEQ ID NO: 227485 - RNA, 22 nt, Human
cauaccuugguaagagugauca

SEQ ID NO: 227486 - RNA, 22 nt, Human
caugggcucuucuggacugcac

SEQ ID NO: 227487 - RNA, 21 nt, Human
caugguaaguacaaagaugac

SEQ ID NO: 227488 - RNA, 22 nt, Human
caugguaaucggggccaucugu

SEQ ID NO: 227489 - RNA, 22 nt, Human
caggucagcacuuggaggugca

SEQ ID NO: 227490 - RNA, 22 nt, Human
cagguugucuaauuccaagggg

SEQ ID NO: 227491 - RNA, 22 nt, Human
cagguuguucugggcauggagg

SEQ ID NO: 227492 - RNA, 22 nt, Human
cauacauguuagcaguagccuu

SEQ ID NO: 227493 - RNA, 22 nt, Human
cagguauaugugugucuaauac

SEQ ID NO: 227494 - RNA, 22 nt, Human
cagguaguuagaaugaccagga

SEQ ID NO: 227495 - RNA, 22 nt, Human
cagggggacuuguuagguuuua

SEQ ID NO: 227496 - RNA, 22 nt, Human
caggguaagagagagugacauu

SEQ ID NO: 227497 - RNA, 22 nt, Human
cagggguaccuggguuaccugu

SEQ ID NO: 227498 - RNA, 19 nt, Human
caggggcuuaugcgaccuc

SEQ ID NO: 227499 - RNA, 22 nt, Human
cauaauuggugcuuauuaaaug

SEQ ID NO: 227500 - RNA, 22 nt, Human
caguacugucuuccugauggca

SEQ ID NO: 227501 - RNA, 22 nt, Human
caguaguucucauaacucauga

SEQ ID NO: 227502 - RNA, 22 nt, Human
caguaaccaguaguuuuggaaa

SEQ ID NO: 227503 - RNA, 22 nt, Human
cauccagggguacccuggagcc

SEQ ID NO: 227504 - RNA, 22 nt, Human
cauccagcuccugggggccacc

SEQ ID NO: 227505 - RNA, 22 nt, Human
caguaugagcacagugccugga

SEQ ID NO: 227506 - RNA, 22 nt, Human
caguaucucuaaaauuacucuu

SEQ ID NO: 227507 - RNA, 22 nt, Human
cauccagagcugccugaccccg

SEQ ID NO: 227508 - RNA, 22 nt, Human
caggccgccacugcagcagcug

SEQ ID NO: 227509 - RNA, 17 nt, Human
cagugcuguuuuagaaa

SEQ ID NO: 227510 - RNA, 22 nt, Human
cagugcuggaggggugcuugca

SEQ ID NO: 227511 - RNA, 22 nt, Human
caggcgcauggugagcagauga

SEQ ID NO: 227512 - RNA, 22 nt, Human
caggcgcugacgggaccgggcu

SEQ ID NO: 227513 - RNA, 22 nt, Human
cagggaaguauuacauguuucc

SEQ ID NO: 227514 - RNA, 22 nt, Human
cagggagguuggauuggggccu

SEQ ID NO: 227515 - RNA, 22 nt, Human
cagggcacaguuauggaggugg

SEQ ID NO: 227516 - RNA, 22 nt, Human
cagggccaggccucaggggcgc

SEQ ID NO: 227517 - RNA, 22 nt, Human
cagggcaucucugaaucuucac

SEQ ID NO: 227518 - RNA, 22 nt, Human
caguuuuauacacugcagcucc

SEQ ID NO: 227519 - RNA, 22 nt, Human
cagggcuuuuuccuccucuuug

SEQ ID NO: 227520 - RNA, 21 nt, Human
caggccaaaagguucaacauu

SEQ ID NO: 227521 - RNA, 22 nt, Human
caggcagggagcuggaaaggau

SEQ ID NO: 227522 - RNA, 22 nt, Human
caggcagggcugccuucugcuu

SEQ ID NO: 227523 - RNA, 22 nt, Human
caguauguuuauuagaacugca

SEQ ID NO: 227524 - RNA, 22 nt, Human
caggcagagagggcagugugga

SEQ ID NO: 227525 - RNA, 22 nt, Human
caggcacagcuaagacuggcca

SEQ ID NO: 227526 - RNA, 22 nt, Human
caggucauaacuaugcaugaac

SEQ ID NO: 227527 - RNA, 22 nt, Human
cagguuuuuauuacaacuuuga

SEQ ID NO: 227528 - RNA, 22 nt, Human
caggguuuuauuuggcuuuaaa

SEQ ID NO: 227529 - RNA, 22 nt, Human
cagguauuugaaggcaguggga

SEQ ID NO: 227530 - RNA, 21 nt, Human
caguagcgcgacaugguuagc

SEQ ID NO: 227531 - RNA, 22 nt, Human
caguaucucccauucacagugu

SEQ ID NO: 227532 - RNA, 22 nt, Human
caauugcuuccuucuguaagua

SEQ ID NO: 227533 - RNA, 22 nt, Human
caaucuucucuagaguauucua

SEQ ID NO: 227534 - RNA, 22 nt, Human
cacaaggagaaauagauauuga

SEQ ID NO: 227535 - RNA, 22 nt, Human
cacaacaaaaaauaaguaugag

SEQ ID NO: 227536 - RNA, 22 nt, Human
cagagcugucauuugccaguga

SEQ ID NO: 227537 - RNA, 22 nt, Human
cagagaugaggcuggcgugguu

SEQ ID NO: 227538 - RNA, 22 nt, Human
cacacaccagaaagccugggac

SEQ ID NO: 227539 - RNA, 22 nt, Human
cagagcagaaaccugggugauu

SEQ ID NO: 227540 - RNA, 22 nt, Human
cagagccagcuguccuuggcau

SEQ ID NO: 227541 - RNA, 22 nt, Human
cagagggagcuaaccagcagcc

SEQ ID NO: 227542 - RNA, 22 nt, Human
cagaggagcgaguuggacgcca

SEQ ID NO: 227543 - RNA, 19 nt, Human
cagcaaacacuguaaaugg

SEQ ID NO: 227544 - RNA, 22 nt, Human
cagaucacucugggcggcggga

SEQ ID NO: 227545 - RNA, 22 nt, Human
cagauaagcuauaaguaguacc

SEQ ID NO: 227546 - RNA, 22 nt, Human
cagagguagaaguagauguuug

SEQ ID NO: 227547 - RNA, 22 nt, Human
cagaguaaugugauuuccaugu

SEQ ID NO: 227548 - RNA, 22 nt, Human
cagaggcugagcugcgggauga

SEQ ID NO: 227549 - RNA, 22 nt, Human
cagaggaugucuacaccuugag

SEQ ID NO: 227550 - RNA, 22 nt, Human
cagccccagcacuuagcugagu

SEQ ID NO: 227551 - RNA, 22 nt, Human
cagauagccugguccuaacaug

SEQ ID NO: 227552 - RNA, 22 nt, Human
cagcucugcugggaggaugcag

SEQ ID NO: 227553 - RNA, 22 nt, Human
cagcucuggcuauugaggacca

SEQ ID NO: 227554 - RNA, 22 nt, Human
cagcuccagcccaggcagcucc

SEQ ID NO: 227555 - RNA, 22 nt, Human
cagacugugagcuccuugaggg

SEQ ID NO: 227556 - RNA, 20 nt, Human
cagagacaagagggaaggga

SEQ ID NO: 227557 - RNA, 18 nt, Human
cagcauuagcagcuucca

SEQ ID NO: 227558 - RNA, 22 nt, Human
cagaaaacauuguguguauaag

SEQ ID NO: 227559 - RNA, 22 nt, Human
cagaaacacuguauuuagggaa

SEQ ID NO: 227560 - RNA, 22 nt, Human
cagacacgucccuguugaccug

SEQ ID NO: 227561 - RNA, 22 nt, Human
cagcuggggagagacauggcag

SEQ ID NO: 227562 - RNA, 22 nt, Human
cagcuguauuucucugguuaga

SEQ ID NO: 227563 - RNA, 21 nt, Human
cagcagaugccagggucucug

SEQ ID NO: 227564 - RNA, 22 nt, Human
cagcagaugacuauuggagcug

SEQ ID NO: 227565 - RNA, 22 nt, Human
cagcagaggagguggcagcacc

SEQ ID NO: 227566 - RNA, 22 nt, Human
cagauggaguuaguuucuaaca

SEQ ID NO: 227567 - RNA, 22 nt, Human
cagauuuaauaaaaaaugcauc

SEQ ID NO: 227568 - RNA, 22 nt, Human
cagauuuagcacugauaggacu

SEQ ID NO: 227569 - RNA, 22 nt, Human
cagaugccauagguauaguaua

SEQ ID NO: 227570 - RNA, 22 nt, Human
cagauguuugaaugcuuaccac

SEQ ID NO: 227571 - RNA, 22 nt, Human
cagccuacaucagaauaccaau

SEQ ID NO: 227572 - RNA, 22 nt, Human
caggaacucuucugggugcuug

SEQ ID NO: 227573 - RNA, 22 nt, Human
cagcccuguugcgcuuccggcg

SEQ ID NO: 227574 - RNA, 22 nt, Human
cagcauugagcacagaaggaaa

SEQ ID NO: 227575 - RNA, 22 nt, Human
cagcccaggcucagauguuggg

SEQ ID NO: 227576 - RNA, 22 nt, Human
cagcuugcccugauguggaaga

SEQ ID NO: 227577 - RNA, 22 nt, Human
cagcuuauggcuucuccaguag

SEQ ID NO: 227578 - RNA, 22 nt, Human
cagccagaucgccuuccgccuc

SEQ ID NO: 227579 - RNA, 22 nt, Human
cagcuguggagauggggugcau

SEQ ID NO: 227580 - RNA, 22 nt, Human
caggcaggagaaaaggcgcggg

SEQ ID NO: 227581 - RNA, 22 nt, Human
cagggagcggggagaucucggg

SEQ ID NO: 227582 - RNA, 22 nt, Human
caggagagucucugucuguacu

SEQ ID NO: 227583 - RNA, 22 nt, Human
cagcucgaauaauggagaacug

SEQ ID NO: 227584 - RNA, 22 nt, Human
cagcuauggaauuggcccagau

SEQ ID NO: 227585 - RNA, 22 nt, Human
cagcuccaucuugcuuauacca

SEQ ID NO: 227586 - RNA, 22 nt, Human
caggacacaaaagguggagaag

SEQ ID NO: 227587 - RNA, 22 nt, Human
cagggcagaguuaagaugcugg

SEQ ID NO: 227588 - RNA, 22 nt, Human
cagggcuugaaucaaggaaguc

SEQ ID NO: 227589 - RNA, 22 nt, Human
caggggcuccaggugagccugg

SEQ ID NO: 227590 - RNA, 22 nt, Human
caggggaagccagcugccaugu

SEQ ID NO: 227591 - RNA, 22 nt, Human
cagcuuuugcagacuucuugcc

SEQ ID NO: 227592 - RNA, 22 nt, Human
caggguugaugaauugucugua

SEQ ID NO: 227593 - RNA, 22 nt, Human
cucugcuuguaucacauuugcu

SEQ ID NO: 227594 - RNA, 18 nt, Human
cucuggacagcaggcauc

SEQ ID NO: 227595 - RNA, 22 nt, Human
cuguacuuguuuuaggaugaug

SEQ ID NO: 227596 - RNA, 22 nt, Human
cuguagaugucagguuaaugag

SEQ ID NO: 227597 - RNA, 19 nt, Human
cucuggcuccugggcugcc

SEQ ID NO: 227598 - RNA, 20 nt, Human
cucugggaggcuugucaccu

SEQ ID NO: 227599 - RNA, 17 nt, Human
cucugggucuccugcuu

SEQ ID NO: 227600 - RNA, 22 nt, Human
cucugguuucgcaggaaauaga

SEQ ID NO: 227601 - RNA, 22 nt, Human
cucucuccuuagcugcagacca

SEQ ID NO: 227602 - RNA, 22 nt, Human
cucucuccuuuuugauauuuag

SEQ ID NO: 227603 - RNA, 22 nt, Human
cucuccaguuauagcugauuug

SEQ ID NO: 227604 - RNA, 22 nt, Human
cucucugcugucuuucgggaaa

SEQ ID NO: 227605 - RNA, 22 nt, Human
cucucuguuaugcuuucaugaa

SEQ ID NO: 227606 - RNA, 22 nt, Human
cucugcguggcugggcccaggg

SEQ ID NO: 227607 - RNA, 22 nt, Human
cucugagcucgugcaguacuuc

SEQ ID NO: 227608 - RNA, 22 nt, Human
cucugauuuuucuaauacuuca

SEQ ID NO: 227609 - RNA, 22 nt, Human
cugugguuucuaugggccuuga

SEQ ID NO: 227610 - RNA, 22 nt, Human
cugugguuuuauuuauuugaag

SEQ ID NO: 227611 - RNA, 22 nt, Human
cucuuuguauucuagaagcucu

SEQ ID NO: 227612 - RNA, 22 nt, Human
cucuuuucaaaccuguuuaugg

SEQ ID NO: 227613 - RNA, 22 nt, Human
cugugcauaugucuugaggucu

SEQ ID NO: 227614 - RNA, 22 nt, Human
cucuguauauugagugcuuacu

SEQ ID NO: 227615 - RNA, 22 nt, Human
cugucucugauaagcucgaggg

SEQ ID NO: 227616 - RNA, 19 nt, Human
cucuucauuggaggguuga

SEQ ID NO: 227617 - RNA, 22 nt, Human
cucuucauguuggugcagaagc

SEQ ID NO: 227618 - RNA, 22 nt, Human
cugugcuguuagcgauuuuuaa

SEQ ID NO: 227619 - RNA, 22 nt, Human
cugugugugcacacguguaugg

SEQ ID NO: 227620 - RNA, 22 nt, Human
cuguguuaggaucuugcuggca

SEQ ID NO: 227621 - RNA, 22 nt, Human
cugugucucccaaggaggguca

SEQ ID NO: 227622 - RNA, 22 nt, Human
cugugugcagggcacaauggaa

SEQ ID NO: 227623 - RNA, 22 nt, Human
cugaaucaaaugacuuagccau

SEQ ID NO: 227624 - RNA, 22 nt, Human
cugaagcugggcacuuccuuuu

SEQ ID NO: 227625 - RNA, 22 nt, Human
cugacacagccauuguccuugu

SEQ ID NO: 227626 - RNA, 20 nt, Human
cugaauaccacagagccauc

SEQ ID NO: 227627 - RNA, 22 nt, Human
cuguuuggaugccauggucaag

SEQ ID NO: 227628 - RNA, 22 nt, Human
cugaauucuuguugucggagca

SEQ ID NO: 227629 - RNA, 22 nt, Human
cugagaggcacaaggcauuucg

SEQ ID NO: 227630 - RNA, 22 nt, Human
cuuauaucaacuggaaaaauua

SEQ ID NO: 227631 - RNA, 22 nt, Human
cugagaaauacccaagucuggu

SEQ ID NO: 227632 - RNA, 22 nt, Human
cugagcggugagggcauacagc

SEQ ID NO: 227633 - RNA, 23 nt, Human
cuuauauaaucauuagaaaccau

SEQ ID NO: 227634 - RNA, 22 nt, Human
cugaggaguaguucuggaggac

SEQ ID NO: 227635 - RNA, 22 nt, Human
cugauagagcauuagugugaga

SEQ ID NO: 227636 - RNA, 22 nt, Human
cugaguuuuucaaaucugaauu

SEQ ID NO: 227637 - RNA, 19 nt, Human
cugagcagggaaaaacccu

SEQ ID NO: 227638 - RNA, 22 nt, Human
cugagaucaugggucagguggu

SEQ ID NO: 227639 - RNA, 22 nt, Human
cuggaaaaauggauccugucuu

SEQ ID NO: 227640 - RNA, 22 nt, Human
cugaccugugagcuaugccggc

SEQ ID NO: 227641 - RNA, 22 nt, Human
cugacugaggaucaguucauca

SEQ ID NO: 227642 - RNA, 22 nt, Human
cucaaugagcuauuuguuucau

SEQ ID NO: 227643 - RNA, 22 nt, Human
cuggaaauggcagaguugcauu

SEQ ID NO: 227644 - RNA, 22 nt, Human
cuggagucagcaaggacgaggc

SEQ ID NO: 227645 - RNA, 22 nt, Human
cuggagcuucaggguucucggg

SEQ ID NO: 227646 - RNA, 22 nt, Human
cuggaugagcuucgugcgcacg

SEQ ID NO: 227647 - RNA, 22 nt, Human
cuggauagaggaugguaggcac

SEQ ID NO: 227648 - RNA, 22 nt, Human
cucaugcugcaaauggcuguuu

SEQ ID NO: 227649 - RNA, 22 nt, Human
cuggcaguguccagcucgugau

SEQ ID NO: 227650 - RNA, 22 nt, Human
cuggauuaaacaguuugauacu

SEQ ID NO: 227651 - RNA, 22 nt, Human
cuggauagaccccuuauugcau

SEQ ID NO: 227652 - RNA, 22 nt, Human
cuggccugugggcugucuccgg

SEQ ID NO: 227653 - RNA, 22 nt, Human
cuggcccugucagcacagaauc

SEQ ID NO: 227654 - RNA, 22 nt, Human
cuggccagccucccagguaccc

SEQ ID NO: 227655 - RNA, 22 nt, Human
cugggacccagcccaagucuuu

SEQ ID NO: 227656 - RNA, 22 nt, Human
cucgccugacucggaugggcug

SEQ ID NO: 227657 - RNA, 22 nt, Human
cuccuugguuccggcguuggag

SEQ ID NO: 227658 - RNA, 22 nt, Human
cucuaaauguggucugcagaua

SEQ ID NO: 227659 - RNA, 22 nt, Human
cucggagggcaaguacuggcug

SEQ ID NO: 227660 - RNA, 22 nt, Human
cucuauuuuuucaucuuucagg

SEQ ID NO: 227661 - RNA, 22 nt, Human
cuccucccagcccaggcgccac

SEQ ID NO: 227662 - RNA, 22 nt, Human
cuccggggacgcagucgccgcc

SEQ ID NO: 227663 - RNA, 19 nt, Human
cugggacaaugaaagcauc

SEQ ID NO: 227664 - RNA, 21 nt, Human
cugggaacccgaccaaggccu

SEQ ID NO: 227665 - RNA, 22 nt, Human
cuccaguugugucuuguaagaa

SEQ ID NO: 227666 - RNA, 23 nt, Human
cuuggcuagccacuuccacgcuc

SEQ ID NO: 227667 - RNA, 22 nt, Human
cugcuguugagguuccaggcca

SEQ ID NO: 227668 - RNA, 22 nt, Human
cugcuggugcugcccacacggu

SEQ ID NO: 227669 - RNA, 22 nt, Human
cugcugcuugauugcaggaagu

SEQ ID NO: 227670 - RNA, 22 nt, Human
cugcugugcagacagacucucu

SEQ ID NO: 227671 - RNA, 22 nt, Human
cuuggggcuugcuguuguagcc

SEQ ID NO: 227672 - RNA, 22 nt, Human
cugcgguucuguuuaguggcga

SEQ ID NO: 227673 - RNA, 22 nt, Human
cugcgcagaucugcuguucucu

SEQ ID NO: 227674 - RNA, 22 nt, Human
cuugcucugggaauaugaguuu

SEQ ID NO: 227675 - RNA, 22 nt, Human
cuugcuguccgaugggucugua

SEQ ID NO: 227676 - RNA, 22 nt, Human
cuugcugggagagcuuuagaga

SEQ ID NO: 227677 - RNA, 22 nt, Human
cugcucuucccaucccuuaaau

SEQ ID NO: 227678 - RNA, 21 nt, Human
cugcugaaggaaccccaugga

SEQ ID NO: 227679 - RNA, 22 nt, Human
cuggagaagagguaguauguag

SEQ ID NO: 227680 - RNA, 22 nt, Human
cuggagaacagagcuguuuaga

SEQ ID NO: 227681 - RNA, 22 nt, Human
cuuucugauguaaggaacuagg

SEQ ID NO: 227682 - RNA, 22 nt, Human
cuuuccaugucuucuuucucca

SEQ ID NO: 227683 - RNA, 22 nt, Human
cuuuccugaaaucucuucugca

SEQ ID NO: 227684 - RNA, 18 nt, Human
cuuucugcccccauuagc

SEQ ID NO: 227685 - RNA, 22 nt, Human
cuuucuuucaaguucugcuuua

SEQ ID NO: 227686 - RNA, 22 nt, Human
cuuguuaaaagugacccuaaug

SEQ ID NO: 227687 - RNA, 19 nt, Human
cuuguggcuaugcagauac

SEQ ID NO: 227688 - RNA, 22 nt, Human
cuggaaagauuuacacggggaa

SEQ ID NO: 227689 - RNA, 23 nt, Human
cuugugacagcaauuauagcaag

SEQ ID NO: 227690 - RNA, 22 nt, Human
cugcuuguguugcucagaguca

SEQ ID NO: 227691 - RNA, 22 nt, Human
cugcuuuggaucucucucugcc

SEQ ID NO: 227692 - RNA, 22 nt, Human
cuggaagcgucggaggaagggc

SEQ ID NO: 227693 - RNA, 22 nt, Human
cuggaauugcuugagcuaggaa

SEQ ID NO: 227694 - RNA, 22 nt, Human
cuggagaacucugugcuucacu

SEQ ID NO: 227695 - RNA, 22 nt, Human
cuuguuuuaaacuguuguggcu

SEQ ID NO: 227696 - RNA, 22 nt, Human
cugauuguagccacugugauga

SEQ ID NO: 227697 - RNA, 22 nt, Human
cugauuucaaauggugcuagau

SEQ ID NO: 227698 - RNA, 22 nt, Human
cuucccugucuacaacccugcc

SEQ ID NO: 227699 - RNA, 22 nt, Human
cuucauuacagcaaccauuuga

SEQ ID NO: 227700 - RNA, 22 nt, Human
cuucauccguaccacggccaca

SEQ ID NO: 227701 - RNA, 22 nt, Human
cugaugucaaauuuaucaaagc

SEQ ID NO: 227702 - RNA, 20 nt, Human
cugauguucgugcuuccugg

SEQ ID NO: 227703 - RNA, 22 nt, Human
cugcaucacagcaggaggcaca

SEQ ID NO: 227704 - RNA, 22 nt, Human
cugcagauguagcugcuuuccu

SEQ ID NO: 227705 - RNA, 22 nt, Human
cugcagagaccuaggucagguu

SEQ ID NO: 227706 - RNA, 22 nt, Human
cuuccugcaacaccuguguugc

SEQ ID NO: 227707 - RNA, 22 nt, Human
cugcagauaaguguuuugaaaa

SEQ ID NO: 227708 - RNA, 22 nt, Human
cugccaggagaggccagggccc

SEQ ID NO: 227709 - RNA, 22 nt, Human
cuucucugcugccugccucuuu

SEQ ID NO: 227710 - RNA, 22 nt, Human
cuucucuuccuucucauccuca

SEQ ID NO: 227711 - RNA, 22 nt, Human
cuucucuuggguguggugucuu

SEQ ID NO: 227712 - RNA, 22 nt, Human
cuucuucaucuuuuggaggaac

SEQ ID NO: 227713 - RNA, 22 nt, Human
cuucuguguggauacagucccu

SEQ ID NO: 227714 - RNA, 22 nt, Human
cuucucuuugacaguugggugu

SEQ ID NO: 227715 - RNA, 22 nt, Human
cuucugaugugugcucuuaguu

SEQ ID NO: 227716 - RNA, 22 nt, Human
cuucuggaggcucuagaggaga

SEQ ID NO: 227717 - RNA, 22 nt, Human
cuucuuucuuuucuucuucucu

SEQ ID NO: 227718 - RNA, 22 nt, Human
cuucuuuccauguguuuugguu

SEQ ID NO: 227719 - RNA, 22 nt, Human
cuucuuuucuacuggccuagaa

SEQ ID NO: 227720 - RNA, 22 nt, Human
cugcccugcagcuccacggacu

SEQ ID NO: 227721 - RNA, 22 nt, Human
cugccgaugcgcaguggcgccu

SEQ ID NO: 227722 - RNA, 22 nt, Human
cuugagcugaguuugcagcucu

SEQ ID NO: 227723 - RNA, 22 nt, Human
cugccccucgcucaccagcucu

SEQ ID NO: 227724 - RNA, 20 nt, Human
cuugaguucagagcugucau

SEQ ID NO: 227725 - RNA, 22 nt, Human
cuugcaaugaaggcacacuuau

SEQ ID NO: 227726 - RNA, 22 nt, Human
cuugcagccuggagcucagccu

SEQ ID NO: 227727 - RNA, 22 nt, Human
cuugccaguguugcagaagcuc

SEQ ID NO: 227728 - RNA, 22 nt, Human
gagaggugaagcuaauuaauuu

SEQ ID NO: 227729 - RNA, 22 nt, Human
gagaggacaggauccggagggc

SEQ ID NO: 227730 - RNA, 22 nt, Human
gagagauacauucccaaccuga

SEQ ID NO: 227731 - RNA, 22 nt, Human
gagagcugucagcguagcaccg

SEQ ID NO: 227732 - RNA, 22 nt, Human
gagagcaaaccuguguuuggag

SEQ ID NO: 227733 - RNA, 22 nt, Human
gaaaucuggugauuuucuguug

SEQ ID NO: 227734 - RNA, 22 nt, Human
gaaagugaauguaacauguuau

SEQ ID NO: 227735 - RNA, 22 nt, Human
gaaauagagacaguaagugucu

SEQ ID NO: 227736 - RNA, 22 nt, Human
gaaauuucuuuguuaucuuggu

SEQ ID NO: 227737 - RNA, 22 nt, Human
gaacagauucaucuaguggcua

SEQ ID NO: 227738 - RNA, 20 nt, Human
gaacauaaauaacucuuuac

SEQ ID NO: 227739 - RNA, 22 nt, Human
gaacauauuuagcaccuaauau

SEQ ID NO: 227740 - RNA, 22 nt, Human
gagauuugaguuccuacugagu

SEQ ID NO: 227741 - RNA, 22 nt, Human
gagauuguggcagcagcuguuu

SEQ ID NO: 227742 - RNA, 22 nt, Human
gagaucuguguuugcugaagcu

SEQ ID NO: 227743 - RNA, 22 nt, Human
gagaugugguucaaggguguuu

SEQ ID NO: 227744 - RNA, 22 nt, Human
gagcagcucgagaaggaagcag

SEQ ID NO: 227745 - RNA, 22 nt, Human
gaacugaauguguaauguuggc

SEQ ID NO: 227746 - RNA, 22 nt, Human
gaacggccucguuccucggugu

SEQ ID NO: 227747 - RNA, 19 nt, Human
gaacuaaggggagcucugg

SEQ ID NO: 227748 - RNA, 22 nt, Human
gaacucuugguggucauuagau

SEQ ID NO: 227749 - RNA, 22 nt, Human
gaaccuggcagcccuauaucug

SEQ ID NO: 227750 - RNA, 22 nt, Human
gaaccauuuaauggagaugcuc

SEQ ID NO: 227751 - RNA, 22 nt, Human
gagcaacacauugaaugaggau

SEQ ID NO: 227752 - RNA, 22 nt, Human
gaacaugaguuuuaugguauuu

SEQ ID NO: 227753 - RNA, 22 nt, Human
gagcagucuuugaaaggcacca

SEQ ID NO: 227754 - RNA, 22 nt, Human
gagcaguuagggaccgcaggcu

SEQ ID NO: 227755 - RNA, 22 nt, Human
gagcagguuauuagaaauggaa

SEQ ID NO: 227756 - RNA, 22 nt, Human
gagcaggucucaguucugccuc

SEQ ID NO: 227757 - RNA, 22 nt, Human
gaacuuaauauacaaucaguuc

SEQ ID NO: 227758 - RNA, 22 nt, Human
gaagaugcugcuuguucacggg

SEQ ID NO: 227759 - RNA, 22 nt, Human
gaagaggaagaggagccagagc

SEQ ID NO: 227760 - RNA, 22 nt, Human
gaagaaggaagaucaugcuuga

SEQ ID NO: 227761 - RNA, 22 nt, Human
gagcagggagaggcagagaggc

SEQ ID NO: 227762 - RNA, 22 nt, Human
gagcaggcuggcagggccaggg

SEQ ID NO: 227763 - RNA, 22 nt, Human
gagcagcugagcuggaaugaga

SEQ ID NO: 227764 - RNA, 22 nt, Human
gaacuugagugugcuauuucuu

SEQ ID NO: 227765 - RNA, 22 nt, Human
gaacuuuaauuagcuuuugucu

SEQ ID NO: 227766 - RNA, 22 nt, Human
gacugucaaauaaaucguuuac

SEQ ID NO: 227767 - RNA, 22 nt, Human
gaaaaacucagugggggucuuu

SEQ ID NO: 227768 - RNA, 16 nt, Human
gaauuccauugcucug

SEQ ID NO: 227769 - RNA, 22 nt, Human
gacuggggcauuagaguagcuu

SEQ ID NO: 227770 - RNA, 22 nt, Human
gacuucaucagagcguacuguu

SEQ ID NO: 227771 - RNA, 23 nt, Human
gacuucacacucucaaccacugc

SEQ ID NO: 227772 - RNA, 22 nt, Human
gaaaagcucuuuagaagagguu

SEQ ID NO: 227773 - RNA, 22 nt, Human
gaaaagaaggcaggagcccaag

SEQ ID NO: 227774 - RNA, 22 nt, Human
gaaagagaugucguuugucuuc

SEQ ID NO: 227775 - RNA, 22 nt, Human
gaaagggggcuuggacacuggc

SEQ ID NO: 227776 - RNA, 22 nt, Human
gaaaaguauuaugugaggguuc

SEQ ID NO: 227777 - RNA, 22 nt, Human
gagaagucaggaguggagaaca

SEQ ID NO: 227778 - RNA, 22 nt, Human
gagaaggagcagaaaaucuccu

SEQ ID NO: 227779 - RNA, 22 nt, Human
cuuuaagugaaaggggauuaaa

SEQ ID NO: 227780 - RNA, 22 nt, Human
cuuuaaaaauguauuuuugugg

SEQ ID NO: 227781 - RNA, 22 nt, Human
cuuguuuggccauaggugcugg

SEQ ID NO: 227782 - RNA, 22 nt, Human
cuuguuaacaauugguaucuuu

SEQ ID NO: 227783 - RNA, 18 nt, Human
gacaaaaguacagacaga

SEQ ID NO: 227784 - RNA, 22 nt, Human
gacaucuguccauggcacugga

SEQ ID NO: 227785 - RNA, 22 nt, Human
cuuuacauuaauuucuacugau

SEQ ID NO: 227786 - RNA, 22 nt, Human
gacauuuauuggauuuuacgag

SEQ ID NO: 227787 - RNA, 22 nt, Human
gacauugaauugaauccagauu

SEQ ID NO: 227788 - RNA, 22 nt, Human
gaccaggagauuugagcuaggc

SEQ ID NO: 227789 - RNA, 19 nt, Human
cuuuuagagggagaggacu

SEQ ID NO: 227790 - RNA, 22 nt, Human
cuuuucaaacaggacagguccu

SEQ ID NO: 227791 - RNA, 22 nt, Human
cuuuuaccuuaauuucgacaca

SEQ ID NO: 227792 - RNA, 19 nt, Human
cuuugugguuuucagaacu

SEQ ID NO: 227793 - RNA, 22 nt, Human
cuuuuaaucuaauuuuuauauu

SEQ ID NO: 227794 - RNA, 22 nt, Human
gacggggcagccagcugguggc

SEQ ID NO: 227795 - RNA, 22 nt, Human
gacggagugcgcuugcuguuca

SEQ ID NO: 227796 - RNA, 22 nt, Human
cuuuuucuugugguuaauaucu

SEQ ID NO: 227797 - RNA, 22 nt, Human
cuucuguggcugagaaggcagc

SEQ ID NO: 227798 - RNA, 22 nt, Human
cuuccagugcauagguagauca

SEQ ID NO: 227799 - RNA, 22 nt, Human
gaaggcagucuggggagcagcc

SEQ ID NO: 227800 - RNA, 22 nt, Human
cuuccguuacugacaaaauguu

SEQ ID NO: 227801 - RNA, 22 nt, Human
gaaggagaggauugugaggcug

SEQ ID NO: 227802 - RNA, 22 nt, Human
gaaggauaauuuugcuggaugu

SEQ ID NO: 227803 - RNA, 22 nt, Human
cuuccacucaguuuuucauugc

SEQ ID NO: 227804 - RNA, 22 nt, Human
cuucauaagauuguugugagga

SEQ ID NO: 227805 - RNA, 22 nt, Human
cuucaguuaguuucaugugagc

SEQ ID NO: 227806 - RNA, 22 nt, Human
gaaggaaaagacgugcuaagua

SEQ ID NO: 227807 - RNA, 22 nt, Human
cuucauuucaggcugaagaaua

SEQ ID NO: 227808 - RNA, 22 nt, Human
gaagcuucgaaagagugauuuc

SEQ ID NO: 227809 - RNA, 19 nt, Human
cuucaguguucaccuggcc

SEQ ID NO: 227810 - RNA, 22 nt, Human
cuucaggaccugaagcccaucu

SEQ ID NO: 227811 - RNA, 22 nt, Human
gaagcgugcagguccguauacu

SEQ ID NO: 227812 - RNA, 22 nt, Human
gaagcuccaggaugccugcacu

SEQ ID NO: 227813 - RNA, 22 nt, Human
cuucagcgucgucaguguugcu

SEQ ID NO: 227814 - RNA, 22 nt, Human
gaagcccuggaggggcuggagg

SEQ ID NO: 227815 - RNA, 22 nt, Human
cuucuugucagugauuucuucc

SEQ ID NO: 227816 - RNA, 22 nt, Human
cuucuuugacucacugguacgc

SEQ ID NO: 227817 - RNA, 22 nt, Human
gaauacaagccugccaccugga

SEQ ID NO: 227818 - RNA, 22 nt, Human
gaauauuuaucucagcugcaga

SEQ ID NO: 227819 - RNA, 22 nt, Human
gaaucucuuugucccugaguuu

SEQ ID NO: 227820 - RNA, 20 nt, Human
gaaucuggucaaaugucuau

SEQ ID NO: 227821 - RNA, 22 nt, Human
gaaugacuugcucauucugugu

SEQ ID NO: 227822 - RNA, 22 nt, Human
cuuggcaaaguggcaaaauuag

SEQ ID NO: 227823 - RNA, 22 nt, Human
cuugcuuuaucugguuucucau

SEQ ID NO: 227824 - RNA, 22 nt, Human
gaauggaugcuggucaguuugg

SEQ ID NO: 227825 - RNA, 22 nt, Human
gaauggaacauagcaacaucuu

SEQ ID NO: 227826 - RNA, 22 nt, Human
cuuggugcgaagagucagggga

SEQ ID NO: 227827 - RNA, 20 nt, Human
gaauucugaagauaauuugg

SEQ ID NO: 227828 - RNA, 22 nt, Human
cuuggugagcuccuggcgcagc

SEQ ID NO: 227829 - RNA, 22 nt, Human
cuuuggggcugaggaggagguu

SEQ ID NO: 227830 - RNA, 21 nt, Human
cuuuggcaagggagaagucac

SEQ ID NO: 227831 - RNA, 22 nt, Human
cuuuggacaacugagugacguu

SEQ ID NO: 227832 - RNA, 22 nt, Human
cuuugugcagcagaaaugugug

SEQ ID NO: 227833 - RNA, 22 nt, Human
cuuuguaaucaauaagucuuuu

SEQ ID NO: 227834 - RNA, 22 nt, Human
cuggaugucugggaggcuuccc

SEQ ID NO: 227835 - RNA, 22 nt, Human
cuggcagcucugagucccuucu

SEQ ID NO: 227836 - RNA, 22 nt, Human
cuggccaggugggggguagugg

SEQ ID NO: 227837 - RNA, 22 nt, Human
gaaagaggcugucagggaaugg

SEQ ID NO: 227838 - RNA, 22 nt, Human
gaaagcauucuggaggggcaga

SEQ ID NO: 227839 - RNA, 22 nt, Human
cuguggaaugcaguugcgagca

SEQ ID NO: 227840 - RNA, 22 nt, Human
gaaaggagacugcacuggagcc

SEQ ID NO: 227841 - RNA, 22 nt, Human
cugugcuugcugugcuggggcc

SEQ ID NO: 227842 - RNA, 22 nt, Human
cuguggcuaggaagcuguggga

SEQ ID NO: 227843 - RNA, 22 nt, Human
gaaauaggcccuuacauggaaa

SEQ ID NO: 227844 - RNA, 22 nt, Human
cuguguguauaauguuugauaa

SEQ ID NO: 227845 - RNA, 22 nt, Human
cuguguggccuaaguggagaca

SEQ ID NO: 227846 - RNA, 22 nt, Human
gaaaugucaagauauguuugga

SEQ ID NO: 227847 - RNA, 22 nt, Human
gaagcagguucuucaggaugaa

SEQ ID NO: 227848 - RNA, 22 nt, Human
cuuauuugcccauguuucuuua

SEQ ID NO: 227849 - RNA, 20 nt, Human
cuuauuuuggagaacuuuuc

SEQ ID NO: 227850 - RNA, 22 nt, Human
cuucacugcagucauggcucug

SEQ ID NO: 227851 - RNA, 22 nt, Human
cuuaggcgugugcgggugaggc

SEQ ID NO: 227852 - RNA, 22 nt, Human
cuuauucuucuggacuuggagu

SEQ ID NO: 227853 - RNA, 22 nt, Human
cuguuacggaggcuuucuaguu

SEQ ID NO: 227854 - RNA, 20 nt, Human
cuguucucuugccacaugag

SEQ ID NO: 227855 - RNA, 22 nt, Human
cuguuuuugccugugacaaaaa

SEQ ID NO: 227856 - RNA, 22 nt, Human
gaacugggguagggguagcuuu

SEQ ID NO: 227857 - RNA, 22 nt, Human
cuguuucucugccugcacacau

SEQ ID NO: 227858 - RNA, 22 nt, Human
cuguuguucacuuugcugguga

SEQ ID NO: 227859 - RNA, 20 nt, Human
cuguuugcuaucaugagcug

SEQ ID NO: 227860 - RNA, 22 nt, Human
cccagggguugaggccguaggg

SEQ ID NO: 227861 - RNA, 22 nt, Human
cccaggccguguaaucagcagc

SEQ ID NO: 227862 - RNA, 22 nt, Human
cccagcuuugcggacccgggag

SEQ ID NO: 227863 - RNA, 22 nt, Human
cccagccgcuguggucuagggu

SEQ ID NO: 227864 - RNA, 22 nt, Human
cccagcugaacuugcauuccaa

SEQ ID NO: 227865 - RNA, 22 nt, Human
ccagcaggagacuagcaacaua

SEQ ID NO: 227866 - RNA, 22 nt, Human
ccagcagaagcucccgcugggu

SEQ ID NO: 227867 - RNA, 22 nt, Human
ccagcaucagcucuuggcuggc

SEQ ID NO: 227868 - RNA, 22 nt, Human
ccccaaauuugugcuuucauag

SEQ ID NO: 227869 - RNA, 22 nt, Human
ccagcaagacucgcagugggau

SEQ ID NO: 227870 - RNA, 22 nt, Human
ccagauaaacauuccuuggccu

SEQ ID NO: 227871 - RNA, 22 nt, Human
cccagccugaucucggccagcu

SEQ ID NO: 227872 - RNA, 22 nt, Human
cccagcaccauaacucaggccu

SEQ ID NO: 227873 - RNA, 20 nt, Human
caucaacaccuugucagccu

SEQ ID NO: 227874 - RNA, 22 nt, Human
cauuaccuggggagaggauacc

SEQ ID NO: 227875 - RNA, 22 nt, Human
cauuacaagaaauagcauaaug

SEQ ID NO: 227876 - RNA, 23 nt, Human
cauguacacacagcuguacagug

SEQ ID NO: 227877 - RNA, 23 nt, Human
cauauucagaaacaccuaguggu

SEQ ID NO: 227878 - RNA, 22 nt, Human
ccaggcuaggaccgauuucccu

SEQ ID NO: 227879 - RNA, 22 nt, Human
ccagggagggccacagggccau

SEQ ID NO: 227880 - RNA, 22 nt, Human
cccggcucggcuucuuccccac

SEQ ID NO: 227881 - RNA, 22 nt, Human
ccaggaguccgugggucuugag

SEQ ID NO: 227882 - RNA, 22 nt, Human
ccaggacuuauuacaguauaac

SEQ ID NO: 227883 - RNA, 22 nt, Human
ccaggcccugccugugguuccu

SEQ ID NO: 227884 - RNA, 22 nt, Human
cccgaaaauuguuguacugcag

SEQ ID NO: 227885 - RNA, 19 nt, Human
cccgauggagacuuagcag

SEQ ID NO: 227886 - RNA, 22 nt, Human
cccgacuccuccugguaccuaa

SEQ ID NO: 227887 - RNA, 22 nt, Human
cccgccggccacaccggccgcc

SEQ ID NO: 227888 - RNA, 22 nt, Human
cccgcuaaaucaguucugaguc

SEQ ID NO: 227889 - RNA, 22 nt, Human
cccggagcagucgggcuccggg

SEQ ID NO: 227890 - RNA, 22 nt, Human
ccccucuguagcccgagcugcu

SEQ ID NO: 227891 - RNA, 22 nt, Human
ccccaguuccugucaaggguaa

SEQ ID NO: 227892 - RNA, 22 nt, Human
ccccauggaaaacccaccuagg

SEQ ID NO: 227893 - RNA, 22 nt, Human
ccagccuucugaugggacccuc

SEQ ID NO: 227894 - RNA, 22 nt, Human
ccccagugguugcaacagcaga

SEQ ID NO: 227895 - RNA, 22 nt, Human
ccagccugccaagcccagcccu

SEQ ID NO: 227896 - RNA, 22 nt, Human
ccagccugagcuugcugcccuc

SEQ ID NO: 227897 - RNA, 22 nt, Human
ccagcugcugcaccgugcaugg

SEQ ID NO: 227898 - RNA, 22 nt, Human
ccagcugggucccugcuggggc

SEQ ID NO: 227899 - RNA, 22 nt, Human
ccagcuuuucagaaucugccug

SEQ ID NO: 227900 - RNA, 22 nt, Human
ccagcucgaggcaggggcugca

SEQ ID NO: 227901 - RNA, 22 nt, Human
ccccugcucagggaggagaccg

SEQ ID NO: 227902 - RNA, 22 nt, Human
ccauuucacaucccugacaugu

SEQ ID NO: 227903 - RNA, 22 nt, Human
ccauuuggccauucaguuguuc

SEQ ID NO: 227904 - RNA, 22 nt, Human
ccaugggugucuggagcacccu

SEQ ID NO: 227905 - RNA, 22 nt, Human
ccaugugaccugugucaguugc

SEQ ID NO: 227906 - RNA, 22 nt, Human
ccgccacggggcaugggaggca

SEQ ID NO: 227907 - RNA, 22 nt, Human
cccacccuacugcuacccagga

SEQ ID NO: 227908 - RNA, 22 nt, Human
ccgcagucugcaaucucccugg

SEQ ID NO: 227909 - RNA, 22 nt, Human
ccgcagggcccggcgggcucag

SEQ ID NO: 227910 - RNA, 21 nt, Human
ccgaggagugcggggagcccc

SEQ ID NO: 227911 - RNA, 22 nt, Human
ccauggccaauugcaccuugcu

SEQ ID NO: 227912 - RNA, 22 nt, Human
ccaucuuugcucuuuuauugca

SEQ ID NO: 227913 - RNA, 22 nt, Human
ccauggauacuaagguauguga

SEQ ID NO: 227914 - RNA, 22 nt, Human
ccauggaaaagacgggcaggcc

SEQ ID NO: 227915 - RNA, 22 nt, Human
ccaugaggcaaagacugauaua

SEQ ID NO: 227916 - RNA, 22 nt, Human
ccauaaaagagaaucuaaauga

SEQ ID NO: 227917 - RNA, 22 nt, Human
cccuucuguaucuucugaguuu

SEQ ID NO: 227918 - RNA, 21 nt, Human
cccuugccugcacuccucggc

SEQ ID NO: 227919 - RNA, 16 nt, Human
ccaguggacuugcuac

SEQ ID NO: 227920 - RNA, 22 nt, Human
ccaguccacgucaagaagaggu

SEQ ID NO: 227921 - RNA, 23 nt, Human
ccagucgagucccaaccuucacc

SEQ ID NO: 227922 - RNA, 22 nt, Human
ccagguuggccaccuucacggg

SEQ ID NO: 227923 - RNA, 22 nt, Human
ccagguggacggcgaguacagg

SEQ ID NO: 227924 - RNA, 22 nt, Human
ccagggcuggaccagugcuugg

SEQ ID NO: 227925 - RNA, 22 nt, Human
cccguggugggaugacaccaug

SEQ ID NO: 227926 - RNA, 22 nt, Human
cccgugggaugagaggcccugg

SEQ ID NO: 227927 - RNA, 22 nt, Human
cccugggccccgaacugcugag

SEQ ID NO: 227928 - RNA, 22 nt, Human
cccuggacuccauuuucccgua

SEQ ID NO: 227929 - RNA, 20 nt, Human
cccuggaaugagaugcauau

SEQ ID NO: 227930 - RNA, 23 nt, Human
ccagucgagucccaaccuucgcc

SEQ ID NO: 227931 - RNA, 22 nt, Human
ccagugacaaagucggaagucc

SEQ ID NO: 227932 - RNA, 17 nt, Human
cccugcauugauccuca

SEQ ID NO: 227933 - RNA, 22 nt, Human
cccuggucucugacuugauccu

SEQ ID NO: 227934 - RNA, 22 nt, Human
cccuguccugcuaggcccuggu

SEQ ID NO: 227935 - RNA, 22 nt, Human
ccagugcagacgcggaacuggc

SEQ ID NO: 227936 - RNA, 22 nt, Human
ccguccgcuccuccagccgcug

SEQ ID NO: 227937 - RNA, 22 nt, Human
ccguaugacuuuuuguuguugu

SEQ ID NO: 227938 - RNA, 22 nt, Human
ccgugcaguuucucacacacau

SEQ ID NO: 227939 - RNA, 22 nt, Human
cccaggucgucagcaguguggu

SEQ ID NO: 227940 - RNA, 22 nt, Human
cccaugacucucauucacaguc

SEQ ID NO: 227941 - RNA, 22 nt, Human
cccaucugugaaauggggcugc

SEQ ID NO: 227942 - RNA, 22 nt, Human
cccaguuguuccuauucuucuu

SEQ ID NO: 227943 - RNA, 22 nt, Human
ccccaguuucaccuaccccgcc

SEQ ID NO: 227944 - RNA, 22 nt, Human
cccauuuuuuggauguguggau

SEQ ID NO: 227945 - RNA, 22 nt, Human
ccccaggcagcccuccaggagc

SEQ ID NO: 227946 - RNA, 22 nt, Human
ccucaguguguggauguuagag

SEQ ID NO: 227947 - RNA, 22 nt, Human
ccucaggaauuuauucuucugu

SEQ ID NO: 227948 - RNA, 22 nt, Human
ccuauauuacaggcuugcucua

SEQ ID NO: 227949 - RNA, 22 nt, Human
ccuacccaccccuccucaucac

SEQ ID NO: 227950 - RNA, 22 nt, Human
ccguuugugcugcaggagaucg

SEQ ID NO: 227951 - RNA, 18 nt, Human
ccccucuuccagacagag

SEQ ID NO: 227952 - RNA, 22 nt, Human
ccccuuguuuuauucaaauugg

SEQ ID NO: 227953 - RNA, 22 nt, Human
cccagaccagagugccuggacg

SEQ ID NO: 227954 - RNA, 22 nt, Human
cccagcccaucauuccugcaaa

SEQ ID NO: 227955 - RNA, 22 nt, Human
ccgcuggccgacuuccgagagc

SEQ ID NO: 227956 - RNA, 22 nt, Human
ccgcggauggggagucaccacc

SEQ ID NO: 227957 - RNA, 22 nt, Human
ccgcgggcagggcuucaccuuu

SEQ ID NO: 227958 - RNA, 22 nt, Human
ccgcucuuugagacucucccga

SEQ ID NO: 227959 - RNA, 22 nt, Human
cccaagcuccacauuuuagcuu

SEQ ID NO: 227960 - RNA, 18 nt, Human
cccaccugcccagguuca

SEQ ID NO: 227961 - RNA, 22 nt, Human
ccgccucucgcucccagcuugc

SEQ ID NO: 227962 - RNA, 22 nt, Human
ccgcgcccccggcugugccccc

SEQ ID NO: 227963 - RNA, 22 nt, Human
ccgcggcagaggcgggggcgcc

SEQ ID NO: 227964 - RNA, 22 nt, Human
ccggauuugggagccaccaggg

SEQ ID NO: 227965 - RNA, 22 nt, Human
ccggcggguggagcaugcgcgg

SEQ ID NO: 227966 - RNA, 22 nt, Human
cccagcucuggaagguggggga

SEQ ID NO: 227967 - RNA, 22 nt, Human
cccagccuuugcuuccugguuc

SEQ ID NO: 227968 - RNA, 22 nt, Human
cccagcuggcaaaggcguccuu

SEQ ID NO: 227969 - RNA, 22 nt, Human
cccagcgccugcccuccgccgc

SEQ ID NO: 227970 - RNA, 22 nt, Human
ccgggcggcauccagccguucc

SEQ ID NO: 227971 - RNA, 22 nt, Human
ccgggcuuccuuagagcaagau

SEQ ID NO: 227972 - RNA, 22 nt, Human
ccucccuucccggcauggcucu

SEQ ID NO: 227973 - RNA, 22 nt, Human
cccggcgccucguuuccuaguc

SEQ ID NO: 227974 - RNA, 22 nt, Human
ccuccugggccuugcucuguga

SEQ ID NO: 227975 - RNA, 22 nt, Human
ccucgcucauggauucugccug

SEQ ID NO: 227976 - RNA, 21 nt, Human
ccuccagccagagggucugga

SEQ ID NO: 227977 - RNA, 22 nt, Human
ccuccccugccugugcuguugg

SEQ ID NO: 227978 - RNA, 19 nt, Human
cccucggcuucugguuacu

SEQ ID NO: 227979 - RNA, 22 nt, Human
cccgggucugugugaaauucca

SEQ ID NO: 227980 - RNA, 23 nt, Human
cccgggaagugcugcuuaucugg

SEQ ID NO: 227981 - RNA, 22 nt, Human
cccgguggagaugugggacagg

SEQ ID NO: 227982 - RNA, 22 nt, Human
ccucucccugcagggcccaggg

SEQ ID NO: 227983 - RNA, 22 nt, Human
cccgggcucuggcagaggcggu

SEQ ID NO: 227984 - RNA, 22 nt, Human
cccugauaaaucagcaccucag

SEQ ID NO: 227985 - RNA, 22 nt, Human
ccugaaaugaguucugcucacu

SEQ ID NO: 227986 - RNA, 22 nt, Human
cccuguccuucccuccaucuga

SEQ ID NO: 227987 - RNA, 22 nt, Human
ccugaguucuuauuuccaguca

SEQ ID NO: 227988 - RNA, 22 nt, Human
ccugagccgagcgcucuuucuc

SEQ ID NO: 227989 - RNA, 22 nt, Human
ccugaggcccuggcugugcuga

SEQ ID NO: 227990 - RNA, 21 nt, Human
ccugagccuguuuauccagaa

SEQ ID NO: 227991 - RNA, 20 nt, Human
cccuggcuggcaucuggacu

SEQ ID NO: 227992 - RNA, 22 nt, Human
ccugaccauuugccacaugggu

SEQ ID NO: 227993 - RNA, 22 nt, Human
cccuggcucaggcagcuuuguu

SEQ ID NO: 227994 - RNA, 17 nt, Human
cccugcacccuacucuc

SEQ ID NO: 227995 - RNA, 22 nt, Human
cccugcuuccucuucuguuugu

SEQ ID NO: 227996 - RNA, 22 nt, Human
ccugccugggcucacuugccag

SEQ ID NO: 227997 - RNA, 18 nt, Human
ccugcguggauguccucu

SEQ ID NO: 227998 - RNA, 22 nt, Human
ccugcacuaccuggggcugcug

SEQ ID NO: 227999 - RNA, 22 nt, Human
cccuuugucaguagucuuagug

SEQ ID NO: 228000 - RNA, 22 nt, Human
cccuuuuuugccauuccuuccu

SEQ ID NO: 228001 - RNA, 22 nt, Human
cccuuuuuuauggaguuggcca

SEQ ID NO: 228002 - RNA, 22 nt, Human
cucuggcaacgauggugcuuau

SEQ ID NO: 228003 - RNA, 22 nt, Human
cucuggacaucugcggugcuuc

SEQ ID NO: 228004 - RNA, 22 nt, Human
cucuccagucauauucucaguc

SEQ ID NO: 228005 - RNA, 22 nt, Human
cucuggggaagugcacucgcug

SEQ ID NO: 228006 - RNA, 22 nt, Human
cucuuucauucuguccuuguuu

SEQ ID NO: 228007 - RNA, 20 nt, Human
cucuuuaugagaccacuguc

SEQ ID NO: 228008 - RNA, 22 nt, Human
cucuucugugggugcuauguca

SEQ ID NO: 228009 - RNA, 22 nt, Human
cucuuuuuccuaugaaaucuau

SEQ ID NO: 228010 - RNA, 22 nt, Human
cugaaagacagccaggcaaagc

SEQ ID NO: 228011 - RNA, 22 nt, Human
cggcuacccaugucauauucgu

SEQ ID NO: 228012 - RNA, 22 nt, Human
cggcggcgaaccgaccugggug

SEQ ID NO: 228013 - RNA, 22 nt, Human
cgggaggcggagcuccgcgggg

SEQ ID NO: 228014 - RNA, 22 nt, Human
cgggagcagcucuggggcuggg

SEQ ID NO: 228015 - RNA, 22 nt, Human
cggggcaaggggggcuggugga

SEQ ID NO: 228016 - RNA, 22 nt, Human
cgggagaugaggagagcuucgg

SEQ ID NO: 228017 - RNA, 22 nt, Human
cggcuucucgggucggauuccg

SEQ ID NO: 228018 - RNA, 23 nt, Human
cugaaauucagaugcuaaagaua

SEQ ID NO: 228019 - RNA, 22 nt, Human
cugaagaaagaaaauggccauc

SEQ ID NO: 228020 - RNA, 20 nt, Human
cugaaaggaaagaaauuuuu

SEQ ID NO: 228021 - RNA, 22 nt, Human
cggggcggcgagcgggccgggc

SEQ ID NO: 228022 - RNA, 22 nt, Human
cugaaucugccuccgaggguuu

SEQ ID NO: 228023 - RNA, 22 nt, Human
cugacagaucuggaucugaacu

SEQ ID NO: 228024 - RNA, 20 nt, Human
cugaccagcagccugucucc

SEQ ID NO: 228025 - RNA, 22 nt, Human
cugaccgugccgcgguacugcu

SEQ ID NO: 228026 - RNA, 22 nt, Human
cugaaggacacgugaggagcca

SEQ ID NO: 228027 - RNA, 22 nt, Human
cugaaggcuuugaauggaauga

SEQ ID NO: 228028 - RNA, 22 nt, Human
cggggcuggcguuagggaggca

SEQ ID NO: 228029 - RNA, 19 nt, Human
cggggcuugguggguucuc

SEQ ID NO: 228030 - RNA, 22 nt, Human
cgggucgcacaggagaaaggcg

SEQ ID NO: 228031 - RNA, 22 nt, Human
cggucggagagaaugaccugga

SEQ ID NO: 228032 - RNA, 19 nt, Human
cggugaagagaguuuagau

SEQ ID NO: 228033 - RNA, 22 nt, Human
cggugccccuagcgcgccgccc

SEQ ID NO: 228034 - RNA, 22 nt, Human
cuaauugcuggcugcuggcaga

SEQ ID NO: 228035 - RNA, 22 nt, Human
cuaauuguaagcuccuugaggg

SEQ ID NO: 228036 - RNA, 21 nt, Human
cuauaaaaaugguucuuugcg

SEQ ID NO: 228037 - RNA, 22 nt, Human
cgccuggccccgcagcgcuugu

SEQ ID NO: 228038 - RNA, 22 nt, Human
cuauuaauggccaggagucaug

SEQ ID NO: 228039 - RNA, 22 nt, Human
cuauguuuugcuagugaugggu

SEQ ID NO: 228040 - RNA, 22 nt, Human
cuaugaaucaauuucugcaguu

SEQ ID NO: 228041 - RNA, 22 nt, Human
cuauauucuggaauguccauuu

SEQ ID NO: 228042 - RNA, 22 nt, Human
cuauaucuguggauaguguaug

SEQ ID NO: 228043 - RNA, 22 nt, Human
cucaauuuuuauugcuuuuuug

SEQ ID NO: 228044 - RNA, 22 nt, Human
cuauugguaucacacugauuuc

SEQ ID NO: 228045 - RNA, 19 nt, Human
cgcugcucccgcuguggcu

SEQ ID NO: 228046 - RNA, 22 nt, Human
cucagcugcuuuguuuugcuuu

SEQ ID NO: 228047 - RNA, 22 nt, Human
cgcucggcuuucccuccgccgg

SEQ ID NO: 228048 - RNA, 22 nt, Human
cuccaugagccaggagggcuac

SEQ ID NO: 228049 - RNA, 22 nt, Human
cucccaucacaauucagggccu

SEQ ID NO: 228050 - RNA, 22 nt, Human
cuccaggcccagggccaagagc

SEQ ID NO: 228051 - RNA, 22 nt, Human
cuccagucccuccuugcccagc

SEQ ID NO: 228052 - RNA, 22 nt, Human
cuccuggagcagcaggcgcagg

SEQ ID NO: 228053 - RNA, 22 nt, Human
cuccugcuuuuucuucuuccga

SEQ ID NO: 228054 - RNA, 22 nt, Human
cgcuuugguaauagggcagccu

SEQ ID NO: 228055 - RNA, 22 nt, Human
cgcuuugacuuuagaaggccaa

SEQ ID NO: 228056 - RNA, 22 nt, Human
cgcuuuccaggcacauccucuu

SEQ ID NO: 228057 - RNA, 22 nt, Human
cucggcccuggucuuacgggac

SEQ ID NO: 228058 - RNA, 22 nt, Human
cuccuuuuuauaucuuucucug

SEQ ID NO: 228059 - RNA, 22 nt, Human
cuccuuuuugggaccgugcagc

SEQ ID NO: 228060 - RNA, 22 nt, Human
cuccuuuuuuuaaagauggauu

SEQ ID NO: 228061 - RNA, 22 nt, Human
cuccuuuuccuacucauacuau

SEQ ID NO: 228062 - RNA, 22 nt, Human
cuccuuccuccgcccuuccucg

SEQ ID NO: 228063 - RNA, 21 nt, Human
ccugucagcccaacuuuugga

SEQ ID NO: 228064 - RNA, 22 nt, Human
ccugugacucugucugaugguc

SEQ ID NO: 228065 - RNA, 19 nt, Human
ccugugaguuaagcuaugu

SEQ ID NO: 228066 - RNA, 20 nt, Human
ccuguucacugcgcaguuuc

SEQ ID NO: 228067 - RNA, 22 nt, Human
ccuguuuguucauguacuguga

SEQ ID NO: 228068 - RNA, 22 nt, Human
cggggggguuggaaaagggaga

SEQ ID NO: 228069 - RNA, 22 nt, Human
cggggcgggcgugggaggugga

SEQ ID NO: 228070 - RNA, 19 nt, Human
cgguaugaauguacuaugg

SEQ ID NO: 228071 - RNA, 22 nt, Human
cgggguguggggcgguagugug

SEQ ID NO: 228072 - RNA, 22 nt, Human
ccuucaguguuacuagaaagcg

SEQ ID NO: 228073 - RNA, 22 nt, Human
cggggugugacggugcgggccu

SEQ ID NO: 228074 - RNA, 19 nt, Human
cggugcugauuggugcagu

SEQ ID NO: 228075 - RNA, 22 nt, Human
ccuuccaguucuugguuguaau

SEQ ID NO: 228076 - RNA, 22 nt, Human
ccuucccagacggcucagcugu

SEQ ID NO: 228077 - RNA, 22 nt, Human
cgugcaggagcuggagguccga

SEQ ID NO: 228078 - RNA, 22 nt, Human
cgguuuuuaaaagucucuucua

SEQ ID NO: 228079 - RNA, 22 nt, Human
ccuuuuaucgcgaagaacucca

SEQ ID NO: 228080 - RNA, 22 nt, Human
cgucauacagaugaacaaucuc

SEQ ID NO: 228081 - RNA, 22 nt, Human
ccuuuggaugucauucuuggca

SEQ ID NO: 228082 - RNA, 20 nt, Human
ccuuuuguugcuguuuggau

SEQ ID NO: 228083 - RNA, 22 nt, Human
cgugugugugcgugugcgugug

SEQ ID NO: 228084 - RNA, 17 nt, Human
cguuccagaacaaauga

SEQ ID NO: 228085 - RNA, 22 nt, Human
cguucccuccugccacgggagg

SEQ ID NO: 228086 - RNA, 22 nt, Human
cguugguggguguguggucgga

SEQ ID NO: 228087 - RNA, 22 nt, Human
cguuugagggaguuggaacugc

SEQ ID NO: 228088 - RNA, 22 nt, Human
cuaaaaauguucuaguaguuca

SEQ ID NO: 228089 - RNA, 20 nt, Human
cuaaaacaggugucuaguga

SEQ ID NO: 228090 - RNA, 22 nt, Human
cuaacuuugucuugguaauugc

SEQ ID NO: 228091 - RNA, 22 nt, Human
ccugauauggugucauuuaaac

SEQ ID NO: 228092 - RNA, 22 nt, Human
cgcucugccugcccuaacuucc

SEQ ID NO: 228093 - RNA, 22 nt, Human
cgcucggugagccaguggcgga

SEQ ID NO: 228094 - RNA, 22 nt, Human
cgccugucugcauggccacugg

SEQ ID NO: 228095 - RNA, 22 nt, Human
ccucuggacuugggacagugag

SEQ ID NO: 228096 - RNA, 20 nt, Human
ccucuuuaguugauggguuu

SEQ ID NO: 228097 - RNA, 22 nt, Human
ccugaagaugguugauccccuu

SEQ ID NO: 228098 - RNA, 22 nt, Human
ccugaauuuaucugaauggugg

SEQ ID NO: 228099 - RNA, 22 nt, Human
cgcgcgguguuccgcauucugc

SEQ ID NO: 228100 - RNA, 22 nt, Human
ccugacagcgugucccuggccc

SEQ ID NO: 228101 - RNA, 22 nt, Human
ccugcucccccugcaagccuug

SEQ ID NO: 228102 - RNA, 22 nt, Human
ccugcucuaauucauucaugcu

SEQ ID NO: 228103 - RNA, 22 nt, Human
ccugcccaucccaccccagcau

SEQ ID NO: 228104 - RNA, 22 nt, Human
ccugccagaaaagagggaguuc

SEQ ID NO: 228105 - RNA, 22 nt, Human
ccugccagccugccaucccaca

SEQ ID NO: 228106 - RNA, 22 nt, Human
ccugcaugacuuugucagaccu

SEQ ID NO: 228107 - RNA, 22 nt, Human
ccugcaguuuuuccaugauaca

SEQ ID NO: 228108 - RNA, 22 nt, Human
cggccgcgggauggcgggcagc

SEQ ID NO: 228109 - RNA, 22 nt, Human
ccuggaccgacacaggaaggga

SEQ ID NO: 228110 - RNA, 22 nt, Human
cggccuuuggcuucuccugugu

SEQ ID NO: 228111 - RNA, 22 nt, Human
cggcgcugguacaguggaagag

SEQ ID NO: 228112 - RNA, 22 nt, Human
ccugcugagccuggugggcagc

SEQ ID NO: 228113 - RNA, 19 nt, Human
ccugcugaagugaugcagc

SEQ ID NO: 228114 - RNA, 22 nt, Human
ccgccccaggcccugagccaag

SEQ ID NO: 228115 - RNA, 22 nt, Human
ccgauuuaugucucugacuuga

SEQ ID NO: 228116 - RNA, 22 nt, Human
cgacagauuauuuugugacugc

SEQ ID NO: 228117 - RNA, 22 nt, Human
ccucaauucgugccucacauug

SEQ ID NO: 228118 - RNA, 22 nt, Human
ccgcaccgucugccauacacgc

SEQ ID NO: 228119 - RNA, 22 nt, Human
ccgauuuauucugacaguuuau

SEQ ID NO: 228120 - RNA, 22 nt, Human
ccugcugcugaugcuguuucac

SEQ ID NO: 228121 - RNA, 23 nt, Human
cgagagccugcaggaccuucgga

SEQ ID NO: 228122 - RNA, 22 nt, Human
cgcacaggcacagacacuggga

SEQ ID NO: 228123 - RNA, 22 nt, Human
cgccaaccaggcuguccuccca

SEQ ID NO: 228124 - RNA, 22 nt, Human
cgccaguggcagcuggaacagg

SEQ ID NO: 228125 - RNA, 22 nt, Human
cgcacuugugagcgacagggcu

SEQ ID NO: 228126 - RNA, 22 nt, Human
cgcaucggguagaggagcugga

SEQ ID NO: 228127 - RNA, 22 nt, Human
ccucaucagaaagcagaaagca

SEQ ID NO: 228128 - RNA, 19 nt, Human
cgacauggguaaugggaga

SEQ ID NO: 228129 - RNA, 22 nt, Human
cgaccccugaaaauggcagcca

SEQ ID NO: 228130 - RNA, 22 nt, Human
cgacgacaggcgcccgaggagg

SEQ ID NO: 228131 - RNA, 22 nt, Human
uuuuuuuguagguguaugaaaa

SEQ ID NO: 228132 - RNA, 22 nt, Human
uuuuuuuuacuccggacagcuc

SEQ ID NO: 228133 - RNA, 22 nt, Human
uuuuuguauaugcuucgaggau

SEQ ID NO: 228134 - RNA, 22 nt, Human
uuuuugggaagaauucugauau

SEQ ID NO: 228135 - RNA, 22 nt, Human
uuuuucuccucucucuuucauu

SEQ ID NO: 228136 - RNA, 22 nt, Human
uuuuucuccauuccaggugccu

SEQ ID NO: 228137 - RNA, 22 nt, Human
uuuuucuuugguaacucuuccu

SEQ ID NO: 228138 - RNA, 22 nt, Human
uuuuucugccucucucccacau

SEQ ID NO: 228139 - RNA, 22 nt, Human
uuuuucuuugcuuuccacuggc

SEQ ID NO: 228140 - RNA, 22 nt, Human
uuuuuuguuccuugguuuuugu

SEQ ID NO: 228141 - RNA, 22 nt, Human
uuuuuugucuugaagaaauggu

SEQ ID NO: 228142 - RNA, 22 nt, Human
uuuuuuuaaguuuugauuuuag

SEQ ID NO: 228143 - RNA, 22 nt, Human
uuuuuuuagaaagaucauaguu

SEQ ID NO: 228144 - RNA, 22 nt, Human
uuuuuuccugguuacagauugu

SEQ ID NO: 228145 - RNA, 22 nt, Human
uuuuuucuucucuaucuuaaua

SEQ ID NO: 228146 - RNA, 22 nt, Human
uuuuuguuauuuagguguagag

SEQ ID NO: 228147 - RNA, 22 nt, Human
uuuuuuaaucaaguaggaaaca

SEQ ID NO: 228148 - RNA, 20 nt, Human
uuuuuuaaauagagcuguug

SEQ ID NO: 228149 - RNA, 22 nt, Human
uuuguucuagauaacugguaau

SEQ ID NO: 228150 - RNA, 22 nt, Human
uuuguucaccuagcaaacuuuu

SEQ ID NO: 228151 - RNA, 21 nt, Human
uuuguucaggggcaaaguuaa

SEQ ID NO: 228152 - RNA, 22 nt, Human
uuuguugaauggcaggauuuua

SEQ ID NO: 228153 - RNA, 22 nt, Human
uuuguugguugcacuggugggu

SEQ ID NO: 228154 - RNA, 22 nt, Human
uuuguucaguuuguugugggug

SEQ ID NO: 228155 - RNA, 19 nt, Human
uuuguuguaucagagcuuu

SEQ ID NO: 228156 - RNA, 23 nt, Human
uuuguugguuuaagaguagcaga

SEQ ID NO: 228157 - RNA, 22 nt, Human
uuuguuugcugagugaauucaa

SEQ ID NO: 228158 - RNA, 22 nt, Human
uuuuaaaacaugucaaaaugug

SEQ ID NO: 228159 - RNA, 22 nt, Human
uuuguuuauuuacuuugggccu

SEQ ID NO: 228160 - RNA, 22 nt, Human
uuuguuuccagccuuuugucuu

SEQ ID NO: 228161 - RNA, 17 nt, Human
uuuguuucauacuucau

SEQ ID NO: 228162 - RNA, 22 nt, Human
uuuacuauuaguauuucauuuu

SEQ ID NO: 228163 - RNA, 22 nt, Human
uuuacuuuugguaaggucauuu

SEQ ID NO: 228164 - RNA, 22 nt, Human
uuuacuguuuacagcuaaugca

SEQ ID NO: 228165 - RNA, 22 nt, Human
uuuguuaugguuggaagcagga

SEQ ID NO: 228166 - RNA, 22 nt, Human
uuuguguuuugaggucuugcaa

SEQ ID NO: 228167 - RNA, 22 nt, Human
uuuguguuggaagaaaugcuac

SEQ ID NO: 228168 - RNA, 22 nt, Human
uuuagaaugaaugcaagagaau

SEQ ID NO: 228169 - RNA, 22 nt, Human
uuuuaaaagguugcuguuauaa

SEQ ID NO: 228170 - RNA, 22 nt, Human
uuuuaaauaaacuacacugauu

SEQ ID NO: 228171 - RNA, 22 nt, Human
uuuuaaguauuuucuuuuuuua

SEQ ID NO: 228172 - RNA, 22 nt, Human
uuuuaauaguauaucuagacac

SEQ ID NO: 228173 - RNA, 22 nt, Human
uuuuaacuuuaccauuucuuca

SEQ ID NO: 228174 - RNA, 22 nt, Human
uuuuaaucagguauuugaguau

SEQ ID NO: 228175 - RNA, 22 nt, Human
uuuuacuuuucccacuuacagc

SEQ ID NO: 228176 - RNA, 22 nt, Human
uuuuaucuuacauggaaucucc

SEQ ID NO: 228177 - RNA, 19 nt, Human
uuuucaacguccgguucau

SEQ ID NO: 228178 - RNA, 22 nt, Human
uuuuauuuguauguugaaugua

SEQ ID NO: 228179 - RNA, 22 nt, Human
uuuucaauuuucauuugcaaga

SEQ ID NO: 228180 - RNA, 22 nt, Human
uuuuauaauacccuugacuaau

SEQ ID NO: 228181 - RNA, 22 nt, Human
uuuuaucagagcuugcagugug

SEQ ID NO: 228182 - RNA, 22 nt, Human
uuuuaggauuugaguugcugga

SEQ ID NO: 228183 - RNA, 22 nt, Human
uuuuagaagcauuuaugagauu

SEQ ID NO: 228184 - RNA, 22 nt, Human
uuuuacgucuuugcugccucgu

SEQ ID NO: 228185 - RNA, 22 nt, Human
uuuuagagacagcauggagaaa

SEQ ID NO: 228186 - RNA, 22 nt, Human
uuuugauacaaguuguaaaaaa

SEQ ID NO: 228187 - RNA, 22 nt, Human
uuuugagucuggcaguuuuguu

SEQ ID NO: 228188 - RNA, 22 nt, Human
uuuugaauaauucagaaacagc

SEQ ID NO: 228189 - RNA, 22 nt, Human
uuuugccuauuguaucaucgua

SEQ ID NO: 228190 - RNA, 22 nt, Human
uuuugcaaauuacuaaauuucu

SEQ ID NO: 228191 - RNA, 22 nt, Human
uuuucugauccuucuaacuuga

SEQ ID NO: 228192 - RNA, 22 nt, Human
uuuucuucucauucugaccuca

SEQ ID NO: 228193 - RNA, 22 nt, Human
uuuucuguuuaugaaauugugu

SEQ ID NO: 228194 - RNA, 22 nt, Human
uuuucuacaaaucuggacuuuu

SEQ ID NO: 228195 - RNA, 22 nt, Human
uuuuccuucuuccugccuugcc

SEQ ID NO: 228196 - RNA, 22 nt, Human
uuuucucaguuuuuuucaaaag

SEQ ID NO: 228197 - RNA, 22 nt, Human
uuuucucacugagagccuugau

SEQ ID NO: 228198 - RNA, 22 nt, Human
uuuucuaggcccuggauuaugu

SEQ ID NO: 228199 - RNA, 22 nt, Human
uuuucuacaaucacucuggaag

SEQ ID NO: 228200 - RNA, 22 nt, Human
uuuucauagccagaaacugaaa

SEQ ID NO: 228201 - RNA, 22 nt, Human
uuuucauuguuaguuucuccuu

SEQ ID NO: 228202 - RNA, 22 nt, Human
uuuuccuguccuugggucugca

SEQ ID NO: 228203 - RNA, 22 nt, Human
uuuuccuuccugucucuuuauu

SEQ ID NO: 228204 - RNA, 22 nt, Human
uuuugguuugaguauuuuuuuu

SEQ ID NO: 228205 - RNA, 22 nt, Human
uuuuggagaaaugggacuuaau

SEQ ID NO: 228206 - RNA, 22 nt, Human
uuuugcuucuaguauauuuuuu

SEQ ID NO: 228207 - RNA, 22 nt, Human
uuuugggugcaaauuguuuguu

SEQ ID NO: 228208 - RNA, 22 nt, Human
uuuuggauugcuaacucagggu

SEQ ID NO: 228209 - RNA, 22 nt, Human
uuuugucuguggaaagcugcua

SEQ ID NO: 228210 - RNA, 22 nt, Human
uuuuguagauagggaaacagag

SEQ ID NO: 228211 - RNA, 22 nt, Human
uuuuguggacugauccgaggac

SEQ ID NO: 228212 - RNA, 21 nt, Human
uuuuguguugcgcacuuugag

SEQ ID NO: 228213 - RNA, 22 nt, Human
uuuuguagauuggaaaaucugg

SEQ ID NO: 228214 - RNA, 22 nt, Human
uuuuuagcauaugucaaaucag

SEQ ID NO: 228215 - RNA, 22 nt, Human
uuuuuaaaagaugauuuaauga

SEQ ID NO: 228216 - RNA, 22 nt, Human
gcagauccaaauauaguucuug

SEQ ID NO: 228217 - RNA, 22 nt, Human
gaggggcgaggacgcugaagua

SEQ ID NO: 228218 - RNA, 22 nt, Human
gaggggcggggcgggaggagag

SEQ ID NO: 228219 - RNA, 22 nt, Human
gcagcaaucuucacagugucau

SEQ ID NO: 228220 - RNA, 22 nt, Human
gcagcagugugggcugaaccua

SEQ ID NO: 228221 - RNA, 20 nt, Human
gcagcagacagacaggggac

SEQ ID NO: 228222 - RNA, 22 nt, Human
gaggguaaauucagaguaggag

SEQ ID NO: 228223 - RNA, 22 nt, Human
gaggggggcacuuguuuugacu

SEQ ID NO: 228224 - RNA, 22 nt, Human
gagggugguggcggccggcacc

SEQ ID NO: 228225 - RNA, 22 nt, Human
gagggugugguauggauguguu

SEQ ID NO: 228226 - RNA, 22 nt, Human
gaggguggggaauagacugcua

SEQ ID NO: 228227 - RNA, 22 nt, Human
gcagauuggguacauaaacagu

SEQ ID NO: 228228 - RNA, 22 nt, Human
gagggggcggccccugugggca

SEQ ID NO: 228229 - RNA, 22 nt, Human
gagggggcaggcucggcaccgg

SEQ ID NO: 228230 - RNA, 22 nt, Human
gagggagugggcccgugggcac

SEQ ID NO: 228231 - RNA, 22 nt, Human
gcagaaguauuguacgguggga

SEQ ID NO: 228232 - RNA, 22 nt, Human
gagggcauugucuucuuaguuu

SEQ ID NO: 228233 - RNA, 22 nt, Human
gcagagcacccugcagugguau

SEQ ID NO: 228234 - RNA, 22 nt, Human
gcagagaaugucagauuuuguu

SEQ ID NO: 228235 - RNA, 22 nt, Human
gaggggaaggguguucaauggg

SEQ ID NO: 228236 - RNA, 22 nt, Human
gaggggcacaguggggccuggg

SEQ ID NO: 228237 - RNA, 22 nt, Human
gaggggaaggagcgaaggcggg

SEQ ID NO: 228238 - RNA, 22 nt, Human
gaggggaauguuccugagcugg

SEQ ID NO: 228239 - RNA, 22 nt, Human
gcagagcugucuaagucacuuc

SEQ ID NO: 228240 - RNA, 22 nt, Human
gaggggaagaacaauuuaauuu

SEQ ID NO: 228241 - RNA, 21 nt, Human
gcagcaugagaaagccccaaa

SEQ ID NO: 228242 - RNA, 22 nt, Human
gcagccagggaccuuugacuau

SEQ ID NO: 228243 - RNA, 22 nt, Human
gcagccauuugcaucuaauuaa

SEQ ID NO: 228244 - RNA, 22 nt, Human
gaggucagcaagccaugcuugu

SEQ ID NO: 228245 - RNA, 22 nt, Human
gaggucagugugggggcaaggg

SEQ ID NO: 228246 - RNA, 22 nt, Human
gaggguuucagugggacggguu

SEQ ID NO: 228247 - RNA, 22 nt, Human
gaggucauuaaagaaaagaguc

SEQ ID NO: 228248 - RNA, 22 nt, Human
gaggucuugagugacuuagcag

SEQ ID NO: 228249 - RNA, 22 nt, Human
gaggugaacccaggugcuucac

SEQ ID NO: 228250 - RNA, 22 nt, Human
gaggucaugcagcucugaguuc

SEQ ID NO: 228251 - RNA, 22 nt, Human
gcaggagggggccuggagccca

SEQ ID NO: 228252 - RNA, 22 nt, Human
gcaggcagauccagaagcacua

SEQ ID NO: 228253 - RNA, 22 nt, Human
gaggugauuccucccauguaau

SEQ ID NO: 228254 - RNA, 22 nt, Human
gcaggcaggauucagagauaca

SEQ ID NO: 228255 - RNA, 22 nt, Human
gcaggaagauugcagaaggcug

SEQ ID NO: 228256 - RNA, 20 nt, Human
gcagcugacccuagugcuug

SEQ ID NO: 228257 - RNA, 21 nt, Human
gcagcucaggauauagacuug

SEQ ID NO: 228258 - RNA, 22 nt, Human
gcagcguguggcuaauggcucu

SEQ ID NO: 228259 - RNA, 22 nt, Human
gcagcgcugagaugauuuguug

SEQ ID NO: 228260 - RNA, 22 nt, Human
gaggccagcacccagaugcaug

SEQ ID NO: 228261 - RNA, 22 nt, Human
gaggcauaaguagaagagauug

SEQ ID NO: 228262 - RNA, 22 nt, Human
gcaccauagagaagagacacaa

SEQ ID NO: 228263 - RNA, 22 nt, Human
gcacauaugcuguaagcacaug

SEQ ID NO: 228264 - RNA, 22 nt, Human
gcaccgagaaggaagcaugccu

SEQ ID NO: 228265 - RNA, 22 nt, Human
gaggauggaaaaaccccaaagg

SEQ ID NO: 228266 - RNA, 22 nt, Human
gcacccagggcaggaagugagg

SEQ ID NO: 228267 - RNA, 22 nt, Human
gcacaggcugcacgaccccagc

SEQ ID NO: 228268 - RNA, 22 nt, Human
gaggauuugagggucacuccac

SEQ ID NO: 228269 - RNA, 22 nt, Human
gaggaugacaaagaaggcagac

SEQ ID NO: 228270 - RNA, 21 nt, Human
gcacucagucacuacucaaga

SEQ ID NO: 228271 - RNA, 22 nt, Human
gaggcuaugucuacgcucagcg

SEQ ID NO: 228272 - RNA, 22 nt, Human
gagggaaauauggguuugguua

SEQ ID NO: 228273 - RNA, 22 nt, Human
gcacagauaaucugccuuacca

SEQ ID NO: 228274 - RNA, 22 nt, Human
gcacacaaaaauauguguugaa

SEQ ID NO: 228275 - RNA, 22 nt, Human
gaggagggagcuggaagcucuu

SEQ ID NO: 228276 - RNA, 22 nt, Human
gaggaggucaccuggugagcaa

SEQ ID NO: 228277 - RNA, 21 nt, Human
gcacaacucucacauucuucu

SEQ ID NO: 228278 - RNA, 22 nt, Human
gaggaggagacggaggccuggg

SEQ ID NO: 228279 - RNA, 22 nt, Human
gaggagcuucagaggaaucuua

SEQ ID NO: 228280 - RNA, 22 nt, Human
gcaauagccuacaugcgucaga

SEQ ID NO: 228281 - RNA, 22 nt, Human
gcaauuggaaugaauucuauuu

SEQ ID NO: 228282 - RNA, 22 nt, Human
gcaauuguauugucaagacaug

SEQ ID NO: 228283 - RNA, 22 nt, Human
gaggagagcuggccagguuucu

SEQ ID NO: 228284 - RNA, 22 nt, Human
gaggagaaacagccgugauagu

SEQ ID NO: 228285 - RNA, 22 nt, Human
gcaagagaagaaagaauaguuu

SEQ ID NO: 228286 - RNA, 22 nt, Human
gaggacugguugggaaugugaa

SEQ ID NO: 228287 - RNA, 22 nt, Human
gagcuuuagcugagaccugcuu

SEQ ID NO: 228288 - RNA, 22 nt, Human
gaggacccuuaggucagacaga

SEQ ID NO: 228289 - RNA, 22 nt, Human
gaggaaagcugguuuaaaguau

SEQ ID NO: 228290 - RNA, 22 nt, Human
gagcaggucuuugguaaugcuu

SEQ ID NO: 228291 - RNA, 22 nt, Human
gauuaaaggucuugauuauaag

SEQ ID NO: 228292 - RNA, 22 nt, Human
gauguuggugcauucacuucug

SEQ ID NO: 228293 - RNA, 22 nt, Human
gauuaagaaagauagaugugga

SEQ ID NO: 228294 - RNA, 22 nt, Human
gauuaucaccaaauggccuccu

SEQ ID NO: 228295 - RNA, 22 nt, Human
gagccaugagauaagagcaccu

SEQ ID NO: 228296 - RNA, 22 nt, Human
gagccgcagcugcguagggucc

SEQ ID NO: 228297 - RNA, 22 nt, Human
gagcccgugugugugugugugu

SEQ ID NO: 228298 - RNA, 22 nt, Human
gauucuaucauucuguauauua

SEQ ID NO: 228299 - RNA, 22 nt, Human
gauugauguaggugauaaaucu

SEQ ID NO: 228300 - RNA, 22 nt, Human
gauucugaaauuaacagacugg

SEQ ID NO: 228301 - RNA, 22 nt, Human
gauugggagugugacauuguau

SEQ ID NO: 228302 - RNA, 22 nt, Human
gauugcauaugcauucugauac

SEQ ID NO: 228303 - RNA, 22 nt, Human
gauugcugccagcguguccgug

SEQ ID NO: 228304 - RNA, 22 nt, Human
gagcgcacagaaggaagcagcc

SEQ ID NO: 228305 - RNA, 22 nt, Human
gagccggggcucccugaggucc

SEQ ID NO: 228306 - RNA, 19 nt, Human
gagccgcucccgcagccgg

SEQ ID NO: 228307 - RNA, 22 nt, Human
gauuucuucauuuaaaaauauu

SEQ ID NO: 228308 - RNA, 22 nt, Human
gauuugucuauauucaaauaug

SEQ ID NO: 228309 - RNA, 21 nt, Human
gauuuuagggcagccaaacac

SEQ ID NO: 228310 - RNA, 22 nt, Human
gauuuucauuauagcuaguuuc

SEQ ID NO: 228311 - RNA, 22 nt, Human
gauuuuaaaagauguauaaggu

SEQ ID NO: 228312 - RNA, 22 nt, Human
gauuuugaaccuuauuuggaaa

SEQ ID NO: 228313 - RNA, 22 nt, Human
gcaaaaacaguguagucuucug

SEQ ID NO: 228314 - RNA, 22 nt, Human
gaggaaaauggaguguaauuaa

SEQ ID NO: 228315 - RNA, 22 nt, Human
gcaacguauauggguaaggaua

SEQ ID NO: 228316 - RNA, 22 nt, Human
gagcuggagaaacacauaagaa

SEQ ID NO: 228317 - RNA, 22 nt, Human
gagcgugaggcagcuuucuaag

SEQ ID NO: 228318 - RNA, 22 nt, Human
gagcuaauagacagcaacauca

SEQ ID NO: 228319 - RNA, 22 nt, Human
gagcggcucaguggccauguga

SEQ ID NO: 228320 - RNA, 22 nt, Human
gagauggauuuuuuugccaguc

SEQ ID NO: 228321 - RNA, 22 nt, Human
gagauuaauuaaaaccuuuaug

SEQ ID NO: 228322 - RNA, 22 nt, Human
gagauuucauuugugaggcuca

SEQ ID NO: 228323 - RNA, 22 nt, Human
gagaguuggaggguauguuagu

SEQ ID NO: 228324 - RNA, 22 nt, Human
gagagucuuaaguuacagaacu

SEQ ID NO: 228325 - RNA, 22 nt, Human
gauggugauggcccuaagcuga

SEQ ID NO: 228326 - RNA, 22 nt, Human
gauggugcaauuaucgugcaug

SEQ ID NO: 228327 - RNA, 22 nt, Human
gaugggaaggugguaaaguuua

SEQ ID NO: 228328 - RNA, 22 nt, Human
gauggguugaguucauggagcc

SEQ ID NO: 228329 - RNA, 22 nt, Human
gauggggaaaaaauggaucuuu

SEQ ID NO: 228330 - RNA, 22 nt, Human
gagcacuucagcauaaaucaca

SEQ ID NO: 228331 - RNA, 22 nt, Human
gagcacugagcuggaauuggag

SEQ ID NO: 228332 - RNA, 22 nt, Human
gagcacauguggagagucuggg

SEQ ID NO: 228333 - RNA, 22 nt, Human
gaugguggaggaaucgcugaag

SEQ ID NO: 228334 - RNA, 22 nt, Human
gagcagcacagaccaaacagaa

SEQ ID NO: 228335 - RNA, 22 nt, Human
gagcagacugcacaguucuugc

SEQ ID NO: 228336 - RNA, 22 nt, Human
gagcagcaggccagguugcagg

SEQ ID NO: 228337 - RNA, 22 nt, Human
gagcagccugaggauucugcuc

SEQ ID NO: 228338 - RNA, 22 nt, Human
gaugucauguuggcagacaguu

SEQ ID NO: 228339 - RNA, 22 nt, Human
gauguaucugagcugcuuaggu

SEQ ID NO: 228340 - RNA, 22 nt, Human
gaugguuuuacauuuuaauguu

SEQ ID NO: 228341 - RNA, 22 nt, Human
gagaccaagcgugggugauaau

SEQ ID NO: 228342 - RNA, 22 nt, Human
gagacagugucagccauugaaa

SEQ ID NO: 228343 - RNA, 22 nt, Human
gaagauuauuacucauugcagg

SEQ ID NO: 228344 - RNA, 20 nt, Human
gagaauuccagguuucugug

SEQ ID NO: 228345 - RNA, 22 nt, Human
gagcccuguagcaagucauguc

SEQ ID NO: 228346 - RNA, 19 nt, Human
gagcaugacuggccuugca

SEQ ID NO: 228347 - RNA, 22 nt, Human
gagcaugacgcaacaccaagug

SEQ ID NO: 228348 - RNA, 22 nt, Human
gagacugcguggcucugacaca

SEQ ID NO: 228349 - RNA, 22 nt, Human
gagacucagccccugcucucaa

SEQ ID NO: 228350 - RNA, 22 nt, Human
gagagaaggaagugaauuuccc

SEQ ID NO: 228351 - RNA, 22 nt, Human
gagagagacugggaaaucauca

SEQ ID NO: 228352 - RNA, 22 nt, Human
gagacugugucugucaagcuag

SEQ ID NO: 228353 - RNA, 23 nt, Human
gaugauggcaacuacauccggug

SEQ ID NO: 228354 - RNA, 22 nt, Human
gaugauugaauaaauaugguca

SEQ ID NO: 228355 - RNA, 22 nt, Human
gaugauuuuguaacuggggaca

SEQ ID NO: 228356 - RNA, 22 nt, Human
gagaggaagugccugcucccag

SEQ ID NO: 228357 - RNA, 22 nt, Human
gagaggguugggaggcagcaga

SEQ ID NO: 228358 - RNA, 22 nt, Human
gagaggcugagcaguccggguu

SEQ ID NO: 228359 - RNA, 22 nt, Human
gaugauaacagcauuucaacug

SEQ ID NO: 228360 - RNA, 22 nt, Human
gaugcauccuuucugucuucuc

SEQ ID NO: 228361 - RNA, 22 nt, Human
gagagaggggaagagaagcucu

SEQ ID NO: 228362 - RNA, 22 nt, Human
gaugcuaauuaaugaagaggag

SEQ ID NO: 228363 - RNA, 22 nt, Human
gauggauuuuuuauuaaaucag

SEQ ID NO: 228364 - RNA, 22 nt, Human
gauggacgguuuuaccagacag

SEQ ID NO: 228365 - RNA, 22 nt, Human
gauuucauaaaacgagaaacuc

SEQ ID NO: 228366 - RNA, 22 nt, Human
gauuguagacauauuagacugc

SEQ ID NO: 228367 - RNA, 20 nt, Human
gauuuaacgcugcgucuguc

SEQ ID NO: 228368 - RNA, 22 nt, Human
gauuggucacacaauaguauau

SEQ ID NO: 228369 - RNA, 22 nt, Human
gccguuccuacucucucugugu

SEQ ID NO: 228370 - RNA, 22 nt, Human
gauugcaucaauauuuagagua

SEQ ID NO: 228371 - RNA, 22 nt, Human
gccggagagccaacaccacgga

SEQ ID NO: 228372 - RNA, 22 nt, Human
gccgggagaggcggcgcagggg

SEQ ID NO: 228373 - RNA, 22 nt, Human
gauugauuuaauaugagaggau

SEQ ID NO: 228374 - RNA, 22 nt, Human
gccgccgcucaccugggcgccg

SEQ ID NO: 228375 - RNA, 22 nt, Human
gccgcagauucugagacgugua

SEQ ID NO: 228376 - RNA, 22 nt, Human
gcccuuuuaucaacuccuagaa

SEQ ID NO: 228377 - RNA, 22 nt, Human
gaugguggggggcagcugggag

SEQ ID NO: 228378 - RNA, 22 nt, Human
gccugggguuugcggggcugca

SEQ ID NO: 228379 - RNA, 22 nt, Human
gccuucgauaugaggguuugcc

SEQ ID NO: 228380 - RNA, 22 nt, Human
gccuuuauauuacauuuggaag

SEQ ID NO: 228381 - RNA, 22 nt, Human
gccuucauuggaaucuagcuuc

SEQ ID NO: 228382 - RNA, 22 nt, Human
gcacucuguggagacaagauag

SEQ ID NO: 228383 - RNA, 23 nt, Human
gcacuguuugaggagcacugugc

SEQ ID NO: 228384 - RNA, 22 nt, Human
gccugagauuggacauuauuua

SEQ ID NO: 228385 - RNA, 22 nt, Human
gccugagucaagauguggcacc

SEQ ID NO: 228386 - RNA, 22 nt, Human
gcacagcuaugagcugaauugu

SEQ ID NO: 228387 - RNA, 22 nt, Human
gccugcaaagacuuccuucucu

SEQ ID NO: 228388 - RNA, 22 nt, Human
gccuggccaaucgccgucuagg

SEQ ID NO: 228389 - RNA, 22 nt, Human
gccuggaaugcaaugugacgaa

SEQ ID NO: 228390 - RNA, 22 nt, Human
gccuccggagucgcagugucuu

SEQ ID NO: 228391 - RNA, 22 nt, Human
gccuagaagaaugagcgcaggg

SEQ ID NO: 228392 - RNA, 22 nt, Human
gcaaaugacuuagucacuccag

SEQ ID NO: 228393 - RNA, 21 nt, Human
gcaaccagaccacagggcagu

SEQ ID NO: 228394 - RNA, 22 nt, Human
gcaacccugggucaugguugac

SEQ ID NO: 228395 - RNA, 22 nt, Human
gcaaagaauugauucauuuugc

SEQ ID NO: 228396 - RNA, 22 nt, Human
gcaacuccuaggcgaggccuuc

SEQ ID NO: 228397 - RNA, 22 nt, Human
gcacaaguccuccgacagcacg

SEQ ID NO: 228398 - RNA, 22 nt, Human
gcacacuguaugcugguauuug

SEQ ID NO: 228399 - RNA, 22 nt, Human
gagguuggagggcuggccugca

SEQ ID NO: 228400 - RNA, 22 nt, Human
gcagcccucuuggucacuaggc

SEQ ID NO: 228401 - RNA, 22 nt, Human
gcaggccgauuuguuagaaguc

SEQ ID NO: 228402 - RNA, 22 nt, Human
gaggugcaggggcccgggcugg

SEQ ID NO: 228403 - RNA, 22 nt, Human
gagguuauucuucuaucaguau

SEQ ID NO: 228404 - RNA, 22 nt, Human
gcaugcuguuuggaaacgauaa

SEQ ID NO: 228405 - RNA, 20 nt, Human
gcauggcuggcugcugucug

SEQ ID NO: 228406 - RNA, 22 nt, Human
gcauggaaaagggaugcuaacu

SEQ ID NO: 228407 - RNA, 22 nt, Human
gauaagugauucugauucacau

SEQ ID NO: 228408 - RNA, 22 nt, Human
gaguuucacguagaucaggguc

SEQ ID NO: 228409 - RNA, 22 nt, Human
gcauucuugucaguggggucag

SEQ ID NO: 228410 - RNA, 22 nt, Human
gcauugcuauuucuguuagugu

SEQ ID NO: 228411 - RNA, 22 nt, Human
gcauuagacuaguacacggcag

SEQ ID NO: 228412 - RNA, 22 nt, Human
gcaugguuuccugcaacguucu

SEQ ID NO: 228413 - RNA, 22 nt, Human
gcaugguuagacaucaauguga

SEQ ID NO: 228414 - RNA, 22 nt, Human
gauacuuuguggaauccuggau

SEQ ID NO: 228415 - RNA, 22 nt, Human
gauggcauucacaaacuuaacu

SEQ ID NO: 228416 - RNA, 22 nt, Human
gauggcaaugcuagaaauuuag

SEQ ID NO: 228417 - RNA, 22 nt, Human
gaugccggggucguagccgugg

SEQ ID NO: 228418 - RNA, 22 nt, Human
gccauguucuugaaucuggguc

SEQ ID NO: 228419 - RNA, 22 nt, Human
gcccagccucagggcaucagcu

SEQ ID NO: 228420 - RNA, 22 nt, Human
gcccagacaucuguugggaccu

SEQ ID NO: 228421 - RNA, 22 nt, Human
gcccguuuagcaaacgccuccu

SEQ ID NO: 228422 - RNA, 22 nt, Human
gauauggaaacuugauguugug

SEQ ID NO: 228423 - RNA, 22 nt, Human
gccaucuucggcagccgccugg

SEQ ID NO: 228424 - RNA, 22 nt, Human
gaugccuccaggaaagaggacg

SEQ ID NO: 228425 - RNA, 22 nt, Human
gaugcucuugauuggaccaggg

SEQ ID NO: 228426 - RNA, 22 nt, Human
gauauuuugugaaaaaacaacu

SEQ ID NO: 228427 - RNA, 19 nt, Human
gauauugagcugagaauuc

SEQ ID NO: 228428 - RNA, 22 nt, Human
gcauuucuguuuuuuuaaauga

SEQ ID NO: 228429 - RNA, 22 nt, Human
gcauuucauaaccagccaugcu

SEQ ID NO: 228430 - RNA, 22 nt, Human
gauauucauaggcagguauuua

SEQ ID NO: 228431 - RNA, 22 nt, Human
gcauuuuaauuggggcaguuag

SEQ ID NO: 228432 - RNA, 22 nt, Human
gaucauauccagucaccacuau

SEQ ID NO: 228433 - RNA, 22 nt, Human
gccaggugauuucaaaguccuu

SEQ ID NO: 228434 - RNA, 22 nt, Human
gccaguaaaguaucuccuuuug

SEQ ID NO: 228435 - RNA, 22 nt, Human
gaugauuccuuuguucauugug

SEQ ID NO: 228436 - RNA, 22 nt, Human
gcagccauggcuggccgggcau

SEQ ID NO: 228437 - RNA, 22 nt, Human
gcagccucugcaguucaggagg

SEQ ID NO: 228438 - RNA, 22 nt, Human
gcagccugaguuuagcucgucg

SEQ ID NO: 228439 - RNA, 22 nt, Human
gcggcaguccuuccaguacagg

SEQ ID NO: 228440 - RNA, 22 nt, Human
gcggacaauggaagaugucauu

SEQ ID NO: 228441 - RNA, 22 nt, Human
gcagccaugcacgucauuauga

SEQ ID NO: 228442 - RNA, 22 nt, Human
gcagccaauggcgagccccaca

SEQ ID NO: 228443 - RNA, 23 nt, Human
gcagccaacccacgugagagaag

SEQ ID NO: 228444 - RNA, 22 nt, Human
gcguagaagaaagcugcugcua

SEQ ID NO: 228445 - RNA, 22 nt, Human
gcguaccugaaauuacggcacu

SEQ ID NO: 228446 - RNA, 22 nt, Human
gcaggaaugguacauaccuguu

SEQ ID NO: 228447 - RNA, 22 nt, Human
gcaggacuucuguuuaaccagu

SEQ ID NO: 228448 - RNA, 22 nt, Human
gcaggacugauggagcauaugu

SEQ ID NO: 228449 - RNA, 22 nt, Human
gcggggggcucgggcagcucgg

SEQ ID NO: 228450 - RNA, 22 nt, Human
gcggucuaggaccucagugugu

SEQ ID NO: 228451 - RNA, 22 nt, Human
gcagcguuaacauuuuuccugu

SEQ ID NO: 228452 - RNA, 22 nt, Human
gcggcuggcuguccaaacuggg

SEQ ID NO: 228453 - RNA, 22 nt, Human
gcgugugugauaugccucugca

SEQ ID NO: 228454 - RNA, 22 nt, Human
gcguguauuccagaccuuaacg

SEQ ID NO: 228455 - RNA, 22 nt, Human
gcuaagcuuugagucuggacag

SEQ ID NO: 228456 - RNA, 22 nt, Human
gcuaagucaaaaaauucaaaau

SEQ ID NO: 228457 - RNA, 22 nt, Human
gcaguugguccagccucggcug

SEQ ID NO: 228458 - RNA, 19 nt, Human
gcaguuauggcccacuucc

SEQ ID NO: 228459 - RNA, 22 nt, Human
gcauaacaacagacucuguguu

SEQ ID NO: 228460 - RNA, 22 nt, Human
gcaguuguagcuguuucuacuc

SEQ ID NO: 228461 - RNA, 22 nt, Human
gcucgauugucaguguuaggga

SEQ ID NO: 228462 - RNA, 22 nt, Human
gcaucuguuguguuaauuuaca

SEQ ID NO: 228463 - RNA, 22 nt, Human
gcucccaguucccaaagugacc

SEQ ID NO: 228464 - RNA, 22 nt, Human
gcuccggggguuccagaucauc

SEQ ID NO: 228465 - RNA, 19 nt, Human
gcuccugcagcuagagugc

SEQ ID NO: 228466 - RNA, 22 nt, Human
gccagggcucgagcaggccagc

SEQ ID NO: 228467 - RNA, 22 nt, Human
gccaggcggcccaggagauggc

SEQ ID NO: 228468 - RNA, 22 nt, Human
gcugcuuacuauaggguuaacu

SEQ ID NO: 228469 - RNA, 22 nt, Human
gcugcuuagaaccauauuuaaa

SEQ ID NO: 228470 - RNA, 22 nt, Human
gcugcucaaaaaaacacuagcu

SEQ ID NO: 228471 - RNA, 22 nt, Human
gcugcuggcuuccugcuguuuu

SEQ ID NO: 228472 - RNA, 22 nt, Human
gccaucugcuuagauugcuggg

SEQ ID NO: 228473 - RNA, 22 nt, Human
gcuggcgauggccgagucuccg

SEQ ID NO: 228474 - RNA, 22 nt, Human
gcuggauuuaggguucccuccu

SEQ ID NO: 228475 - RNA, 22 nt, Human
gccauguuuugguaaauaccau

SEQ ID NO: 228476 - RNA, 22 nt, Human
gcccagaagguagcgaguaguc

SEQ ID NO: 228477 - RNA, 21 nt, Human
gcuggcugucucuuacacggu

SEQ ID NO: 228478 - RNA, 22 nt, Human
gcuggcggguuggggaggcgga

SEQ ID NO: 228479 - RNA, 22 nt, Human
gccaugguggggccucccugac

SEQ ID NO: 228480 - RNA, 22 nt, Human
gcugagaguguaggauguuuac

SEQ ID NO: 228481 - RNA, 22 nt, Human
gcugagcaaugcacugccgcau

SEQ ID NO: 228482 - RNA, 22 nt, Human
gcucuggcugccuuaguuuugu

SEQ ID NO: 228483 - RNA, 22 nt, Human
gcucuggcuacuguggcuaccg

SEQ ID NO: 228484 - RNA, 23 nt, Human
gcucugauaccagcuacaucuag

SEQ ID NO: 228485 - RNA, 23 nt, Human
gcauuugcaggaaacuggaaaag

SEQ ID NO: 228486 - RNA, 22 nt, Human
gcugauucuucugcuuuuucuc

SEQ ID NO: 228487 - RNA, 22 nt, Human
gcugagcagcgaaggcacaugc

SEQ ID NO: 228488 - RNA, 22 nt, Human
gcugccgcugcggggcgcgggc

SEQ ID NO: 228489 - RNA, 22 nt, Human
gcugcccauugcucucccacuc

SEQ ID NO: 228490 - RNA, 22 nt, Human
gcugcaggaggugguagggucu

SEQ ID NO: 228491 - RNA, 20 nt, Human
gccaccucugcucuuucccg

SEQ ID NO: 228492 - RNA, 22 nt, Human
gccaaucaggaggcuguacauc

SEQ ID NO: 228493 - RNA, 22 nt, Human
gccagcuuagaucccccagccc

SEQ ID NO: 228494 - RNA, 22 nt, Human
gccagccggugaguggaagcgg

SEQ ID NO: 228495 - RNA, 19 nt, Human
gccacguuggcuaguugcc

SEQ ID NO: 228496 - RNA, 23 nt, Human
gcugccguuucccaucgugguga

SEQ ID NO: 228497 - RNA, 22 nt, Human
gcugcgccgggagccggggccg

SEQ ID NO: 228498 - RNA, 22 nt, Human
gggucuggagauccgggugaag

SEQ ID NO: 228499 - RNA, 22 nt, Human
gggucagggaggccccaccaug

SEQ ID NO: 228500 - RNA, 22 nt, Human
ggagggaggggugggagaugga

SEQ ID NO: 228501 - RNA, 22 nt, Human
ggaggcggaaguccaagcaggu

SEQ ID NO: 228502 - RNA, 22 nt, Human
ggguauuugacaaacugacacu

SEQ ID NO: 228503 - RNA, 21 nt, Human
gggguuuuguucuuauaaugu

SEQ ID NO: 228504 - RNA, 22 nt, Human
ggagggagugcaggcaggcaga

SEQ ID NO: 228505 - RNA, 22 nt, Human
ggaguucacagcaauggaacag

SEQ ID NO: 228506 - RNA, 19 nt, Human
ggaguugccaggagaagga

SEQ ID NO: 228507 - RNA, 22 nt, Human
ggauaaaugaaggcauacagau

SEQ ID NO: 228508 - RNA, 22 nt, Human
gggugguggagguuugacagac

SEQ ID NO: 228509 - RNA, 22 nt, Human
gggugguuccuggaucugacug

SEQ ID NO: 228510 - RNA, 22 nt, Human
gggucauugcgugacgcgagca

SEQ ID NO: 228511 - RNA, 22 nt, Human
ggaguucaaaucuggaccuugc

SEQ ID NO: 228512 - RNA, 22 nt, Human
ggggcggggagcaugagcuggg

SEQ ID NO: 228513 - RNA, 22 nt, Human
ggggcggcgugggcgcggugau

SEQ ID NO: 228514 - RNA, 22 nt, Human
ggggccaugauggacgagguga

SEQ ID NO: 228515 - RNA, 22 nt, Human
ggggugagaguguuuuaaagca

SEQ ID NO: 228516 - RNA, 22 nt, Human
ggagaucuuggacuggccggcc

SEQ ID NO: 228517 - RNA, 22 nt, Human
ggaggaagagaccagggggcuu

SEQ ID NO: 228518 - RNA, 17 nt, Human
ggggcguguauuugaug

SEQ ID NO: 228519 - RNA, 22 nt, Human
gggggggcagguuggaugucag

SEQ ID NO: 228520 - RNA, 18 nt, Human
ggagaagaacagaugugg

SEQ ID NO: 228521 - RNA, 22 nt, Human
ggacuuuggauuuuauucuaaa

SEQ ID NO: 228522 - RNA, 22 nt, Human
ggggaaauauuucugaccugug

SEQ ID NO: 228523 - RNA, 22 nt, Human
ggggaaggaaggggagggcacg

SEQ ID NO: 228524 - RNA, 22 nt, Human
gggcugagagcuggaaucugag

SEQ ID NO: 228525 - RNA, 22 nt, Human
gggcugcuccgcccgcugcgcc

SEQ ID NO: 228526 - RNA, 22 nt, Human
ggacauuguuguuggauccuug

SEQ ID NO: 228527 - RNA, 22 nt, Human
ggggaauuaaaugagaagccuu

SEQ ID NO: 228528 - RNA, 22 nt, Human
ggggacggcuggccggggcccc

SEQ ID NO: 228529 - RNA, 22 nt, Human
ggggaggugugcaggacaccuc

SEQ ID NO: 228530 - RNA, 22 nt, Human
ggggagaugauaagugcauuug

SEQ ID NO: 228531 - RNA, 23 nt, Human
ggagaaggaugucaucaaaagac

SEQ ID NO: 228532 - RNA, 22 nt, Human
ggagaagaggagcuggaagccu

SEQ ID NO: 228533 - RNA, 22 nt, Human
ggggaauaaacacuuugucacu

SEQ ID NO: 228534 - RNA, 22 nt, Human
ggagagcguggaugggcuucca

SEQ ID NO: 228535 - RNA, 22 nt, Human
ggagaccaauuaaugaaggaau

SEQ ID NO: 228536 - RNA, 22 nt, Human
ggagacuaagaaaauagagucc

SEQ ID NO: 228537 - RNA, 22 nt, Human
ggggauuucccaaugcgaagca

SEQ ID NO: 228538 - RNA, 22 nt, Human
gggcgcaagcaugugucugggu

SEQ ID NO: 228539 - RNA, 18 nt, Human
ggaaggugcuggagugca

SEQ ID NO: 228540 - RNA, 20 nt, Human
ggaaguauccacaaauuccu

SEQ ID NO: 228541 - RNA, 22 nt, Human
ggaagguauuucuccuugagug

SEQ ID NO: 228542 - RNA, 22 nt, Human
gggcaggggcagugguggcauu

SEQ ID NO: 228543 - RNA, 22 nt, Human
ggaaagagaaacaugaacuaga

SEQ ID NO: 228544 - RNA, 21 nt, Human
gggagugucuguugcaaggug

SEQ ID NO: 228545 - RNA, 22 nt, Human
gggcaggcuggguggugguccc

SEQ ID NO: 228546 - RNA, 22 nt, Human
gggcaugugauggacgugugcc

SEQ ID NO: 228547 - RNA, 22 nt, Human
gggcaguuucaugugguucaac

SEQ ID NO: 228548 - RNA, 17 nt, Human
ggaagaaaaggaucauc

SEQ ID NO: 228549 - RNA, 22 nt, Human
gggcggccugcucuguggggag

SEQ ID NO: 228550 - RNA, 22 nt, Human
gggcggcguccucagucgggug

SEQ ID NO: 228551 - RNA, 22 nt, Human
gggcggggcucacggugcggca

SEQ ID NO: 228552 - RNA, 22 nt, Human
gggcggggggagcuggaaugaa

SEQ ID NO: 228553 - RNA, 22 nt, Human
gggcgcuuucugggucagggcu

SEQ ID NO: 228554 - RNA, 20 nt, Human
gggcucugcauccaucagcc

SEQ ID NO: 228555 - RNA, 22 nt, Human
gggcucaaccauagcacaaaga

SEQ ID NO: 228556 - RNA, 23 nt, Human
ggaauuucagaugugaaauaaaa

SEQ ID NO: 228557 - RNA, 22 nt, Human
gcuuuucaaguuacaauuagcu

SEQ ID NO: 228558 - RNA, 22 nt, Human
gcuuuguugauggugagucugu

SEQ ID NO: 228559 - RNA, 22 nt, Human
gggagggaggagccccggccau

SEQ ID NO: 228560 - RNA, 22 nt, Human
gggaggaagaguaggaauuuga

SEQ ID NO: 228561 - RNA, 22 nt, Human
gcuuuucucccugcuuucuucc

SEQ ID NO: 228562 - RNA, 22 nt, Human
gggagcuggagcuggaagacuc

SEQ ID NO: 228563 - RNA, 22 nt, Human
gcuguggacacagcucucuuca

SEQ ID NO: 228564 - RNA, 22 nt, Human
gcuguggcuccaauggugagcc

SEQ ID NO: 228565 - RNA, 22 nt, Human
gcuguggagaagcugccuaugg

SEQ ID NO: 228566 - RNA, 22 nt, Human
ggcuuccuggugcagaguuaua

SEQ ID NO: 228567 - RNA, 22 nt, Human
gcuuuggcuucuccuggcagga

SEQ ID NO: 228568 - RNA, 22 nt, Human
gcuuuguucauuuaguuuuuuu

SEQ ID NO: 228569 - RNA, 22 nt, Human
gggauguuuugcaggcaaagaa

SEQ ID NO: 228570 - RNA, 19 nt, Human
gggauuccuggcuuuagaa

SEQ ID NO: 228571 - RNA, 22 nt, Human
gggauuaaaaaucaccaaagua

SEQ ID NO: 228572 - RNA, 22 nt, Human
gggauguauguuuguguggaga

SEQ ID NO: 228573 - RNA, 22 nt, Human
ggaaaagccauauuauaggcaa

SEQ ID NO: 228574 - RNA, 22 nt, Human
gggagggcuuggacccagaugu

SEQ ID NO: 228575 - RNA, 22 nt, Human
ggaaagaggacaucuuacuucu

SEQ ID NO: 228576 - RNA, 22 nt, Human
ggaaaaugcugaagcaucugaa

SEQ ID NO: 228577 - RNA, 22 nt, Human
gggauuuaaugggaaaaauaug

SEQ ID NO: 228578 - RNA, 22 nt, Human
gggcacggaaggcgccaggggu

SEQ ID NO: 228579 - RNA, 20 nt, Human
ggccugagcauggcuggcag

SEQ ID NO: 228580 - RNA, 18 nt, Human
ggccucagccuggccgga

SEQ ID NO: 228581 - RNA, 22 nt, Human
ggccuggccuccugcuuuucca

SEQ ID NO: 228582 - RNA, 22 nt, Human
ggccuucuuuucaugucuuucg

SEQ ID NO: 228583 - RNA, 22 nt, Human
ggccugcucuggcuguggucag

SEQ ID NO: 228584 - RNA, 22 nt, Human
ggccgccacuuuccagugcugc

SEQ ID NO: 228585 - RNA, 22 nt, Human
ggccgggcaugcgagcugagcg

SEQ ID NO: 228586 - RNA, 22 nt, Human
guagagcagaaacauggagaaa

SEQ ID NO: 228587 - RNA, 22 nt, Human
guagauaauuuuggaaagcugg

SEQ ID NO: 228588 - RNA, 22 nt, Human
guacuugauucauuauugcauu

SEQ ID NO: 228589 - RNA, 22 nt, Human
guacugggaauggagccugggc

SEQ ID NO: 228590 - RNA, 22 nt, Human
guacugguuuucuuacucuggc

SEQ ID NO: 228591 - RNA, 22 nt, Human
guaggugggcuuccaagguccu

SEQ ID NO: 228592 - RNA, 22 nt, Human
guagcaugauuuuaaaauccug

SEQ ID NO: 228593 - RNA, 22 nt, Human
guagaucaugaaaauucacugc

SEQ ID NO: 228594 - RNA, 22 nt, Human
guaggggccagaaagacuuaga

SEQ ID NO: 228595 - RNA, 22 nt, Human
guaaacugaauuggauacugug

SEQ ID NO: 228596 - RNA, 22 nt, Human
guaaauaucucacgaaugauuc

SEQ ID NO: 228597 - RNA, 22 nt, Human
gguuuuuggcucaauauuuugg

SEQ ID NO: 228598 - RNA, 22 nt, Human
guaagaauauacccaggaguca

SEQ ID NO: 228599 - RNA, 22 nt, Human
guaaauuaugucugggucaguu

SEQ ID NO: 228600 - RNA, 22 nt, Human
guacauauggcacaugcuauuu

SEQ ID NO: 228601 - RNA, 22 nt, Human
guaauugcucauauggcaccug

SEQ ID NO: 228602 - RNA, 22 nt, Human
guaaugcuuuuauuucggggaa

SEQ ID NO: 228603 - RNA, 22 nt, Human
guaaccacuaugguuauugauu

SEQ ID NO: 228604 - RNA, 22 nt, Human
guaaggcaggagucuuaaaccu

SEQ ID NO: 228605 - RNA, 22 nt, Human
ggcccuggggcaggagcagagg

SEQ ID NO: 228606 - RNA, 22 nt, Human
gguuuucagaaugcaguccugu

SEQ ID NO: 228607 - RNA, 22 nt, Human
gguugauuuuuaugaagccaug

SEQ ID NO: 228608 - RNA, 22 nt, Human
gguguagggaaacuugacuaau

SEQ ID NO: 228609 - RNA, 22 nt, Human
ggugucagccacuuugucggag

SEQ ID NO: 228610 - RNA, 22 nt, Human
gguucuggaaaagaaagcaaag

SEQ ID NO: 228611 - RNA, 22 nt, Human
gguuccagacaguuauaugggc

SEQ ID NO: 228612 - RNA, 22 nt, Human
ggccagcgugggggaguagcgg

SEQ ID NO: 228613 - RNA, 22 nt, Human
ggucugauaccugcagguuguc

SEQ ID NO: 228614 - RNA, 22 nt, Human
ggucugcgauggcaagggucuu

SEQ ID NO: 228615 - RNA, 22 nt, Human
ggucugagcaaguuaccauggg

SEQ ID NO: 228616 - RNA, 22 nt, Human
ggucuuauaauuaauuuaggcu

SEQ ID NO: 228617 - RNA, 22 nt, Human
ggucgagcagcacccguucggc

SEQ ID NO: 228618 - RNA, 22 nt, Human
ggcaccuuucaucccaucuaga

SEQ ID NO: 228619 - RNA, 22 nt, Human
gggugugcuaaaccuacgcaca

SEQ ID NO: 228620 - RNA, 22 nt, Human
ggguguggaggugacacauuug

SEQ ID NO: 228621 - RNA, 22 nt, Human
ggauaauguauuuuaaaauggg

SEQ ID NO: 228622 - RNA, 19 nt, Human
ggauaagguuggagugauc

SEQ ID NO: 228623 - RNA, 22 nt, Human
ggguguuaugccucugagucag

SEQ ID NO: 228624 - RNA, 22 nt, Human
gguaauguucugaugaauuugu

SEQ ID NO: 228625 - RNA, 22 nt, Human
gguaccuggcccuggggcugcu

SEQ ID NO: 228626 - RNA, 22 nt, Human
ggauugaagggaaccucagaau

SEQ ID NO: 228627 - RNA, 22 nt, Human
ggauggugauguacccagucau

SEQ ID NO: 228628 - RNA, 22 nt, Human
ggauuucuucucauaacugaga

SEQ ID NO: 228629 - RNA, 22 nt, Human
gguagggggaggagaagaaaaa

SEQ ID NO: 228630 - RNA, 23 nt, Human
gguagguggggagauuaaagucu

SEQ ID NO: 228631 - RNA, 19 nt, Human
ggugaucugucccuugcuc

SEQ ID NO: 228632 - RNA, 22 nt, Human
ggugaucucuggcucugcuugu

SEQ ID NO: 228633 - RNA, 22 nt, Human
ggugcaauaaaguuguagaacc

SEQ ID NO: 228634 - RNA, 22 nt, Human
ggugcagucuggggcacauuau

SEQ ID NO: 228635 - RNA, 22 nt, Human
ggugccugggcacggaaagcau

SEQ ID NO: 228636 - RNA, 22 nt, Human
ggcagggaauucagagggaagg

SEQ ID NO: 228637 - RNA, 22 nt, Human
ggcaggaaguaaggaugcuaca

SEQ ID NO: 228638 - RNA, 22 nt, Human
ggcagggacugggauauggaga

SEQ ID NO: 228639 - RNA, 22 nt, Human
ggcagguccugaguccugaggc

SEQ ID NO: 228640 - RNA, 22 nt, Human
ggugguucagugguuagggcca

SEQ ID NO: 228641 - RNA, 22 nt, Human
gguguaaucacaagcuggaauu

SEQ ID NO: 228642 - RNA, 22 nt, Human
gguggucaggagcgcccguugg

SEQ ID NO: 228643 - RNA, 19 nt, Human
ggugggacaggugagauau

SEQ ID NO: 228644 - RNA, 22 nt, Human
ggugggaauccaggccuucauc

SEQ ID NO: 228645 - RNA, 22 nt, Human
gguggcuucuguuugcaagagg

SEQ ID NO: 228646 - RNA, 22 nt, Human
ggcagguggcacugcugcuccc

SEQ ID NO: 228647 - RNA, 22 nt, Human
ggcagucaucacuuauucauca

SEQ ID NO: 228648 - RNA, 22 nt, Human
gcugggagucgcgucuguggcc

SEQ ID NO: 228649 - RNA, 22 nt, Human
ggcuggaacuucuucuggcauu

SEQ ID NO: 228650 - RNA, 22 nt, Human
gcuggccugcgagggcaggcug

SEQ ID NO: 228651 - RNA, 21 nt, Human
ggcugcucgugaugaacuuca

SEQ ID NO: 228652 - RNA, 17 nt, Human
ggcugccaggcaacaua

SEQ ID NO: 228653 - RNA, 22 nt, Human
ggcugcagggaacaggaugggu

SEQ ID NO: 228654 - RNA, 22 nt, Human
ggcugcuugauagauaugagua

SEQ ID NO: 228655 - RNA, 22 nt, Human
ggcugcugcccaccccugcaug

SEQ ID NO: 228656 - RNA, 22 nt, Human
ggcugcuggaguugggucucuc

SEQ ID NO: 228657 - RNA, 22 nt, Human
ggcugaugacgccugagucuga

SEQ ID NO: 228658 - RNA, 22 nt, Human
gcuggaugucugugccaggcac

SEQ ID NO: 228659 - RNA, 22 nt, Human
gcuggauaaggaucaguuucuu

SEQ ID NO: 228660 - RNA, 22 nt, Human
gcugcuucgcugcacacccgag

SEQ ID NO: 228661 - RNA, 22 nt, Human
ggcucuccacuauggaugagaa

SEQ ID NO: 228662 - RNA, 22 nt, Human
gcuggaagggccagcuuucagg

SEQ ID NO: 228663 - RNA, 22 nt, Human
gcuggaaauaacuuguguagaa

SEQ ID NO: 228664 - RNA, 22 nt, Human
ggcuccugggcgucuucgaaca

SEQ ID NO: 228665 - RNA, 22 nt, Human
ggcuccucaggcugggguaagg

SEQ ID NO: 228666 - RNA, 22 nt, Human
gcuguauaucuuuugaagugau

SEQ ID NO: 228667 - RNA, 18 nt, Human
gcuguccgguagcuggug

SEQ ID NO: 228668 - RNA, 22 nt, Human
gcugugacaagaggcugcuucu

SEQ ID NO: 228669 - RNA, 22 nt, Human
gcuguccugggaacaggcacua

SEQ ID NO: 228670 - RNA, 22 nt, Human
gcuguaacuuuuucauuuucaa

SEQ ID NO: 228671 - RNA, 21 nt, Human
gcuguagauucacaaagaggu

SEQ ID NO: 228672 - RNA, 22 nt, Human
ggcuuaguagggacagaugcac

SEQ ID NO: 228673 - RNA, 22 nt, Human
gcugucccccaaagaugcuccu

SEQ ID NO: 228674 - RNA, 22 nt, Human
ggcugugguggacgcgggaaac

SEQ ID NO: 228675 - RNA, 22 nt, Human
ggcugugggguccuguggugug

SEQ ID NO: 228676 - RNA, 22 nt, Human
ggcuuauauguauucccagaga

SEQ ID NO: 228677 - RNA, 21 nt, Human
ggcuguuaauagugauuagaa

SEQ ID NO: 228678 - RNA, 20 nt, Human
gcugugccaugacccucgag

SEQ ID NO: 228679 - RNA, 22 nt, Human
gcuggggaucgaaggcagagcc

SEQ ID NO: 228680 - RNA, 19 nt, Human
gcugggauaggauguauuu

SEQ ID NO: 228681 - RNA, 22 nt, Human
gcugggccucuuacuucuuacg

SEQ ID NO: 228682 - RNA, 22 nt, Human
gcuggguuguucuccuggucca

SEQ ID NO: 228683 - RNA, 22 nt, Human
gcuggugugagauucucgaggg

SEQ ID NO: 228684 - RNA, 22 nt, Human
gcugguggcagagcuccgcggc

SEQ ID NO: 228685 - RNA, 22 nt, Human
gcugguuacuucauuagguccu

SEQ ID NO: 228686 - RNA, 22 nt, Human
ggcuggacuuucugcugggcuc

SEQ ID NO: 228687 - RNA, 22 nt, Human
ggcugggaggcggaggcugaga

SEQ ID NO: 228688 - RNA, 22 nt, Human
ggcuggggccuguugaagaugc

SEQ ID NO: 228689 - RNA, 22 nt, Human
ggcugugaaguacguugaaggu

SEQ ID NO: 228690 - RNA, 22 nt, Human
ggcugguggcgggcagcacaga

SEQ ID NO: 228691 - RNA, 22 nt, Human
gcugcgcgcagccggcgccgag

SEQ ID NO: 228692 - RNA, 22 nt, Human
gcugcgcugggacgccaccaac

SEQ ID NO: 228693 - RNA, 22 nt, Human
gcugcuacagagcuggaggggg

SEQ ID NO: 228694 - RNA, 22 nt, Human
ggcgauuggccgggaggaggca

SEQ ID NO: 228695 - RNA, 22 nt, Human
gcugcuggcggagcuggcgcug

SEQ ID NO: 228696 - RNA, 22 nt, Human
gcugccuugaacuuggccuggg

SEQ ID NO: 228697 - RNA, 22 nt, Human
ggccuugggauguggcugcagc

SEQ ID NO: 228698 - RNA, 22 nt, Human
ggcuaagcaguaaaugggguua

SEQ ID NO: 228699 - RNA, 22 nt, Human
ggcuagggagacagagggcaug

SEQ ID NO: 228700 - RNA, 22 nt, Human
ggcgggggagccaggaacccag

SEQ ID NO: 228701 - RNA, 22 nt, Human
ggcggcugcuccuugcccucgg

SEQ ID NO: 228702 - RNA, 22 nt, Human
ggcggugcgaggaugcagggcu

SEQ ID NO: 228703 - RNA, 22 nt, Human
ggcgggucuagggcccuggagu

SEQ ID NO: 228704 - RNA, 22 nt, Human
ggccuggcacauaguaggcagu

SEQ ID NO: 228705 - RNA, 22 nt, Human
ggccugcuaccagcugugaccu

SEQ ID NO: 228706 - RNA, 22 nt, Human
ggccgggugggaggcagcggag

SEQ ID NO: 228707 - RNA, 22 nt, Human
ggccuccaucuuaucuuacucu

SEQ ID NO: 228708 - RNA, 22 nt, Human
ggccugagaagcaaggacacaa

SEQ ID NO: 228709 - RNA, 22 nt, Human
ggcccugcuuccccaguguaca

SEQ ID NO: 228710 - RNA, 22 nt, Human
ggccgccacacagauucccccg

SEQ ID NO: 228711 - RNA, 22 nt, Human
ggccgcuuucuggggagugagg

SEQ ID NO: 228712 - RNA, 22 nt, Human
ggccgccgcuuagcugagcccc

SEQ ID NO: 228713 - RNA, 22 nt, Human
ggcccgcgcugcuggcgcgcca

SEQ ID NO: 228714 - RNA, 22 nt, Human
ggccccagggauuaggccaacc

SEQ ID NO: 228715 - RNA, 22 nt, Human
ggccccggaggccguuagcuua

SEQ ID NO: 228716 - RNA, 22 nt, Human
ggccaguauacaaacuuccggu

SEQ ID NO: 228717 - RNA, 22 nt, Human
ggccagcuuugagcugcaggaa

SEQ ID NO: 228718 - RNA, 22 nt, Human
gcugcccucccagggcaagcuu

SEQ ID NO: 228719 - RNA, 22 nt, Human
gcugcacgguccuggcaccacg

SEQ ID NO: 228720 - RNA, 22 nt, Human
gcugcagggagcuggaaggcuc

SEQ ID NO: 228721 - RNA, 23 nt, Human
gcugcagugaauguuguuguugu

SEQ ID NO: 228722 - RNA, 18 nt, Human
gcugaaauucuaaacaaa

SEQ ID NO: 228723 - RNA, 22 nt, Human
gcugacuauaaggcugcucugu

SEQ ID NO: 228724 - RNA, 21 nt, Human
gcucccgaagugcucggcguu

SEQ ID NO: 228725 - RNA, 22 nt, Human
gcucugcuccaucuguuuccuc

SEQ ID NO: 228726 - RNA, 22 nt, Human
gcgguguuuuaacacucccucg

SEQ ID NO: 228727 - RNA, 22 nt, Human
gcggguggaggagggacgggca

SEQ ID NO: 228728 - RNA, 22 nt, Human
gcgguuauggcagagauuacag

SEQ ID NO: 228729 - RNA, 22 nt, Human
gcgguggcuacuaaaguucgaa

SEQ ID NO: 228730 - RNA, 22 nt, Human
gcgggugagauucgagagaugg

SEQ ID NO: 228731 - RNA, 22 nt, Human
gcuacaaaaccagggcaaagga

SEQ ID NO: 228732 - RNA, 22 nt, Human
ggcagcuuucaauaggguuaug

SEQ ID NO: 228733 - RNA, 22 nt, Human
ggcagagguagcuggaaccagg

SEQ ID NO: 228734 - RNA, 22 nt, Human
gcgggcuuggcuccagggccca

SEQ ID NO: 228735 - RNA, 22 nt, Human
ggcagauaaacaauguuguaua

SEQ ID NO: 228736 - RNA, 22 nt, Human
gcggggcucuacuuggccugga

SEQ ID NO: 228737 - RNA, 22 nt, Human
ggcagaggaagcuggaaguggg

SEQ ID NO: 228738 - RNA, 22 nt, Human
ggcagagcugugcgcccaccca

SEQ ID NO: 228739 - RNA, 22 nt, Human
gcuacaacugugucuguggggc

SEQ ID NO: 228740 - RNA, 22 nt, Human
gcuacaaauaaaaugggugacu

SEQ ID NO: 228741 - RNA, 22 nt, Human
gcuauuggcuaauuguugcaac

SEQ ID NO: 228742 - RNA, 22 nt, Human
ggcaggauggagcagggcuaaa

SEQ ID NO: 228743 - RNA, 22 nt, Human
gcuauuuagaaaggcuuggaga

SEQ ID NO: 228744 - RNA, 22 nt, Human
gcucccagcuuuuguccacggc

SEQ ID NO: 228745 - RNA, 22 nt, Human
gcucaugggcccagagcagccc

SEQ ID NO: 228746 - RNA, 22 nt, Human
gcucagccuuuuguucuauuca

SEQ ID NO: 228747 - RNA, 22 nt, Human
ggcagggagagcaugcugauaa

SEQ ID NO: 228748 - RNA, 20 nt, Human
gcucaguggagaaaugcacc

SEQ ID NO: 228749 - RNA, 22 nt, Human
ggcagggagagcgccgccaugc

SEQ ID NO: 228750 - RNA, 22 nt, Human
ggaugcugcuccacaucccaca

SEQ ID NO: 228751 - RNA, 22 nt, Human
ggauccuucagcacugaggugu

SEQ ID NO: 228752 - RNA, 22 nt, Human
ggaugauacuuggagaaauauu

SEQ ID NO: 228753 - RNA, 22 nt, Human
ggaugauuuucaguuguguggg

SEQ ID NO: 228754 - RNA, 20 nt, Human
ggagcgggcauuuguguucc

SEQ ID NO: 228755 - RNA, 22 nt, Human
ggaucccaucgagcuggcuguc

SEQ ID NO: 228756 - RNA, 22 nt, Human
ggaucgauuccaaauguagauc

SEQ ID NO: 228757 - RNA, 22 nt, Human
gcgggccggcaggggaggaguu

SEQ ID NO: 228758 - RNA, 22 nt, Human
gcggcgucccagcuccgacggc

SEQ ID NO: 228759 - RNA, 19 nt, Human
gcggcggugccggcuggga

SEQ ID NO: 228760 - RNA, 22 nt, Human
ggcaaagaguacaucguccugg

SEQ ID NO: 228761 - RNA, 22 nt, Human
ggauuugaugagacuaucuacu

SEQ ID NO: 228762 - RNA, 22 nt, Human
gcggaucuccuugagugggcaa

SEQ ID NO: 228763 - RNA, 22 nt, Human
gcggcggcggaggcgggggcag

SEQ ID NO: 228764 - RNA, 22 nt, Human
ggaugggcuuggggaggucuag

SEQ ID NO: 228765 - RNA, 20 nt, Human
ggauugaacuauuucucagc

SEQ ID NO: 228766 - RNA, 22 nt, Human
gcgcagugagguuaagaaugca

SEQ ID NO: 228767 - RNA, 20 nt, Human
gcgcaguuccgggcgcgucu

SEQ ID NO: 228768 - RNA, 22 nt, Human
gcgcgccugccucccgcggugc

SEQ ID NO: 228769 - RNA, 22 nt, Human
ggagagcuagugagcuggaggu

SEQ ID NO: 228770 - RNA, 22 nt, Human
ggagaggaaguuuaaagaauug

SEQ ID NO: 228771 - RNA, 22 nt, Human
ggagauaugugaaaaagacagc

SEQ ID NO: 228772 - RNA, 22 nt, Human
ggagaugucugugccacgucuc

SEQ ID NO: 228773 - RNA, 19 nt, Human
ggagcagauaaacauacuu

SEQ ID NO: 228774 - RNA, 22 nt, Human
ggagcagaggaaagaguagcau

SEQ ID NO: 228775 - RNA, 22 nt, Human
ggagaugaaugugguaaaacug

SEQ ID NO: 228776 - RNA, 22 nt, Human
ggagaugacaucccagcccggc

SEQ ID NO: 228777 - RNA, 22 nt, Human
ggaauugagcaagggguggggc

SEQ ID NO: 228778 - RNA, 22 nt, Human
gccuucccuccucugcucucag

SEQ ID NO: 228779 - RNA, 22 nt, Human
ggacaauuguacucgauuucaa

SEQ ID NO: 228780 - RNA, 22 nt, Human
ggaccagagcuaaugcgcgccc

SEQ ID NO: 228781 - RNA, 22 nt, Human
ggacggcuagcagcagaauuca

SEQ ID NO: 228782 - RNA, 23 nt, Human
ggacgugaggcgcccuuuuuccc

SEQ ID NO: 228783 - RNA, 22 nt, Human
gcgcacaaccccguggcgguga

SEQ ID NO: 228784 - RNA, 22 nt, Human
gcgauugguuuggggccagagu

SEQ ID NO: 228785 - RNA, 22 nt, Human
ggaaguggauucagggcugcua

SEQ ID NO: 228786 - RNA, 22 nt, Human
ggaagugagcucauuacuuuag

SEQ ID NO: 228787 - RNA, 22 nt, Human
ggaaggggagcuggaaagggua

SEQ ID NO: 228788 - RNA, 22 nt, Human
ggaaggugagugcugugugauu

SEQ ID NO: 228789 - RNA, 22 nt, Human
gccugcuugaaagcacuuucug

SEQ ID NO: 228790 - RNA, 22 nt, Human
gccuggcagggagauuguaaga

SEQ ID NO: 228791 - RNA, 22 nt, Human
gccugcugggcucuuccugcug

SEQ ID NO: 228792 - RNA, 21 nt, Human
gccugcuguucacccugccac

SEQ ID NO: 228793 - RNA, 22 nt, Human
gcuggguaguucuuguuuggga

SEQ ID NO: 228794 - RNA, 22 nt, Human
gcugggucucucccugguccug

SEQ ID NO: 228795 - RNA, 22 nt, Human
gcugggacacacagucuucuuu

SEQ ID NO: 228796 - RNA, 23 nt, Human
gcccagaggccccuggccugagc

SEQ ID NO: 228797 - RNA, 22 nt, Human
gcugggagaggcagcuuucgga

SEQ ID NO: 228798 - RNA, 22 nt, Human
ggaagccugggcgcaggcaggg

SEQ ID NO: 228799 - RNA, 22 nt, Human
ggaagcuguugugagugcagca

SEQ ID NO: 228800 - RNA, 22 nt, Human
gcuggucuggcaauccucaugg

SEQ ID NO: 228801 - RNA, 22 nt, Human
ggaagauagaaguucaaaaguu

SEQ ID NO: 228802 - RNA, 22 nt, Human
guguuuauguuuuugcuaggga

SEQ ID NO: 228803 - RNA, 23 nt, Human
guguuguugauuuucgaaucuuu

SEQ ID NO: 228804 - RNA, 21 nt, Human
guguugugagguugguguuag

SEQ ID NO: 228805 - RNA, 22 nt, Human
guguuucccuggcacaagaacc

SEQ ID NO: 228806 - RNA, 22 nt, Human
ggggaggguuuggaugagaguc

SEQ ID NO: 228807 - RNA, 22 nt, Human
guguuggugagcucauuuccac

SEQ ID NO: 228808 - RNA, 22 nt, Human
ggggaagugguggggcuccgag

SEQ ID NO: 228809 - RNA, 22 nt, Human
guguugaugugucuguauucua

SEQ ID NO: 228810 - RNA, 22 nt, Human
ggggaagagagaagaaugaucu

SEQ ID NO: 228811 - RNA, 22 nt, Human
ggggauuuuucuuacucuuagg

SEQ ID NO: 228812 - RNA, 22 nt, Human
ggggcaucguugauugcauggu

SEQ ID NO: 228813 - RNA, 22 nt, Human
ggggcgaguguggaccgcagcc

SEQ ID NO: 228814 - RNA, 22 nt, Human
ggggccgggccggcagacuggg

SEQ ID NO: 228815 - RNA, 22 nt, Human
guuacagagcugcuaugugugc

SEQ ID NO: 228816 - RNA, 22 nt, Human
guuaaaggaagccauauguucg

SEQ ID NO: 228817 - RNA, 22 nt, Human
guuauuaaauauuuuggugauu

SEQ ID NO: 228818 - RNA, 22 nt, Human
guuauugggagagggaauggga

SEQ ID NO: 228819 - RNA, 22 nt, Human
ggggugaggcagggcagggguc

SEQ ID NO: 228820 - RNA, 22 nt, Human
ggggugugcugggagaagggau

SEQ ID NO: 228821 - RNA, 22 nt, Human
guuauuguuauugcguugucga

SEQ ID NO: 228822 - RNA, 22 nt, Human
guuaguucccaccccuguaaga

SEQ ID NO: 228823 - RNA, 22 nt, Human
ggggucugaucccuucuggcuu

SEQ ID NO: 228824 - RNA, 18 nt, Human
guucaagcauuuugcucu

SEQ ID NO: 228825 - RNA, 22 nt, Human
guucaaccaugauuaggaacug

SEQ ID NO: 228826 - RNA, 22 nt, Human
ggguacaccaauggaugccagg

SEQ ID NO: 228827 - RNA, 22 nt, Human
gggguugauaauuagagaaaug

SEQ ID NO: 228828 - RNA, 22 nt, Human
gggggcagguuccaggccagcu

SEQ ID NO: 228829 - RNA, 22 nt, Human
gggggcugugugcccgcucccc

SEQ ID NO: 228830 - RNA, 22 nt, Human
gggggcgccgccgcucaucuca

SEQ ID NO: 228831 - RNA, 22 nt, Human
guuaggcagugugguauagcag

SEQ ID NO: 228832 - RNA, 22 nt, Human
gggguauuugguagacauuuug

SEQ ID NO: 228833 - RNA, 22 nt, Human
ggggcuggguuugcgcaggcuc

SEQ ID NO: 228834 - RNA, 22 nt, Human
ggggcguugccacggggacggg

SEQ ID NO: 228835 - RNA, 22 nt, Human
ggggcugggaggccggcgcgca

SEQ ID NO: 228836 - RNA, 22 nt, Human
gggggagaauaugugaaggggg

SEQ ID NO: 228837 - RNA, 22 nt, Human
gggggagcuacaggucccuugg

SEQ ID NO: 228838 - RNA, 22 nt, Human
guucuuagguacucauauuuaa

SEQ ID NO: 228839 - RNA, 22 nt, Human
ggguggugauacugcuucugcc

SEQ ID NO: 228840 - RNA, 22 nt, Human
guucuucagauuccauuucagu

SEQ ID NO: 228841 - RNA, 22 nt, Human
guucuccaggggcuguucaucu

SEQ ID NO: 228842 - RNA, 22 nt, Human
gggugcuucauaggugaugcug

SEQ ID NO: 228843 - RNA, 22 nt, Human
gggugcucauggauaaggcgaa

SEQ ID NO: 228844 - RNA, 22 nt, Human
ggguggcaagucuuucugcaac

SEQ ID NO: 228845 - RNA, 22 nt, Human
guucuguauauauccuagcaaa

SEQ ID NO: 228846 - RNA, 22 nt, Human
guucuguuguugaucuuuggag

SEQ ID NO: 228847 - RNA, 22 nt, Human
guuccgcugcaaggccaggaaa

SEQ ID NO: 228848 - RNA, 22 nt, Human
guuccucugugguggaggaagg

SEQ ID NO: 228849 - RNA, 22 nt, Human
guucaaucucucaugcauuuuc

SEQ ID NO: 228850 - RNA, 22 nt, Human
guucaccaguagcugggcuguu

SEQ ID NO: 228851 - RNA, 22 nt, Human
guuccgcggccucgcgcugagc

SEQ ID NO: 228852 - RNA, 20 nt, Human
gggucuggcaucucucucug

SEQ ID NO: 228853 - RNA, 22 nt, Human
gggugcuuaagcuuguuuguaa

SEQ ID NO: 228854 - RNA, 22 nt, Human
guucgucuguggugugaggugc

SEQ ID NO: 228855 - RNA, 22 nt, Human
gggucggcacucuggcagcacc

SEQ ID NO: 228856 - RNA, 23 nt, Human
guugccuuugcaucuucauccau

SEQ ID NO: 228857 - RNA, 22 nt, Human
guugccugguuucaaaaggaau

SEQ ID NO: 228858 - RNA, 22 nt, Human
guugauuuaaccucaccuuuga

SEQ ID NO: 228859 - RNA, 22 nt, Human
guugauuuaggguuuugguuuu

SEQ ID NO: 228860 - RNA, 22 nt, Human
gguaagcacuucauguacauga

SEQ ID NO: 228861 - RNA, 22 nt, Human
guugauauggaaacucuagguu

SEQ ID NO: 228862 - RNA, 22 nt, Human
guugagaggccuggcucuuuuc

SEQ ID NO: 228863 - RNA, 22 nt, Human
guugagacguguauuggaaucu

SEQ ID NO: 228864 - RNA, 18 nt, Human
gguacguuuugaucaaug

SEQ ID NO: 228865 - RNA, 22 nt, Human
gguaauugaaaguuuguugaug

SEQ ID NO: 228866 - RNA, 22 nt, Human
gguagagagugaggaggggcuc

SEQ ID NO: 228867 - RNA, 22 nt, Human
gguagauacaaaaagauugugg

SEQ ID NO: 228868 - RNA, 22 nt, Human
ggguuuuaccagauguguggug

SEQ ID NO: 228869 - RNA, 22 nt, Human
ggguuguuuguauuucucugaa

SEQ ID NO: 228870 - RNA, 20 nt, Human
ggguugagcguggccccucu

SEQ ID NO: 228871 - RNA, 22 nt, Human
guugagaaucucuagcuuagga

SEQ ID NO: 228872 - RNA, 22 nt, Human
guugagaagaccauuuuguuca

SEQ ID NO: 228873 - RNA, 22 nt, Human
gugucauuggcuucccaagucc

SEQ ID NO: 228874 - RNA, 22 nt, Human
gugucuuauugauguuggcacu

SEQ ID NO: 228875 - RNA, 22 nt, Human
guguccuguagaaacuguucca

SEQ ID NO: 228876 - RNA, 22 nt, Human
gggcuggcaguuuucugaguuc

SEQ ID NO: 228877 - RNA, 22 nt, Human
gggcugaugcuuauacauacug

SEQ ID NO: 228878 - RNA, 22 nt, Human
gggcuguggggccugcagaagg

SEQ ID NO: 228879 - RNA, 22 nt, Human
gggcuguaggagcuggaauggg

SEQ ID NO: 228880 - RNA, 22 nt, Human
gggcuggggcucuggggcuagg

SEQ ID NO: 228881 - RNA, 23 nt, Human
gugugccuuuaucuucuguacuc

SEQ ID NO: 228882 - RNA, 22 nt, Human
gugugcacaaucuggcaugugc

SEQ ID NO: 228883 - RNA, 22 nt, Human
guguuaaucauuuuugauuuug

SEQ ID NO: 228884 - RNA, 18 nt, Human
gggcuuugggguucuauc

SEQ ID NO: 228885 - RNA, 22 nt, Human
gggcuuuuccaacacucuggag

SEQ ID NO: 228886 - RNA, 19 nt, Human
gggcuuguuggcaaaugac

SEQ ID NO: 228887 - RNA, 20 nt, Human
gggcuuugagcucagggcuu

SEQ ID NO: 228888 - RNA, 19 nt, Human
guguucuguuauacaguug

SEQ ID NO: 228889 - RNA, 22 nt, Human
ggggaagaaauagaacauuuug

SEQ ID NO: 228890 - RNA, 22 nt, Human
guguugaaaaguagcacugcuu

SEQ ID NO: 228891 - RNA, 22 nt, Human
gugguaagugcuccuauuggcg

SEQ ID NO: 228892 - RNA, 22 nt, Human
guggguuggguuuuugaaggga

SEQ ID NO: 228893 - RNA, 22 nt, Human
gguucaaagccugaugggguug

SEQ ID NO: 228894 - RNA, 22 nt, Human
gggcgcuguguuaggugcugua

SEQ ID NO: 228895 - RNA, 22 nt, Human
gugggugauacugccgugggag

SEQ ID NO: 228896 - RNA, 22 nt, Human
gggcgcgcggagccucgccggg

SEQ ID NO: 228897 - RNA, 22 nt, Human
gggcgccgggagugagagugag

SEQ ID NO: 228898 - RNA, 22 nt, Human
gggcgcgccaggagcugcgcgg

SEQ ID NO: 228899 - RNA, 22 nt, Human
guggugauuugggucuagcuuu

SEQ ID NO: 228900 - RNA, 22 nt, Human
guggugaacauuugcaucugcu

SEQ ID NO: 228901 - RNA, 22 nt, Human
guggucaagaccgggaauagga

SEQ ID NO: 228902 - RNA, 22 nt, Human
gggcggggcuuccguccuccac

SEQ ID NO: 228903 - RNA, 22 nt, Human
gggcggugccugucuccgaagc

SEQ ID NO: 228904 - RNA, 22 nt, Human
gggcuacagaugggagggauga

SEQ ID NO: 228905 - RNA, 22 nt, Human
guggugguguuggugacaaguu

SEQ ID NO: 228906 - RNA, 22 nt, Human
guguagugugcuguucaguguu

SEQ ID NO: 228907 - RNA, 22 nt, Human
guguauaguggugucgguagaa

SEQ ID NO: 228908 - RNA, 22 nt, Human
guguauuucuagaagaaaugaa

SEQ ID NO: 228909 - RNA, 17 nt, Human
gugguguacauuuccau

SEQ ID NO: 228910 - RNA, 22 nt, Human
gugguuugacccuucagguaaa

SEQ ID NO: 228911 - RNA, 22 nt, Human
gggccugcgcuggggggagccg

SEQ ID NO: 228912 - RNA, 22 nt, Human
gugggugaguggggccgccuga

SEQ ID NO: 228913 - RNA, 22 nt, Human
gggccuuggaggagaaggacuu

SEQ ID NO: 228914 - RNA, 22 nt, Human
gggccuguccccccaggagaac

SEQ ID NO: 228915 - RNA, 22 nt, Human
gugggggugaggaauguucuau

SEQ ID NO: 228916 - RNA, 22 nt, Human
guggggcgggucccccgccugg

SEQ ID NO: 228917 - RNA, 22 nt, Human
gugggggauggcgugugggucu

SEQ ID NO: 228918 - RNA, 22 nt, Human
gugggaguggagcucagcaugu

SEQ ID NO: 228919 - RNA, 18 nt, Human
gugggcacacacucuguu

SEQ ID NO: 228920 - RNA, 22 nt, Human
gugggauaaccugagauaacau

SEQ ID NO: 228921 - RNA, 22 nt, Human
gggcaugcagcaauucuguggu

SEQ ID NO: 228922 - RNA, 22 nt, Human
guggcuuuguuuccaaaugaaa

SEQ ID NO: 228923 - RNA, 20 nt, Human
guggcagugguggcagcagu

SEQ ID NO: 228924 - RNA, 22 nt, Human
guggcaguaaagcuggaaaagu

SEQ ID NO: 228925 - RNA, 22 nt, Human
guggauggagcuggaagccauu

SEQ ID NO: 228926 - RNA, 22 nt, Human
guggauuguaccacgaaaagug

SEQ ID NO: 228927 - RNA, 22 nt, Human
guggcuuaauauuuauagcaga

SEQ ID NO: 228928 - RNA, 22 nt, Human
guggcuugguauuaaggugcca

SEQ ID NO: 228929 - RNA, 22 nt, Human
guggcuuucuaccauuaaauug

SEQ ID NO: 228930 - RNA, 22 nt, Human
guggcuuauguccagcagauau

SEQ ID NO: 228931 - RNA, 22 nt, Human
guggcgucgaugauggugucau

SEQ ID NO: 228932 - RNA, 22 nt, Human
gggcagagagcuggaacuccuu

SEQ ID NO: 228933 - RNA, 22 nt, Human
gggcagaaaggaaggcuggggg

SEQ ID NO: 228934 - RNA, 22 nt, Human
gggcaggacccguuagaguggc

SEQ ID NO: 228935 - RNA, 22 nt, Human
guggaaauuuuaggaucaucuu

SEQ ID NO: 228936 - RNA, 23 nt, Human
ggccuuuuuaaccgcgagcgaca

SEQ ID NO: 228937 - RNA, 22 nt, Human
gugcuugcgcauaacuggggcc

SEQ ID NO: 228938 - RNA, 22 nt, Human
ggccuugauuccggucauugaa

SEQ ID NO: 228939 - RNA, 22 nt, Human
guggaggguuugcaaugugcag

SEQ ID NO: 228940 - RNA, 22 nt, Human
guggagaucuggugcccccugg

SEQ ID NO: 228941 - RNA, 22 nt, Human
guggagauauuugugauagggg

SEQ ID NO: 228942 - RNA, 22 nt, Human
guggacuuuggucugugccauc

SEQ ID NO: 228943 - RNA, 22 nt, Human
guggagaaagcuggaaucugag

SEQ ID NO: 228944 - RNA, 22 nt, Human
guggagaaauauguucagcuuc

SEQ ID NO: 228945 - RNA, 22 nt, Human
guaugugguaccaugcaacggg

SEQ ID NO: 228946 - RNA, 22 nt, Human
guaugugucuuagaacuuggga

SEQ ID NO: 228947 - RNA, 22 nt, Human
guauuaagaaaugccugugaaa

SEQ ID NO: 228948 - RNA, 22 nt, Human
uaagacuuuaccaggcucaaau

SEQ ID NO: 228949 - RNA, 22 nt, Human
uaacuuuuuauccuguuaaaug

SEQ ID NO: 228950 - RNA, 22 nt, Human
uaagaaacauuuuuaugacagu

SEQ ID NO: 228951 - RNA, 22 nt, Human
gucaaaguuaacuagcaggugc

SEQ ID NO: 228952 - RNA, 22 nt, Human
gucaaaggcggugcaggaggag

SEQ ID NO: 228953 - RNA, 22 nt, Human
gucaaugcuuaguuugccugaa

SEQ ID NO: 228954 - RNA, 22 nt, Human
gucaccgguuuuuagguaaaca

SEQ ID NO: 228955 - RNA, 21 nt, Human
uaagcuaaacauucaguuaac

SEQ ID NO: 228956 - RNA, 22 nt, Human
guauuugcaaucacaaacaaaa

SEQ ID NO: 228957 - RNA, 22 nt, Human
guauuuggacugccuguucauu

SEQ ID NO: 228958 - RNA, 22 nt, Human
guauuugacaccagugaauggu

SEQ ID NO: 228959 - RNA, 22 nt, Human
gucagacucuggggccccaggc

SEQ ID NO: 228960 - RNA, 22 nt, Human
gucacuuugcuugcgaugcucc

SEQ ID NO: 228961 - RNA, 22 nt, Human
uaaggaaaugcaaauuuaagaa

SEQ ID NO: 228962 - RNA, 22 nt, Human
guagccauuuucuagagaguua

SEQ ID NO: 228963 - RNA, 22 nt, Human
guagccacugaaguaaggccac

SEQ ID NO: 228964 - RNA, 22 nt, Human
uaaccuugaagacugagcugac

SEQ ID NO: 228965 - RNA, 22 nt, Human
uaacaguggucugugguaucug

SEQ ID NO: 228966 - RNA, 22 nt, Human
uaacauuuaguuuuaagauggu

SEQ ID NO: 228967 - RNA, 22 nt, Human
uaacauuucggugacaguggga

SEQ ID NO: 228968 - RNA, 22 nt, Human
uaacccaaaggcaaugucucga

SEQ ID NO: 228969 - RNA, 22 nt, Human
uaacccuucauaacuagaugaa

SEQ ID NO: 228970 - RNA, 22 nt, Human
uaacagugcuacaguuacuuuc

SEQ ID NO: 228971 - RNA, 22 nt, Human
guaauucugugugaaucuauua

SEQ ID NO: 228972 - RNA, 23 nt, Human
uaacacaguccuggucuuuggcc

SEQ ID NO: 228973 - RNA, 22 nt, Human
uaacaacuuucugguguaacuu

SEQ ID NO: 228974 - RNA, 23 nt, Human
uaaauuuuauucugauaacacag

SEQ ID NO: 228975 - RNA, 22 nt, Human
uaaauuugugaauuagcuauca

SEQ ID NO: 228976 - RNA, 22 nt, Human
uaacuuuucuguucaauuuucc

SEQ ID NO: 228977 - RNA, 22 nt, Human
uaaccuuuuuuaaaguuuccug

SEQ ID NO: 228978 - RNA, 22 nt, Human
guauaaagaugccauacuuacu

SEQ ID NO: 228979 - RNA, 22 nt, Human
guaguuuucaugguuagaaaua

SEQ ID NO: 228980 - RNA, 22 nt, Human
guauaaauaucuauauuguuac

SEQ ID NO: 228981 - RNA, 22 nt, Human
guagucuuaggaaugauuuugu

SEQ ID NO: 228982 - RNA, 22 nt, Human
guaguggaauuuagaguauaau

SEQ ID NO: 228983 - RNA, 22 nt, Human
guaguuuuugagcuguaaucuu

SEQ ID NO: 228984 - RNA, 22 nt, Human
guaguuuuucuugcaagaguag

SEQ ID NO: 228985 - RNA, 22 nt, Human
guagugauuguuccucaggggu

SEQ ID NO: 228986 - RNA, 22 nt, Human
guaguucuuucucaauguucaa

SEQ ID NO: 228987 - RNA, 22 nt, Human
guaguucuccaggggcuguuca

SEQ ID NO: 228988 - RNA, 22 nt, Human
ggugcuggggaaauuaggguag

SEQ ID NO: 228989 - RNA, 22 nt, Human
guuuuauaacuauagugagaau

SEQ ID NO: 228990 - RNA, 21 nt, Human
guugcuccuucuuuuucuugc

SEQ ID NO: 228991 - RNA, 22 nt, Human
gguauagacaaauuauauaucc

SEQ ID NO: 228992 - RNA, 22 nt, Human
ggucaaucaugggucauugucu

SEQ ID NO: 228993 - RNA, 22 nt, Human
ggucaauuuggucaaucguuua

SEQ ID NO: 228994 - RNA, 22 nt, Human
gguggcuugcugguaggugugc

SEQ ID NO: 228995 - RNA, 22 nt, Human
guuuuguucaugaacauugggu

SEQ ID NO: 228996 - RNA, 22 nt, Human
guuuugaagagaagcaagucug

SEQ ID NO: 228997 - RNA, 22 nt, Human
guuuugauggaguguguuaaau

SEQ ID NO: 228998 - RNA, 22 nt, Human
gguggcauguaccucacagacu

SEQ ID NO: 228999 - RNA, 22 nt, Human
gguggcauucaguaaguauaua

SEQ ID NO: 229000 - RNA, 22 nt, Human
guuuucuccugcuauacagugc

SEQ ID NO: 229001 - RNA, 22 nt, Human
uaaaugagcaccucuaguuuug

SEQ ID NO: 229002 - RNA, 22 nt, Human
uaaaugaaaugaagugaaagcu

SEQ ID NO: 229003 - RNA, 22 nt, Human
uaaauguacugaggcaacagga

SEQ ID NO: 229004 - RNA, 22 nt, Human
guaaauacuaugagauaaugaa

SEQ ID NO: 229005 - RNA, 22 nt, Human
gguuuauucccacaaaggaagu

SEQ ID NO: 229006 - RNA, 21 nt, Human
gguuucugcaaaccuuguaca

SEQ ID NO: 229007 - RNA, 22 nt, Human
gguuuaucuuuacaaaugaaau

SEQ ID NO: 229008 - RNA, 23 nt, Human
uaaagauaguuuaaaggugaguu

SEQ ID NO: 229009 - RNA, 22 nt, Human
uaaagacaauuucgagcuguag

SEQ ID NO: 229010 - RNA, 22 nt, Human
gguuauuucugauuauaugaua

SEQ ID NO: 229011 - RNA, 22 nt, Human
uaaagaagaaaaggcuucaggc

SEQ ID NO: 229012 - RNA, 22 nt, Human
gguugcggaccagcugggcugc

SEQ ID NO: 229013 - RNA, 19 nt, Human
gguuaccagugugucuggc

SEQ ID NO: 229014 - RNA, 22 nt, Human
gguuaacaccacagcugggaca

SEQ ID NO: 229015 - RNA, 22 nt, Human
uaaaaguuagcuaggacaaagu

SEQ ID NO: 229016 - RNA, 22 nt, Human
guuuuucuagaaaucuccuccu

SEQ ID NO: 229017 - RNA, 22 nt, Human
guuuuucuuugauuuagaacca

SEQ ID NO: 229018 - RNA, 22 nt, Human
guuuuuaguuuaaguuuuugca

SEQ ID NO: 229019 - RNA, 22 nt, Human
gugauuucaaauauagagugag

SEQ ID NO: 229020 - RNA, 22 nt, Human
gugauuucagguuuuucauacu

SEQ ID NO: 229021 - RNA, 19 nt, Human
uagaggagaauggcaaaga

SEQ ID NO: 229022 - RNA, 22 nt, Human
gugaugugugaaggucugcagg

SEQ ID NO: 229023 - RNA, 22 nt, Human
uagagaaauauuuguagugcug

SEQ ID NO: 229024 - RNA, 22 nt, Human
gugauggucgagcgcuuguugu

SEQ ID NO: 229025 - RNA, 22 nt, Human
gugauggggagagcgcagcuuu

SEQ ID NO: 229026 - RNA, 22 nt, Human
gugaguugugugaguaagcaga

SEQ ID NO: 229027 - RNA, 22 nt, Human
uagaaauaaacacugcuaccuu

SEQ ID NO: 229028 - RNA, 22 nt, Human
gugaguuuucgugacacuauuu

SEQ ID NO: 229029 - RNA, 22 nt, Human
gugaggcccaggugaaauuaac

SEQ ID NO: 229030 - RNA, 19 nt, Human
uagacuaauucauccccuu

SEQ ID NO: 229031 - RNA, 22 nt, Human
gugaugaaggccugcaccuggu

SEQ ID NO: 229032 - RNA, 22 nt, Human
gugaucagaagaaccugccgaa

SEQ ID NO: 229033 - RNA, 23 nt, Human
uagacugcaggcuccuugagggc

SEQ ID NO: 229034 - RNA, 22 nt, Human
uagagugcugucaaagacuugu

SEQ ID NO: 229035 - RNA, 22 nt, Human
gugcagcugguggagucugggg

SEQ ID NO: 229036 - RNA, 22 nt, Human
gugcagcugggcgcugaccuuc

SEQ ID NO: 229037 - RNA, 23 nt, Human
uagauccuuccaacuacucuuac

SEQ ID NO: 229038 - RNA, 22 nt, Human
gugcaucuguaauuacaauggu

SEQ ID NO: 229039 - RNA, 22 nt, Human
gugccaccagaugcuguugcua

SEQ ID NO: 229040 - RNA, 22 nt, Human
gugccaaauagcuugauuaaga

SEQ ID NO: 229041 - RNA, 22 nt, Human
gugccuggugcaggauaaucac

SEQ ID NO: 229042 - RNA, 22 nt, Human
gugcgaaagaagcgacuccagu

SEQ ID NO: 229043 - RNA, 22 nt, Human
uagcacauaguaggcacaggcu

SEQ ID NO: 229044 - RNA, 20 nt, Human
uagcacuguauccucuucau

SEQ ID NO: 229045 - RNA, 20 nt, Human
uagcacagacuuuugcuuac

SEQ ID NO: 229046 - RNA, 22 nt, Human
uagcaaucugugaugugugugu

SEQ ID NO: 229047 - RNA, 22 nt, Human
uagauuuaaaaagggugggaug

SEQ ID NO: 229048 - RNA, 22 nt, Human
gugccgcuggagcuggaauuga

SEQ ID NO: 229049 - RNA, 22 nt, Human
gugccugcucauucucaauauu

SEQ ID NO: 229050 - RNA, 22 nt, Human
uacacacacaugcauguacgug

SEQ ID NO: 229051 - RNA, 22 nt, Human
uacaaucaggcucuagcuucuc

SEQ ID NO: 229052 - RNA, 18 nt, Human
uacagauguaugucuaca

SEQ ID NO: 229053 - RNA, 22 nt, Human
gucugcccuuggccugggacuu

SEQ ID NO: 229054 - RNA, 22 nt, Human
gucugcacgugccagggagggg

SEQ ID NO: 229055 - RNA, 22 nt, Human
gucuccuucauuuacuguuucc

SEQ ID NO: 229056 - RNA, 21 nt, Human
uaauaauugggggcagggugg

SEQ ID NO: 229057 - RNA, 22 nt, Human
uaauaauuaacagugauggguc

SEQ ID NO: 229058 - RNA, 22 nt, Human
uaauaagugcuggcuguacauc

SEQ ID NO: 229059 - RNA, 20 nt, Human
gucaauguuuucuuggcccu

SEQ ID NO: 229060 - RNA, 22 nt, Human
uaagugugcauguguauuauau

SEQ ID NO: 229061 - RNA, 23 nt, Human
gucagcuugaccaguggagaguc

SEQ ID NO: 229062 - RNA, 22 nt, Human
uacaaauugccugacggcaggu

SEQ ID NO: 229063 - RNA, 22 nt, Human
gucuauuuauagacagauccua

SEQ ID NO: 229064 - RNA, 22 nt, Human
uacaaaugaucaucucuuugaa

SEQ ID NO: 229065 - RNA, 22 nt, Human
gucuaccuucuuucucaacugg

SEQ ID NO: 229066 - RNA, 22 nt, Human
uacuauuuugacaugaaauuga

SEQ ID NO: 229067 - RNA, 22 nt, Human
uacuaaagaaugaguuaaguuu

SEQ ID NO: 229068 - RNA, 22 nt, Human
uacaggaggaugugcagccagg

SEQ ID NO: 229069 - RNA, 22 nt, Human
uacagugaggcgagauucacca

SEQ ID NO: 229070 - RNA, 20 nt, Human
uaccagggguuugggacagc

SEQ ID NO: 229071 - RNA, 21 nt, Human
uaccacugaaauugaucguuc

SEQ ID NO: 229072 - RNA, 22 nt, Human
uacagcuuccucuaugguggcc

SEQ ID NO: 229073 - RNA, 22 nt, Human
uacuuacacugaagcaaagaua

SEQ ID NO: 229074 - RNA, 22 nt, Human
uacuuaauuuuaaaagcuagau

SEQ ID NO: 229075 - RNA, 22 nt, Human
gugaagcacaugggcguugggu

SEQ ID NO: 229076 - RNA, 22 nt, Human
gugaagaugccucaggugaccc

SEQ ID NO: 229077 - RNA, 20 nt, Human
gugaacuggagaacugaugu

SEQ ID NO: 229078 - RNA, 22 nt, Human
uacugccauuauccugcugaaa

SEQ ID NO: 229079 - RNA, 22 nt, Human
uacugaaagagugguggacucu

SEQ ID NO: 229080 - RNA, 22 nt, Human
uacugauggagauaggcuauca

SEQ ID NO: 229081 - RNA, 22 nt, Human
uacugacguaguagaguugcuu

SEQ ID NO: 229082 - RNA, 22 nt, Human
uacugaagaugccaucacaagc

SEQ ID NO: 229083 - RNA, 22 nt, Human
uacucuggaguugagaugcgag

SEQ ID NO: 229084 - RNA, 22 nt, Human
uaaugaugaacacuuggaagaa

SEQ ID NO: 229085 - RNA, 22 nt, Human
uaaugcucauuuggcucugcaa

SEQ ID NO: 229086 - RNA, 22 nt, Human
ucauugguugcguaauuugauu

SEQ ID NO: 229087 - RNA, 20 nt, Human
ucauucagaaucaguaugca

SEQ ID NO: 229088 - RNA, 22 nt, Human
ucauucucucguauucgcgaau

SEQ ID NO: 229089 - RNA, 22 nt, Human
uaauagauagggagaguugcug

SEQ ID NO: 229090 - RNA, 22 nt, Human
uaauaaaaauuuaauucacauu

SEQ ID NO: 229091 - RNA, 22 nt, Human
uaagugguagaaagagaaaggu

SEQ ID NO: 229092 - RNA, 21 nt, Human
uacaagaccggauucgggccc

SEQ ID NO: 229093 - RNA, 22 nt, Human
uacaaauuguuuugccacaaag

SEQ ID NO: 229094 - RNA, 22 nt, Human
uacaacuuacuugaauggcuuu

SEQ ID NO: 229095 - RNA, 22 nt, Human
uccaaauucccaugacagaagu

SEQ ID NO: 229096 - RNA, 20 nt, Human
uacaauauucccacuuugcu

SEQ ID NO: 229097 - RNA, 22 nt, Human
ucauuguguaguagagguggca

SEQ ID NO: 229098 - RNA, 22 nt, Human
uaauggagggucugagucuggg

SEQ ID NO: 229099 - RNA, 22 nt, Human
uaauuauuaauuuuagguugcu

SEQ ID NO: 229100 - RNA, 22 nt, Human
uaagaggucugaaacgguggga

SEQ ID NO: 229101 - RNA, 22 nt, Human
ucagagugagcuggggcugcuu

SEQ ID NO: 229102 - RNA, 22 nt, Human
uaagagcagacacaaccugaga

SEQ ID NO: 229103 - RNA, 22 nt, Human
ucaucagccaaagaguccuuca

SEQ ID NO: 229104 - RNA, 22 nt, Human
uaaagaggagaauuaagucagc

SEQ ID NO: 229105 - RNA, 22 nt, Human
uaagaaaggggaaguuccucuu

SEQ ID NO: 229106 - RNA, 23 nt, Human
uaagccugugccugcuaccugcu

SEQ ID NO: 229107 - RNA, 22 nt, Human
ucaucauccuuuuuugaagagu

SEQ ID NO: 229108 - RNA, 22 nt, Human
uaagcacuuuauaugcuuuauc

SEQ ID NO: 229109 - RNA, 21 nt, Human
uaagccaccaugugaaaccag

SEQ ID NO: 229110 - RNA, 22 nt, Human
ucauccugaagaaccugcuucc

SEQ ID NO: 229111 - RNA, 22 nt, Human
ucaucccuuccugcacuauuag

SEQ ID NO: 229112 - RNA, 22 nt, Human
ucaucuuucuuuauggaaauac

SEQ ID NO: 229113 - RNA, 22 nt, Human
ucaugacaacuugcacaguuuu

SEQ ID NO: 229114 - RNA, 22 nt, Human
ucaucuuuauaaugcaaguuuu

SEQ ID NO: 229115 - RNA, 22 nt, Human
uaagggagcagaagcugugaaa

SEQ ID NO: 229116 - RNA, 22 nt, Human
uacagaccaguaguucucagcg

SEQ ID NO: 229117 - RNA, 22 nt, Human
uacaccuuaagccgcggcuccc

SEQ ID NO: 229118 - RNA, 22 nt, Human
uacaccaugcuccagcaggaca

SEQ ID NO: 229119 - RNA, 22 nt, Human
uacaguauuuuuuaagaaaaaa

SEQ ID NO: 229120 - RNA, 22 nt, Human
uccacagcagagcacgguaccu

SEQ ID NO: 229121 - RNA, 22 nt, Human
uacauaauagcaaggugcuguc

SEQ ID NO: 229122 - RNA, 22 nt, Human
uccaccugucccugcuuccugc

SEQ ID NO: 229123 - RNA, 22 nt, Human
uccacgcucuuucuacuuuuca

SEQ ID NO: 229124 - RNA, 19 nt, Human
uccaccgcgugcaccucua

SEQ ID NO: 229125 - RNA, 22 nt, Human
uccaccacgaaacugcagcugc

SEQ ID NO: 229126 - RNA, 22 nt, Human
uccaccaccaucacagucagac

SEQ ID NO: 229127 - RNA, 22 nt, Human
uccacagggaugccugcggcuu

SEQ ID NO: 229128 - RNA, 22 nt, Human
uacaugggcguguucaguuagu

SEQ ID NO: 229129 - RNA, 22 nt, Human
uacauggauguuauccuuacug

SEQ ID NO: 229130 - RNA, 22 nt, Human
uacauuccagaaaguuucugua

SEQ ID NO: 229131 - RNA, 22 nt, Human
uacauuugauuuuugcuucuuu

SEQ ID NO: 229132 - RNA, 22 nt, Human
uaccaauuaaauagccaaucua

SEQ ID NO: 229133 - RNA, 22 nt, Human
uccacuguguagucucccaagu

SEQ ID NO: 229134 - RNA, 22 nt, Human
uccagagcuguccuacugugag

SEQ ID NO: 229135 - RNA, 22 nt, Human
uccagacucaaaaaccagaugg

SEQ ID NO: 229136 - RNA, 22 nt, Human
uccagaaaucucuguugauugu

SEQ ID NO: 229137 - RNA, 22 nt, Human
uccagaaagccguugacuuauu

SEQ ID NO: 229138 - RNA, 20 nt, Human
uaccaucauuggcaaaccuc

SEQ ID NO: 229139 - RNA, 22 nt, Human
uccagcacacagguggcucuca

SEQ ID NO: 229140 - RNA, 22 nt, Human
uacucgaaaucagagagaauaa

SEQ ID NO: 229141 - RNA, 22 nt, Human
uacucucuuccauacaaucugu

SEQ ID NO: 229142 - RNA, 22 nt, Human
ucccaaaacuugaagcaagccu

SEQ ID NO: 229143 - RNA, 22 nt, Human
uacuggaugcaacaaagcccag

SEQ ID NO: 229144 - RNA, 22 nt, Human
uacugggugagcugggcuggga

SEQ ID NO: 229145 - RNA, 22 nt, Human
ucccagaaccuuuuagcuucac

SEQ ID NO: 229146 - RNA, 22 nt, Human
uacugguguauuucuucuuauu

SEQ ID NO: 229147 - RNA, 21 nt, Human
uacugugccagggcagcucug

SEQ ID NO: 229148 - RNA, 22 nt, Human
uccauuuacuauucucauaucg

SEQ ID NO: 229149 - RNA, 22 nt, Human
ucccacugucuucucgugcucg

SEQ ID NO: 229150 - RNA, 22 nt, Human
ucccacacucaacacacaugua

SEQ ID NO: 229151 - RNA, 22 nt, Human
uccagugaacaucauggcucca

SEQ ID NO: 229152 - RNA, 22 nt, Human
uccaguggcaccuuggcccuca

SEQ ID NO: 229153 - RNA, 22 nt, Human
uccauguugauaaucuugugaa

SEQ ID NO: 229154 - RNA, 22 nt, Human
uacuaucauuuuuuguugccaa

SEQ ID NO: 229155 - RNA, 22 nt, Human
uacucauuggagaauuacgagg

SEQ ID NO: 229156 - RNA, 23 nt, Human
uaccauugauuuuaugguuuucu

SEQ ID NO: 229157 - RNA, 22 nt, Human
uacccauuuugguucuugaugc

SEQ ID NO: 229158 - RNA, 19 nt, Human
uacccggauagccagguag

SEQ ID NO: 229159 - RNA, 20 nt, Human
uacccgcagcugggucuggc

SEQ ID NO: 229160 - RNA, 22 nt, Human
uaccgcagagucauugugagga

SEQ ID NO: 229161 - RNA, 22 nt, Human
uccagguucaguucaucaucua

SEQ ID NO: 229162 - RNA, 22 nt, Human
uccagccauaucuuguagcccu

SEQ ID NO: 229163 - RNA, 22 nt, Human
uccagccugaacuuuguccaga

SEQ ID NO: 229164 - RNA, 22 nt, Human
ucgccauguacaugaagggcgg

SEQ ID NO: 229165 - RNA, 22 nt, Human
ucgcccagguuggagugcagug

SEQ ID NO: 229166 - RNA, 22 nt, Human
uaggaucaugaugguaaggcaa

SEQ ID NO: 229167 - RNA, 22 nt, Human
uaggauauuuuagaaugguaca

SEQ ID NO: 229168 - RNA, 22 nt, Human
ucgacuccauuuuucuugguuc

SEQ ID NO: 229169 - RNA, 22 nt, Human
ucgacguuguuuuuucucuguc

SEQ ID NO: 229170 - RNA, 22 nt, Human
ucgaaacuucucauuuaucugu

SEQ ID NO: 229171 - RNA, 22 nt, Human
uccuuguaccauuugcucacag

SEQ ID NO: 229172 - RNA, 22 nt, Human
uaggcagggauuaggguugauu

SEQ ID NO: 229173 - RNA, 22 nt, Human
uaggcaauauuagacuuugucu

SEQ ID NO: 229174 - RNA, 22 nt, Human
uaggcauguaaaagugaguucg

SEQ ID NO: 229175 - RNA, 22 nt, Human
uaggcuuuguuacuuucccuuu

SEQ ID NO: 229176 - RNA, 19 nt, Human
uaggcccugcgaauggcuu

SEQ ID NO: 229177 - RNA, 22 nt, Human
uaggguagugggaaacuggacg

SEQ ID NO: 229178 - RNA, 22 nt, Human
ucggcgaccugucauggaccaa

SEQ ID NO: 229179 - RNA, 19 nt, Human
ucggaaugugggaagcaug

SEQ ID NO: 229180 - RNA, 22 nt, Human
ucggauuggggaugggugggag

SEQ ID NO: 229181 - RNA, 22 nt, Human
ucgggccacauccacacaucca

SEQ ID NO: 229182 - RNA, 21 nt, Human
ucgggcggcggcugaggcggc

SEQ ID NO: 229183 - RNA, 22 nt, Human
ucguauucagugcaagucaacg

SEQ ID NO: 229184 - RNA, 22 nt, Human
ucguccaauaaccugccagcgc

SEQ ID NO: 229185 - RNA, 22 nt, Human
uaggucuuggagguggggcugg

SEQ ID NO: 229186 - RNA, 22 nt, Human
uaggucugaggcugcaucuugg

SEQ ID NO: 229187 - RNA, 22 nt, Human
uagguuguuguggggauuaagu

SEQ ID NO: 229188 - RNA, 22 nt, Human
ucgugagugcugucaccugcug

SEQ ID NO: 229189 - RNA, 22 nt, Human
uaguccacagagggcaggguca

SEQ ID NO: 229190 - RNA, 22 nt, Human
ucgugaagaaauguggacuuca

SEQ ID NO: 229191 - RNA, 22 nt, Human
uaguauuuguaauuaucaaagc

SEQ ID NO: 229192 - RNA, 22 nt, Human
uagucuaguggaaccaucacug

SEQ ID NO: 229193 - RNA, 22 nt, Human
uagucauaauucuugcugccuu

SEQ ID NO: 229194 - RNA, 22 nt, Human
uagucggcuaggagggccuucu

SEQ ID NO: 229195 - RNA, 22 nt, Human
ucgugacuggacaaacuugggu

SEQ ID NO: 229196 - RNA, 22 nt, Human
uagugcauaccuaacauuuuug

SEQ ID NO: 229197 - RNA, 22 nt, Human
ucguuucuuuuucuucccugga

SEQ ID NO: 229198 - RNA, 22 nt, Human
ucuaaaaauuagaaauuagguc

SEQ ID NO: 229199 - RNA, 22 nt, Human
ucuaagcuugaucacuugcuuu

SEQ ID NO: 229200 - RNA, 22 nt, Human
ucuaaaugaccuccuugcccag

SEQ ID NO: 229201 - RNA, 21 nt, Human
uccuuguuucuuccaaaacug

SEQ ID NO: 229202 - RNA, 22 nt, Human
uagcuucccagcuaaccauguc

SEQ ID NO: 229203 - RNA, 21 nt, Human
uagcuugaucauuuuauuucc

SEQ ID NO: 229204 - RNA, 22 nt, Human
uccuuuauuuaugggcagugua

SEQ ID NO: 229205 - RNA, 22 nt, Human
uagcgggucacccugcugugaa

SEQ ID NO: 229206 - RNA, 17 nt, Human
uagccagcuugugauuu

SEQ ID NO: 229207 - RNA, 22 nt, Human
uccugcccuguccuugccucug

SEQ ID NO: 229208 - RNA, 22 nt, Human
uagauuguaagcuccuugaggg

SEQ ID NO: 229209 - RNA, 22 nt, Human
uccucuucucuagagccggaau

SEQ ID NO: 229210 - RNA, 21 nt, Human
uccugcagggcagcagagugg

SEQ ID NO: 229211 - RNA, 22 nt, Human
uccugaaugguguaauagguuu

SEQ ID NO: 229212 - RNA, 22 nt, Human
uagcauuuagaacaccuugaga

SEQ ID NO: 229213 - RNA, 22 nt, Human
uagcauaaaguuucuguguggu

SEQ ID NO: 229214 - RNA, 22 nt, Human
uagcauccugugugaauguauu

SEQ ID NO: 229215 - RNA, 22 nt, Human
uagcaggaggcaguuccucgcu

SEQ ID NO: 229216 - RNA, 22 nt, Human
uagcaggagagaaguuuuaagu

SEQ ID NO: 229217 - RNA, 22 nt, Human
uccucagagacaaguugagagg

SEQ ID NO: 229218 - RNA, 22 nt, Human
uccucuucaaaauagcucugaa

SEQ ID NO: 229219 - RNA, 22 nt, Human
uccuacccccuucuccagcucc

SEQ ID NO: 229220 - RNA, 22 nt, Human
uagagaaauuacagcuuucuuu

SEQ ID NO: 229221 - RNA, 19 nt, Human
uagagcagcuucagauucc

SEQ ID NO: 229222 - RNA, 22 nt, Human
uagagagaaaccaggguuuggg

SEQ ID NO: 229223 - RNA, 22 nt, Human
uagaaguuaaaggaauacagaa

SEQ ID NO: 229224 - RNA, 22 nt, Human
uagaagaugccuuaaaguugaa

SEQ ID NO: 229225 - RNA, 22 nt, Human
uacuucaguuacaugaagguau

SEQ ID NO: 229226 - RNA, 22 nt, Human
uacuuaucuuagggaugcuugc

SEQ ID NO: 229227 - RNA, 22 nt, Human
ucccagucuagagccggauugg

SEQ ID NO: 229228 - RNA, 22 nt, Human
ucccagguugaggccuugccug

SEQ ID NO: 229229 - RNA, 22 nt, Human
guuuuuacuuccaaugcuauga

SEQ ID NO: 229230 - RNA, 22 nt, Human
guuuuggagauguccauuuucc

SEQ ID NO: 229231 - RNA, 22 nt, Human
guuuucuuguuaauuuugaacg

SEQ ID NO: 229232 - RNA, 22 nt, Human
ucagagagagagaggcggaaga

SEQ ID NO: 229233 - RNA, 22 nt, Human
ucagagaaguaggcuaauggug

SEQ ID NO: 229234 - RNA, 21 nt, Human
ucagaccaacucuuguauccu

SEQ ID NO: 229235 - RNA, 22 nt, Human
guuuuguagucuggagacuguc

SEQ ID NO: 229236 - RNA, 22 nt, Human
guuuuauguuuuauagacacaa

SEQ ID NO: 229237 - RNA, 22 nt, Human
guuuucuaaaacacauauaagu

SEQ ID NO: 229238 - RNA, 21 nt, Human
ucagaaucguuccagguagau

SEQ ID NO: 229239 - RNA, 18 nt, Human
ucagaaugauuuggugga

SEQ ID NO: 229240 - RNA, 22 nt, Human
guuuuaucuauguaauuauaaa

SEQ ID NO: 229241 - RNA, 22 nt, Human
ucagaacugcggggaagguggg

SEQ ID NO: 229242 - RNA, 22 nt, Human
guuugggauucuagacaaaaau

SEQ ID NO: 229243 - RNA, 22 nt, Human
guuuguguauauguguauuuuu

SEQ ID NO: 229244 - RNA, 22 nt, Human
guuuuaaucuccuuauuccuaa

SEQ ID NO: 229245 - RNA, 22 nt, Human
guuuuagugauaagaacaccaa

SEQ ID NO: 229246 - RNA, 22 nt, Human
ucagcaggugcuuuguuuacuc

SEQ ID NO: 229247 - RNA, 22 nt, Human
ucagcaaugggauucaggcuuu

SEQ ID NO: 229248 - RNA, 22 nt, Human
ucagauggucauucacuagggu

SEQ ID NO: 229249 - RNA, 22 nt, Human
uaaaaaccuuguauuuaacucu

SEQ ID NO: 229250 - RNA, 23 nt, Human
guuuuugcugcagcugaagaagg

SEQ ID NO: 229251 - RNA, 21 nt, Human
uaaaagaugacaagacagcuc

SEQ ID NO: 229252 - RNA, 22 nt, Human
uaaaaccauucauugaccuaug

SEQ ID NO: 229253 - RNA, 22 nt, Human
uaaaaauuagauauguauuuag

SEQ ID NO: 229254 - RNA, 22 nt, Human
ucagcucacaauguugagaaag

SEQ ID NO: 229255 - RNA, 22 nt, Human
ucagcugggagaaaguuuuagg

SEQ ID NO: 229256 - RNA, 22 nt, Human
ucagcuucaucuugagcccaca

SEQ ID NO: 229257 - RNA, 22 nt, Human
uaaaccuuauuugaauaccaac

SEQ ID NO: 229258 - RNA, 22 nt, Human
uaaacugacagugagggagagu

SEQ ID NO: 229259 - RNA, 22 nt, Human
uaaaauaccacauauggugcuc

SEQ ID NO: 229260 - RNA, 22 nt, Human
uaaaaugcucagauaaauauau

SEQ ID NO: 229261 - RNA, 22 nt, Human
ucacugccuagggcuacugugc

SEQ ID NO: 229262 - RNA, 23 nt, Human
ucacugccaagaaaaguuacaga

SEQ ID NO: 229263 - RNA, 22 nt, Human
ucacucgccuuuucguucgccg

SEQ ID NO: 229264 - RNA, 22 nt, Human
ucaccuuuugaauugcuguugu

SEQ ID NO: 229265 - RNA, 22 nt, Human
ucaccuguucaacagcaauaau

SEQ ID NO: 229266 - RNA, 22 nt, Human
guuuggguggcuagagaaagaa

SEQ ID NO: 229267 - RNA, 22 nt, Human
ucacuucuaugaucugucucuu

SEQ ID NO: 229268 - RNA, 22 nt, Human
ucacuggauucauguuucuuua

SEQ ID NO: 229269 - RNA, 22 nt, Human
ucacuguugccacggugauaau

SEQ ID NO: 229270 - RNA, 22 nt, Human
ucacuuccuugcagcuguagaa

SEQ ID NO: 229271 - RNA, 22 nt, Human
guuucucuuugguggguugaga

SEQ ID NO: 229272 - RNA, 22 nt, Human
guuuauuucuuaucaucacuau

SEQ ID NO: 229273 - RNA, 22 nt, Human
guuuccaggcuuugguaugguu

SEQ ID NO: 229274 - RNA, 22 nt, Human
ucaccaggauugggcuguaggc

SEQ ID NO: 229275 - RNA, 22 nt, Human
guuuauucuuuuauuugugaga

SEQ ID NO: 229276 - RNA, 22 nt, Human
guuuaucagagagcagaggugg

SEQ ID NO: 229277 - RNA, 22 nt, Human
ucaccauguacaugaagggcgg

SEQ ID NO: 229278 - RNA, 22 nt, Human
ucacagguuuaguccagcaguc

SEQ ID NO: 229279 - RNA, 22 nt, Human
ucacacaucucagguguuuaau

SEQ ID NO: 229280 - RNA, 22 nt, Human
ucacaggagucaaggaauagua

SEQ ID NO: 229281 - RNA, 22 nt, Human
ucaauuggcuacaaauaaugua

SEQ ID NO: 229282 - RNA, 22 nt, Human
ucaauuuauguggcuauucauu

SEQ ID NO: 229283 - RNA, 22 nt, Human
ucacaugcucaccuaagccaca

SEQ ID NO: 229284 - RNA, 22 nt, Human
guuguuuuuguuaaaacaguga

SEQ ID NO: 229285 - RNA, 22 nt, Human
ucacauggauuaacucauuuau

SEQ ID NO: 229286 - RNA, 22 nt, Human
guuguuuucagcccagcauuag

SEQ ID NO: 229287 - RNA, 22 nt, Human
guuuaagcagauugcuguggug

SEQ ID NO: 229288 - RNA, 22 nt, Human
uauuuuggcuccugagcucuga

SEQ ID NO: 229289 - RNA, 22 nt, Human
guugcaaaugggaagaugguua

SEQ ID NO: 229290 - RNA, 22 nt, Human
guugucuggcucugaccauucu

SEQ ID NO: 229291 - RNA, 22 nt, Human
uauuuuuacuguuugaugauuc

SEQ ID NO: 229292 - RNA, 21 nt, Human
guugugaccaugggaguugcu

SEQ ID NO: 229293 - RNA, 22 nt, Human
guugugcaaaacaggaaggucu

SEQ ID NO: 229294 - RNA, 22 nt, Human
uauaagaaaagucauuaucaaa

SEQ ID NO: 229295 - RNA, 18 nt, Human
uauaaacacacuuagguu

SEQ ID NO: 229296 - RNA, 22 nt, Human
uauaaagaccuuauccuucaua

SEQ ID NO: 229297 - RNA, 22 nt, Human
uauaaugucuuuguugaaaucu

SEQ ID NO: 229298 - RNA, 22 nt, Human
uauauauacauauagaauaugu

SEQ ID NO: 229299 - RNA, 22 nt, Human
uauauaauacacaaauauguac

SEQ ID NO: 229300 - RNA, 22 nt, Human
uaguuaaugauagggagagggg

SEQ ID NO: 229301 - RNA, 22 nt, Human
uaguuauuucugcacuuaauga

SEQ ID NO: 229302 - RNA, 22 nt, Human
gugguuugcugguguacguuua

SEQ ID NO: 229303 - RNA, 22 nt, Human
gugcucaagacauuaggaauau

SEQ ID NO: 229304 - RNA, 22 nt, Human
gugcuaugugcugaacucaggu

SEQ ID NO: 229305 - RNA, 22 nt, Human
uaguuggguagacaguucuaca

SEQ ID NO: 229306 - RNA, 22 nt, Human
uaguugguggagcgauuugucu

SEQ ID NO: 229307 - RNA, 22 nt, Human
uaguugaauuuaucaguagcau

SEQ ID NO: 229308 - RNA, 22 nt, Human
uaguucauucucucuauuccug

SEQ ID NO: 229309 - RNA, 22 nt, Human
uaguuuucuuuuguguuauucu

SEQ ID NO: 229310 - RNA, 19 nt, Human
uaugacaaguacuaguucu

SEQ ID NO: 229311 - RNA, 22 nt, Human
gugucuuggaacuggaauugag

SEQ ID NO: 229312 - RNA, 19 nt, Human
uaugaaguugauaaaaguu

SEQ ID NO: 229313 - RNA, 22 nt, Human
gugugaguggcuaagugugccu

SEQ ID NO: 229314 - RNA, 22 nt, Human
guguggcgacucagagcugccu

SEQ ID NO: 229315 - RNA, 22 nt, Human
guguguauguagguauauaugu

SEQ ID NO: 229316 - RNA, 22 nt, Human
gugugguguuaagcaaauuaau

SEQ ID NO: 229317 - RNA, 22 nt, Human
uauccuaaaggguaguguggga

SEQ ID NO: 229318 - RNA, 22 nt, Human
uaucugaugcaggcucccagga

SEQ ID NO: 229319 - RNA, 22 nt, Human
uaucugcuggagguaauuacuc

SEQ ID NO: 229320 - RNA, 22 nt, Human
uaucuguauuguagaacuguug

SEQ ID NO: 229321 - RNA, 22 nt, Human
uaucuguagucucaugguuccu

SEQ ID NO: 229322 - RNA, 22 nt, Human
uaucacauaaaugaggaauauu

SEQ ID NO: 229323 - RNA, 22 nt, Human
uaucaguagaacaauggacauu

SEQ ID NO: 229324 - RNA, 22 nt, Human
uauauuuguccuagcuccuagc

SEQ ID NO: 229325 - RNA, 22 nt, Human
uauauauaugcaccacaugugu

SEQ ID NO: 229326 - RNA, 22 nt, Human
uauaugcacucagguguaugug

SEQ ID NO: 229327 - RNA, 22 nt, Human
uauuugauggaacucuugcuuu

SEQ ID NO: 229328 - RNA, 22 nt, Human
uauuuguuucuaguggcagcaa

SEQ ID NO: 229329 - RNA, 22 nt, Human
uauuucuagggcaugaaaauaa

SEQ ID NO: 229330 - RNA, 22 nt, Human
guucuuuacuucgcaucugcua

SEQ ID NO: 229331 - RNA, 22 nt, Human
guugauaauuaauagcuuuuga

SEQ ID NO: 229332 - RNA, 22 nt, Human
guugaacagucacccugggagu

SEQ ID NO: 229333 - RNA, 22 nt, Human
uauuuugaggugaaagaguuug

SEQ ID NO: 229334 - RNA, 22 nt, Human
uauugugaaggccaugugcuaa

SEQ ID NO: 229335 - RNA, 22 nt, Human
uauuguauuagcucuuggagau

SEQ ID NO: 229336 - RNA, 22 nt, Human
uauucuucagcauaaaaauucu

SEQ ID NO: 229337 - RNA, 22 nt, Human
uauuggcucagucagaaguuuu

SEQ ID NO: 229338 - RNA, 22 nt, Human
uauuuaggcagaaagugauauu

SEQ ID NO: 229339 - RNA, 22 nt, Human
uauuuaugcaucacuuuuuucc

SEQ ID NO: 229340 - RNA, 22 nt, Human
uauuucaguuaagaugagguca

SEQ ID NO: 229341 - RNA, 20 nt, Human
uauuucaaugugccaaguuu

SEQ ID NO: 229342 - RNA, 22 nt, Human
uauuuacgcaaacaauugugca

SEQ ID NO: 229343 - RNA, 22 nt, Human
uauuuacuuugaggaaguuguu

SEQ ID NO: 229344 - RNA, 22 nt, Human
uaugguuucuccugcagauuug

SEQ ID NO: 229345 - RNA, 23 nt, Human
guuaccgaccugauucggcagcc

SEQ ID NO: 229346 - RNA, 18 nt, Human
uaugugucuguuacaacu

SEQ ID NO: 229347 - RNA, 22 nt, Human
uauguacauauauguguauaua

SEQ ID NO: 229348 - RNA, 22 nt, Human
uauguguaauuaaauacuauag

SEQ ID NO: 229349 - RNA, 22 nt, Human
uauguuaaauguuugauguuua

SEQ ID NO: 229350 - RNA, 22 nt, Human
uauggcuaguguguuuguaaca

SEQ ID NO: 229351 - RNA, 22 nt, Human
uauggcuucucagucaugaaaa

SEQ ID NO: 229352 - RNA, 22 nt, Human
guguuaggugcauuaaacgugg

SEQ ID NO: 229353 - RNA, 23 nt, Human
guuauugcuggugcuggccagcc

SEQ ID NO: 229354 - RNA, 22 nt, Human
guuauuuugucuuguucaugaa

SEQ ID NO: 229355 - RNA, 22 nt, Human
guucacauccuugugaggauuu

SEQ ID NO: 229356 - RNA, 22 nt, Human
uauuaaaagagaaaaagccacc

SEQ ID NO: 229357 - RNA, 22 nt, Human
uauguuuugcaaauaucaaaca

SEQ ID NO: 229358 - RNA, 18 nt, Human
uauuccucuuccucuauc

SEQ ID NO: 229359 - RNA, 22 nt, Human
uauucccacuccucagcaauuu

SEQ ID NO: 229360 - RNA, 22 nt, Human
guucauuucaagucuaauccau

SEQ ID NO: 229361 - RNA, 22 nt, Human
ugaagcuagguucaugaggucg

SEQ ID NO: 229362 - RNA, 22 nt, Human
ugaagcuaguauuaacucagau

SEQ ID NO: 229363 - RNA, 22 nt, Human
ucaagaagauaaugucuagggu

SEQ ID NO: 229364 - RNA, 22 nt, Human
ugaaggaggugaauccaugcau

SEQ ID NO: 229365 - RNA, 22 nt, Human
ugaaggagucgaggugggugag

SEQ ID NO: 229366 - RNA, 22 nt, Human
ucaagcaaggaauccuuuugua

SEQ ID NO: 229367 - RNA, 22 nt, Human
ucaagcuggaaaugaagaaucu

SEQ ID NO: 229368 - RNA, 22 nt, Human
ugaaggccagggauuugcagcc

SEQ ID NO: 229369 - RNA, 22 nt, Human
ucaaggaagggguaggaauaau

SEQ ID NO: 229370 - RNA, 21 nt, Human
ucaagcggcagagcaguuauu

SEQ ID NO: 229371 - RNA, 23 nt, Human
ugaagugaaauuucacaagggac

SEQ ID NO: 229372 - RNA, 22 nt, Human
ugaagguggcuugcagcuaguc

SEQ ID NO: 229373 - RNA, 22 nt, Human
ugaaucugagccugcgcaaagu

SEQ ID NO: 229374 - RNA, 22 nt, Human
ugaauagcaccuugaguaauga

SEQ ID NO: 229375 - RNA, 22 nt, Human
ucaagguauuauuuuuguggug

SEQ ID NO: 229376 - RNA, 22 nt, Human
ucacaagaagaaauuaaacugu

SEQ ID NO: 229377 - RNA, 22 nt, Human
ucacccagacugucugacucuu

SEQ ID NO: 229378 - RNA, 22 nt, Human
ugaaugcuacccugcuggcucu

SEQ ID NO: 229379 - RNA, 22 nt, Human
ugaauguguacacgauuguuug

SEQ ID NO: 229380 - RNA, 22 nt, Human
ugaauguggucaggaaauuguu

SEQ ID NO: 229381 - RNA, 22 nt, Human
ucaccaugcccuucucugcucu

SEQ ID NO: 229382 - RNA, 22 nt, Human
ucacauugcauuuucucauuug

SEQ ID NO: 229383 - RNA, 22 nt, Human
ucaccauguuuucauaggaaca

SEQ ID NO: 229384 - RNA, 21 nt, Human
ucacagggucacucuuaccac

SEQ ID NO: 229385 - RNA, 22 nt, Human
ucacagauguuauccugaggau

SEQ ID NO: 229386 - RNA, 22 nt, Human
ucacaguucaacuaguucagau

SEQ ID NO: 229387 - RNA, 22 nt, Human
ugaauuauaugguauugaacau

SEQ ID NO: 229388 - RNA, 22 nt, Human
ucacuggaaaacaaauguuuua

SEQ ID NO: 229389 - RNA, 22 nt, Human
ucacugaacucucauagagaaa

SEQ ID NO: 229390 - RNA, 22 nt, Human
ucacugaauuucaagcuagugg

SEQ ID NO: 229391 - RNA, 22 nt, Human
ucaccugccuggguggucaccu

SEQ ID NO: 229392 - RNA, 22 nt, Human
ucaccuguuggauguauacugu

SEQ ID NO: 229393 - RNA, 22 nt, Human
ucaccuggagagcuugcuaaua

SEQ ID NO: 229394 - RNA, 22 nt, Human
ucacucagucugagcaauugcu

SEQ ID NO: 229395 - RNA, 22 nt, Human
ucacuaugcccagaauacaguu

SEQ ID NO: 229396 - RNA, 22 nt, Human
ucacuagcaucugaauauuguu

SEQ ID NO: 229397 - RNA, 23 nt, Human
ugacagguucuaugguuuccaac

SEQ ID NO: 229398 - RNA, 22 nt, Human
ucagaaggagagacagcgugga

SEQ ID NO: 229399 - RNA, 22 nt, Human
ugacauccuacaccccuggguc

SEQ ID NO: 229400 - RNA, 22 nt, Human
ucagaagguacugaagacaugg

SEQ ID NO: 229401 - RNA, 22 nt, Human
ucagagacaucagguuguagca

SEQ ID NO: 229402 - RNA, 22 nt, Human
ucagagccagacacacagcaga

SEQ ID NO: 229403 - RNA, 18 nt, Human
ucagaggagauaccuaaa

SEQ ID NO: 229404 - RNA, 23 nt, Human
ucagaccaaccucuugcuggaac

SEQ ID NO: 229405 - RNA, 20 nt, Human
ucagaaugugacccccaugg

SEQ ID NO: 229406 - RNA, 22 nt, Human
ucagaaugaaauuucuuucaga

SEQ ID NO: 229407 - RNA, 22 nt, Human
ugaauuucuuuuuaaaauauua

SEQ ID NO: 229408 - RNA, 22 nt, Human
ugaauuuguaggaauucuccau

SEQ ID NO: 229409 - RNA, 22 nt, Human
ugaauuuuggcaauuuucugug

SEQ ID NO: 229410 - RNA, 22 nt, Human
ucacuguuucaccgucugaagg

SEQ ID NO: 229411 - RNA, 22 nt, Human
ucagaacuaacuuugcugaacc

SEQ ID NO: 229412 - RNA, 22 nt, Human
ucagaacucuagucucagccug

SEQ ID NO: 229413 - RNA, 22 nt, Human
ucagaaacuaaauguggauuug

SEQ ID NO: 229414 - RNA, 22 nt, Human
ugacacagaccaaguggugcug

SEQ ID NO: 229415 - RNA, 22 nt, Human
ugacagaaaccaccccccaggu

SEQ ID NO: 229416 - RNA, 22 nt, Human
ucacuucugcuccuuggaugcc

SEQ ID NO: 229417 - RNA, 22 nt, Human
ucacuuuacaucuguaaaagga

SEQ ID NO: 229418 - RNA, 22 nt, Human
ucaggacacuuaauaggaacag

SEQ ID NO: 229419 - RNA, 19 nt, Human
ugacuggguucuaggcagg

SEQ ID NO: 229420 - RNA, 22 nt, Human
ugacuaauacagaaacuacaag

SEQ ID NO: 229421 - RNA, 22 nt, Human
ucagcguuggccuccuccaggg

SEQ ID NO: 229422 - RNA, 22 nt, Human
ucagccuugguuuugguguugg

SEQ ID NO: 229423 - RNA, 22 nt, Human
ucagcuauccauucuccuauga

SEQ ID NO: 229424 - RNA, 22 nt, Human
ucagcguuaguuuuucaucuaa

SEQ ID NO: 229425 - RNA, 22 nt, Human
ucagcgucuccaaaagagcccg

SEQ ID NO: 229426 - RNA, 22 nt, Human
ucagcucaggggauguggggga

SEQ ID NO: 229427 - RNA, 22 nt, Human
ucagcucucucuuggugaucuc

SEQ ID NO: 229428 - RNA, 21 nt, Human
ucaggaagagccaguucaugc

SEQ ID NO: 229429 - RNA, 22 nt, Human
ugacauuugagagagauauaca

SEQ ID NO: 229430 - RNA, 23 nt, Human
ugaccauauauccaucagauaua

SEQ ID NO: 229431 - RNA, 22 nt, Human
ucagcacagcugcuuuuacuuc

SEQ ID NO: 229432 - RNA, 22 nt, Human
ucagauagcaagggauaccugu

SEQ ID NO: 229433 - RNA, 22 nt, Human
ucagauaauccaauagagagga

SEQ ID NO: 229434 - RNA, 19 nt, Human
ucagcagauuuugcaaaca

SEQ ID NO: 229435 - RNA, 22 nt, Human
ucagcaguuaagcuucccugcc

SEQ ID NO: 229436 - RNA, 21 nt, Human
ucagccuguccaguguuaacc

SEQ ID NO: 229437 - RNA, 23 nt, Human
ucagccgcuggcgaguccacugg

SEQ ID NO: 229438 - RNA, 22 nt, Human
uauuuguauugucuuaucacuu

SEQ ID NO: 229439 - RNA, 18 nt, Human
uauuugugugugugugug

SEQ ID NO: 229440 - RNA, 22 nt, Human
uauuucaucugaacuucccaac

SEQ ID NO: 229441 - RNA, 22 nt, Human
uauuucaugagugaauaucuag

SEQ ID NO: 229442 - RNA, 22 nt, Human
ucuuuugaacauccaggauguc

SEQ ID NO: 229443 - RNA, 22 nt, Human
ucuuuugugauuuucugaagca

SEQ ID NO: 229444 - RNA, 22 nt, Human
ucuuuucagccagcugguagga

SEQ ID NO: 229445 - RNA, 22 nt, Human
uauuuuagccaacagaaugaug

SEQ ID NO: 229446 - RNA, 22 nt, Human
uauuuuagaagauuuggagaaa

SEQ ID NO: 229447 - RNA, 22 nt, Human
uauuuucucugccacacuucca

SEQ ID NO: 229448 - RNA, 22 nt, Human
ugaaaggaauuuaaauguuguu

SEQ ID NO: 229449 - RNA, 22 nt, Human
ugaaagcuggcucugcagagug

SEQ ID NO: 229450 - RNA, 22 nt, Human
ugaaaaauauuuuuagaaauaa

SEQ ID NO: 229451 - RNA, 22 nt, Human
ucaaaggcuugugguucuggga

SEQ ID NO: 229452 - RNA, 22 nt, Human
ucaaagaucuuugcuuuugggg

SEQ ID NO: 229453 - RNA, 22 nt, Human
uauuuuucacagauuggugcuu

SEQ ID NO: 229454 - RNA, 22 nt, Human
ucaaaaauaagauauucuggac

SEQ ID NO: 229455 - RNA, 22 nt, Human
ugaagccaugcuaaauguuaca

SEQ ID NO: 229456 - RNA, 22 nt, Human
ucaacauguuuuuuaaaagaaa

SEQ ID NO: 229457 - RNA, 21 nt, Human
ugaacaccaggagaaaucggu

SEQ ID NO: 229458 - RNA, 22 nt, Human
ugaacuaauguuguguccuaau

SEQ ID NO: 229459 - RNA, 22 nt, Human
ugaaccaugaauuacaggagca

SEQ ID NO: 229460 - RNA, 22 nt, Human
ugaaccgcuucauggugccugu

SEQ ID NO: 229461 - RNA, 22 nt, Human
ugaacuucccauguacagacug

SEQ ID NO: 229462 - RNA, 22 nt, Human
ugaacuguccuuguugucuaga

SEQ ID NO: 229463 - RNA, 22 nt, Human
ugaacuggauuugugagcuccu

SEQ ID NO: 229464 - RNA, 22 nt, Human
uauuuuuaccuaauuuaugaga

SEQ ID NO: 229465 - RNA, 22 nt, Human
ucuuugcugacacuuacacugu

SEQ ID NO: 229466 - RNA, 22 nt, Human
ucuuugcauggacauguguuuu

SEQ ID NO: 229467 - RNA, 22 nt, Human
ucuuuguuagucagaauugauc

SEQ ID NO: 229468 - RNA, 22 nt, Human
uauuuacuguguucaucccucu

SEQ ID NO: 229469 - RNA, 18 nt, Human
uauuuacuguguguuacc

SEQ ID NO: 229470 - RNA, 22 nt, Human
ucuuugcagaauuuaacuuugc

SEQ ID NO: 229471 - RNA, 22 nt, Human
uauuuaaagucagcaacuuuuc

SEQ ID NO: 229472 - RNA, 22 nt, Human
uauuguuuuaagguguauuaau

SEQ ID NO: 229473 - RNA, 22 nt, Human
ucuuucucauccaaacuaguug

SEQ ID NO: 229474 - RNA, 22 nt, Human
uauugucuuuuucuuccaccug

SEQ ID NO: 229475 - RNA, 22 nt, Human
ucuuggcaguucuugugcuuuu

SEQ ID NO: 229476 - RNA, 22 nt, Human
ucuugcuguggcagaucuggag

SEQ ID NO: 229477 - RNA, 22 nt, Human
ucuuguuaaagguuaaagguga

SEQ ID NO: 229478 - RNA, 20 nt, Human
ucuugucuggcagccuggag

SEQ ID NO: 229479 - RNA, 22 nt, Human
ucuugccuuuucuagcuucuag

SEQ ID NO: 229480 - RNA, 22 nt, Human
ucuucuuugugguugcccaagg

SEQ ID NO: 229481 - RNA, 22 nt, Human
ucuugauggugauguuguguca

SEQ ID NO: 229482 - RNA, 22 nt, Human
ucuucuuauuuuaugaucgcuu

SEQ ID NO: 229483 - RNA, 22 nt, Human
uauugauuuuguugcuaccugg

SEQ ID NO: 229484 - RNA, 22 nt, Human
uauugguagauggagagagaca

SEQ ID NO: 229485 - RNA, 22 nt, Human
uauucuucaacuuuucuccucu

SEQ ID NO: 229486 - RNA, 22 nt, Human
uauugaucuuugaaaccuuggu

SEQ ID NO: 229487 - RNA, 22 nt, Human
ucuucuuaggaaagucaggagg

SEQ ID NO: 229488 - RNA, 22 nt, Human
ucuuccucuccuggggcauuug

SEQ ID NO: 229489 - RNA, 22 nt, Human
ucuuccagauacuuccugacuu

SEQ ID NO: 229490 - RNA, 22 nt, Human
ucuuccauuccccuccuacgcc

SEQ ID NO: 229491 - RNA, 21 nt, Human
ucuagaugggaugaaaggugc

SEQ ID NO: 229492 - RNA, 22 nt, Human
uaguggcccagcauuucucaau

SEQ ID NO: 229493 - RNA, 22 nt, Human
uagugggguccacuuccuucac

SEQ ID NO: 229494 - RNA, 22 nt, Human
uaguggaaacagacugagcccg

SEQ ID NO: 229495 - RNA, 22 nt, Human
ugacuuauuaaaaguuuuuauu

SEQ ID NO: 229496 - RNA, 22 nt, Human
ucaggcgcucuucguggcugcc

SEQ ID NO: 229497 - RNA, 22 nt, Human
ugaggcuuucacuuggcaaaga

SEQ ID NO: 229498 - RNA, 20 nt, Human
ugagaaacaagggcuggucu

SEQ ID NO: 229499 - RNA, 22 nt, Human
ugagguuacauuaggaauaacc

SEQ ID NO: 229500 - RNA, 22 nt, Human
ugagucaccucucagaagccac

SEQ ID NO: 229501 - RNA, 20 nt, Human
ugagucagcugcaugggugg

SEQ ID NO: 229502 - RNA, 22 nt, Human
ugagguugggaggacugccuaa

SEQ ID NO: 229503 - RNA, 19 nt, Human
ugaguacuaaugagauuga

SEQ ID NO: 229504 - RNA, 22 nt, Human
ugaggggaggggagaaaauggu

SEQ ID NO: 229505 - RNA, 22 nt, Human
ugaguuuaggccaggauauggu

SEQ ID NO: 229506 - RNA, 22 nt, Human
ugagugugugucuuggguaccg

SEQ ID NO: 229507 - RNA, 22 nt, Human
ugauagcaugcucucaguaaaa

SEQ ID NO: 229508 - RNA, 22 nt, Human
ugaguugucacaacgucacaag

SEQ ID NO: 229509 - RNA, 22 nt, Human
ugaguuucuuacucaggagcug

SEQ ID NO: 229510 - RNA, 22 nt, Human
ucauaucauuuugaaagcugag

SEQ ID NO: 229511 - RNA, 22 nt, Human
ugagucuguugcuagggggaau

SEQ ID NO: 229512 - RNA, 22 nt, Human
ugagugugugcugcuuacauuc

SEQ ID NO: 229513 - RNA, 22 nt, Human
ugagucugaagagagaauaagg

SEQ ID NO: 229514 - RNA, 22 nt, Human
ugagugggaggugggaagggua

SEQ ID NO: 229515 - RNA, 22 nt, Human
ugaguguuguaaccauaugauu

SEQ ID NO: 229516 - RNA, 22 nt, Human
ugaguuagcucuauucuuuugg

SEQ ID NO: 229517 - RNA, 22 nt, Human
ucauuguuucugcuuuucauga

SEQ ID NO: 229518 - RNA, 22 nt, Human
ucauuguuuacugucuuuuuuc

SEQ ID NO: 229519 - RNA, 22 nt, Human
ucauugguugcauaauuugauc

SEQ ID NO: 229520 - RNA, 23 nt, Human
ucauugcucaagauaaugguuga

SEQ ID NO: 229521 - RNA, 22 nt, Human
ugaucauugaacaucgaguuaa

SEQ ID NO: 229522 - RNA, 22 nt, Human
ucauuauuuggaauaugggacu

SEQ ID NO: 229523 - RNA, 22 nt, Human
ucauuuaucgcugccuuuuaaa

SEQ ID NO: 229524 - RNA, 21 nt, Human
uccaaaggagacugagugugu

SEQ ID NO: 229525 - RNA, 22 nt, Human
ugaugaucaugcagguugguuu

SEQ ID NO: 229526 - RNA, 22 nt, Human
uccaaguuugagacugagagug

SEQ ID NO: 229527 - RNA, 22 nt, Human
uccaaugugccuuauuuugagc

SEQ ID NO: 229528 - RNA, 22 nt, Human
uccaagacagauaccuagaaga

SEQ ID NO: 229529 - RNA, 22 nt, Human
uccagguuuggcuuuauaacuu

SEQ ID NO: 229530 - RNA, 22 nt, Human
uccagguccuacuggcccauag

SEQ ID NO: 229531 - RNA, 22 nt, Human
uccaggucgggggugggccggc

SEQ ID NO: 229532 - RNA, 22 nt, Human
uccagugccagcuguuaaaguu

SEQ ID NO: 229533 - RNA, 22 nt, Human
ugauuuggcaucaguguauccu

SEQ ID NO: 229534 - RNA, 22 nt, Human
ugauuuguuuaaauugcucguu

SEQ ID NO: 229535 - RNA, 20 nt, Human
uccaguuuuggagacauucu

SEQ ID NO: 229536 - RNA, 22 nt, Human
ugcaaauuuuuuuauuuuuccu

SEQ ID NO: 229537 - RNA, 22 nt, Human
ugcaaaaguuuuauacacagau

SEQ ID NO: 229538 - RNA, 23 nt, Human
ugcaaaauuugcagaguucgaug

SEQ ID NO: 229539 - RNA, 22 nt, Human
uccagugguggcucccggaccu

SEQ ID NO: 229540 - RNA, 22 nt, Human
uccauacuggccucuuucccag

SEQ ID NO: 229541 - RNA, 23 nt, Human
uccaagagagauuuuaaauuucu

SEQ ID NO: 229542 - RNA, 22 nt, Human
uccaccuaagucuccgggagcu

SEQ ID NO: 229543 - RNA, 17 nt, Human
uccauugagacaagaag

SEQ ID NO: 229544 - RNA, 23 nt, Human
ugcaaugcagcuagauguaaaau

SEQ ID NO: 229545 - RNA, 16 nt, Human
ugcaccgggaacacug

SEQ ID NO: 229546 - RNA, 22 nt, Human
ugcacauuucucacaauguaca

SEQ ID NO: 229547 - RNA, 22 nt, Human
ugcacagagggaggcauaaaau

SEQ ID NO: 229548 - RNA, 21 nt, Human
ugcaacugaaaggaauauggu

SEQ ID NO: 229549 - RNA, 19 nt, Human
ugcaagcuuuuucuuguua

SEQ ID NO: 229550 - RNA, 22 nt, Human
ugcaaggcacccacucugcuuu

SEQ ID NO: 229551 - RNA, 22 nt, Human
ugcagcgugaggacagcugagc

SEQ ID NO: 229552 - RNA, 20 nt, Human
ugcagcucccccgcaguuuc

SEQ ID NO: 229553 - RNA, 18 nt, Human
ugcagcuuugugauuggc

SEQ ID NO: 229554 - RNA, 22 nt, Human
ugcagccucacgcauccgcauu

SEQ ID NO: 229555 - RNA, 22 nt, Human
uccccgcugcgcccgcugcugc

SEQ ID NO: 229556 - RNA, 22 nt, Human
ugcacgcgcccuucgauggccc

SEQ ID NO: 229557 - RNA, 22 nt, Human
ugcacgcacuugcucuccagcg

SEQ ID NO: 229558 - RNA, 22 nt, Human
ugcagaacacaguagacagaac

SEQ ID NO: 229559 - RNA, 22 nt, Human
ugcucugcuaggagaagaauga

SEQ ID NO: 229560 - RNA, 22 nt, Human
ugcucgggcuccuuugagugag

SEQ ID NO: 229561 - RNA, 22 nt, Human
ucgggcgaauguuguuuuucuc

SEQ ID NO: 229562 - RNA, 22 nt, Human
ucgggaggaggcggagcucguu

SEQ ID NO: 229563 - RNA, 22 nt, Human
ucggguguguguguuggguaug

SEQ ID NO: 229564 - RNA, 23 nt, Human
ucgucgucagccacuaccucccc

SEQ ID NO: 229565 - RNA, 22 nt, Human
ugcucuguucaguguaucuugu

SEQ ID NO: 229566 - RNA, 22 nt, Human
ugcucuguuuuaacucuuucaa

SEQ ID NO: 229567 - RNA, 22 nt, Human
ugcucuuuguagcugcuuugcu

SEQ ID NO: 229568 - RNA, 22 nt, Human
ugcucuuucaggcauagaccuu

SEQ ID NO: 229569 - RNA, 22 nt, Human
ucguggaugaagaauagaggcc

SEQ ID NO: 229570 - RNA, 22 nt, Human
ucuaaugcuuccucucauccca

SEQ ID NO: 229571 - RNA, 22 nt, Human
ugcugacuauacauuuagcauu

SEQ ID NO: 229572 - RNA, 22 nt, Human
ucuaaucuacaaaaggaaauuc

SEQ ID NO: 229573 - RNA, 22 nt, Human
ugcuaucuagaaauacuggguu

SEQ ID NO: 229574 - RNA, 22 nt, Human
ugcuacaucuacugguaagggu

SEQ ID NO: 229575 - RNA, 22 nt, Human
ugcuaaugaauggaggaucuga

SEQ ID NO: 229576 - RNA, 22 nt, Human
ugcuauccagacacauaugauc

SEQ ID NO: 229577 - RNA, 22 nt, Human
ugcuagggcaggaggugaggag

SEQ ID NO: 229578 - RNA, 22 nt, Human
ucggccggagggggcgggcgca

SEQ ID NO: 229579 - RNA, 22 nt, Human
ugcucacugcuuguguucaguu

SEQ ID NO: 229580 - RNA, 20 nt, Human
ugcuccaggaacacuggccg

SEQ ID NO: 229581 - RNA, 22 nt, Human
ugcuccguucuucugcuucuug

SEQ ID NO: 229582 - RNA, 22 nt, Human
ugcggcucaaagggaaggccuu

SEQ ID NO: 229583 - RNA, 22 nt, Human
ucgauccaggaaggcugguuua

SEQ ID NO: 229584 - RNA, 22 nt, Human
ucgaugcuggcgcagguuucac

SEQ ID NO: 229585 - RNA, 22 nt, Human
ugcggugcagcccugcccucuc

SEQ ID NO: 229586 - RNA, 22 nt, Human
ugcggugcgcccgggcgagugc

SEQ ID NO: 229587 - RNA, 19 nt, Human
ugcgggcugcggucagggc

SEQ ID NO: 229588 - RNA, 22 nt, Human
ugcguggauuuaggagugaggg

SEQ ID NO: 229589 - RNA, 22 nt, Human
uccguugaggcugccaggcgag

SEQ ID NO: 229590 - RNA, 22 nt, Human
ugcaugcagcuggucgggcgcc

SEQ ID NO: 229591 - RNA, 23 nt, Human
ugcaugagcaucuccaccucagu

SEQ ID NO: 229592 - RNA, 22 nt, Human
ucccuugauauccuuuuaaugg

SEQ ID NO: 229593 - RNA, 23 nt, Human
ucccuuuguucuugcuaggaugu

SEQ ID NO: 229594 - RNA, 22 nt, Human
ugcagcuucucugcaacaggag

SEQ ID NO: 229595 - RNA, 22 nt, Human
ucccuuuucauccuaucccagc

SEQ ID NO: 229596 - RNA, 22 nt, Human
ugcauucugaacguaaauguga

SEQ ID NO: 229597 - RNA, 22 nt, Human
ugcauguuuuaagugaagcuga

SEQ ID NO: 229598 - RNA, 22 nt, Human
ugcauugccauagcagggggau

SEQ ID NO: 229599 - RNA, 22 nt, Human
ugcauucugggucgcagagugg

SEQ ID NO: 229600 - RNA, 22 nt, Human
ugccaaugauuccacaauggaa

SEQ ID NO: 229601 - RNA, 22 nt, Human
ugccaauuaccuauuucugaga

SEQ ID NO: 229602 - RNA, 22 nt, Human
ugccaguaauuguccuguagcu

SEQ ID NO: 229603 - RNA, 22 nt, Human
ugccauuggucuuaaggcuagc

SEQ ID NO: 229604 - RNA, 22 nt, Human
ugccauauuuugaggauguaca

SEQ ID NO: 229605 - RNA, 22 nt, Human
ugccaucuuugccccuauuuua

SEQ ID NO: 229606 - RNA, 22 nt, Human
ugccaucaugucagauuuggga

SEQ ID NO: 229607 - RNA, 22 nt, Human
uccugggcuugcucuuuccauu

SEQ ID NO: 229608 - RNA, 22 nt, Human
ugcccugcagacccugcagugu

SEQ ID NO: 229609 - RNA, 22 nt, Human
ugcccuuucuccagugaccauu

SEQ ID NO: 229610 - RNA, 22 nt, Human
uccucugagguccucucggcca

SEQ ID NO: 229611 - RNA, 22 nt, Human
uccugagaagcacuuaauacac

SEQ ID NO: 229612 - RNA, 22 nt, Human
ugcccugucccuagguuugugg

SEQ ID NO: 229613 - RNA, 22 nt, Human
ugccgccgugggucccgacgcg

SEQ ID NO: 229614 - RNA, 22 nt, Human
uccuucagaggacggcagccag

SEQ ID NO: 229615 - RNA, 22 nt, Human
ugccuggugcggagugaguggc

SEQ ID NO: 229616 - RNA, 22 nt, Human
ucgaaugccaacaccgaaguuu

SEQ ID NO: 229617 - RNA, 22 nt, Human
uccuuuuuagguuauuguacau

SEQ ID NO: 229618 - RNA, 22 nt, Human
uccuuucaaauuuauuugacau

SEQ ID NO: 229619 - RNA, 22 nt, Human
uccuucuuuucgccggaguuga

SEQ ID NO: 229620 - RNA, 22 nt, Human
uggauucucuguagccugguuc

SEQ ID NO: 229621 - RNA, 18 nt, Human
uggcaaugccaaaggcuu

SEQ ID NO: 229622 - RNA, 22 nt, Human
ucuuauugguaaugauggcauu

SEQ ID NO: 229623 - RNA, 22 nt, Human
ucuuauugugaugaugaagaac

SEQ ID NO: 229624 - RNA, 22 nt, Human
uggcagaaugaagacuggggcc

SEQ ID NO: 229625 - RNA, 22 nt, Human
uggcacaguuaaaguuguagaa

SEQ ID NO: 229626 - RNA, 22 nt, Human
uggcacagcuugucauaaacuc

SEQ ID NO: 229627 - RNA, 22 nt, Human
uggauuguuuacaucaugucug

SEQ ID NO: 229628 - RNA, 22 nt, Human
uggauauagcugaggugucuug

SEQ ID NO: 229629 - RNA, 22 nt, Human
uggaguuuuaaucuguacagaa

SEQ ID NO: 229630 - RNA, 22 nt, Human
uggaugagugaauggauaaauc

SEQ ID NO: 229631 - RNA, 22 nt, Human
uggaugccauuugauuaaggcu

SEQ ID NO: 229632 - RNA, 22 nt, Human
uggaugcuccaaguagaccuua

SEQ ID NO: 229633 - RNA, 22 nt, Human
ucuguuuuucagaccuuuuugg

SEQ ID NO: 229634 - RNA, 22 nt, Human
uggauuagugcugaaaugaugg

SEQ ID NO: 229635 - RNA, 22 nt, Human
uggagucucacuuccuggaauu

SEQ ID NO: 229636 - RNA, 22 nt, Human
uggaguuuauuugaauucuugg

SEQ ID NO: 229637 - RNA, 22 nt, Human
uggagucuugcuuugggagugc

SEQ ID NO: 229638 - RNA, 22 nt, Human
uggcaggggaaaagggguggga

SEQ ID NO: 229639 - RNA, 22 nt, Human
ucuucuuuccuuuugugcauuu

SEQ ID NO: 229640 - RNA, 22 nt, Human
uggcagccucugguccuuaguu

SEQ ID NO: 229641 - RNA, 22 nt, Human
uggcaguaaagcuggaaaagug

SEQ ID NO: 229642 - RNA, 22 nt, Human
uggccaaucagcugugaccugc

SEQ ID NO: 229643 - RNA, 22 nt, Human
uggccagucuuagcugugccug

SEQ ID NO: 229644 - RNA, 22 nt, Human
ucuugcuguagcuguuucuucu

SEQ ID NO: 229645 - RNA, 19 nt, Human
ucuugaggaaaguaaggca

SEQ ID NO: 229646 - RNA, 22 nt, Human
ucuugccccugcuuuggaacaa

SEQ ID NO: 229647 - RNA, 23 nt, Human
ucuuuccuuucauacagucagcu

SEQ ID NO: 229648 - RNA, 19 nt, Human
ucuuucauuucuagcucug

SEQ ID NO: 229649 - RNA, 22 nt, Human
ucuuuccagaccagccccagcu

SEQ ID NO: 229650 - RNA, 22 nt, Human
ucuuuauuucccuaacuugcua

SEQ ID NO: 229651 - RNA, 20 nt, Human
uggcccagcacgacgaggac

SEQ ID NO: 229652 - RNA, 22 nt, Human
uggcccaucagggcaccugaga

SEQ ID NO: 229653 - RNA, 22 nt, Human
ucuuggggagacuaguguuugg

SEQ ID NO: 229654 - RNA, 22 nt, Human
ucuuggucccugagcucuuuca

SEQ ID NO: 229655 - RNA, 22 nt, Human
ucuuuaaauucuuaugagugaa

SEQ ID NO: 229656 - RNA, 22 nt, Human
ucuugugagcugagauaaagcc

SEQ ID NO: 229657 - RNA, 22 nt, Human
uggagagauagucauucuagag

SEQ ID NO: 229658 - RNA, 22 nt, Human
uggagagaaguucuauaaauca

SEQ ID NO: 229659 - RNA, 22 nt, Human
uggagaaauaacauuuggauuc

SEQ ID NO: 229660 - RNA, 22 nt, Human
uggacuguucauugauacugga

SEQ ID NO: 229661 - RNA, 22 nt, Human
uggacagugguggggaggagga

SEQ ID NO: 229662 - RNA, 22 nt, Human
uggaaugccgggccaggcuccg

SEQ ID NO: 229663 - RNA, 22 nt, Human
uggaaugaaagaaaaauuguag

SEQ ID NO: 229664 - RNA, 22 nt, Human
uggaaggggagcuggaaagggg

SEQ ID NO: 229665 - RNA, 20 nt, Human
uggaaggaaagguguaucuu

SEQ ID NO: 229666 - RNA, 22 nt, Human
uggaaggaaauguguaucauaa

SEQ ID NO: 229667 - RNA, 22 nt, Human
uggaagaucugguguagcuccu

SEQ ID NO: 229668 - RNA, 22 nt, Human
ucugggccacccgccuccaggg

SEQ ID NO: 229669 - RNA, 22 nt, Human
ucugggagaguagauaaaggaa

SEQ ID NO: 229670 - RNA, 22 nt, Human
uggagccuugugagaccacaau

SEQ ID NO: 229671 - RNA, 22 nt, Human
uggagcugaaguacucucacua

SEQ ID NO: 229672 - RNA, 17 nt, Human
ucuguguccgcucaguc

SEQ ID NO: 229673 - RNA, 22 nt, Human
uggagccugauggauaggaacg

SEQ ID NO: 229674 - RNA, 22 nt, Human
uggagaugcacgagcaggugga

SEQ ID NO: 229675 - RNA, 22 nt, Human
uggaggauggaaggaaagcugg

SEQ ID NO: 229676 - RNA, 22 nt, Human
uggaggauaacacaagaaguga

SEQ ID NO: 229677 - RNA, 22 nt, Human
uggaggaggagaacuuggcacu

SEQ ID NO: 229678 - RNA, 22 nt, Human
ugcugccucccaucccucccga

SEQ ID NO: 229679 - RNA, 22 nt, Human
ugcugccgccgccaccgccgcc

SEQ ID NO: 229680 - RNA, 19 nt, Human
ugcugcaggaauucucaag

SEQ ID NO: 229681 - RNA, 22 nt, Human
ucuaccuucagaaugugggguu

SEQ ID NO: 229682 - RNA, 22 nt, Human
uggaaauagauguaggaaauug

SEQ ID NO: 229683 - RNA, 17 nt, Human
ucugcagaggcaaaccu

SEQ ID NO: 229684 - RNA, 21 nt, Human
ucugccaguuucucuuacuuu

SEQ ID NO: 229685 - RNA, 22 nt, Human
uggaaaggcccauaaaaggaua

SEQ ID NO: 229686 - RNA, 22 nt, Human
uggaaaggaguucuguuuauuu

SEQ ID NO: 229687 - RNA, 22 nt, Human
uggaaagcagcccugcucccca

SEQ ID NO: 229688 - RNA, 22 nt, Human
uggaacugguuugcuucagacu

SEQ ID NO: 229689 - RNA, 22 nt, Human
uggaagaaaugguugagccaug

SEQ ID NO: 229690 - RNA, 22 nt, Human
ucuggaaauggaaguaacuaug

SEQ ID NO: 229691 - RNA, 22 nt, Human
ucugcccaggaggucccauggg

SEQ ID NO: 229692 - RNA, 17 nt, Human
ucugccaguuuuagaau

SEQ ID NO: 229693 - RNA, 22 nt, Human
ucugccuucaggagcagacucu

SEQ ID NO: 229694 - RNA, 23 nt, Human
ucugccuccuaauuguugguguc

SEQ ID NO: 229695 - RNA, 22 nt, Human
ucugcggccuagcgcccggcgc

SEQ ID NO: 229696 - RNA, 22 nt, Human
uggaaaugcuuagaggugaucu

SEQ ID NO: 229697 - RNA, 22 nt, Human
uggggcggaaggaggagaggug

SEQ ID NO: 229698 - RNA, 22 nt, Human
uggggcuauggcccgaccacgu

SEQ ID NO: 229699 - RNA, 22 nt, Human
uggggcuggccaggaggagucu

SEQ ID NO: 229700 - RNA, 22 nt, Human
ugaaugaacugaugaacuuaac

SEQ ID NO: 229701 - RNA, 22 nt, Human
ugaaucuuguuuacugauuccu

SEQ ID NO: 229702 - RNA, 22 nt, Human
ugggggagggagaguugauggg

SEQ ID NO: 229703 - RNA, 22 nt, Human
ugggggaggaggagacagacug

SEQ ID NO: 229704 - RNA, 22 nt, Human
ugaauggugcccuagagggaug

SEQ ID NO: 229705 - RNA, 22 nt, Human
ugaaugaagcacuguaauucuc

SEQ ID NO: 229706 - RNA, 22 nt, Human
ugaaugaguucaccgcucaguu

SEQ ID NO: 229707 - RNA, 22 nt, Human
ugaauuacacugggaucagggc

SEQ ID NO: 229708 - RNA, 22 nt, Human
ugaauuagagugaaggaaagcu

SEQ ID NO: 229709 - RNA, 22 nt, Human
ugaauuuuaacauucugcugga

SEQ ID NO: 229710 - RNA, 22 nt, Human
ugaauucaaacuuuuuaacaag

SEQ ID NO: 229711 - RNA, 22 nt, Human
ugacagugugcccggagguuag

SEQ ID NO: 229712 - RNA, 22 nt, Human
ugacaguuugacugcaaccuuu

SEQ ID NO: 229713 - RNA, 22 nt, Human
ugacagucacagcagaaacucg

SEQ ID NO: 229714 - RNA, 17 nt, Human
ugacagcuaaggggcuu

SEQ ID NO: 229715 - RNA, 22 nt, Human
ugacacacagggggauggaguu

SEQ ID NO: 229716 - RNA, 22 nt, Human
ugacaagagaccccuccgcagg

SEQ ID NO: 229717 - RNA, 22 nt, Human
ugacagaggagcuggaaugauu

SEQ ID NO: 229718 - RNA, 22 nt, Human
ugaaucaaugaauugcacuuca

SEQ ID NO: 229719 - RNA, 22 nt, Human
ugaaucagaccuucauugggua

SEQ ID NO: 229720 - RNA, 22 nt, Human
uggggaagaacuugccauuuca

SEQ ID NO: 229721 - RNA, 21 nt, Human
uggggaugcauugcagaggca

SEQ ID NO: 229722 - RNA, 22 nt, Human
uggggagacauggaguaaaaga

SEQ ID NO: 229723 - RNA, 22 nt, Human
uggggacucacugacuaucuug

SEQ ID NO: 229724 - RNA, 22 nt, Human
ugggccaaaugucugcauaagu

SEQ ID NO: 229725 - RNA, 22 nt, Human
ugaaguuuagaaaaagugccuu

SEQ ID NO: 229726 - RNA, 22 nt, Human
ugaauaaauaaacuuuuacuac

SEQ ID NO: 229727 - RNA, 22 nt, Human
ugaauaaucuuggguauuaaua

SEQ ID NO: 229728 - RNA, 22 nt, Human
ugaaggggaaagucuugcuaua

SEQ ID NO: 229729 - RNA, 21 nt, Human
ugaagggugagauauaaguga

SEQ ID NO: 229730 - RNA, 22 nt, Human
ugggcagagggugaggaaggcg

SEQ ID NO: 229731 - RNA, 22 nt, Human
ugggccacguggagucuguagg

SEQ ID NO: 229732 - RNA, 21 nt, Human
ugaagccuagagaauugggga

SEQ ID NO: 229733 - RNA, 22 nt, Human
ugggauggacuuuagagaaucg

SEQ ID NO: 229734 - RNA, 22 nt, Human
ugggauucucagaaacacagag

SEQ ID NO: 229735 - RNA, 22 nt, Human
ugaacagacuauucucccaugu

SEQ ID NO: 229736 - RNA, 22 nt, Human
ugaaauugaguaccucuuuaua

SEQ ID NO: 229737 - RNA, 22 nt, Human
ugaaauguggagaugguaagua

SEQ ID NO: 229738 - RNA, 22 nt, Human
ugaaaugccucuuugguucuaa

SEQ ID NO: 229739 - RNA, 22 nt, Human
ugaaauuuuuuggagauaauuu

SEQ ID NO: 229740 - RNA, 22 nt, Human
uggcuuuugaaaaggugaugua

SEQ ID NO: 229741 - RNA, 22 nt, Human
uggcuugagcugggcccaccug

SEQ ID NO: 229742 - RNA, 22 nt, Human
uggcuucuggccaggcacagga

SEQ ID NO: 229743 - RNA, 22 nt, Human
uggcuucagacuucugcuacgu

SEQ ID NO: 229744 - RNA, 22 nt, Human
uggcuucugguuuauccuuaua

SEQ ID NO: 229745 - RNA, 22 nt, Human
uggcugaggcuuuucuuaaaga

SEQ ID NO: 229746 - RNA, 22 nt, Human
uggcugaugucuguucuguuau

SEQ ID NO: 229747 - RNA, 22 nt, Human
uggcugagcugcagcguggcuu

SEQ ID NO: 229748 - RNA, 22 nt, Human
uggcucuucucaagcauuggcu

SEQ ID NO: 229749 - RNA, 23 nt, Human
uggcucugagcuuccugguggcc

SEQ ID NO: 229750 - RNA, 19 nt, Human
ucuuugcuuuucuaagagg

SEQ ID NO: 229751 - RNA, 22 nt, Human
uggccugauuuugcuaagagaa

SEQ ID NO: 229752 - RNA, 22 nt, Human
ugaaagccuacagcucacuguu

SEQ ID NO: 229753 - RNA, 22 nt, Human
ucuuuuaucuguuguguaacaa

SEQ ID NO: 229754 - RNA, 17 nt, Human
ucuuuuacuuucucucc

SEQ ID NO: 229755 - RNA, 22 nt, Human
ugaacuuacauugaggaauucu

SEQ ID NO: 229756 - RNA, 22 nt, Human
ugggaauuuaugagaaaauaua

SEQ ID NO: 229757 - RNA, 22 nt, Human
ugggaaggggagcuggaaagga

SEQ ID NO: 229758 - RNA, 22 nt, Human
ugaagacaguuuuacucaugag

SEQ ID NO: 229759 - RNA, 22 nt, Human
ugaagaauuccauggcuuccau

SEQ ID NO: 229760 - RNA, 22 nt, Human
ugaagccacacuagcuuguccu

SEQ ID NO: 229761 - RNA, 21 nt, Human
ugaagcccugugaggugcuua

SEQ ID NO: 229762 - RNA, 22 nt, Human
ugggauauagaauuggcagagu

SEQ ID NO: 229763 - RNA, 22 nt, Human
ugggaugagcuauauagaaagu

SEQ ID NO: 229764 - RNA, 22 nt, Human
ugggaagaguuagagacagcug

SEQ ID NO: 229765 - RNA, 22 nt, Human
ugaacauuuuugcuugcagcuu

SEQ ID NO: 229766 - RNA, 22 nt, Human
ugaaccugagggcaaagggaca

SEQ ID NO: 229767 - RNA, 22 nt, Human
ugaacagugugagggugugacc

SEQ ID NO: 229768 - RNA, 22 nt, Human
ugggaaaauagcuauuuugaaa

SEQ ID NO: 229769 - RNA, 23 nt, Human
uguauacacccugugcaucuggg

SEQ ID NO: 229770 - RNA, 18 nt, Human
ugauggcuaagagccggg

SEQ ID NO: 229771 - RNA, 22 nt, Human
ugauggaucuguuggcggguuu

SEQ ID NO: 229772 - RNA, 22 nt, Human
uguagcaauauaucagugcaca

SEQ ID NO: 229773 - RNA, 22 nt, Human
ugauguaaaauaggaaguucua

SEQ ID NO: 229774 - RNA, 22 nt, Human
uguauugaggauucauuuuugu

SEQ ID NO: 229775 - RNA, 22 nt, Human
ugauucaguacuuucucuaacu

SEQ ID NO: 229776 - RNA, 22 nt, Human
uguaucucugacacagucucac

SEQ ID NO: 229777 - RNA, 22 nt, Human
ugauguggaucuauaacuguaa

SEQ ID NO: 229778 - RNA, 22 nt, Human
ugauguuucugaagggguuacu

SEQ ID NO: 229779 - RNA, 22 nt, Human
ugauuagauacuucagaugaca

SEQ ID NO: 229780 - RNA, 22 nt, Human
ugauuagccguccuuuuauuaa

SEQ ID NO: 229781 - RNA, 22 nt, Human
ugauguauaaaaagagugaaau

SEQ ID NO: 229782 - RNA, 22 nt, Human
ugauucacgcuucucuuuaaac

SEQ ID NO: 229783 - RNA, 22 nt, Human
uguauuugaagaaagagcuucu

SEQ ID NO: 229784 - RNA, 22 nt, Human
uguauuuuuucccugaaauaaa

SEQ ID NO: 229785 - RNA, 22 nt, Human
ugcaaaaagagcgaggagcccu

SEQ ID NO: 229786 - RNA, 18 nt, Human
uguauuguucacuucugu

SEQ ID NO: 229787 - RNA, 22 nt, Human
ugauugcucgacacucugcuug

SEQ ID NO: 229788 - RNA, 22 nt, Human
uguauuuauuuuucaacuacca

SEQ ID NO: 229789 - RNA, 22 nt, Human
ugauugcucagcuagccucuuu

SEQ ID NO: 229790 - RNA, 22 nt, Human
ugauucuuugaccaaaaaauug

SEQ ID NO: 229791 - RNA, 22 nt, Human
ugcaaauucuuuacucugugau

SEQ ID NO: 229792 - RNA, 22 nt, Human
ugcaagauccagucuugagaag

SEQ ID NO: 229793 - RNA, 22 nt, Human
ugucugcauucgaguucaugga

SEQ ID NO: 229794 - RNA, 21 nt, Human
ugucugcaauuccagggaacc

SEQ ID NO: 229795 - RNA, 22 nt, Human
ugucugggauguuggcagccac

SEQ ID NO: 229796 - RNA, 20 nt, Human
ugucugguaagacgcccauc

SEQ ID NO: 229797 - RNA, 22 nt, Human
ugcacccacuuagcugaaguuc

SEQ ID NO: 229798 - RNA, 23 nt, Human
uggugugaggaaggaagacuuua

SEQ ID NO: 229799 - RNA, 17 nt, Human
ugguucuuuuccugacc

SEQ ID NO: 229800 - RNA, 22 nt, Human
ugguugauuaauuuugccaagc

SEQ ID NO: 229801 - RNA, 22 nt, Human
ugaggucaggcagggguuuggc

SEQ ID NO: 229802 - RNA, 18 nt, Human
ugguuggugggggugaag

SEQ ID NO: 229803 - RNA, 22 nt, Human
ugguugagguugacucuauaua

SEQ ID NO: 229804 - RNA, 22 nt, Human
ugaguucugacugagcaugggg

SEQ ID NO: 229805 - RNA, 22 nt, Human
ugguuuacucuguaaaccagga

SEQ ID NO: 229806 - RNA, 22 nt, Human
ugaguugcagucaauauugcaa

SEQ ID NO: 229807 - RNA, 22 nt, Human
uguaaacuuuugcauacugcuu

SEQ ID NO: 229808 - RNA, 22 nt, Human
ugaucauguucuccaaaagcgu

SEQ ID NO: 229809 - RNA, 22 nt, Human
uguaaauucuauacacuuaaaa

SEQ ID NO: 229810 - RNA, 22 nt, Human
uguaaagguuuuagagcagaga

SEQ ID NO: 229811 - RNA, 22 nt, Human
uguaauucuaauccagagcugg

SEQ ID NO: 229812 - RNA, 22 nt, Human
ugaugaugauacauuucuucag

SEQ ID NO: 229813 - RNA, 22 nt, Human
ugagccauguucaugagguuca

SEQ ID NO: 229814 - RNA, 22 nt, Human
uggugaggacccagauuuuccu

SEQ ID NO: 229815 - RNA, 22 nt, Human
ugagccugaguguguauugaac

SEQ ID NO: 229816 - RNA, 22 nt, Human
ugacaucagacugugagaagag

SEQ ID NO: 229817 - RNA, 22 nt, Human
ugagggaguguggauacaguag

SEQ ID NO: 229818 - RNA, 22 nt, Human
ugguggaggugggggguauuuu

SEQ ID NO: 229819 - RNA, 22 nt, Human
ugaggcaguucuuacuuguauu

SEQ ID NO: 229820 - RNA, 22 nt, Human
uggugcaggauuuauuuaacua

SEQ ID NO: 229821 - RNA, 22 nt, Human
ugagcuauuucaccauauagau

SEQ ID NO: 229822 - RNA, 22 nt, Human
ugagcuuugguaccuucauuug

SEQ ID NO: 229823 - RNA, 22 nt, Human
ugaggaaugugacaaaaccaag

SEQ ID NO: 229824 - RNA, 22 nt, Human
uguuauugccucaugagacucc

SEQ ID NO: 229825 - RNA, 22 nt, Human
uguucaguuugcuaucauaauc

SEQ ID NO: 229826 - RNA, 23 nt, Human
uguuaucacauguuccuuuaaau

SEQ ID NO: 229827 - RNA, 22 nt, Human
uguuccucuuagucuuaugugu

SEQ ID NO: 229828 - RNA, 22 nt, Human
ugcgccaggacacccguggcgg

SEQ ID NO: 229829 - RNA, 22 nt, Human
uguuaaaaagucccuguuuugu

SEQ ID NO: 229830 - RNA, 22 nt, Human
uguguuuuucauuuuaaguccu

SEQ ID NO: 229831 - RNA, 22 nt, Human
uguuaacuuagcugaccuuaaa

SEQ ID NO: 229832 - RNA, 23 nt, Human
ugugugugugugugugugugugu

SEQ ID NO: 229833 - RNA, 22 nt, Human
uguguguguguguguguuugug

SEQ ID NO: 229834 - RNA, 22 nt, Human
uguguucagaagaggcugccgg

SEQ ID NO: 229835 - RNA, 19 nt, Human
uguguguguuuuguuugaa

SEQ ID NO: 229836 - RNA, 22 nt, Human
uguguguucauccccucaacau

SEQ ID NO: 229837 - RNA, 22 nt, Human
uguguuucggauagcagauucu

SEQ ID NO: 229838 - RNA, 22 nt, Human
ugccuguguuugggguggggaa

SEQ ID NO: 229839 - RNA, 22 nt, Human
ugccuucugccaaggacggugc

SEQ ID NO: 229840 - RNA, 17 nt, Human
ugccuucgucuucaguu

SEQ ID NO: 229841 - RNA, 21 nt, Human
uguguuuauauguguuuauau

SEQ ID NO: 229842 - RNA, 22 nt, Human
uguguuuaaacuauaugccugc

SEQ ID NO: 229843 - RNA, 22 nt, Human
uguugagaacaucucggggaca

SEQ ID NO: 229844 - RNA, 22 nt, Human
uguugaucucuuuccaaauucu

SEQ ID NO: 229845 - RNA, 22 nt, Human
uguugaugaccacaauuuaugc

SEQ ID NO: 229846 - RNA, 19 nt, Human
uguugcagcuugaucggua

SEQ ID NO: 229847 - RNA, 22 nt, Human
ugcguugaggaccgcgagggcg

SEQ ID NO: 229848 - RNA, 23 nt, Human
ugcuaaaggcagaauauucaccu

SEQ ID NO: 229849 - RNA, 22 nt, Human
ugcuaaugagugcugugugaag

SEQ ID NO: 229850 - RNA, 21 nt, Human
ugcuaagugucacaugucugc

SEQ ID NO: 229851 - RNA, 21 nt, Human
ugcguaugucuuguauuacuc

SEQ ID NO: 229852 - RNA, 22 nt, Human
ugcguuuaguuucaagacacgu

SEQ ID NO: 229853 - RNA, 22 nt, Human
uguucggaaaagggcaagcuau

SEQ ID NO: 229854 - RNA, 22 nt, Human
ugcgcgccgacggcuccgugac

SEQ ID NO: 229855 - RNA, 23 nt, Human
uguuccugaugccucguccuguc

SEQ ID NO: 229856 - RNA, 22 nt, Human
uguuccuuuuguuguuuuguuu

SEQ ID NO: 229857 - RNA, 22 nt, Human
ugcauaagguuaaauuagcaga

SEQ ID NO: 229858 - RNA, 22 nt, Human
ugcauuauaacaauaaggcuua

SEQ ID NO: 229859 - RNA, 22 nt, Human
ugcauuacuuugauaagcgucu

SEQ ID NO: 229860 - RNA, 22 nt, Human
ugcauugccucuauucauuaua

SEQ ID NO: 229861 - RNA, 22 nt, Human
ugcaguugcguuugcauuccau

SEQ ID NO: 229862 - RNA, 22 nt, Human
uguggccaccagagcugcuauu

SEQ ID NO: 229863 - RNA, 22 nt, Human
ugcaggaagcucagcggggccg

SEQ ID NO: 229864 - RNA, 22 nt, Human
ugcagguuuucagauguguguu

SEQ ID NO: 229865 - RNA, 21 nt, Human
uguggccauuugaaaacaggg

SEQ ID NO: 229866 - RNA, 22 nt, Human
ugugccuagauuccaugcacuc

SEQ ID NO: 229867 - RNA, 22 nt, Human
ugcaggagcccaggaauacuau

SEQ ID NO: 229868 - RNA, 22 nt, Human
ugugcgcgugugcuuugugugu

SEQ ID NO: 229869 - RNA, 22 nt, Human
ugugccuucuucauuuaauuua

SEQ ID NO: 229870 - RNA, 22 nt, Human
ugugcaucuggaggcaauguuu

SEQ ID NO: 229871 - RNA, 20 nt, Human
ugcacggcugugugugugca

SEQ ID NO: 229872 - RNA, 22 nt, Human
ugcacugccuuucuuggcauga

SEQ ID NO: 229873 - RNA, 22 nt, Human
ugucuucagguuccucaccacu

SEQ ID NO: 229874 - RNA, 22 nt, Human
ugucuuaugcugcauagacuau

SEQ ID NO: 229875 - RNA, 20 nt, Human
ugucugugugugauaauagu

SEQ ID NO: 229876 - RNA, 22 nt, Human
ugugugggcgaagacagccuuu

SEQ ID NO: 229877 - RNA, 22 nt, Human
uguguguauauauuuuuauaug

SEQ ID NO: 229878 - RNA, 22 nt, Human
uguguguauauauauguaucau

SEQ ID NO: 229879 - RNA, 22 nt, Human
uguggugcucagggaggauggg

SEQ ID NO: 229880 - RNA, 22 nt, Human
ugugguagagcuuaaaugaggu

SEQ ID NO: 229881 - RNA, 22 nt, Human
uguggugacuugagcuuccuaa

SEQ ID NO: 229882 - RNA, 22 nt, Human
uguggguggucagcgugugaug

SEQ ID NO: 229883 - RNA, 22 nt, Human
ugugggaucguaaauuugggac

SEQ ID NO: 229884 - RNA, 22 nt, Human
ugcccaaucaauuguagcuauu

SEQ ID NO: 229885 - RNA, 22 nt, Human
ugccaugguuguacaguagcag

SEQ ID NO: 229886 - RNA, 22 nt, Human
ugcccacuucaaaaucuucauu

SEQ ID NO: 229887 - RNA, 22 nt, Human
ugugggaucauggaucagggcc

SEQ ID NO: 229888 - RNA, 22 nt, Human
ugccauagccacugaggugagu

SEQ ID NO: 229889 - RNA, 22 nt, Human
ugcauuuucuaccacacccacu

SEQ ID NO: 229890 - RNA, 22 nt, Human
uugcugggauucauugaagggu

SEQ ID NO: 229891 - RNA, 22 nt, Human
ugugcuugucuguuuugauugu

SEQ ID NO: 229892 - RNA, 22 nt, Human
uguggauauauuuuaaaaggaa

SEQ ID NO: 229893 - RNA, 22 nt, Human
uugcugaggcuggggagaggug

SEQ ID NO: 229894 - RNA, 22 nt, Human
uugcugccagcgcccugcaggg

SEQ ID NO: 229895 - RNA, 22 nt, Human
uguggcuuaggugagcauguga

SEQ ID NO: 229896 - RNA, 22 nt, Human
ugugggaggauuuaggugaauc

SEQ ID NO: 229897 - RNA, 22 nt, Human
uugcuuaaaucgcuuaaacugg

SEQ ID NO: 229898 - RNA, 22 nt, Human
ugugcagugcguggguguugaa

SEQ ID NO: 229899 - RNA, 22 nt, Human
ugugcagaaaacacuuaagaac

SEQ ID NO: 229900 - RNA, 22 nt, Human
ugugcaguauugaaauauaugu

SEQ ID NO: 229901 - RNA, 22 nt, Human
ugugccuuucacuaugucauuc

SEQ ID NO: 229902 - RNA, 22 nt, Human
uugcucaugucaccaaagcaca

SEQ ID NO: 229903 - RNA, 20 nt, Human
uugcucucuuguguugaugu

SEQ ID NO: 229904 - RNA, 22 nt, Human
ugugcugcagcgagagcuacga

SEQ ID NO: 229905 - RNA, 22 nt, Human
ugugcgucuguguacagaugug

SEQ ID NO: 229906 - RNA, 22 nt, Human
ugugcuaauguuaggauugaau

SEQ ID NO: 229907 - RNA, 22 nt, Human
uugcucuuaccauuauguguga

SEQ ID NO: 229908 - RNA, 22 nt, Human
ugugcuggcuucugugagcuga

SEQ ID NO: 229909 - RNA, 17 nt, Human
uguguaaguugcauaga

SEQ ID NO: 229910 - RNA, 19 nt, Human
uuggagcaucccaaaggcu

SEQ ID NO: 229911 - RNA, 22 nt, Human
uguguaacaacauaaugguuau

SEQ ID NO: 229912 - RNA, 22 nt, Human
ugugguuuguaagcaaagcaaa

SEQ ID NO: 229913 - RNA, 22 nt, Human
ugugguuggggucagauaggga

SEQ ID NO: 229914 - RNA, 22 nt, Human
uguggugcagcgggaacagcuu

SEQ ID NO: 229915 - RNA, 22 nt, Human
ugugugcuaguuuugucaguau

SEQ ID NO: 229916 - RNA, 22 nt, Human
uuggauguccucuguggaguau

SEQ ID NO: 229917 - RNA, 22 nt, Human
uuggauagaauuuaaauugucu

SEQ ID NO: 229918 - RNA, 22 nt, Human
uguguggccuccauaggguacu

SEQ ID NO: 229919 - RNA, 22 nt, Human
uuggaggcagagucuugcugag

SEQ ID NO: 229920 - RNA, 22 nt, Human
uuggaggucucugugguggugg

SEQ ID NO: 229921 - RNA, 22 nt, Human
uugcuuuuuuggguuuacuggg

SEQ ID NO: 229922 - RNA, 22 nt, Human
ugugggcguggguuggggaggg

SEQ ID NO: 229923 - RNA, 23 nt, Human
uugcuugagcccaggaaguggag

SEQ ID NO: 229924 - RNA, 22 nt, Human
uugcuugcggccuuugugccuu

SEQ ID NO: 229925 - RNA, 22 nt, Human
uugcuuucuuuguagguuuucc

SEQ ID NO: 229926 - RNA, 23 nt, Human
uugcuuuugccccaaaagaguua

SEQ ID NO: 229927 - RNA, 22 nt, Human
uguuccggucuaucgugucaau

SEQ ID NO: 229928 - RNA, 22 nt, Human
uguucccgaugacaggaccagg

SEQ ID NO: 229929 - RNA, 22 nt, Human
uguuacugaaugucucugcuuu

SEQ ID NO: 229930 - RNA, 22 nt, Human
uuggcuucuugcuaggaagcug

SEQ ID NO: 229931 - RNA, 22 nt, Human
uguuaacugccaggacagaucg

SEQ ID NO: 229932 - RNA, 22 nt, Human
uuggccugcuccagaacaaggg

SEQ ID NO: 229933 - RNA, 22 nt, Human
uguguguauauauggaauauug

SEQ ID NO: 229934 - RNA, 22 nt, Human
uuggggaaaaagaccuaaugac

SEQ ID NO: 229935 - RNA, 22 nt, Human
uugggauuggugggguggguuu

SEQ ID NO: 229936 - RNA, 22 nt, Human
uugggcauuucuuauguauuuu

SEQ ID NO: 229937 - RNA, 20 nt, Human
uguuccgugguguccuuuuc

SEQ ID NO: 229938 - RNA, 22 nt, Human
uugggauucugucagugugugu

SEQ ID NO: 229939 - RNA, 22 nt, Human
uguugauuaauuuucccaaaca

SEQ ID NO: 229940 - RNA, 22 nt, Human
uguugaaacagcuauugacuuu

SEQ ID NO: 229941 - RNA, 22 nt, Human
uguugaagcaccucugucuuuc

SEQ ID NO: 229942 - RNA, 22 nt, Human
uguucuucaaacucaguuccac

SEQ ID NO: 229943 - RNA, 22 nt, Human
uguucuuaacuuuuguguauau

SEQ ID NO: 229944 - RNA, 22 nt, Human
uguuggugcacugaaaggcagg

SEQ ID NO: 229945 - RNA, 22 nt, Human
uguugguuucaagcaggagccu

SEQ ID NO: 229946 - RNA, 22 nt, Human
uugguuaccuucagaaaugagu

SEQ ID NO: 229947 - RNA, 22 nt, Human
uuguacaaauaggaaccucuga

SEQ ID NO: 229948 - RNA, 22 nt, Human
uuguagaucagauggccaguag

SEQ ID NO: 229949 - RNA, 22 nt, Human
uuguacuuguucuguuuccuug

SEQ ID NO: 229950 - RNA, 22 nt, Human
uuguacccaccuuggggccuca

SEQ ID NO: 229951 - RNA, 22 nt, Human
uuguagccaugucacaagcaca

SEQ ID NO: 229952 - RNA, 22 nt, Human
uguuuccuaagugucucugaag

SEQ ID NO: 229953 - RNA, 22 nt, Human
uguuucaugcagcccccuguca

SEQ ID NO: 229954 - RNA, 22 nt, Human
uguuggaauaagugcuugaagg

SEQ ID NO: 229955 - RNA, 22 nt, Human
uguugccaucuaaaauguuacu

SEQ ID NO: 229956 - RNA, 22 nt, Human
uguugcauguggcuguuugcca

SEQ ID NO: 229957 - RNA, 22 nt, Human
uuggugaugaaagugcugcgcu

SEQ ID NO: 229958 - RNA, 22 nt, Human
uuggugaugcccaccuuuucau

SEQ ID NO: 229959 - RNA, 22 nt, Human
uuggugaugcuaggaauguagu

SEQ ID NO: 229960 - RNA, 22 nt, Human
uuggugauguagcagcaauugu

SEQ ID NO: 229961 - RNA, 22 nt, Human
ugucacguaaaaacuagauuuc

SEQ ID NO: 229962 - RNA, 22 nt, Human
uugauggaggaaaaguuggaau

SEQ ID NO: 229963 - RNA, 22 nt, Human
uugauuugcagaagguguagag

SEQ ID NO: 229964 - RNA, 22 nt, Human
uugauuuggaauuuuuagagcu

SEQ ID NO: 229965 - RNA, 20 nt, Human
ugucccuggagagcugcaga

SEQ ID NO: 229966 - RNA, 22 nt, Human
ugucauggacuggauuucugcu

SEQ ID NO: 229967 - RNA, 22 nt, Human
ugucaucuuucuaaagcugguc

SEQ ID NO: 229968 - RNA, 22 nt, Human
ugucaucuuggugcugugagag

SEQ ID NO: 229969 - RNA, 22 nt, Human
uguaucuguguguauguguuua

SEQ ID NO: 229970 - RNA, 22 nt, Human
uguauauuccagggguagggcc

SEQ ID NO: 229971 - RNA, 22 nt, Human
uguauauuuucuguauaaaaua

SEQ ID NO: 229972 - RNA, 22 nt, Human
uguauauguguguagcauguua

SEQ ID NO: 229973 - RNA, 22 nt, Human
uguauggguaggaaacagcugg

SEQ ID NO: 229974 - RNA, 22 nt, Human
uguauguguuuuauguguguuu

SEQ ID NO: 229975 - RNA, 22 nt, Human
uguauugugggugucagagugc

SEQ ID NO: 229976 - RNA, 22 nt, Human
uugaguuuacauuguauuagcc

SEQ ID NO: 229977 - RNA, 22 nt, Human
ugucaaguuguuaaguucuggg

SEQ ID NO: 229978 - RNA, 19 nt, Human
uguauuuauauuucugugc

SEQ ID NO: 229979 - RNA, 23 nt, Human
ugucugccuaucaugugaaggac

SEQ ID NO: 229980 - RNA, 22 nt, Human
uugcacuccagcccgagcaaca

SEQ ID NO: 229981 - RNA, 22 nt, Human
uugcaagcccugaagggcugga

SEQ ID NO: 229982 - RNA, 22 nt, Human
ugucuuucuuucucuugacaga

SEQ ID NO: 229983 - RNA, 22 nt, Human
ugucuuugaccuuaagaaguuu

SEQ ID NO: 229984 - RNA, 22 nt, Human
ugucuuuagagugaacagaaga

SEQ ID NO: 229985 - RNA, 17 nt, Human
ugucuuuuuccuccucc

SEQ ID NO: 229986 - RNA, 22 nt, Human
ugugcagaaggagguucuccgg

SEQ ID NO: 229987 - RNA, 22 nt, Human
ugugauaauauuauuagagcuc

SEQ ID NO: 229988 - RNA, 22 nt, Human
ugugaagugaugggugaccgag

SEQ ID NO: 229989 - RNA, 22 nt, Human
ugugaaugacuguguucuuugc

SEQ ID NO: 229990 - RNA, 22 nt, Human
ugugacaugauggcgucaugua

SEQ ID NO: 229991 - RNA, 22 nt, Human
uugaacguguaggaagcugguu

SEQ ID NO: 229992 - RNA, 22 nt, Human
uguagacaugcuuuucugauga

SEQ ID NO: 229993 - RNA, 22 nt, Human
uugaaagaacaauucugugaug

SEQ ID NO: 229994 - RNA, 22 nt, Human
uguacagauaucaggagugagg

SEQ ID NO: 229995 - RNA, 22 nt, Human
uugaaaucuucccuccugucug

SEQ ID NO: 229996 - RNA, 22 nt, Human
uguaauuugguuagauuucuuu

SEQ ID NO: 229997 - RNA, 22 nt, Human
uugaaaaguuuguuacucacau

SEQ ID NO: 229998 - RNA, 22 nt, Human
ugguugugcucuguuugaaagu

SEQ ID NO: 229999 - RNA, 22 nt, Human
ugguugguuaaugugcccauuu

SEQ ID NO: 230000 - RNA, 22 nt, Human
ugguugugcuucuuugccucag

SEQ ID NO: 230001 - RNA, 22 nt, Human
ugguuuguauauguuugugaga

SEQ ID NO: 230002 - RNA, 22 nt, Human
uucuuuucuucccuguuuauua

SEQ ID NO: 230003 - RNA, 22 nt, Human
ugguuuccugauggacacuugg

SEQ ID NO: 230004 - RNA, 22 nt, Human
uucuuuuuagcugguuguaaga

SEQ ID NO: 230005 - RNA, 23 nt, Human
uguaaaacaccguuauugcaccu

SEQ ID NO: 230006 - RNA, 22 nt, Human
uguaaagaaagacgcagaguua

SEQ ID NO: 230007 - RNA, 22 nt, Human
uucuuccagugaaacgugcauc

SEQ ID NO: 230008 - RNA, 19 nt, Human
ugguggaggugcaccugac

SEQ ID NO: 230009 - RNA, 22 nt, Human
uucuuauuuuucguaaauccug

SEQ ID NO: 230010 - RNA, 22 nt, Human
uucuucauucccuuacuuccga

SEQ ID NO: 230011 - RNA, 22 nt, Human
ugguggagucugggggaggcuu

SEQ ID NO: 230012 - RNA, 22 nt, Human
uggugguaggggugguuucuga

SEQ ID NO: 230013 - RNA, 22 nt, Human
ugguggcuuuucguagguucac

SEQ ID NO: 230014 - RNA, 22 nt, Human
ugguggccucaguggcuucugu

SEQ ID NO: 230015 - RNA, 22 nt, Human
uucuuggcacagaugagauucu

SEQ ID NO: 230016 - RNA, 20 nt, Human
ugguguacauuuccauaguu

SEQ ID NO: 230017 - RNA, 22 nt, Human
uggcuuauggguccucccucuu

SEQ ID NO: 230018 - RNA, 22 nt, Human
uucugauacagucccaacacaa

SEQ ID NO: 230019 - RNA, 22 nt, Human
uucugaaacauugcuauuuucc

SEQ ID NO: 230020 - RNA, 22 nt, Human
uucugaaggcaggggcuaucuu

SEQ ID NO: 230021 - RNA, 22 nt, Human
uucugagccacaguaaggaucu

SEQ ID NO: 230022 - RNA, 22 nt, Human
uucugaaccauugagcacugcc

SEQ ID NO: 230023 - RNA, 23 nt, Human
uggugcagcgcaggccggguggc

SEQ ID NO: 230024 - RNA, 22 nt, Human
uggugcagacaggagccccgcu

SEQ ID NO: 230025 - RNA, 22 nt, Human
uucuguuuauaauuugcaguug

SEQ ID NO: 230026 - RNA, 22 nt, Human
uucuguguauggaagaaugucc

SEQ ID NO: 230027 - RNA, 22 nt, Human
uucuguuuaaccuggaaagugu

SEQ ID NO: 230028 - RNA, 22 nt, Human
uuauguugauaggaaucugauu

SEQ ID NO: 230029 - RNA, 22 nt, Human
uuaugugcuuuuugagcucuaa

SEQ ID NO: 230030 - RNA, 22 nt, Human
ugcucagaagacuuacugguua

SEQ ID NO: 230031 - RNA, 22 nt, Human
ugcuauuuuguuuucaguccau

SEQ ID NO: 230032 - RNA, 22 nt, Human
ugcuauucuuggagcugaugga

SEQ ID NO: 230033 - RNA, 22 nt, Human
uuauucuuagccucgguauuuc

SEQ ID NO: 230034 - RNA, 22 nt, Human
uggagcugguucuggggaagcu

SEQ ID NO: 230035 - RNA, 22 nt, Human
uggaggagaacugauuuggcuu

SEQ ID NO: 230036 - RNA, 22 nt, Human
uuauuuaaaauguagguuggga

SEQ ID NO: 230037 - RNA, 22 nt, Human
uuauuucauguaaaauuuaugu

SEQ ID NO: 230038 - RNA, 22 nt, Human
uuauuucaggcauuuguaaaug

SEQ ID NO: 230039 - RNA, 22 nt, Human
uuauuugguuuuggcuuuagcu

SEQ ID NO: 230040 - RNA, 22 nt, Human
uuauuuuauaaagagaagacuu

SEQ ID NO: 230041 - RNA, 22 nt, Human
uuauuuucgugugugugugugu

SEQ ID NO: 230042 - RNA, 22 nt, Human
uuauuuuguagcucugaucuuu

SEQ ID NO: 230043 - RNA, 22 nt, Human
uuauuuaaguauuuauugaagu

SEQ ID NO: 230044 - RNA, 22 nt, Human
uggaggaugacagagaugggcu

SEQ ID NO: 230045 - RNA, 22 nt, Human
uggagcuuuguguauuuuuaau

SEQ ID NO: 230046 - RNA, 22 nt, Human
uggagcuggcuuguggaaguug

SEQ ID NO: 230047 - RNA, 22 nt, Human
uuauuuuuaggaauguagaggu

SEQ ID NO: 230048 - RNA, 21 nt, Human
uggaggcguaaucacuguuga

SEQ ID NO: 230049 - RNA, 22 nt, Human
uggaguguuggucccacugagg

SEQ ID NO: 230050 - RNA, 22 nt, Human
uggagucagaaugcgacaggcc

SEQ ID NO: 230051 - RNA, 22 nt, Human
uggagguagcugacuccagccc

SEQ ID NO: 230052 - RNA, 19 nt, Human
uggaggcggguggcccaga

SEQ ID NO: 230053 - RNA, 22 nt, Human
uucaacaacuugguucaaaugg

SEQ ID NO: 230054 - RNA, 22 nt, Human
uggaguucauauuggacauaag

SEQ ID NO: 230055 - RNA, 23 nt, Human
uucaccaaugcuguccaaguacc

SEQ ID NO: 230056 - RNA, 22 nt, Human
uucaauuacaucagaaucuaaa

SEQ ID NO: 230057 - RNA, 22 nt, Human
uggauaugaaacaaaacaagag

SEQ ID NO: 230058 - RNA, 21 nt, Human
uggauauugaguaguuucuga

SEQ ID NO: 230059 - RNA, 22 nt, Human
uggauauuuuguaugugcguuu

SEQ ID NO: 230060 - RNA, 22 nt, Human
uggaucaugcgaggccuccccu

SEQ ID NO: 230061 - RNA, 22 nt, Human
uggaugacaaccauuggaagag

SEQ ID NO: 230062 - RNA, 20 nt, Human
uggaugacuucaggcagccu

SEQ ID NO: 230063 - RNA, 22 nt, Human
uggauuguauugauugguuggc

SEQ ID NO: 230064 - RNA, 22 nt, Human
uggaugccuugggggaggagga

SEQ ID NO: 230065 - RNA, 22 nt, Human
uggcaaggccacaggugcaguu

SEQ ID NO: 230066 - RNA, 22 nt, Human
uggcaacucaauuucuacaaga

SEQ ID NO: 230067 - RNA, 23 nt, Human
uggcaaacgggaauaaaggaauu

SEQ ID NO: 230068 - RNA, 22 nt, Human
uggcaagcuguuggcagauagc

SEQ ID NO: 230069 - RNA, 22 nt, Human
uggcaaacacaauauggguaca

SEQ ID NO: 230070 - RNA, 22 nt, Human
uggcaaaaccugcaauuacuuu

SEQ ID NO: 230071 - RNA, 22 nt, Human
uggcacguuggauugggaguuc

SEQ ID NO: 230072 - RNA, 22 nt, Human
uggcacugcccugucucggugg

SEQ ID NO: 230073 - RNA, 22 nt, Human
uggcacugaagcuggaaagccu

SEQ ID NO: 230074 - RNA, 22 nt, Human
uucagaaagugaaucuuguuau

SEQ ID NO: 230075 - RNA, 22 nt, Human
uggcagccugcgugaaggagcu

SEQ ID NO: 230076 - RNA, 22 nt, Human
uggcagcauuuuuuccagaaca

SEQ ID NO: 230077 - RNA, 20 nt, Human
uucacggaggccgcgccccc

SEQ ID NO: 230078 - RNA, 22 nt, Human
uucacguuguugaagaaaauac

SEQ ID NO: 230079 - RNA, 22 nt, Human
uucacuuuuucucugcuugaga

SEQ ID NO: 230080 - RNA, 22 nt, Human
uggcacaggcagaaggugccgc

SEQ ID NO: 230081 - RNA, 22 nt, Human
uucaggacacauuauuuaugaa

SEQ ID NO: 230082 - RNA, 22 nt, Human
uucagcugcuugccugaaguca

SEQ ID NO: 230083 - RNA, 22 nt, Human
uggcauuugagcuggaaggaug

SEQ ID NO: 230084 - RNA, 22 nt, Human
uucagcaagugucucuacuguc

SEQ ID NO: 230085 - RNA, 23 nt, Human
uucagcucuccugaagcaucugu

SEQ ID NO: 230086 - RNA, 18 nt, Human
uggcaugcuuugauacau

SEQ ID NO: 230087 - RNA, 22 nt, Human
uggcaugugaauuguuacauug

SEQ ID NO: 230088 - RNA, 20 nt, Human
uggcaugcucucuuuuuagg

SEQ ID NO: 230089 - RNA, 20 nt, Human
uggcaugaaauuuuccaagc

SEQ ID NO: 230090 - RNA, 22 nt, Human
uucagaauuaucauaauuuuga

SEQ ID NO: 230091 - RNA, 22 nt, Human
uucagaccucaaauccacaugc

SEQ ID NO: 230092 - RNA, 22 nt, Human
uucagaauguacugauagaaca

SEQ ID NO: 230093 - RNA, 22 nt, Human
uucagacugcccauguuugcca

SEQ ID NO: 230094 - RNA, 21 nt, Human
uggcaggcagcuggaagcuug

SEQ ID NO: 230095 - RNA, 22 nt, Human
uggcagcucauuuggaaaugga

SEQ ID NO: 230096 - RNA, 22 nt, Human
uggcaucucggugcugguucuu

SEQ ID NO: 230097 - RNA, 22 nt, Human
uggcaucacagacaaggcagca

SEQ ID NO: 230098 - RNA, 22 nt, Human
uggcaguugcaguaacuuguau

SEQ ID NO: 230099 - RNA, 22 nt, Human
uggcaguagagcuggaacuuga

SEQ ID NO: 230100 - RNA, 22 nt, Human
uggcagugggaagcuggaaguc

SEQ ID NO: 230101 - RNA, 22 nt, Human
uggcagugagauuucucuucug

SEQ ID NO: 230102 - RNA, 22 nt, Human
uggcgcgcagccugcuggugcu

SEQ ID NO: 230103 - RNA, 22 nt, Human
uggcggagacauggacuucaga

SEQ ID NO: 230104 - RNA, 22 nt, Human
uggcgcucacccugcggcccug

SEQ ID NO: 230105 - RNA, 22 nt, Human
uggcggcggggagguaggcaga

SEQ ID NO: 230106 - RNA, 22 nt, Human
uucauggauuugugaaauuuag

SEQ ID NO: 230107 - RNA, 22 nt, Human
uucaugucuuugauucugauaa

SEQ ID NO: 230108 - RNA, 22 nt, Human
uucauugcagaauuuggccuca

SEQ ID NO: 230109 - RNA, 21 nt, Human
uucauucauggcauaauauag

SEQ ID NO: 230110 - RNA, 22 nt, Human
uggcucaguaaucgagucuccu

SEQ ID NO: 230111 - RNA, 22 nt, Human
uggcucaggccuacgacgccuu

SEQ ID NO: 230112 - RNA, 22 nt, Human
uggcucacaggaggcagaggug

SEQ ID NO: 230113 - RNA, 22 nt, Human
uggcuacguacaauggaacuuu

SEQ ID NO: 230114 - RNA, 22 nt, Human
uggcuacauuuauacucucauu

SEQ ID NO: 230115 - RNA, 22 nt, Human
uuccaggacuggguguuugaag

SEQ ID NO: 230116 - RNA, 16 nt, Human
uggcuuccaguucucu

SEQ ID NO: 230117 - RNA, 22 nt, Human
uuccagucugggcucuucacug

SEQ ID NO: 230118 - RNA, 22 nt, Human
uuccagguggcuuuccuggggg

SEQ ID NO: 230119 - RNA, 22 nt, Human
uuccagaacaauguggacguau

SEQ ID NO: 230120 - RNA, 22 nt, Human
uucauauuuaauuggucaucaa

SEQ ID NO: 230121 - RNA, 20 nt, Human
uucaugcagugguugcugug

SEQ ID NO: 230122 - RNA, 22 nt, Human
uucaugcgcuuuucaggagugu

SEQ ID NO: 230123 - RNA, 22 nt, Human
uucaucuucaaaccccagugcc

SEQ ID NO: 230124 - RNA, 21 nt, Human
uggcccgagccgggguuggcu

SEQ ID NO: 230125 - RNA, 22 nt, Human
uggccccauuuuucuggagccu

SEQ ID NO: 230126 - RNA, 22 nt, Human
uucauauuguggucuugcauuc

SEQ ID NO: 230127 - RNA, 22 nt, Human
uggccgaugagcaugcgcugau

SEQ ID NO: 230128 - RNA, 23 nt, Human
uggccguccccugacucucuggc

SEQ ID NO: 230129 - RNA, 20 nt, Human
uggccgacccugaggaguug

SEQ ID NO: 230130 - RNA, 22 nt, Human
uggcccugaaucaaggccagca

SEQ ID NO: 230131 - RNA, 22 nt, Human
uucauagaagggaguuuuuccu

SEQ ID NO: 230132 - RNA, 22 nt, Human
uucaguguuagaauuccaagaa

SEQ ID NO: 230133 - RNA, 22 nt, Human
uucaguuuugcuuuuaaucaug

SEQ ID NO: 230134 - RNA, 22 nt, Human
uggccauuuacucuguaagagu

SEQ ID NO: 230135 - RNA, 22 nt, Human
uggcccaagggaggcuuggccu

SEQ ID NO: 230136 - RNA, 22 nt, Human
uucagguuuuaugguaaugcuu

SEQ ID NO: 230137 - RNA, 22 nt, Human
uucagguuauugaagagcuuuc

SEQ ID NO: 230138 - RNA, 22 nt, Human
uggccaugagaaucuuugcugu

SEQ ID NO: 230139 - RNA, 22 nt, Human
uggccaaauuggccugauguau

SEQ ID NO: 230140 - RNA, 22 nt, Human
ugggggauucaucucagagcgu

SEQ ID NO: 230141 - RNA, 22 nt, Human
ugggggcacccagccgaugagg

SEQ ID NO: 230142 - RNA, 22 nt, Human
uggggggacagauggagaggac

SEQ ID NO: 230143 - RNA, 22 nt, Human
uucuacuagugguugauggccu

SEQ ID NO: 230144 - RNA, 22 nt, Human
ugggggauauggcuccauacuu

SEQ ID NO: 230145 - RNA, 22 nt, Human
ugggggaugacuugcucuuuca

SEQ ID NO: 230146 - RNA, 22 nt, Human
uucgucauuguuguugguuuuc

SEQ ID NO: 230147 - RNA, 22 nt, Human
uucgucauuaugcagccuguga

SEQ ID NO: 230148 - RNA, 22 nt, Human
uggggcuuucgcggagcgucgg

SEQ ID NO: 230149 - RNA, 20 nt, Human
uucguuucaguguuggauca

SEQ ID NO: 230150 - RNA, 22 nt, Human
uucuccaccugcuccucccacc

SEQ ID NO: 230151 - RNA, 22 nt, Human
ugggugaagaggcuaugcuacu

SEQ ID NO: 230152 - RNA, 22 nt, Human
uucucaauggcaacuuguugcu

SEQ ID NO: 230153 - RNA, 20 nt, Human
uucucugcagcaggcggccc

SEQ ID NO: 230154 - RNA, 22 nt, Human
uucucuggggacugucucuauu

SEQ ID NO: 230155 - RNA, 22 nt, Human
ugggucacuggccaagcucgac

SEQ ID NO: 230156 - RNA, 22 nt, Human
ugggucagauacaguguuuggu

SEQ ID NO: 230157 - RNA, 22 nt, Human
uggggugccccccucgguuugc

SEQ ID NO: 230158 - RNA, 18 nt, Human
ugggggacgcuuuuuuuc

SEQ ID NO: 230159 - RNA, 20 nt, Human
uuccccauaaaaauguucca

SEQ ID NO: 230160 - RNA, 22 nt, Human
uuccccagaaaaguaaacaagg

SEQ ID NO: 230161 - RNA, 22 nt, Human
uuccccgagccuggggaagcug

SEQ ID NO: 230162 - RNA, 22 nt, Human
uucccauuccagcucgaucaau

SEQ ID NO: 230163 - RNA, 22 nt, Human
uucccagggaucucuaguauuu

SEQ ID NO: 230164 - RNA, 18 nt, Human
uuccauuuuucagucuuc

SEQ ID NO: 230165 - RNA, 20 nt, Human
ugggauggaaucaccugcac

SEQ ID NO: 230166 - RNA, 22 nt, Human
ugggagccuuccacugggggaa

SEQ ID NO: 230167 - RNA, 22 nt, Human
uggcuugacaucaauacuuauu

SEQ ID NO: 230168 - RNA, 22 nt, Human
uggcuuuucaccugcuccucug

SEQ ID NO: 230169 - RNA, 22 nt, Human
uggggagcucagcaccaucagu

SEQ ID NO: 230170 - RNA, 22 nt, Human
uggggcugguaccguaauauau

SEQ ID NO: 230171 - RNA, 22 nt, Human
uggggaauguaauucuuuggcu

SEQ ID NO: 230172 - RNA, 22 nt, Human
ugggcuguuucuuaaggauaug

SEQ ID NO: 230173 - RNA, 22 nt, Human
ugggcaguccagcuggaaacgg

SEQ ID NO: 230174 - RNA, 22 nt, Human
ugggcacacugaaucugcuauu

SEQ ID NO: 230175 - RNA, 22 nt, Human
ugggcaaaugcuuuuuagucaa

SEQ ID NO: 230176 - RNA, 20 nt, Human
uuccucaaaagucugaugcu

SEQ ID NO: 230177 - RNA, 22 nt, Human
uuuauuuuccaugucucuaggu

SEQ ID NO: 230178 - RNA, 22 nt, Human
uuuauuugugguaguguaaucu

SEQ ID NO: 230179 - RNA, 22 nt, Human
uuuauuuggugguguuacuguu

SEQ ID NO: 230180 - RNA, 19 nt, Human
uuucacaaagagagcguga

SEQ ID NO: 230181 - RNA, 22 nt, Human
uuauaaaccgcuaacagcacuu

SEQ ID NO: 230182 - RNA, 22 nt, Human
uuuauugcuaugucuugauugu

SEQ ID NO: 230183 - RNA, 22 nt, Human
uuuauuuacuuucgguucugcu

SEQ ID NO: 230184 - RNA, 22 nt, Human
uuuauucuuugcuagguuccau

SEQ ID NO: 230185 - RNA, 22 nt, Human
uuuauugaccugaguaucagca

SEQ ID NO: 230186 - RNA, 22 nt, Human
uuaguuauaggugaaucagaga

SEQ ID NO: 230187 - RNA, 22 nt, Human
uuuauuuagguaaacaugaguu

SEQ ID NO: 230188 - RNA, 22 nt, Human
uuagccuccaguuuucucauuu

SEQ ID NO: 230189 - RNA, 22 nt, Human
uuuauaauuacguaaaauauuu

SEQ ID NO: 230190 - RNA, 22 nt, Human
uuaggacucuauuuggguaucu

SEQ ID NO: 230191 - RNA, 22 nt, Human
uuuauaauuguuauguuaccca

SEQ ID NO: 230192 - RNA, 22 nt, Human
uuuaucucugcauagaagugau

SEQ ID NO: 230193 - RNA, 22 nt, Human
uguuugaugugcacgugugugu

SEQ ID NO: 230194 - RNA, 21 nt, Human
uguuugcuuuuggagcaacug

SEQ ID NO: 230195 - RNA, 22 nt, Human
uguuugagaauuugcugauguu

SEQ ID NO: 230196 - RNA, 22 nt, Human
uuuacaaggcaguuauuuuccu

SEQ ID NO: 230197 - RNA, 23 nt, Human
uguuugggcuaucuuuuguucuc

SEQ ID NO: 230198 - RNA, 22 nt, Human
uuaccugagcggauuuguugca

SEQ ID NO: 230199 - RNA, 22 nt, Human
uuaccugcagagacguggaggc

SEQ ID NO: 230200 - RNA, 22 nt, Human
uuuacucagucugagcaggugu

SEQ ID NO: 230201 - RNA, 22 nt, Human
uuaccgagaacaugacuggaau

SEQ ID NO: 230202 - RNA, 22 nt, Human
uuuacaagucuguugaucccaa

SEQ ID NO: 230203 - RNA, 22 nt, Human
uuagacaucaagaagccaaugu

SEQ ID NO: 230204 - RNA, 22 nt, Human
uuagaaauguccuacuaauaug

SEQ ID NO: 230205 - RNA, 21 nt, Human
uuacuggcagcagaaaccuga

SEQ ID NO: 230206 - RNA, 22 nt, Human
uuacuggaauauaaagauaaga

SEQ ID NO: 230207 - RNA, 20 nt, Human
uuuagcacauuguacaaaac

SEQ ID NO: 230208 - RNA, 22 nt, Human
uuuagcauggacacugagggcu

SEQ ID NO: 230209 - RNA, 22 nt, Human
uuuagcaguuuauuuaaggggg

SEQ ID NO: 230210 - RNA, 22 nt, Human
uuuaggaauuugcugggcauga

SEQ ID NO: 230211 - RNA, 22 nt, Human
uuuagcugugugugucgcucca

SEQ ID NO: 230212 - RNA, 22 nt, Human
uuuccugcagacaguuuaagca

SEQ ID NO: 230213 - RNA, 22 nt, Human
uuuccuaggaaaugauugaagu

SEQ ID NO: 230214 - RNA, 22 nt, Human
uuuccuuaauuguaaaauggag

SEQ ID NO: 230215 - RNA, 22 nt, Human
uuauuggcagcuccugcacaug

SEQ ID NO: 230216 - RNA, 22 nt, Human
uuauuccauagaagucaaggaa

SEQ ID NO: 230217 - RNA, 22 nt, Human
uuauuaauacaugcaccugcau

SEQ ID NO: 230218 - RNA, 22 nt, Human
uuaugguuuaauauccagcaca

SEQ ID NO: 230219 - RNA, 22 nt, Human
uuaugucauuugaauuaauuuu

SEQ ID NO: 230220 - RNA, 22 nt, Human
uuuccaguaaguggcaaggagc

SEQ ID NO: 230221 - RNA, 22 nt, Human
uuaugggguuaaauuucuccua

SEQ ID NO: 230222 - RNA, 22 nt, Human
uuuccugacuucaccuuuuacc

SEQ ID NO: 230223 - RNA, 18 nt, Human
uuuccucauuugcagacu

SEQ ID NO: 230224 - RNA, 22 nt, Human
uuuccccugggaacauugauuc

SEQ ID NO: 230225 - RNA, 22 nt, Human
uuucccuugcgcuugcucuccg

SEQ ID NO: 230226 - RNA, 22 nt, Human
uuauuguagcacuuuggcagug

SEQ ID NO: 230227 - RNA, 22 nt, Human
uuuccuuacuuauaaaaugggg

SEQ ID NO: 230228 - RNA, 22 nt, Human
uuucguugcacucauaugguug

SEQ ID NO: 230229 - RNA, 19 nt, Human
uuucucacugagucguuug

SEQ ID NO: 230230 - RNA, 22 nt, Human
uuucuaguagcuacagcaccau

SEQ ID NO: 230231 - RNA, 22 nt, Human
uuucuacacuucgugguguuuu

SEQ ID NO: 230232 - RNA, 22 nt, Human
uuucuaaguuugaggcgaagca

SEQ ID NO: 230233 - RNA, 22 nt, Human
uuucagaaauggcacugaaauc

SEQ ID NO: 230234 - RNA, 22 nt, Human
uuucagcaugacuguuaucuuu

SEQ ID NO: 230235 - RNA, 22 nt, Human
uuucagauuauguucauggguu

SEQ ID NO: 230236 - RNA, 22 nt, Human
uuauauuaaaaaucgcuaacag

SEQ ID NO: 230237 - RNA, 22 nt, Human
uuucaucccugucagugaaggc

SEQ ID NO: 230238 - RNA, 22 nt, Human
uuauaagugccucuuuauuuuc

SEQ ID NO: 230239 - RNA, 22 nt, Human
uuauaucagaaggugagauuga

SEQ ID NO: 230240 - RNA, 22 nt, Human
uuauaguggcuuggggaaaaaa

SEQ ID NO: 230241 - RNA, 22 nt, Human
uuaugccuguuaggcagcaucu

SEQ ID NO: 230242 - RNA, 22 nt, Human
uuaugcaaaggggccucuuccu

SEQ ID NO: 230243 - RNA, 22 nt, Human
uuaucuguuuuaaugaauaauu

SEQ ID NO: 230244 - RNA, 19 nt, Human
uuauccggacuuaauuuau

SEQ ID NO: 230245 - RNA, 22 nt, Human
uuaucaaaaaauaguacuuuga

SEQ ID NO: 230246 - RNA, 22 nt, Human
uuuccacacucacugcacucau

SEQ ID NO: 230247 - RNA, 22 nt, Human
uuaucagggaguuguguguucu

SEQ ID NO: 230248 - RNA, 22 nt, Human
uuauauuuuauuuaauuaaaua

SEQ ID NO: 230249 - RNA, 22 nt, Human
uuucauggaggccaggacagag

SEQ ID NO: 230250 - RNA, 22 nt, Human
uuucauguuggauacuguuuca

SEQ ID NO: 230251 - RNA, 22 nt, Human
uucauugauuuccuuggaauaa

SEQ ID NO: 230252 - RNA, 22 nt, Human
uucauugcuacuuaaaauacca

SEQ ID NO: 230253 - RNA, 22 nt, Human
uuuguacuuucuaauguauuua

SEQ ID NO: 230254 - RNA, 22 nt, Human
uuugguguuuucaggaauauac

SEQ ID NO: 230255 - RNA, 22 nt, Human
uuugucauuuagcccauggugg

SEQ ID NO: 230256 - RNA, 23 nt, Human
uuugucaucccucucacuuucug

SEQ ID NO: 230257 - RNA, 22 nt, Human
uucauuuuauauuagagcuguu

SEQ ID NO: 230258 - RNA, 17 nt, Human
uuugugauggcagaugc

SEQ ID NO: 230259 - RNA, 22 nt, Human
uuugucaucuuccauauuugca

SEQ ID NO: 230260 - RNA, 22 nt, Human
uuugugauaaguggauucaagg

SEQ ID NO: 230261 - RNA, 22 nt, Human
uucccugggggggccgcuuucc

SEQ ID NO: 230262 - RNA, 22 nt, Human
uuuguuaggguuucagcuagcc

SEQ ID NO: 230263 - RNA, 22 nt, Human
uuuguguuuucaggcacauggc

SEQ ID NO: 230264 - RNA, 22 nt, Human
uucagguuuuuaaguucugccu

SEQ ID NO: 230265 - RNA, 22 nt, Human
uuuggccauuuguaugcaugau

SEQ ID NO: 230266 - RNA, 22 nt, Human
uuuggaugcugucauaugcugc

SEQ ID NO: 230267 - RNA, 22 nt, Human
uucaggaucuaggaguauuuuu

SEQ ID NO: 230268 - RNA, 22 nt, Human
uucagguacuaagugcugauuc

SEQ ID NO: 230269 - RNA, 22 nt, Human
uucaggggcaaauacauuuuga

SEQ ID NO: 230270 - RNA, 18 nt, Human
uucaggcucuugcaugaa

SEQ ID NO: 230271 - RNA, 22 nt, Human
uuugcauuaguuuagauuucaa

SEQ ID NO: 230272 - RNA, 22 nt, Human
uuugcaaaguccauugaaguua

SEQ ID NO: 230273 - RNA, 22 nt, Human
uuugauuaccuggggcccucug

SEQ ID NO: 230274 - RNA, 22 nt, Human
uuuggguuaguuuuccaaucuu

SEQ ID NO: 230275 - RNA, 22 nt, Human
uuuggguuuuuccuuagggacu

SEQ ID NO: 230276 - RNA, 19 nt, Human
uuugguaggcuugagggaa

SEQ ID NO: 230277 - RNA, 22 nt, Human
uuuggggcucauuugcuuuugu

SEQ ID NO: 230278 - RNA, 22 nt, Human
uuuggguauuaguuuagcuaga

SEQ ID NO: 230279 - RNA, 22 nt, Human
uuugggcauuuuuaaggaucuu

SEQ ID NO: 230280 - RNA, 22 nt, Human
uuugggcuuuguuuuaagguau

SEQ ID NO: 230281 - RNA, 22 nt, Human
uucaguuugaauucuguagaac

SEQ ID NO: 230282 - RNA, 22 nt, Human
uucaguagagguggaaauaaca

SEQ ID NO: 230283 - RNA, 22 nt, Human
uucaguaugcugaaugauuuuu

SEQ ID NO: 230284 - RNA, 22 nt, Human
uuugggaaguaauuaauugcag

SEQ ID NO: 230285 - RNA, 18 nt, Human
uuugggauccucuuuucu

SEQ ID NO: 230286 - RNA, 22 nt, Human
uuucuuugggcccuggcagucu

SEQ ID NO: 230287 - RNA, 22 nt, Human
uuauuuuuguaacacuguauag

SEQ ID NO: 230288 - RNA, 22 nt, Human
uuucuuuuucuacaccuuagcu

SEQ ID NO: 230289 - RNA, 22 nt, Human
uuugaagaccuuaucucuaaau

SEQ ID NO: 230290 - RNA, 22 nt, Human
uuugaagaaacagucuuaagag

SEQ ID NO: 230291 - RNA, 22 nt, Human
uucaaaaugcagaauaguuugg

SEQ ID NO: 230292 - RNA, 22 nt, Human
uuauuuuuguuuguuaagccua

SEQ ID NO: 230293 - RNA, 22 nt, Human
uucaaacaguguagaauauaug

SEQ ID NO: 230294 - RNA, 22 nt, Human
uucaaacacugugcaauugggu

SEQ ID NO: 230295 - RNA, 22 nt, Human
uucaacacaaguugugcaguaa

SEQ ID NO: 230296 - RNA, 22 nt, Human
uuugaauauuaugucccacuuu

SEQ ID NO: 230297 - RNA, 22 nt, Human
uuugacaccaggagagaaaaca

SEQ ID NO: 230298 - RNA, 22 nt, Human
uuugagugcccauguuucccag

SEQ ID NO: 230299 - RNA, 22 nt, Human
uuugaguacagcugccuuuuug

SEQ ID NO: 230300 - RNA, 22 nt, Human
uuugaugagaaaugacuuaagu

SEQ ID NO: 230301 - RNA, 22 nt, Human
uuugaugauuuucuagagugua

SEQ ID NO: 230302 - RNA, 19 nt, Human
uuucuggguucaccucuug

SEQ ID NO: 230303 - RNA, 22 nt, Human
uuucugugguggguaguucaga

SEQ ID NO: 230304 - RNA, 22 nt, Human
uuucugggggucgugcuggcug

SEQ ID NO: 230305 - RNA, 22 nt, Human
uuucuggauaagcagggucucu

SEQ ID NO: 230306 - RNA, 22 nt, Human
uuucuguuuguaacuccagcaa

SEQ ID NO: 230307 - RNA, 22 nt, Human
uuucuguugugaccugacucuu

SEQ ID NO: 230308 - RNA, 22 nt, Human
uuucuugugauuuugaugaacu

SEQ ID NO: 230309 - RNA, 22 nt, Human
uuucuugggaaaugucagaagu

SEQ ID NO: 230310 - RNA, 22 nt, Human
uuucuuccuucuugaucauuug

SEQ ID NO: 230311 - RNA, 22 nt, Human
uuauuugcccauguuuagcaga

SEQ ID NO: 230312 - RNA, 22 nt, Human
uuucuuugcugguuggcucucc

SEQ ID NO: 230313 - RNA, 22 nt, Human
uuucuuaguuaaguagguaggc

SEQ ID NO: 230314 - RNA, 22 nt, Human
uuucucuuucaaucugcaguac

SEQ ID NO: 230315 - RNA, 17 nt, Human
uuucugcaugauuggac

SEQ ID NO: 230316 - RNA, 22 nt, Human
uuucugcauuuguauuggaaaa

SEQ ID NO: 230317 - RNA, 23 nt, Human
uuucugaguuuuuuaaaagucca

SEQ ID NO: 230318 - RNA, 22 nt, Human
uuauuucuucucgaagcuuggg

SEQ ID NO: 230319 - RNA, 22 nt, Human
uuauuguuuggguauaauuuga

SEQ ID NO: 230320 - RNA, 22 nt, Human
uuauuuaagaucuuaauauaua

SEQ ID NO: 230321 - RNA, 22 nt, Human
uugccucuaauuagcucuguga

SEQ ID NO: 230322 - RNA, 22 nt, Human
uugccaggggacaucuggagcc

SEQ ID NO: 230323 - RNA, 23 nt, Human
uugcauuaauguggaggcacagg

SEQ ID NO: 230324 - RNA, 22 nt, Human
uugcguaauuugagauuguaaa

SEQ ID NO: 230325 - RNA, 18 nt, Human
uugcucucucugggggca

SEQ ID NO: 230326 - RNA, 22 nt, Human
uugcucaccugagaagaauaga

SEQ ID NO: 230327 - RNA, 22 nt, Human
uugcagagaacuaaagggagua

SEQ ID NO: 230328 - RNA, 22 nt, Human
uugcauauguccagccaugcau

SEQ ID NO: 230329 - RNA, 22 nt, Human
uugcaugugugaaaugcacaga

SEQ ID NO: 230330 - RNA, 22 nt, Human
uugcaucagcaggcauaauugg

SEQ ID NO: 230331 - RNA, 22 nt, Human
uugcaugauuuaagaauaucug

SEQ ID NO: 230332 - RNA, 22 nt, Human
uugcaagauaguguauuuuuca

SEQ ID NO: 230333 - RNA, 20 nt, Human
uugcaaagugaauagcaauu

SEQ ID NO: 230334 - RNA, 22 nt, Human
uugcacgucacccuucccaccu

SEQ ID NO: 230335 - RNA, 22 nt, Human
uugcagaauucuucccacucag

SEQ ID NO: 230336 - RNA, 22 nt, Human
uugcacagaugcacaugguugc

SEQ ID NO: 230337 - RNA, 22 nt, Human
uugcugcgcugaccuccaguga

SEQ ID NO: 230338 - RNA, 22 nt, Human
uugcugagcugaaccagccacc

SEQ ID NO: 230339 - RNA, 21 nt, Human
uugcuggagcaauguaaauca

SEQ ID NO: 230340 - RNA, 22 nt, Human
uugcuggaguagaaaacuuaac

SEQ ID NO: 230341 - RNA, 22 nt, Human
uugcuugaacccaggaagugga

SEQ ID NO: 230342 - RNA, 22 nt, Human
uugcuuaggccaaauggcgcau

SEQ ID NO: 230343 - RNA, 22 nt, Human
uugcugugucauuuguuuaauc

SEQ ID NO: 230344 - RNA, 22 nt, Human
uugcugguggcucugauuucau

SEQ ID NO: 230345 - RNA, 22 nt, Human
uuggaauuugagaccaagaaaa

SEQ ID NO: 230346 - RNA, 22 nt, Human
uuggacugggauggccgaggcu

SEQ ID NO: 230347 - RNA, 22 nt, Human
uuggacugguuuacauuucaag

SEQ ID NO: 230348 - RNA, 22 nt, Human
uuggagagggugggcuuugaag

SEQ ID NO: 230349 - RNA, 22 nt, Human
uuggagaaagcugcaggcucug

SEQ ID NO: 230350 - RNA, 22 nt, Human
uuggaaauguagaaaagcagau

SEQ ID NO: 230351 - RNA, 22 nt, Human
uuggaaaugcauuuguuauuau

SEQ ID NO: 230352 - RNA, 22 nt, Human
uugcuuuuugggguuuacuggg

SEQ ID NO: 230353 - RNA, 22 nt, Human
uuggaaaagaaauacucauaua

SEQ ID NO: 230354 - RNA, 18 nt, Human
uuuaauaagccuguuaug

SEQ ID NO: 230355 - RNA, 22 nt, Human
uuuaaucaguugguaauauuga

SEQ ID NO: 230356 - RNA, 22 nt, Human
uuuaaucaauaaccuccugggu

SEQ ID NO: 230357 - RNA, 22 nt, Human
uuuaaauaguugguuuuuuugc

SEQ ID NO: 230358 - RNA, 22 nt, Human
uuuaaagucaggcuguaguggu

SEQ ID NO: 230359 - RNA, 22 nt, Human
uuuaaacuaacaguacacguug

SEQ ID NO: 230360 - RNA, 20 nt, Human
uuuaacuggccuucuggcuc

SEQ ID NO: 230361 - RNA, 22 nt, Human
uuuaagguacagcuagcagcau

SEQ ID NO: 230362 - RNA, 22 nt, Human
uugugacaauacagcauggaga

SEQ ID NO: 230363 - RNA, 21 nt, Human
uugugaaaguccaggaacaac

SEQ ID NO: 230364 - RNA, 22 nt, Human
uuguuucauggggacgacuggc

SEQ ID NO: 230365 - RNA, 22 nt, Human
uuguuuacuugagcugcacucu

SEQ ID NO: 230366 - RNA, 22 nt, Human
uuguuuuucucuagggaaggcu

SEQ ID NO: 230367 - RNA, 22 nt, Human
uuuaaaauguuuuauuuauuua

SEQ ID NO: 230368 - RNA, 22 nt, Human
uuguuuuaguagaaguuacaug

SEQ ID NO: 230369 - RNA, 22 nt, Human
uuuaaaacagcauuuaaaaggu

SEQ ID NO: 230370 - RNA, 22 nt, Human
uuguauaaagauggcuagaucc

SEQ ID NO: 230371 - RNA, 22 nt, Human
uuguaugcugggaagcgggagg

SEQ ID NO: 230372 - RNA, 22 nt, Human
uuguccacuaagaaagugcccu

SEQ ID NO: 230373 - RNA, 22 nt, Human
uugucuuggcauaccguuauau

SEQ ID NO: 230374 - RNA, 22 nt, Human
uugucuuucguauggaacacua

SEQ ID NO: 230375 - RNA, 19 nt, Human
uugucuuagcugcauaaga

SEQ ID NO: 230376 - RNA, 20 nt, Human
uuguacuuaugugagaagga

SEQ ID NO: 230377 - RNA, 22 nt, Human
uuguacuuaaauaugcaaauag

SEQ ID NO: 230378 - RNA, 19 nt, Human
uuggugaagguucacugac

SEQ ID NO: 230379 - RNA, 22 nt, Human
uuggggauugggugcaagggac

SEQ ID NO: 230380 - RNA, 22 nt, Human
uuggcaaaagauuggguacuua

SEQ ID NO: 230381 - RNA, 22 nt, Human
uugguaaccaaucaaaugugag

SEQ ID NO: 230382 - RNA, 22 nt, Human
uuggggcugcguguuuccaugu

SEQ ID NO: 230383 - RNA, 22 nt, Human
uucugcauaggcuauauuuguu

SEQ ID NO: 230384 - RNA, 20 nt, Human
uucugcagcagguguugaag

SEQ ID NO: 230385 - RNA, 22 nt, Human
uucugaguguugucaccaugug

SEQ ID NO: 230386 - RNA, 22 nt, Human
uucugaugccuggguugcuucu

SEQ ID NO: 230387 - RNA, 22 nt, Human
uucugcccuugccagacaagua

SEQ ID NO: 230388 - RNA, 22 nt, Human
uuuucaaucaaguuuauuuaua

SEQ ID NO: 230389 - RNA, 22 nt, Human
uuuucacugacuuggucuggaa

SEQ ID NO: 230390 - RNA, 22 nt, Human
uucucugcgcuccggcccaguu

SEQ ID NO: 230391 - RNA, 22 nt, Human
uucugucaguguugguggaaau

SEQ ID NO: 230392 - RNA, 19 nt, Human
uucugguacauacugccug

SEQ ID NO: 230393 - RNA, 22 nt, Human
uucuggugauuugccucuuuag

SEQ ID NO: 230394 - RNA, 22 nt, Human
uucuggucucucugaccuagga

SEQ ID NO: 230395 - RNA, 23 nt, Human
uucugcuucccauagcacuuugu

SEQ ID NO: 230396 - RNA, 22 nt, Human
uucuggagacccagcaacaggg

SEQ ID NO: 230397 - RNA, 19 nt, Human
uucugcucaguaacacccu

SEQ ID NO: 230398 - RNA, 22 nt, Human
uucuccccacuccucccucuga

SEQ ID NO: 230399 - RNA, 22 nt, Human
uucucuauuugcugcaccucuc

SEQ ID NO: 230400 - RNA, 22 nt, Human
uucucucacucuuagaucccgc

SEQ ID NO: 230401 - RNA, 22 nt, Human
uuuucaacuuuauuuuccccca

SEQ ID NO: 230402 - RNA, 22 nt, Human
uucuccucuuugucacugcuuu

SEQ ID NO: 230403 - RNA, 22 nt, Human
uuuuauguuccugaagcuaucu

SEQ ID NO: 230404 - RNA, 22 nt, Human
uucguugaagcaacgacuuugg

SEQ ID NO: 230405 - RNA, 22 nt, Human
uucguucagcgcuugcgcaugc

SEQ ID NO: 230406 - RNA, 22 nt, Human
uuuuagccagcaucugggucga

SEQ ID NO: 230407 - RNA, 22 nt, Human
uucuacauugugaaguucuuua

SEQ ID NO: 230408 - RNA, 22 nt, Human
uucuaauauuaugauuucuaag

SEQ ID NO: 230409 - RNA, 22 nt, Human
uuuuauaaaaccuguuugaccu

SEQ ID NO: 230410 - RNA, 22 nt, Human
uuccuaauguccaccuaguccu

SEQ ID NO: 230411 - RNA, 22 nt, Human
uuuuacauuuuauucguuuauu

SEQ ID NO: 230412 - RNA, 22 nt, Human
uuuguucuucucaugcacacaa

SEQ ID NO: 230413 - RNA, 22 nt, Human
uuuuuuccuguuugucuuuggg

SEQ ID NO: 230414 - RNA, 22 nt, Human
uuuuuucuggaguuugggguuu

SEQ ID NO: 230415 - RNA, 22 nt, Human
uugaacucagcuacugguuggu

SEQ ID NO: 230416 - RNA, 22 nt, Human
uugaaccaggauaaacauagaa

SEQ ID NO: 230417 - RNA, 20 nt, Human
uugaaagucagggcuccagu

SEQ ID NO: 230418 - RNA, 22 nt, Human
uuuuuguggggggcggugugaa

SEQ ID NO: 230419 - RNA, 22 nt, Human
uugaaaacugucaccuuuauuc

SEQ ID NO: 230420 - RNA, 22 nt, Human
uugaaaauuaauagguguacaa

SEQ ID NO: 230421 - RNA, 22 nt, Human
uugaguaaugcaagccuuugua

SEQ ID NO: 230422 - RNA, 22 nt, Human
uugaggucuguguaggcagcaa

SEQ ID NO: 230423 - RNA, 20 nt, Human
uugaggagauauugaauacu

SEQ ID NO: 230424 - RNA, 22 nt, Human
uugacucuuucauuuauuauuu

SEQ ID NO: 230425 - RNA, 18 nt, Human
uuuuuuguucuguuuugu

SEQ ID NO: 230426 - RNA, 22 nt, Human
uugaaucauauguaauugacuu

SEQ ID NO: 230427 - RNA, 22 nt, Human
uuuuuugguuuggggauuauuu

SEQ ID NO: 230428 - RNA, 22 nt, Human
uuuuuuguggcuggaagaaaaa

SEQ ID NO: 230429 - RNA, 22 nt, Human
uucuguucugcuuucuccaucc

SEQ ID NO: 230430 - RNA, 19 nt, Human
uucuguggucccaggccuu

SEQ ID NO: 230431 - RNA, 22 nt, Human
uuuugucagggcaggaggaaga

SEQ ID NO: 230432 - RNA, 22 nt, Human
uucuuacuaaguagaguacuca

SEQ ID NO: 230433 - RNA, 22 nt, Human
uucuuaaugcauccuguguuca

SEQ ID NO: 230434 - RNA, 22 nt, Human
uucuuagauuuuauuucuucug

SEQ ID NO: 230435 - RNA, 22 nt, Human
uuuuguggacugugagggugca

SEQ ID NO: 230436 - RNA, 18 nt, Human
uuuuguguuuauucugca

SEQ ID NO: 230437 - RNA, 22 nt, Human
uuuuguuacugauuauuaaaau

SEQ ID NO: 230438 - RNA, 22 nt, Human
uuuuguuuacauuaaauuuuga

SEQ ID NO: 230439 - RNA, 22 nt, Human
uucuucuuuccuauaauuaauu

SEQ ID NO: 230440 - RNA, 22 nt, Human
uuuuuaauuuuaagcuauuugu

SEQ ID NO: 230441 - RNA, 22 nt, Human
uuuuuaagguuuguuuauauau

SEQ ID NO: 230442 - RNA, 22 nt, Human
uuuuuauaagagcagcagaguu

SEQ ID NO: 230443 - RNA, 22 nt, Human
uuuuuagcuguuauuguggaag

SEQ ID NO: 230444 - RNA, 22 nt, Human
uuuuuaccugguguccagcuuc

SEQ ID NO: 230445 - RNA, 21 nt, Human
uuuuucuccagaguuuccacu

SEQ ID NO: 230446 - RNA, 22 nt, Human
uuuuuauguaaaauauuaaaag

SEQ ID NO: 230447 - RNA, 22 nt, Human
uuuuuauaagauuuaaaaugua

SEQ ID NO: 230448 - RNA, 22 nt, Human
uuuuucagacuaauagggcaua

SEQ ID NO: 230449 - RNA, 22 nt, Human
uuuuucacacuccuuuccaguu

SEQ ID NO: 230450 - RNA, 22 nt, Human
aaaacauuuuacugccaucuca

SEQ ID NO: 230451 - RNA, 22 nt, Human
aaaacauuuaggguuuuuuuua

SEQ ID NO: 230452 - RNA, 22 nt, Human
aaaacuuucagggauacagaaa

SEQ ID NO: 230453 - RNA, 22 nt, Human
aaaagauguaaacauauauuaa

SEQ ID NO: 230454 - RNA, 22 nt, Human
aaaagcauuauuagucugggug

SEQ ID NO: 230455 - RNA, 22 nt, Human
aaaaggacaguagccuugaggu

SEQ ID NO: 230456 - RNA, 22 nt, Human
aaaagguauuuagcgauugcau

SEQ ID NO: 230457 - RNA, 22 nt, Human
aaaagggucugacacugcuuga

SEQ ID NO: 230458 - RNA, 22 nt, Human
aaaaggucacuguaaaaugacg

SEQ ID NO: 230459 - RNA, 22 nt, Human
aaaaguuguaauauuuccuuua

SEQ ID NO: 230460 - RNA, 22 nt, Human
aaaaggauauuuggugcaaagc

SEQ ID NO: 230461 - RNA, 17 nt, Human
aaaaucaaaggaggugc

SEQ ID NO: 230462 - RNA, 22 nt, Human
aaaauauucuauaucaaagaua

SEQ ID NO: 230463 - RNA, 22 nt, Human
aaaauauguugagauacugaaa

SEQ ID NO: 230464 - RNA, 22 nt, Human
aaaauauuuaucuagcucuuaa

SEQ ID NO: 230465 - RNA, 22 nt, Human
aaaagguuauagcuuugccuug

SEQ ID NO: 230466 - RNA, 22 nt, Human
aaaaguauaagugucuccugau

SEQ ID NO: 230467 - RNA, 22 nt, Human
aaacaaauccaauaauaaaauu

SEQ ID NO: 230468 - RNA, 22 nt, Human
aaaauuuccuuggaccauuuuu

SEQ ID NO: 230469 - RNA, 22 nt, Human
aaacaagagcuuacauggcugc

SEQ ID NO: 230470 - RNA, 22 nt, Human
aaacccaggguuuugucuuccc

SEQ ID NO: 230471 - RNA, 22 nt, Human
aaacacacaacauauuuuggaa

SEQ ID NO: 230472 - RNA, 22 nt, Human
aaaaucucagaaaaguuuaggu

SEQ ID NO: 230473 - RNA, 22 nt, Human
aaacaccaagagcuagcuauua

SEQ ID NO: 230474 - RNA, 22 nt, Human
aaaccgguacccuccugccugc

SEQ ID NO: 230475 - RNA, 22 nt, Human
aaaaugggaaaauuuuagauua

SEQ ID NO: 230476 - RNA, 22 nt, Human
aaagcagucuguuuuaaccuga

SEQ ID NO: 230477 - RNA, 22 nt, Human
aaagcagguugcaauuacagug

SEQ ID NO: 230478 - RNA, 22 nt, Human
aaagaguuguauucuuuuugag

SEQ ID NO: 230479 - RNA, 22 nt, Human
aaagaguuaagagucuuaagcu

SEQ ID NO: 230480 - RNA, 22 nt, Human
aaagagcugccaagguuacagu

SEQ ID NO: 230481 - RNA, 22 nt, Human
aaagagggaaggaaggagugaa

SEQ ID NO: 230482 - RNA, 22 nt, Human
aaagcaaagaucuguagcccaa

SEQ ID NO: 230483 - RNA, 22 nt, Human
aaagaauuucaagauucccaca

SEQ ID NO: 230484 - RNA, 23 nt, Human
aaagaggugaauccaggacaagc

SEQ ID NO: 230485 - RNA, 22 nt, Human
aaacgcaauuucuugcauguca

SEQ ID NO: 230486 - RNA, 22 nt, Human
aaacgcauucuuacaugcuucc

SEQ ID NO: 230487 - RNA, 18 nt, Human
aaacgguuucaugcugua

SEQ ID NO: 230488 - RNA, 22 nt, Human
aaagacaauaauucucucuagc

SEQ ID NO: 230489 - RNA, 22 nt, Human
aaagagugugcauguaccugug

SEQ ID NO: 230490 - RNA, 22 nt, Human
aaagaacguuucugggaaucag

SEQ ID NO: 230491 - RNA, 22 nt, Human
aaagguggugguuagggaauau

SEQ ID NO: 230492 - RNA, 22 nt, Human
aaaggucagaugugucgaggag

SEQ ID NO: 230493 - RNA, 22 nt, Human
aaagggaugauuucugaagaua

SEQ ID NO: 230494 - RNA, 22 nt, Human
aaagcauucuaaccgaucgacg

SEQ ID NO: 230495 - RNA, 22 nt, Human
aaaggaaacuaugaaucucugg

SEQ ID NO: 230496 - RNA, 22 nt, Human
aaaggagugaaaugagaggaaa

SEQ ID NO: 230497 - RNA, 22 nt, Human
aaagccagggacagugugcaug

SEQ ID NO: 230498 - RNA, 22 nt, Human
aaagccaagguccauguacuuu

SEQ ID NO: 230499 - RNA, 22 nt, Human
aaagcugaaacgaaaugacaac

SEQ ID NO: 230500 - RNA, 22 nt, Human
aaagccuacagucaugguuaga

SEQ ID NO: 230501 - RNA, 22 nt, Human
aaagcaaauaguugcuuaauau

SEQ ID NO: 230502 - RNA, 22 nt, Human
aaagccauaucuauucuauucu

SEQ ID NO: 230503 - RNA, 22 nt, Human
aaagcauuuguuucuccuggaa

SEQ ID NO: 230504 - RNA, 22 nt, Human
aaagaugaaguucagcgaagaa

SEQ ID NO: 230505 - RNA, 22 nt, Human
aaagaugucauacacauuaaga

SEQ ID NO: 230506 - RNA, 22 nt, Human
aaagaucaguuaacgccaucaa

SEQ ID NO: 230507 - RNA, 22 nt, Human
aaaguuacacgacuauuuaugu

SEQ ID NO: 230508 - RNA, 22 nt, Human
aaaguaaagccuauuuaauaau

SEQ ID NO: 230509 - RNA, 22 nt, Human
aaagggcugaaguagucucugu

SEQ ID NO: 230510 - RNA, 22 nt, Human
aaaggugccucuuacaaggcuu

SEQ ID NO: 230511 - RNA, 22 nt, Human
aaaguuguccuuugugccuuua

SEQ ID NO: 230512 - RNA, 22 nt, Human
aaaguugcauccuaugaccuca

SEQ ID NO: 230513 - RNA, 22 nt, Human
aaauagauuugacuacuuggug

SEQ ID NO: 230514 - RNA, 22 nt, Human
aaauagucagaaaucaacgugc

SEQ ID NO: 230515 - RNA, 23 nt, Human
aaaguacuuaaucugcaaaccac

SEQ ID NO: 230516 - RNA, 22 nt, Human
aaaguagaauaauaaacccuug

SEQ ID NO: 230517 - RNA, 22 nt, Human
aaaguguaagucccugguuguc

SEQ ID NO: 230518 - RNA, 22 nt, Human
aaaguguuaacacuggcuacuu

SEQ ID NO: 230519 - RNA, 22 nt, Human
aaaguguuuaacaaauugcuuu

SEQ ID NO: 230520 - RNA, 22 nt, Human
aaagggagauaaaguaauuuua

SEQ ID NO: 230521 - RNA, 17 nt, Human
aaagccgaucagauguu

SEQ ID NO: 230522 - RNA, 22 nt, Human
aaagcgagccggcuuggaggga

SEQ ID NO: 230523 - RNA, 21 nt, Human
aaauccagugaucuccucuaa

SEQ ID NO: 230524 - RNA, 22 nt, Human
aaaucauguuaaagagggaguu

SEQ ID NO: 230525 - RNA, 22 nt, Human
aaaucgcuugaacccaggaagu

SEQ ID NO: 230526 - RNA, 22 nt, Human
aaaucugaaggaaacagcuuca

SEQ ID NO: 230527 - RNA, 22 nt, Human
aaaucccacucacgaguuuugc

SEQ ID NO: 230528 - RNA, 22 nt, Human
aaauauuugaaugguguaagau

SEQ ID NO: 230529 - RNA, 22 nt, Human
aaaguuuguacugggaguuacu

SEQ ID NO: 230530 - RNA, 22 nt, Human
aaaucaagucagcugaauucca

SEQ ID NO: 230531 - RNA, 22 nt, Human
aaaucaaaagugguuauuuuau

SEQ ID NO: 230532 - RNA, 23 nt, Human
aaauaauaauuucucuguuggga

SEQ ID NO: 230533 - RNA, 22 nt, Human
aaauaggaguagugauguauua

SEQ ID NO: 230534 - RNA, 22 nt, Human
aaauauuagacauaccuggaga

SEQ ID NO: 230535 - RNA, 22 nt, Human
aaauauuaaugaugaagguagu

SEQ ID NO: 230536 - RNA, 22 nt, Human
aaaguuacccaaucucuaugaa

SEQ ID NO: 230537 - RNA, 22 nt, Human
aaauauugaauuugaggaugua

SEQ ID NO: 230538 - RNA, 22 nt, Human
aaaguagaugagaauuuuguug

SEQ ID NO: 230539 - RNA, 21 nt, Human
aaagugguaaggauuauuuug

SEQ ID NO: 230540 - RNA, 22 nt, Human
aaauauauauaauauauauauu

SEQ ID NO: 230541 - RNA, 22 nt, Human
aacaggaagaauccagauggug

SEQ ID NO: 230542 - RNA, 19 nt, Human
aacaaaauaguucuaguua

SEQ ID NO: 230543 - RNA, 22 nt, Human
aacacaguuucucuaugagagu

SEQ ID NO: 230544 - RNA, 22 nt, Human
aacaaguagaauagguuuuuuu

SEQ ID NO: 230545 - RNA, 22 nt, Human
aacauuuauguuuugaccaagu

SEQ ID NO: 230546 - RNA, 22 nt, Human
aacauuguuuaaguuaaauugu

SEQ ID NO: 230547 - RNA, 22 nt, Human
aacaaccuaguaguaucuuuca

SEQ ID NO: 230548 - RNA, 20 nt, Human
aacagcucucgacuuaucuu

SEQ ID NO: 230549 - RNA, 22 nt, Human
aacaaagaacuuucuuccuuug

SEQ ID NO: 230550 - RNA, 22 nt, Human
aacaaagaaaagcuugagguuu

SEQ ID NO: 230551 - RNA, 20 nt, Human
aaauugaacaagccaggcug

SEQ ID NO: 230552 - RNA, 22 nt, Human
aaauuaacuaucacuuuuguga

SEQ ID NO: 230553 - RNA, 22 nt, Human
aaauuaaaguuuuauuuagagc

SEQ ID NO: 230554 - RNA, 22 nt, Human
aaaucauagccaugaacauuug

SEQ ID NO: 230555 - RNA, 22 nt, Human
aaauaugguaucugccaaacua

SEQ ID NO: 230556 - RNA, 22 nt, Human
aaaucugaauuaaaaucugguu

SEQ ID NO: 230557 - RNA, 22 nt, Human
aaauauagugacacuuauaguc

SEQ ID NO: 230558 - RNA, 22 nt, Human
aaauauauccuucuguccugcc

SEQ ID NO: 230559 - RNA, 20 nt, Human
aaauccuugggaguggugca

SEQ ID NO: 230560 - RNA, 22 nt, Human
aaauguaaacuguauuuauaaa

SEQ ID NO: 230561 - RNA, 22 nt, Human
aaaugguguucuuuagaugaaa

SEQ ID NO: 230562 - RNA, 22 nt, Human
aaauuagucacaccagugucuu

SEQ ID NO: 230563 - RNA, 22 nt, Human
aaaugcacaauaaaguaaaggc

SEQ ID NO: 230564 - RNA, 22 nt, Human
aagcgcggccgccgcggucgcu

SEQ ID NO: 230565 - RNA, 22 nt, Human
aagcaggaaaugaaaugcuugc

SEQ ID NO: 230566 - RNA, 22 nt, Human
aagcauuuuagauaaagcauca

SEQ ID NO: 230567 - RNA, 22 nt, Human
aagcuagguccuccugaacugc

SEQ ID NO: 230568 - RNA, 22 nt, Human
aagcucuauaggagauacagua

SEQ ID NO: 230569 - RNA, 22 nt, Human
aagccugguuauuugaggaugu

SEQ ID NO: 230570 - RNA, 22 nt, Human
aagcucugggacugaggcuccu

SEQ ID NO: 230571 - RNA, 22 nt, Human
aaggaaaaccugacugaagaac

SEQ ID NO: 230572 - RNA, 22 nt, Human
aagcuuugaauauuagaccuug

SEQ ID NO: 230573 - RNA, 22 nt, Human
aagcuguuagggagugguaggu

SEQ ID NO: 230574 - RNA, 20 nt, Human
aagcuguguucaagauggga

SEQ ID NO: 230575 - RNA, 22 nt, Human
aagcgggcagcggccugcgcca

SEQ ID NO: 230576 - RNA, 22 nt, Human
aaggcgauuuaaagauguuagg

SEQ ID NO: 230577 - RNA, 22 nt, Human
aagccuuagauuggcgaugucg

SEQ ID NO: 230578 - RNA, 22 nt, Human
aagcgcaaggugucagcagguu

SEQ ID NO: 230579 - RNA, 22 nt, Human
aagcuguuauuucacagguuca

SEQ ID NO: 230580 - RNA, 22 nt, Human
aagcugaguaggaaugguaggu

SEQ ID NO: 230581 - RNA, 22 nt, Human
aagcugcagacccccugucuca

SEQ ID NO: 230582 - RNA, 22 nt, Human
aagcugccugggaggaagggcu

SEQ ID NO: 230583 - RNA, 22 nt, Human
aaggacaaaacagcuguucuaa

SEQ ID NO: 230584 - RNA, 22 nt, Human
aagcuuugggcagaagaggauu

SEQ ID NO: 230585 - RNA, 22 nt, Human
aaggagaggagucauugggaua

SEQ ID NO: 230586 - RNA, 18 nt, Human
aaggaggaaugaauagca

SEQ ID NO: 230587 - RNA, 22 nt, Human
aaggaguggugaagucagaugu

SEQ ID NO: 230588 - RNA, 22 nt, Human
aaggauuuccaggccugcgccu

SEQ ID NO: 230589 - RNA, 22 nt, Human
aaggauguuuaaacuacuuucc

SEQ ID NO: 230590 - RNA, 22 nt, Human
aaggcagagggaaaacgggaau

SEQ ID NO: 230591 - RNA, 22 nt, Human
aaggcgaggggcacagcugaga

SEQ ID NO: 230592 - RNA, 22 nt, Human
aaggcaggagaguaggaggugg

SEQ ID NO: 230593 - RNA, 22 nt, Human
aaggcaguuaauuuggcuagaa

SEQ ID NO: 230594 - RNA, 22 nt, Human
aagaaaggcacaagaaagaaaa

SEQ ID NO: 230595 - RNA, 22 nt, Human
aagacagaaaagcagagagagg

SEQ ID NO: 230596 - RNA, 22 nt, Human
aagacagugacagucacaauug

SEQ ID NO: 230597 - RNA, 22 nt, Human
aagaaaagguaaccgcuuaucu

SEQ ID NO: 230598 - RNA, 22 nt, Human
aaccaagcucaauggucugagu

SEQ ID NO: 230599 - RNA, 22 nt, Human
aagaaaagcaucuuuguaguag

SEQ ID NO: 230600 - RNA, 22 nt, Human
aagaaaccauauuaguuccugg

SEQ ID NO: 230601 - RNA, 22 nt, Human
aagaacuagauagugguguaaa

SEQ ID NO: 230602 - RNA, 22 nt, Human
aagaccacaggaaucaaacagg

SEQ ID NO: 230603 - RNA, 22 nt, Human
aagacccuaccccuggagagga

SEQ ID NO: 230604 - RNA, 22 nt, Human
aagagaaaaaucuuaaucuagu

SEQ ID NO: 230605 - RNA, 22 nt, Human
aagagaaacauauggccagauu

SEQ ID NO: 230606 - RNA, 22 nt, Human
aagaacaugggugugggcauuc

SEQ ID NO: 230607 - RNA, 23 nt, Human
aagaaugcuucugaagagcugcc

SEQ ID NO: 230608 - RNA, 22 nt, Human
aagaaggcggaccagaagggag

SEQ ID NO: 230609 - RNA, 22 nt, Human
aagaggaggcuggaauccuaaa

SEQ ID NO: 230610 - RNA, 23 nt, Human
aagcaacagacuucaucagauau

SEQ ID NO: 230611 - RNA, 21 nt, Human
aagcagcugcagaauuucagu

SEQ ID NO: 230612 - RNA, 22 nt, Human
aagcagacugggccauaaggaa

SEQ ID NO: 230613 - RNA, 22 nt, Human
aagaugaucagagggcaagagg

SEQ ID NO: 230614 - RNA, 22 nt, Human
aagcaaaugguauugguauuau

SEQ ID NO: 230615 - RNA, 22 nt, Human
aagauauauaacccuuucacuu

SEQ ID NO: 230616 - RNA, 22 nt, Human
aagcaaaaucgcaucuggggcc

SEQ ID NO: 230617 - RNA, 22 nt, Human
aagcaaagucaucuagaguagu

SEQ ID NO: 230618 - RNA, 22 nt, Human
aagagugugagguugugcuuuu

SEQ ID NO: 230619 - RNA, 22 nt, Human
aagagggguggucugugaggau

SEQ ID NO: 230620 - RNA, 22 nt, Human
aagaucugaccgugauggcggc

SEQ ID NO: 230621 - RNA, 22 nt, Human
aagaugcaagcauuuugaacug

SEQ ID NO: 230622 - RNA, 22 nt, Human
aaggaaaaaauggcuugugaua

SEQ ID NO: 230623 - RNA, 18 nt, Human
aagcugcauuauuuuggc

SEQ ID NO: 230624 - RNA, 22 nt, Human
aaggaacuucagggcgaaugga

SEQ ID NO: 230625 - RNA, 22 nt, Human
aaggaaaguuaagguaaacucu

SEQ ID NO: 230626 - RNA, 22 nt, Human
aaggcugugaacuuuucgggaa

SEQ ID NO: 230627 - RNA, 22 nt, Human
aaggcgguuccgguucgcggcg

SEQ ID NO: 230628 - RNA, 22 nt, Human
aaggacaccaaacuaauuggga

SEQ ID NO: 230629 - RNA, 19 nt, Human
aaggcuuucugagugaaaa

SEQ ID NO: 230630 - RNA, 22 nt, Human
aaggucucucgggcuuugcuga

SEQ ID NO: 230631 - RNA, 22 nt, Human
aaggucuucgaaccuuauguua

SEQ ID NO: 230632 - RNA, 22 nt, Human
aagggcuucucgccugugugca

SEQ ID NO: 230633 - RNA, 22 nt, Human
aaggggaauaguaggaccuggg

SEQ ID NO: 230634 - RNA, 23 nt, Human
aaggugaagccaccaggugagga

SEQ ID NO: 230635 - RNA, 22 nt, Human
aagguauaaauaacucgggagg

SEQ ID NO: 230636 - RNA, 22 nt, Human
aaggggaggccugcgcuuucgg

SEQ ID NO: 230637 - RNA, 22 nt, Human
aagggagagggagaagguggga

SEQ ID NO: 230638 - RNA, 22 nt, Human
aagggccuccuggggagccugg

SEQ ID NO: 230639 - RNA, 22 nt, Human
aagucccaucugccuccaugua

SEQ ID NO: 230640 - RNA, 22 nt, Human
aagucgccuaaacaaaguaucu

SEQ ID NO: 230641 - RNA, 22 nt, Human
aaguauuccccaaguauucugg

SEQ ID NO: 230642 - RNA, 22 nt, Human
aagguccaugaauaucuaagcc

SEQ ID NO: 230643 - RNA, 22 nt, Human
aaggucuuggcucuggccgcac

SEQ ID NO: 230644 - RNA, 22 nt, Human
aaguaauuugugaaggcauguu

SEQ ID NO: 230645 - RNA, 22 nt, Human
aaguacugauucuguuccucaa

SEQ ID NO: 230646 - RNA, 22 nt, Human
aaggugcugaggguccuggcuu

SEQ ID NO: 230647 - RNA, 22 nt, Human
aagguggugaucaucuugaagg

SEQ ID NO: 230648 - RNA, 20 nt, Human
aagucuauuuagaguugcuu

SEQ ID NO: 230649 - RNA, 22 nt, Human
aagucuuugagaucggacauag

SEQ ID NO: 230650 - RNA, 22 nt, Human
aagugaaaaaagucaguacuga

SEQ ID NO: 230651 - RNA, 22 nt, Human
aagucuguucuacagcaccaga

SEQ ID NO: 230652 - RNA, 22 nt, Human
aagugaggagaccucuucuuca

SEQ ID NO: 230653 - RNA, 22 nt, Human
aagugauuuagagagcucuuag

SEQ ID NO: 230654 - RNA, 22 nt, Human
aagugagaugggagucagagga

SEQ ID NO: 230655 - RNA, 22 nt, Human
aagugaagccaauuuuuuuagg

SEQ ID NO: 230656 - RNA, 22 nt, Human
aauaugaugccaaauugcuaca

SEQ ID NO: 230657 - RNA, 22 nt, Human
aauaucuagccuuuagcagcuu

SEQ ID NO: 230658 - RNA, 22 nt, Human
aauaugccaaauccugucacau

SEQ ID NO: 230659 - RNA, 22 nt, Human
aauagaguccuguacugaauga

SEQ ID NO: 230660 - RNA, 22 nt, Human
aagugauuuucccaccaucuac

SEQ ID NO: 230661 - RNA, 20 nt, Human
aauagcacagcucaaacauu

SEQ ID NO: 230662 - RNA, 22 nt, Human
aauaauuuuuuugugauuaugu

SEQ ID NO: 230663 - RNA, 22 nt, Human
aauagcaauuacccuucaacuc

SEQ ID NO: 230664 - RNA, 22 nt, Human
aauacaaucagauuaugguagu

SEQ ID NO: 230665 - RNA, 22 nt, Human
aauaagacugucauggaguaaa

SEQ ID NO: 230666 - RNA, 22 nt, Human
aauauuuaaauagaauuacauc

SEQ ID NO: 230667 - RNA, 22 nt, Human
aauaugucacacuccuuaauag

SEQ ID NO: 230668 - RNA, 22 nt, Human
aaucaucuguuguucccuugga

SEQ ID NO: 230669 - RNA, 22 nt, Human
aaucauaacaaaagcaauuaua

SEQ ID NO: 230670 - RNA, 22 nt, Human
aauaugcaaagcguguuaucug

SEQ ID NO: 230671 - RNA, 22 nt, Human
aaucacuuagaacccaggaagu

SEQ ID NO: 230672 - RNA, 22 nt, Human
aaucacuggcuccucacggcaa

SEQ ID NO: 230673 - RNA, 22 nt, Human
aaucaauuauccauuuguuagu

SEQ ID NO: 230674 - RNA, 20 nt, Human
aauaaauauaacccauaauu

SEQ ID NO: 230675 - RNA, 22 nt, Human
aauaaagcuugaaagcagggaa

SEQ ID NO: 230676 - RNA, 21 nt, Human
aaguuuuggcuguacaguugu

SEQ ID NO: 230677 - RNA, 22 nt, Human
aauaagagaauaaaaucuguua

SEQ ID NO: 230678 - RNA, 22 nt, Human
aauaauacaugugaugagaauu

SEQ ID NO: 230679 - RNA, 22 nt, Human
aauaacuuacucuaugcuuagu

SEQ ID NO: 230680 - RNA, 23 nt, Human
aagugcucaguggacagcauugc

SEQ ID NO: 230681 - RNA, 22 nt, Human
aagugauuuuccuacuugcuaa

SEQ ID NO: 230682 - RNA, 22 nt, Human
aagugcuggccuacucaaucga

SEQ ID NO: 230683 - RNA, 20 nt, Human
aagugcuguuagcugccuga

SEQ ID NO: 230684 - RNA, 22 nt, Human
aaguuccuaaagucagggguca

SEQ ID NO: 230685 - RNA, 23 nt, Human
aaguugucauguaaaaugggcua

SEQ ID NO: 230686 - RNA, 22 nt, Human
aaguuuaagguagugaugauga

SEQ ID NO: 230687 - RNA, 22 nt, Human
acaaggccugagggugacagca

SEQ ID NO: 230688 - RNA, 22 nt, Human
acaagaaaggucugggaacaau

SEQ ID NO: 230689 - RNA, 22 nt, Human
acaacuuuaauggguuucagcu

SEQ ID NO: 230690 - RNA, 22 nt, Human
acaaggaagaaaacauuacuuu

SEQ ID NO: 230691 - RNA, 22 nt, Human
acaauaauguuuuuagguuauu

SEQ ID NO: 230692 - RNA, 22 nt, Human
acaaucuuauuaguaguauaga

SEQ ID NO: 230693 - RNA, 17 nt, Human
acaaugggcaacaauau

SEQ ID NO: 230694 - RNA, 22 nt, Human
acaaugugcuuaugaaggcagu

SEQ ID NO: 230695 - RNA, 22 nt, Human
acaaucagcacugaguuuaucu

SEQ ID NO: 230696 - RNA, 22 nt, Human
acacacagaaggaagccccacu

SEQ ID NO: 230697 - RNA, 22 nt, Human
acacaagaaugugcacucagcc

SEQ ID NO: 230698 - RNA, 20 nt, Human
acacagccuagaguuuggcu

SEQ ID NO: 230699 - RNA, 22 nt, Human
acacaggacacaaaagucacca

SEQ ID NO: 230700 - RNA, 22 nt, Human
acacagaguauuuagaaggggu

SEQ ID NO: 230701 - RNA, 20 nt, Human
acacaccugcucagacugag

SEQ ID NO: 230702 - RNA, 19 nt, Human
acacaccagugccugugac

SEQ ID NO: 230703 - RNA, 22 nt, Human
acacgauguuuuaagccccuaa

SEQ ID NO: 230704 - RNA, 22 nt, Human
acacccuuuagcaauucuucaa

SEQ ID NO: 230705 - RNA, 22 nt, Human
acacgcacaccugugcacucgu

SEQ ID NO: 230706 - RNA, 22 nt, Human
acacucagaaaggcagagguuc

SEQ ID NO: 230707 - RNA, 22 nt, Human
acacuagcgcaaauacgcccau

SEQ ID NO: 230708 - RNA, 23 nt, Human
acacauguuuaugcuugggggca

SEQ ID NO: 230709 - RNA, 14 nt, Human
acagaagucugcua

SEQ ID NO: 230710 - RNA, 22 nt, Human
acagacaucaucaacaucuucc

SEQ ID NO: 230711 - RNA, 23 nt, Human
acagaggcaucagagcagcaggc

SEQ ID NO: 230712 - RNA, 22 nt, Human
acagacuuuuagacuuaugagu

SEQ ID NO: 230713 - RNA, 22 nt, Human
acagagcucccagccaucuccu

SEQ ID NO: 230714 - RNA, 22 nt, Human
acagaucugcacagugaacaau

SEQ ID NO: 230715 - RNA, 22 nt, Human
acagacuuaguauccugcugcu

SEQ ID NO: 230716 - RNA, 22 nt, Human
acagacuugaccuuggagaggc

SEQ ID NO: 230717 - RNA, 21 nt, Human
acagaaguggcuuggucucag

SEQ ID NO: 230718 - RNA, 22 nt, Human
acagcaauccuggcagaggguu

SEQ ID NO: 230719 - RNA, 22 nt, Human
acagcagguuauuguuauggca

SEQ ID NO: 230720 - RNA, 22 nt, Human
acagccacccuggaacgguugu

SEQ ID NO: 230721 - RNA, 22 nt, Human
acagcuauuuaaaggcuuuagg

SEQ ID NO: 230722 - RNA, 20 nt, Human
acagccguaaugguccuugg

SEQ ID NO: 230723 - RNA, 22 nt, Human
acagaucuauauuauauauaca

SEQ ID NO: 230724 - RNA, 22 nt, Human
acagaugccagcuacaccaccg

SEQ ID NO: 230725 - RNA, 22 nt, Human
acagagggagugacggccaacc

SEQ ID NO: 230726 - RNA, 22 nt, Human
acagcauagaggaaauguggaa

SEQ ID NO: 230727 - RNA, 23 nt, Human
acagcaagaggaccagaugugag

SEQ ID NO: 230728 - RNA, 19 nt, Human
acaggaaggaaaauuucaa

SEQ ID NO: 230729 - RNA, 22 nt, Human
acagcucaggcccaucaacccc

SEQ ID NO: 230730 - RNA, 22 nt, Human
acagcuggaggucugugagcac

SEQ ID NO: 230731 - RNA, 22 nt, Human
acagcugguugaaggggaccaa

SEQ ID NO: 230732 - RNA, 19 nt, Human
acagccuguugguggggcu

SEQ ID NO: 230733 - RNA, 22 nt, Human
acagccaacgucuuucuuacuu

SEQ ID NO: 230734 - RNA, 22 nt, Human
acagccacuaugacagauuuag

SEQ ID NO: 230735 - RNA, 22 nt, Human
acaggacgugugugcgcaugug

SEQ ID NO: 230736 - RNA, 22 nt, Human
acagcugagaugcuacuugugg

SEQ ID NO: 230737 - RNA, 22 nt, Human
acaggacaaaaaucuggauggc

SEQ ID NO: 230738 - RNA, 22 nt, Human
acaggaaugaagaugagagagu

SEQ ID NO: 230739 - RNA, 22 nt, Human
acaggccuggguucaaauuugg

SEQ ID NO: 230740 - RNA, 22 nt, Human
acaggauuuucagggaagguga

SEQ ID NO: 230741 - RNA, 22 nt, Human
acagucuuggauuccaggaguc

SEQ ID NO: 230742 - RNA, 22 nt, Human
acaggcgucgccugcucuugcc

SEQ ID NO: 230743 - RNA, 22 nt, Human
acaggcugcccgcuccccaccu

SEQ ID NO: 230744 - RNA, 22 nt, Human
acaggguauauaggcaaagcua

SEQ ID NO: 230745 - RNA, 22 nt, Human
acaggguaagggagggugagug

SEQ ID NO: 230746 - RNA, 22 nt, Human
acagguaucccuuucuaccuga

SEQ ID NO: 230747 - RNA, 22 nt, Human
acagguuucuccccugguuauu

SEQ ID NO: 230748 - RNA, 22 nt, Human
acaggaaaugaaaugguaucua

SEQ ID NO: 230749 - RNA, 22 nt, Human
acagguuggagguguggaguca

SEQ ID NO: 230750 - RNA, 22 nt, Human
acauaaaccccccuuccccagg

SEQ ID NO: 230751 - RNA, 22 nt, Human
acaggggauaggcaggaaggca

SEQ ID NO: 230752 - RNA, 22 nt, Human
acauauggcagguugaucaaug

SEQ ID NO: 230753 - RNA, 22 nt, Human
acaucacuugguuaaugugguc

SEQ ID NO: 230754 - RNA, 20 nt, Human
acauccacugagugggauga

SEQ ID NO: 230755 - RNA, 21 nt, Human
acauccaggguccucacugcc

SEQ ID NO: 230756 - RNA, 22 nt, Human
acaguuuuccuugguauagaac

SEQ ID NO: 230757 - RNA, 22 nt, Human
acaguguuacuugauaguguau

SEQ ID NO: 230758 - RNA, 19 nt, Human
acaguucuguggccuguuc

SEQ ID NO: 230759 - RNA, 22 nt, Human
acauaaacaugcagccugccaa

SEQ ID NO: 230760 - RNA, 22 nt, Human
aauggaaaggagccugacuaua

SEQ ID NO: 230761 - RNA, 22 nt, Human
aauggaaaaauccacagggaac

SEQ ID NO: 230762 - RNA, 22 nt, Human
aaugcugaaugcauguuuccau

SEQ ID NO: 230763 - RNA, 22 nt, Human
aaugcugugggauagggcuccu

SEQ ID NO: 230764 - RNA, 22 nt, Human
aauggcaagccacaugcuuuuc

SEQ ID NO: 230765 - RNA, 22 nt, Human
aauggcaauagugcauuaugua

SEQ ID NO: 230766 - RNA, 22 nt, Human
aauggcaaaaguuucggaaauu

SEQ ID NO: 230767 - RNA, 22 nt, Human
aauggaugauuaaauggaugaa

SEQ ID NO: 230768 - RNA, 22 nt, Human
aauggauaacaccgguucuguc

SEQ ID NO: 230769 - RNA, 22 nt, Human
aauggaaaaagaacuguuuaaa

SEQ ID NO: 230770 - RNA, 22 nt, Human
aaugcgcagaguggugugugca

SEQ ID NO: 230771 - RNA, 22 nt, Human
aaucuacaaugaaaaaauguuu

SEQ ID NO: 230772 - RNA, 22 nt, Human
aaucgguugaacccaggaagug

SEQ ID NO: 230773 - RNA, 22 nt, Human
aaugcugugauuuauuaaguau

SEQ ID NO: 230774 - RNA, 22 nt, Human
aaugcuuuuugcgaaaugugca

SEQ ID NO: 230775 - RNA, 22 nt, Human
aaucauguguaaugggcagacc

SEQ ID NO: 230776 - RNA, 22 nt, Human
aaucaugagguguuucuuugca

SEQ ID NO: 230777 - RNA, 22 nt, Human
aaucccaguugacagaacuguu

SEQ ID NO: 230778 - RNA, 22 nt, Human
aaugguaauauuucauaguugu

SEQ ID NO: 230779 - RNA, 22 nt, Human
aauggcagauaauuuuccagau

SEQ ID NO: 230780 - RNA, 22 nt, Human
aauggcuagcauguaaaauauc

SEQ ID NO: 230781 - RNA, 22 nt, Human
aauggugaggagugcauugaga

SEQ ID NO: 230782 - RNA, 22 nt, Human
aaugguagaguauuuuaauccu

SEQ ID NO: 230783 - RNA, 23 nt, Human
aaugugaaauugaguuuuuguua

SEQ ID NO: 230784 - RNA, 22 nt, Human
aauguucauauggguagcagau

SEQ ID NO: 230785 - RNA, 22 nt, Human
aaugugguauuuuggcauucuu

SEQ ID NO: 230786 - RNA, 22 nt, Human
aaugugcugguaacugcuuugc

SEQ ID NO: 230787 - RNA, 22 nt, Human
aaugugcauaacuuuauaaauu

SEQ ID NO: 230788 - RNA, 22 nt, Human
aauguuaguauuuaagagcuug

SEQ ID NO: 230789 - RNA, 22 nt, Human
aaugugugggagaacagucuuu

SEQ ID NO: 230790 - RNA, 22 nt, Human
aauguguauguguauauauaug

SEQ ID NO: 230791 - RNA, 22 nt, Human
aauuaaauguuugguuugagcu

SEQ ID NO: 230792 - RNA, 22 nt, Human
aauguuuuucaaguguggagca

SEQ ID NO: 230793 - RNA, 22 nt, Human
aauuauuauguggaagacgacg

SEQ ID NO: 230794 - RNA, 22 nt, Human
aauuauuaagcuuucuccagug

SEQ ID NO: 230795 - RNA, 22 nt, Human
aauuauuaucauuaucuuccug

SEQ ID NO: 230796 - RNA, 22 nt, Human
aauuauguugaaauaugagaac

SEQ ID NO: 230797 - RNA, 22 nt, Human
acaaauuuaaauguugucuguu

SEQ ID NO: 230798 - RNA, 20 nt, Human
acaaccacugcucacaguuu

SEQ ID NO: 230799 - RNA, 22 nt, Human
acaaccaugucaguucaaacca

SEQ ID NO: 230800 - RNA, 22 nt, Human
acaaaucccuguaaacacagcu

SEQ ID NO: 230801 - RNA, 22 nt, Human
acaaacugggauaggauccugu

SEQ ID NO: 230802 - RNA, 22 nt, Human
acaaagugaaaagcaucgaauu

SEQ ID NO: 230803 - RNA, 22 nt, Human
aauuugcuccaaugucaguucu

SEQ ID NO: 230804 - RNA, 22 nt, Human
aauuucuccuuuucaguuagau

SEQ ID NO: 230805 - RNA, 22 nt, Human
aauuucuuuagagguacugauc

SEQ ID NO: 230806 - RNA, 22 nt, Human
aauuucuuucagcugcuuuaag

SEQ ID NO: 230807 - RNA, 22 nt, Human
acaaaaauauuguagaagugcu

SEQ ID NO: 230808 - RNA, 21 nt, Human
acaaaaccuaacuuggcugcu

SEQ ID NO: 230809 - RNA, 18 nt, Human
acaaaaauagugcuuugg

SEQ ID NO: 230810 - RNA, 22 nt, Human
aauuuuauuuuuuccccuagau

SEQ ID NO: 230811 - RNA, 22 nt, Human
aauuuuagcuaaagauccaugg

SEQ ID NO: 230812 - RNA, 22 nt, Human
aauuuuauuagacaggcauaau

SEQ ID NO: 230813 - RNA, 22 nt, Human
aauuucaucugagacugggagc

SEQ ID NO: 230814 - RNA, 20 nt, Human
aauuuagaguuuuaccaagg

SEQ ID NO: 230815 - RNA, 22 nt, Human
aauuuaauugguuuuuacuugu

SEQ ID NO: 230816 - RNA, 22 nt, Human
aauuuauccuuuugcuaaagca

SEQ ID NO: 230817 - RNA, 22 nt, Human
aauuucagaccaacgagucagg

SEQ ID NO: 230818 - RNA, 22 nt, Human
aauuuaaguuauugcuaaugug

SEQ ID NO: 230819 - RNA, 22 nt, Human
aauugugagaguuagagagcau

SEQ ID NO: 230820 - RNA, 22 nt, Human
aauuguuagaaaugacuguuuu

SEQ ID NO: 230821 - RNA, 22 nt, Human
aauugguuugaauaaauaaaga

SEQ ID NO: 230822 - RNA, 22 nt, Human
aauuauucaugucugggcagcc

SEQ ID NO: 230823 - RNA, 22 nt, Human
aauuauucucucaacugagaug

SEQ ID NO: 230824 - RNA, 22 nt, Human
aauucuuuguuccucugccaag

SEQ ID NO: 230825 - RNA, 22 nt, Human
aauucuguugguuagaguugga

SEQ ID NO: 230826 - RNA, 22 nt, Human
aauugccaagaauuagugauac

SEQ ID NO: 230827 - RNA, 21 nt, Human
aauugccuaauauaugggaag

SEQ ID NO: 230828 - RNA, 22 nt, Human
aauugcuuucacaaguguuaua

SEQ ID NO: 230829 - RNA, 22 nt, Human
aauugcauucauuuguauauuu

SEQ ID NO: 230830 - RNA, 19 nt, Human
agcagccaucgaccaugga

SEQ ID NO: 230831 - RNA, 22 nt, Human
agcagcaggugaccucgaugcc

SEQ ID NO: 230832 - RNA, 22 nt, Human
agcagccgccgccgccgcgcac

SEQ ID NO: 230833 - RNA, 22 nt, Human
agcagggagacagugcagcauu

SEQ ID NO: 230834 - RNA, 20 nt, Human
agcauucaacuuucuauguu

SEQ ID NO: 230835 - RNA, 22 nt, Human
agcaugucuaacucuucagggu

SEQ ID NO: 230836 - RNA, 22 nt, Human
agcaggacuugcugagcccucc

SEQ ID NO: 230837 - RNA, 22 nt, Human
agcaggaaggcuagaagcagga

SEQ ID NO: 230838 - RNA, 22 nt, Human
agcacuuuagaauuuagaguug

SEQ ID NO: 230839 - RNA, 22 nt, Human
agcacuagcugcuugucucaag

SEQ ID NO: 230840 - RNA, 22 nt, Human
agcacguucuucauuacuucac

SEQ ID NO: 230841 - RNA, 22 nt, Human
agcagcaaugacaauucaacca

SEQ ID NO: 230842 - RNA, 22 nt, Human
agcagauuguacagugcauuag

SEQ ID NO: 230843 - RNA, 22 nt, Human
agcagcugagccccagcuguga

SEQ ID NO: 230844 - RNA, 22 nt, Human
agcagauaaagguugcauuucu

SEQ ID NO: 230845 - RNA, 22 nt, Human
agcaauucagagcauggacuuu

SEQ ID NO: 230846 - RNA, 22 nt, Human
agcacagugccugacauauaug

SEQ ID NO: 230847 - RNA, 22 nt, Human
agauuuggaauggggguucaua

SEQ ID NO: 230848 - RNA, 22 nt, Human
agauuuucuuuuccaucuuugu

SEQ ID NO: 230849 - RNA, 20 nt, Human
agcacaggcagucauucagu

SEQ ID NO: 230850 - RNA, 22 nt, Human
agcacauguuucuuuugcaauu

SEQ ID NO: 230851 - RNA, 22 nt, Human
agcaccuuguucagaucuuaca

SEQ ID NO: 230852 - RNA, 22 nt, Human
agauuguaugaggacuccauga

SEQ ID NO: 230853 - RNA, 22 nt, Human
agcaauucugaaauuacuugac

SEQ ID NO: 230854 - RNA, 22 nt, Human
agcaaauaauugucuuugaggg

SEQ ID NO: 230855 - RNA, 22 nt, Human
agcaagggucucucauggcuug

SEQ ID NO: 230856 - RNA, 22 nt, Human
agcaaggagcugaaaccgggcu

SEQ ID NO: 230857 - RNA, 22 nt, Human
agcaaggguugguuuucugaca

SEQ ID NO: 230858 - RNA, 22 nt, Human
agcaauguuggccuauauaccu

SEQ ID NO: 230859 - RNA, 22 nt, Human
agcacucacuagaguuagaacc

SEQ ID NO: 230860 - RNA, 22 nt, Human
agcacuugggugauaguacuuu

SEQ ID NO: 230861 - RNA, 22 nt, Human
agcaaagccucuuugaaaaaaa

SEQ ID NO: 230862 - RNA, 22 nt, Human
agcagagggucaguuuuuuagu

SEQ ID NO: 230863 - RNA, 22 nt, Human
agcagagaacauucauucaugu

SEQ ID NO: 230864 - RNA, 22 nt, Human
agccuggacagcuacggagaac

SEQ ID NO: 230865 - RNA, 22 nt, Human
agcgcccguugagucgcgcggu

SEQ ID NO: 230866 - RNA, 22 nt, Human
agcgccgcugugauuggugagg

SEQ ID NO: 230867 - RNA, 19 nt, Human
agcgccucuacugcaugga

SEQ ID NO: 230868 - RNA, 22 nt, Human
agcgcucauuuuccuccugcuc

SEQ ID NO: 230869 - RNA, 21 nt, Human
agcgcugcauccaccauggcu

SEQ ID NO: 230870 - RNA, 22 nt, Human
agccuguacuuagagggauuaa

SEQ ID NO: 230871 - RNA, 22 nt, Human
agccucucugaugugacagcua

SEQ ID NO: 230872 - RNA, 22 nt, Human
agccugaaccaauauagcagcc

SEQ ID NO: 230873 - RNA, 22 nt, Human
agccucuagcuccccaaagcca

SEQ ID NO: 230874 - RNA, 22 nt, Human
agccuauucaucugaucuugaa

SEQ ID NO: 230875 - RNA, 21 nt, Human
agccgggacaacguggacccc

SEQ ID NO: 230876 - RNA, 22 nt, Human
agccuacauuugacuauagucu

SEQ ID NO: 230877 - RNA, 22 nt, Human
agccgcugaauuugaaacaagc

SEQ ID NO: 230878 - RNA, 22 nt, Human
agccgcgcuguuccugcugcug

SEQ ID NO: 230879 - RNA, 22 nt, Human
agccuugcaugauuucauucau

SEQ ID NO: 230880 - RNA, 22 nt, Human
agccuuucugcgcacucuuccg

SEQ ID NO: 230881 - RNA, 22 nt, Human
agcgacuguaagagggccccgg

SEQ ID NO: 230882 - RNA, 22 nt, Human
agccggccucggacagagggag

SEQ ID NO: 230883 - RNA, 22 nt, Human
agcccuauacuuagauuuauuc

SEQ ID NO: 230884 - RNA, 22 nt, Human
agcccgggagggcugucuggga

SEQ ID NO: 230885 - RNA, 22 nt, Human
agcccccaaaauguuugccugc

SEQ ID NO: 230886 - RNA, 22 nt, Human
agcccagguggagugugugggg

SEQ ID NO: 230887 - RNA, 22 nt, Human
agcaguuuauccucauaaugga

SEQ ID NO: 230888 - RNA, 22 nt, Human
agcauaacaaagggcauaauug

SEQ ID NO: 230889 - RNA, 22 nt, Human
agccaugcuguuuugccuggga

SEQ ID NO: 230890 - RNA, 22 nt, Human
agccaucuggugucaaugauuc

SEQ ID NO: 230891 - RNA, 22 nt, Human
agccagugucgugugacaugag

SEQ ID NO: 230892 - RNA, 22 nt, Human
agccagugcagcuggaaauuca

SEQ ID NO: 230893 - RNA, 22 nt, Human
agccagauuuuuugagaggcga

SEQ ID NO: 230894 - RNA, 22 nt, Human
agccagcauauauauaguugaa

SEQ ID NO: 230895 - RNA, 22 nt, Human
agccacagucuguagccagcuu

SEQ ID NO: 230896 - RNA, 22 nt, Human
agcccugugugcuuguguuccu

SEQ ID NO: 230897 - RNA, 22 nt, Human
agccgauaaauuguuuucuugg

SEQ ID NO: 230898 - RNA, 22 nt, Human
agcccuucccuuucacuggugc

SEQ ID NO: 230899 - RNA, 22 nt, Human
agccauggagauguggguuggg

SEQ ID NO: 230900 - RNA, 22 nt, Human
agccauggaggaugugcagcau

SEQ ID NO: 230901 - RNA, 23 nt, Human
agcccagcagagaaccuaggucc

SEQ ID NO: 230902 - RNA, 22 nt, Human
agauauucugccuaacagguuu

SEQ ID NO: 230903 - RNA, 22 nt, Human
agauggaguccugaagccagaa

SEQ ID NO: 230904 - RNA, 19 nt, Human
agaucaggauguauuuuug

SEQ ID NO: 230905 - RNA, 22 nt, Human
agauccuagaugugaauagcua

SEQ ID NO: 230906 - RNA, 22 nt, Human
agaugaugugugucuucagcua

SEQ ID NO: 230907 - RNA, 21 nt, Human
agaugcaguuugcaggugggu

SEQ ID NO: 230908 - RNA, 22 nt, Human
agauggaggaaagcaguuagaa

SEQ ID NO: 230909 - RNA, 20 nt, Human
agaugcccaacucuguuuug

SEQ ID NO: 230910 - RNA, 22 nt, Human
agaugaguaaauggagucuucc

SEQ ID NO: 230911 - RNA, 22 nt, Human
agauauuauuuucuauuuauca

SEQ ID NO: 230912 - RNA, 22 nt, Human
agauaucuuguuggcauaaaug

SEQ ID NO: 230913 - RNA, 22 nt, Human
agauaggcuuagccaagcuuuc

SEQ ID NO: 230914 - RNA, 21 nt, Human
agauguucaguguccuaaccc

SEQ ID NO: 230915 - RNA, 22 nt, Human
agauguugucucuuacguuuga

SEQ ID NO: 230916 - RNA, 23 nt, Human
agaugaugaauaaagagugagga

SEQ ID NO: 230917 - RNA, 22 nt, Human
agaugacuuuguccugagcuga

SEQ ID NO: 230918 - RNA, 22 nt, Human
agaucugucaccauccuggagc

SEQ ID NO: 230919 - RNA, 22 nt, Human
agaucauuaaccaccuguucug

SEQ ID NO: 230920 - RNA, 22 nt, Human
agaugaacuuuuuuaaacugga

SEQ ID NO: 230921 - RNA, 22 nt, Human
agauggcuccaguguccagagg

SEQ ID NO: 230922 - RNA, 22 nt, Human
agauguuaauaaccuuagggca

SEQ ID NO: 230923 - RNA, 22 nt, Human
agauucucccuccuggcgcugu

SEQ ID NO: 230924 - RNA, 22 nt, Human
agauuuuacggaguauuagggu

SEQ ID NO: 230925 - RNA, 22 nt, Human
agauuucaauggauauugcaag

SEQ ID NO: 230926 - RNA, 22 nt, Human
agauugaacgagcuggcaugga

SEQ ID NO: 230927 - RNA, 22 nt, Human
agauggcugggagcucuguuug

SEQ ID NO: 230928 - RNA, 22 nt, Human
agaugguucagaauuauaaaga

SEQ ID NO: 230929 - RNA, 22 nt, Human
agauggggccugaggacacugu

SEQ ID NO: 230930 - RNA, 19 nt, Human
agauggcaaaaugcaaaga

SEQ ID NO: 230931 - RNA, 22 nt, Human
agauuuguauagaugugguuga

SEQ ID NO: 230932 - RNA, 22 nt, Human
agcaacauggaguuugugcgca

SEQ ID NO: 230933 - RNA, 22 nt, Human
agcaaaguacugagcucaaagg

SEQ ID NO: 230934 - RNA, 22 nt, Human
agcaaaacuaaagacacagaca

SEQ ID NO: 230935 - RNA, 22 nt, Human
agcaaaauuccaaaaugcuaau

SEQ ID NO: 230936 - RNA, 22 nt, Human
agaugucauguguugcuccaag

SEQ ID NO: 230937 - RNA, 22 nt, Human
agauuauuuaagacaggaacca

SEQ ID NO: 230938 - RNA, 22 nt, Human
agauugaugugaccauuggaag

SEQ ID NO: 230939 - RNA, 22 nt, Human
agauuaagcauuauaauuauaa

SEQ ID NO: 230940 - RNA, 22 nt, Human
agagauuuacaacuugggcuuu

SEQ ID NO: 230941 - RNA, 22 nt, Human
agacacauuuucagcucugcca

SEQ ID NO: 230942 - RNA, 22 nt, Human
agagcaauggugcuuuaauucu

SEQ ID NO: 230943 - RNA, 22 nt, Human
agagcagaggcauggccguggg

SEQ ID NO: 230944 - RNA, 22 nt, Human
agacgggacagacuuuugagug

SEQ ID NO: 230945 - RNA, 22 nt, Human
agagggagagauuggcaaucag

SEQ ID NO: 230946 - RNA, 22 nt, Human
agaggcagagcugggguuugac

SEQ ID NO: 230947 - RNA, 22 nt, Human
agagcauagggcauuaggaagg

SEQ ID NO: 230948 - RNA, 22 nt, Human
agagcaucgguggaguccccac

SEQ ID NO: 230949 - RNA, 22 nt, Human
agagccggagucuucuuguuug

SEQ ID NO: 230950 - RNA, 22 nt, Human
agauaaaucauuuauuaagcgg

SEQ ID NO: 230951 - RNA, 22 nt, Human
agaguucaccccacugaugagu

SEQ ID NO: 230952 - RNA, 22 nt, Human
agaguuaguggccucagcaggg

SEQ ID NO: 230953 - RNA, 22 nt, Human
agaguuaaugcaggccaagccu

SEQ ID NO: 230954 - RNA, 22 nt, Human
agaguggcaccuuaccugagac

SEQ ID NO: 230955 - RNA, 22 nt, Human
agaguacagaagcauuucagau

SEQ ID NO: 230956 - RNA, 22 nt, Human
agauacaaaagauaagauuuag

SEQ ID NO: 230957 - RNA, 22 nt, Human
agaugacuaacauaguauugcu

SEQ ID NO: 230958 - RNA, 17 nt, Human
agaucugaaggagaaca

SEQ ID NO: 230959 - RNA, 23 nt, Human
agauaaggaagcauuugagccag

SEQ ID NO: 230960 - RNA, 22 nt, Human
agauaacauguugcagauucug

SEQ ID NO: 230961 - RNA, 22 nt, Human
agauaagaacauuaguaagccg

SEQ ID NO: 230962 - RNA, 22 nt, Human
agauaaacaacucuuagcuguu

SEQ ID NO: 230963 - RNA, 21 nt, Human
agaguuuucuccauuucaggc

SEQ ID NO: 230964 - RNA, 21 nt, Human
agaguugaaggcaguaaagag

SEQ ID NO: 230965 - RNA, 22 nt, Human
agaagaagacccuaaggaaagg

SEQ ID NO: 230966 - RNA, 22 nt, Human
agaagaaugguuugaaagauuu

SEQ ID NO: 230967 - RNA, 22 nt, Human
agaagguagaugcaucaggagg

SEQ ID NO: 230968 - RNA, 22 nt, Human
agaacaggaggaagccagcucc

SEQ ID NO: 230969 - RNA, 22 nt, Human
agaacccaaggcccagggaugu

SEQ ID NO: 230970 - RNA, 22 nt, Human
agaaccaauacuacagcaagua

SEQ ID NO: 230971 - RNA, 22 nt, Human
agaaggcagaaaagcuuuacaa

SEQ ID NO: 230972 - RNA, 22 nt, Human
agaaguuuguuauguaaacaaa

SEQ ID NO: 230973 - RNA, 22 nt, Human
agaaguguacuuagagaacaua

SEQ ID NO: 230974 - RNA, 22 nt, Human
agaauacaauuguucaguaaua

SEQ ID NO: 230975 - RNA, 21 nt, Human
agaaguuauuccauggguguu

SEQ ID NO: 230976 - RNA, 22 nt, Human
agaaguagacaguuggauauaa

SEQ ID NO: 230977 - RNA, 22 nt, Human
agaauauaguaaauauuuucua

SEQ ID NO: 230978 - RNA, 22 nt, Human
agaagcauaagggcuuugccag

SEQ ID NO: 230979 - RNA, 22 nt, Human
agaagcagaaggaagcagggcc

SEQ ID NO: 230980 - RNA, 21 nt, Human
agaagcggucgaaucgcagac

SEQ ID NO: 230981 - RNA, 20 nt, Human
agaaggagagaugaggcaaa

SEQ ID NO: 230982 - RNA, 22 nt, Human
agaagggcugcuuagaauauac

SEQ ID NO: 230983 - RNA, 22 nt, Human
agaaucugcauuuuaacaagau

SEQ ID NO: 230984 - RNA, 22 nt, Human
agaagggaagcaggagaggcau

SEQ ID NO: 230985 - RNA, 22 nt, Human
agaagguggaguagaacaagcu

SEQ ID NO: 230986 - RNA, 22 nt, Human
agaauaagucuaauauauuggu

SEQ ID NO: 230987 - RNA, 22 nt, Human
agacaagagcugaggacauauu

SEQ ID NO: 230988 - RNA, 22 nt, Human
agacaaucaacuguugaugccu

SEQ ID NO: 230989 - RNA, 22 nt, Human
agaauuuguaucuacggugugc

SEQ ID NO: 230990 - RNA, 19 nt, Human
agaauuggaaccaugaacc

SEQ ID NO: 230991 - RNA, 22 nt, Human
agaccauuuuguagccagcaua

SEQ ID NO: 230992 - RNA, 22 nt, Human
agacaaggggauuuuugauggu

SEQ ID NO: 230993 - RNA, 22 nt, Human
agacccugauucugcuggcggu

SEQ ID NO: 230994 - RNA, 22 nt, Human
agaaugucaagucaagaacaau

SEQ ID NO: 230995 - RNA, 20 nt, Human
acuuucacaugaacauuuaa

SEQ ID NO: 230996 - RNA, 22 nt, Human
agaaaauagguaguagacgggc

SEQ ID NO: 230997 - RNA, 19 nt, Human
agaaacaacauucuggaga

SEQ ID NO: 230998 - RNA, 22 nt, Human
agaaaaggaagcuuagacugua

SEQ ID NO: 230999 - RNA, 22 nt, Human
agaaauggccagacuugccccu

SEQ ID NO: 231000 - RNA, 22 nt, Human
agaaaagaggcuuucuaagcau

SEQ ID NO: 231001 - RNA, 20 nt, Human
agaaaggaguaaagaagaga

SEQ ID NO: 231002 - RNA, 22 nt, Human
acuugagcuugaaagguaugcu

SEQ ID NO: 231003 - RNA, 22 nt, Human
acuuguaaaauagagauaggga

SEQ ID NO: 231004 - RNA, 22 nt, Human
acuuuauacuagugauaguuug

SEQ ID NO: 231005 - RNA, 22 nt, Human
acuuuaaaucuguugcuuagcu

SEQ ID NO: 231006 - RNA, 21 nt, Human
acuuccacaucacugaguaga

SEQ ID NO: 231007 - RNA, 22 nt, Human
acuuugccagcucccugcuggc

SEQ ID NO: 231008 - RNA, 22 nt, Human
acuuugaauuagaauuuugcug

SEQ ID NO: 231009 - RNA, 22 nt, Human
acuuaagcagaucuguggucca

SEQ ID NO: 231010 - RNA, 22 nt, Human
acuguugugaauaaugaaaugc

SEQ ID NO: 231011 - RNA, 22 nt, Human
acuguugcuuguuuggaauguu

SEQ ID NO: 231012 - RNA, 19 nt, Human
acuugcuuucauuuaagau

SEQ ID NO: 231013 - RNA, 22 nt, Human
acuuggucguggugcagcaugg

SEQ ID NO: 231014 - RNA, 22 nt, Human
acuuggcuaggguuuuuaucuu

SEQ ID NO: 231015 - RNA, 22 nt, Human
acuugcauuguguaguguuuuu

SEQ ID NO: 231016 - RNA, 22 nt, Human
acuugaugcauauggaagagca

SEQ ID NO: 231017 - RNA, 22 nt, Human
acugcguuucuaaaguagcaua

SEQ ID NO: 231018 - RNA, 22 nt, Human
acugccuugcaccauggcuuuu

SEQ ID NO: 231019 - RNA, 22 nt, Human
acuucaggacggcaguggaggg

SEQ ID NO: 231020 - RNA, 22 nt, Human
acuucaggagcagucucuggaa

SEQ ID NO: 231021 - RNA, 22 nt, Human
acuggauucucuuacacagaug

SEQ ID NO: 231022 - RNA, 23 nt, Human
acuggauuguucuugggcgcuga

SEQ ID NO: 231023 - RNA, 22 nt, Human
acuggauuuugugguguaucuu

SEQ ID NO: 231024 - RNA, 22 nt, Human
acuucauuugaaaugguugaau

SEQ ID NO: 231025 - RNA, 22 nt, Human
acuucccacugcagugacugag

SEQ ID NO: 231026 - RNA, 22 nt, Human
acuucugcccuggcgagggcgu

SEQ ID NO: 231027 - RNA, 22 nt, Human
acuugaagcaugaaaauaagcc

SEQ ID NO: 231028 - RNA, 22 nt, Human
acucugaaaggcuacaaaugcu

SEQ ID NO: 231029 - RNA, 22 nt, Human
acucucugcugcugagcuuggg

SEQ ID NO: 231030 - RNA, 23 nt, Human
acucucuguuuggaggcacuggu

SEQ ID NO: 231031 - RNA, 18 nt, Human
acucugaagcuaagucac

SEQ ID NO: 231032 - RNA, 22 nt, Human
acuccuuuuaugugugcuaaaa

SEQ ID NO: 231033 - RNA, 22 nt, Human
acucugaggauuucaguuuuac

SEQ ID NO: 231034 - RNA, 22 nt, Human
acucugagaugugucuugauuc

SEQ ID NO: 231035 - RNA, 22 nt, Human
acucgggggccgcugcagggag

SEQ ID NO: 231036 - RNA, 22 nt, Human
acucggcggccucgagugcugg

SEQ ID NO: 231037 - RNA, 22 nt, Human
acucggaggccaaggccaacgg

SEQ ID NO: 231038 - RNA, 21 nt, Human
acuccagccacugacugucuc

SEQ ID NO: 231039 - RNA, 22 nt, Human
acucaguuuugaucguucuuau

SEQ ID NO: 231040 - RNA, 22 nt, Human
acucagucauuuggggaacagu

SEQ ID NO: 231041 - RNA, 22 nt, Human
acucaguaacuguuugcugaau

SEQ ID NO: 231042 - RNA, 22 nt, Human
acucaucauuuuacggagcagc

SEQ ID NO: 231043 - RNA, 22 nt, Human
acuaugugucuguaucuggugc

SEQ ID NO: 231044 - RNA, 22 nt, Human
acuauugcuuuagggggaaacc

SEQ ID NO: 231045 - RNA, 22 nt, Human
acucuugacuaaugcuaauguc

SEQ ID NO: 231046 - RNA, 22 nt, Human
acugaaaguugaugagucacug

SEQ ID NO: 231047 - RNA, 22 nt, Human
acucugagguuuuccaaguaca

SEQ ID NO: 231048 - RNA, 22 nt, Human
acugaaauuuauauuuugggca

SEQ ID NO: 231049 - RNA, 22 nt, Human
acugaaggcuggaccaugcauc

SEQ ID NO: 231050 - RNA, 22 nt, Human
acugaaauggggacaguccuua

SEQ ID NO: 231051 - RNA, 18 nt, Human
acucuuccuuauguucuu

SEQ ID NO: 231052 - RNA, 22 nt, Human
acugagcaaaacugauccuguu

SEQ ID NO: 231053 - RNA, 22 nt, Human
acugacuacauguccugucauu

SEQ ID NO: 231054 - RNA, 22 nt, Human
acugaauguucucaaaggggag

SEQ ID NO: 231055 - RNA, 22 nt, Human
acugacuucugguauuuuuagu

SEQ ID NO: 231056 - RNA, 22 nt, Human
acugcuguugugauggguauuu

SEQ ID NO: 231057 - RNA, 22 nt, Human
acuggagcccguggaggcgcag

SEQ ID NO: 231058 - RNA, 22 nt, Human
acugcugauuauugaaguagag

SEQ ID NO: 231059 - RNA, 22 nt, Human
acugcauuucauaaauuacaau

SEQ ID NO: 231060 - RNA, 22 nt, Human
acugccauauuaggagcuucag

SEQ ID NO: 231061 - RNA, 22 nt, Human
acugcaggucccaucaccugcg

SEQ ID NO: 231062 - RNA, 22 nt, Human
acugcacuccagcccgagcaac

SEQ ID NO: 231063 - RNA, 22 nt, Human
acugcauuaucaccaagaugua

SEQ ID NO: 231064 - RNA, 22 nt, Human
acugaucuguguaauauguuac

SEQ ID NO: 231065 - RNA, 22 nt, Human
acugcagauccucugagaaacc

SEQ ID NO: 231066 - RNA, 22 nt, Human
acugaugacaaugugaguguuc

SEQ ID NO: 231067 - RNA, 22 nt, Human
acuauggaguucagaucuugag

SEQ ID NO: 231068 - RNA, 22 nt, Human
acucacuguuuugaaauugaac

SEQ ID NO: 231069 - RNA, 22 nt, Human
acucagcaccuagaaagugugc

SEQ ID NO: 231070 - RNA, 22 nt, Human
acuauuguccgauuucuuuacu

SEQ ID NO: 231071 - RNA, 22 nt, Human
acucaaccaucugcauuuuuga

SEQ ID NO: 231072 - RNA, 22 nt, Human
acuaucaacagcaucagggugu

SEQ ID NO: 231073 - RNA, 22 nt, Human
acuauauaaugcacacaguaua

SEQ ID NO: 231074 - RNA, 22 nt, Human
acuauacaguauguacgugcac

SEQ ID NO: 231075 - RNA, 22 nt, Human
acuaggugggugucacugacuc

SEQ ID NO: 231076 - RNA, 20 nt, Human
acuaccaugcaauuccgcuu

SEQ ID NO: 231077 - RNA, 22 nt, Human
acgguuuugugagguaguacuu

SEQ ID NO: 231078 - RNA, 22 nt, Human
acgguuuggggaggaggauccc

SEQ ID NO: 231079 - RNA, 22 nt, Human
acguccgcugauucuuuggaag

SEQ ID NO: 231080 - RNA, 22 nt, Human
acguaaacagcaaagacaugau

SEQ ID NO: 231081 - RNA, 22 nt, Human
acgucaucguugucaucgucau

SEQ ID NO: 231082 - RNA, 22 nt, Human
acgucuacaugcaauucuuaua

SEQ ID NO: 231083 - RNA, 22 nt, Human
acgugugugugcacguguguau

SEQ ID NO: 231084 - RNA, 22 nt, Human
acgugaccuuauuugaaaaaug

SEQ ID NO: 231085 - RNA, 22 nt, Human
acguugaaaugggcauuuuccg

SEQ ID NO: 231086 - RNA, 22 nt, Human
acuaggaaguaaauaugucauc

SEQ ID NO: 231087 - RNA, 22 nt, Human
acuagcacgccuuaccguaaga

SEQ ID NO: 231088 - RNA, 20 nt, Human
acgccgcgaggugagcuggu

SEQ ID NO: 231089 - RNA, 22 nt, Human
acgccugccuguacuugugggg

SEQ ID NO: 231090 - RNA, 22 nt, Human
acgccuugagccuugccugaau

SEQ ID NO: 231091 - RNA, 22 nt, Human
acagucucucaagcauauccug

SEQ ID NO: 231092 - RNA, 21 nt, Human
acaguaugaucaaaugugcca

SEQ ID NO: 231093 - RNA, 22 nt, Human
acauccaguaucagaagcauca

SEQ ID NO: 231094 - RNA, 22 nt, Human
acggccgaugacuccagcaugg

SEQ ID NO: 231095 - RNA, 22 nt, Human
acgggaggcguggucuuguagu

SEQ ID NO: 231096 - RNA, 23 nt, Human
acgcagacacauguaugggccuc

SEQ ID NO: 231097 - RNA, 22 nt, Human
acgccaggagcuucuccguuca

SEQ ID NO: 231098 - RNA, 22 nt, Human
acgccggguaaggucauucugc

SEQ ID NO: 231099 - RNA, 22 nt, Human
aggcaguggcuuuuguuguguu

SEQ ID NO: 231100 - RNA, 22 nt, Human
aggcauauaguguuuaaaaaaa

SEQ ID NO: 231101 - RNA, 22 nt, Human
aggcaucguguuuuucugcuuu

SEQ ID NO: 231102 - RNA, 22 nt, Human
aggcaggauuugcgaugugguu

SEQ ID NO: 231103 - RNA, 22 nt, Human
aggcaggagcugugguggugag

SEQ ID NO: 231104 - RNA, 22 nt, Human
aggcauguugcuucgggcuuug

SEQ ID NO: 231105 - RNA, 22 nt, Human
aggcaggcucaaugcccagucu

SEQ ID NO: 231106 - RNA, 23 nt, Human
aggcagcaugcaacaggccauuu

SEQ ID NO: 231107 - RNA, 22 nt, Human
aggcagaugggagcuggaaguu

SEQ ID NO: 231108 - RNA, 19 nt, Human
aggcagccccaacuugcau

SEQ ID NO: 231109 - RNA, 22 nt, Human
aggcacagaauccagucugcug

SEQ ID NO: 231110 - RNA, 22 nt, Human
aggcaagauuaggaccagaaga

SEQ ID NO: 231111 - RNA, 22 nt, Human
aggcaauagagggugaggagga

SEQ ID NO: 231112 - RNA, 22 nt, Human
aggcaauuuuuaggguuguugu

SEQ ID NO: 231113 - RNA, 22 nt, Human
aggcagcagggagggagaaaug

SEQ ID NO: 231114 - RNA, 21 nt, Human
aggcagcgauuuucauauugc

SEQ ID NO: 231115 - RNA, 23 nt, Human
aggcagaguccuggggcacagcc

SEQ ID NO: 231116 - RNA, 22 nt, Human
aggcagagauggcugcagggcc

SEQ ID NO: 231117 - RNA, 22 nt, Human
aggccccacaaacucgccuuug

SEQ ID NO: 231118 - RNA, 22 nt, Human
aggccgagaugacagagccacu

SEQ ID NO: 231119 - RNA, 20 nt, Human
aggccgcccgcugccgcuuc

SEQ ID NO: 231120 - RNA, 22 nt, Human
aggcugcuggcaggcguggacg

SEQ ID NO: 231121 - RNA, 22 nt, Human
aggccagugcagcuggaacaga

SEQ ID NO: 231122 - RNA, 22 nt, Human
aggccauuucacagguuuugga

SEQ ID NO: 231123 - RNA, 22 nt, Human
aggccagggacaaugaggcaga

SEQ ID NO: 231124 - RNA, 22 nt, Human
aggcugccuaugaaggcagaag

SEQ ID NO: 231125 - RNA, 22 nt, Human
aggccacucagggggccaagau

SEQ ID NO: 231126 - RNA, 21 nt, Human
aggcauuuucuuggagauucu

SEQ ID NO: 231127 - RNA, 22 nt, Human
aggcauuuucuuguuauuuuua

SEQ ID NO: 231128 - RNA, 22 nt, Human
aggccaggcgccggcgcgagac

SEQ ID NO: 231129 - RNA, 22 nt, Human
aggcauuuaaagauguaagacu

SEQ ID NO: 231130 - RNA, 22 nt, Human
aggcauuuaucaggaaauguuc

SEQ ID NO: 231131 - RNA, 22 nt, Human
aggcaguguggagggcuguugc

SEQ ID NO: 231132 - RNA, 22 nt, Human
aggcagugguguuugcuggugg

SEQ ID NO: 231133 - RNA, 22 nt, Human
aggcaguguguagcuggaagag

SEQ ID NO: 231134 - RNA, 22 nt, Human
aggcagugccuggaccccagcu

SEQ ID NO: 231135 - RNA, 22 nt, Human
aggcaggggagcuggaagggua

SEQ ID NO: 231136 - RNA, 22 nt, Human
aggcaguggagcuggaauaggc

SEQ ID NO: 231137 - RNA, 22 nt, Human
agcggcaggacgucuucuucga

SEQ ID NO: 231138 - RNA, 22 nt, Human
aggaaauaagggcacuucagau

SEQ ID NO: 231139 - RNA, 22 nt, Human
agcggcaagguguauguggcag

SEQ ID NO: 231140 - RNA, 22 nt, Human
agcgcugugaaggcugggccac

SEQ ID NO: 231141 - RNA, 22 nt, Human
agcgcuguguucccgugggcau

SEQ ID NO: 231142 - RNA, 22 nt, Human
aggaauugucgucauguauaau

SEQ ID NO: 231143 - RNA, 22 nt, Human
aggaaauaggaccagacaaagc

SEQ ID NO: 231144 - RNA, 22 nt, Human
aggaaguucuggaauuacuagg

SEQ ID NO: 231145 - RNA, 22 nt, Human
aggaauuucacugcguuuuuua

SEQ ID NO: 231146 - RNA, 22 nt, Human
aggaauuugggguuacaugaug

SEQ ID NO: 231147 - RNA, 19 nt, Human
agcggagguuguauauugu

SEQ ID NO: 231148 - RNA, 22 nt, Human
aggaauguugagacauggcuaa

SEQ ID NO: 231149 - RNA, 22 nt, Human
aggacacagaguauggaagugu

SEQ ID NO: 231150 - RNA, 20 nt, Human
aggaacuggaagggaggaaa

SEQ ID NO: 231151 - RNA, 22 nt, Human
aggagcacugggcaugucaccc

SEQ ID NO: 231152 - RNA, 16 nt, Human
aggagcagaaagcagu

SEQ ID NO: 231153 - RNA, 22 nt, Human
aggaauuuuaauaugcuugucu

SEQ ID NO: 231154 - RNA, 22 nt, Human
aggaggaggacucgccaggcca

SEQ ID NO: 231155 - RNA, 22 nt, Human
aggagcugccggauggggcaug

SEQ ID NO: 231156 - RNA, 22 nt, Human
aggcaauuauacuagguuuugg

SEQ ID NO: 231157 - RNA, 23 nt, Human
aggcaagaacggguuguucaccc

SEQ ID NO: 231158 - RNA, 20 nt, Human
aggauuauguacauggaugc

SEQ ID NO: 231159 - RNA, 22 nt, Human
aggcagagaggucuuccuggaa

SEQ ID NO: 231160 - RNA, 20 nt, Human
aggcagacaaggagucuguu

SEQ ID NO: 231161 - RNA, 22 nt, Human
aggcaacagacaggcuugguuc

SEQ ID NO: 231162 - RNA, 22 nt, Human
aggauuuauuccagaaaugcaa

SEQ ID NO: 231163 - RNA, 22 nt, Human
aggauuuagcaugaaaugugaa

SEQ ID NO: 231164 - RNA, 22 nt, Human
aggauugucuccugugaugugc

SEQ ID NO: 231165 - RNA, 22 nt, Human
aggauucuccuguuucccaccc

SEQ ID NO: 231166 - RNA, 22 nt, Human
aggacaaaggaccagaucugga

SEQ ID NO: 231167 - RNA, 22 nt, Human
aggagguagggugugaaacagc

SEQ ID NO: 231168 - RNA, 22 nt, Human
aggaguuugaaaacuuaacuaa

SEQ ID NO: 231169 - RNA, 22 nt, Human
aggauaaaugggucauuaggca

SEQ ID NO: 231170 - RNA, 22 nt, Human
aggauauguccuuuuuuucccc

SEQ ID NO: 231171 - RNA, 22 nt, Human
aggaugagugaagagguaaauu

SEQ ID NO: 231172 - RNA, 22 nt, Human
aggauuuaauugcauuuuucuc

SEQ ID NO: 231173 - RNA, 22 nt, Human
agguguaauuacucuugcaguu

SEQ ID NO: 231174 - RNA, 22 nt, Human
aggugucauuauagaccagaua

SEQ ID NO: 231175 - RNA, 22 nt, Human
agguggugacgaugcuccguac

SEQ ID NO: 231176 - RNA, 22 nt, Human
agguggucccaauggcugggca

SEQ ID NO: 231177 - RNA, 22 nt, Human
agguggucuuguggaugccgca

SEQ ID NO: 231178 - RNA, 22 nt, Human
aggugugcacccggucgcuucc

SEQ ID NO: 231179 - RNA, 18 nt, Human
agguguguuucuaggagc

SEQ ID NO: 231180 - RNA, 22 nt, Human
agguuaauaugaacagcagaag

SEQ ID NO: 231181 - RNA, 22 nt, Human
agguuaggaggggagugccaca

SEQ ID NO: 231182 - RNA, 22 nt, Human
agguuagaauauuuuuucaaga

SEQ ID NO: 231183 - RNA, 22 nt, Human
agguuaugcacugcacaacccu

SEQ ID NO: 231184 - RNA, 22 nt, Human
agguucaucaauaacucagaga

SEQ ID NO: 231185 - RNA, 22 nt, Human
agguuaggaaugggagguaaug

SEQ ID NO: 231186 - RNA, 22 nt, Human
aggugcccaaaucuucuguuuu

SEQ ID NO: 231187 - RNA, 22 nt, Human
aggugggcuuagaaaucuguau

SEQ ID NO: 231188 - RNA, 19 nt, Human
aggugaugugacucuagaa

SEQ ID NO: 231189 - RNA, 22 nt, Human
agguggcguauguguucguguu

SEQ ID NO: 231190 - RNA, 22 nt, Human
aggugauauuauguauuucuau

SEQ ID NO: 231191 - RNA, 22 nt, Human
aggugagaacguggaggggcgg

SEQ ID NO: 231192 - RNA, 22 nt, Human
aggucuugcggaagauauggcu

SEQ ID NO: 231193 - RNA, 22 nt, Human
agguggcuaugaggaugcaguc

SEQ ID NO: 231194 - RNA, 22 nt, Human
agguuagcuguaugucuguaaa

SEQ ID NO: 231195 - RNA, 20 nt, Human
agguuugcuguauaucaugg

SEQ ID NO: 231196 - RNA, 22 nt, Human
agguuguugagaucaucuggcu

SEQ ID NO: 231197 - RNA, 22 nt, Human
agguuuaggaaaacugagaguc

SEQ ID NO: 231198 - RNA, 22 nt, Human
agguuguaagcuuuauauaaau

SEQ ID NO: 231199 - RNA, 18 nt, Human
agguugcaucugugcaga

SEQ ID NO: 231200 - RNA, 22 nt, Human
agguuuggguucauugcuggcu

SEQ ID NO: 231201 - RNA, 18 nt, Human
aguaaauguuaaauauug

SEQ ID NO: 231202 - RNA, 22 nt, Human
agguuuuugucauuuucuggua

SEQ ID NO: 231203 - RNA, 22 nt, Human
aguaaaggaaggaagggacagc

SEQ ID NO: 231204 - RNA, 22 nt, Human
agguuuuacuuuuuuuggaggu

SEQ ID NO: 231205 - RNA, 22 nt, Human
agguuuauggagcaccacaucu

SEQ ID NO: 231206 - RNA, 22 nt, Human
agguuuuagaagcugaagccaa

SEQ ID NO: 231207 - RNA, 20 nt, Human
aguacugacaauauucugug

SEQ ID NO: 231208 - RNA, 21 nt, Human
aguaccugugugccugugugu

SEQ ID NO: 231209 - RNA, 20 nt, Human
aguacauauuugugauuuuu

SEQ ID NO: 231210 - RNA, 22 nt, Human
aguaauggucucaauaaauucu

SEQ ID NO: 231211 - RNA, 22 nt, Human
aguaagaacugugggugggguu

SEQ ID NO: 231212 - RNA, 22 nt, Human
aguaaucgugaucgagagauca

SEQ ID NO: 231213 - RNA, 23 nt, Human
agggcacugaagcuggaauuggg

SEQ ID NO: 231214 - RNA, 22 nt, Human
agggcaguuaugaaugucucca

SEQ ID NO: 231215 - RNA, 22 nt, Human
agggcucacuacaacccuggga

SEQ ID NO: 231216 - RNA, 22 nt, Human
agggccggggagggcugugggg

SEQ ID NO: 231217 - RNA, 20 nt, Human
agggccuauauaaacugcug

SEQ ID NO: 231218 - RNA, 20 nt, Human
agggauuugguugguauugu

SEQ ID NO: 231219 - RNA, 22 nt, Human
agggaugcaguaaaaacuguag

SEQ ID NO: 231220 - RNA, 22 nt, Human
agggaguuccgaucugugcacc

SEQ ID NO: 231221 - RNA, 22 nt, Human
agggaggcccagcagacuggcg

SEQ ID NO: 231222 - RNA, 22 nt, Human
agggcaguuuuacugaaaggug

SEQ ID NO: 231223 - RNA, 22 nt, Human
agggcaggguuggugcuggugc

SEQ ID NO: 231224 - RNA, 22 nt, Human
agggcaugugaaguaaccuagg

SEQ ID NO: 231225 - RNA, 22 nt, Human
agggcauacauuuuccugagau

SEQ ID NO: 231226 - RNA, 21 nt, Human
agggccagaucaccaaggagc

SEQ ID NO: 231227 - RNA, 22 nt, Human
agggaggagggacagaaagagg

SEQ ID NO: 231228 - RNA, 22 nt, Human
agggaaauaggagaagaaagga

SEQ ID NO: 231229 - RNA, 22 nt, Human
aggcuuaaaugcucauaucagu

SEQ ID NO: 231230 - RNA, 22 nt, Human
aggcuuaacuacaauuuuugcc

SEQ ID NO: 231231 - RNA, 22 nt, Human
aggcuuuugcucuggcuccucu

SEQ ID NO: 231232 - RNA, 22 nt, Human
aggcuucaaggacagcagccac

SEQ ID NO: 231233 - RNA, 22 nt, Human
aggcuguagaucuagacaugua

SEQ ID NO: 231234 - RNA, 22 nt, Human
aggguggaggacaggccaguga

SEQ ID NO: 231235 - RNA, 22 nt, Human
agggucgucuggguccgugggg

SEQ ID NO: 231236 - RNA, 22 nt, Human
aggguguuugggagcagaggau

SEQ ID NO: 231237 - RNA, 22 nt, Human
aggguguacauuuguuggugaa

SEQ ID NO: 231238 - RNA, 22 nt, Human
aggguggcuggaguggucuggu

SEQ ID NO: 231239 - RNA, 22 nt, Human
agggcugggcuuggcaggcugg

SEQ ID NO: 231240 - RNA, 22 nt, Human
aggggcugagaguuugaugugg

SEQ ID NO: 231241 - RNA, 22 nt, Human
aggggcagaggaugauggaaga

SEQ ID NO: 231242 - RNA, 19 nt, Human
aggggccugcuuggccuug

SEQ ID NO: 231243 - RNA, 22 nt, Human
aggguauguuuuuaucuacugu

SEQ ID NO: 231244 - RNA, 22 nt, Human
aggguuucucuccaguguggac

SEQ ID NO: 231245 - RNA, 22 nt, Human
aggucugcccaggaugcugcuu

SEQ ID NO: 231246 - RNA, 22 nt, Human
aggucggcuuuuuuccuuucac

SEQ ID NO: 231247 - RNA, 22 nt, Human
aggucguauaguuaccuccuug

SEQ ID NO: 231248 - RNA, 22 nt, Human
agggggcuccugcaggccccca

SEQ ID NO: 231249 - RNA, 22 nt, Human
agggguuugggaaggguuaggg

SEQ ID NO: 231250 - RNA, 22 nt, Human
aggguaauaacaguauggugau

SEQ ID NO: 231251 - RNA, 22 nt, Human
agggggcaugaaauaaaggaaa

SEQ ID NO: 231252 - RNA, 22 nt, Human
aggguuacuuauuuuggauagu

SEQ ID NO: 231253 - RNA, 22 nt, Human
agugugacccauggcaagggca

SEQ ID NO: 231254 - RNA, 22 nt, Human
agugucuuuagucgcugagcaa

SEQ ID NO: 231255 - RNA, 22 nt, Human
aguguucaauuugagcucaaag

SEQ ID NO: 231256 - RNA, 22 nt, Human
aguggguaaggacaggugucug

SEQ ID NO: 231257 - RNA, 22 nt, Human
aguggugaucuguuacagucac

SEQ ID NO: 231258 - RNA, 22 nt, Human
aguggugccuaagcgcggaggc

SEQ ID NO: 231259 - RNA, 22 nt, Human
aguggcugugaaauacauggga

SEQ ID NO: 231260 - RNA, 22 nt, Human
aguggcuggcaggggagggucc

SEQ ID NO: 231261 - RNA, 22 nt, Human
aguggcuucucuggggucaaga

SEQ ID NO: 231262 - RNA, 22 nt, Human
aguggcuguuccaggugaggac

SEQ ID NO: 231263 - RNA, 22 nt, Human
agugucagcagcuucauugucu

SEQ ID NO: 231264 - RNA, 22 nt, Human
agugucugcgggcagaggagcg

SEQ ID NO: 231265 - RNA, 22 nt, Human
aguguauuugccuauaaaaaug

SEQ ID NO: 231266 - RNA, 20 nt, Human
aguguuggugcuuuucccag

SEQ ID NO: 231267 - RNA, 22 nt, Human
aguguuugggagagggugugag

SEQ ID NO: 231268 - RNA, 20 nt, Human
aguguugaacuacacuuccc

SEQ ID NO: 231269 - RNA, 22 nt, Human
aguguucaucacaggcuagaga

SEQ ID NO: 231270 - RNA, 23 nt, Human
aguguucagcauguaguaaauac

SEQ ID NO: 231271 - RNA, 22 nt, Human
aguguggcccaugaauuauugg

SEQ ID NO: 231272 - RNA, 22 nt, Human
aguguguauauaugugugugug

SEQ ID NO: 231273 - RNA, 22 nt, Human
aguguuuuaugugccaguuuaa

SEQ ID NO: 231274 - RNA, 22 nt, Human
aguguuuuaagaaaguaauuuu

SEQ ID NO: 231275 - RNA, 22 nt, Human
aguuaaagggggcuacagugug

SEQ ID NO: 231276 - RNA, 22 nt, Human
aguuaacuugugguuuggcugu

SEQ ID NO: 231277 - RNA, 22 nt, Human
aguguggccaaugaggaugggc

SEQ ID NO: 231278 - RNA, 22 nt, Human
aguuaucuauaaaucccugagg

SEQ ID NO: 231279 - RNA, 22 nt, Human
aguuaugcaagcaaguaccacu

SEQ ID NO: 231280 - RNA, 22 nt, Human
aguuauggguauguauuauaau

SEQ ID NO: 231281 - RNA, 17 nt, Human
aguuacugcacuugcca

SEQ ID NO: 231282 - RNA, 22 nt, Human
aguuaauuauagugcuuaauau

SEQ ID NO: 231283 - RNA, 22 nt, Human
aguuacuauuacuuauuauuau

SEQ ID NO: 231284 - RNA, 22 nt, Human
aguuaaucuuguauuaaugguu

SEQ ID NO: 231285 - RNA, 22 nt, Human
aguucauccucauuuacaagga

SEQ ID NO: 231286 - RNA, 22 nt, Human
aguucauaucuacuuuuccauc

SEQ ID NO: 231287 - RNA, 22 nt, Human
aguucauucuagcugggagcag

SEQ ID NO: 231288 - RNA, 22 nt, Human
aguuauuaagaaaauuuugcca

SEQ ID NO: 231289 - RNA, 22 nt, Human
aguuauuuuucacuauuaggcu

SEQ ID NO: 231290 - RNA, 22 nt, Human
aguucaauuguuuuguaaaagu

SEQ ID NO: 231291 - RNA, 22 nt, Human
aguucaugugguuuaacuuaau

SEQ ID NO: 231292 - RNA, 22 nt, Human
aguucaugcuuagaucucauuu

SEQ ID NO: 231293 - RNA, 22 nt, Human
agugaggggagaaugaggugga

SEQ ID NO: 231294 - RNA, 20 nt, Human
agugauuuguuaguacauug

SEQ ID NO: 231295 - RNA, 22 nt, Human
agugaugcuuuggagaagaucc

SEQ ID NO: 231296 - RNA, 23 nt, Human
agugaugcaguaucugggucugu

SEQ ID NO: 231297 - RNA, 22 nt, Human
agugacuguccuacuuuguaga

SEQ ID NO: 231298 - RNA, 22 nt, Human
agugagaguauuaaugugaacu

SEQ ID NO: 231299 - RNA, 21 nt, Human
agugagauuuaugccugguuc

SEQ ID NO: 231300 - RNA, 22 nt, Human
agugaagauagagccaggucug

SEQ ID NO: 231301 - RNA, 23 nt, Human
agugaagcugguuagugaugacc

SEQ ID NO: 231302 - RNA, 22 nt, Human
agugaauuagccuauuuguaaa

SEQ ID NO: 231303 - RNA, 22 nt, Human
agugacauuauuuuguguacua

SEQ ID NO: 231304 - RNA, 21 nt, Human
aguagucgauucaggagaagu

SEQ ID NO: 231305 - RNA, 22 nt, Human
agucugaaccagauggcaaggu

SEQ ID NO: 231306 - RNA, 22 nt, Human
aguacuuuuuguucaauugugc

SEQ ID NO: 231307 - RNA, 21 nt, Human
agugaagagugggcuugauca

SEQ ID NO: 231308 - RNA, 22 nt, Human
agugaaauaugcccauugcugu

SEQ ID NO: 231309 - RNA, 19 nt, Human
agucugugacaaggagugg

SEQ ID NO: 231310 - RNA, 22 nt, Human
agucugugguccucuguaucuc

SEQ ID NO: 231311 - RNA, 22 nt, Human
agugaaaacugaaucaccuucc

SEQ ID NO: 231312 - RNA, 20 nt, Human
agucuuaucugcauuuagaa

SEQ ID NO: 231313 - RNA, 22 nt, Human
agugauguaauggugaauguga

SEQ ID NO: 231314 - RNA, 23 nt, Human
agugaucuguguuugaagaaugc

SEQ ID NO: 231315 - RNA, 20 nt, Human
agugaguuaucagcuacagu

SEQ ID NO: 231316 - RNA, 22 nt, Human
agugaugauccaaaugaauuga

SEQ ID NO: 231317 - RNA, 21 nt, Human
aguggcacuguuucuucccua

SEQ ID NO: 231318 - RNA, 22 nt, Human
agugccauggcugcuagauggc

SEQ ID NO: 231319 - RNA, 22 nt, Human
agugcgagaugaggacagaagc

SEQ ID NO: 231320 - RNA, 19 nt, Human
agugggauggcuuuuuccc

SEQ ID NO: 231321 - RNA, 22 nt, Human
aguggggaaauaucaauauuug

SEQ ID NO: 231322 - RNA, 19 nt, Human
agugggcaaggaagaugac

SEQ ID NO: 231323 - RNA, 22 nt, Human
agugggaaagcugccuuguaga

SEQ ID NO: 231324 - RNA, 23 nt, Human
aguggccgaucaucucgggcuug

SEQ ID NO: 231325 - RNA, 22 nt, Human
aguggcuagaucaugagugagc

SEQ ID NO: 231326 - RNA, 22 nt, Human
aguggggcccaagaaucugcau

SEQ ID NO: 231327 - RNA, 22 nt, Human
aguggagguuacagcuguacau

SEQ ID NO: 231328 - RNA, 23 nt, Human
aguggaggucgggguggggagac

SEQ ID NO: 231329 - RNA, 22 nt, Human
agugccuuaaaggucuugcagc

SEQ ID NO: 231330 - RNA, 22 nt, Human
agugccuggcugauggguccug

SEQ ID NO: 231331 - RNA, 22 nt, Human
agugccaucuuuaacuguccca

SEQ ID NO: 231332 - RNA, 22 nt, Human
agugcucagggaaugccacuga

SEQ ID NO: 231333 - RNA, 22 nt, Human
aguugcagguucacguaucuug

SEQ ID NO: 231334 - RNA, 22 nt, Human
aguucuuugcucccugcuuuuu

SEQ ID NO: 231335 - RNA, 22 nt, Human
aguucuggcccugaaacaggga

SEQ ID NO: 231336 - RNA, 22 nt, Human
aguucugacucugaaucuggga

SEQ ID NO: 231337 - RNA, 22 nt, Human
aguugcugccagguccugggag

SEQ ID NO: 231338 - RNA, 22 nt, Human
aguucugggaggugcacgucca

SEQ ID NO: 231339 - RNA, 22 nt, Human
aguucucaagguuaggaaaagu

SEQ ID NO: 231340 - RNA, 22 nt, Human
aguuccucagaagggccuggga

SEQ ID NO: 231341 - RNA, 22 nt, Human
aguugguggaagcuaagcuucu

SEQ ID NO: 231342 - RNA, 22 nt, Human
aguugggaaaugcugcaguagu

SEQ ID NO: 231343 - RNA, 22 nt, Human
aguugguauuuacugcaguugg

SEQ ID NO: 231344 - RNA, 22 nt, Human
aguuggaagacacccugaaauc

SEQ ID NO: 231345 - RNA, 22 nt, Human
aguugcuucccuauucuuagca

SEQ ID NO: 231346 - RNA, 22 nt, Human
aguucuguucccccaguuacau

SEQ ID NO: 231347 - RNA, 22 nt, Human
aguuggcauuuuauuuaaguau

SEQ ID NO: 231348 - RNA, 22 nt, Human
aguugugagaaugaacacugaa

SEQ ID NO: 231349 - RNA, 22 nt, Human
aguugguguuagaguuuuucag

SEQ ID NO: 231350 - RNA, 21 nt, Human
aguuguacuguauagcagaug

SEQ ID NO: 231351 - RNA, 22 nt, Human
aguuuccacuggagacacugug

SEQ ID NO: 231352 - RNA, 23 nt, Human
aguuuacguauucauucuuacuc

SEQ ID NO: 231353 - RNA, 22 nt, Human
aguuguucucagcagaagaacu

SEQ ID NO: 231354 - RNA, 22 nt, Human
aguuuaaauuguucuaucagaa

SEQ ID NO: 231355 - RNA, 22 nt, Human
aguuguuuuucuuagauuuuag

SEQ ID NO: 231356 - RNA, 22 nt, Human
aguuuacccacuguugaaauua

SEQ ID NO: 231357 - RNA, 22 nt, Human
aguuuuugagaauucuucugaa

SEQ ID NO: 231358 - RNA, 22 nt, Human
aguuuucugccucuggaugcgu

SEQ ID NO: 231359 - RNA, 22 nt, Human
aguuucaguuaguugggugaca

SEQ ID NO: 231360 - RNA, 22 nt, Human
aguuucccucacaggucugcau

SEQ ID NO: 231361 - RNA, 22 nt, Human
aguuuggaggagaaagugcggg

SEQ ID NO: 231362 - RNA, 22 nt, Human
aguuuguagguuaggaucagca

SEQ ID NO: 231363 - RNA, 22 nt, Human
aguuucuugaagacugauguuu

SEQ ID NO: 231364 - RNA, 22 nt, Human
aguuugauuugucuaucuucau

SEQ ID NO: 231365 - RNA, 22 nt, Human
aguuuuugccucgaauucugcg

SEQ ID NO: 231366 - RNA, 18 nt, Human
aguuuuuuuggcaaaagg

SEQ ID NO: 231367 - RNA, 22 nt, Human
auacaaaaaguggugaguguau

SEQ ID NO: 231368 - RNA, 22 nt, Human
auaaccaaaaauaguuuaguac

SEQ ID NO: 231369 - RNA, 22 nt, Human
auaaauucuaugauggauuggg

SEQ ID NO: 231370 - RNA, 22 nt, Human
auaacgaaagcaauuauuuuca

SEQ ID NO: 231371 - RNA, 22 nt, Human
auaccaaugaaucccugagaau

SEQ ID NO: 231372 - RNA, 22 nt, Human
auaacccuauuaaauggugcgc

SEQ ID NO: 231373 - RNA, 22 nt, Human
auacaugugugugcauacaugu

SEQ ID NO: 231374 - RNA, 21 nt, Human
auaccaaaagaacaccuuguu

SEQ ID NO: 231375 - RNA, 18 nt, Human
auaccaggauagggacaa

SEQ ID NO: 231376 - RNA, 22 nt, Human
auaccuauagcagacugagacu

SEQ ID NO: 231377 - RNA, 22 nt, Human
auaauugaauaagagcugcagg

SEQ ID NO: 231378 - RNA, 22 nt, Human
auaaucuuuccagucaguuucc

SEQ ID NO: 231379 - RNA, 23 nt, Human
auaaugauaaugcuauuuuuugu

SEQ ID NO: 231380 - RNA, 22 nt, Human
auacauauaugcacauuaauau

SEQ ID NO: 231381 - RNA, 22 nt, Human
auaaaagcacaauagaguuaug

SEQ ID NO: 231382 - RNA, 22 nt, Human
auaaaguaaugcauauaaugug

SEQ ID NO: 231383 - RNA, 22 nt, Human
auaaucuuugaguagaguugag

SEQ ID NO: 231384 - RNA, 22 nt, Human
auaaguuauuuuaguaaaucag

SEQ ID NO: 231385 - RNA, 22 nt, Human
auaaggcauagugagucaucau

SEQ ID NO: 231386 - RNA, 20 nt, Human
auaaauaggauuuucugaca

SEQ ID NO: 231387 - RNA, 22 nt, Human
auaaagggccuuauuuuagcaa

SEQ ID NO: 231388 - RNA, 22 nt, Human
auaaaaaguggcugcuauugga

SEQ ID NO: 231389 - RNA, 22 nt, Human
auaaauuugccagcauauguuc

SEQ ID NO: 231390 - RNA, 22 nt, Human
auaaauuugacagcucuucaug

SEQ ID NO: 231391 - RNA, 22 nt, Human
auaaaucaagggcaguauuucc

SEQ ID NO: 231392 - RNA, 22 nt, Human
aguuuuguuuguuuguuuguua

SEQ ID NO: 231393 - RNA, 22 nt, Human
aguuuuuaacgccauguuugaa

SEQ ID NO: 231394 - RNA, 22 nt, Human
auaaaaauguuuuuguguggua

SEQ ID NO: 231395 - RNA, 22 nt, Human
auaaaacagaucaggagaauga

SEQ ID NO: 231396 - RNA, 22 nt, Human
auaaaaucugaagcaagaauaa

SEQ ID NO: 231397 - RNA, 22 nt, Human
auugagcuguugaagucccaca

SEQ ID NO: 231398 - RNA, 22 nt, Human
auugagacugaaauuacugaag

SEQ ID NO: 231399 - RNA, 22 nt, Human
auucuuacaaagcagagucugu

SEQ ID NO: 231400 - RNA, 22 nt, Human
auucuguuuaauacacgaaagg

SEQ ID NO: 231401 - RNA, 20 nt, Human
auucuguguaaauguccugu

SEQ ID NO: 231402 - RNA, 22 nt, Human
auucuguugguuuaauagucaa

SEQ ID NO: 231403 - RNA, 22 nt, Human
auucugcaauaaucaguccuua

SEQ ID NO: 231404 - RNA, 19 nt, Human
auugcaguguaaaacuauu

SEQ ID NO: 231405 - RNA, 16 nt, Human
auucuuccaccauuac

SEQ ID NO: 231406 - RNA, 21 nt, Human
auuggcagaucucuggauugu

SEQ ID NO: 231407 - RNA, 22 nt, Human
auucuugauauagauaguuaau

SEQ ID NO: 231408 - RNA, 22 nt, Human
auucuuuagaguccuucaaaua

SEQ ID NO: 231409 - RNA, 22 nt, Human
auucuacucuccuacaggucua

SEQ ID NO: 231410 - RNA, 20 nt, Human
auucuuguuccauuucccag

SEQ ID NO: 231411 - RNA, 22 nt, Human
auucuuuauuuucuguacuugc

SEQ ID NO: 231412 - RNA, 22 nt, Human
auuccguuuuaaaaccuuaagc

SEQ ID NO: 231413 - RNA, 22 nt, Human
auucccucaagagacccacagc

SEQ ID NO: 231414 - RNA, 22 nt, Human
auucccuuugacgaucccuagg

SEQ ID NO: 231415 - RNA, 22 nt, Human
auuccccagcaggccuuuuguu

SEQ ID NO: 231416 - RNA, 22 nt, Human
auuccaccccauccucccaggu

SEQ ID NO: 231417 - RNA, 22 nt, Human
auucuucauguugaagcuguca

SEQ ID NO: 231418 - RNA, 22 nt, Human
auucgaucacugccgaggaccu

SEQ ID NO: 231419 - RNA, 22 nt, Human
auucgcggcuugaucugcuugc

SEQ ID NO: 231420 - RNA, 22 nt, Human
auucuagaguuucaauccaagg

SEQ ID NO: 231421 - RNA, 22 nt, Human
auucuaugaaugacuguuagau

SEQ ID NO: 231422 - RNA, 22 nt, Human
auugaauuagauguuguagucc

SEQ ID NO: 231423 - RNA, 22 nt, Human
auugaaguguacguuugaucua

SEQ ID NO: 231424 - RNA, 22 nt, Human
auucauauagcgcuuacagccu

SEQ ID NO: 231425 - RNA, 22 nt, Human
auucauucugaccucaagagaa

SEQ ID NO: 231426 - RNA, 22 nt, Human
auucaguucuaaggucagugcc

SEQ ID NO: 231427 - RNA, 22 nt, Human
auucauuuuuacaucaccaaua

SEQ ID NO: 231428 - RNA, 17 nt, Human
auucuuauacucuguga

SEQ ID NO: 231429 - RNA, 22 nt, Human
auucuuauaaaaaguguugacu

SEQ ID NO: 231430 - RNA, 22 nt, Human
auucuguuuuaccauuuucuuu

SEQ ID NO: 231431 - RNA, 22 nt, Human
auucugcugccuaguuuaugaa

SEQ ID NO: 231432 - RNA, 22 nt, Human
auucugcauuucuaaccagguc

SEQ ID NO: 231433 - RNA, 22 nt, Human
auucugaagcagaaaaggcaga

SEQ ID NO: 231434 - RNA, 22 nt, Human
auucugagaucucuucuaggcc

SEQ ID NO: 231435 - RNA, 21 nt, Human
auucugaguugucagucuuca

SEQ ID NO: 231436 - RNA, 21 nt, Human
auucugauguuucuauuguuu

SEQ ID NO: 231437 - RNA, 22 nt, Human
auucaagauaagggucugggag

SEQ ID NO: 231438 - RNA, 22 nt, Human
auucucuguacagaagguaccg

SEQ ID NO: 231439 - RNA, 21 nt, Human
auucaaagaagaggaaggccc

SEQ ID NO: 231440 - RNA, 22 nt, Human
auuauucuuugggaaaguugaa

SEQ ID NO: 231441 - RNA, 20 nt, Human
auuauuucuucugcccaaag

SEQ ID NO: 231442 - RNA, 22 nt, Human
auguuguugaacucuuugcaug

SEQ ID NO: 231443 - RNA, 22 nt, Human
auuaacaggcucuguucuaguu

SEQ ID NO: 231444 - RNA, 21 nt, Human
auuaagacaauggcaaugggu

SEQ ID NO: 231445 - RNA, 22 nt, Human
auuaaauagcagaagaaagaug

SEQ ID NO: 231446 - RNA, 22 nt, Human
auuaaagcuaguugagauuuaa

SEQ ID NO: 231447 - RNA, 22 nt, Human
auguugagaaucucucuucuaa

SEQ ID NO: 231448 - RNA, 22 nt, Human
auuccuguggcuggguaaagua

SEQ ID NO: 231449 - RNA, 22 nt, Human
auuauaguuuugcccuuaagaa

SEQ ID NO: 231450 - RNA, 22 nt, Human
auucuaauaagcguuuugucgc

SEQ ID NO: 231451 - RNA, 22 nt, Human
auucuacgcuccgucucuauca

SEQ ID NO: 231452 - RNA, 22 nt, Human
auuaucuauccgccaacaguaa

SEQ ID NO: 231453 - RNA, 23 nt, Human
auuaugaagaagacucgccuguu

SEQ ID NO: 231454 - RNA, 22 nt, Human
auuaucugacugaguagucugu

SEQ ID NO: 231455 - RNA, 22 nt, Human
auuauggacuuucuuguuuggg

SEQ ID NO: 231456 - RNA, 22 nt, Human
auuauucaaggugaggguaaaa

SEQ ID NO: 231457 - RNA, 22 nt, Human
auuaugugagggacuuaaucau

SEQ ID NO: 231458 - RNA, 22 nt, Human
auucucugaugcagguggaaga

SEQ ID NO: 231459 - RNA, 22 nt, Human
auucucauguuuuaaaaaaguu

SEQ ID NO: 231460 - RNA, 22 nt, Human
auucucuauugguaaauuugac

SEQ ID NO: 231461 - RNA, 22 nt, Human
auucucauguuaccaaauucua

SEQ ID NO: 231462 - RNA, 17 nt, Human
auucuaguuggcuuuuu

SEQ ID NO: 231463 - RNA, 20 nt, Human
auucucaccaugugacaugg

SEQ ID NO: 231464 - RNA, 22 nt, Human
auucuacucuuuaaauaugaaa

SEQ ID NO: 231465 - RNA, 22 nt, Human
auuucagcagcccauguuugga

SEQ ID NO: 231466 - RNA, 22 nt, Human
auuucaguuugcaguuucucuc

SEQ ID NO: 231467 - RNA, 21 nt, Human
auuuggucaaugucugcguga

SEQ ID NO: 231468 - RNA, 22 nt, Human
auuugcauguuuauuucuuaga

SEQ ID NO: 231469 - RNA, 22 nt, Human
auuuaaguuacuucucuuuccu

SEQ ID NO: 231470 - RNA, 22 nt, Human
auuuagacaacaagccuucucc

SEQ ID NO: 231471 - RNA, 22 nt, Human
auuguagucuggacuuuuggga

SEQ ID NO: 231472 - RNA, 22 nt, Human
auuuccagcagcauauuugucu

SEQ ID NO: 231473 - RNA, 19 nt, Human
auugguuugcucgggaaug

SEQ ID NO: 231474 - RNA, 22 nt, Human
auugguuucuuguggguuaucc

SEQ ID NO: 231475 - RNA, 22 nt, Human
auuggccaguggacagcgccgu

SEQ ID NO: 231476 - RNA, 22 nt, Human
auuugaaguauaaguaauugcu

SEQ ID NO: 231477 - RNA, 22 nt, Human
auuugaaaaucuaugaugugca

SEQ ID NO: 231478 - RNA, 22 nt, Human
auuguuuccccggaauuauuca

SEQ ID NO: 231479 - RNA, 22 nt, Human
auuguuacuggguuaauuugga

SEQ ID NO: 231480 - RNA, 22 nt, Human
auuugccaguuacucacaccac

SEQ ID NO: 231481 - RNA, 22 nt, Human
auugacuuucccuucuccucau

SEQ ID NO: 231482 - RNA, 22 nt, Human
auugagaaaauucgagcaaguu

SEQ ID NO: 231483 - RNA, 22 nt, Human
auugagaugcuuaaaucuucac

SEQ ID NO: 231484 - RNA, 18 nt, Human
auugagcaugacagaccu

SEQ ID NO: 231485 - RNA, 22 nt, Human
auuuaagugagucuuuaaaaua

SEQ ID NO: 231486 - RNA, 22 nt, Human
auugaguucaccucuuucagaa

SEQ ID NO: 231487 - RNA, 22 nt, Human
auugaguauuguaaauaaaaca

SEQ ID NO: 231488 - RNA, 22 nt, Human
auuuaagacuguggugcaguuu

SEQ ID NO: 231489 - RNA, 22 nt, Human
auugaugccugaaaaauaugua

SEQ ID NO: 231490 - RNA, 22 nt, Human
auugaugaaaauaguuauuuua

SEQ ID NO: 231491 - RNA, 22 nt, Human
auugcaggucguguggaaguga

SEQ ID NO: 231492 - RNA, 22 nt, Human
auugauuuugugcuuuccuacg

SEQ ID NO: 231493 - RNA, 22 nt, Human
auuuauccuugggguagagcca

SEQ ID NO: 231494 - RNA, 22 nt, Human
auugccauaauagagccaugua

SEQ ID NO: 231495 - RNA, 23 nt, Human
auugccuguagaucuucacuuuc

SEQ ID NO: 231496 - RNA, 22 nt, Human
auuggcugucagcccggauggg

SEQ ID NO: 231497 - RNA, 19 nt, Human
auucuucucuuccugcugu

SEQ ID NO: 231498 - RNA, 22 nt, Human
auugaagcauggagaugaggca

SEQ ID NO: 231499 - RNA, 22 nt, Human
auugaaauuugcuuccucacug

SEQ ID NO: 231500 - RNA, 22 nt, Human
auuguuuugugaaacauaguga

SEQ ID NO: 231501 - RNA, 22 nt, Human
auugacagaaaauuggauggca

SEQ ID NO: 231502 - RNA, 22 nt, Human
auuguucuagaauuuuuuuucc

SEQ ID NO: 231503 - RNA, 22 nt, Human
auuuucuucauuuugauuguau

SEQ ID NO: 231504 - RNA, 22 nt, Human
auuucuguaauucugaggagug

SEQ ID NO: 231505 - RNA, 17 nt, Human
auuuccgaguuucuuuc

SEQ ID NO: 231506 - RNA, 22 nt, Human
auuuuuagagugaaagaauuaa

SEQ ID NO: 231507 - RNA, 19 nt, Human
auuuugguucuuuccauuc

SEQ ID NO: 231508 - RNA, 19 nt, Human
auuuccuggcauauaucac

SEQ ID NO: 231509 - RNA, 22 nt, Human
auuuuagagaaacaaacguagg

SEQ ID NO: 231510 - RNA, 22 nt, Human
auuuuauuuugggaucuuuuua

SEQ ID NO: 231511 - RNA, 22 nt, Human
auuuucauauggguuauuugua

SEQ ID NO: 231512 - RNA, 22 nt, Human
auuuuucacauuuugggggaca

SEQ ID NO: 231513 - RNA, 21 nt, Human
auuuuucagaaggaugugaua

SEQ ID NO: 231514 - RNA, 22 nt, Human
auuuuuauuugccuaugauaua

SEQ ID NO: 231515 - RNA, 22 nt, Human
auuuuuagucuugcugcaauca

SEQ ID NO: 231516 - RNA, 22 nt, Human
auuuuuucaugugugguugaga

SEQ ID NO: 231517 - RNA, 22 nt, Human
auuuuugguuucaccugcacgc

SEQ ID NO: 231518 - RNA, 22 nt, Human
auuuuugugcuuuauuggggua

SEQ ID NO: 231519 - RNA, 22 nt, Human
caaauggggaauagaugauggg

SEQ ID NO: 231520 - RNA, 19 nt, Human
caagagcaaagucuuauga

SEQ ID NO: 231521 - RNA, 22 nt, Human
auuuuuuuggucauaugagaua

SEQ ID NO: 231522 - RNA, 22 nt, Human
caaaguauuuagcugacucgcu

SEQ ID NO: 231523 - RNA, 22 nt, Human
caaaguaggcuaagaccuucca

SEQ ID NO: 231524 - RNA, 22 nt, Human
auuuuuaucuaaaauccacuuu

SEQ ID NO: 231525 - RNA, 22 nt, Human
caaaauuguugaugcugcuuug

SEQ ID NO: 231526 - RNA, 22 nt, Human
auuuuguugaaacccuuguugu

SEQ ID NO: 231527 - RNA, 22 nt, Human
aucuccaguuagcaguacugau

SEQ ID NO: 231528 - RNA, 22 nt, Human
aucuccagcagugcuuuugagc

SEQ ID NO: 231529 - RNA, 22 nt, Human
auccuucaaaaggaauagcagg

SEQ ID NO: 231530 - RNA, 22 nt, Human
auacacauguuauuguggaagc

SEQ ID NO: 231531 - RNA, 22 nt, Human
auaaugccucauaggguguucc

SEQ ID NO: 231532 - RNA, 22 nt, Human
auacagccuaguuugaguccca

SEQ ID NO: 231533 - RNA, 22 nt, Human
auacuacaucacagccaagaag

SEQ ID NO: 231534 - RNA, 22 nt, Human
aucugcugccuaggguuugucu

SEQ ID NO: 231535 - RNA, 22 nt, Human
aucugacaaccuauugacuuga

SEQ ID NO: 231536 - RNA, 22 nt, Human
aucucuguaaaccauaaauuga

SEQ ID NO: 231537 - RNA, 22 nt, Human
auccuugacuguagugauauua

SEQ ID NO: 231538 - RNA, 18 nt, Human
auccuuugaucaucuguc

SEQ ID NO: 231539 - RNA, 22 nt, Human
aucugcuguaguuggugccagu

SEQ ID NO: 231540 - RNA, 22 nt, Human
aucugcugcuccuucuucuugc

SEQ ID NO: 231541 - RNA, 22 nt, Human
aucugugauuuuggcaagauuu

SEQ ID NO: 231542 - RNA, 20 nt, Human
aucugugaugagaacgguuu

SEQ ID NO: 231543 - RNA, 20 nt, Human
aucugguggggaauaacuuc

SEQ ID NO: 231544 - RNA, 22 nt, Human
aucugcauguggcagguggauu

SEQ ID NO: 231545 - RNA, 22 nt, Human
aucuuugccuuuaugccucuag

SEQ ID NO: 231546 - RNA, 22 nt, Human
aucuuuguaaguaaucaaagcu

SEQ ID NO: 231547 - RNA, 21 nt, Human
aucucaguccugggaaugauu

SEQ ID NO: 231548 - RNA, 22 nt, Human
aucucacuucugucauguggca

SEQ ID NO: 231549 - RNA, 22 nt, Human
aucuagucccugcccuugaaga

SEQ ID NO: 231550 - RNA, 22 nt, Human
aucuucuuucaucagccccuca

SEQ ID NO: 231551 - RNA, 22 nt, Human
aucuugaaacauauaugcauuu

SEQ ID NO: 231552 - RNA, 22 nt, Human
aucuucucucucaucaggauca

SEQ ID NO: 231553 - RNA, 22 nt, Human
aucuucaaggacgccaagaucc

SEQ ID NO: 231554 - RNA, 22 nt, Human
aucuucaggggcaauggagaua

SEQ ID NO: 231555 - RNA, 22 nt, Human
aucuacuuugggaguuucucuu

SEQ ID NO: 231556 - RNA, 20 nt, Human
aucuuaucuaucuuuuguuc

SEQ ID NO: 231557 - RNA, 23 nt, Human
aucgcccggguccagucccggcu

SEQ ID NO: 231558 - RNA, 22 nt, Human
aucuguuccccuaugcucucua

SEQ ID NO: 231559 - RNA, 22 nt, Human
aucguggcacgucgccgcagcg

SEQ ID NO: 231560 - RNA, 22 nt, Human
aucuaaaacuacgaauacuacc

SEQ ID NO: 231561 - RNA, 22 nt, Human
aucuuagagagucguguuuugu

SEQ ID NO: 231562 - RNA, 21 nt, Human
aucugugucauuagguggcag

SEQ ID NO: 231563 - RNA, 22 nt, Human
augacagcuaaggaauguguag

SEQ ID NO: 231564 - RNA, 22 nt, Human
aucuuggauccuuugccagcuu

SEQ ID NO: 231565 - RNA, 22 nt, Human
augaccuucuuuccuuaaauuu

SEQ ID NO: 231566 - RNA, 22 nt, Human
augaggauuagcaucugcaaau

SEQ ID NO: 231567 - RNA, 22 nt, Human
aucuuguuagaaggcaguaggu

SEQ ID NO: 231568 - RNA, 22 nt, Human
aucuuugauuuuggcuuuuagg

SEQ ID NO: 231569 - RNA, 22 nt, Human
augaggccacaguuauagauuu

SEQ ID NO: 231570 - RNA, 22 nt, Human
aucuuggccuucuccuggagug

SEQ ID NO: 231571 - RNA, 22 nt, Human
aucuuuuuucacaauuuauuuu

SEQ ID NO: 231572 - RNA, 22 nt, Human
augaagguggacagauuuuuuu

SEQ ID NO: 231573 - RNA, 22 nt, Human
augaacugcaguauaaacuugg

SEQ ID NO: 231574 - RNA, 22 nt, Human
augaacuaagagucauuagugu

SEQ ID NO: 231575 - RNA, 20 nt, Human
augaaugcuccccacguuuc

SEQ ID NO: 231576 - RNA, 22 nt, Human
aucuguggguaaggauaagcau

SEQ ID NO: 231577 - RNA, 22 nt, Human
aucugugguacaugacggcugc

SEQ ID NO: 231578 - RNA, 22 nt, Human
augaaggauagggcaaaauuuu

SEQ ID NO: 231579 - RNA, 23 nt, Human
augcaacauugccaguaugggca

SEQ ID NO: 231580 - RNA, 22 nt, Human
augauaucuuguuuuucaugca

SEQ ID NO: 231581 - RNA, 22 nt, Human
augaaaacggaccagagcuauu

SEQ ID NO: 231582 - RNA, 22 nt, Human
augaaaacgugugugugugugu

SEQ ID NO: 231583 - RNA, 19 nt, Human
augaaauagcauuuucuga

SEQ ID NO: 231584 - RNA, 22 nt, Human
augaaacucuagcuuucagcac

SEQ ID NO: 231585 - RNA, 21 nt, Human
augagguggcuacuaaagagu

SEQ ID NO: 231586 - RNA, 19 nt, Human
augcaauguuaucaauaac

SEQ ID NO: 231587 - RNA, 22 nt, Human
augcaguuagguaauagucuca

SEQ ID NO: 231588 - RNA, 22 nt, Human
augcauaugugugcaagugugu

SEQ ID NO: 231589 - RNA, 22 nt, Human
augcauaucuccuaucuccuca

SEQ ID NO: 231590 - RNA, 18 nt, Human
augauaauguuugcauca

SEQ ID NO: 231591 - RNA, 22 nt, Human
augagugugugguucuaaauga

SEQ ID NO: 231592 - RNA, 22 nt, Human
augaguuaaguagcccuucaug

SEQ ID NO: 231593 - RNA, 22 nt, Human
augaggguggggaaugggccau

SEQ ID NO: 231594 - RNA, 22 nt, Human
augaguaaguucugauuagauu

SEQ ID NO: 231595 - RNA, 22 nt, Human
auguccugacaguccaagggcg

SEQ ID NO: 231596 - RNA, 22 nt, Human
auguaaugucaaucuucagugg

SEQ ID NO: 231597 - RNA, 22 nt, Human
auguacugacuguacuuuuaaa

SEQ ID NO: 231598 - RNA, 22 nt, Human
auguaccgccuuggagaaaugc

SEQ ID NO: 231599 - RNA, 22 nt, Human
augugcucaggucuauaucuca

SEQ ID NO: 231600 - RNA, 22 nt, Human
auguggaaagcuugucuuagag

SEQ ID NO: 231601 - RNA, 22 nt, Human
auguccccagacugcugugcag

SEQ ID NO: 231602 - RNA, 22 nt, Human
augggggccagggacccuggca

SEQ ID NO: 231603 - RNA, 22 nt, Human
augguguaagacuguauuucuu

SEQ ID NO: 231604 - RNA, 22 nt, Human
auggugaaaugauuugauguca

SEQ ID NO: 231605 - RNA, 22 nt, Human
auguccugguccacagaaggga

SEQ ID NO: 231606 - RNA, 22 nt, Human
auggcagcggagcuggaaauga

SEQ ID NO: 231607 - RNA, 22 nt, Human
augggaauggauugagugggug

SEQ ID NO: 231608 - RNA, 22 nt, Human
auggugaugaugaugaugauaa

SEQ ID NO: 231609 - RNA, 22 nt, Human
augggagugacagggccacugg

SEQ ID NO: 231610 - RNA, 18 nt, Human
augggggaggaggaaagg

SEQ ID NO: 231611 - RNA, 22 nt, Human
auggugugugugugugugugug

SEQ ID NO: 231612 - RNA, 22 nt, Human
augggcauggauggccgagucu

SEQ ID NO: 231613 - RNA, 22 nt, Human
auguaguccuuauuugacauaa

SEQ ID NO: 231614 - RNA, 22 nt, Human
auguguuuugaccccugcuaaa

SEQ ID NO: 231615 - RNA, 22 nt, Human
auguauauauacauguauugua

SEQ ID NO: 231616 - RNA, 22 nt, Human
augugugugcgagcgugugugu

SEQ ID NO: 231617 - RNA, 20 nt, Human
augugcuaauauuaauaugu

SEQ ID NO: 231618 - RNA, 22 nt, Human
augugggugaggaggccauugu

SEQ ID NO: 231619 - RNA, 22 nt, Human
auguauguauguauauacacac

SEQ ID NO: 231620 - RNA, 22 nt, Human
augugagcuggaugaauuuaua

SEQ ID NO: 231621 - RNA, 22 nt, Human
augugauacuccuucuagugga

SEQ ID NO: 231622 - RNA, 22 nt, Human
augugcauguauguaucauauu

SEQ ID NO: 231623 - RNA, 22 nt, Human
auguugcugauccuguggcugu

SEQ ID NO: 231624 - RNA, 22 nt, Human
auguuguuuauggguuaucaag

SEQ ID NO: 231625 - RNA, 22 nt, Human
augugccugagggcuccuugug

SEQ ID NO: 231626 - RNA, 22 nt, Human
auuaaaaaaagauaaugaguua

SEQ ID NO: 231627 - RNA, 22 nt, Human
auguuuucuugucuggagaagu

SEQ ID NO: 231628 - RNA, 22 nt, Human
auguuuuauacacauguaucac

SEQ ID NO: 231629 - RNA, 22 nt, Human
augugccuuaauauaggcgcug

SEQ ID NO: 231630 - RNA, 22 nt, Human
auguuuaaguguuuugccccaa

SEQ ID NO: 231631 - RNA, 22 nt, Human
augcaugaucccgguaugugaa

SEQ ID NO: 231632 - RNA, 22 nt, Human
augcccagaacccccuggaugg

SEQ ID NO: 231633 - RNA, 22 nt, Human
augccacuguuuaugucacuua

SEQ ID NO: 231634 - RNA, 22 nt, Human
augcaaaaucuuauuuuuucua

SEQ ID NO: 231635 - RNA, 22 nt, Human
augcugccuccucuucagccgc

SEQ ID NO: 231636 - RNA, 22 nt, Human
augccaccucuucugauuccag

SEQ ID NO: 231637 - RNA, 22 nt, Human
auggaggaugugcagcaugggc

SEQ ID NO: 231638 - RNA, 22 nt, Human
auggagcgggaggauggaggag

SEQ ID NO: 231639 - RNA, 22 nt, Human
auggagcagagcugaugggccu

SEQ ID NO: 231640 - RNA, 22 nt, Human
auggaguguggccaggcaguaa

SEQ ID NO: 231641 - RNA, 22 nt, Human
auggagggguuguugcuugagu

SEQ ID NO: 231642 - RNA, 22 nt, Human
auggaacccgggcgucugcucu

SEQ ID NO: 231643 - RNA, 22 nt, Human
auggaagagacaaugcuaucug

SEQ ID NO: 231644 - RNA, 22 nt, Human
auggacagcucuuaugugggca

SEQ ID NO: 231645 - RNA, 20 nt, Human
auggaaacacgcagccccaa

SEQ ID NO: 231646 - RNA, 22 nt, Human
auggacguuuguguauuaugua

SEQ ID NO: 231647 - RNA, 22 nt, Human
auggggaauugaccguggaucu

SEQ ID NO: 231648 - RNA, 22 nt, Human
auggggaucugcaguguugauc

SEQ ID NO: 231649 - RNA, 22 nt, Human
augggcuuuacccucagagcuu

SEQ ID NO: 231650 - RNA, 22 nt, Human
augggcggugcauuugcacagu

SEQ ID NO: 231651 - RNA, 22 nt, Human
auggggaggcggauggagugcu

SEQ ID NO: 231652 - RNA, 22 nt, Human
auggagguuugucugguuuugu

SEQ ID NO: 231653 - RNA, 22 nt, Human
auggaggagcagaggguuucca

SEQ ID NO: 231654 - RNA, 22 nt, Human
auggauggaagcagccugaacu

SEQ ID NO: 231655 - RNA, 22 nt, Human
augggugggagugaaggggcuc

SEQ ID NO: 231656 - RNA, 19 nt, Human
augguauugcuggguuuuu

SEQ ID NO: 231657 - RNA, 22 nt, Human
augggcauacaaaugcuacccu

SEQ ID NO: 231658 - RNA, 22 nt, Human
auggaaggggagguagggagga

SEQ ID NO: 231659 - RNA, 22 nt, Human
auggaauuuaaauuuugguguc

SEQ ID NO: 231660 - RNA, 22 nt, Human
auggaacauuaaucuucaaaug

SEQ ID NO: 231661 - RNA, 22 nt, Human
auggccguggccagggucaggg

SEQ ID NO: 231662 - RNA, 22 nt, Human
auggcaucuucgguuggacugc

SEQ ID NO: 231663 - RNA, 22 nt, Human
auggauuggguugauggcauac

SEQ ID NO: 231664 - RNA, 22 nt, Human
augggaggguagagugaacaga

SEQ ID NO: 231665 - RNA, 22 nt, Human
auggagggcagccccacuaaag

SEQ ID NO: 231666 - RNA, 22 nt, Human
augcuuucucuucuauuucuca

SEQ ID NO: 231667 - RNA, 22 nt, Human
augggauuugaaaaguggaaau

SEQ ID NO: 231668 - RNA, 22 nt, Human
cagguugaagagguuaacgaua

SEQ ID NO: 231669 - RNA, 22 nt, Human
caggugggauuuugcugcuuga

SEQ ID NO: 231670 - RNA, 23 nt, Human
cagguuacacuuuaaaauaugca

SEQ ID NO: 231671 - RNA, 22 nt, Human
cagguuguugacugcauauagg

SEQ ID NO: 231672 - RNA, 22 nt, Human
caggacagaaauaaggaauaua

SEQ ID NO: 231673 - RNA, 19 nt, Human
caggucuucuuggaggacu

SEQ ID NO: 231674 - RNA, 22 nt, Human
caggaacucggagcccaucucu

SEQ ID NO: 231675 - RNA, 22 nt, Human
caggugcucugauauggggcug

SEQ ID NO: 231676 - RNA, 22 nt, Human
caggaagagaacugcucagccu

SEQ ID NO: 231677 - RNA, 22 nt, Human
caggaagucugaauucugagag

SEQ ID NO: 231678 - RNA, 22 nt, Human
cagugcucauagcuguuccucc

SEQ ID NO: 231679 - RNA, 22 nt, Human
cagugcuccugccccugcccuu

SEQ ID NO: 231680 - RNA, 22 nt, Human
caggcacaaugagcgccaucuu

SEQ ID NO: 231681 - RNA, 22 nt, Human
cagucucuggugaguugacagu

SEQ ID NO: 231682 - RNA, 23 nt, Human
cagucgacugugcccucccgagc

SEQ ID NO: 231683 - RNA, 22 nt, Human
cagugcaacguugugcauucaa

SEQ ID NO: 231684 - RNA, 22 nt, Human
cagucucuugcuucauuaguug

SEQ ID NO: 231685 - RNA, 19 nt, Human
caggauuguuuaaagcuuu

SEQ ID NO: 231686 - RNA, 22 nt, Human
caggcacaagaucggcuagaua

SEQ ID NO: 231687 - RNA, 22 nt, Human
cagguuuuccuuuuaaaaggaa

SEQ ID NO: 231688 - RNA, 22 nt, Human
cagguuuggaagucacgaagcu

SEQ ID NO: 231689 - RNA, 22 nt, Human
caggauauguucaagguuuucu

SEQ ID NO: 231690 - RNA, 22 nt, Human
caggaggaaaguuccacucaac

SEQ ID NO: 231691 - RNA, 21 nt, Human
caguuugcuauuuuaguauga

SEQ ID NO: 231692 - RNA, 22 nt, Human
caguucaagauuguugcuuucu

SEQ ID NO: 231693 - RNA, 22 nt, Human
caguggaugucucauaguguga

SEQ ID NO: 231694 - RNA, 22 nt, Human
caguggggaggccaggauagaa

SEQ ID NO: 231695 - RNA, 22 nt, Human
caggggacacuccugcuugggc

SEQ ID NO: 231696 - RNA, 22 nt, Human
cauauacauauacaugcauaca

SEQ ID NO: 231697 - RNA, 22 nt, Human
cauauuaugcauguuguucuuu

SEQ ID NO: 231698 - RNA, 22 nt, Human
cauaaauuuuaccuuguaagug

SEQ ID NO: 231699 - RNA, 22 nt, Human
cauaaucaagggguugugaugu

SEQ ID NO: 231700 - RNA, 22 nt, Human
cagguggauggcgagcccugca

SEQ ID NO: 231701 - RNA, 22 nt, Human
caggaacagcaccaggagcuag

SEQ ID NO: 231702 - RNA, 22 nt, Human
caggaaaauaauggugauggga

SEQ ID NO: 231703 - RNA, 22 nt, Human
cagcauucuacuuugugaacug

SEQ ID NO: 231704 - RNA, 22 nt, Human
cagcauggagacaaagugggca

SEQ ID NO: 231705 - RNA, 22 nt, Human
cagcaugcaaguccagaugugg

SEQ ID NO: 231706 - RNA, 22 nt, Human
cagcaugguggagcugcucuuu

SEQ ID NO: 231707 - RNA, 19 nt, Human
caggacaguuugccaagaa

SEQ ID NO: 231708 - RNA, 22 nt, Human
caggacccaacggugcaauguc

SEQ ID NO: 231709 - RNA, 22 nt, Human
cagcgguggcaaggugacugug

SEQ ID NO: 231710 - RNA, 22 nt, Human
caggagaaauucacauuaguga

SEQ ID NO: 231711 - RNA, 22 nt, Human
cagccuggccucuggauauuug

SEQ ID NO: 231712 - RNA, 22 nt, Human
cagccgcucaugggcccggagc

SEQ ID NO: 231713 - RNA, 20 nt, Human
cagagccaggguuuuguuuu

SEQ ID NO: 231714 - RNA, 22 nt, Human
cagagcugagucuucaagguug

SEQ ID NO: 231715 - RNA, 22 nt, Human
cagaggauggaaaugagaacaa

SEQ ID NO: 231716 - RNA, 20 nt, Human
cagcagucagcucuccaaug

SEQ ID NO: 231717 - RNA, 22 nt, Human
cagcuucacuuaaaacaugcaa

SEQ ID NO: 231718 - RNA, 22 nt, Human
cagccuuuucuuaaaaugcaag

SEQ ID NO: 231719 - RNA, 22 nt, Human
cagcuauuguucuguauaauga

SEQ ID NO: 231720 - RNA, 22 nt, Human
caggguuuuaguugcagguuau

SEQ ID NO: 231721 - RNA, 22 nt, Human
cagcuguacgugaucuacaugg

SEQ ID NO: 231722 - RNA, 22 nt, Human
cagcugcgcagcgccgggccug

SEQ ID NO: 231723 - RNA, 22 nt, Human
cagcuggaggagcagcuuccag

SEQ ID NO: 231724 - RNA, 22 nt, Human
cagcugacaagaguccuuggag

SEQ ID NO: 231725 - RNA, 22 nt, Human
cagcugcugguguaucgggucc

SEQ ID NO: 231726 - RNA, 22 nt, Human
caggugccucugccccacgcgg

SEQ ID NO: 231727 - RNA, 22 nt, Human
cagcuuguucugaccugugauu

SEQ ID NO: 231728 - RNA, 22 nt, Human
caggugauuuuguuuucaaaug

SEQ ID NO: 231729 - RNA, 22 nt, Human
cagcuucaaaggcccugauggu

SEQ ID NO: 231730 - RNA, 22 nt, Human
cagcuucuccauucuucuggcu

SEQ ID NO: 231731 - RNA, 22 nt, Human
cagcuucaugacaaacaguuuu

SEQ ID NO: 231732 - RNA, 22 nt, Human
caggccgcccucuccuguuagc

SEQ ID NO: 231733 - RNA, 22 nt, Human
caggccagcuggaggggcagcu

SEQ ID NO: 231734 - RNA, 22 nt, Human
cagggacgugagccaugucagu

SEQ ID NO: 231735 - RNA, 20 nt, Human
caggccuucaggauggcugg

SEQ ID NO: 231736 - RNA, 22 nt, Human
caggauuuaauaagauaguguu

SEQ ID NO: 231737 - RNA, 22 nt, Human
caggaguggugagguuagcaga

SEQ ID NO: 231738 - RNA, 22 nt, Human
cagaaagaaguggggauagagg

SEQ ID NO: 231739 - RNA, 22 nt, Human
cacauaaggacauuauugaaag

SEQ ID NO: 231740 - RNA, 22 nt, Human
cacuugauugucagaaaaaugg

SEQ ID NO: 231741 - RNA, 22 nt, Human
cacuuuuucccccuggugucau

SEQ ID NO: 231742 - RNA, 22 nt, Human
cagaaaaaaaugcagacuagca

SEQ ID NO: 231743 - RNA, 22 nt, Human
cacuuauuuuuccuuugugauu

SEQ ID NO: 231744 - RNA, 20 nt, Human
cacagcugacgaguauccaa

SEQ ID NO: 231745 - RNA, 22 nt, Human
cagacagagcucacaagucuuu

SEQ ID NO: 231746 - RNA, 22 nt, Human
cagacagagucuucccaucagu

SEQ ID NO: 231747 - RNA, 22 nt, Human
cagacaaauccuuaugagacug

SEQ ID NO: 231748 - RNA, 22 nt, Human
cagaaugugacaucaaaggcuc

SEQ ID NO: 231749 - RNA, 22 nt, Human
cagaaauuggcagagaagaccu

SEQ ID NO: 231750 - RNA, 22 nt, Human
cagaaagugauuugcuauucca

SEQ ID NO: 231751 - RNA, 22 nt, Human
cagaaguugcuugagagagagc

SEQ ID NO: 231752 - RNA, 22 nt, Human
cacaucaaacuuacuaagauuu

SEQ ID NO: 231753 - RNA, 22 nt, Human
cacaucucagggcuacaggcag

SEQ ID NO: 231754 - RNA, 22 nt, Human
cacauuaagcccaagcauagaa

SEQ ID NO: 231755 - RNA, 22 nt, Human
cacugcguaguggcccgaagcu

SEQ ID NO: 231756 - RNA, 22 nt, Human
cacacguuuagcuucuggcggc

SEQ ID NO: 231757 - RNA, 22 nt, Human
cacacguuucuacugcugccaa

SEQ ID NO: 231758 - RNA, 22 nt, Human
cacuguugagcaauguacagug

SEQ ID NO: 231759 - RNA, 22 nt, Human
cacugugagugcaagcaggggu

SEQ ID NO: 231760 - RNA, 22 nt, Human
cacagcaggcagaacgugggca

SEQ ID NO: 231761 - RNA, 22 nt, Human
cacugguugccucuuucuguuc

SEQ ID NO: 231762 - RNA, 20 nt, Human
caauguuggcaguauagagc

SEQ ID NO: 231763 - RNA, 22 nt, Human
caauggguuuucuauagagugc

SEQ ID NO: 231764 - RNA, 22 nt, Human
caauggagccaagaggaggaaa

SEQ ID NO: 231765 - RNA, 22 nt, Human
cacuauguacauaauagcugcu

SEQ ID NO: 231766 - RNA, 22 nt, Human
caagcagauauuuuagucaaga

SEQ ID NO: 231767 - RNA, 22 nt, Human
caaaacccaagugcuauugcaa

SEQ ID NO: 231768 - RNA, 22 nt, Human
caaaagcaaagaucuuugauug

SEQ ID NO: 231769 - RNA, 22 nt, Human
caaugcacauggacaucaggcu

SEQ ID NO: 231770 - RNA, 21 nt, Human
cacuguauagcaggagaaaac

SEQ ID NO: 231771 - RNA, 22 nt, Human
cacuguugaagauacuuccucu

SEQ ID NO: 231772 - RNA, 22 nt, Human
cagauacaacagcaggaaugaa

SEQ ID NO: 231773 - RNA, 22 nt, Human
cacugcugaggcccguguuacu

SEQ ID NO: 231774 - RNA, 22 nt, Human
cacucuucucucauuuuccuuu

SEQ ID NO: 231775 - RNA, 23 nt, Human
cacuggugggguuuaaaagaagc

SEQ ID NO: 231776 - RNA, 22 nt, Human
cacugcacuccagccugggcaa

SEQ ID NO: 231777 - RNA, 22 nt, Human
cacugcaaccuccaccucccgg

SEQ ID NO: 231778 - RNA, 22 nt, Human
cagagaagaggucuugaccccu

SEQ ID NO: 231779 - RNA, 19 nt, Human
cagagacuguaacacuuuu

SEQ ID NO: 231780 - RNA, 22 nt, Human
cagagacuuuugcuccgauucu

SEQ ID NO: 231781 - RNA, 22 nt, Human
cagacuccugcuccucuggggc

SEQ ID NO: 231782 - RNA, 22 nt, Human
cagacgguuaaacgauuuugcu

SEQ ID NO: 231783 - RNA, 23 nt, Human
cagagaaaauagaauaugcugug

SEQ ID NO: 231784 - RNA, 18 nt, Human
cacgcaacuguaaaaccc

SEQ ID NO: 231785 - RNA, 22 nt, Human
caccgaacuuugcaaaugcaau

SEQ ID NO: 231786 - RNA, 22 nt, Human
caccgagagccacuuccggaac

SEQ ID NO: 231787 - RNA, 22 nt, Human
cagaccagaaggaagccgacaa

SEQ ID NO: 231788 - RNA, 22 nt, Human
cacuaaccauguucccaacagc

SEQ ID NO: 231789 - RNA, 22 nt, Human
cacgggcgacgugaucuaggac

SEQ ID NO: 231790 - RNA, 22 nt, Human
caccaccaguaccaucacacgc

SEQ ID NO: 231791 - RNA, 23 nt, Human
caccaugacaugccuauagggga

SEQ ID NO: 231792 - RNA, 22 nt, Human
cagccauucuaacacugccagu

SEQ ID NO: 231793 - RNA, 22 nt, Human
cagaccucuaugggguaaaucu

SEQ ID NO: 231794 - RNA, 22 nt, Human
cagaccucucaggcuguucuug

SEQ ID NO: 231795 - RNA, 22 nt, Human
cagcccuggccucuucgcuuuc

SEQ ID NO: 231796 - RNA, 22 nt, Human
cagagagcguccauccggugcc

SEQ ID NO: 231797 - RNA, 22 nt, Human
cagagaggagcacaaagugaag

SEQ ID NO: 231798 - RNA, 22 nt, Human
cagaccuggaaaacaggcuugc

SEQ ID NO: 231799 - RNA, 22 nt, Human
cagccccgcuggccucgccucc

SEQ ID NO: 231800 - RNA, 21 nt, Human
cagcccccauacccugcccag

SEQ ID NO: 231801 - RNA, 22 nt, Human
cacuucaguacuagaggaugaa

SEQ ID NO: 231802 - RNA, 22 nt, Human
cagcacaggugugaggccugau

SEQ ID NO: 231803 - RNA, 22 nt, Human
cagaaaguauguucuaguaguu

SEQ ID NO: 231804 - RNA, 22 nt, Human
cagcagccuccccggccgaccu

SEQ ID NO: 231805 - RNA, 22 nt, Human
cagaacugaauaaagccaggau

SEQ ID NO: 231806 - RNA, 21 nt, Human
cagcagaaaugagaggagaaa

SEQ ID NO: 231807 - RNA, 20 nt, Human
ccagaagagaagaaaaggaa

SEQ ID NO: 231808 - RNA, 22 nt, Human
cauugcaaccccaaaaagaaca

SEQ ID NO: 231809 - RNA, 22 nt, Human
cauugcugugggcauuugcugc

SEQ ID NO: 231810 - RNA, 22 nt, Human
cauugcugccaaggugagcugg

SEQ ID NO: 231811 - RNA, 22 nt, Human
cauugcuguuaauugucucuag

SEQ ID NO: 231812 - RNA, 22 nt, Human
ccacuguuggcccgaagggguc

SEQ ID NO: 231813 - RNA, 22 nt, Human
ccacuuugagaagcugaugaaa

SEQ ID NO: 231814 - RNA, 22 nt, Human
cauuccuucucagguacuggca

SEQ ID NO: 231815 - RNA, 22 nt, Human
ccagaugggggcugugggaggg

SEQ ID NO: 231816 - RNA, 22 nt, Human
ccagaggcuuaugcagcugcug

SEQ ID NO: 231817 - RNA, 22 nt, Human
ccagacuggggcuccuugaggg

SEQ ID NO: 231818 - RNA, 22 nt, Human
cauuuaaccccuugguacugaa

SEQ ID NO: 231819 - RNA, 22 nt, Human
cauugggcggggaccucggcug

SEQ ID NO: 231820 - RNA, 22 nt, Human
ccagagaugcagugggugcagu

SEQ ID NO: 231821 - RNA, 23 nt, Human
cauuugauccucacaauaaaugg

SEQ ID NO: 231822 - RNA, 22 nt, Human
cauuugcuuaucacucuucuuu

SEQ ID NO: 231823 - RNA, 22 nt, Human
cauuucaaacaguuacagcugc

SEQ ID NO: 231824 - RNA, 22 nt, Human
ccagcaugcucagucuaaauug

SEQ ID NO: 231825 - RNA, 22 nt, Human
ccagccacagcuuccagcuccu

SEQ ID NO: 231826 - RNA, 22 nt, Human
ccagccacugacugauuuaaaa

SEQ ID NO: 231827 - RNA, 22 nt, Human
ccagcaaguaagucagugucag

SEQ ID NO: 231828 - RNA, 22 nt, Human
cauuuacguaacaguaacgcug

SEQ ID NO: 231829 - RNA, 22 nt, Human
ccaaagaagcaaugagaauagu

SEQ ID NO: 231830 - RNA, 22 nt, Human
cauuuuuuuuccccuccuggua

SEQ ID NO: 231831 - RNA, 22 nt, Human
cauuuuuccucaggcaauuuga

SEQ ID NO: 231832 - RNA, 22 nt, Human
cauuuugguaauguucguuugc

SEQ ID NO: 231833 - RNA, 17 nt, Human
ccagcugcucccucaga

SEQ ID NO: 231834 - RNA, 23 nt, Human
ccagcugugccuggcccaggagc

SEQ ID NO: 231835 - RNA, 22 nt, Human
ccaggcagaggggucuggagca

SEQ ID NO: 231836 - RNA, 22 nt, Human
ccagucuuggugucuguagcac

SEQ ID NO: 231837 - RNA, 22 nt, Human
ccagugagauagugguauaugc

SEQ ID NO: 231838 - RNA, 22 nt, Human
ccaguccugucaggggagggga

SEQ ID NO: 231839 - RNA, 22 nt, Human
ccagucagccuaguucuucuuu

SEQ ID NO: 231840 - RNA, 22 nt, Human
ccaaccaguuucuuggcuuuag

SEQ ID NO: 231841 - RNA, 22 nt, Human
ccaguguguuuuucucugacuc

SEQ ID NO: 231842 - RNA, 22 nt, Human
ccagugcuuccaggaauacggu

SEQ ID NO: 231843 - RNA, 22 nt, Human
ccagugcaguacaaaccuuagu

SEQ ID NO: 231844 - RNA, 22 nt, Human
ccagggucggcaucagcguggg

SEQ ID NO: 231845 - RNA, 22 nt, Human
ccaauguuaggcucugguuuua

SEQ ID NO: 231846 - RNA, 22 nt, Human
ccaaggcuguggggcugugcag

SEQ ID NO: 231847 - RNA, 22 nt, Human
ccaagcguguuuaggaaaugcu

SEQ ID NO: 231848 - RNA, 22 nt, Human
ccaggggagagucugagucguu

SEQ ID NO: 231849 - RNA, 22 nt, Human
ccaaagaauuuggaaaaucuga

SEQ ID NO: 231850 - RNA, 22 nt, Human
ccaaauuguuguuguuguuguu

SEQ ID NO: 231851 - RNA, 22 nt, Human
ccagggcuggaggaggucagga

SEQ ID NO: 231852 - RNA, 22 nt, Human
ccagggcugcugccugggcugg

SEQ ID NO: 231853 - RNA, 22 nt, Human
ccagggcuggguuugucggugu

SEQ ID NO: 231854 - RNA, 22 nt, Human
ccagggaagaaagaugaagugc

SEQ ID NO: 231855 - RNA, 22 nt, Human
ccagggcggacaaggucuuuga

SEQ ID NO: 231856 - RNA, 22 nt, Human
ccagggaggucauagugcuggu

SEQ ID NO: 231857 - RNA, 22 nt, Human
ccacuuucuaaauuggcgauuu

SEQ ID NO: 231858 - RNA, 22 nt, Human
ccacucucucccucuguagggg

SEQ ID NO: 231859 - RNA, 22 nt, Human
ccacucagaagaaacaagagag

SEQ ID NO: 231860 - RNA, 23 nt, Human
ccaugugcaggguucagcacuua

SEQ ID NO: 231861 - RNA, 22 nt, Human
ccagaacgacgggcagaggcgc

SEQ ID NO: 231862 - RNA, 22 nt, Human
ccauuuuccuguauggacucga

SEQ ID NO: 231863 - RNA, 22 nt, Human
ccagaacguuugugcgaggcag

SEQ ID NO: 231864 - RNA, 22 nt, Human
cccagaagaguauguguuugcu

SEQ ID NO: 231865 - RNA, 22 nt, Human
cccacgccuucuuucuucaaau

SEQ ID NO: 231866 - RNA, 22 nt, Human
ccacagcauugaaaucuauaau

SEQ ID NO: 231867 - RNA, 22 nt, Human
ccauaaaguaggaaacacuaca

SEQ ID NO: 231868 - RNA, 22 nt, Human
ccaguuguggagaauuguuuga

SEQ ID NO: 231869 - RNA, 22 nt, Human
ccaguggugcauguuugagcaa

SEQ ID NO: 231870 - RNA, 22 nt, Human
ccaguuuuuccagugcuuucug

SEQ ID NO: 231871 - RNA, 19 nt, Human
ccaguuuuuuaauauucaa

SEQ ID NO: 231872 - RNA, 22 nt, Human
ccaugauguugccuacacugcu

SEQ ID NO: 231873 - RNA, 22 nt, Human
ccacccacuucucugcccucca

SEQ ID NO: 231874 - RNA, 22 nt, Human
caucacggagcaugagaagaca

SEQ ID NO: 231875 - RNA, 22 nt, Human
caucaggcugggaacacagauc

SEQ ID NO: 231876 - RNA, 22 nt, Human
cagguugaaaguggaggagcua

SEQ ID NO: 231877 - RNA, 22 nt, Human
cagguguugcaguugaagacug

SEQ ID NO: 231878 - RNA, 22 nt, Human
cagguggccggguaggaggugg

SEQ ID NO: 231879 - RNA, 22 nt, Human
cauaucuccagguucugcugga

SEQ ID NO: 231880 - RNA, 22 nt, Human
cauuagugaggggcugccugcu

SEQ ID NO: 231881 - RNA, 22 nt, Human
cauguguauuauucuuguggaa

SEQ ID NO: 231882 - RNA, 22 nt, Human
caugugguauugugagauccac

SEQ ID NO: 231883 - RNA, 22 nt, Human
cauguggaaaugcaugcuuuuu

SEQ ID NO: 231884 - RNA, 22 nt, Human
caugugacuuagguuuuaucac

SEQ ID NO: 231885 - RNA, 22 nt, Human
caugugcaucagccaauuggag

SEQ ID NO: 231886 - RNA, 22 nt, Human
caucaacagucuacuuuuugcc

SEQ ID NO: 231887 - RNA, 20 nt, Human
cauuccaugcaucuuggucc

SEQ ID NO: 231888 - RNA, 22 nt, Human
cauuccaagaaguaguucugca

SEQ ID NO: 231889 - RNA, 22 nt, Human
caucaguaaaguacuuuuaugu

SEQ ID NO: 231890 - RNA, 22 nt, Human
cauugcaaccauuccaaauggc

SEQ ID NO: 231891 - RNA, 22 nt, Human
caucccaacaggugaucuggua

SEQ ID NO: 231892 - RNA, 22 nt, Human
caucgagaauuggcagcuaaag

SEQ ID NO: 231893 - RNA, 22 nt, Human
cauuggcacauguauucugggc

SEQ ID NO: 231894 - RNA, 22 nt, Human
cauugguacaaaauguacuuug

SEQ ID NO: 231895 - RNA, 22 nt, Human
cauuuaucacuugcuaaacaua

SEQ ID NO: 231896 - RNA, 22 nt, Human
cauuuacauaacaguaacgcug

SEQ ID NO: 231897 - RNA, 22 nt, Human
cauuuucugcaagucugcucaa

SEQ ID NO: 231898 - RNA, 22 nt, Human
cauuuuccucugcugguguuca

SEQ ID NO: 231899 - RNA, 22 nt, Human
cauuuuaucagcacacgucacu

SEQ ID NO: 231900 - RNA, 22 nt, Human
cauuucuugugagccgcauccu

SEQ ID NO: 231901 - RNA, 22 nt, Human
cauuucuggccuggggagcggg

SEQ ID NO: 231902 - RNA, 22 nt, Human
cauuugacaauugggauagauc

SEQ ID NO: 231903 - RNA, 22 nt, Human
caugagaguaaccuagagaaga

SEQ ID NO: 231904 - RNA, 22 nt, Human
caugaccauuuggguuugugcg

SEQ ID NO: 231905 - RNA, 22 nt, Human
caugaacucucggguuuggaau

SEQ ID NO: 231906 - RNA, 22 nt, Human
caugccaguagccggcuugacu

SEQ ID NO: 231907 - RNA, 22 nt, Human
cauuuugguccucauguguagc

SEQ ID NO: 231908 - RNA, 22 nt, Human
caugccugaucagcggccagca

SEQ ID NO: 231909 - RNA, 22 nt, Human
caugaugagaguaauaacacag

SEQ ID NO: 231910 - RNA, 22 nt, Human
caugauguuaucaagcacaaag

SEQ ID NO: 231911 - RNA, 22 nt, Human
caugauucccacauugcgauca

SEQ ID NO: 231912 - RNA, 22 nt, Human
caugcagauugccaggcucccu

SEQ ID NO: 231913 - RNA, 19 nt, Human
ccaacaguacugaagcacu

SEQ ID NO: 231914 - RNA, 22 nt, Human
ccaaaauauuagugcuuaagua

SEQ ID NO: 231915 - RNA, 22 nt, Human
cauggccaaagaauuauauuuu

SEQ ID NO: 231916 - RNA, 22 nt, Human
cauggcacuuuugugucuaaau

SEQ ID NO: 231917 - RNA, 22 nt, Human
caugcuucccacauuccgauuu

SEQ ID NO: 231918 - RNA, 22 nt, Human
cauggcacagaagaugucguuu

SEQ ID NO: 231919 - RNA, 19 nt, Human
cauggcgguaaagaggcug

SEQ ID NO: 231920 - RNA, 22 nt, Human
cauggcaggugcagauucugug

SEQ ID NO: 231921 - RNA, 22 nt, Human
caugggaauaaaguuauuucaa

SEQ ID NO: 231922 - RNA, 22 nt, Human
ccaaauuaccuucuuggauuca

SEQ ID NO: 231923 - RNA, 22 nt, Human
ccaaccaaagggccuaaggucu

SEQ ID NO: 231924 - RNA, 22 nt, Human
caugcuggcacugaccagccua

SEQ ID NO: 231925 - RNA, 22 nt, Human
caugcgucugcauuggguggug

SEQ ID NO: 231926 - RNA, 22 nt, Human
ccaaucaacuguguggcuuucu

SEQ ID NO: 231927 - RNA, 22 nt, Human
caugucaagacugaagauccag

SEQ ID NO: 231928 - RNA, 22 nt, Human
caugguacugccacagaagagu

SEQ ID NO: 231929 - RNA, 22 nt, Human
cauguaaguucacagucgaugu

SEQ ID NO: 231930 - RNA, 22 nt, Human
cauguauguuaguggcugcuuu

SEQ ID NO: 231931 - RNA, 22 nt, Human
cauguguuucuuaagccaggcc

SEQ ID NO: 231932 - RNA, 22 nt, Human
ccaauuuuggaauuauuaggca

SEQ ID NO: 231933 - RNA, 21 nt, Human
ccacaauucuaguuacauaug

SEQ ID NO: 231934 - RNA, 22 nt, Human
ccacagugauucacuuuugaag

SEQ ID NO: 231935 - RNA, 22 nt, Human
ccaccucuaccuggccggccuu

SEQ ID NO: 231936 - RNA, 22 nt, Human
cauucauagaaucaguuuggga

SEQ ID NO: 231937 - RNA, 22 nt, Human
cauuauacaugaagacucaccc

SEQ ID NO: 231938 - RNA, 22 nt, Human
cauuauucaggcuuuggaauuu

SEQ ID NO: 231939 - RNA, 22 nt, Human
ccacccuuccauucuuccucuu

SEQ ID NO: 231940 - RNA, 22 nt, Human
ccaccacauuugccuagacuuu

SEQ ID NO: 231941 - RNA, 22 nt, Human
ccaccacugaggcacaggagcc

SEQ ID NO: 231942 - RNA, 22 nt, Human
ccugucuuuucugaucauacua

SEQ ID NO: 231943 - RNA, 22 nt, Human
ccugugucaucagcuguggcua

SEQ ID NO: 231944 - RNA, 22 nt, Human
ccugggugaugugcugcccucg

SEQ ID NO: 231945 - RNA, 22 nt, Human
ccuggguccucacaaucccagg

SEQ ID NO: 231946 - RNA, 22 nt, Human
ccugggcucgcgcacuucaccc

SEQ ID NO: 231947 - RNA, 22 nt, Human
ccugggccuaaacaaacaagag

SEQ ID NO: 231948 - RNA, 22 nt, Human
ccugggcauuuguuucacaggu

SEQ ID NO: 231949 - RNA, 23 nt, Human
ccuggcugaccugaagguguagu

SEQ ID NO: 231950 - RNA, 19 nt, Human
ccuggccaacgucaacauu

SEQ ID NO: 231951 - RNA, 22 nt, Human
ccgcggcugcgcggugccccuc

SEQ ID NO: 231952 - RNA, 22 nt, Human
ccuggccacagggcucugcauu

SEQ ID NO: 231953 - RNA, 19 nt, Human
ccgagcagauugauguuuc

SEQ ID NO: 231954 - RNA, 21 nt, Human
ccgacggcgcagaugccggcc

SEQ ID NO: 231955 - RNA, 22 nt, Human
ccagacucucucauuuuccugu

SEQ ID NO: 231956 - RNA, 22 nt, Human
cccagagggcugaggauaugaa

SEQ ID NO: 231957 - RNA, 22 nt, Human
ccgaaaaacagaaucuuggaac

SEQ ID NO: 231958 - RNA, 22 nt, Human
ccgaaccacacgacagugcuca

SEQ ID NO: 231959 - RNA, 22 nt, Human
ccugcuggagucuaguuggucu

SEQ ID NO: 231960 - RNA, 22 nt, Human
ccagagcacaccguuugccuuc

SEQ ID NO: 231961 - RNA, 22 nt, Human
ccagagcaccgaaacgagcuuu

SEQ ID NO: 231962 - RNA, 21 nt, Human
ccuuuggagacugcagcaaug

SEQ ID NO: 231963 - RNA, 22 nt, Human
ccuuugcugggccucuccaucu

SEQ ID NO: 231964 - RNA, 22 nt, Human
ccggcugagccucgccgcggcc

SEQ ID NO: 231965 - RNA, 22 nt, Human
ccggcggaaacauggcggcgcc

SEQ ID NO: 231966 - RNA, 22 nt, Human
ccggaggaaauugcauugguug

SEQ ID NO: 231967 - RNA, 22 nt, Human
ccuuucuggucucugagagacu

SEQ ID NO: 231968 - RNA, 22 nt, Human
ccgcucgggugcagagggcaga

SEQ ID NO: 231969 - RNA, 22 nt, Human
ccuuucucuuggauaccgauug

SEQ ID NO: 231970 - RNA, 22 nt, Human
ccgcuggaagcgaguggugggc

SEQ ID NO: 231971 - RNA, 22 nt, Human
ccuugguuuagcaauuuuucuu

SEQ ID NO: 231972 - RNA, 23 nt, Human
ccuuguguaucuccagccacucc

SEQ ID NO: 231973 - RNA, 22 nt, Human
ccuuggcuuaccuucugugugg

SEQ ID NO: 231974 - RNA, 22 nt, Human
ccgcggcuguaguggaggugga

SEQ ID NO: 231975 - RNA, 22 nt, Human
ccuucuuaaacaucauuuuggc

SEQ ID NO: 231976 - RNA, 22 nt, Human
ccuugcuucuagcauucccaug

SEQ ID NO: 231977 - RNA, 22 nt, Human
ccuucgcuggcaucuccaggua

SEQ ID NO: 231978 - RNA, 18 nt, Human
ccuucaucucugcuucuu

SEQ ID NO: 231979 - RNA, 22 nt, Human
cgcccguacuuugccggcauga

SEQ ID NO: 231980 - RNA, 22 nt, Human
cgccgccgccugcccgcgcccc

SEQ ID NO: 231981 - RNA, 22 nt, Human
ccucucugcgaaugcugauagu

SEQ ID NO: 231982 - RNA, 22 nt, Human
ccucuccuugcuccccuuccuu

SEQ ID NO: 231983 - RNA, 22 nt, Human
ccugacgcugauauauaguuaa

SEQ ID NO: 231984 - RNA, 22 nt, Human
ccugacucugauuucgcugcau

SEQ ID NO: 231985 - RNA, 22 nt, Human
cgcugcagcggcugagucccgc

SEQ ID NO: 231986 - RNA, 22 nt, Human
ccugacuugguuuaggagaugg

SEQ ID NO: 231987 - RNA, 22 nt, Human
ccugagacucuccugugcagcc

SEQ ID NO: 231988 - RNA, 22 nt, Human
cggaggcugcuuucuguugcua

SEQ ID NO: 231989 - RNA, 22 nt, Human
cggagggcccucaggacugggu

SEQ ID NO: 231990 - RNA, 22 nt, Human
cggcugcagcggagcaggcugg

SEQ ID NO: 231991 - RNA, 22 nt, Human
cggcugcgguucaccuagggca

SEQ ID NO: 231992 - RNA, 22 nt, Human
cgggacaauagcagugcugaug

SEQ ID NO: 231993 - RNA, 22 nt, Human
cgggagagacagaggaggcgcc

SEQ ID NO: 231994 - RNA, 22 nt, Human
cgggaaguaaacauuauuucag

SEQ ID NO: 231995 - RNA, 22 nt, Human
cggacugaccugcucggggaga

SEQ ID NO: 231996 - RNA, 22 nt, Human
cggaagcacuagacacugacac

SEQ ID NO: 231997 - RNA, 22 nt, Human
cggagcgagaaggggaaagccc

SEQ ID NO: 231998 - RNA, 22 nt, Human
cggagagacaagucugcuuugg

SEQ ID NO: 231999 - RNA, 22 nt, Human
ccuauuuucaaaauuguuuauc

SEQ ID NO: 232000 - RNA, 22 nt, Human
ccuagcauagcuuuugccuccc

SEQ ID NO: 232001 - RNA, 22 nt, Human
cgaaaaagaagugcaccauguu

SEQ ID NO: 232002 - RNA, 22 nt, Human
cgaacggcagagagcccguccc

SEQ ID NO: 232003 - RNA, 22 nt, Human
ccuuuuuagaugugcgaauguu

SEQ ID NO: 232004 - RNA, 20 nt, Human
ccucaaccuccuuucucucc

SEQ ID NO: 232005 - RNA, 22 nt, Human
ccuuuuguuucccuuuauguuc

SEQ ID NO: 232006 - RNA, 19 nt, Human
ccggucaugcauuccuuug

SEQ ID NO: 232007 - RNA, 22 nt, Human
ccgguguggguuucucgguagu

SEQ ID NO: 232008 - RNA, 22 nt, Human
ccggguucuuguucuaggaugu

SEQ ID NO: 232009 - RNA, 21 nt, Human
ccguuauucuucccaccccca

SEQ ID NO: 232010 - RNA, 22 nt, Human
ccuaauuuuagacccacuccua

SEQ ID NO: 232011 - RNA, 19 nt, Human
ccuccgcauccucaucugu

SEQ ID NO: 232012 - RNA, 22 nt, Human
ccuccuggaguuacuuccaaaa

SEQ ID NO: 232013 - RNA, 22 nt, Human
ccuccuuucaggaaguaggugg

SEQ ID NO: 232014 - RNA, 22 nt, Human
cgaaggaaucacuuaacacuuu

SEQ ID NO: 232015 - RNA, 22 nt, Human
cgagggcuggaggggagacaga

SEQ ID NO: 232016 - RNA, 22 nt, Human
cgagguacuuacccuggucugu

SEQ ID NO: 232017 - RNA, 22 nt, Human
cgcccggcugagacgcucgccc

SEQ ID NO: 232018 - RNA, 22 nt, Human
cuacacgauaaauuuuaguggu

SEQ ID NO: 232019 - RNA, 22 nt, Human
cgaggcuugcaaggacgaggag

SEQ ID NO: 232020 - RNA, 22 nt, Human
cgaggccgcuucauggcuggca

SEQ ID NO: 232021 - RNA, 22 nt, Human
cuaaauucuauauccuugcuuc

SEQ ID NO: 232022 - RNA, 22 nt, Human
cuaaauguuuuaucuuccuggc

SEQ ID NO: 232023 - RNA, 22 nt, Human
cgugucauggcggcgcaggugg

SEQ ID NO: 232024 - RNA, 22 nt, Human
cuacuguaguuaaaguuuugua

SEQ ID NO: 232025 - RNA, 22 nt, Human
cuacugaugccccgcugugccu

SEQ ID NO: 232026 - RNA, 18 nt, Human
cgauguguaugugauuug

SEQ ID NO: 232027 - RNA, 22 nt, Human
cuacugaagcaugcuuauaugu

SEQ ID NO: 232028 - RNA, 22 nt, Human
cgagguuuaugaguuuguguuc

SEQ ID NO: 232029 - RNA, 22 nt, Human
cgagugauuauucuggcugaga

SEQ ID NO: 232030 - RNA, 22 nt, Human
cgaguaauuggaaauuugcuau

SEQ ID NO: 232031 - RNA, 22 nt, Human
cgauuccugauaagugaauaag

SEQ ID NO: 232032 - RNA, 22 nt, Human
cuacugacugaccauaguuuca

SEQ ID NO: 232033 - RNA, 22 nt, Human
cgcacuggagcuggaacgaguc

SEQ ID NO: 232034 - RNA, 22 nt, Human
cgcacacaaaugcauacgccag

SEQ ID NO: 232035 - RNA, 22 nt, Human
ccuucugcuggucaucccagug

SEQ ID NO: 232036 - RNA, 22 nt, Human
ccuggcccagcuggaagcggga

SEQ ID NO: 232037 - RNA, 22 nt, Human
ccuggcauuagaaauuccguca

SEQ ID NO: 232038 - RNA, 22 nt, Human
cgggcacagguugagguagaug

SEQ ID NO: 232039 - RNA, 22 nt, Human
cgggcacucagggucgaggugg

SEQ ID NO: 232040 - RNA, 22 nt, Human
cgucauuuguaaaugaucaaga

SEQ ID NO: 232041 - RNA, 21 nt, Human
ccuuugaguguguuugaagua

SEQ ID NO: 232042 - RNA, 22 nt, Human
ccuuugcccugagaaauguucc

SEQ ID NO: 232043 - RNA, 17 nt, Human
ccuuucugaucaucuga

SEQ ID NO: 232044 - RNA, 22 nt, Human
ccuuucuaacagauuguggauc

SEQ ID NO: 232045 - RNA, 22 nt, Human
ccuuuccuggaaaugguaaguu

SEQ ID NO: 232046 - RNA, 22 nt, Human
cgugccugguggagagcgaggg

SEQ ID NO: 232047 - RNA, 22 nt, Human
cgucuaaggaacuccauucaca

SEQ ID NO: 232048 - RNA, 22 nt, Human
cgcuggagagcaagugcgugca

SEQ ID NO: 232049 - RNA, 22 nt, Human
cucaucagagcccuccucuggc

SEQ ID NO: 232050 - RNA, 22 nt, Human
cgcugggugguugauguacagc

SEQ ID NO: 232051 - RNA, 22 nt, Human
cgcugcugucaucgucuacggu

SEQ ID NO: 232052 - RNA, 20 nt, Human
cucauugcuuucauuuucuu

SEQ ID NO: 232053 - RNA, 22 nt, Human
cuccacagccccuccaguggca

SEQ ID NO: 232054 - RNA, 22 nt, Human
cuccagcucgcgagcucugcuc

SEQ ID NO: 232055 - RNA, 22 nt, Human
cuccgcagcugggguuggcgcu

SEQ ID NO: 232056 - RNA, 22 nt, Human
cuccggccuucugacuccccug

SEQ ID NO: 232057 - RNA, 22 nt, Human
cucccuucaggggaggacuagg

SEQ ID NO: 232058 - RNA, 22 nt, Human
cuccaggacugaggacagagcu

SEQ ID NO: 232059 - RNA, 22 nt, Human
cucuaagcuuugguguuucacu

SEQ ID NO: 232060 - RNA, 20 nt, Human
cuccuccccucggccccacc

SEQ ID NO: 232061 - RNA, 22 nt, Human
cuccugauuucuaggccuuauc

SEQ ID NO: 232062 - RNA, 22 nt, Human
cuccgaaaugcaucccagggca

SEQ ID NO: 232063 - RNA, 22 nt, Human
cggaggagcugcgcggaggggg

SEQ ID NO: 232064 - RNA, 22 nt, Human
cggagcauacugccuggagaug

SEQ ID NO: 232065 - RNA, 22 nt, Human
cucugcuagaaggucaaucucu

SEQ ID NO: 232066 - RNA, 22 nt, Human
cucucuuuuuuucccuuguuaa

SEQ ID NO: 232067 - RNA, 22 nt, Human
cggcccggccucgcggcgcaug

SEQ ID NO: 232068 - RNA, 22 nt, Human
cuaguucugccauucaguguca

SEQ ID NO: 232069 - RNA, 22 nt, Human
cuaguauuaagugugaguaaaa

SEQ ID NO: 232070 - RNA, 22 nt, Human
cgcccccgaucggggccgccgc

SEQ ID NO: 232071 - RNA, 22 nt, Human
cgcauugcaauucaggggauaa

SEQ ID NO: 232072 - RNA, 22 nt, Human
cgcagcuucagggccaggaggg

SEQ ID NO: 232073 - RNA, 22 nt, Human
cuaggaugcuguaauggugucu

SEQ ID NO: 232074 - RNA, 22 nt, Human
cucaagugacucagccugguug

SEQ ID NO: 232075 - RNA, 22 nt, Human
cucaaauggguuuguagaauau

SEQ ID NO: 232076 - RNA, 22 nt, Human
cgccgugucuggucuguacguc

SEQ ID NO: 232077 - RNA, 22 nt, Human
cgccgugcagucagcccagaag

SEQ ID NO: 232078 - RNA, 22 nt, Human
cuauuuucccauaugguugaca

SEQ ID NO: 232079 - RNA, 22 nt, Human
cucaaaauccauaaaaucaggu

SEQ ID NO: 232080 - RNA, 22 nt, Human
cucagcacauuccuaagggaug

SEQ ID NO: 232081 - RNA, 22 nt, Human
cgcgcuuugggcaguguggcug

SEQ ID NO: 232082 - RNA, 22 nt, Human
cgcuagggagcacuuggcagug

SEQ ID NO: 232083 - RNA, 22 nt, Human
cgcgggcuugggcaccugcgga

SEQ ID NO: 232084 - RNA, 22 nt, Human
cucagcgagggaaagaggccgc

SEQ ID NO: 232085 - RNA, 22 nt, Human
cucagcaauuaccugugucucu

SEQ ID NO: 232086 - RNA, 22 nt, Human
cucagcgggagucuggccgaac

SEQ ID NO: 232087 - RNA, 22 nt, Human
cucacugugggcuaugaauggg

SEQ ID NO: 232088 - RNA, 23 nt, Human
cuggacauucgcaaaguucaucu

SEQ ID NO: 232089 - RNA, 22 nt, Human
cucagaagaacaaaggcucuac

SEQ ID NO: 232090 - RNA, 22 nt, Human
cucagaugaugucuucagggaa

SEQ ID NO: 232091 - RNA, 22 nt, Human
cucagcaacccacacacggucu

SEQ ID NO: 232092 - RNA, 22 nt, Human
cucaguauugacgaaagagauu

SEQ ID NO: 232093 - RNA, 22 nt, Human
cucaggaaaauauugaagaagu

SEQ ID NO: 232094 - RNA, 22 nt, Human
cucaugagucugucagagucau

SEQ ID NO: 232095 - RNA, 22 nt, Human
cucaugaauggcucuuugugcu

SEQ ID NO: 232096 - RNA, 22 nt, Human
cugcuucacccugccugagaac

SEQ ID NO: 232097 - RNA, 22 nt, Human
cuauuauuauugucguuuuaca

SEQ ID NO: 232098 - RNA, 22 nt, Human
cucacgguuugcaucaagagug

SEQ ID NO: 232099 - RNA, 22 nt, Human
cucaaagcagacuuuucccuuu

SEQ ID NO: 232100 - RNA, 22 nt, Human
cugcuugaugaggaaaggauug

SEQ ID NO: 232101 - RNA, 22 nt, Human
cugggguaucugccacaacucu

SEQ ID NO: 232102 - RNA, 22 nt, Human
cugggagaggaaccucgagggu

SEQ ID NO: 232103 - RNA, 22 nt, Human
cugggcaugggaacuucaaggc

SEQ ID NO: 232104 - RNA, 22 nt, Human
cugggaguugacgaggcuugua

SEQ ID NO: 232105 - RNA, 22 nt, Human
cuggucaauaaucauguaguac

SEQ ID NO: 232106 - RNA, 22 nt, Human
cugggugugugugaacagagau

SEQ ID NO: 232107 - RNA, 22 nt, Human
cugggugggcacccagccuggg

SEQ ID NO: 232108 - RNA, 22 nt, Human
cuggguaaggaaacuccuuugu

SEQ ID NO: 232109 - RNA, 22 nt, Human
cuggguguggugggugcugccg

SEQ ID NO: 232110 - RNA, 22 nt, Human
cuccaaaucugauugcuaccuu

SEQ ID NO: 232111 - RNA, 22 nt, Human
cucauugacagagcagcucuac

SEQ ID NO: 232112 - RNA, 22 nt, Human
cuccagcagaaagggcgagugg

SEQ ID NO: 232113 - RNA, 22 nt, Human
cucccucauaugguugcuuauc

SEQ ID NO: 232114 - RNA, 22 nt, Human
cuccagauuugggggauauacu

SEQ ID NO: 232115 - RNA, 22 nt, Human
cucccucacaaagcauucucuu

SEQ ID NO: 232116 - RNA, 22 nt, Human
cuggcuguguguuugugcaucu

SEQ ID NO: 232117 - RNA, 21 nt, Human
cuggcucgccaugguucuuuu

SEQ ID NO: 232118 - RNA, 22 nt, Human
cucccugagaugcaggagagag

SEQ ID NO: 232119 - RNA, 22 nt, Human
cuggcggugaucccgauggugu

SEQ ID NO: 232120 - RNA, 22 nt, Human
cugucagcaaaucagugucugg

SEQ ID NO: 232121 - RNA, 22 nt, Human
cuguccauuuucgugccuccuu

SEQ ID NO: 232122 - RNA, 22 nt, Human
cuguauggaggaggugcuagcc

SEQ ID NO: 232123 - RNA, 22 nt, Human
cugguacuggaggaguucagag

SEQ ID NO: 232124 - RNA, 22 nt, Human
cucuguugucaguggaagcagc

SEQ ID NO: 232125 - RNA, 22 nt, Human
cugguuuuccaauguuuugacu

SEQ ID NO: 232126 - RNA, 22 nt, Human
cuggugcuguagccugauugag

SEQ ID NO: 232127 - RNA, 22 nt, Human
cuggugggucacgugugggugg

SEQ ID NO: 232128 - RNA, 22 nt, Human
cugguuacuucagaucaguagu

SEQ ID NO: 232129 - RNA, 22 nt, Human
cucuggagggaggcugagcugg

SEQ ID NO: 232130 - RNA, 22 nt, Human
cuguguuguuugaguagcuuga

SEQ ID NO: 232131 - RNA, 22 nt, Human
cugugggcucucaugggaccug

SEQ ID NO: 232132 - RNA, 22 nt, Human
cuguguugggauggugcgcgca

SEQ ID NO: 232133 - RNA, 22 nt, Human
cugaaacucaagauaggaggaa

SEQ ID NO: 232134 - RNA, 19 nt, Human
cugaaacacagagagggcu

SEQ ID NO: 232135 - RNA, 22 nt, Human
cugaaacuauggggaggggagc

SEQ ID NO: 232136 - RNA, 20 nt, Human
cucuuucugcuuuaugccuc

SEQ ID NO: 232137 - RNA, 22 nt, Human
cucuuucauucuuagguugccg

SEQ ID NO: 232138 - RNA, 22 nt, Human
cugugcauguucucuagcugau

SEQ ID NO: 232139 - RNA, 22 nt, Human
cugugccagucagggggcaagu

SEQ ID NO: 232140 - RNA, 22 nt, Human
cucuuuuuuugucuuaagaacc

SEQ ID NO: 232141 - RNA, 22 nt, Human
cugugcuguuaagaaauuuagu

SEQ ID NO: 232142 - RNA, 22 nt, Human
cuguucagugcauauguauuga

SEQ ID NO: 232143 - RNA, 22 nt, Human
cuguuccuccaccucaacaaac

SEQ ID NO: 232144 - RNA, 22 nt, Human
cuguucuccacuccugacuucu

SEQ ID NO: 232145 - RNA, 22 nt, Human
cugaaagcaaaguaauucuuaa

SEQ ID NO: 232146 - RNA, 22 nt, Human
cugaaagacgaggggaagucgg

SEQ ID NO: 232147 - RNA, 22 nt, Human
cuguuguguuauuugcagugca

SEQ ID NO: 232148 - RNA, 22 nt, Human
cugagggagcugcuggccuugg

SEQ ID NO: 232149 - RNA, 22 nt, Human
cuguuucuuugcugucagagag

SEQ ID NO: 232150 - RNA, 22 nt, Human
cugagcaucaaaugggcaauua

SEQ ID NO: 232151 - RNA, 22 nt, Human
cuguuuggcuuccacugcuucu

SEQ ID NO: 232152 - RNA, 22 nt, Human
cguuauagagcacucgaacuuu

SEQ ID NO: 232153 - RNA, 22 nt, Human
cgugugcguauguguuuguaug

SEQ ID NO: 232154 - RNA, 22 nt, Human
cgugcuaccugagcugacagcu

SEQ ID NO: 232155 - RNA, 20 nt, Human
cguugccagcccggcccggg

SEQ ID NO: 232156 - RNA, 22 nt, Human
cugaugugcauguggggggaug

SEQ ID NO: 232157 - RNA, 22 nt, Human
cugcacuggguacauagaaaca

SEQ ID NO: 232158 - RNA, 22 nt, Human
cugcacagucauuuccucucaa

SEQ ID NO: 232159 - RNA, 22 nt, Human
cugauguuuaucucaagaguuc

SEQ ID NO: 232160 - RNA, 22 nt, Human
cugcaguaacuauuuucaauaa

SEQ ID NO: 232161 - RNA, 22 nt, Human
cugcaguguccgcuugcucagc

SEQ ID NO: 232162 - RNA, 22 nt, Human
cugccacuaccaugcuggauga

SEQ ID NO: 232163 - RNA, 22 nt, Human
cguuuugaguagauagccauau

SEQ ID NO: 232164 - RNA, 16 nt, Human
cuaaaaugucuacuug

SEQ ID NO: 232165 - RNA, 22 nt, Human
cuaaacacuauucuggaaauag

SEQ ID NO: 232166 - RNA, 22 nt, Human
cuaaacuucauauguugcuuua

SEQ ID NO: 232167 - RNA, 22 nt, Human
cuaaagacagcaagacaucauc

SEQ ID NO: 232168 - RNA, 21 nt, Human
cugauguaccucaagccuagu

SEQ ID NO: 232169 - RNA, 22 nt, Human
cugauggagagugugauuuggg

SEQ ID NO: 232170 - RNA, 22 nt, Human
cugaucuuaaguaacauuauuu

SEQ ID NO: 232171 - RNA, 22 nt, Human
cgugaagaaguaauagguggug

SEQ ID NO: 232172 - RNA, 22 nt, Human
cgugaucuguuauauagugagc

SEQ ID NO: 232173 - RNA, 17 nt, Human
cgugaggaccaggcagc

SEQ ID NO: 232174 - RNA, 22 nt, Human
cgugaaaugcagaaaguugugg

SEQ ID NO: 232175 - RNA, 22 nt, Human
cguggaggucgcauauuccucu

SEQ ID NO: 232176 - RNA, 22 nt, Human
cguggcaguagagcuggaacuu

SEQ ID NO: 232177 - RNA, 22 nt, Human
cgucagccacagcugccccggg

SEQ ID NO: 232178 - RNA, 22 nt, Human
cgguugcaggaugugcgggcag

SEQ ID NO: 232179 - RNA, 22 nt, Human
cggugcuuuccauaucagcagc

SEQ ID NO: 232180 - RNA, 22 nt, Human
cucugcuuagacaggcuuuaag

SEQ ID NO: 232181 - RNA, 22 nt, Human
cugagcugcucccgcugcagcg

SEQ ID NO: 232182 - RNA, 22 nt, Human
cgucauguuauggcucauucua

SEQ ID NO: 232183 - RNA, 23 nt, Human
cugagggcuggucugaagucugc

SEQ ID NO: 232184 - RNA, 22 nt, Human
cugagggagacagugcggacua

SEQ ID NO: 232185 - RNA, 22 nt, Human
cugagcuuuucucugcuucuua

SEQ ID NO: 232186 - RNA, 22 nt, Human
cugaggcuaauagaauuuucug

SEQ ID NO: 232187 - RNA, 22 nt, Human
cugcugccagcuuaauacucac

SEQ ID NO: 232188 - RNA, 22 nt, Human
cugcucugagaggcucuuccua

SEQ ID NO: 232189 - RNA, 22 nt, Human
cugcuacgguguccgguggggc

SEQ ID NO: 232190 - RNA, 22 nt, Human
cuaguuuucacaaaggaagggc

SEQ ID NO: 232191 - RNA, 22 nt, Human
cugcuauaacacuaacaucuaa

SEQ ID NO: 232192 - RNA, 22 nt, Human
cuagcaggacucagcagauauu

SEQ ID NO: 232193 - RNA, 22 nt, Human
cugcguugaccagacuccuggg

SEQ ID NO: 232194 - RNA, 22 nt, Human
cuaggucagaggacacagcuua

SEQ ID NO: 232195 - RNA, 22 nt, Human
cuaggcuuucugugugacuaga

SEQ ID NO: 232196 - RNA, 22 nt, Human
cuaugguaguggcacaggagga

SEQ ID NO: 232197 - RNA, 22 nt, Human
cugcugucuuuauuucacugcu

SEQ ID NO: 232198 - RNA, 22 nt, Human
cugcuguuuuccccaccaucuc

SEQ ID NO: 232199 - RNA, 22 nt, Human
cugcuguuuucugggcuucuua

SEQ ID NO: 232200 - RNA, 22 nt, Human
cugcccgcaugcaggaaugcug

SEQ ID NO: 232201 - RNA, 22 nt, Human
cugcccauggcuccuggcugug

SEQ ID NO: 232202 - RNA, 22 nt, Human
cugccaguaucuuuggggcugu

SEQ ID NO: 232203 - RNA, 22 nt, Human
cuaccccaggccccucgaugcc

SEQ ID NO: 232204 - RNA, 22 nt, Human
cuaccagcacgccuuccucuac

SEQ ID NO: 232205 - RNA, 22 nt, Human
cuaaauuuuuuagugaaauagg

SEQ ID NO: 232206 - RNA, 22 nt, Human
cgugggggcaacgaccccuccc

SEQ ID NO: 232207 - RNA, 22 nt, Human
cuaaugaaaugauggcuccuac

SEQ ID NO: 232208 - RNA, 22 nt, Human
cuaauaauuuacugagugcuac

SEQ ID NO: 232209 - RNA, 22 nt, Human
cugccggcugcugcagagaggu

SEQ ID NO: 232210 - RNA, 22 nt, Human
cugccucucaugccugcuugcu

SEQ ID NO: 232211 - RNA, 22 nt, Human
cugccugugcgccaagugcacg

SEQ ID NO: 232212 - RNA, 22 nt, Human
cugccuggggaaugugaggauu

SEQ ID NO: 232213 - RNA, 22 nt, Human
cuacuucuguggcucuaagaga

SEQ ID NO: 232214 - RNA, 22 nt, Human
cuacuuucuucuucagaauugu

SEQ ID NO: 232215 - RNA, 22 nt, Human
cuagaaaguaugcuuuuauaau

SEQ ID NO: 232216 - RNA, 22 nt, Human
cugccuucaaaguaauauuuua

SEQ ID NO: 232217 - RNA, 22 nt, Human
cugccuuggcccuaguucaugg

SEQ ID NO: 232218 - RNA, 22 nt, Human
cugcgcgagcacugccggcggg

SEQ ID NO: 232219 - RNA, 22 nt, Human
cugcggcaccaaccccuucaug

SEQ ID NO: 232220 - RNA, 22 nt, Human
cugguuuauuucauaguuuguu

SEQ ID NO: 232221 - RNA, 20 nt, Human
cuggugccuucugcgauuua

SEQ ID NO: 232222 - RNA, 22 nt, Human
gaaaaggaggggaggcagaugg

SEQ ID NO: 232223 - RNA, 22 nt, Human
gaaaagaaaggaugguaugugu

SEQ ID NO: 232224 - RNA, 22 nt, Human
gaaaacccuguauguagcguuu

SEQ ID NO: 232225 - RNA, 22 nt, Human
cuggguguuccuuucauuuuaa

SEQ ID NO: 232226 - RNA, 22 nt, Human
cuggguuuggcugugcuugaau

SEQ ID NO: 232227 - RNA, 22 nt, Human
gaaaaucaugaaaguguguugu

SEQ ID NO: 232228 - RNA, 22 nt, Human
gaaaaucaggauggaugugagg

SEQ ID NO: 232229 - RNA, 22 nt, Human
cuggugagaccgacuuccacuu

SEQ ID NO: 232230 - RNA, 22 nt, Human
cuggugaagccuucggagaccc

SEQ ID NO: 232231 - RNA, 21 nt, Human
gaaaaucuaaugugacaaugc

SEQ ID NO: 232232 - RNA, 22 nt, Human
cuguccugauggugccacuggu

SEQ ID NO: 232233 - RNA, 22 nt, Human
gaaaccauggcaaccagguccu

SEQ ID NO: 232234 - RNA, 22 nt, Human
cugugaaugguggccacgcguu

SEQ ID NO: 232235 - RNA, 22 nt, Human
gaaacguuguggaaaauccucu

SEQ ID NO: 232236 - RNA, 22 nt, Human
gaaaugaaacacacaugcagcu

SEQ ID NO: 232237 - RNA, 22 nt, Human
gaaaugggggcaugcguuacau

SEQ ID NO: 232238 - RNA, 22 nt, Human
cuguggcugcgcccugggggag

SEQ ID NO: 232239 - RNA, 22 nt, Human
gaacaguuucccuguagaaaau

SEQ ID NO: 232240 - RNA, 22 nt, Human
gaacaaggauucccaaagaaga

SEQ ID NO: 232241 - RNA, 22 nt, Human
gaacaaaagauagcccaaacau

SEQ ID NO: 232242 - RNA, 22 nt, Human
gaagaagagauaauggggagca

SEQ ID NO: 232243 - RNA, 22 nt, Human
gaacauuucugcagaugucuga

SEQ ID NO: 232244 - RNA, 22 nt, Human
cugggaugagcuguuuccuggu

SEQ ID NO: 232245 - RNA, 22 nt, Human
cugggaggagacaggggauggg

SEQ ID NO: 232246 - RNA, 22 nt, Human
cugggagaugacucagagcagg

SEQ ID NO: 232247 - RNA, 22 nt, Human
cugggaaucuagagggcucauu

SEQ ID NO: 232248 - RNA, 22 nt, Human
cugggacacguugugcuuuaac

SEQ ID NO: 232249 - RNA, 22 nt, Human
cuuuuucuuaucuuuuucuaug

SEQ ID NO: 232250 - RNA, 22 nt, Human
cuuuuugcccuugggcuuccug

SEQ ID NO: 232251 - RNA, 22 nt, Human
cugggguaucuggugucuuggu

SEQ ID NO: 232252 - RNA, 22 nt, Human
cugggcuuucaggcccuaaggc

SEQ ID NO: 232253 - RNA, 22 nt, Human
cuggguaaauauguauuccuga

SEQ ID NO: 232254 - RNA, 22 nt, Human
cugggguggugcaggccucaug

SEQ ID NO: 232255 - RNA, 22 nt, Human
gaaaaaccacaauugguauuuu

SEQ ID NO: 232256 - RNA, 22 nt, Human
gaaaaagagaaggaguucagua

SEQ ID NO: 232257 - RNA, 22 nt, Human
cuuuucauuucauggaauacaa

SEQ ID NO: 232258 - RNA, 22 nt, Human
cuggcgagcugggccuggggga

SEQ ID NO: 232259 - RNA, 22 nt, Human
cuggcuuucauggcgcaguuga

SEQ ID NO: 232260 - RNA, 22 nt, Human
cugggaaggaagggaaaaacag

SEQ ID NO: 232261 - RNA, 22 nt, Human
cuuuucuuuucuucucuuccca

SEQ ID NO: 232262 - RNA, 22 nt, Human
cuggcuaaugugcugauagcca

SEQ ID NO: 232263 - RNA, 22 nt, Human
cuggcgauugcgagagucgccu

SEQ ID NO: 232264 - RNA, 22 nt, Human
cuggcggcccgaggcagaggag

SEQ ID NO: 232265 - RNA, 22 nt, Human
cuggagaucaguuggacaacag

SEQ ID NO: 232266 - RNA, 22 nt, Human
cuggagcucugggcaucucagg

SEQ ID NO: 232267 - RNA, 20 nt, Human
cuggaguguagcaguggcug

SEQ ID NO: 232268 - RNA, 22 nt, Human
cuggaucgccccgaugugcccc

SEQ ID NO: 232269 - RNA, 22 nt, Human
cugauccuauauugguaugagg

SEQ ID NO: 232270 - RNA, 22 nt, Human
cuucagagugacucagcaucuu

SEQ ID NO: 232271 - RNA, 23 nt, Human
cuucagaccucagaaggucuguu

SEQ ID NO: 232272 - RNA, 22 nt, Human
cugaugcucuggauguagucaa

SEQ ID NO: 232273 - RNA, 20 nt, Human
cuuaugcaaaauguuaggga

SEQ ID NO: 232274 - RNA, 22 nt, Human
cuuugauuucucugguccaauc

SEQ ID NO: 232275 - RNA, 22 nt, Human
gacagcguaucaauugaacaua

SEQ ID NO: 232276 - RNA, 22 nt, Human
gacaggaccgagguggggcggg

SEQ ID NO: 232277 - RNA, 22 nt, Human
gacaggcagagaggaagagaga

SEQ ID NO: 232278 - RNA, 22 nt, Human
cuuucucucaaacacacauaca

SEQ ID NO: 232279 - RNA, 22 nt, Human
cuuucuccagagugaagauccu

SEQ ID NO: 232280 - RNA, 22 nt, Human
gacagcaggaugugaggggaug

SEQ ID NO: 232281 - RNA, 22 nt, Human
gacagaccucugcugacuggag

SEQ ID NO: 232282 - RNA, 22 nt, Human
gaccugcucagcccuguguguu

SEQ ID NO: 232283 - RNA, 22 nt, Human
gaccugguggccauugucccag

SEQ ID NO: 232284 - RNA, 22 nt, Human
gaccugaccucauuagcaaguu

SEQ ID NO: 232285 - RNA, 21 nt, Human
cuuugccuccagcagccgcag

SEQ ID NO: 232286 - RNA, 22 nt, Human
cuuugcaaagagagaaaguggg

SEQ ID NO: 232287 - RNA, 22 nt, Human
cuuuuucaugggugaugagugg

SEQ ID NO: 232288 - RNA, 22 nt, Human
cuuuuggcaucagccucaggaa

SEQ ID NO: 232289 - RNA, 22 nt, Human
gacuuaaaugcuccccucaggg

SEQ ID NO: 232290 - RNA, 22 nt, Human
cuuuugcaauagugacacugau

SEQ ID NO: 232291 - RNA, 22 nt, Human
cuuuuuaaaguaaauggcuaga

SEQ ID NO: 232292 - RNA, 18 nt, Human
gacugccuugaacuauug

SEQ ID NO: 232293 - RNA, 22 nt, Human
gacuugcucaaaucagauuuua

SEQ ID NO: 232294 - RNA, 22 nt, Human
gacuucaagaugaaucuuuggg

SEQ ID NO: 232295 - RNA, 22 nt, Human
cuuuuugccuugaagugaccuc

SEQ ID NO: 232296 - RNA, 22 nt, Human
cuuuuuuucuccauauuucugg

SEQ ID NO: 232297 - RNA, 22 nt, Human
gaaaaagucuuaaaguaaggca

SEQ ID NO: 232298 - RNA, 22 nt, Human
gagaacaaggaagagucggcag

SEQ ID NO: 232299 - RNA, 22 nt, Human
gagaaagggagaaaaagaucuu

SEQ ID NO: 232300 - RNA, 22 nt, Human
gagaaaacauacuuaguguccu

SEQ ID NO: 232301 - RNA, 22 nt, Human
gaaaaauggguuguuugaagau

SEQ ID NO: 232302 - RNA, 22 nt, Human
cuugccagggacucagucaggg

SEQ ID NO: 232303 - RNA, 22 nt, Human
cuugauucauuuaagguuggag

SEQ ID NO: 232304 - RNA, 22 nt, Human
gaaugguuauaugauguuuaaa

SEQ ID NO: 232305 - RNA, 19 nt, Human
gaauggguucuguagggag

SEQ ID NO: 232306 - RNA, 22 nt, Human
cuuggggauuuuaaagaccucu

SEQ ID NO: 232307 - RNA, 22 nt, Human
cuuggcuccuucacagggagau

SEQ ID NO: 232308 - RNA, 22 nt, Human
cuuggcauguucaucugcuugg

SEQ ID NO: 232309 - RNA, 22 nt, Human
gaauuagguaauagaacuagua

SEQ ID NO: 232310 - RNA, 22 nt, Human
gacaccuucuacugacuaugga

SEQ ID NO: 232311 - RNA, 22 nt, Human
cuuucauuuuugggcaucugag

SEQ ID NO: 232312 - RNA, 22 nt, Human
cuugguuugaaacauacucuac

SEQ ID NO: 232313 - RNA, 22 nt, Human
cuuguaccuuuguguuuauuuu

SEQ ID NO: 232314 - RNA, 18 nt, Human
cuuuagcugucaucuuug

SEQ ID NO: 232315 - RNA, 22 nt, Human
gaagcaagagggaucaggaucu

SEQ ID NO: 232316 - RNA, 22 nt, Human
gaagaugacaucggaucugucu

SEQ ID NO: 232317 - RNA, 23 nt, Human
cuucggcgcucgcugggcggagg

SEQ ID NO: 232318 - RNA, 21 nt, Human
cuucgcuguuccagcucuugg

SEQ ID NO: 232319 - RNA, 22 nt, Human
gaagguuuacugaagauuuaaa

SEQ ID NO: 232320 - RNA, 22 nt, Human
gaaggcuguggcuggucucagu

SEQ ID NO: 232321 - RNA, 22 nt, Human
gaaggggacuccauggaaugau

SEQ ID NO: 232322 - RNA, 21 nt, Human
gaaguagcucugagaaaagug

SEQ ID NO: 232323 - RNA, 22 nt, Human
gaaguauuucugaguugcccag

SEQ ID NO: 232324 - RNA, 22 nt, Human
gaagucagaucuuuugacuccc

SEQ ID NO: 232325 - RNA, 22 nt, Human
gaagucugacucuuuguaagcu

SEQ ID NO: 232326 - RNA, 22 nt, Human
gaaggggccuggggcaaggcua

SEQ ID NO: 232327 - RNA, 22 nt, Human
gaagguuuuguuugcaaaucau

SEQ ID NO: 232328 - RNA, 22 nt, Human
cuucuuuuggggaugaaaaugg

SEQ ID NO: 232329 - RNA, 22 nt, Human
cuugcagagcccauggauguca

SEQ ID NO: 232330 - RNA, 22 nt, Human
gaaguucuuagucucauuugca

SEQ ID NO: 232331 - RNA, 22 nt, Human
gaaguggggaggagaagacuga

SEQ ID NO: 232332 - RNA, 22 nt, Human
gaauaagaauccacuucuggca

SEQ ID NO: 232333 - RNA, 22 nt, Human
gaggucacacugauagucuuga

SEQ ID NO: 232334 - RNA, 22 nt, Human
gacacucauauuaagccuauuu

SEQ ID NO: 232335 - RNA, 22 nt, Human
gacaagaugacaucauggcuuc

SEQ ID NO: 232336 - RNA, 22 nt, Human
gagggguuguuaacaaagaaua

SEQ ID NO: 232337 - RNA, 22 nt, Human
gaggguggagccuccuggaagu

SEQ ID NO: 232338 - RNA, 22 nt, Human
gaggguaagcugggacuccucg

SEQ ID NO: 232339 - RNA, 22 nt, Human
gacacaacuauccaguauggga

SEQ ID NO: 232340 - RNA, 22 nt, Human
gacaauuucucaauauagaaac

SEQ ID NO: 232341 - RNA, 22 nt, Human
gagguucgauacagcguauuua

SEQ ID NO: 232342 - RNA, 22 nt, Human
gagguuuaguccauaguauuua

SEQ ID NO: 232343 - RNA, 22 nt, Human
gacaguggagccacguugggag

SEQ ID NO: 232344 - RNA, 19 nt, Human
gaguaaaacuagagagaaa

SEQ ID NO: 232345 - RNA, 22 nt, Human
gacaggaauuaucuaaaguaga

SEQ ID NO: 232346 - RNA, 22 nt, Human
gacagguagacaugaauauuaa

SEQ ID NO: 232347 - RNA, 22 nt, Human
gacagggacacagccagugagg

SEQ ID NO: 232348 - RNA, 22 nt, Human
gacagcguguuuugcaugaaca

SEQ ID NO: 232349 - RNA, 22 nt, Human
gacacugccaagugccccgaga

SEQ ID NO: 232350 - RNA, 22 nt, Human
gaccuuguucuggcauucucag

SEQ ID NO: 232351 - RNA, 22 nt, Human
gagucaucucuagaaugaugau

SEQ ID NO: 232352 - RNA, 22 nt, Human
gagugaucuguaggcagcaugg

SEQ ID NO: 232353 - RNA, 22 nt, Human
gacgacgggccccguggccacc

SEQ ID NO: 232354 - RNA, 20 nt, Human
gacgaacuagaacaguggua

SEQ ID NO: 232355 - RNA, 22 nt, Human
gacccggauguuguacucgagg

SEQ ID NO: 232356 - RNA, 22 nt, Human
gaccgggcucugcugacggucu

SEQ ID NO: 232357 - RNA, 22 nt, Human
gacagugucccucuggggugga

SEQ ID NO: 232358 - RNA, 22 nt, Human
gaguaauuuucuuaaaacauca

SEQ ID NO: 232359 - RNA, 22 nt, Human
gaguacagaagauaaaggcaca

SEQ ID NO: 232360 - RNA, 22 nt, Human
gaguggucacuaauuuccuuaa

SEQ ID NO: 232361 - RNA, 22 nt, Human
gacccgacaaguaaucagguga

SEQ ID NO: 232362 - RNA, 22 nt, Human
gaguuggggcugcguguuucca

SEQ ID NO: 232363 - RNA, 22 nt, Human
gaguugauggccauugaguuga

SEQ ID NO: 232364 - RNA, 22 nt, Human
gacuggucuuuugugauggaug

SEQ ID NO: 232365 - RNA, 22 nt, Human
gacuggaaucucugcuuguuaa

SEQ ID NO: 232366 - RNA, 22 nt, Human
gacuggcucuaucaggauaaau

SEQ ID NO: 232367 - RNA, 19 nt, Human
gacuccugagaugugaaac

SEQ ID NO: 232368 - RNA, 22 nt, Human
gacuaaggaauagcuaguuguu

SEQ ID NO: 232369 - RNA, 22 nt, Human
gagugggugaaugugcucauaa

SEQ ID NO: 232370 - RNA, 22 nt, Human
gagugguaaaguguacugaaua

SEQ ID NO: 232371 - RNA, 20 nt, Human
gagugucacacacaaccccu

SEQ ID NO: 232372 - RNA, 22 nt, Human
gaguuaaauagcuuaggauuca

SEQ ID NO: 232373 - RNA, 22 nt, Human
gacuggguaaagcuuauccaaa

SEQ ID NO: 232374 - RNA, 22 nt, Human
gauaaauaguguuuggggacau

SEQ ID NO: 232375 - RNA, 22 nt, Human
gauaaugcuuuggucagacaug

SEQ ID NO: 232376 - RNA, 22 nt, Human
gauacaugucacaaguugugca

SEQ ID NO: 232377 - RNA, 22 nt, Human
gauaauuauaggcuaagccacu

SEQ ID NO: 232378 - RNA, 22 nt, Human
gauaccugccaagcugcacuca

SEQ ID NO: 232379 - RNA, 22 nt, Human
gacuuaaccacggucacauggu

SEQ ID NO: 232380 - RNA, 22 nt, Human
gacuugauugguuugucaaguu

SEQ ID NO: 232381 - RNA, 22 nt, Human
gacugacagugguacuguaauu

SEQ ID NO: 232382 - RNA, 22 nt, Human
gacuucuuaaagaggugaggaa

SEQ ID NO: 232383 - RNA, 22 nt, Human
gauagaaagagaaucagaacuu

SEQ ID NO: 232384 - RNA, 16 nt, Human
gacuuucuacgacucu

SEQ ID NO: 232385 - RNA, 22 nt, Human
gauacuugaggagaucaccaca

SEQ ID NO: 232386 - RNA, 20 nt, Human
gauagcacaaagagaauggg

SEQ ID NO: 232387 - RNA, 22 nt, Human
gagaaauagauucaugguagau

SEQ ID NO: 232388 - RNA, 22 nt, Human
gagaaagauuguccuucagggg

SEQ ID NO: 232389 - RNA, 22 nt, Human
gagaaaaauuucuuugcugcac

SEQ ID NO: 232390 - RNA, 22 nt, Human
gagaagguggaccugaaggagc

SEQ ID NO: 232391 - RNA, 22 nt, Human
gagaaguaggaauaucaggagu

SEQ ID NO: 232392 - RNA, 22 nt, Human
gagaaugagucagagcuggcug

SEQ ID NO: 232393 - RNA, 22 nt, Human
gagaagugaauaacgaagcagg

SEQ ID NO: 232394 - RNA, 22 nt, Human
gagaagugggggucugggauga

SEQ ID NO: 232395 - RNA, 22 nt, Human
gaucauuuucauuaauguugca

SEQ ID NO: 232396 - RNA, 22 nt, Human
gagaacagauaugaugacuuca

SEQ ID NO: 232397 - RNA, 22 nt, Human
gaaaaugcacacauacacaccc

SEQ ID NO: 232398 - RNA, 22 nt, Human
gaaacauuuguugaguacuugc

SEQ ID NO: 232399 - RNA, 22 nt, Human
gaaaauaguucaucacaaugau

SEQ ID NO: 232400 - RNA, 22 nt, Human
gaagauucugacccugacucag

SEQ ID NO: 232401 - RNA, 22 nt, Human
gaaaaguuuaaccuuguacauu

SEQ ID NO: 232402 - RNA, 22 nt, Human
gagccuaccugcugcucuuuca

SEQ ID NO: 232403 - RNA, 22 nt, Human
gagccuggagcuggaacgaagc

SEQ ID NO: 232404 - RNA, 18 nt, Human
gaagcaacaguucugagu

SEQ ID NO: 232405 - RNA, 22 nt, Human
gaagcgucaugaaagaaaggcu

SEQ ID NO: 232406 - RNA, 22 nt, Human
gaagcggguucacuggauggcu

SEQ ID NO: 232407 - RNA, 22 nt, Human
gaagccaugauaaccagugugg

SEQ ID NO: 232408 - RNA, 22 nt, Human
gagcgcgcaaucucuccagcug

SEQ ID NO: 232409 - RNA, 22 nt, Human
gagcggcggugagaaguguggg

SEQ ID NO: 232410 - RNA, 22 nt, Human
gagccuguuaggcaccuguguu

SEQ ID NO: 232411 - RNA, 22 nt, Human
gagcguuucccugggggucugc

SEQ ID NO: 232412 - RNA, 21 nt, Human
gaagcugcuaugaagggggac

SEQ ID NO: 232413 - RNA, 22 nt, Human
gaagcucaguugcuuagaucuc

SEQ ID NO: 232414 - RNA, 22 nt, Human
gaaggaagcugucuggaugugu

SEQ ID NO: 232415 - RNA, 22 nt, Human
gaaggcaguaaauggcuguuuu

SEQ ID NO: 232416 - RNA, 22 nt, Human
gagcuggacauacaggaaacca

SEQ ID NO: 232417 - RNA, 22 nt, Human
gagcuuuguuccgugguggcac

SEQ ID NO: 232418 - RNA, 22 nt, Human
gaggacuucaggccuggccagg

SEQ ID NO: 232419 - RNA, 22 nt, Human
gaggaagucuuaucuggaugca

SEQ ID NO: 232420 - RNA, 22 nt, Human
gaaggcugaauuauuuguuccu

SEQ ID NO: 232421 - RNA, 22 nt, Human
gaagggccaggggcaggcugga

SEQ ID NO: 232422 - RNA, 22 nt, Human
gaggagcugggucagggagaca

SEQ ID NO: 232423 - RNA, 22 nt, Human
gaggagcggugcaugugggggc

SEQ ID NO: 232424 - RNA, 22 nt, Human
gaggagcaggcaggaucugguc

SEQ ID NO: 232425 - RNA, 22 nt, Human
gaaggugcugaaacagaaauuu

SEQ ID NO: 232426 - RNA, 22 nt, Human
gaaguaaaacaguaacuuuguu

SEQ ID NO: 232427 - RNA, 22 nt, Human
gaaguaaugugauugcucaggg

SEQ ID NO: 232428 - RNA, 22 nt, Human
gaggauaaugaaucugaaucau

SEQ ID NO: 232429 - RNA, 22 nt, Human
gaggaggcuggagaggccagga

SEQ ID NO: 232430 - RNA, 22 nt, Human
gaggcgcgcugcgagggcgcgg

SEQ ID NO: 232431 - RNA, 22 nt, Human
gaauggagaacccuggacacug

SEQ ID NO: 232432 - RNA, 22 nt, Human
gaaugccugggguucuucgauc

SEQ ID NO: 232433 - RNA, 22 nt, Human
gaaugcauuuuuuaaaagcaua

SEQ ID NO: 232434 - RNA, 22 nt, Human
gaggcuccgccggggcgggccg

SEQ ID NO: 232435 - RNA, 22 nt, Human
gaggcggugguggcgagaguca

SEQ ID NO: 232436 - RNA, 22 nt, Human
gaggcugguucccuugaucuuu

SEQ ID NO: 232437 - RNA, 22 nt, Human
gaggcagaggaugggacuguau

SEQ ID NO: 232438 - RNA, 22 nt, Human
gaggcagaggaaacagcucauu

SEQ ID NO: 232439 - RNA, 22 nt, Human
gaauaauuuugaucagaaggga

SEQ ID NO: 232440 - RNA, 22 nt, Human
gaauagauuagaaagaguaugu

SEQ ID NO: 232441 - RNA, 22 nt, Human
gaauaccauuuacauuugaaaa

SEQ ID NO: 232442 - RNA, 22 nt, Human
gaagugagcauccuaguuaacc

SEQ ID NO: 232443 - RNA, 22 nt, Human
gaauuagacggcaucacauggg

SEQ ID NO: 232444 - RNA, 22 nt, Human
gaggggcaagaaguuggccucu

SEQ ID NO: 232445 - RNA, 22 nt, Human
gacaacuucaguaaaguagauu

SEQ ID NO: 232446 - RNA, 19 nt, Human
gaauugcacgagcagaggc

SEQ ID NO: 232447 - RNA, 22 nt, Human
gaggggcuccagguguugagga

SEQ ID NO: 232448 - RNA, 22 nt, Human
gaggggcugggguugacuccaa

SEQ ID NO: 232449 - RNA, 22 nt, Human
gaauggcagaaugaagcagugu

SEQ ID NO: 232450 - RNA, 22 nt, Human
gaaugggaauuauggugggacu

SEQ ID NO: 232451 - RNA, 22 nt, Human
gagggauuuuagugcagcaacu

SEQ ID NO: 232452 - RNA, 22 nt, Human
gagggaggugacaaggacauag

SEQ ID NO: 232453 - RNA, 22 nt, Human
gagggagagaugcuggaccggg

SEQ ID NO: 232454 - RNA, 22 nt, Human
gagggaaaggggccaugauugg

SEQ ID NO: 232455 - RNA, 22 nt, Human
gaauguuaaugcacuucuagcu

SEQ ID NO: 232456 - RNA, 22 nt, Human
gaauuacuccaguguguggguu

SEQ ID NO: 232457 - RNA, 22 nt, Human
gaauuacagaguuguuaaguca

SEQ ID NO: 232458 - RNA, 22 nt, Human
gaggggaacaggcauucuuaag

SEQ ID NO: 232459 - RNA, 22 nt, Human
gagggcugccacguugggcgag

SEQ ID NO: 232460 - RNA, 22 nt, Human
uuuguggaaaagagcccaggag

SEQ ID NO: 232461 - RNA, 22 nt, Human
uuuguggugagcagggaacguc

SEQ ID NO: 232462 - RNA, 19 nt, Human
ggaacgcugggcuccccuc

SEQ ID NO: 232463 - RNA, 22 nt, Human
ggaagaagagggagcuguggga

SEQ ID NO: 232464 - RNA, 20 nt, Human
gccugggagaagaucaggga

SEQ ID NO: 232465 - RNA, 21 nt, Human
ggaauagcuuaaagugagggg

SEQ ID NO: 232466 - RNA, 22 nt, Human
gccugggauuggggauuuuuug

SEQ ID NO: 232467 - RNA, 22 nt, Human
ggaauauaaaucagaugcuccg

SEQ ID NO: 232468 - RNA, 22 nt, Human
ggaaugcagugagcauuagaua

SEQ ID NO: 232469 - RNA, 22 nt, Human
ggaauccugguguuuucugccu

SEQ ID NO: 232470 - RNA, 22 nt, Human
ggaaugcuuggcaugagaaccu

SEQ ID NO: 232471 - RNA, 22 nt, Human
ggaauguuuuccagaccuagau

SEQ ID NO: 232472 - RNA, 22 nt, Human
gccuggggaacuugauccuguc

SEQ ID NO: 232473 - RNA, 22 nt, Human
gccugggccgggcgcggccccc

SEQ ID NO: 232474 - RNA, 22 nt, Human
ggacuggugaagccuucggaga

SEQ ID NO: 232475 - RNA, 22 nt, Human
ggacuugaaguaguuauggccu

SEQ ID NO: 232476 - RNA, 22 nt, Human
gccuuucuugguuugucaggca

SEQ ID NO: 232477 - RNA, 22 nt, Human
gccuuuugcaaugguguuggug

SEQ ID NO: 232478 - RNA, 22 nt, Human
gccuuuuaaggcagagggagau

SEQ ID NO: 232479 - RNA, 22 nt, Human
ggacauggccguaguccccacg

SEQ ID NO: 232480 - RNA, 22 nt, Human
ggacauggaaagugugugauuu

SEQ ID NO: 232481 - RNA, 23 nt, Human
ggacaugucucuggguauuuuga

SEQ ID NO: 232482 - RNA, 22 nt, Human
ggacagagcaacccuacgcagc

SEQ ID NO: 232483 - RNA, 22 nt, Human
ggacagggagcaaaaacguccc

SEQ ID NO: 232484 - RNA, 18 nt, Human
ggacaguuguagaggacu

SEQ ID NO: 232485 - RNA, 22 nt, Human
ggagcugaacccuuaacuggcu

SEQ ID NO: 232486 - RNA, 22 nt, Human
ggaggaaauccuuaguaaggca

SEQ ID NO: 232487 - RNA, 22 nt, Human
ggaggaugaggguggugguguu

SEQ ID NO: 232488 - RNA, 22 nt, Human
ggagcuaaggauuuuuauaugu

SEQ ID NO: 232489 - RNA, 22 nt, Human
ggaggaggggcggggaggggag

SEQ ID NO: 232490 - RNA, 22 nt, Human
ggaggggaguuugccucugggg

SEQ ID NO: 232491 - RNA, 22 nt, Human
ggagguaagaggcccugggccg

SEQ ID NO: 232492 - RNA, 21 nt, Human
gcgcgcucgugcucgacgcgc

SEQ ID NO: 232493 - RNA, 22 nt, Human
gcgcgcucugcgaggacacgcu

SEQ ID NO: 232494 - RNA, 22 nt, Human
ggagagaacguaaucuaguauu

SEQ ID NO: 232495 - RNA, 22 nt, Human
ggagagagggaucuuuguggag

SEQ ID NO: 232496 - RNA, 22 nt, Human
ggagaccagaaggaagcuucga

SEQ ID NO: 232497 - RNA, 22 nt, Human
ggagacagugacuuagagacug

SEQ ID NO: 232498 - RNA, 22 nt, Human
ggagacagauggcgucucaguu

SEQ ID NO: 232499 - RNA, 22 nt, Human
ggagcucacuacgaaauaagcu

SEQ ID NO: 232500 - RNA, 22 nt, Human
ggagcucaggaguugauuauuu

SEQ ID NO: 232501 - RNA, 22 nt, Human
gcggagcuaaagauuggcuccu

SEQ ID NO: 232502 - RNA, 22 nt, Human
gcggagaggcagagacuccgcg

SEQ ID NO: 232503 - RNA, 20 nt, Human
gcgcuucccuacgcucugcu

SEQ ID NO: 232504 - RNA, 22 nt, Human
gcgcgggugagucacgggcgga

SEQ ID NO: 232505 - RNA, 22 nt, Human
ggaguuucugucaucccguccc

SEQ ID NO: 232506 - RNA, 22 nt, Human
ggagugauuugucuugucuggu

SEQ ID NO: 232507 - RNA, 22 nt, Human
ggagugaguauguucugaugca

SEQ ID NO: 232508 - RNA, 22 nt, Human
ggagugaagacagagugaacuu

SEQ ID NO: 232509 - RNA, 22 nt, Human
ggaguguaagugacucaccugg

SEQ ID NO: 232510 - RNA, 22 nt, Human
ggaguucaaaucuuuuggaucu

SEQ ID NO: 232511 - RNA, 22 nt, Human
ggauaauugaugauuuauaaga

SEQ ID NO: 232512 - RNA, 22 nt, Human
ggcaauuacguauuagucaugu

SEQ ID NO: 232513 - RNA, 22 nt, Human
ggcacaggcugguaccaguuca

SEQ ID NO: 232514 - RNA, 22 nt, Human
ggcacuggguugcagagagaga

SEQ ID NO: 232515 - RNA, 22 nt, Human
gcuacauuagcuucaauggcua

SEQ ID NO: 232516 - RNA, 22 nt, Human
ggcagcgcuuggcugcucgaca

SEQ ID NO: 232517 - RNA, 22 nt, Human
ggcagcagaaccaacuguggcu

SEQ ID NO: 232518 - RNA, 20 nt, Human
ggcagcaaccauaugcuaca

SEQ ID NO: 232519 - RNA, 22 nt, Human
ggcagcagaacuggcccuguau

SEQ ID NO: 232520 - RNA, 22 nt, Human
ggcagcccuggacccuggagaa

SEQ ID NO: 232521 - RNA, 22 nt, Human
gcguggaugauuuugagucggu

SEQ ID NO: 232522 - RNA, 22 nt, Human
gcguggccugcugaaggacuuc

SEQ ID NO: 232523 - RNA, 22 nt, Human
gcgugcauguguguaugcgugu

SEQ ID NO: 232524 - RNA, 22 nt, Human
gcgugcauggccguguguaugc

SEQ ID NO: 232525 - RNA, 22 nt, Human
gcgucucugggcugacccaggu

SEQ ID NO: 232526 - RNA, 22 nt, Human
gcgguuggacguucgccucggg

SEQ ID NO: 232527 - RNA, 22 nt, Human
gcgguuguucugugugcaugga

SEQ ID NO: 232528 - RNA, 22 nt, Human
gcuaguguuccacgaugugugu

SEQ ID NO: 232529 - RNA, 22 nt, Human
ggcaguagucagaggguuuuac

SEQ ID NO: 232530 - RNA, 22 nt, Human
gcucuccuugaugcccucuguu

SEQ ID NO: 232531 - RNA, 22 nt, Human
gcucaagaccaagggagcgggg

SEQ ID NO: 232532 - RNA, 22 nt, Human
gcucaacuucuaggacuucagg

SEQ ID NO: 232533 - RNA, 22 nt, Human
gcucagagaugucugcugccuu

SEQ ID NO: 232534 - RNA, 18 nt, Human
ggcagggcucagcugcuc

SEQ ID NO: 232535 - RNA, 22 nt, Human
gcucagagaaaacuggggcuug

SEQ ID NO: 232536 - RNA, 22 nt, Human
ggcagugguaggagcccaggag

SEQ ID NO: 232537 - RNA, 22 nt, Human
ggcauuccgggguccccuucuc

SEQ ID NO: 232538 - RNA, 22 nt, Human
gcugagcagaacaauuagaaau

SEQ ID NO: 232539 - RNA, 23 nt, Human
gcugagcaccagccauaucuuuu

SEQ ID NO: 232540 - RNA, 22 nt, Human
gcucucuggccugggaggagga

SEQ ID NO: 232541 - RNA, 22 nt, Human
gcucugaacugucaugaauugg

SEQ ID NO: 232542 - RNA, 22 nt, Human
gcugacuguagcugggggaaga

SEQ ID NO: 232543 - RNA, 22 nt, Human
gcugacuuauuagaaaaggaca

SEQ ID NO: 232544 - RNA, 22 nt, Human
gcugacucugcuuuuagccucc

SEQ ID NO: 232545 - RNA, 22 nt, Human
gcucuugcuuuuucuagaaaga

SEQ ID NO: 232546 - RNA, 22 nt, Human
gcauuccagaguugcuggaaaa

SEQ ID NO: 232547 - RNA, 22 nt, Human
gcauguucaaguuaguauauuu

SEQ ID NO: 232548 - RNA, 22 nt, Human
gccccgcgcgcguagcgccgcu

SEQ ID NO: 232549 - RNA, 22 nt, Human
gcccgaccgcgccggcccgcac

SEQ ID NO: 232550 - RNA, 22 nt, Human
gcccgccaacuugccagcggug

SEQ ID NO: 232551 - RNA, 22 nt, Human
gccccaggggaggugcccugca

SEQ ID NO: 232552 - RNA, 22 nt, Human
gcauuuaaauuugaacuucaga

SEQ ID NO: 232553 - RNA, 22 nt, Human
gcccuguuauagucugaggccu

SEQ ID NO: 232554 - RNA, 22 nt, Human
gcccuggcauuucuauucaugu

SEQ ID NO: 232555 - RNA, 22 nt, Human
gcccugaaggccuccaggacuc

SEQ ID NO: 232556 - RNA, 22 nt, Human
gcccugaagagguagagaauuu

SEQ ID NO: 232557 - RNA, 22 nt, Human
gcugucauggacaugucuguuu

SEQ ID NO: 232558 - RNA, 22 nt, Human
gcccucugccacaggacgccag

SEQ ID NO: 232559 - RNA, 22 nt, Human
gcugucaggaacaugccuuggu

SEQ ID NO: 232560 - RNA, 22 nt, Human
gcugguuucucucauugucagu

SEQ ID NO: 232561 - RNA, 22 nt, Human
gcuguuuaaguggaauuuguuu

SEQ ID NO: 232562 - RNA, 22 nt, Human
gcuguuguugcacggaaggugg

SEQ ID NO: 232563 - RNA, 22 nt, Human
gcuguuucuuuggcaaacugau

SEQ ID NO: 232564 - RNA, 22 nt, Human
gcuguugugaggaucagcauau

SEQ ID NO: 232565 - RNA, 22 nt, Human
gcuguuggaggaguucagugcu

SEQ ID NO: 232566 - RNA, 22 nt, Human
gcuguugcaaucaaggccaugg

SEQ ID NO: 232567 - RNA, 22 nt, Human
gcuguugagucagacaaguuuu

SEQ ID NO: 232568 - RNA, 22 nt, Human
gcuguguucauccugcccaggu

SEQ ID NO: 232569 - RNA, 22 nt, Human
gcuguguaugaugcaggcaccu

SEQ ID NO: 232570 - RNA, 22 nt, Human
gccgcaacggacccugggaguc

SEQ ID NO: 232571 - RNA, 22 nt, Human
gccgccgccgccuuuguugcgg

SEQ ID NO: 232572 - RNA, 21 nt, Human
gccgaugugacucuacguagu

SEQ ID NO: 232573 - RNA, 20 nt, Human
gcccuucccccuccgcgagc

SEQ ID NO: 232574 - RNA, 22 nt, Human
gcuucugugagugcagaugcug

SEQ ID NO: 232575 - RNA, 22 nt, Human
gcuuauugcuuauagauaggaa

SEQ ID NO: 232576 - RNA, 22 nt, Human
gcuuauuagguuauuucaagga

SEQ ID NO: 232577 - RNA, 21 nt, Human
gcuucaauucauccaccucuc

SEQ ID NO: 232578 - RNA, 22 nt, Human
gcuuaugauguuuacauaaaag

SEQ ID NO: 232579 - RNA, 22 nt, Human
ggaaaggggaaaauacagagag

SEQ ID NO: 232580 - RNA, 22 nt, Human
gccugaaaugaaccagaggacu

SEQ ID NO: 232581 - RNA, 22 nt, Human
ggaaauauaagcaguuugugug

SEQ ID NO: 232582 - RNA, 22 nt, Human
ggaacuaagcacauuaucugau

SEQ ID NO: 232583 - RNA, 22 nt, Human
gccugcacucaaacacucucuu

SEQ ID NO: 232584 - RNA, 22 nt, Human
gccugcagccagggaguucucu

SEQ ID NO: 232585 - RNA, 18 nt, Human
gccugccagccgagggac

SEQ ID NO: 232586 - RNA, 22 nt, Human
gccggcugggggcggagggcag

SEQ ID NO: 232587 - RNA, 22 nt, Human
gccgggagugcagcgggcgcgc

SEQ ID NO: 232588 - RNA, 22 nt, Human
gccgcguggcagucuuggugac

SEQ ID NO: 232589 - RNA, 21 nt, Human
gccgugcgccuccaggcgcgc

SEQ ID NO: 232590 - RNA, 20 nt, Human
gccggggcauaggggccguc

SEQ ID NO: 232591 - RNA, 22 nt, Human
gccggguguuccugggaagaug

SEQ ID NO: 232592 - RNA, 20 nt, Human
gccuccuccaaguuucauca

SEQ ID NO: 232593 - RNA, 22 nt, Human
gccucuuugcucuuugguuguu

SEQ ID NO: 232594 - RNA, 22 nt, Human
gccuccuuccgaccucaguccu

SEQ ID NO: 232595 - RNA, 22 nt, Human
gcuuuuuaauuugcuucccugg

SEQ ID NO: 232596 - RNA, 22 nt, Human
ggaaaaucaaaccauuuacagu

SEQ ID NO: 232597 - RNA, 22 nt, Human
ggaaaagaauuguuaguuagug

SEQ ID NO: 232598 - RNA, 23 nt, Human
gcuuugaaaaugcuuucuuccag

SEQ ID NO: 232599 - RNA, 20 nt, Human
gcuugaauuugauggccaga

SEQ ID NO: 232600 - RNA, 22 nt, Human
gcuugcaucaggggcuggggcc

SEQ ID NO: 232601 - RNA, 20 nt, Human
gcuugcgugggaggaggggg

SEQ ID NO: 232602 - RNA, 22 nt, Human
gcuugcuuuguaaauaucugug

SEQ ID NO: 232603 - RNA, 22 nt, Human
gccgcgggucugggucuggcuc

SEQ ID NO: 232604 - RNA, 18 nt, Human
gccgccuugcucgugaac

SEQ ID NO: 232605 - RNA, 22 nt, Human
gcuuucccaaccuucuugguau

SEQ ID NO: 232606 - RNA, 22 nt, Human
gcuuuccuggcccugucccugc

SEQ ID NO: 232607 - RNA, 22 nt, Human
gcuuguauguguauauauacau

SEQ ID NO: 232608 - RNA, 18 nt, Human
gcuuggguggcuauguuu

SEQ ID NO: 232609 - RNA, 22 nt, Human
gcuagaaacuguuuaaucucuu

SEQ ID NO: 232610 - RNA, 23 nt, Human
gcaguggagcgagaacuuccugu

SEQ ID NO: 232611 - RNA, 22 nt, Human
gcuaguaagugauagagcugag

SEQ ID NO: 232612 - RNA, 22 nt, Human
gcuagcugugcuuggaaguuug

SEQ ID NO: 232613 - RNA, 22 nt, Human
gcuagauugucacuugaguguc

SEQ ID NO: 232614 - RNA, 22 nt, Human
gcauaauauugagaaauuauua

SEQ ID NO: 232615 - RNA, 22 nt, Human
gcauagauauguaaugcaucau

SEQ ID NO: 232616 - RNA, 22 nt, Human
gcucacuuguaaccccuuccuc

SEQ ID NO: 232617 - RNA, 22 nt, Human
gcauauuuuaaaguguaaccug

SEQ ID NO: 232618 - RNA, 22 nt, Human
gcucagcuggagagggacgggu

SEQ ID NO: 232619 - RNA, 22 nt, Human
gcauccugacuauggugguggu

SEQ ID NO: 232620 - RNA, 22 nt, Human
gcuccagcuccauaaacauaag

SEQ ID NO: 232621 - RNA, 23 nt, Human
gcucauguugcuucuguucuguc

SEQ ID NO: 232622 - RNA, 22 nt, Human
gcaugcgugcgugcgugcaugu

SEQ ID NO: 232623 - RNA, 22 nt, Human
gcaugaauggaacccccugagu

SEQ ID NO: 232624 - RNA, 23 nt, Human
gcugaagcccacucccugggucu

SEQ ID NO: 232625 - RNA, 20 nt, Human
gcucuucuccgggucugccu

SEQ ID NO: 232626 - RNA, 22 nt, Human
gcaugcaggaagggcuugggga

SEQ ID NO: 232627 - RNA, 22 nt, Human
gcagucuacuuaagaaucucag

SEQ ID NO: 232628 - RNA, 22 nt, Human
gcagucauggguagaacucaag

SEQ ID NO: 232629 - RNA, 22 nt, Human
gcagugacagacaacuguuuga

SEQ ID NO: 232630 - RNA, 22 nt, Human
gcaguaaggaggggaaggguuu

SEQ ID NO: 232631 - RNA, 22 nt, Human
gcaguagauccagcagccugca

SEQ ID NO: 232632 - RNA, 22 nt, Human
gcaguauuguguguggucaugg

SEQ ID NO: 232633 - RNA, 22 nt, Human
gcaggucacagcugauuggcca

SEQ ID NO: 232634 - RNA, 22 nt, Human
gcagguuguuuaaauuaggauu

SEQ ID NO: 232635 - RNA, 22 nt, Human
gcaggguaggugacagguaguc

SEQ ID NO: 232636 - RNA, 21 nt, Human
gcaggggugugugagcugggg

SEQ ID NO: 232637 - RNA, 22 nt, Human
gcgggcgcuguggccccggccu

SEQ ID NO: 232638 - RNA, 23 nt, Human
gcgggcggagccgggaggcgggg

SEQ ID NO: 232639 - RNA, 22 nt, Human
gcagggcucagccgcucccacc

SEQ ID NO: 232640 - RNA, 22 nt, Human
gcaggccuccccugcuggagcu

SEQ ID NO: 232641 - RNA, 22 nt, Human
gcgcggcgcggguccucggccu

SEQ ID NO: 232642 - RNA, 22 nt, Human
gcgcucuccugcagacagccuc

SEQ ID NO: 232643 - RNA, 22 nt, Human
gcgcugagcuuuucuuauugaa

SEQ ID NO: 232644 - RNA, 22 nt, Human
gcagcucagcacgcacagguaa

SEQ ID NO: 232645 - RNA, 22 nt, Human
gcagcuuuggagguggaacucu

SEQ ID NO: 232646 - RNA, 22 nt, Human
gcagacuaacuuuugucagccu

SEQ ID NO: 232647 - RNA, 21 nt, Human
gcagaacuaggacuugaacau

SEQ ID NO: 232648 - RNA, 22 nt, Human
gcacucugggucaucugcugcc

SEQ ID NO: 232649 - RNA, 23 nt, Human
gcacuccgagggcacgugucucu

SEQ ID NO: 232650 - RNA, 21 nt, Human
gcagaaagugauuugcuauuc

SEQ ID NO: 232651 - RNA, 22 nt, Human
gccugccucugacuggggcuga

SEQ ID NO: 232652 - RNA, 22 nt, Human
gcagauaguaggagcuaaucuu

SEQ ID NO: 232653 - RNA, 22 nt, Human
gcagauaaaauuuuugauggga

SEQ ID NO: 232654 - RNA, 22 nt, Human
gcagaggcaaagucuggaugac

SEQ ID NO: 232655 - RNA, 22 nt, Human
gcagaggcugccgugggcagga

SEQ ID NO: 232656 - RNA, 22 nt, Human
gcagaguauaaguguggagcug

SEQ ID NO: 232657 - RNA, 22 nt, Human
gcgccgacccucccugccggac

SEQ ID NO: 232658 - RNA, 22 nt, Human
gcagcauuaccaagacauggca

SEQ ID NO: 232659 - RNA, 22 nt, Human
gcagcaauaaaacugaaggugu

SEQ ID NO: 232660 - RNA, 22 nt, Human
gcagaugagagugugaucuggg

SEQ ID NO: 232661 - RNA, 22 nt, Human
gccugcaggaaggugugccugu

SEQ ID NO: 232662 - RNA, 22 nt, Human
gcacaaaagguacuucauguag

SEQ ID NO: 232663 - RNA, 22 nt, Human
gcaauaaguuuucucuucuguc

SEQ ID NO: 232664 - RNA, 19 nt, Human
gcaaguuaucugucuccau

SEQ ID NO: 232665 - RNA, 22 nt, Human
gcacauauuuagaucuugaugu

SEQ ID NO: 232666 - RNA, 22 nt, Human
gcaccacccaaaggcggggcuc

SEQ ID NO: 232667 - RNA, 22 nt, Human
gccucucuggcaaagcggugau

SEQ ID NO: 232668 - RNA, 22 nt, Human
gcaaggaagcagaguugcuauc

SEQ ID NO: 232669 - RNA, 22 nt, Human
gauuuuuaaaaguaguuuugaa

SEQ ID NO: 232670 - RNA, 22 nt, Human
gauuuugcuuuagugaaggaag

SEQ ID NO: 232671 - RNA, 22 nt, Human
gcccuguuuucuggguuccuug

SEQ ID NO: 232672 - RNA, 22 nt, Human
gauuccugcuauucacagggcu

SEQ ID NO: 232673 - RNA, 22 nt, Human
gauucagagcugcaacaaagaa

SEQ ID NO: 232674 - RNA, 22 nt, Human
gauuaagauuacauauuuaagu

SEQ ID NO: 232675 - RNA, 22 nt, Human
gauuaagugaauuggagaaaag

SEQ ID NO: 232676 - RNA, 22 nt, Human
gcagggcucuggagucaggcug

SEQ ID NO: 232677 - RNA, 22 nt, Human
gagaauaauaauaggcauggug

SEQ ID NO: 232678 - RNA, 22 nt, Human
gaucugguuccaggacauugca

SEQ ID NO: 232679 - RNA, 22 nt, Human
gaucuguccuggcaguuaacac

SEQ ID NO: 232680 - RNA, 22 nt, Human
gaugaaguaguccacuggaagg

SEQ ID NO: 232681 - RNA, 18 nt, Human
gaugaagaggaagaggag

SEQ ID NO: 232682 - RNA, 22 nt, Human
gaguaaggaaguguuggccaca

SEQ ID NO: 232683 - RNA, 22 nt, Human
gaguaaaagaugaggcaguaga

SEQ ID NO: 232684 - RNA, 19 nt, Human
gaguacuuuacaaguuuuc

SEQ ID NO: 232685 - RNA, 22 nt, Human
gaguaucagauuggaguccuca

SEQ ID NO: 232686 - RNA, 22 nt, Human
gcaguaaauugagagucauguu

SEQ ID NO: 232687 - RNA, 22 nt, Human
gcagguggaagcagcagacuca

SEQ ID NO: 232688 - RNA, 22 nt, Human
gcaguccuguagcgacuuuuuu

SEQ ID NO: 232689 - RNA, 23 nt, Human
gcagugacugggauggaaguaga

SEQ ID NO: 232690 - RNA, 22 nt, Human
gcagugcauggaagggggugug

SEQ ID NO: 232691 - RNA, 22 nt, Human
gcaguugugguuucguuuccuu

SEQ ID NO: 232692 - RNA, 22 nt, Human
gcauaaaggacuauaaggauca

SEQ ID NO: 232693 - RNA, 22 nt, Human
gcaucacacgcacauacacaca

SEQ ID NO: 232694 - RNA, 19 nt, Human
gagugaggagcaucguuua

SEQ ID NO: 232695 - RNA, 22 nt, Human
gcauagacaccuuagagcaaua

SEQ ID NO: 232696 - RNA, 22 nt, Human
gaguggcaaagagaacaaagau

SEQ ID NO: 232697 - RNA, 22 nt, Human
gaguggugagaauacaacggaa

SEQ ID NO: 232698 - RNA, 22 nt, Human
gagucuacaugcaggcaauugu

SEQ ID NO: 232699 - RNA, 22 nt, Human
gaguguuugcuguauaauugga

SEQ ID NO: 232700 - RNA, 21 nt, Human
gcauccucguacucuucaggu

SEQ ID NO: 232701 - RNA, 22 nt, Human
gcaguuaccuauuuuguagaaa

SEQ ID NO: 232702 - RNA, 22 nt, Human
gcagugucacuaguaauagucu

SEQ ID NO: 232703 - RNA, 22 nt, Human
gcagugccauguggaggaucuc

SEQ ID NO: 232704 - RNA, 22 nt, Human
gcagugcugcgacagucgggug

SEQ ID NO: 232705 - RNA, 22 nt, Human
gaguauuagaagaguaguuauu

SEQ ID NO: 232706 - RNA, 22 nt, Human
gaguauuuaccacuaaaugguu

SEQ ID NO: 232707 - RNA, 22 nt, Human
gaguauuacuaaaauucgccua

SEQ ID NO: 232708 - RNA, 22 nt, Human
gagucaaugugcagugcagccc

SEQ ID NO: 232709 - RNA, 22 nt, Human
gagucaauucaccuuggugcuu

SEQ ID NO: 232710 - RNA, 22 nt, Human
gcaguuugugauguggcaguca

SEQ ID NO: 232711 - RNA, 22 nt, Human
gagucaggucaggcuuguagau

SEQ ID NO: 232712 - RNA, 22 nt, Human
gaguucuagauguauuauuaau

SEQ ID NO: 232713 - RNA, 22 nt, Human
gaguucaaagaucuaggaagag

SEQ ID NO: 232714 - RNA, 22 nt, Human
gaguuauuuuuccuguuuuuua

SEQ ID NO: 232715 - RNA, 22 nt, Human
gcaucuguuagagugugcaugc

SEQ ID NO: 232716 - RNA, 22 nt, Human
gcaucuccugagucagauuuug

SEQ ID NO: 232717 - RNA, 23 nt, Human
gcaucgcaggucuaagauuagcu

SEQ ID NO: 232718 - RNA, 21 nt, Human
gccacugcugcucauucucug

SEQ ID NO: 232719 - RNA, 22 nt, Human
gccaaccagucgguccaggaag

SEQ ID NO: 232720 - RNA, 20 nt, Human
gccaaggaggagaaacaggc

SEQ ID NO: 232721 - RNA, 22 nt, Human
gccagucgucuuuauuacagcu

SEQ ID NO: 232722 - RNA, 22 nt, Human
gccaggagaaaaggcgaaugau

SEQ ID NO: 232723 - RNA, 22 nt, Human
gccaggcagcagcgaggauggu

SEQ ID NO: 232724 - RNA, 22 nt, Human
gccaggccuggguggagcgcuc

SEQ ID NO: 232725 - RNA, 18 nt, Human
gccagcccuccaaccucc

SEQ ID NO: 232726 - RNA, 22 nt, Human
gaugaagaaacucaaccaagaa

SEQ ID NO: 232727 - RNA, 22 nt, Human
gaucuuacucacuucagcuggc

SEQ ID NO: 232728 - RNA, 21 nt, Human
gaucgcaaugugggaaucaug

SEQ ID NO: 232729 - RNA, 22 nt, Human
gauccucagacccuccucuggu

SEQ ID NO: 232730 - RNA, 22 nt, Human
gauccagauauuugggcuggua

SEQ ID NO: 232731 - RNA, 22 nt, Human
gcccagcuuuuugaggcaggca

SEQ ID NO: 232732 - RNA, 22 nt, Human
gcccagcucucuggccugucuu

SEQ ID NO: 232733 - RNA, 23 nt, Human
gccaucugcugggugccccggcc

SEQ ID NO: 232734 - RNA, 22 nt, Human
gccauauucaugcaggugcuaa

SEQ ID NO: 232735 - RNA, 22 nt, Human
gccaguuuguuuacugaugguu

SEQ ID NO: 232736 - RNA, 22 nt, Human
gccaguggucagugggagggug

SEQ ID NO: 232737 - RNA, 22 nt, Human
gaugguaucugcuggcuuucag

SEQ ID NO: 232738 - RNA, 22 nt, Human
gauggguuugagauguuugggu

SEQ ID NO: 232739 - RNA, 22 nt, Human
gcccauggagaccucaggcugg

SEQ ID NO: 232740 - RNA, 22 nt, Human
gcccuguguguuugcacugauu

SEQ ID NO: 232741 - RNA, 22 nt, Human
gcccuggucguggagggcaaca

SEQ ID NO: 232742 - RNA, 22 nt, Human
gcccugucagcucucauggaca

SEQ ID NO: 232743 - RNA, 22 nt, Human
gauguuuugaaagaagaauaca

SEQ ID NO: 232744 - RNA, 22 nt, Human
gcccugccauugaucggcccag

SEQ ID NO: 232745 - RNA, 22 nt, Human
gcccuggagauggaaguucuga

SEQ ID NO: 232746 - RNA, 22 nt, Human
gauguuaauauguuucaccaaa

SEQ ID NO: 232747 - RNA, 22 nt, Human
gaugugugugcccugggccugc

SEQ ID NO: 232748 - RNA, 22 nt, Human
gaugucuauguccagggccauc

SEQ ID NO: 232749 - RNA, 22 nt, Human
gcccccagcuggcuugaggauu

SEQ ID NO: 232750 - RNA, 22 nt, Human
ggcauggugggggaggacuugg

SEQ ID NO: 232751 - RNA, 22 nt, Human
ggcaugcaaaugugggugaccu

SEQ ID NO: 232752 - RNA, 22 nt, Human
ggcaucuuuaaugaacaugaau

SEQ ID NO: 232753 - RNA, 22 nt, Human
ggcauuccucucuguucaugga

SEQ ID NO: 232754 - RNA, 22 nt, Human
gguggccggcaccccacccucg

SEQ ID NO: 232755 - RNA, 22 nt, Human
gguggccuaacaaugguggcaa

SEQ ID NO: 232756 - RNA, 22 nt, Human
ggcaguguggauccuggagaag

SEQ ID NO: 232757 - RNA, 22 nt, Human
ggugagagaaaagaaacacugu

SEQ ID NO: 232758 - RNA, 20 nt, Human
ggcaucugacaacuaguugc

SEQ ID NO: 232759 - RNA, 22 nt, Human
ggugcuuuucacaagcauggga

SEQ ID NO: 232760 - RNA, 22 nt, Human
gguggagacucagauuuguugc

SEQ ID NO: 232761 - RNA, 22 nt, Human
ggugcuucgauagguguccaua

SEQ ID NO: 232762 - RNA, 22 nt, Human
gguggcagaggaggcgggagag

SEQ ID NO: 232763 - RNA, 22 nt, Human
ggugaucucagucuagaugguu

SEQ ID NO: 232764 - RNA, 22 nt, Human
ggugauaaaaagcauuuaaauu

SEQ ID NO: 232765 - RNA, 22 nt, Human
ggugaggggauccuguuaccau

SEQ ID NO: 232766 - RNA, 18 nt, Human
ggugagggagcuggaagc

SEQ ID NO: 232767 - RNA, 23 nt, Human
gguuggcuguacccaggcucccu

SEQ ID NO: 232768 - RNA, 22 nt, Human
ggccacgggguuugcugaaacu

SEQ ID NO: 232769 - RNA, 19 nt, Human
ggccacacuauuaaaagau

SEQ ID NO: 232770 - RNA, 22 nt, Human
ggccaauuuccuagacauuagu

SEQ ID NO: 232771 - RNA, 22 nt, Human
ggccacauuccagagggcugaa

SEQ ID NO: 232772 - RNA, 22 nt, Human
ggccaccuaagguugugcauca

SEQ ID NO: 232773 - RNA, 22 nt, Human
ggccaaagagcacaaugaauag

SEQ ID NO: 232774 - RNA, 20 nt, Human
ggcauuuuuuaguugagcuu

SEQ ID NO: 232775 - RNA, 22 nt, Human
gguguuccgguucugcucuggg

SEQ ID NO: 232776 - RNA, 22 nt, Human
ggcauugauggggucuugggga

SEQ ID NO: 232777 - RNA, 22 nt, Human
ggugucaucugggcuggagaua

SEQ ID NO: 232778 - RNA, 22 nt, Human
ggugucuuugauguugggcuga

SEQ ID NO: 232779 - RNA, 22 nt, Human
ggugucguuucacaugacccag

SEQ ID NO: 232780 - RNA, 22 nt, Human
gguguguaggugaaggccaaga

SEQ ID NO: 232781 - RNA, 22 nt, Human
ggugugugugugugugugugug

SEQ ID NO: 232782 - RNA, 22 nt, Human
ggcaaggaagaaagcagaaguu

SEQ ID NO: 232783 - RNA, 22 nt, Human
ggcaauauuauaagggcauuua

SEQ ID NO: 232784 - RNA, 22 nt, Human
ggcacagcgacuaccaucgaaa

SEQ ID NO: 232785 - RNA, 22 nt, Human
ggcacccugcauuggcuugagu

SEQ ID NO: 232786 - RNA, 22 nt, Human
ggugacuucugaaccuggagug

SEQ ID NO: 232787 - RNA, 22 nt, Human
ggcagaaaacaauaaccauuuc

SEQ ID NO: 232788 - RNA, 20 nt, Human
ggcagagcuaugucuguugc

SEQ ID NO: 232789 - RNA, 21 nt, Human
ggcagagaagcuggaaguugg

SEQ ID NO: 232790 - RNA, 22 nt, Human
ggcagaggagcuggaaacaugg

SEQ ID NO: 232791 - RNA, 22 nt, Human
ggucauagagcuggaaauuggc

SEQ ID NO: 232792 - RNA, 20 nt, Human
ggucagccaagaaguuaccu

SEQ ID NO: 232793 - RNA, 22 nt, Human
gguaugaggaugaggguggcau

SEQ ID NO: 232794 - RNA, 22 nt, Human
ggaugcguuugaauguguuugu

SEQ ID NO: 232795 - RNA, 22 nt, Human
ggcaagcacugggugucuuagc

SEQ ID NO: 232796 - RNA, 22 nt, Human
gguaaucuccucauugacguua

SEQ ID NO: 232797 - RNA, 22 nt, Human
ggauggaugugaucugccuccu

SEQ ID NO: 232798 - RNA, 22 nt, Human
ggaugcagcagagaccuggagu

SEQ ID NO: 232799 - RNA, 23 nt, Human
ggauggacauacguaugcacagg

SEQ ID NO: 232800 - RNA, 22 nt, Human
ggagcuaagagaauggacaagg

SEQ ID NO: 232801 - RNA, 22 nt, Human
ggagcauggcuucuuggggcug

SEQ ID NO: 232802 - RNA, 22 nt, Human
ggagccuggaguuucugauggg

SEQ ID NO: 232803 - RNA, 22 nt, Human
ggagcaucuaccauuucuagau

SEQ ID NO: 232804 - RNA, 22 nt, Human
gggggcgcguggagggccgugg

SEQ ID NO: 232805 - RNA, 22 nt, Human
ggaggagggaguucaggaguau

SEQ ID NO: 232806 - RNA, 22 nt, Human
gggugcauggcagcccuucugg

SEQ ID NO: 232807 - RNA, 22 nt, Human
ggaggccgugcugugcugccag

SEQ ID NO: 232808 - RNA, 22 nt, Human
ggggcuuggguagagcagaaac

SEQ ID NO: 232809 - RNA, 22 nt, Human
ggggcuuggguaagaaugcaaa

SEQ ID NO: 232810 - RNA, 22 nt, Human
gggggaaaguggagguucguga

SEQ ID NO: 232811 - RNA, 22 nt, Human
gggggacaggaugaauaucugu

SEQ ID NO: 232812 - RNA, 22 nt, Human
ggagauggucacagguaaacau

SEQ ID NO: 232813 - RNA, 22 nt, Human
ggagcaagagugagcaagcaga

SEQ ID NO: 232814 - RNA, 18 nt, Human
gggcuuuacagaguggag

SEQ ID NO: 232815 - RNA, 22 nt, Human
ggaggguggaggagggaauuga

SEQ ID NO: 232816 - RNA, 19 nt, Human
ggaggguguccucaguguc

SEQ ID NO: 232817 - RNA, 22 nt, Human
ggagguggagcuggaaguucca

SEQ ID NO: 232818 - RNA, 22 nt, Human
ggagucugugucuugaagcagu

SEQ ID NO: 232819 - RNA, 22 nt, Human
ggagucguguuugggaucggag

SEQ ID NO: 232820 - RNA, 22 nt, Human
ggagugaaugguggccguguuu

SEQ ID NO: 232821 - RNA, 22 nt, Human
ggguggaaugugagugugugug

SEQ ID NO: 232822 - RNA, 22 nt, Human
ggguggugagagaacuuugcag

SEQ ID NO: 232823 - RNA, 22 nt, Human
gggugggguaggugacucucgc

SEQ ID NO: 232824 - RNA, 22 nt, Human
ggguuaaauggauggcauuugc

SEQ ID NO: 232825 - RNA, 22 nt, Human
ggguuggaggcauugaaacaga

SEQ ID NO: 232826 - RNA, 22 nt, Human
ggaucguauuucaguuuuuugg

SEQ ID NO: 232827 - RNA, 22 nt, Human
ggaugaguuguauauaggauuc

SEQ ID NO: 232828 - RNA, 23 nt, Human
ggauccugacauauaccaucacc

SEQ ID NO: 232829 - RNA, 22 nt, Human
ggaucaccagguuuguuguugg

SEQ ID NO: 232830 - RNA, 22 nt, Human
ggaucagcgagaagggcugaaa

SEQ ID NO: 232831 - RNA, 22 nt, Human
gguaagguugggugucagaggg

SEQ ID NO: 232832 - RNA, 22 nt, Human
gguaagcugcuguagggucaga

SEQ ID NO: 232833 - RNA, 22 nt, Human
ggguuuguuccuacuucuacuc

SEQ ID NO: 232834 - RNA, 22 nt, Human
ggguuuuggggaggaagugagc

SEQ ID NO: 232835 - RNA, 22 nt, Human
gggagaguagcuggaagguucu

SEQ ID NO: 232836 - RNA, 22 nt, Human
gcuuuugcaaagcuggagaauu

SEQ ID NO: 232837 - RNA, 22 nt, Human
gggaugaaugccuggcuccccc

SEQ ID NO: 232838 - RNA, 22 nt, Human
gggagauuuguguaggaaaacu

SEQ ID NO: 232839 - RNA, 22 nt, Human
gcuuucagggucacugucaaca

SEQ ID NO: 232840 - RNA, 22 nt, Human
gcuuucacugcaauagaugaau

SEQ ID NO: 232841 - RNA, 22 nt, Human
gcuuucauuauguuguguuuuu

SEQ ID NO: 232842 - RNA, 22 nt, Human
gggcagagggcgagcugggaga

SEQ ID NO: 232843 - RNA, 22 nt, Human
ggaaaggaagggaaggagaugc

SEQ ID NO: 232844 - RNA, 22 nt, Human
ggaaaaauggguggugauauga

SEQ ID NO: 232845 - RNA, 22 nt, Human
ggaaaggacuggagcccagcgc

SEQ ID NO: 232846 - RNA, 22 nt, Human
ggaagacuuagaguagcaucag

SEQ ID NO: 232847 - RNA, 22 nt, Human
gggccaggaugugguucauuuu

SEQ ID NO: 232848 - RNA, 20 nt, Human
gggccagguggaccaggggc

SEQ ID NO: 232849 - RNA, 22 nt, Human
ggaagaggaagaugaggcagca

SEQ ID NO: 232850 - RNA, 22 nt, Human
ggaauaauauuacagauacagu

SEQ ID NO: 232851 - RNA, 22 nt, Human
ggaauacggguuuauuuagucu

SEQ ID NO: 232852 - RNA, 22 nt, Human
ggaauaaaaggagguggcgaga

SEQ ID NO: 232853 - RNA, 22 nt, Human
ggaaucuucagccaugccaaga

SEQ ID NO: 232854 - RNA, 22 nt, Human
ggaagcugucugcccggcgcuc

SEQ ID NO: 232855 - RNA, 22 nt, Human
ggaaguuaguucuuggcaaagg

SEQ ID NO: 232856 - RNA, 22 nt, Human
gggccggagaagguagcugaag

SEQ ID NO: 232857 - RNA, 22 nt, Human
gggccggcuggggcggggcggg

SEQ ID NO: 232858 - RNA, 21 nt, Human
ggacccuuagauuuuaucuga

SEQ ID NO: 232859 - RNA, 22 nt, Human
ggacugggagaauggaggcaag

SEQ ID NO: 232860 - RNA, 22 nt, Human
ggaauuaagaggcuggacaggg

SEQ ID NO: 232861 - RNA, 22 nt, Human
gggcuguuugcauauguuuaua

SEQ ID NO: 232862 - RNA, 22 nt, Human
ggaauuauuuuaaauagacauu

SEQ ID NO: 232863 - RNA, 22 nt, Human
gggcuuguuaacuuggcuucca

SEQ ID NO: 232864 - RNA, 21 nt, Human
gggaagagaagagaaaggagg

SEQ ID NO: 232865 - RNA, 22 nt, Human
gggaagagggagcuggaaugau

SEQ ID NO: 232866 - RNA, 22 nt, Human
gggaagaagaaaagagguggga

SEQ ID NO: 232867 - RNA, 22 nt, Human
gggaagaaccucugcuaccaau

SEQ ID NO: 232868 - RNA, 22 nt, Human
gcuucucacccuuacuaucucu

SEQ ID NO: 232869 - RNA, 22 nt, Human
gcuucucauguuuauuuuuaca

SEQ ID NO: 232870 - RNA, 18 nt, Human
gggaagaugccacaguga

SEQ ID NO: 232871 - RNA, 22 nt, Human
gcuuccuuagcuuaccaaguau

SEQ ID NO: 232872 - RNA, 22 nt, Human
gggaacuuggcaggaaaauuau

SEQ ID NO: 232873 - RNA, 22 nt, Human
gcuuccuccaucuggggcuugc

SEQ ID NO: 232874 - RNA, 22 nt, Human
gcuuccucaccucaaauuuccg

SEQ ID NO: 232875 - RNA, 22 nt, Human
gcuucccacagcuggacugggg

SEQ ID NO: 232876 - RNA, 22 nt, Human
gcuucacucugagacuuggagc

SEQ ID NO: 232877 - RNA, 22 nt, Human
gcuuguuuagcauaggucacug

SEQ ID NO: 232878 - RNA, 22 nt, Human
gcuugggcugaaggccuggguc

SEQ ID NO: 232879 - RNA, 22 nt, Human
gggacaggacuccuggggccug

SEQ ID NO: 232880 - RNA, 22 nt, Human
gggaauuuuaggaugacuccua

SEQ ID NO: 232881 - RNA, 22 nt, Human
gggaauguuaaccuuucuauuu

SEQ ID NO: 232882 - RNA, 22 nt, Human
gggacucugaaucuagauuccu

SEQ ID NO: 232883 - RNA, 22 nt, Human
gggaaguugguaagaggcuguu

SEQ ID NO: 232884 - RNA, 22 nt, Human
gcuugaggaacucagacuugag

SEQ ID NO: 232885 - RNA, 20 nt, Human
gcuugcggacagguggcuca

SEQ ID NO: 232886 - RNA, 22 nt, Human
gcuucuguuaggauguggcuua

SEQ ID NO: 232887 - RNA, 22 nt, Human
gggaagugagcuggaaucaagg

SEQ ID NO: 232888 - RNA, 22 nt, Human
gcuugcugaacaggaaccuggc

SEQ ID NO: 232889 - RNA, 21 nt, Human
ggccagauucucccauagcug

SEQ ID NO: 232890 - RNA, 22 nt, Human
ggcuuugggaggaugaggcggu

SEQ ID NO: 232891 - RNA, 22 nt, Human
ggcuuuuucccuaggguaagag

SEQ ID NO: 232892 - RNA, 22 nt, Human
ggcuucuuaacauuuggacacc

SEQ ID NO: 232893 - RNA, 19 nt, Human
ggcuuugcccuucgcuccg

SEQ ID NO: 232894 - RNA, 22 nt, Human
gcuguggguuccuccccugucc

SEQ ID NO: 232895 - RNA, 22 nt, Human
ggcuuguaggugauggagaacu

SEQ ID NO: 232896 - RNA, 22 nt, Human
gcuuacagauaaugaggagacu

SEQ ID NO: 232897 - RNA, 22 nt, Human
gggaaaaaggaguuagagauaa

SEQ ID NO: 232898 - RNA, 23 nt, Human
gggaaaucaaaagauauuucuuc

SEQ ID NO: 232899 - RNA, 22 nt, Human
gcuuacuguuccuguuggugcu

SEQ ID NO: 232900 - RNA, 22 nt, Human
gcuuagaugcugucauucacca

SEQ ID NO: 232901 - RNA, 22 nt, Human
gggaaaugugucuuggcauucu

SEQ ID NO: 232902 - RNA, 22 nt, Human
gggaacccaaauaggaaaauug

SEQ ID NO: 232903 - RNA, 22 nt, Human
gucuucugacacuguuaggagg

SEQ ID NO: 232904 - RNA, 22 nt, Human
gucuucuauuuggcaugacaga

SEQ ID NO: 232905 - RNA, 22 nt, Human
gucuguuggcacagggggaggu

SEQ ID NO: 232906 - RNA, 18 nt, Human
ggcugggcugugccccuu

SEQ ID NO: 232907 - RNA, 22 nt, Human
gucuguacugccguuauucaga

SEQ ID NO: 232908 - RNA, 22 nt, Human
gucuuugagccucaguuuccuc

SEQ ID NO: 232909 - RNA, 22 nt, Human
gucuuuguaguuuuaauuugag

SEQ ID NO: 232910 - RNA, 22 nt, Human
ggcuguggcagcuggaaguggu

SEQ ID NO: 232911 - RNA, 22 nt, Human
ggcuuacgcgcuaacagugaau

SEQ ID NO: 232912 - RNA, 22 nt, Human
ggcuucucuuggccaugguccc

SEQ ID NO: 232913 - RNA, 22 nt, Human
gugaagcaagggucaccugugg

SEQ ID NO: 232914 - RNA, 22 nt, Human
ggcuuuuguuauaaucaggccu

SEQ ID NO: 232915 - RNA, 22 nt, Human
gugaaacuggaugugaaaacaa

SEQ ID NO: 232916 - RNA, 22 nt, Human
ggcuucaaaacacaugucaaga

SEQ ID NO: 232917 - RNA, 22 nt, Human
gugaaauuguacacucaguacc

SEQ ID NO: 232918 - RNA, 23 nt, Human
gugaacaaugcuccaggagauac

SEQ ID NO: 232919 - RNA, 19 nt, Human
gugauauuuauuauuuauu

SEQ ID NO: 232920 - RNA, 22 nt, Human
gggaagaacugauuucacacca

SEQ ID NO: 232921 - RNA, 22 nt, Human
gggaagugcaguuuucuuuugg

SEQ ID NO: 232922 - RNA, 22 nt, Human
gugagaggaggcagcuuuuaca

SEQ ID NO: 232923 - RNA, 23 nt, Human
gugagaccagagccuauucucag

SEQ ID NO: 232924 - RNA, 22 nt, Human
gugacugagugaagguugggua

SEQ ID NO: 232925 - RNA, 22 nt, Human
gggaaauagagcuggaaccuug

SEQ ID NO: 232926 - RNA, 22 nt, Human
gugaggugauugcugguguuug

SEQ ID NO: 232927 - RNA, 17 nt, Human
gugagcugagucaggac

SEQ ID NO: 232928 - RNA, 22 nt, Human
gugauauaacaauuuagggaau

SEQ ID NO: 232929 - RNA, 22 nt, Human
gugaaggcaugugugcugugcu

SEQ ID NO: 232930 - RNA, 22 nt, Human
gggaaaaaggaaccuuauuacu

SEQ ID NO: 232931 - RNA, 20 nt, Human
gugaaguuuucugaagacag

SEQ ID NO: 232932 - RNA, 22 nt, Human
gggaacuguaguuuacgcugcc

SEQ ID NO: 232933 - RNA, 22 nt, Human
gggaaaucugcuuccuagggcu

SEQ ID NO: 232934 - RNA, 22 nt, Human
gugacuaugguggagaucagua

SEQ ID NO: 232935 - RNA, 22 nt, Human
gugacugagcuggcaaaguaug

SEQ ID NO: 232936 - RNA, 22 nt, Human
gggaaaauguuucugagacaaa

SEQ ID NO: 232937 - RNA, 22 nt, Human
gggcaagaggguuugacaugag

SEQ ID NO: 232938 - RNA, 22 nt, Human
gggcaagagaggaagagauggc

SEQ ID NO: 232939 - RNA, 22 nt, Human
gggcaagaagcuggaagcauuc

SEQ ID NO: 232940 - RNA, 22 nt, Human
gugcucgagcugugcgcgcugc

SEQ ID NO: 232941 - RNA, 20 nt, Human
gugcggcucuaccacucggu

SEQ ID NO: 232942 - RNA, 22 nt, Human
gugccgggcugcggcaaggugu

SEQ ID NO: 232943 - RNA, 22 nt, Human
gugccgaugaggccuggcauuc

SEQ ID NO: 232944 - RNA, 22 nt, Human
gugcccaguugaggccaggacu

SEQ ID NO: 232945 - RNA, 22 nt, Human
gugccuggaaucuuuucuucac

SEQ ID NO: 232946 - RNA, 22 nt, Human
gugccuuuuucccaguucauug

SEQ ID NO: 232947 - RNA, 22 nt, Human
gggauacuuuguuucccugcca

SEQ ID NO: 232948 - RNA, 22 nt, Human
gggagguaaugggggugcaggg

SEQ ID NO: 232949 - RNA, 22 nt, Human
gggagggggauucuggcgagaa

SEQ ID NO: 232950 - RNA, 22 nt, Human
gggaguggagagugaagcuaau

SEQ ID NO: 232951 - RNA, 21 nt, Human
gggagugaguaaugauggggg

SEQ ID NO: 232952 - RNA, 22 nt, Human
gggagcucaccaugcucugcau

SEQ ID NO: 232953 - RNA, 22 nt, Human
gggagcugagcuggaagagaau

SEQ ID NO: 232954 - RNA, 22 nt, Human
gggagcccuggacgggcgguau

SEQ ID NO: 232955 - RNA, 21 nt, Human
gggagccucauuuucuucauc

SEQ ID NO: 232956 - RNA, 22 nt, Human
gggagccagcagggcauggagc

SEQ ID NO: 232957 - RNA, 22 nt, Human
gugcacagaaacauacaaugug

SEQ ID NO: 232958 - RNA, 22 nt, Human
gugcacuugaucuagacagauu

SEQ ID NO: 232959 - RNA, 22 nt, Human
gugcaaugaguguggcaaagcc

SEQ ID NO: 232960 - RNA, 19 nt, Human
gugcacugucacuuugcuc

SEQ ID NO: 232961 - RNA, 22 nt, Human
gggacugcgagauucucaaggg

SEQ ID NO: 232962 - RNA, 22 nt, Human
gggacgggcuagcugccguggc

SEQ ID NO: 232963 - RNA, 22 nt, Human
gugauaguucuuacuccaaagu

SEQ ID NO: 232964 - RNA, 22 nt, Human
gugauucaucuggggccuuauu

SEQ ID NO: 232965 - RNA, 22 nt, Human
gggagaaccagccagugcaagg

SEQ ID NO: 232966 - RNA, 22 nt, Human
gggacugguuguguguggugug

SEQ ID NO: 232967 - RNA, 19 nt, Human
gggagaaaaucuuuauccu

SEQ ID NO: 232968 - RNA, 20 nt, Human
gggaauggauggauugcucc

SEQ ID NO: 232969 - RNA, 19 nt, Human
gugaugaugccacuccaac

SEQ ID NO: 232970 - RNA, 22 nt, Human
gugaugaagguggagaaucaga

SEQ ID NO: 232971 - RNA, 22 nt, Human
guaugaguggauagauguaucu

SEQ ID NO: 232972 - RNA, 22 nt, Human
ggcgcuccccgccugcgucgcg

SEQ ID NO: 232973 - RNA, 22 nt, Human
guauggaguuuuguugcacuuc

SEQ ID NO: 232974 - RNA, 22 nt, Human
ggcgccuuguggaaugagagcu

SEQ ID NO: 232975 - RNA, 22 nt, Human
ggcgccugguauucuuccucuc

SEQ ID NO: 232976 - RNA, 22 nt, Human
ggcgccauuuuugccuucggag

SEQ ID NO: 232977 - RNA, 22 nt, Human
guauauccaauaggugaugaaa

SEQ ID NO: 232978 - RNA, 22 nt, Human
guaucaggugugagcauuuuaa

SEQ ID NO: 232979 - RNA, 22 nt, Human
guaucugaaaaagaauucugac

SEQ ID NO: 232980 - RNA, 22 nt, Human
guaucaggacuaaauuauggau

SEQ ID NO: 232981 - RNA, 22 nt, Human
guauauuuaugagcauuagccu

SEQ ID NO: 232982 - RNA, 22 nt, Human
ggcgcaguguucgcccucucgc

SEQ ID NO: 232983 - RNA, 22 nt, Human
ggcgaugaggucuuagaaucua

SEQ ID NO: 232984 - RNA, 22 nt, Human
gguuugccagugcuggaaugca

SEQ ID NO: 232985 - RNA, 22 nt, Human
gguuugauauguuugugauucu

SEQ ID NO: 232986 - RNA, 22 nt, Human
gguuuucacgauccucccuuuu

SEQ ID NO: 232987 - RNA, 22 nt, Human
gguuuguggagcuggaaacacu

SEQ ID NO: 232988 - RNA, 22 nt, Human
gguugggauuauccaaggcaga

SEQ ID NO: 232989 - RNA, 22 nt, Human
ggccagucaaggggauccugaa

SEQ ID NO: 232990 - RNA, 22 nt, Human
ggcgacuacugaaugcuugaaa

SEQ ID NO: 232991 - RNA, 22 nt, Human
ggcggaggucacgcacccgcca

SEQ ID NO: 232992 - RNA, 22 nt, Human
ggcggcaagggaauggagaaga

SEQ ID NO: 232993 - RNA, 20 nt, Human
gucaucucagggacugucug

SEQ ID NO: 232994 - RNA, 22 nt, Human
gucagugcuuuaguucaggaug

SEQ ID NO: 232995 - RNA, 20 nt, Human
gucagaggacccuagagcga

SEQ ID NO: 232996 - RNA, 22 nt, Human
gucagaagauagaggaaguuug

SEQ ID NO: 232997 - RNA, 22 nt, Human
gucaggugcaccuccaccaaca

SEQ ID NO: 232998 - RNA, 22 nt, Human
gucagacugaguuccuggguac

SEQ ID NO: 232999 - RNA, 22 nt, Human
gucagauucuuucauuugcuga

SEQ ID NO: 233000 - RNA, 22 nt, Human
gucacaaaugauuuagcaauca

SEQ ID NO: 233001 - RNA, 22 nt, Human
gucacgucgggacagacugggg

SEQ ID NO: 233002 - RNA, 22 nt, Human
gucaagaugcuacauaauggga

SEQ ID NO: 233003 - RNA, 22 nt, Human
guauugauuguuuuaaaagauu

SEQ ID NO: 233004 - RNA, 22 nt, Human
guauuaugaaugccgaggcggc

SEQ ID NO: 233005 - RNA, 22 nt, Human
guaugugugcauacauguacga

SEQ ID NO: 233006 - RNA, 22 nt, Human
gucccuggucuaccguggcuuc

SEQ ID NO: 233007 - RNA, 22 nt, Human
guccccugcuguggaucugugg

SEQ ID NO: 233008 - RNA, 22 nt, Human
ggcugaggccucuggggaggga

SEQ ID NO: 233009 - RNA, 22 nt, Human
guccuggagcagcuggaagaug

SEQ ID NO: 233010 - RNA, 22 nt, Human
ggcucuggcgagcuuuaguaca

SEQ ID NO: 233011 - RNA, 22 nt, Human
ggcugcaagacguuauuagcgu

SEQ ID NO: 233012 - RNA, 22 nt, Human
ggcugagguguggggaacuaua

SEQ ID NO: 233013 - RNA, 22 nt, Human
ggcgucuugcgggcgguagcgc

SEQ ID NO: 233014 - RNA, 22 nt, Human
ggcuaaggacgggcaaguccca

SEQ ID NO: 233015 - RNA, 23 nt, Human
ggcgugcugggcugacccuuggc

SEQ ID NO: 233016 - RNA, 22 nt, Human
ggcuaaucaagaaggcccagug

SEQ ID NO: 233017 - RNA, 22 nt, Human
ggcucagaggagcuggaacggu

SEQ ID NO: 233018 - RNA, 22 nt, Human
ggcucacuguaccugccgccgc

SEQ ID NO: 233019 - RNA, 22 nt, Human
gucaugaugauacagguggagg

SEQ ID NO: 233020 - RNA, 22 nt, Human
ggcuccaggguaccccuggaug

SEQ ID NO: 233021 - RNA, 19 nt, Human
guccaugguaaagaaggau

SEQ ID NO: 233022 - RNA, 22 nt, Human
guccaugugcuaacagugcuua

SEQ ID NO: 233023 - RNA, 22 nt, Human
gucguucugcuauucuaugagg

SEQ ID NO: 233024 - RNA, 22 nt, Human
gucuauucaucauucaucaaac

SEQ ID NO: 233025 - RNA, 22 nt, Human
ggcugcuugggcuguuucuuuu

SEQ ID NO: 233026 - RNA, 22 nt, Human
ggcugcuauuggucuggcuugg

SEQ ID NO: 233027 - RNA, 22 nt, Human
ggcugcagugcaacucuuucua

SEQ ID NO: 233028 - RNA, 22 nt, Human
gucggagcggcugcacaggggg

SEQ ID NO: 233029 - RNA, 22 nt, Human
gucgagcuggaggagcgaaugg

SEQ ID NO: 233030 - RNA, 22 nt, Human
guccuuuauuugaacaugacau

SEQ ID NO: 233031 - RNA, 22 nt, Human
gucugcuuuuaucacaugucau

SEQ ID NO: 233032 - RNA, 22 nt, Human
ggcugggagguggcgaggaggc

SEQ ID NO: 233033 - RNA, 22 nt, Human
ggcuggagcaggcugcacagug

SEQ ID NO: 233034 - RNA, 22 nt, Human
gucuccugcccacccugguccc

SEQ ID NO: 233035 - RNA, 22 nt, Human
gucugccagauucugcuggauc

SEQ ID NO: 233036 - RNA, 22 nt, Human
gucugcagcacugugcacgguc

SEQ ID NO: 233037 - RNA, 22 nt, Human
gucugaaauaucuuuugucuug

SEQ ID NO: 233038 - RNA, 22 nt, Human
ggugaaggaucccucuuggccu

SEQ ID NO: 233039 - RNA, 22 nt, Human
ggucuuccuugggggacuugaa

SEQ ID NO: 233040 - RNA, 23 nt, Human
ggugagccuuucuaguagucuug

SEQ ID NO: 233041 - RNA, 22 nt, Human
ggugaggagaaacucugccccu

SEQ ID NO: 233042 - RNA, 22 nt, Human
guuuccuuuugugguuuuucua

SEQ ID NO: 233043 - RNA, 22 nt, Human
guuucuguggacucugcuuagg

SEQ ID NO: 233044 - RNA, 22 nt, Human
guuucuguguugauugugcccu

SEQ ID NO: 233045 - RNA, 22 nt, Human
guuugaacagaaggguugauca

SEQ ID NO: 233046 - RNA, 22 nt, Human
guuugcagacuauguaaacuuc

SEQ ID NO: 233047 - RNA, 19 nt, Human
ggucugcggggugaccgug

SEQ ID NO: 233048 - RNA, 22 nt, Human
ggucuucauaugccacagaguc

SEQ ID NO: 233049 - RNA, 22 nt, Human
ggucugcaaugauuugaaaaac

SEQ ID NO: 233050 - RNA, 20 nt, Human
ggucuguuucuucuuuucau

SEQ ID NO: 233051 - RNA, 22 nt, Human
guuuaaaagcaaccaacaggcu

SEQ ID NO: 233052 - RNA, 22 nt, Human
guuguugucauuagcuguuuaa

SEQ ID NO: 233053 - RNA, 22 nt, Human
ggucuagcucggugcuggcgac

SEQ ID NO: 233054 - RNA, 22 nt, Human
guuuagauguagauucucuggu

SEQ ID NO: 233055 - RNA, 22 nt, Human
guuuaaguuaaaauuuaccugc

SEQ ID NO: 233056 - RNA, 20 nt, Human
guugggagaagugucagcug

SEQ ID NO: 233057 - RNA, 22 nt, Human
guuggguaauuaagcacagaaa

SEQ ID NO: 233058 - RNA, 22 nt, Human
guugggcugaagugugugcuua

SEQ ID NO: 233059 - RNA, 22 nt, Human
gugcuggcaaagagaacaucuu

SEQ ID NO: 233060 - RNA, 22 nt, Human
gugcugggaggcccaggaugga

SEQ ID NO: 233061 - RNA, 22 nt, Human
guuguuaagugcugguuguuag

SEQ ID NO: 233062 - RNA, 22 nt, Human
guuguuagccucacauuuagga

SEQ ID NO: 233063 - RNA, 19 nt, Human
guuguguuugguucuuuug

SEQ ID NO: 233064 - RNA, 22 nt, Human
guuguugcuauguuauuguuau

SEQ ID NO: 233065 - RNA, 22 nt, Human
ggucgucuguccugucgccgcu

SEQ ID NO: 233066 - RNA, 22 nt, Human
ggucggggcuggccggcguggu

SEQ ID NO: 233067 - RNA, 22 nt, Human
ggucgguuggagagaucaugaa

SEQ ID NO: 233068 - RNA, 19 nt, Human
gguccguuacaggcuuucc

SEQ ID NO: 233069 - RNA, 22 nt, Human
ggucaucacugagagcagaucc

SEQ ID NO: 233070 - RNA, 22 nt, Human
ggugcaaagauggcaguugcaa

SEQ ID NO: 233071 - RNA, 22 nt, Human
ggugcguggcccauccuccacc

SEQ ID NO: 233072 - RNA, 22 nt, Human
guuugguucucauuguuuuucu

SEQ ID NO: 233073 - RNA, 22 nt, Human
ggugcugcugcugaacccagcu

SEQ ID NO: 233074 - RNA, 22 nt, Human
gguguaaggaagauggaagaug

SEQ ID NO: 233075 - RNA, 22 nt, Human
gguguacgaagaggcgggaguc

SEQ ID NO: 233076 - RNA, 22 nt, Human
guuuguuugccagcuuaguaaa

SEQ ID NO: 233077 - RNA, 22 nt, Human
gguggggacuuggggucagcgg

SEQ ID NO: 233078 - RNA, 22 nt, Human
gguugaagcuacuuucuggaug

SEQ ID NO: 233079 - RNA, 22 nt, Human
guuuugaugugauuucucaugu

SEQ ID NO: 233080 - RNA, 22 nt, Human
gguguggguguuaguuugcuua

SEQ ID NO: 233081 - RNA, 22 nt, Human
gguguggcaguggaccugugaa

SEQ ID NO: 233082 - RNA, 22 nt, Human
ggugugaauagagccuggagca

SEQ ID NO: 233083 - RNA, 22 nt, Human
uaaacgaagcuucaugcuugaa

SEQ ID NO: 233084 - RNA, 22 nt, Human
uaaaggaguguauaauuguagu

SEQ ID NO: 233085 - RNA, 22 nt, Human
uaaaguauucaaguagcuuucu

SEQ ID NO: 233086 - RNA, 22 nt, Human
uaaaaucaugacagauugacau

SEQ ID NO: 233087 - RNA, 22 nt, Human
gguuugggaagaacuauucccu

SEQ ID NO: 233088 - RNA, 22 nt, Human
gguuucuuuccucucugugccu

SEQ ID NO: 233089 - RNA, 22 nt, Human
gguuuuccaguagaucagaaga

SEQ ID NO: 233090 - RNA, 22 nt, Human
uaaagugaaguucagaauggcu

SEQ ID NO: 233091 - RNA, 22 nt, Human
guacauauccuuuacguuuugu

SEQ ID NO: 233092 - RNA, 22 nt, Human
guacaaagucaaggugaaaaua

SEQ ID NO: 233093 - RNA, 22 nt, Human
guaaaucuuggcaucugcuuuc

SEQ ID NO: 233094 - RNA, 22 nt, Human
guaacuuuuuccucauuggcua

SEQ ID NO: 233095 - RNA, 22 nt, Human
guaacugguuuucuucccucuc

SEQ ID NO: 233096 - RNA, 22 nt, Human
guaaaucccucucuuuguagau

SEQ ID NO: 233097 - RNA, 22 nt, Human
gguuuucuuguucauuuuuuaa

SEQ ID NO: 233098 - RNA, 22 nt, Human
uaaaguguacaagucauaagua

SEQ ID NO: 233099 - RNA, 22 nt, Human
gucgguacuaguacugguguug

SEQ ID NO: 233100 - RNA, 22 nt, Human
gucgucgcucccaccuuccgcu

SEQ ID NO: 233101 - RNA, 22 nt, Human
gucguuugucaauuuugaugug

SEQ ID NO: 233102 - RNA, 22 nt, Human
gucgagaacauucauuaugcaa

SEQ ID NO: 233103 - RNA, 22 nt, Human
gucgcuuuccugaggggucuca

SEQ ID NO: 233104 - RNA, 22 nt, Human
gucugugguccaaaauugccuc

SEQ ID NO: 233105 - RNA, 22 nt, Human
gucuggugguggguguagggca

SEQ ID NO: 233106 - RNA, 22 nt, Human
gucuggagccacugcugcugcu

SEQ ID NO: 233107 - RNA, 22 nt, Human
gucugguggaguuguauauacu

SEQ ID NO: 233108 - RNA, 22 nt, Human
gucugcucauguuugguuugug

SEQ ID NO: 233109 - RNA, 22 nt, Human
uaccgaagcugcuuuugcaugu

SEQ ID NO: 233110 - RNA, 22 nt, Human
gugaaaaauggccaucaggaca

SEQ ID NO: 233111 - RNA, 18 nt, Human
gucuguuccuuuaauguc

SEQ ID NO: 233112 - RNA, 22 nt, Human
gucuuucuuuuacauauuugug

SEQ ID NO: 233113 - RNA, 22 nt, Human
uacagauaaaaaugcuguucuu

SEQ ID NO: 233114 - RNA, 22 nt, Human
uacauaauucauuagcuccucu

SEQ ID NO: 233115 - RNA, 21 nt, Human
uacaucaguuuucuuggcuca

SEQ ID NO: 233116 - RNA, 22 nt, Human
uacauguggagauaacugaagc

SEQ ID NO: 233117 - RNA, 22 nt, Human
uacuucuuuuguaaaguauuga

SEQ ID NO: 233118 - RNA, 22 nt, Human
uacuggguguucugagaaaaua

SEQ ID NO: 233119 - RNA, 22 nt, Human
gugaaaugaagugacuggauau

SEQ ID NO: 233120 - RNA, 22 nt, Human
gugaaaauaguaaccuggcuag

SEQ ID NO: 233121 - RNA, 22 nt, Human
uacguuuuauaucuuuuggaau

SEQ ID NO: 233122 - RNA, 20 nt, Human
uaccuccccagcagucauga

SEQ ID NO: 233123 - RNA, 22 nt, Human
uacuugcaaggcucuuggaaua

SEQ ID NO: 233124 - RNA, 22 nt, Human
uacuuuuuucacuucuagcccc

SEQ ID NO: 233125 - RNA, 22 nt, Human
gugaagguccugauuugugacc

SEQ ID NO: 233126 - RNA, 22 nt, Human
gugacucuacuuaagauuaagc

SEQ ID NO: 233127 - RNA, 22 nt, Human
gugaccagacagagucuagccc

SEQ ID NO: 233128 - RNA, 22 nt, Human
gugaaggggaagcagggagagg

SEQ ID NO: 233129 - RNA, 21 nt, Human
gugaccuguuaugcaaaggca

SEQ ID NO: 233130 - RNA, 22 nt, Human
uaauucuucaauccaguguuca

SEQ ID NO: 233131 - RNA, 22 nt, Human
uaauuccacacucccgcaagcg

SEQ ID NO: 233132 - RNA, 22 nt, Human
guccuuuuuuuauacccaggcc

SEQ ID NO: 233133 - RNA, 22 nt, Human
guccuguguaaguacuugcuca

SEQ ID NO: 233134 - RNA, 22 nt, Human
guccuguaagauacaaguuuaa

SEQ ID NO: 233135 - RNA, 22 nt, Human
guccugauggccauuuuucacu

SEQ ID NO: 233136 - RNA, 22 nt, Human
guccuggugccaccugcgggau

SEQ ID NO: 233137 - RNA, 22 nt, Human
guccacauaggaacccagcuuc

SEQ ID NO: 233138 - RNA, 22 nt, Human
guccagaguagucgaguauucu

SEQ ID NO: 233139 - RNA, 23 nt, Human
gucauuacuguuaccuuauucuu

SEQ ID NO: 233140 - RNA, 22 nt, Human
gucccucauaacuggcaggugu

SEQ ID NO: 233141 - RNA, 22 nt, Human
gucccagaggacagggucacau

SEQ ID NO: 233142 - RNA, 22 nt, Human
guccaggucauuuaaaaagucc

SEQ ID NO: 233143 - RNA, 22 nt, Human
guccaguaguguuugcaugugg

SEQ ID NO: 233144 - RNA, 22 nt, Human
uaauauaacugccaguuaaggu

SEQ ID NO: 233145 - RNA, 22 nt, Human
uaauauccaguuauuucccuca

SEQ ID NO: 233146 - RNA, 22 nt, Human
uaagugcuagaauuccagguuu

SEQ ID NO: 233147 - RNA, 22 nt, Human
gucaggaugagggaugaggagu

SEQ ID NO: 233148 - RNA, 22 nt, Human
gucacuccuucccagagggagc

SEQ ID NO: 233149 - RNA, 22 nt, Human
gucaucugagggacgagauuuc

SEQ ID NO: 233150 - RNA, 22 nt, Human
gucagugaaccuucaccaaacc

SEQ ID NO: 233151 - RNA, 22 nt, Human
gucaguccugugccuuuccgga

SEQ ID NO: 233152 - RNA, 22 nt, Human
uaagggaagucuucaggagaca

SEQ ID NO: 233153 - RNA, 22 nt, Human
uaaggcuguuaggaggauuaaa

SEQ ID NO: 233154 - RNA, 22 nt, Human
uaaggagagaauuuagagguuu

SEQ ID NO: 233155 - RNA, 22 nt, Human
uaagauuuuuacaaauagagug

SEQ ID NO: 233156 - RNA, 22 nt, Human
guauuggcaguauacauagcac

SEQ ID NO: 233157 - RNA, 22 nt, Human
uaagauauugagugguaauuug

SEQ ID NO: 233158 - RNA, 22 nt, Human
guaugucuuaggguucaguaac

SEQ ID NO: 233159 - RNA, 22 nt, Human
uaacacauagauauuuuaacuu

SEQ ID NO: 233160 - RNA, 21 nt, Human
uaagaacauuaucuucuuccu

SEQ ID NO: 233161 - RNA, 22 nt, Human
uaagaauguuuguugaguaaau

SEQ ID NO: 233162 - RNA, 22 nt, Human
guauucugugugaucaagugau

SEQ ID NO: 233163 - RNA, 22 nt, Human
guacuuccauccacauauaugu

SEQ ID NO: 233164 - RNA, 22 nt, Human
guagaaaauagauugucucuug

SEQ ID NO: 233165 - RNA, 22 nt, Human
guagaauggggcucucaaagca

SEQ ID NO: 233166 - RNA, 22 nt, Human
gugguaaagugugccugugguc

SEQ ID NO: 233167 - RNA, 22 nt, Human
gugguccugguugucugagaga

SEQ ID NO: 233168 - RNA, 22 nt, Human
gugguggggaguuggauggaag

SEQ ID NO: 233169 - RNA, 22 nt, Human
guggugggcgugguguaugccu

SEQ ID NO: 233170 - RNA, 22 nt, Human
uaucaguccaggguuuugugac

SEQ ID NO: 233171 - RNA, 22 nt, Human
gugguuuagccuucauuaaccu

SEQ ID NO: 233172 - RNA, 22 nt, Human
gugguggugaggcaaggggugu

SEQ ID NO: 233173 - RNA, 23 nt, Human
gugguguaaaugccaaaaugaaa

SEQ ID NO: 233174 - RNA, 22 nt, Human
uaucauuaggagugcugcucgg

SEQ ID NO: 233175 - RNA, 22 nt, Human
uaucauuuuacugugacauuuu

SEQ ID NO: 233176 - RNA, 21 nt, Human
uaucauuuuuuccccugagau

SEQ ID NO: 233177 - RNA, 22 nt, Human
uaugcaucaguaugguuggaaa

SEQ ID NO: 233178 - RNA, 22 nt, Human
guguaucagaggcuguguuaua

SEQ ID NO: 233179 - RNA, 22 nt, Human
uaugcgguccaucaggggcacu

SEQ ID NO: 233180 - RNA, 22 nt, Human
uaugccaccagucuggaacucu

SEQ ID NO: 233181 - RNA, 22 nt, Human
uaugccaaaaauaaguuuuaug

SEQ ID NO: 233182 - RNA, 22 nt, Human
guguucucagcacccacuucau

SEQ ID NO: 233183 - RNA, 22 nt, Human
uauggacagcuuucuuuguguu

SEQ ID NO: 233184 - RNA, 22 nt, Human
uaucuuugccuuggguuuuguu

SEQ ID NO: 233185 - RNA, 22 nt, Human
guguagauuuguucaccuauua

SEQ ID NO: 233186 - RNA, 22 nt, Human
uaugaaagguuuuuucuugaaa

SEQ ID NO: 233187 - RNA, 22 nt, Human
uauguggcaggugggagaucag

SEQ ID NO: 233188 - RNA, 22 nt, Human
guguuuugagaggaugguuuua

SEQ ID NO: 233189 - RNA, 22 nt, Human
guuaaaaugauuugugauuuau

SEQ ID NO: 233190 - RNA, 22 nt, Human
uaugugaguaccugucaugugc

SEQ ID NO: 233191 - RNA, 22 nt, Human
uaugugaaauggaauauagaaa

SEQ ID NO: 233192 - RNA, 22 nt, Human
uauguugucuuguucagccaua

SEQ ID NO: 233193 - RNA, 22 nt, Human
guuaaaugcagauucugacuca

SEQ ID NO: 233194 - RNA, 22 nt, Human
guuaauaugcaaaacggaugcg

SEQ ID NO: 233195 - RNA, 22 nt, Human
guuaucauccucagaggcaguu

SEQ ID NO: 233196 - RNA, 22 nt, Human
uauguuugcaguucuaggucuu

SEQ ID NO: 233197 - RNA, 22 nt, Human
guguuuguauccuccauauaac

SEQ ID NO: 233198 - RNA, 22 nt, Human
guguuugagagguacaagggaa

SEQ ID NO: 233199 - RNA, 22 nt, Human
guguugcaggaagauauagcug

SEQ ID NO: 233200 - RNA, 22 nt, Human
guguucuuuguagaggaucuug

SEQ ID NO: 233201 - RNA, 22 nt, Human
guguucuucacuguuagaaggu

SEQ ID NO: 233202 - RNA, 22 nt, Human
guguucuuuaugguuguagugu

SEQ ID NO: 233203 - RNA, 22 nt, Human
guucaaggagcagcuugcuaca

SEQ ID NO: 233204 - RNA, 22 nt, Human
uauuacugccacaucauuaggu

SEQ ID NO: 233205 - RNA, 22 nt, Human
uauuaugguuguagguuaacaa

SEQ ID NO: 233206 - RNA, 22 nt, Human
guucggcuuccuaugucaugag

SEQ ID NO: 233207 - RNA, 22 nt, Human
guuccugagcaguuccuggcca

SEQ ID NO: 233208 - RNA, 22 nt, Human
guucuacaacuucgcuugcaga

SEQ ID NO: 233209 - RNA, 17 nt, Human
guucucaaacugacuga

SEQ ID NO: 233210 - RNA, 22 nt, Human
uauuuuaaaagcauuaauucuu

SEQ ID NO: 233211 - RNA, 22 nt, Human
uauuuguuuuuaaugcugggug

SEQ ID NO: 233212 - RNA, 22 nt, Human
guucuucagcccucagguccua

SEQ ID NO: 233213 - RNA, 21 nt, Human
guucucacagcugaggugguu

SEQ ID NO: 233214 - RNA, 22 nt, Human
guucucuuaauccuaguuggua

SEQ ID NO: 233215 - RNA, 22 nt, Human
guucucuccugcuggugaugga

SEQ ID NO: 233216 - RNA, 22 nt, Human
guucuguucuucacagguuugu

SEQ ID NO: 233217 - RNA, 22 nt, Human
guucuggaggagagccuggugu

SEQ ID NO: 233218 - RNA, 22 nt, Human
guugcuggggcugaguccccag

SEQ ID NO: 233219 - RNA, 23 nt, Human
uauuuuccccuguaauauguauu

SEQ ID NO: 233220 - RNA, 22 nt, Human
guugcggaguguagcgaugcuu

SEQ ID NO: 233221 - RNA, 22 nt, Human
guuggcgaaggaccuggaggag

SEQ ID NO: 233222 - RNA, 22 nt, Human
guuggaaauaucagucacguga

SEQ ID NO: 233223 - RNA, 22 nt, Human
uauuuuauuuagguuuaguugu

SEQ ID NO: 233224 - RNA, 22 nt, Human
uauuuuuuuaacauuuauugua

SEQ ID NO: 233225 - RNA, 22 nt, Human
uauuuuuguuuaccaguuaaca

SEQ ID NO: 233226 - RNA, 22 nt, Human
ucaaaucuuuuuuccuucccug

SEQ ID NO: 233227 - RNA, 22 nt, Human
guugggauugaaggugccucua

SEQ ID NO: 233228 - RNA, 22 nt, Human
ucaacagaagugauagcuauua

SEQ ID NO: 233229 - RNA, 22 nt, Human
ucaaaucugauaggcgacaccu

SEQ ID NO: 233230 - RNA, 22 nt, Human
ucaaauaugggccagaggaaau

SEQ ID NO: 233231 - RNA, 21 nt, Human
ucaaccagguguugaaggcac

SEQ ID NO: 233232 - RNA, 22 nt, Human
ucaaccagcuuaucugcaggau

SEQ ID NO: 233233 - RNA, 22 nt, Human
guuggggccuggagucucuugg

SEQ ID NO: 233234 - RNA, 22 nt, Human
guugggguuucaguggcaguca

SEQ ID NO: 233235 - RNA, 22 nt, Human
guugggugccagaggcuucacg

SEQ ID NO: 233236 - RNA, 22 nt, Human
guuggugagaguuagggauuua

SEQ ID NO: 233237 - RNA, 22 nt, Human
guggcuggguggaacugagucu

SEQ ID NO: 233238 - RNA, 18 nt, Human
guggccauugaccagcuu

SEQ ID NO: 233239 - RNA, 22 nt, Human
guggccuuccuguuccuuugaa

SEQ ID NO: 233240 - RNA, 22 nt, Human
guggccugacagaucggaacag

SEQ ID NO: 233241 - RNA, 22 nt, Human
uagguuuugugucagaguagaa

SEQ ID NO: 233242 - RNA, 23 nt, Human
uaggucacacauugggugguugc

SEQ ID NO: 233243 - RNA, 22 nt, Human
uaguaauauuccuacauuaugu

SEQ ID NO: 233244 - RNA, 22 nt, Human
uaguacguuccaaaucacugga

SEQ ID NO: 233245 - RNA, 22 nt, Human
uagguaauacuuagaccugauu

SEQ ID NO: 233246 - RNA, 22 nt, Human
uaggguuucaugcugguuucca

SEQ ID NO: 233247 - RNA, 22 nt, Human
uaggggggugaaggaggucccu

SEQ ID NO: 233248 - RNA, 22 nt, Human
uaggccugcugaagagcaagcu

SEQ ID NO: 233249 - RNA, 22 nt, Human
uaggcaguagcuuuggauguca

SEQ ID NO: 233250 - RNA, 22 nt, Human
guggcagguguacagcucagcu

SEQ ID NO: 233251 - RNA, 22 nt, Human
guggcauggggagcagcuagaa

SEQ ID NO: 233252 - RNA, 22 nt, Human
guggcaaguuuucugacaagga

SEQ ID NO: 233253 - RNA, 22 nt, Human
guggcagagagcaagugucuga

SEQ ID NO: 233254 - RNA, 22 nt, Human
guggcagagccuugcggcuuug

SEQ ID NO: 233255 - RNA, 22 nt, Human
guggguauauauaugugugcug

SEQ ID NO: 233256 - RNA, 23 nt, Human
uaguguuauuaauuaguaaggau

SEQ ID NO: 233257 - RNA, 22 nt, Human
uagugcuagaagcaaagacaaa

SEQ ID NO: 233258 - RNA, 22 nt, Human
gugggccaguuccucacaggua

SEQ ID NO: 233259 - RNA, 22 nt, Human
gugggcacguccuacugucacu

SEQ ID NO: 233260 - RNA, 22 nt, Human
gugggaaacagccuugcuucua

SEQ ID NO: 233261 - RNA, 22 nt, Human
gugggagaaugggaggaguaau

SEQ ID NO: 233262 - RNA, 22 nt, Human
gugggagggaguccugggagca

SEQ ID NO: 233263 - RNA, 22 nt, Human
gugggcuuuuuugaaaccugaa

SEQ ID NO: 233264 - RNA, 22 nt, Human
gugggggcagaagcgagugcag

SEQ ID NO: 233265 - RNA, 22 nt, Human
uaguaugaaaauuagcgggagg

SEQ ID NO: 233266 - RNA, 22 nt, Human
gugcucuagaaauugucagugg

SEQ ID NO: 233267 - RNA, 22 nt, Human
gugcucaucuucuguaacuguu

SEQ ID NO: 233268 - RNA, 22 nt, Human
gugcugcaaggauggagaggca

SEQ ID NO: 233269 - RNA, 22 nt, Human
uagcuggaggggcaggaugcug

SEQ ID NO: 233270 - RNA, 22 nt, Human
uagcugacagcagaagaguauu

SEQ ID NO: 233271 - RNA, 22 nt, Human
uagaacugcucucauacuugcu

SEQ ID NO: 233272 - RNA, 22 nt, Human
gugagagugguuuauguccaug

SEQ ID NO: 233273 - RNA, 22 nt, Human
uagaagagcaugucaaacuaua

SEQ ID NO: 233274 - RNA, 22 nt, Human
uagcauuucacugaucuucacu

SEQ ID NO: 233275 - RNA, 22 nt, Human
uagccaaguguuuuucaugacc

SEQ ID NO: 233276 - RNA, 22 nt, Human
uagccaucaugaguaagggcuu

SEQ ID NO: 233277 - RNA, 22 nt, Human
uagcccgugaggaggggcugug

SEQ ID NO: 233278 - RNA, 22 nt, Human
uagccguugggguaacuggaca

SEQ ID NO: 233279 - RNA, 22 nt, Human
uagccuguuuuuaugagaauuu

SEQ ID NO: 233280 - RNA, 22 nt, Human
uaggauaacaauuuguaguuuc

SEQ ID NO: 233281 - RNA, 22 nt, Human
guggauuucaggcuccccucag

SEQ ID NO: 233282 - RNA, 22 nt, Human
uaggaagagauuuucacauggc

SEQ ID NO: 233283 - RNA, 22 nt, Human
uaggagcagauggcagcaggug

SEQ ID NO: 233284 - RNA, 22 nt, Human
guggauaaguuguuugaccuac

SEQ ID NO: 233285 - RNA, 22 nt, Human
guggagaugagauauaccccuu

SEQ ID NO: 233286 - RNA, 22 nt, Human
guggaguggguuguacucaggg

SEQ ID NO: 233287 - RNA, 22 nt, Human
guggaggaagaucuuugaugau

SEQ ID NO: 233288 - RNA, 22 nt, Human
guggagaagggaccgggaagga

SEQ ID NO: 233289 - RNA, 22 nt, Human
gugcugcaugagcaucacguag

SEQ ID NO: 233290 - RNA, 22 nt, Human
gugcuguuagcgguuuauaaca

SEQ ID NO: 233291 - RNA, 22 nt, Human
gugcuugaguaaaaauagucuu

SEQ ID NO: 233292 - RNA, 22 nt, Human
gugcugucguggaacugggcug

SEQ ID NO: 233293 - RNA, 22 nt, Human
guggaaauaugggcaacaaaga

SEQ ID NO: 233294 - RNA, 22 nt, Human
guggaagauauuucugguccag

SEQ ID NO: 233295 - RNA, 22 nt, Human
guggaaggaauuaacagacuag

SEQ ID NO: 233296 - RNA, 22 nt, Human
guggacuagaguaggaguugca

SEQ ID NO: 233297 - RNA, 22 nt, Human
guggaagggaaaccgcacuggc

SEQ ID NO: 233298 - RNA, 22 nt, Human
guggacagacauaauccuaauu

SEQ ID NO: 233299 - RNA, 22 nt, Human
uaccuggauaaauguacaaccg

SEQ ID NO: 233300 - RNA, 22 nt, Human
uaccugguuucuuaaacccaaa

SEQ ID NO: 233301 - RNA, 22 nt, Human
uacguaauagcuuuauuuuggg

SEQ ID NO: 233302 - RNA, 22 nt, Human
uccaugcgcgauggccuggcuu

SEQ ID NO: 233303 - RNA, 22 nt, Human
uccaugcaguagaggcgcuggg

SEQ ID NO: 233304 - RNA, 22 nt, Human
uccaugauauauaugugcacau

SEQ ID NO: 233305 - RNA, 22 nt, Human
uacuaccugcaggaacaauuag

SEQ ID NO: 233306 - RNA, 22 nt, Human
uccaucaccacagaggacagag

SEQ ID NO: 233307 - RNA, 21 nt, Human
uacagcucaucaauuacugcu

SEQ ID NO: 233308 - RNA, 22 nt, Human
uccagcuucugccugcugcugc

SEQ ID NO: 233309 - RNA, 21 nt, Human
uccaggagcacgggacuagga

SEQ ID NO: 233310 - RNA, 22 nt, Human
uccaggcagcugcuugaugaua

SEQ ID NO: 233311 - RNA, 22 nt, Human
uccacaaagucuaugagaguug

SEQ ID NO: 233312 - RNA, 22 nt, Human
uacagcgaaaauuuagcuugau

SEQ ID NO: 233313 - RNA, 22 nt, Human
uccccaugaacuuguggcugcu

SEQ ID NO: 233314 - RNA, 19 nt, Human
uccccuacuccuuucccuc

SEQ ID NO: 233315 - RNA, 22 nt, Human
uacuugaacaucacuaagagaa

SEQ ID NO: 233316 - RNA, 22 nt, Human
uacuugaaaugggcaucaagag

SEQ ID NO: 233317 - RNA, 22 nt, Human
uacugagcauaaaacccauacu

SEQ ID NO: 233318 - RNA, 22 nt, Human
uacugaauuacugcugguaaau

SEQ ID NO: 233319 - RNA, 22 nt, Human
uacugcaguuccugcugucucc

SEQ ID NO: 233320 - RNA, 23 nt, Human
uccccagcugcccgugucccggg

SEQ ID NO: 233321 - RNA, 22 nt, Human
uacugaguuucacugucugugc

SEQ ID NO: 233322 - RNA, 22 nt, Human
ucccugcagggccauugugcag

SEQ ID NO: 233323 - RNA, 22 nt, Human
ucccugccuccuggcagugcca

SEQ ID NO: 233324 - RNA, 22 nt, Human
ucccugcugggcgaucuucucu

SEQ ID NO: 233325 - RNA, 22 nt, Human
ucccucacacagcugggagaac

SEQ ID NO: 233326 - RNA, 22 nt, Human
ucccgcccugcguucucccaug

SEQ ID NO: 233327 - RNA, 22 nt, Human
uacuuuaauugcaaaaauaaau

SEQ ID NO: 233328 - RNA, 22 nt, Human
uacuuuggugaaauuggaaaua

SEQ ID NO: 233329 - RNA, 21 nt, Human
uccuaaaggaaauacucaauu

SEQ ID NO: 233330 - RNA, 22 nt, Human
uccgugguguuggcucuccggc

SEQ ID NO: 233331 - RNA, 22 nt, Human
uccgggcagcuccuggagcugu

SEQ ID NO: 233332 - RNA, 22 nt, Human
ucccuuguguaggacaccccag

SEQ ID NO: 233333 - RNA, 22 nt, Human
uccgcguugguuagagagggcu

SEQ ID NO: 233334 - RNA, 22 nt, Human
uagaggccguagguggcugguu

SEQ ID NO: 233335 - RNA, 22 nt, Human
uagaggauucuaaaggaagcug

SEQ ID NO: 233336 - RNA, 22 nt, Human
uagaguaagugugugcugagcu

SEQ ID NO: 233337 - RNA, 22 nt, Human
uagaggguccaggagggcaaga

SEQ ID NO: 233338 - RNA, 22 nt, Human
uagaguguaagcuccuugaggg

SEQ ID NO: 233339 - RNA, 22 nt, Human
uccucagcaagacgcuggcagc

SEQ ID NO: 233340 - RNA, 22 nt, Human
uccgacacacgugcucgcagcg

SEQ ID NO: 233341 - RNA, 22 nt, Human
ucccuuuuuccugaucugugaa

SEQ ID NO: 233342 - RNA, 22 nt, Human
ucccuuuuagccccgcccuccu

SEQ ID NO: 233343 - RNA, 22 nt, Human
uagaacuguaaauuaucucucc

SEQ ID NO: 233344 - RNA, 22 nt, Human
ucccuuuggagguguccagcac

SEQ ID NO: 233345 - RNA, 22 nt, Human
ucccuucccaccccugccuuuu

SEQ ID NO: 233346 - RNA, 22 nt, Human
uagaagaacaugucaaacuaua

SEQ ID NO: 233347 - RNA, 22 nt, Human
uagaacaaacagcauguuugau

SEQ ID NO: 233348 - RNA, 22 nt, Human
uccucccugcacucagugaagu

SEQ ID NO: 233349 - RNA, 22 nt, Human
uccuccuggagacuuucucucu

SEQ ID NO: 233350 - RNA, 22 nt, Human
uccucgccgucacgcagccucu

SEQ ID NO: 233351 - RNA, 22 nt, Human
uagaugguguccagaaagagaa

SEQ ID NO: 233352 - RNA, 22 nt, Human
uagaugaacagaaagccacugu

SEQ ID NO: 233353 - RNA, 22 nt, Human
uagcagaacaauagucaaugau

SEQ ID NO: 233354 - RNA, 22 nt, Human
uagcagcacuauuuguuguagu

SEQ ID NO: 233355 - RNA, 20 nt, Human
uccugaaauuacgugauuca

SEQ ID NO: 233356 - RNA, 22 nt, Human
uccugaaggccugaguuccacc

SEQ ID NO: 233357 - RNA, 21 nt, Human
uccugccuuaguccagagcag

SEQ ID NO: 233358 - RNA, 22 nt, Human
uccuuacuccuggagauucuga

SEQ ID NO: 233359 - RNA, 22 nt, Human
uagcguaugcugugugaugaau

SEQ ID NO: 233360 - RNA, 22 nt, Human
uagccaaguuuucuuugaaagu

SEQ ID NO: 233361 - RNA, 22 nt, Human
uccuggcgugggcuggcugcag

SEQ ID NO: 233362 - RNA, 22 nt, Human
uccugguaaagaguaucagauu

SEQ ID NO: 233363 - RNA, 22 nt, Human
uccuggccuuggggagagaagu

SEQ ID NO: 233364 - RNA, 22 nt, Human
uccuggcuguuagagaggcaag

SEQ ID NO: 233365 - RNA, 22 nt, Human
uccuggaagggaugguugagga

SEQ ID NO: 233366 - RNA, 22 nt, Human
uccugcucucuccauuccuucc

SEQ ID NO: 233367 - RNA, 22 nt, Human
uccugcuucaaucugcugcugg

SEQ ID NO: 233368 - RNA, 22 nt, Human
ucagguuuuuaaggagcuagga

SEQ ID NO: 233369 - RNA, 22 nt, Human
ucaguagcauuuaauguucagu

SEQ ID NO: 233370 - RNA, 22 nt, Human
uaaaugauaguauugaagguag

SEQ ID NO: 233371 - RNA, 22 nt, Human
ucaguauuagugcauuaucagg

SEQ ID NO: 233372 - RNA, 22 nt, Human
ucagucacugucucagacagga

SEQ ID NO: 233373 - RNA, 22 nt, Human
uaaauaugcaugugguauucau

SEQ ID NO: 233374 - RNA, 22 nt, Human
uaaaugaaaggguuuaauuuau

SEQ ID NO: 233375 - RNA, 22 nt, Human
ucaagagauauaugcugguuua

SEQ ID NO: 233376 - RNA, 22 nt, Human
guugguggaggcgagagaagaa

SEQ ID NO: 233377 - RNA, 22 nt, Human
uaaagcauguuucaguaagguu

SEQ ID NO: 233378 - RNA, 18 nt, Human
ucagggaaacuuugccug

SEQ ID NO: 233379 - RNA, 22 nt, Human
ucagggaggagaggcaggggga

SEQ ID NO: 233380 - RNA, 22 nt, Human
ucaggcuagcccagugcuuggg

SEQ ID NO: 233381 - RNA, 19 nt, Human
ucaggaggucgaccuggca

SEQ ID NO: 233382 - RNA, 22 nt, Human
ucaggagaguguucaguggagg

SEQ ID NO: 233383 - RNA, 22 nt, Human
ucaggaggucugcugcggggug

SEQ ID NO: 233384 - RNA, 22 nt, Human
guuggaggaaggacaggaacag

SEQ ID NO: 233385 - RNA, 22 nt, Human
ucaggcaggaucccagggaagg

SEQ ID NO: 233386 - RNA, 22 nt, Human
uaaauuagauucccagcgcuau

SEQ ID NO: 233387 - RNA, 22 nt, Human
uaaauguugcuugugcugcuca

SEQ ID NO: 233388 - RNA, 22 nt, Human
uaaaugcucuuuaaaagugcuu

SEQ ID NO: 233389 - RNA, 22 nt, Human
ucagucauguuuaccagacgua

SEQ ID NO: 233390 - RNA, 22 nt, Human
uaaauuccuagucacaaacuuc

SEQ ID NO: 233391 - RNA, 23 nt, Human
ucagugccaaggagaacuuggug

SEQ ID NO: 233392 - RNA, 23 nt, Human
ucagugaaggaacaacuaaauag

SEQ ID NO: 233393 - RNA, 22 nt, Human
ucagucugguggaugcucauug

SEQ ID NO: 233394 - RNA, 22 nt, Human
uaacauuagcuuugcucaugca

SEQ ID NO: 233395 - RNA, 22 nt, Human
uaacaguauacuacaucauauu

SEQ ID NO: 233396 - RNA, 22 nt, Human
uaaccaggaaaaagauaugcau

SEQ ID NO: 233397 - RNA, 22 nt, Human
uaacuguuuugaauauuguggu

SEQ ID NO: 233398 - RNA, 22 nt, Human
uaacgcaucuggaaacaggaca

SEQ ID NO: 233399 - RNA, 22 nt, Human
ucagugguuaaguucuguccac

SEQ ID NO: 233400 - RNA, 20 nt, Human
ucaguggcauaguugcuaag

SEQ ID NO: 233401 - RNA, 20 nt, Human
ucagugggaaagugagagug

SEQ ID NO: 233402 - RNA, 22 nt, Human
ucaguggaacacacagaguggg

SEQ ID NO: 233403 - RNA, 22 nt, Human
uaauuucauuuugcaaugaucu

SEQ ID NO: 233404 - RNA, 22 nt, Human
uaauugagauuucuggcugcuu

SEQ ID NO: 233405 - RNA, 22 nt, Human
uaauugaacguucauuuuuaau

SEQ ID NO: 233406 - RNA, 22 nt, Human
ucauugugugugcuucuugggc

SEQ ID NO: 233407 - RNA, 22 nt, Human
uacaaaauucaaauaauguuug

SEQ ID NO: 233408 - RNA, 22 nt, Human
uaauuuugucacagugacaugc

SEQ ID NO: 233409 - RNA, 22 nt, Human
uaauaguugaaggucaucacua

SEQ ID NO: 233410 - RNA, 22 nt, Human
uaauauauuuuuuaagggaugu

SEQ ID NO: 233411 - RNA, 22 nt, Human
uaauaucuuuacacauuuucaa

SEQ ID NO: 233412 - RNA, 22 nt, Human
ucauuauuuugauguauuuccu

SEQ ID NO: 233413 - RNA, 22 nt, Human
ucauuuuaucaggaauggaauc

SEQ ID NO: 233414 - RNA, 22 nt, Human
ucauuuguauucuacaaagcac

SEQ ID NO: 233415 - RNA, 17 nt, Human
ucauuucaguaaaucca

SEQ ID NO: 233416 - RNA, 17 nt, Human
ucauuuauccucuuugg

SEQ ID NO: 233417 - RNA, 22 nt, Human
ucauuuaauuuggaacucagag

SEQ ID NO: 233418 - RNA, 22 nt, Human
uccaagcgcuucuggagcuccu

SEQ ID NO: 233419 - RNA, 23 nt, Human
uacagccaugucgcugauuuaac

SEQ ID NO: 233420 - RNA, 22 nt, Human
uccaacuuaauugggaagauua

SEQ ID NO: 233421 - RNA, 22 nt, Human
uacagauggacacuguuucaag

SEQ ID NO: 233422 - RNA, 22 nt, Human
uacaaagugauuuuggaauuga

SEQ ID NO: 233423 - RNA, 22 nt, Human
ucaugcagauaagaauaaguaa

SEQ ID NO: 233424 - RNA, 22 nt, Human
ucaugcagaguagaaagggcaa

SEQ ID NO: 233425 - RNA, 22 nt, Human
ucaugggcaaacuuggggauca

SEQ ID NO: 233426 - RNA, 22 nt, Human
ucaugccugcgauugucccugg

SEQ ID NO: 233427 - RNA, 22 nt, Human
ucaugagagaaaacgugcuucu

SEQ ID NO: 233428 - RNA, 21 nt, Human
uaaggaagagcauuuuagguc

SEQ ID NO: 233429 - RNA, 22 nt, Human
uaagucaagagcuagaaaaagc

SEQ ID NO: 233430 - RNA, 22 nt, Human
ucauuagucuuuaauacauaau

SEQ ID NO: 233431 - RNA, 22 nt, Human
ucauuagaccucucugguucag

SEQ ID NO: 233432 - RNA, 22 nt, Human
ucauuagcuaucagaguggaac

SEQ ID NO: 233433 - RNA, 20 nt, Human
ucaguuucccuauuagguug

SEQ ID NO: 233434 - RNA, 22 nt, Human
uaagagauuuauugaggacuuc

SEQ ID NO: 233435 - RNA, 22 nt, Human
ucaguuuaucuagcugggggaa

SEQ ID NO: 233436 - RNA, 17 nt, Human
ucaguugugcgagcagc

SEQ ID NO: 233437 - RNA, 22 nt, Human
ucaguuguuggaaguagaugua

SEQ ID NO: 233438 - RNA, 22 nt, Human
ucaucgauggggagcucuacaa

SEQ ID NO: 233439 - RNA, 22 nt, Human
ucauaggaguagcagugagagg

SEQ ID NO: 233440 - RNA, 22 nt, Human
ucauauugguagagauguguaa

SEQ ID NO: 233441 - RNA, 22 nt, Human
uaagcuauuccugaagaagguu

SEQ ID NO: 233442 - RNA, 22 nt, Human
ucaucuauaaguagcaucuggg

SEQ ID NO: 233443 - RNA, 22 nt, Human
uaagcguuugggaguuaugaac

SEQ ID NO: 233444 - RNA, 22 nt, Human
uauguuaauuaccagcacugau

SEQ ID NO: 233445 - RNA, 22 nt, Human
ucuggggaugagugaugucgua

SEQ ID NO: 233446 - RNA, 21 nt, Human
ucuggggacaagguccaggaa

SEQ ID NO: 233447 - RNA, 22 nt, Human
ucuguaaaugcaaguuuuccuc

SEQ ID NO: 233448 - RNA, 22 nt, Human
ucugguuaggcuugugaggucc

SEQ ID NO: 233449 - RNA, 22 nt, Human
ucugguagauuauuuagaguac

SEQ ID NO: 233450 - RNA, 22 nt, Human
ucuggugcacucugauauuuga

SEQ ID NO: 233451 - RNA, 22 nt, Human
ucugguuuggguugcuauggcu

SEQ ID NO: 233452 - RNA, 22 nt, Human
ucuguagcuaauucucuuuaaa

SEQ ID NO: 233453 - RNA, 22 nt, Human
ucuguaguaugguacuuauuua

SEQ ID NO: 233454 - RNA, 22 nt, Human
uauuaauugugguuauuguauu

SEQ ID NO: 233455 - RNA, 19 nt, Human
uauuagccucaucccagcc

SEQ ID NO: 233456 - RNA, 22 nt, Human
ucugucaguguccucguguggu

SEQ ID NO: 233457 - RNA, 22 nt, Human
ucugugugugcauguguguaua

SEQ ID NO: 233458 - RNA, 19 nt, Human
ucuguggccuucccugaug

SEQ ID NO: 233459 - RNA, 22 nt, Human
ucugugcuccuuccuugucauc

SEQ ID NO: 233460 - RNA, 22 nt, Human
ucuguuuacaugucagcagcaa

SEQ ID NO: 233461 - RNA, 22 nt, Human
ucuguuuuccaggaaucucaua

SEQ ID NO: 233462 - RNA, 22 nt, Human
ucuguucacaauuacacacacu

SEQ ID NO: 233463 - RNA, 22 nt, Human
ucuguucaugucuuuuuaagug

SEQ ID NO: 233464 - RNA, 19 nt, Human
ucuguugcuuuguguccuc

SEQ ID NO: 233465 - RNA, 22 nt, Human
ucuguucucuuguucugacggu

SEQ ID NO: 233466 - RNA, 22 nt, Human
uauucagugcugguucuuuuuc

SEQ ID NO: 233467 - RNA, 22 nt, Human
ucugugugugugcauaugcaug

SEQ ID NO: 233468 - RNA, 22 nt, Human
uauuauggguuuuuguguaaau

SEQ ID NO: 233469 - RNA, 22 nt, Human
uauucauuuuuauuugugacug

SEQ ID NO: 233470 - RNA, 22 nt, Human
ucuguguguguggcuaaacaag

SEQ ID NO: 233471 - RNA, 21 nt, Human
uauucgcauuucugucuuuac

SEQ ID NO: 233472 - RNA, 22 nt, Human
ucuguuuugugcuuuguuuucu

SEQ ID NO: 233473 - RNA, 22 nt, Human
ucuuagacagagaagacuauug

SEQ ID NO: 233474 - RNA, 22 nt, Human
ucuuaaguuccaggugugcuca

SEQ ID NO: 233475 - RNA, 22 nt, Human
ucuuauucuuuuaaacaacgca

SEQ ID NO: 233476 - RNA, 22 nt, Human
ucuuauuucuuucuuuuccugu

SEQ ID NO: 233477 - RNA, 22 nt, Human
ucuucacugaagcuuugcaucu

SEQ ID NO: 233478 - RNA, 22 nt, Human
ucuucacagaugcauauacuuc

SEQ ID NO: 233479 - RNA, 22 nt, Human
ucuucagacuguuguucuuuug

SEQ ID NO: 233480 - RNA, 20 nt, Human
ucuucagcuccaagucuggc

SEQ ID NO: 233481 - RNA, 22 nt, Human
uaugguuagugcuguagauuau

SEQ ID NO: 233482 - RNA, 22 nt, Human
ucugcuguugaucaugacuagc

SEQ ID NO: 233483 - RNA, 20 nt, Human
ucugcuugucuucagguucc

SEQ ID NO: 233484 - RNA, 22 nt, Human
ucugcuuuucuuaaggggauca

SEQ ID NO: 233485 - RNA, 22 nt, Human
ucugcagggcccuuggcuccug

SEQ ID NO: 233486 - RNA, 22 nt, Human
uaugcuguauucuguauguuag

SEQ ID NO: 233487 - RNA, 22 nt, Human
uaugggaaggauuugucuuuca

SEQ ID NO: 233488 - RNA, 22 nt, Human
uaugggcaagagauaggugguc

SEQ ID NO: 233489 - RNA, 22 nt, Human
ucugcuggugucauuuuugcua

SEQ ID NO: 233490 - RNA, 22 nt, Human
ucuggcaguugccgcuucaguc

SEQ ID NO: 233491 - RNA, 22 nt, Human
ucuggcucaggagcuguguuca

SEQ ID NO: 233492 - RNA, 22 nt, Human
uauguauaacuugauaggauga

SEQ ID NO: 233493 - RNA, 22 nt, Human
uauguauguauguauguauaug

SEQ ID NO: 233494 - RNA, 22 nt, Human
ucuggcuucaguaggguucacu

SEQ ID NO: 233495 - RNA, 22 nt, Human
ucugggccaacccuuccauggg

SEQ ID NO: 233496 - RNA, 20 nt, Human
uaugugcaguuugguuuauc

SEQ ID NO: 233497 - RNA, 22 nt, Human
uaugugguuugucauuuaauau

SEQ ID NO: 233498 - RNA, 22 nt, Human
uaugugugaguauauaugcaca

SEQ ID NO: 233499 - RNA, 22 nt, Human
uaugaguauagugcaccauggu

SEQ ID NO: 233500 - RNA, 22 nt, Human
uaugacugcucagugaauggaa

SEQ ID NO: 233501 - RNA, 22 nt, Human
uaugaggagaacauuccugaac

SEQ ID NO: 233502 - RNA, 22 nt, Human
uaugaccuuaggaagcaagaag

SEQ ID NO: 233503 - RNA, 22 nt, Human
ucugagugacguccugacagga

SEQ ID NO: 233504 - RNA, 22 nt, Human
uaugaauauaccacaauuuagg

SEQ ID NO: 233505 - RNA, 22 nt, Human
ucugcaugccucaggaggccug

SEQ ID NO: 233506 - RNA, 22 nt, Human
ucugcccguucaaauccuuguu

SEQ ID NO: 233507 - RNA, 20 nt, Human
uaugcgaagccuuucuggac

SEQ ID NO: 233508 - RNA, 22 nt, Human
ucugcggccggaauucccuuca

SEQ ID NO: 233509 - RNA, 22 nt, Human
uaugcauaauuggauaaguaga

SEQ ID NO: 233510 - RNA, 22 nt, Human
uaugcagauaguuugccauuca

SEQ ID NO: 233511 - RNA, 22 nt, Human
uaugagugccaaguuaccuggg

SEQ ID NO: 233512 - RNA, 22 nt, Human
uaugaucuuaggauggaacuuc

SEQ ID NO: 233513 - RNA, 22 nt, Human
uaugauuuucaugguagaguua

SEQ ID NO: 233514 - RNA, 22 nt, Human
uauauauaauguguacagguga

SEQ ID NO: 233515 - RNA, 22 nt, Human
uauauacuugaaaauugcugag

SEQ ID NO: 233516 - RNA, 22 nt, Human
uauauacacgcacauauacaua

SEQ ID NO: 233517 - RNA, 22 nt, Human
uauaggugagugaagcucagga

SEQ ID NO: 233518 - RNA, 22 nt, Human
ucucuccuccacaccgggugcu

SEQ ID NO: 233519 - RNA, 22 nt, Human
ucucucggagcuaccggaaguu

SEQ ID NO: 233520 - RNA, 20 nt, Human
ucucucacccuugcugugca

SEQ ID NO: 233521 - RNA, 22 nt, Human
ucucucguuuuuugcagauaaa

SEQ ID NO: 233522 - RNA, 22 nt, Human
ucucucucucuuccagcauguu

SEQ ID NO: 233523 - RNA, 22 nt, Human
ucucucgguacagcuggcugga

SEQ ID NO: 233524 - RNA, 22 nt, Human
ucucugaggaagcgaucuuuag

SEQ ID NO: 233525 - RNA, 22 nt, Human
ucucucugcuguccagcguuau

SEQ ID NO: 233526 - RNA, 20 nt, Human
ucucugccaaccaccuccuc

SEQ ID NO: 233527 - RNA, 22 nt, Human
ucucugguggcuccaucaguag

SEQ ID NO: 233528 - RNA, 22 nt, Human
uauaugcagauuuucaucaucg

SEQ ID NO: 233529 - RNA, 22 nt, Human
ucucuguacauagugaagcccg

SEQ ID NO: 233530 - RNA, 22 nt, Human
uauauuaaagugcuuugcagug

SEQ ID NO: 233531 - RNA, 22 nt, Human
ucucuuuuuuuaaaacucuaug

SEQ ID NO: 233532 - RNA, 22 nt, Human
ucugaaauuuuaguuauagaaa

SEQ ID NO: 233533 - RNA, 22 nt, Human
ucugaccaggcucuuguagccu

SEQ ID NO: 233534 - RNA, 18 nt, Human
ucugaaggaaugauucca

SEQ ID NO: 233535 - RNA, 22 nt, Human
ucucuugcuauugcgaacaggu

SEQ ID NO: 233536 - RNA, 22 nt, Human
uaucuccauucuagccccuugu

SEQ ID NO: 233537 - RNA, 22 nt, Human
uauccauaccuucaaguuugcu

SEQ ID NO: 233538 - RNA, 22 nt, Human
uauccaucuucuuugagaaugg

SEQ ID NO: 233539 - RNA, 23 nt, Human
uaucccauacagagagugguaca

SEQ ID NO: 233540 - RNA, 22 nt, Human
uaugaaggauacaccucugauu

SEQ ID NO: 233541 - RNA, 21 nt, Human
ucugaggagaaacucuuggug

SEQ ID NO: 233542 - RNA, 22 nt, Human
ucugaguaauacucuugccuug

SEQ ID NO: 233543 - RNA, 22 nt, Human
ucugagucgcucccuggaucca

SEQ ID NO: 233544 - RNA, 22 nt, Human
uaucuucaauagcccagaugug

SEQ ID NO: 233545 - RNA, 22 nt, Human
ucugacugucccguagaggaac

SEQ ID NO: 233546 - RNA, 22 nt, Human
ucugacguugguucugcccuuu

SEQ ID NO: 233547 - RNA, 22 nt, Human
ucuagguuguaauuuguaguaa

SEQ ID NO: 233548 - RNA, 22 nt, Human
uaguucugaauagcauugaaga

SEQ ID NO: 233549 - RNA, 22 nt, Human
ucuaggcugugugugggcaggg

SEQ ID NO: 233550 - RNA, 23 nt, Human
ucucaccaggauaugacugucac

SEQ ID NO: 233551 - RNA, 22 nt, Human
ucucaccuagucuuggaggucu

SEQ ID NO: 233552 - RNA, 22 nt, Human
uaggaaugcagaugcauaauaa

SEQ ID NO: 233553 - RNA, 22 nt, Human
ucgagcgcucccugugcucucg

SEQ ID NO: 233554 - RNA, 22 nt, Human
uagcugucauuggaucagaagg

SEQ ID NO: 233555 - RNA, 19 nt, Human
uagcuguucuugaguguga

SEQ ID NO: 233556 - RNA, 22 nt, Human
uaggagccagaauugcauuagu

SEQ ID NO: 233557 - RNA, 22 nt, Human
uagugucuuccaggacauggua

SEQ ID NO: 233558 - RNA, 22 nt, Human
uaguguuauuucuuaugugcua

SEQ ID NO: 233559 - RNA, 22 nt, Human
uaguuagagggaagcgacucgg

SEQ ID NO: 233560 - RNA, 22 nt, Human
uauaggaugaugucauguugcu

SEQ ID NO: 233561 - RNA, 22 nt, Human
ucucgcuguuccugcuucaggu

SEQ ID NO: 233562 - RNA, 22 nt, Human
uauaagaaacaaggcaaauuuu

SEQ ID NO: 233563 - RNA, 22 nt, Human
uauagcaagagaaccauuacca

SEQ ID NO: 233564 - RNA, 22 nt, Human
uauagcccaaucuggaugcagu

SEQ ID NO: 233565 - RNA, 22 nt, Human
uauagccuuacaagauauuaua

SEQ ID NO: 233566 - RNA, 22 nt, Human
uauacucaauaaauauuuggag

SEQ ID NO: 233567 - RNA, 22 nt, Human
ucugauucauucugguaaaugg

SEQ ID NO: 233568 - RNA, 22 nt, Human
ucugaugaccacaugugggacu

SEQ ID NO: 233569 - RNA, 22 nt, Human
ucugaucagaagacaaaugagg

SEQ ID NO: 233570 - RNA, 22 nt, Human
ucugauaaggaaggauuaaaag

SEQ ID NO: 233571 - RNA, 23 nt, Human
uggaagaaaaugguuuggcugug

SEQ ID NO: 233572 - RNA, 22 nt, Human
ucugaucuuucauccuaaaugg

SEQ ID NO: 233573 - RNA, 22 nt, Human
ucugauucucuuguugaccuag

SEQ ID NO: 233574 - RNA, 21 nt, Human
ucuggccuauaaaguagucgc

SEQ ID NO: 233575 - RNA, 22 nt, Human
ucuggcacuugccaguuucuau

SEQ ID NO: 233576 - RNA, 22 nt, Human
uggaagcuggcugaucugacuu

SEQ ID NO: 233577 - RNA, 22 nt, Human
ucugcguggcgugguucugugc

SEQ ID NO: 233578 - RNA, 22 nt, Human
ucugcgggccuggcucccagcg

SEQ ID NO: 233579 - RNA, 22 nt, Human
ucugguuccugcauucauucaa

SEQ ID NO: 233580 - RNA, 22 nt, Human
ucugguuucccaguuccuccgu

SEQ ID NO: 233581 - RNA, 22 nt, Human
uggaagugucagcaggcugguu

SEQ ID NO: 233582 - RNA, 22 nt, Human
ucuggguuuccuucacaagcac

SEQ ID NO: 233583 - RNA, 22 nt, Human
ucugggucuaucccaugccuuu

SEQ ID NO: 233584 - RNA, 22 nt, Human
ucuggucugccgagauccauuu

SEQ ID NO: 233585 - RNA, 17 nt, Human
ucuggguuucugauuua

SEQ ID NO: 233586 - RNA, 22 nt, Human
ucuggguaacugaggcuaauau

SEQ ID NO: 233587 - RNA, 22 nt, Human
uggaaguggcaggggagacgua

SEQ ID NO: 233588 - RNA, 22 nt, Human
uggaagucuucucucccaugga

SEQ ID NO: 233589 - RNA, 22 nt, Human
ucuggcucuccagugcucuuag

SEQ ID NO: 233590 - RNA, 22 nt, Human
uggaguaauggguguuuuugaa

SEQ ID NO: 233591 - RNA, 22 nt, Human
ucuguuauaaaucacacugcau

SEQ ID NO: 233592 - RNA, 22 nt, Human
ucuguguuccuggcaccaaacu

SEQ ID NO: 233593 - RNA, 22 nt, Human
ucuguucagaagaggugaaagu

SEQ ID NO: 233594 - RNA, 22 nt, Human
ucuguuuuuaucuauucuguua

SEQ ID NO: 233595 - RNA, 20 nt, Human
uggaucaccauccuguugcu

SEQ ID NO: 233596 - RNA, 22 nt, Human
ucuguuguauggcugucuaauu

SEQ ID NO: 233597 - RNA, 22 nt, Human
ucuguuucaggggucuggaaug

SEQ ID NO: 233598 - RNA, 21 nt, Human
ucuguuguguguugaggacuu

SEQ ID NO: 233599 - RNA, 22 nt, Human
ucuguagcuuuagaggacagga

SEQ ID NO: 233600 - RNA, 22 nt, Human
ucuguaccuuauguucagagug

SEQ ID NO: 233601 - RNA, 22 nt, Human
ucuguaauccacacagguggau

SEQ ID NO: 233602 - RNA, 22 nt, Human
ucuguauuuuuuacacacaugc

SEQ ID NO: 233603 - RNA, 20 nt, Human
ucuguggcagguggcgcuug

SEQ ID NO: 233604 - RNA, 22 nt, Human
ucugugcuggacugauuucaua

SEQ ID NO: 233605 - RNA, 22 nt, Human
ucuguggcaaacacagugacca

SEQ ID NO: 233606 - RNA, 22 nt, Human
ucugucucugucaggcugcugc

SEQ ID NO: 233607 - RNA, 21 nt, Human
ucugucuaguuaccaccgccc

SEQ ID NO: 233608 - RNA, 22 nt, Human
uggcauuuuguagcuguguauc

SEQ ID NO: 233609 - RNA, 22 nt, Human
ucuugcuggagucaaggcuaca

SEQ ID NO: 233610 - RNA, 22 nt, Human
uggcaucuggugauauggacua

SEQ ID NO: 233611 - RNA, 22 nt, Human
uggcgacuggaauuaaucuuuu

SEQ ID NO: 233612 - RNA, 22 nt, Human
ucuuuaucugugagcagucucc

SEQ ID NO: 233613 - RNA, 22 nt, Human
ucuuuaagugugugccuccagg

SEQ ID NO: 233614 - RNA, 22 nt, Human
ucuuuaaggggccuuuguguca

SEQ ID NO: 233615 - RNA, 22 nt, Human
uggcgcgcucgcucucgcugag

SEQ ID NO: 233616 - RNA, 22 nt, Human
ucuuucugaugggaagggucaa

SEQ ID NO: 233617 - RNA, 22 nt, Human
ucuuucucuccagccuggaccu

SEQ ID NO: 233618 - RNA, 22 nt, Human
uggccuucagcucuggggugca

SEQ ID NO: 233619 - RNA, 22 nt, Human
uggcgugaagcuggaaggcgga

SEQ ID NO: 233620 - RNA, 22 nt, Human
uggcucagcgcggccuggucuu

SEQ ID NO: 233621 - RNA, 22 nt, Human
ucuuccacuugaaccuucuguc

SEQ ID NO: 233622 - RNA, 21 nt, Human
ucuuccaacacugacaccaug

SEQ ID NO: 233623 - RNA, 19 nt, Human
ucuuccaucuauccuccuc

SEQ ID NO: 233624 - RNA, 15 nt, Human
uggauuugccacaua

SEQ ID NO: 233625 - RNA, 22 nt, Human
ucuucauuucuggggaauuggc

SEQ ID NO: 233626 - RNA, 22 nt, Human
ucuucuauaucuacauaugcaa

SEQ ID NO: 233627 - RNA, 22 nt, Human
ucuucuguguguagugguugug

SEQ ID NO: 233628 - RNA, 22 nt, Human
ucuucccgggcaucucugcuca

SEQ ID NO: 233629 - RNA, 22 nt, Human
ucuucaguaaucgacauuccac

SEQ ID NO: 233630 - RNA, 20 nt, Human
uggaucgaccucacuuccau

SEQ ID NO: 233631 - RNA, 22 nt, Human
uggauuuuggaauguuucagua

SEQ ID NO: 233632 - RNA, 22 nt, Human
ucuucaggaaaaccaaaguugu

SEQ ID NO: 233633 - RNA, 22 nt, Human
ucucugguagcucugugcucug

SEQ ID NO: 233634 - RNA, 19 nt, Human
ucucugguggcuccaucag

SEQ ID NO: 233635 - RNA, 22 nt, Human
ucucuggcuuuuuuuccauuuu

SEQ ID NO: 233636 - RNA, 22 nt, Human
ucucuguaguugggcagcugcu

SEQ ID NO: 233637 - RNA, 22 nt, Human
ugcuuguuuuguggcuucagcu

SEQ ID NO: 233638 - RNA, 22 nt, Human
ugcuuguuuguuuucuuccauu

SEQ ID NO: 233639 - RNA, 22 nt, Human
ugcuugaacccaggaaguggag

SEQ ID NO: 233640 - RNA, 22 nt, Human
ugcuugacucagcaucggcaau

SEQ ID NO: 233641 - RNA, 22 nt, Human
ucucuggacggacauuuaaggu

SEQ ID NO: 233642 - RNA, 22 nt, Human
ugcuuggagaaucagucccagc

SEQ ID NO: 233643 - RNA, 22 nt, Human
ucucugcguucaucccaucaca

SEQ ID NO: 233644 - RNA, 22 nt, Human
ugcuucucacuucuugguuucc

SEQ ID NO: 233645 - RNA, 22 nt, Human
ugcuuagcggugggggcuccau

SEQ ID NO: 233646 - RNA, 22 nt, Human
ugcuucuuuaggauguaguuau

SEQ ID NO: 233647 - RNA, 20 nt, Human
ucucuaacaugaaugcuauc

SEQ ID NO: 233648 - RNA, 17 nt, Human
ucuccuggcucuaucag

SEQ ID NO: 233649 - RNA, 22 nt, Human
ucucuacugcuucugugaguga

SEQ ID NO: 233650 - RNA, 22 nt, Human
ugcuuaaagcauuucucuuuaa

SEQ ID NO: 233651 - RNA, 22 nt, Human
ugcuuaucuccuuaguuuuugc

SEQ ID NO: 233652 - RNA, 21 nt, Human
ugcuuuuguugucagcugcug

SEQ ID NO: 233653 - RNA, 22 nt, Human
ugcuuuuguaucagaguauuca

SEQ ID NO: 233654 - RNA, 22 nt, Human
uggaaaauuuagaaagauuuau

SEQ ID NO: 233655 - RNA, 17 nt, Human
ucugaccuuuacuccug

SEQ ID NO: 233656 - RNA, 22 nt, Human
uggaaaagaugucuuccugaau

SEQ ID NO: 233657 - RNA, 22 nt, Human
ucugaguuaaaauuccagaggu

SEQ ID NO: 233658 - RNA, 22 nt, Human
ucugaggacagugcugugccug

SEQ ID NO: 233659 - RNA, 22 nt, Human
ucugaggaauaagaugucuaaa

SEQ ID NO: 233660 - RNA, 22 nt, Human
ucugagcaggaaagagcagaga

SEQ ID NO: 233661 - RNA, 22 nt, Human
ucugacuucuuuuauuaucauu

SEQ ID NO: 233662 - RNA, 22 nt, Human
ucugaccccccuugccuccacu

SEQ ID NO: 233663 - RNA, 22 nt, Human
ugcuuuggcccaacauugaugc

SEQ ID NO: 233664 - RNA, 22 nt, Human
ucugaaaggagaguagggcaga

SEQ ID NO: 233665 - RNA, 22 nt, Human
ucugaauauguuuaucaucucu

SEQ ID NO: 233666 - RNA, 22 nt, Human
ucugaagagaacucuuaguguu

SEQ ID NO: 233667 - RNA, 23 nt, Human
ugcuuugauuauuauucccaccu

SEQ ID NO: 233668 - RNA, 22 nt, Human
ugcuuuauucgacaucugguag

SEQ ID NO: 233669 - RNA, 22 nt, Human
ucucugugaauggcgucaccug

SEQ ID NO: 233670 - RNA, 22 nt, Human
ucucuucggagagaccuuugga

SEQ ID NO: 233671 - RNA, 20 nt, Human
ucucauuuugauuucgcauu

SEQ ID NO: 233672 - RNA, 21 nt, Human
ucucauuuuaacacagaguug

SEQ ID NO: 233673 - RNA, 22 nt, Human
ucucauaauuguuucccagcua

SEQ ID NO: 233674 - RNA, 22 nt, Human
ugcugggagcugggccucgaca

SEQ ID NO: 233675 - RNA, 20 nt, Human
ugcugggccaucuugcaugc

SEQ ID NO: 233676 - RNA, 22 nt, Human
ugcuggugauuaaauccugaag

SEQ ID NO: 233677 - RNA, 22 nt, Human
ucuccaggaaagacacuggacu

SEQ ID NO: 233678 - RNA, 22 nt, Human
ugcuggagccauguuuucucua

SEQ ID NO: 233679 - RNA, 22 nt, Human
ugcuggagucucuugacccugg

SEQ ID NO: 233680 - RNA, 22 nt, Human
ucucauugugcuuuuuguacug

SEQ ID NO: 233681 - RNA, 22 nt, Human
ugcugugcuggcggcagaggcc

SEQ ID NO: 233682 - RNA, 22 nt, Human
ucuccucuauuucuguauguau

SEQ ID NO: 233683 - RNA, 22 nt, Human
ugcugguuucugaguaaccaca

SEQ ID NO: 233684 - RNA, 22 nt, Human
ucucccuuuggauuuguuuugg

SEQ ID NO: 233685 - RNA, 22 nt, Human
ucucccuggccagcccuuuccc

SEQ ID NO: 233686 - RNA, 23 nt, Human
ucucccagaaguucucggggacu

SEQ ID NO: 233687 - RNA, 22 nt, Human
ucuccagcugaggccuucuucc

SEQ ID NO: 233688 - RNA, 22 nt, Human
ucuccaggggcagggucuggag

SEQ ID NO: 233689 - RNA, 22 nt, Human
ucucccgcuuccugcuggcugc

SEQ ID NO: 233690 - RNA, 22 nt, Human
ucuccccagcucgcucucuccc

SEQ ID NO: 233691 - RNA, 22 nt, Human
ucgcuucugaguuggugacccc

SEQ ID NO: 233692 - RNA, 22 nt, Human
ucgcuguguccuuuucacuuau

SEQ ID NO: 233693 - RNA, 22 nt, Human
ucgcuugaacccaggaagugga

SEQ ID NO: 233694 - RNA, 22 nt, Human
ucgcuuuaauggucuucacagc

SEQ ID NO: 233695 - RNA, 22 nt, Human
ucuaugaagucuuccuuuccuc

SEQ ID NO: 233696 - RNA, 22 nt, Human
ucuauauucuauguucuucuuu

SEQ ID NO: 233697 - RNA, 22 nt, Human
ucgccuccucccagaucaacaa

SEQ ID NO: 233698 - RNA, 22 nt, Human
ugcggaaggcagcgcagggugg

SEQ ID NO: 233699 - RNA, 22 nt, Human
ucgcgcgugccacgcgccgcgg

SEQ ID NO: 233700 - RNA, 22 nt, Human
ucgcucgcuggcuccugcccgc

SEQ ID NO: 233701 - RNA, 20 nt, Human
ucgcugcaagggaaauggag

SEQ ID NO: 233702 - RNA, 22 nt, Human
ugcugcggauauacaggaucug

SEQ ID NO: 233703 - RNA, 22 nt, Human
ugcugcuguuaucauuuuacca

SEQ ID NO: 233704 - RNA, 22 nt, Human
ucucagaaaugacaggagguac

SEQ ID NO: 233705 - RNA, 22 nt, Human
ucucagaagaaacaucugcugg

SEQ ID NO: 233706 - RNA, 21 nt, Human
ucucaagguaacauuuaagau

SEQ ID NO: 233707 - RNA, 22 nt, Human
ucuauuauauuuacacgagagu

SEQ ID NO: 233708 - RNA, 22 nt, Human
ucuaugcuacguuccucugaaa

SEQ ID NO: 233709 - RNA, 22 nt, Human
ugcauuugcaauggguacacaa

SEQ ID NO: 233710 - RNA, 22 nt, Human
ugccaacaggcuugccugaugu

SEQ ID NO: 233711 - RNA, 22 nt, Human
uccucccgaaugaguagaaggg

SEQ ID NO: 233712 - RNA, 23 nt, Human
uccuccccaccuuuguccccucc

SEQ ID NO: 233713 - RNA, 22 nt, Human
uccuccauguugugcacuugaa

SEQ ID NO: 233714 - RNA, 23 nt, Human
ugccaggaagaaugaccucugcu

SEQ ID NO: 233715 - RNA, 21 nt, Human
ugccccucuuuucuuuccuuc

SEQ ID NO: 233716 - RNA, 22 nt, Human
ugcccccggcugcccaggggaa

SEQ ID NO: 233717 - RNA, 22 nt, Human
ugcccagcagggagcuaccugg

SEQ ID NO: 233718 - RNA, 22 nt, Human
ugcccagagccucuuaccucca

SEQ ID NO: 233719 - RNA, 22 nt, Human
ugccccagcacauuuacuaucc

SEQ ID NO: 233720 - RNA, 22 nt, Human
uccugcaugcuagugagugcuu

SEQ ID NO: 233721 - RNA, 22 nt, Human
ugcccacuuugucuccaugcug

SEQ ID NO: 233722 - RNA, 22 nt, Human
ugcccacaggaagacaccagcg

SEQ ID NO: 233723 - RNA, 22 nt, Human
ugcaucccaaacaugguuuccu

SEQ ID NO: 233724 - RNA, 22 nt, Human
ugcaucauuaagguacaguugg

SEQ ID NO: 233725 - RNA, 21 nt, Human
uccguucgguuaaaaaggccc

SEQ ID NO: 233726 - RNA, 17 nt, Human
uccuacaggugugcuga

SEQ ID NO: 233727 - RNA, 22 nt, Human
ugcauuguuuauggaauaaaau

SEQ ID NO: 233728 - RNA, 17 nt, Human
ugcaugcgucugugaua

SEQ ID NO: 233729 - RNA, 22 nt, Human
ugcauguuauuguggcaagaau

SEQ ID NO: 233730 - RNA, 22 nt, Human
ugccaaagauagagguuugagu

SEQ ID NO: 233731 - RNA, 22 nt, Human
ugcauuuuuaauuuggaaaaaa

SEQ ID NO: 233732 - RNA, 21 nt, Human
uccugccuggccuucugacua

SEQ ID NO: 233733 - RNA, 22 nt, Human
uccuggccucugagucaagaac

SEQ ID NO: 233734 - RNA, 22 nt, Human
ugccgggcugagcaagugcugc

SEQ ID NO: 233735 - RNA, 19 nt, Human
uccuugacuguauucagag

SEQ ID NO: 233736 - RNA, 22 nt, Human
ugccucucucugucauuaugcu

SEQ ID NO: 233737 - RNA, 20 nt, Human
ugccugagcgcagcuccagg

SEQ ID NO: 233738 - RNA, 22 nt, Human
ugccugaagccugccccugggu

SEQ ID NO: 233739 - RNA, 22 nt, Human
ugccucucuggaucugcuguga

SEQ ID NO: 233740 - RNA, 20 nt, Human
ugccuuccgccccgggcacc

SEQ ID NO: 233741 - RNA, 22 nt, Human
ugccuguguauuuccggccugc

SEQ ID NO: 233742 - RNA, 19 nt, Human
ugccuggcaccagcuccac

SEQ ID NO: 233743 - RNA, 22 nt, Human
uccuuguuggaauauccuuacc

SEQ ID NO: 233744 - RNA, 22 nt, Human
ugccuggacgacaucacaguga

SEQ ID NO: 233745 - RNA, 22 nt, Human
ugccuuccuucuccccuccuuc

SEQ ID NO: 233746 - RNA, 22 nt, Human
ugccuuuggcuguucugugacc

SEQ ID NO: 233747 - RNA, 22 nt, Human
ugcgccucugucacucagcauc

SEQ ID NO: 233748 - RNA, 22 nt, Human
ugcgcgcaccugcauauauaug

SEQ ID NO: 233749 - RNA, 22 nt, Human
ucgagauguuuguuguggugau

SEQ ID NO: 233750 - RNA, 22 nt, Human
ucgagcacaccagacuugcaga

SEQ ID NO: 233751 - RNA, 22 nt, Human
ugcgccuccugcugccugcccu

SEQ ID NO: 233752 - RNA, 23 nt, Human
ucccuguuucagggccagaacug

SEQ ID NO: 233753 - RNA, 22 nt, Human
ucccuguuuccugcgcuccuuc

SEQ ID NO: 233754 - RNA, 22 nt, Human
ucccugagcucacauggcagga

SEQ ID NO: 233755 - RNA, 22 nt, Human
ugcagcaucuccuugugccaug

SEQ ID NO: 233756 - RNA, 22 nt, Human
ucccucugccugcaguccugcu

SEQ ID NO: 233757 - RNA, 22 nt, Human
ucccugcaggcauguacucuga

SEQ ID NO: 233758 - RNA, 22 nt, Human
ugcaggagaaaguacggagcgu

SEQ ID NO: 233759 - RNA, 18 nt, Human
ugcaggggaggggugaua

SEQ ID NO: 233760 - RNA, 22 nt, Human
ugcagggucuccuguacuuggg

SEQ ID NO: 233761 - RNA, 22 nt, Human
uccggcgaccuccagauguucc

SEQ ID NO: 233762 - RNA, 22 nt, Human
ugcaggagcaccagcucacccu

SEQ ID NO: 233763 - RNA, 22 nt, Human
ugcaggguuucaauacacagga

SEQ ID NO: 233764 - RNA, 22 nt, Human
uccgaccuuuacuucuugucuc

SEQ ID NO: 233765 - RNA, 18 nt, Human
uccggaggucagaguaaa

SEQ ID NO: 233766 - RNA, 22 nt, Human
ugcaggucuggacccccacuuu

SEQ ID NO: 233767 - RNA, 22 nt, Human
ugcagugaugcuucuggcucag

SEQ ID NO: 233768 - RNA, 22 nt, Human
ugcagguggcagcggggcacca

SEQ ID NO: 233769 - RNA, 22 nt, Human
ugcagugcagcuggaauaucuu

SEQ ID NO: 233770 - RNA, 22 nt, Human
ugcauaaauauuguugggagua

SEQ ID NO: 233771 - RNA, 22 nt, Human
ugcaauggauaucugaacgugg

SEQ ID NO: 233772 - RNA, 22 nt, Human
ucccacgugccaucugcucugu

SEQ ID NO: 233773 - RNA, 22 nt, Human
ugcacacaguucucaggaaaga

SEQ ID NO: 233774 - RNA, 22 nt, Human
ucccagcaggcaccgcuucugc

SEQ ID NO: 233775 - RNA, 22 nt, Human
uccccaccuaagauacccaucu

SEQ ID NO: 233776 - RNA, 22 nt, Human
ucccccuugucguuugagguuu

SEQ ID NO: 233777 - RNA, 22 nt, Human
ucccagccugacagugcaucaa

SEQ ID NO: 233778 - RNA, 22 nt, Human
uccccgcuccguagagaaagag

SEQ ID NO: 233779 - RNA, 22 nt, Human
uccccucucugcgcucccaggu

SEQ ID NO: 233780 - RNA, 22 nt, Human
ucccguuucacuccuugccagc

SEQ ID NO: 233781 - RNA, 22 nt, Human
ucccggcaccgggagccccugc

SEQ ID NO: 233782 - RNA, 21 nt, Human
ugcaaugcauugacagcagca

SEQ ID NO: 233783 - RNA, 23 nt, Human
ucccacauuucacagcacuuucc

SEQ ID NO: 233784 - RNA, 22 nt, Human
uccagcuccugaguucacugcu

SEQ ID NO: 233785 - RNA, 22 nt, Human
uccaggacgccgacgugucggc

SEQ ID NO: 233786 - RNA, 22 nt, Human
uccaggagucagacagauggug

SEQ ID NO: 233787 - RNA, 22 nt, Human
ugagaagucagucuauugugaa

SEQ ID NO: 233788 - RNA, 22 nt, Human
ucagucacugugaaaugaauuu

SEQ ID NO: 233789 - RNA, 22 nt, Human
ugagagaauuacuaaagggcuu

SEQ ID NO: 233790 - RNA, 22 nt, Human
ugagacuugaacuccagugcca

SEQ ID NO: 233791 - RNA, 22 nt, Human
ucagucauacuuuaugauugaa

SEQ ID NO: 233792 - RNA, 23 nt, Human
ucagggaucgucagaaaaugaaa

SEQ ID NO: 233793 - RNA, 22 nt, Human
ucaggguacuuguggccaaagu

SEQ ID NO: 233794 - RNA, 22 nt, Human
ucuucaucucuaaaaugggaac

SEQ ID NO: 233795 - RNA, 22 nt, Human
ucagguuugcaaccucgggcaa

SEQ ID NO: 233796 - RNA, 22 nt, Human
ugagaacuguuuugguuugggu

SEQ ID NO: 233797 - RNA, 22 nt, Human
ugagaagaggucuuuugggaug

SEQ ID NO: 233798 - RNA, 22 nt, Human
ucagguuuaagcuacuggaauc

SEQ ID NO: 233799 - RNA, 20 nt, Human
ucaggguuucccauucuugg

SEQ ID NO: 233800 - RNA, 22 nt, Human
ucaggucacugauaaaguggaa

SEQ ID NO: 233801 - RNA, 22 nt, Human
ucagguuuaagugacuggaauc

SEQ ID NO: 233802 - RNA, 21 nt, Human
ugagagucuguguauuuuuag

SEQ ID NO: 233803 - RNA, 22 nt, Human
ugagagacggagccccggcucg

SEQ ID NO: 233804 - RNA, 22 nt, Human
ugagauguaauguaguacuuug

SEQ ID NO: 233805 - RNA, 22 nt, Human
ucagucugcuauagguauuugu

SEQ ID NO: 233806 - RNA, 22 nt, Human
ucagucucuggggcuucuguuu

SEQ ID NO: 233807 - RNA, 22 nt, Human
ugagagggagacagcucuagca

SEQ ID NO: 233808 - RNA, 22 nt, Human
ugagauucuguucagaaaaaug

SEQ ID NO: 233809 - RNA, 22 nt, Human
ucagugagauuuuuagcaguag

SEQ ID NO: 233810 - RNA, 22 nt, Human
ucagugauccagauauuugagc

SEQ ID NO: 233811 - RNA, 22 nt, Human
ucagucuucaggacuaugaaaa

SEQ ID NO: 233812 - RNA, 22 nt, Human
ugagcaaacacagauaggcuua

SEQ ID NO: 233813 - RNA, 22 nt, Human
ugagcagagcacuugggaacga

SEQ ID NO: 233814 - RNA, 22 nt, Human
ugagcagccagucauucaaaaa

SEQ ID NO: 233815 - RNA, 22 nt, Human
ugaggaagugguuguaugguuu

SEQ ID NO: 233816 - RNA, 22 nt, Human
ugaggaacaugggagaaauguc

SEQ ID NO: 233817 - RNA, 22 nt, Human
ugaggaugaggaagaagaagaa

SEQ ID NO: 233818 - RNA, 22 nt, Human
ugaggaggugggcacacagagu

SEQ ID NO: 233819 - RNA, 22 nt, Human
ucaguugauggcaguuaauguc

SEQ ID NO: 233820 - RNA, 22 nt, Human
ucaguugagguggucuauugcg

SEQ ID NO: 233821 - RNA, 22 nt, Human
ucaguguccuucguucuuguug

SEQ ID NO: 233822 - RNA, 22 nt, Human
ucaguuacucugauguccugug

SEQ ID NO: 233823 - RNA, 22 nt, Human
ucaugagcacaggugcagggac

SEQ ID NO: 233824 - RNA, 22 nt, Human
ucauggcucuaaagacauagau

SEQ ID NO: 233825 - RNA, 22 nt, Human
ucaguuccccaaagccuccuag

SEQ ID NO: 233826 - RNA, 22 nt, Human
ugagugacuguugucaagaugg

SEQ ID NO: 233827 - RNA, 22 nt, Human
ucauccugucucuguucggaau

SEQ ID NO: 233828 - RNA, 22 nt, Human
ucaucggcugucaucuucacgu

SEQ ID NO: 233829 - RNA, 19 nt, Human
ugaggauugagguccagua

SEQ ID NO: 233830 - RNA, 22 nt, Human
ucauaaaaucaguguccauugu

SEQ ID NO: 233831 - RNA, 22 nt, Human
ucauaaaggugccacucaguuu

SEQ ID NO: 233832 - RNA, 22 nt, Human
ucauaagucucauauaugucca

SEQ ID NO: 233833 - RNA, 22 nt, Human
ucauaaguuguugacuagcaaa

SEQ ID NO: 233834 - RNA, 21 nt, Human
ucauaauaauuacaugggggg

SEQ ID NO: 233835 - RNA, 21 nt, Human
ugaggccugccagucucagaa

SEQ ID NO: 233836 - RNA, 22 nt, Human
ucauccgcaaccacuuuagccu

SEQ ID NO: 233837 - RNA, 22 nt, Human
ucauccucguccucuggugccc

SEQ ID NO: 233838 - RNA, 21 nt, Human
ucauccagguccugcuucuuc

SEQ ID NO: 233839 - RNA, 22 nt, Human
ugaucaacagggcuggaaagag

SEQ ID NO: 233840 - RNA, 22 nt, Human
ugauaugguaauaagauauucu

SEQ ID NO: 233841 - RNA, 22 nt, Human
ucauggguauaauuuuagaugu

SEQ ID NO: 233842 - RNA, 20 nt, Human
ugauaugcgguacagagagg

SEQ ID NO: 233843 - RNA, 22 nt, Human
ugaugaugaagaaauauuauca

SEQ ID NO: 233844 - RNA, 22 nt, Human
ugaucaguacuguaugagggau

SEQ ID NO: 233845 - RNA, 22 nt, Human
ugauggugagaugucccguguu

SEQ ID NO: 233846 - RNA, 22 nt, Human
ugauguaggacauuauuauuuc

SEQ ID NO: 233847 - RNA, 22 nt, Human
uccaaggacuaaauucuagauu

SEQ ID NO: 233848 - RNA, 22 nt, Human
ugaugugugaauucuuaaaugu

SEQ ID NO: 233849 - RNA, 22 nt, Human
ugauucacagacuucacaaggc

SEQ ID NO: 233850 - RNA, 20 nt, Human
ugauuauuccaacaagaaug

SEQ ID NO: 233851 - RNA, 22 nt, Human
ugauugaauaauguuaugugaa

SEQ ID NO: 233852 - RNA, 22 nt, Human
ugauugauaaugaagacaguca

SEQ ID NO: 233853 - RNA, 22 nt, Human
ugccccuggaggagagcaaugg

SEQ ID NO: 233854 - RNA, 20 nt, Human
ugccagagagcucauacccu

SEQ ID NO: 233855 - RNA, 22 nt, Human
ugccagauuaugucuccagggc

SEQ ID NO: 233856 - RNA, 22 nt, Human
ugccagucggcacuuuaucugg

SEQ ID NO: 233857 - RNA, 22 nt, Human
ugccagugugccuuccgcucac

SEQ ID NO: 233858 - RNA, 22 nt, Human
ugcaugguuauauacuacuagu

SEQ ID NO: 233859 - RNA, 22 nt, Human
ugcauguuucuguauguuaaug

SEQ ID NO: 233860 - RNA, 22 nt, Human
ugccagcuccgaggagcugcag

SEQ ID NO: 233861 - RNA, 22 nt, Human
ugccgccccggggcccccagcc

SEQ ID NO: 233862 - RNA, 22 nt, Human
ugccgcaggaggggcgauuucu

SEQ ID NO: 233863 - RNA, 22 nt, Human
ugcccuagaucacauuacaggu

SEQ ID NO: 233864 - RNA, 22 nt, Human
uguguggaggugggugaugucu

SEQ ID NO: 233865 - RNA, 22 nt, Human
uguguggaaaugcuguauaugu

SEQ ID NO: 233866 - RNA, 22 nt, Human
uguguauguauguauguaugua

SEQ ID NO: 233867 - RNA, 22 nt, Human
ugugucgccaacaauugugucu

SEQ ID NO: 233868 - RNA, 22 nt, Human
ugugucauuugagaggagacga

SEQ ID NO: 233869 - RNA, 23 nt, Human
ugccggaucuacuuuggguucuc

SEQ ID NO: 233870 - RNA, 22 nt, Human
ugugauuucaaagggugucuuu

SEQ ID NO: 233871 - RNA, 22 nt, Human
ugugcuauuuuugcauaugugu

SEQ ID NO: 233872 - RNA, 19 nt, Human
ugcagcuguaugagcuuaa

SEQ ID NO: 233873 - RNA, 22 nt, Human
ugcaggaacucgaaaacuauag

SEQ ID NO: 233874 - RNA, 22 nt, Human
ugcagcuuuugguuucuagaug

SEQ ID NO: 233875 - RNA, 22 nt, Human
ugugauugcauugcagauuacu

SEQ ID NO: 233876 - RNA, 22 nt, Human
ugugauugucuucugaaaguca

SEQ ID NO: 233877 - RNA, 22 nt, Human
ugugaugagaugaacuguagac

SEQ ID NO: 233878 - RNA, 22 nt, Human
ugugauaaaggcccgcagaucc

SEQ ID NO: 233879 - RNA, 22 nt, Human
ugcaugaucucacuuacaggug

SEQ ID NO: 233880 - RNA, 22 nt, Human
ugcaugacugaucuguuuguca

SEQ ID NO: 233881 - RNA, 22 nt, Human
ugcaucugagcacuacggugga

SEQ ID NO: 233882 - RNA, 22 nt, Human
ugcaugacaauugccgucaagu

SEQ ID NO: 233883 - RNA, 22 nt, Human
ugugcuugucguggagccaggc

SEQ ID NO: 233884 - RNA, 22 nt, Human
uguggcaauauggaauguguuu

SEQ ID NO: 233885 - RNA, 22 nt, Human
ugcagugcagcuggaaguuggc

SEQ ID NO: 233886 - RNA, 22 nt, Human
ugucaguuugucaaauacccca

SEQ ID NO: 233887 - RNA, 22 nt, Human
ugucagccacggugugaccggc

SEQ ID NO: 233888 - RNA, 21 nt, Human
ugucaucucuaaaaagauugu

SEQ ID NO: 233889 - RNA, 22 nt, Human
ugucauauagaauguucuauga

SEQ ID NO: 233890 - RNA, 21 nt, Human
ugucagcaacaauacuuucuc

SEQ ID NO: 233891 - RNA, 21 nt, Human
ugucagaaagccugugacuuu

SEQ ID NO: 233892 - RNA, 23 nt, Human
ugucacugcggaguggccugcag

SEQ ID NO: 233893 - RNA, 22 nt, Human
ugucauuggugaucugaugccu

SEQ ID NO: 233894 - RNA, 22 nt, Human
ugcaaugagcuucuuugauaaa

SEQ ID NO: 233895 - RNA, 22 nt, Human
ugcaagugccauggauucaggu

SEQ ID NO: 233896 - RNA, 22 nt, Human
ugucguaaaagggccgcagugg

SEQ ID NO: 233897 - RNA, 22 nt, Human
ugucccuggacuccaggagcca

SEQ ID NO: 233898 - RNA, 22 nt, Human
ugaugaugccaaaauuuggcau

SEQ ID NO: 233899 - RNA, 22 nt, Human
ugaugcuagaacuuccaagaua

SEQ ID NO: 233900 - RNA, 22 nt, Human
ugaugccauaguaaaauuugcu

SEQ ID NO: 233901 - RNA, 22 nt, Human
ugauuguauuuauccucuguuc

SEQ ID NO: 233902 - RNA, 22 nt, Human
ugauuucauaugacagcuuuuu

SEQ ID NO: 233903 - RNA, 22 nt, Human
ugauugguauguauguuuguca

SEQ ID NO: 233904 - RNA, 22 nt, Human
ugauggaguauaauaaaaugac

SEQ ID NO: 233905 - RNA, 22 nt, Human
ugucacaccuggcgauaauggg

SEQ ID NO: 233906 - RNA, 22 nt, Human
ugucacggccggguggcaccga

SEQ ID NO: 233907 - RNA, 22 nt, Human
ugucacagugcacagcuaagaa

SEQ ID NO: 233908 - RNA, 22 nt, Human
ugucacagagcgugcaacagaa

SEQ ID NO: 233909 - RNA, 22 nt, Human
ugucacaccucguuuagcauuc

SEQ ID NO: 233910 - RNA, 22 nt, Human
ugauuugaaaccuuuggcaaga

SEQ ID NO: 233911 - RNA, 22 nt, Human
ugauuugauuuguuuaugccug

SEQ ID NO: 233912 - RNA, 22 nt, Human
ugauuugguauccaggauuuaa

SEQ ID NO: 233913 - RNA, 22 nt, Human
ugugaaugacuuuguucuuugc

SEQ ID NO: 233914 - RNA, 22 nt, Human
ugugaagcgugugcaggggaca

SEQ ID NO: 233915 - RNA, 19 nt, Human
ugugaagaccucagugcgg

SEQ ID NO: 233916 - RNA, 22 nt, Human
ugugaaggaaaguaggagggac

SEQ ID NO: 233917 - RNA, 22 nt, Human
ugucuuuuaaaaauguguaaaa

SEQ ID NO: 233918 - RNA, 22 nt, Human
ugugaagaauuaaugugaauca

SEQ ID NO: 233919 - RNA, 22 nt, Human
ugugagucuugcaggucgcuca

SEQ ID NO: 233920 - RNA, 22 nt, Human
ugugacugaaaaugauugagug

SEQ ID NO: 233921 - RNA, 22 nt, Human
ugugagauuuuauuugauaugc

SEQ ID NO: 233922 - RNA, 22 nt, Human
ugcagcagaauauggcugcagg

SEQ ID NO: 233923 - RNA, 19 nt, Human
ugcagcacuaaaaacuuuc

SEQ ID NO: 233924 - RNA, 22 nt, Human
ugcagaauauucuggugacaau

SEQ ID NO: 233925 - RNA, 22 nt, Human
ugcagaggagcuggaaggcugg

SEQ ID NO: 233926 - RNA, 22 nt, Human
ugcagacuguuucuugacugaa

SEQ ID NO: 233927 - RNA, 22 nt, Human
ugucuucuuuucccuuagcccu

SEQ ID NO: 233928 - RNA, 22 nt, Human
ugucugauccuucaggagcccc

SEQ ID NO: 233929 - RNA, 21 nt, Human
ugguguacauuuccauaguuu

SEQ ID NO: 233930 - RNA, 22 nt, Human
ugaggaggugcuaccagcgucu

SEQ ID NO: 233931 - RNA, 22 nt, Human
ugaggaugagaaggaagagaag

SEQ ID NO: 233932 - RNA, 22 nt, Human
ugguggcaauuuuuggggucaa

SEQ ID NO: 233933 - RNA, 20 nt, Human
ugguuaaagugggugagcgg

SEQ ID NO: 233934 - RNA, 22 nt, Human
ugagggaagguugauaauguuc

SEQ ID NO: 233935 - RNA, 22 nt, Human
ugagggaggggaaugugugcag

SEQ ID NO: 233936 - RNA, 22 nt, Human
ugguucggcuguaaguauaucu

SEQ ID NO: 233937 - RNA, 22 nt, Human
ugguuauggaacuggcuauggc

SEQ ID NO: 233938 - RNA, 22 nt, Human
ugagauuuagaacuggauuuca

SEQ ID NO: 233939 - RNA, 19 nt, Human
ugagauuguaugaggagau

SEQ ID NO: 233940 - RNA, 22 nt, Human
ugguccgagaacuguccugguu

SEQ ID NO: 233941 - RNA, 22 nt, Human
uggugcucucgauauauaaggc

SEQ ID NO: 233942 - RNA, 22 nt, Human
uggugccuuccgagagcuguga

SEQ ID NO: 233943 - RNA, 22 nt, Human
uggucuccucuuaauugccuac

SEQ ID NO: 233944 - RNA, 22 nt, Human
uggucggugguguggggaggca

SEQ ID NO: 233945 - RNA, 22 nt, Human
ugguuuucuuaauuagcaguca

SEQ ID NO: 233946 - RNA, 21 nt, Human
ugguuuuaucuugguggcugc

SEQ ID NO: 233947 - RNA, 22 nt, Human
ugauaccugagucuuccccguu

SEQ ID NO: 233948 - RNA, 22 nt, Human
ugaguuuuggaagauguuacag

SEQ ID NO: 233949 - RNA, 22 nt, Human
ugaguacauuugauuaucagag

SEQ ID NO: 233950 - RNA, 22 nt, Human
ugagugcacaggccacucuuca

SEQ ID NO: 233951 - RNA, 23 nt, Human
uguacugucuuucagguucuuau

SEQ ID NO: 233952 - RNA, 22 nt, Human
uguacuuguaauaucagugaaa

SEQ ID NO: 233953 - RNA, 22 nt, Human
uguagaaguuaauugaugagua

SEQ ID NO: 233954 - RNA, 22 nt, Human
ugaugaaguuggaaggaaaguu

SEQ ID NO: 233955 - RNA, 22 nt, Human
ugaucuuugcuuuuggcuuagu

SEQ ID NO: 233956 - RNA, 20 nt, Human
ugauccacucucauugcucu

SEQ ID NO: 233957 - RNA, 20 nt, Human
ugauaggcauugacauaagg

SEQ ID NO: 233958 - RNA, 22 nt, Human
ugauaguaucugauuauuucac

SEQ ID NO: 233959 - RNA, 22 nt, Human
ugauauaaaagauucuuauuga

SEQ ID NO: 233960 - RNA, 22 nt, Human
uguaagaagaaaaccguaugga

SEQ ID NO: 233961 - RNA, 22 nt, Human
uguaauguuagaaacaauugcu

SEQ ID NO: 233962 - RNA, 22 nt, Human
ucuuuuuaugucaaaaucgaug

SEQ ID NO: 233963 - RNA, 22 nt, Human
ucuuuuucccugguuccuuuuu

SEQ ID NO: 233964 - RNA, 22 nt, Human
ugaaaaaugcuuuaaugcaugu

SEQ ID NO: 233965 - RNA, 22 nt, Human
ugggucaguagccuugcagaac

SEQ ID NO: 233966 - RNA, 22 nt, Human
ugggucagauugagccccuggu

SEQ ID NO: 233967 - RNA, 22 nt, Human
uggguauauauguugcuacaga

SEQ ID NO: 233968 - RNA, 22 nt, Human
ugaccuuuuuaaauuauuuuua

SEQ ID NO: 233969 - RNA, 22 nt, Human
ugacgggacacaggugccaaca

SEQ ID NO: 233970 - RNA, 22 nt, Human
ugacgcauggccagcucugucu

SEQ ID NO: 233971 - RNA, 22 nt, Human
ugaccuacauuuauagcuguca

SEQ ID NO: 233972 - RNA, 22 nt, Human
uggcggcuggacuggggggcca

SEQ ID NO: 233973 - RNA, 22 nt, Human
ugacuuuucuccucugaaguuu

SEQ ID NO: 233974 - RNA, 22 nt, Human
uggguguggaagcagcgugggg

SEQ ID NO: 233975 - RNA, 22 nt, Human
ugggugugggguaggguaagag

SEQ ID NO: 233976 - RNA, 22 nt, Human
ugacugguauuuguaaaccaua

SEQ ID NO: 233977 - RNA, 22 nt, Human
uggguguuccuggggugcaagg

SEQ ID NO: 233978 - RNA, 22 nt, Human
uggguuaaaguuugucacugac

SEQ ID NO: 233979 - RNA, 22 nt, Human
uggguuaaaaguugaaugaauu

SEQ ID NO: 233980 - RNA, 22 nt, Human
ugggugaugagguccccagccc

SEQ ID NO: 233981 - RNA, 22 nt, Human
ugggugccgcaucuugcuguuc

SEQ ID NO: 233982 - RNA, 22 nt, Human
ugacguuugcgccgcgcacgac

SEQ ID NO: 233983 - RNA, 22 nt, Human
uggguggugaaauggaugggaa

SEQ ID NO: 233984 - RNA, 22 nt, Human
ugacugaggaaggugggguggg

SEQ ID NO: 233985 - RNA, 22 nt, Human
ugacugagacugcaaugaccga

SEQ ID NO: 233986 - RNA, 22 nt, Human
ugagacugaguuugguuuuguu

SEQ ID NO: 233987 - RNA, 23 nt, Human
ugagacacuggaaggcaagaaaa

SEQ ID NO: 233988 - RNA, 22 nt, Human
ugguagacaacagcagugggac

SEQ ID NO: 233989 - RNA, 22 nt, Human
ugagagguagaacuuguagugu

SEQ ID NO: 233990 - RNA, 22 nt, Human
ugagaggaagggaaagaugauu

SEQ ID NO: 233991 - RNA, 22 nt, Human
ugagacuuggggggcugagggc

SEQ ID NO: 233992 - RNA, 22 nt, Human
ugagagaggugaaaugacuuuc

SEQ ID NO: 233993 - RNA, 22 nt, Human
uggucacagauuuacaggaaug

SEQ ID NO: 233994 - RNA, 22 nt, Human
ugguaugaaggaggccggcagc

SEQ ID NO: 233995 - RNA, 22 nt, Human
uggucaaauccuagauccuuug

SEQ ID NO: 233996 - RNA, 22 nt, Human
ugagaauuuaacuugauuagga

SEQ ID NO: 233997 - RNA, 22 nt, Human
ugagacaaaguuguuggauguu

SEQ ID NO: 233998 - RNA, 22 nt, Human
ugguaaaguguacugaauauga

SEQ ID NO: 233999 - RNA, 22 nt, Human
ugguaaaugucuaacaaucacu

SEQ ID NO: 234000 - RNA, 22 nt, Human
ugguaaguuacaugucugccuc

SEQ ID NO: 234001 - RNA, 22 nt, Human
ugguacaaaaaagauuuuggac

SEQ ID NO: 234002 - RNA, 22 nt, Human
ugguaauuuaacaaaauuguca

SEQ ID NO: 234003 - RNA, 22 nt, Human
ugguauaaaaaaaugaguauaa

SEQ ID NO: 234004 - RNA, 22 nt, Human
ugagaaaacaguuuguaauaau

SEQ ID NO: 234005 - RNA, 22 nt, Human
ugagaaauauacaccagacaca

SEQ ID NO: 234006 - RNA, 22 nt, Human
ugcuccugaacacagcccuaug

SEQ ID NO: 234007 - RNA, 23 nt, Human
ugcucgccuucaggacuugggcu

SEQ ID NO: 234008 - RNA, 22 nt, Human
ugcucgauuauuucauuuugca

SEQ ID NO: 234009 - RNA, 22 nt, Human
ugcucugguccucccucggcgc

SEQ ID NO: 234010 - RNA, 22 nt, Human
uguuguuguuguuguuguuguu

SEQ ID NO: 234011 - RNA, 22 nt, Human
uguuuaaauagaacauacugca

SEQ ID NO: 234012 - RNA, 17 nt, Human
uguuguguggauuuucc

SEQ ID NO: 234013 - RNA, 22 nt, Human
uguuguucuuuuucuucuuguu

SEQ ID NO: 234014 - RNA, 22 nt, Human
uguuguaaacagaggagccauu

SEQ ID NO: 234015 - RNA, 23 nt, Human
uguuguccaacugaucuccaggc

SEQ ID NO: 234016 - RNA, 22 nt, Human
uguugucaugcagucaguggua

SEQ ID NO: 234017 - RNA, 21 nt, Human
uguugguugugggaaggagga

SEQ ID NO: 234018 - RNA, 18 nt, Human
uguugguguucacucacu

SEQ ID NO: 234019 - RNA, 21 nt, Human
uguuggccuucauucucuguc

SEQ ID NO: 234020 - RNA, 22 nt, Human
uguuggcagugcuacagucagu

SEQ ID NO: 234021 - RNA, 22 nt, Human
uguuggauuuugugaaauauga

SEQ ID NO: 234022 - RNA, 22 nt, Human
ugcuccucugcaugucugcggc

SEQ ID NO: 234023 - RNA, 22 nt, Human
uguuggaaucuucuagucuucc

SEQ ID NO: 234024 - RNA, 22 nt, Human
uguguguguguguaugugcgug

SEQ ID NO: 234025 - RNA, 22 nt, Human
ugugugugugugugugugugug

SEQ ID NO: 234026 - RNA, 22 nt, Human
uguguguguguguguaauauau

SEQ ID NO: 234027 - RNA, 21 nt, Human
ugccuggccuuugcuuuuccu

SEQ ID NO: 234028 - RNA, 22 nt, Human
ugccugucuaucuuugucaucu

SEQ ID NO: 234029 - RNA, 22 nt, Human
ugcugaccggccuccccccagc

SEQ ID NO: 234030 - RNA, 22 nt, Human
uguuucguugguggagagcuac

SEQ ID NO: 234031 - RNA, 22 nt, Human
ugcugcacucacaggaagaguu

SEQ ID NO: 234032 - RNA, 22 nt, Human
ugcugcacuuauggcucugagg

SEQ ID NO: 234033 - RNA, 22 nt, Human
uguuuaucaguagacucaaguu

SEQ ID NO: 234034 - RNA, 22 nt, Human
uguuuagcucugacuaugugau

SEQ ID NO: 234035 - RNA, 22 nt, Human
uguuuccuguaccacagguuuu

SEQ ID NO: 234036 - RNA, 22 nt, Human
ugcugcacccuucauuuuccca

SEQ ID NO: 234037 - RNA, 22 nt, Human
uguuugaggugacucuggaaug

SEQ ID NO: 234038 - RNA, 22 nt, Human
uguuuguaugauggcacaucca

SEQ ID NO: 234039 - RNA, 22 nt, Human
uguuuguuuuguauuuuuaauu

SEQ ID NO: 234040 - RNA, 22 nt, Human
ugcugccucugaauggagcagu

SEQ ID NO: 234041 - RNA, 22 nt, Human
uguuuucccacugguuuguaca

SEQ ID NO: 234042 - RNA, 22 nt, Human
uuaaacauuuccacuugccagu

SEQ ID NO: 234043 - RNA, 22 nt, Human
uuaaagguacuccuaagcgggg

SEQ ID NO: 234044 - RNA, 22 nt, Human
ugcugcuguuuccuacaucuca

SEQ ID NO: 234045 - RNA, 22 nt, Human
ugcuggaaggguaguauuaacu

SEQ ID NO: 234046 - RNA, 22 nt, Human
ugcugcucaagcugcagcaaaa

SEQ ID NO: 234047 - RNA, 22 nt, Human
ugcugcucuucaccauggccuc

SEQ ID NO: 234048 - RNA, 22 nt, Human
ugcugcggcgcaggcacuccag

SEQ ID NO: 234049 - RNA, 23 nt, Human
ugcugcgggacccgagcgcgcgc

SEQ ID NO: 234050 - RNA, 22 nt, Human
uuaaaagaauccuguuauccuc

SEQ ID NO: 234051 - RNA, 23 nt, Human
ugcugcuggaguaucuacaaugc

SEQ ID NO: 234052 - RNA, 22 nt, Human
ugcuggaguggcacuguguggc

SEQ ID NO: 234053 - RNA, 22 nt, Human
uuaacuaguauuuuuaguccug

SEQ ID NO: 234054 - RNA, 22 nt, Human
uuaacggugagacgccccaaau

SEQ ID NO: 234055 - RNA, 22 nt, Human
uuaacauuguccuuagcagauu

SEQ ID NO: 234056 - RNA, 22 nt, Human
uuaacgaauugugcauaauucc

SEQ ID NO: 234057 - RNA, 23 nt, Human
uuaaggugccguguaauucaugc

SEQ ID NO: 234058 - RNA, 22 nt, Human
uuaagagaagaguaucuagaac

SEQ ID NO: 234059 - RNA, 22 nt, Human
uuaaggcauagcuuguguugac

SEQ ID NO: 234060 - RNA, 22 nt, Human
ugcugugagaccauuuguugag

SEQ ID NO: 234061 - RNA, 22 nt, Human
ugcuguacaagacccucuguuu

SEQ ID NO: 234062 - RNA, 22 nt, Human
uuaauuguuagauagauuauag

SEQ ID NO: 234063 - RNA, 22 nt, Human
ugcuugugcacacacauguuau

SEQ ID NO: 234064 - RNA, 22 nt, Human
ugcuugaggcuugucaucuaac

SEQ ID NO: 234065 - RNA, 22 nt, Human
uuaauguggaagaguuuggcua

SEQ ID NO: 234066 - RNA, 22 nt, Human
ugcuucuuuccuuggugacuuc

SEQ ID NO: 234067 - RNA, 21 nt, Human
uuaaugcuaugcagaaaaucu

SEQ ID NO: 234068 - RNA, 22 nt, Human
uuaaugcauguaaaugugcaaa

SEQ ID NO: 234069 - RNA, 20 nt, Human
ugcugugugucuacuguggg

SEQ ID NO: 234070 - RNA, 20 nt, Human
ugcuguggguaagcuuuaua

SEQ ID NO: 234071 - RNA, 22 nt, Human
uuaaguauauccauuugacugg

SEQ ID NO: 234072 - RNA, 22 nt, Human
uuaaugauuaauguggacccaa

SEQ ID NO: 234073 - RNA, 22 nt, Human
ugcuguugacuuuguuguucuu

SEQ ID NO: 234074 - RNA, 22 nt, Human
uuaaucuauuucauauaaggga

SEQ ID NO: 234075 - RNA, 22 nt, Human
uuaaucagacauucucaaguuu

SEQ ID NO: 234076 - RNA, 22 nt, Human
ugcuucucucuaggaagacgcu

SEQ ID NO: 234077 - RNA, 22 nt, Human
ugcuuacgcaaccuguguuugg

SEQ ID NO: 234078 - RNA, 22 nt, Human
uuaccuuuucuuguuuacaagu

SEQ ID NO: 234079 - RNA, 21 nt, Human
uuacuaagagagcagagggac

SEQ ID NO: 234080 - RNA, 22 nt, Human
uuaccugccucaaacacgaaug

SEQ ID NO: 234081 - RNA, 22 nt, Human
ugcuuuuggcagcaguguuuau

SEQ ID NO: 234082 - RNA, 22 nt, Human
uuacuguguguaaaauaucuuu

SEQ ID NO: 234083 - RNA, 22 nt, Human
uggaaaacgcaguuuaauuuuu

SEQ ID NO: 234084 - RNA, 21 nt, Human
ugcuuucugugcuuuuucugc

SEQ ID NO: 234085 - RNA, 22 nt, Human
ugcuuucagauaucuguuucaa

SEQ ID NO: 234086 - RNA, 22 nt, Human
ugcuuuccuucccuauguugag

SEQ ID NO: 234087 - RNA, 22 nt, Human
uuacccuugaauuugugacaaa

SEQ ID NO: 234088 - RNA, 22 nt, Human
ugcuuuaccuuccauuuaagga

SEQ ID NO: 234089 - RNA, 22 nt, Human
ugcuuucaaugaauuguauacu

SEQ ID NO: 234090 - RNA, 22 nt, Human
ugcuuucaaaacucagaggaau

SEQ ID NO: 234091 - RNA, 19 nt, Human
uuacaugacauaugaagga

SEQ ID NO: 234092 - RNA, 22 nt, Human
uuaccauaguacuaucaguuua

SEQ ID NO: 234093 - RNA, 22 nt, Human
uggaaagaagacugugguugag

SEQ ID NO: 234094 - RNA, 22 nt, Human
uggaaagauuuaaaauaacgag

SEQ ID NO: 234095 - RNA, 22 nt, Human
uuacuuuuuucccccuuagaug

SEQ ID NO: 234096 - RNA, 22 nt, Human
uuacuuucugggauaucaaaug

SEQ ID NO: 234097 - RNA, 22 nt, Human
uuacuguaggugggugaauuug

SEQ ID NO: 234098 - RNA, 22 nt, Human
uuacuuacagggggucaggcug

SEQ ID NO: 234099 - RNA, 22 nt, Human
uggaaaguuggaagucucagga

SEQ ID NO: 234100 - RNA, 22 nt, Human
ugcuucuuugggggugaagaga

SEQ ID NO: 234101 - RNA, 22 nt, Human
uggaaauacaagaaguauguca

SEQ ID NO: 234102 - RNA, 22 nt, Human
uuagaauggaaucauuugcauu

SEQ ID NO: 234103 - RNA, 22 nt, Human
uuagagagaggagagagagaga

SEQ ID NO: 234104 - RNA, 22 nt, Human
uggaacugauuaaaagggcaga

SEQ ID NO: 234105 - RNA, 22 nt, Human
uggaaauaguugugagucaggc

SEQ ID NO: 234106 - RNA, 22 nt, Human
uuagagagguuggagugguaga

SEQ ID NO: 234107 - RNA, 22 nt, Human
uuagauaaaucagcccugagua

SEQ ID NO: 234108 - RNA, 22 nt, Human
uggaagaaaacuuggaaggcau

SEQ ID NO: 234109 - RNA, 22 nt, Human
uuagaugaaaaucggaacaugu

SEQ ID NO: 234110 - RNA, 22 nt, Human
uuagaugcugugauuuuucaaa

SEQ ID NO: 234111 - RNA, 22 nt, Human
uuagcacugucugguuaucuug

SEQ ID NO: 234112 - RNA, 22 nt, Human
uuaguauuuucaccauaugagg

SEQ ID NO: 234113 - RNA, 22 nt, Human
uuagguuuaugaggucugcauu

SEQ ID NO: 234114 - RNA, 23 nt, Human
uuagcccaggcuggagguagccc

SEQ ID NO: 234115 - RNA, 21 nt, Human
uuagcaguuguugauuuccag

SEQ ID NO: 234116 - RNA, 22 nt, Human
uggaagaagcuacaagcgguga

SEQ ID NO: 234117 - RNA, 22 nt, Human
uuaguccucaugaccaccaagu

SEQ ID NO: 234118 - RNA, 22 nt, Human
uuagugucugacgcaggcgcca

SEQ ID NO: 234119 - RNA, 22 nt, Human
uuaguuaauaaauauugagugu

SEQ ID NO: 234120 - RNA, 20 nt, Human
uuaguuacuuagugagaguc

SEQ ID NO: 234121 - RNA, 22 nt, Human
uuaguuacuugacucaagaccc

SEQ ID NO: 234122 - RNA, 22 nt, Human
uggaagggguuacgcagcagga

SEQ ID NO: 234123 - RNA, 22 nt, Human
uggaaggggccaggcgcggagu

SEQ ID NO: 234124 - RNA, 19 nt, Human
uggaagugauaguauagua

SEQ ID NO: 234125 - RNA, 22 nt, Human
uggaaggugauucucugguuaa

SEQ ID NO: 234126 - RNA, 22 nt, Human
uggaagggagcuggaauuugga

SEQ ID NO: 234127 - RNA, 21 nt, Human
uggaagggaagucuugguugu

SEQ ID NO: 234128 - RNA, 22 nt, Human
uuaucugcccauuguagaauug

SEQ ID NO: 234129 - RNA, 19 nt, Human
uuauccacagggaauuuau

SEQ ID NO: 234130 - RNA, 22 nt, Human
uuaucugugcuuuacugacaga

SEQ ID NO: 234131 - RNA, 21 nt, Human
uggagcagggaggauuugggg

SEQ ID NO: 234132 - RNA, 22 nt, Human
uggagcaagaagggaggcagaa

SEQ ID NO: 234133 - RNA, 22 nt, Human
uggagagcaaugaggggcaggc

SEQ ID NO: 234134 - RNA, 22 nt, Human
uggacuguaauguguguggacc

SEQ ID NO: 234135 - RNA, 22 nt, Human
uggaauuaucugaagugauuug

SEQ ID NO: 234136 - RNA, 23 nt, Human
uggaaguugagagucugcuuugu

SEQ ID NO: 234137 - RNA, 22 nt, Human
uggaagugggcaucaccaucca

SEQ ID NO: 234138 - RNA, 21 nt, Human
uggaauuggaaaccauucuau

SEQ ID NO: 234139 - RNA, 22 nt, Human
uuauaaguaagggucucuggca

SEQ ID NO: 234140 - RNA, 22 nt, Human
uggggcgccuggcugaggcugc

SEQ ID NO: 234141 - RNA, 22 nt, Human
ugggguuuuagagcaggcagag

SEQ ID NO: 234142 - RNA, 22 nt, Human
uucuccacguucuucucggccu

SEQ ID NO: 234143 - RNA, 22 nt, Human
uucuccucagcaaggcagcuuu

SEQ ID NO: 234144 - RNA, 22 nt, Human
uucuccugacuggccauucagu

SEQ ID NO: 234145 - RNA, 22 nt, Human
ugggugugcaccuacgaucucu

SEQ ID NO: 234146 - RNA, 22 nt, Human
uggguggauucgggaacuuguu

SEQ ID NO: 234147 - RNA, 22 nt, Human
ugggugggcagagucuaagaua

SEQ ID NO: 234148 - RNA, 22 nt, Human
uggguguguccauauuuugacu

SEQ ID NO: 234149 - RNA, 22 nt, Human
uggguucaaauccugguuccac

SEQ ID NO: 234150 - RNA, 22 nt, Human
uggguuuaccaguguuucuucc

SEQ ID NO: 234151 - RNA, 20 nt, Human
uggguucaguuguuucuggc

SEQ ID NO: 234152 - RNA, 22 nt, Human
uggguuugcuuguucagguucu

SEQ ID NO: 234153 - RNA, 23 nt, Human
uggguuucagugccaaugcugcc

SEQ ID NO: 234154 - RNA, 21 nt, Human
uucugcuguucaccaccaccc

SEQ ID NO: 234155 - RNA, 22 nt, Human
uucugcuuuaaagcucauguuu

SEQ ID NO: 234156 - RNA, 20 nt, Human
uucugcucuagagucuagaa

SEQ ID NO: 234157 - RNA, 17 nt, Human
uucugcucaggaacaga

SEQ ID NO: 234158 - RNA, 18 nt, Human
uucugcggugacagauau

SEQ ID NO: 234159 - RNA, 21 nt, Human
ugguaaggggauccuguuacu

SEQ ID NO: 234160 - RNA, 22 nt, Human
ugguaacgguuuccuugccauu

SEQ ID NO: 234161 - RNA, 22 nt, Human
uucuggacuuccaaauggcuuc

SEQ ID NO: 234162 - RNA, 22 nt, Human
uggguuuauuguauuucccuua

SEQ ID NO: 234163 - RNA, 22 nt, Human
ugguagcaggugcuaaaggccu

SEQ ID NO: 234164 - RNA, 22 nt, Human
ugguauaaaaauuugugaaugu

SEQ ID NO: 234165 - RNA, 22 nt, Human
uucuggagucuauuuugaaaag

SEQ ID NO: 234166 - RNA, 22 nt, Human
ugguccaugcuccaggcacauu

SEQ ID NO: 234167 - RNA, 22 nt, Human
ugguccucacccuacccagcug

SEQ ID NO: 234168 - RNA, 22 nt, Human
uggucccuagugugggagcuug

SEQ ID NO: 234169 - RNA, 22 nt, Human
uggucacgucgggguauugcca

SEQ ID NO: 234170 - RNA, 22 nt, Human
ugguauauuugaccauaugugu

SEQ ID NO: 234171 - RNA, 22 nt, Human
uucuggggccgugacgaggggc

SEQ ID NO: 234172 - RNA, 22 nt, Human
uucugggguaagcacugaggau

SEQ ID NO: 234173 - RNA, 22 nt, Human
uuaugugcuacacauaauuugu

SEQ ID NO: 234174 - RNA, 22 nt, Human
uucauuuccauuuuauagauaa

SEQ ID NO: 234175 - RNA, 22 nt, Human
uuaugggcgaugcaaaccugau

SEQ ID NO: 234176 - RNA, 22 nt, Human
uuauggauuagaguuugauucu

SEQ ID NO: 234177 - RNA, 22 nt, Human
uuaucuuuuaaaaacacuugug

SEQ ID NO: 234178 - RNA, 22 nt, Human
uggagccagcaggacucagagg

SEQ ID NO: 234179 - RNA, 22 nt, Human
ugggaaaauugugauucuuucu

SEQ ID NO: 234180 - RNA, 22 nt, Human
ugggaagaggaggcagggggca

SEQ ID NO: 234181 - RNA, 22 nt, Human
ugggaacuggaaaaaaugaagu

SEQ ID NO: 234182 - RNA, 22 nt, Human
uuccauuacuaaugccugcaau

SEQ ID NO: 234183 - RNA, 22 nt, Human
ugggaaacucuaaacuugagua

SEQ ID NO: 234184 - RNA, 22 nt, Human
ugggaagccaguaucagacuaa

SEQ ID NO: 234185 - RNA, 22 nt, Human
ugggaagcugagccucgaugug

SEQ ID NO: 234186 - RNA, 22 nt, Human
uggcuuuuuauuccuaugugau

SEQ ID NO: 234187 - RNA, 22 nt, Human
uggcuuuuuucuccccuuggau

SEQ ID NO: 234188 - RNA, 22 nt, Human
uggcuguuggagcuggaagaug

SEQ ID NO: 234189 - RNA, 22 nt, Human
uggcugggagcuggaacugggc

SEQ ID NO: 234190 - RNA, 22 nt, Human
uggcugagugaacauguccauu

SEQ ID NO: 234191 - RNA, 22 nt, Human
uuccauggggcuguugcgcaga

SEQ ID NO: 234192 - RNA, 21 nt, Human
uuccauggacccugucagugu

SEQ ID NO: 234193 - RNA, 22 nt, Human
uucggcagaaagucauuugucu

SEQ ID NO: 234194 - RNA, 22 nt, Human
uucgcucuucacacagugcuga

SEQ ID NO: 234195 - RNA, 22 nt, Human
uucgcggccaggcggggaggcc

SEQ ID NO: 234196 - RNA, 22 nt, Human
uggggccaggcuguuggcuucc

SEQ ID NO: 234197 - RNA, 22 nt, Human
uucgucaauaugcagccuguga

SEQ ID NO: 234198 - RNA, 22 nt, Human
uuccuguggggugucaucauag

SEQ ID NO: 234199 - RNA, 22 nt, Human
ugggccgugagacgucucuggg

SEQ ID NO: 234200 - RNA, 22 nt, Human
uuccuggaguggagggagguga

SEQ ID NO: 234201 - RNA, 21 nt, Human
uuccuggaggcagaaacguga

SEQ ID NO: 234202 - RNA, 20 nt, Human
uuccuuucuuucuuuuuuuu

SEQ ID NO: 234203 - RNA, 22 nt, Human
uuccuucccccuucuuugccuu

SEQ ID NO: 234204 - RNA, 19 nt, Human
uuccuuucuauccugggua

SEQ ID NO: 234205 - RNA, 22 nt, Human
uggggcauacgugaaauaauuu

SEQ ID NO: 234206 - RNA, 21 nt, Human
uucgaaugggucguugcugcc

SEQ ID NO: 234207 - RNA, 22 nt, Human
uuccuaagugcugguaugaggc

SEQ ID NO: 234208 - RNA, 22 nt, Human
uucccuuggcuuugauuguguu

SEQ ID NO: 234209 - RNA, 22 nt, Human
ugggacaugaugcauuugaaag

SEQ ID NO: 234210 - RNA, 22 nt, Human
uuccucauuuggcacaucugag

SEQ ID NO: 234211 - RNA, 22 nt, Human
ugggagagaaauuuaaguuuuu

SEQ ID NO: 234212 - RNA, 22 nt, Human
ugggagagaagcugaggcaggg

SEQ ID NO: 234213 - RNA, 19 nt, Human
uugaauguuugauagucuc

SEQ ID NO: 234214 - RNA, 22 nt, Human
uugaauuuagguuuaugugaaa

SEQ ID NO: 234215 - RNA, 22 nt, Human
uugaaggugggaggauuuauau

SEQ ID NO: 234216 - RNA, 22 nt, Human
uugaauaguuuuggauagcaua

SEQ ID NO: 234217 - RNA, 22 nt, Human
uugagauuuggagguaauuccc

SEQ ID NO: 234218 - RNA, 21 nt, Human
uguauacacacauuguaccaa

SEQ ID NO: 234219 - RNA, 22 nt, Human
uugacuauacucuggcggaaaa

SEQ ID NO: 234220 - RNA, 22 nt, Human
uugacacauuagagcuuguaaa

SEQ ID NO: 234221 - RNA, 20 nt, Human
uugauucacaaaaagcuuag

SEQ ID NO: 234222 - RNA, 22 nt, Human
uguccagcuauauguguaugug

SEQ ID NO: 234223 - RNA, 22 nt, Human
ugucauuuauucucuuauucua

SEQ ID NO: 234224 - RNA, 23 nt, Human
uugaucuggaaaauacuuguuug

SEQ ID NO: 234225 - RNA, 22 nt, Human
uugaugagucacuuucuguaaa

SEQ ID NO: 234226 - RNA, 22 nt, Human
uugaugacauuuagcauaauug

SEQ ID NO: 234227 - RNA, 22 nt, Human
uugauaacuuagcugggcugcu

SEQ ID NO: 234228 - RNA, 22 nt, Human
ugucagacagggcugcagucag

SEQ ID NO: 234229 - RNA, 22 nt, Human
uugaggguggauugucagggga

SEQ ID NO: 234230 - RNA, 22 nt, Human
uugauuggguauaaugacagga

SEQ ID NO: 234231 - RNA, 22 nt, Human
ugucucuuccuccucuugguac

SEQ ID NO: 234232 - RNA, 22 nt, Human
ugucugaauuguaauguugcgu

SEQ ID NO: 234233 - RNA, 22 nt, Human
uugauuuggcguuuuccuccug

SEQ ID NO: 234234 - RNA, 22 nt, Human
ugucuguauuugaggacauugu

SEQ ID NO: 234235 - RNA, 22 nt, Human
uugccaggagacaucuggagcc

SEQ ID NO: 234236 - RNA, 20 nt, Human
uugcaugcagccggaugcug

SEQ ID NO: 234237 - RNA, 22 nt, Human
ugugccuguugguguagacaua

SEQ ID NO: 234238 - RNA, 22 nt, Human
uugccgacuggccaaggaguaa

SEQ ID NO: 234239 - RNA, 22 nt, Human
uugcaucaaauauguaccacag

SEQ ID NO: 234240 - RNA, 22 nt, Human
uugcagugucaucuagacgugg

SEQ ID NO: 234241 - RNA, 22 nt, Human
uugcagcuguugcaaagucucu

SEQ ID NO: 234242 - RNA, 22 nt, Human
ugucuucauuccccaugaaguc

SEQ ID NO: 234243 - RNA, 22 nt, Human
uggugcacgugggcagucggcc

SEQ ID NO: 234244 - RNA, 22 nt, Human
uggucugggaagaucacaauua

SEQ ID NO: 234245 - RNA, 22 nt, Human
uggugacaucuaccuagguaaa

SEQ ID NO: 234246 - RNA, 22 nt, Human
uggucugauggucccaccaccg

SEQ ID NO: 234247 - RNA, 22 nt, Human
uucuguuuuuauucuaucucug

SEQ ID NO: 234248 - RNA, 22 nt, Human
uggugcucuugauauauaaggc

SEQ ID NO: 234249 - RNA, 20 nt, Human
uucuguggcccguuuaagug

SEQ ID NO: 234250 - RNA, 19 nt, Human
uggugcgcuguuccugagc

SEQ ID NO: 234251 - RNA, 22 nt, Human
ugguucuagaugagaugaugag

SEQ ID NO: 234252 - RNA, 22 nt, Human
uucuuugcucaccugccgcucc

SEQ ID NO: 234253 - RNA, 22 nt, Human
ugguuauauaaggauuaaauac

SEQ ID NO: 234254 - RNA, 22 nt, Human
ugguuacagaugaagaucggcc

SEQ ID NO: 234255 - RNA, 22 nt, Human
uggugugggauccugggaagga

SEQ ID NO: 234256 - RNA, 22 nt, Human
uucuugcuuccggugcuccagg

SEQ ID NO: 234257 - RNA, 22 nt, Human
uggugcuuuuguggaugcuaac

SEQ ID NO: 234258 - RNA, 20 nt, Human
ugguguccuaugcuugugcu

SEQ ID NO: 234259 - RNA, 22 nt, Human
uucuugcgaaagaaugagcuga

SEQ ID NO: 234260 - RNA, 22 nt, Human
uucuucuguuggcagagcauac

SEQ ID NO: 234261 - RNA, 22 nt, Human
uugaaaaaauguguuuaaggag

SEQ ID NO: 234262 - RNA, 22 nt, Human
uguaaucaugguagaggcaaag

SEQ ID NO: 234263 - RNA, 22 nt, Human
uucuuuuaauuucugucugcag

SEQ ID NO: 234264 - RNA, 21 nt, Human
uucuuugcugcuguuuuugua

SEQ ID NO: 234265 - RNA, 22 nt, Human
ugguuuuuuguaggauaaacau

SEQ ID NO: 234266 - RNA, 23 nt, Human
ugguuuucagaagaccuuguuag

SEQ ID NO: 234267 - RNA, 22 nt, Human
ugguugcaguggugcuuauaca

SEQ ID NO: 234268 - RNA, 22 nt, Human
ugguucugccacuuuccccuug

SEQ ID NO: 234269 - RNA, 22 nt, Human
ugguucugucugugcugggggg

SEQ ID NO: 234270 - RNA, 22 nt, Human
uugaaaaaugcccagcagacaa

SEQ ID NO: 234271 - RNA, 22 nt, Human
uguacauacauagauauacaca

SEQ ID NO: 234272 - RNA, 22 nt, Human
uguacuacaugauuauugacca

SEQ ID NO: 234273 - RNA, 22 nt, Human
uguacuguuuucuaggcaaaaa

SEQ ID NO: 234274 - RNA, 20 nt, Human
uguacuauaaaagguugagu

SEQ ID NO: 234275 - RNA, 22 nt, Human
uguagugaaauuaaaccaaagc

SEQ ID NO: 234276 - RNA, 22 nt, Human
uguauaaaauggaaugucagaa

SEQ ID NO: 234277 - RNA, 22 nt, Human
uugaagccaccacuguaaguca

SEQ ID NO: 234278 - RNA, 22 nt, Human
uugaagaagucaaaagcugcag

SEQ ID NO: 234279 - RNA, 22 nt, Human
uugaaagucuaagaauagguau

SEQ ID NO: 234280 - RNA, 22 nt, Human
uguagcucaaggaauuguucuc

SEQ ID NO: 234281 - RNA, 22 nt, Human
uguagggaucugccucuuccuc

SEQ ID NO: 234282 - RNA, 22 nt, Human
uguaggcacauguauauauccc

SEQ ID NO: 234283 - RNA, 22 nt, Human
uuuauaaacacaagaugggcuc

SEQ ID NO: 234284 - RNA, 22 nt, Human
uuaggcuuuauugaaaacaaua

SEQ ID NO: 234285 - RNA, 22 nt, Human
uuaggcugcuuuggaaaacugu

SEQ ID NO: 234286 - RNA, 22 nt, Human
uuaggcuaauagagauggaaug

SEQ ID NO: 234287 - RNA, 22 nt, Human
uuuaugucaaaaguaaaaugaa

SEQ ID NO: 234288 - RNA, 22 nt, Human
uuuaugguacaggaaugcuguu

SEQ ID NO: 234289 - RNA, 22 nt, Human
uuagucauucccucuugauauu

SEQ ID NO: 234290 - RNA, 22 nt, Human
uuaguauuuuuugaaugaugaa

SEQ ID NO: 234291 - RNA, 22 nt, Human
uuuagcaaaaaagcucugcgua

SEQ ID NO: 234292 - RNA, 22 nt, Human
uuagaaaaaggcuguggucuua

SEQ ID NO: 234293 - RNA, 22 nt, Human
uuuagguuguguucuggcaugu

SEQ ID NO: 234294 - RNA, 20 nt, Human
uuuagucauuuccuaggaaa

SEQ ID NO: 234295 - RNA, 22 nt, Human
uuuaaugaugucuaugccuguu

SEQ ID NO: 234296 - RNA, 22 nt, Human
uuacaucacuuuacuuaauaau

SEQ ID NO: 234297 - RNA, 22 nt, Human
uuacaacgcacacagauuucac

SEQ ID NO: 234298 - RNA, 22 nt, Human
uuacaguuuacauaagaauugu

SEQ ID NO: 234299 - RNA, 22 nt, Human
uuacacaugaagguccaauguu

SEQ ID NO: 234300 - RNA, 22 nt, Human
uuacaagaucuuugaaggcaag

SEQ ID NO: 234301 - RNA, 22 nt, Human
uuuaacauaugaaagaauauuu

SEQ ID NO: 234302 - RNA, 22 nt, Human
uuuaacccaaauaaccacagga

SEQ ID NO: 234303 - RNA, 22 nt, Human
uuuaauauuacacuuaccuugu

SEQ ID NO: 234304 - RNA, 22 nt, Human
uuuaauauucucuuugaaggaa

SEQ ID NO: 234305 - RNA, 21 nt, Human
uuaauugagggauggggguga

SEQ ID NO: 234306 - RNA, 22 nt, Human
uuuaaugucuuggaaaaagacu

SEQ ID NO: 234307 - RNA, 19 nt, Human
uuuaaugugugcugcaauc

SEQ ID NO: 234308 - RNA, 22 nt, Human
uuuaaugucuuuggccuuuaau

SEQ ID NO: 234309 - RNA, 22 nt, Human
uuuaauuauaucugggcaguua

SEQ ID NO: 234310 - RNA, 22 nt, Human
uuuaccuuauguaaauaagagu

SEQ ID NO: 234311 - RNA, 22 nt, Human
uuuaaugguuuauggucuaaga

SEQ ID NO: 234312 - RNA, 22 nt, Human
uuaccuuggaccggguaucaga

SEQ ID NO: 234313 - RNA, 22 nt, Human
uuuacuuguuuugcucuuuucc

SEQ ID NO: 234314 - RNA, 19 nt, Human
uuuacuuaggccacagaau

SEQ ID NO: 234315 - RNA, 22 nt, Human
uuacuuaucugaugugauuuuu

SEQ ID NO: 234316 - RNA, 22 nt, Human
uuaacccagccauuuucaauuu

SEQ ID NO: 234317 - RNA, 22 nt, Human
uuaagggauugagauggaauga

SEQ ID NO: 234318 - RNA, 23 nt, Human
uuaagacuggcugaacuuaguag

SEQ ID NO: 234319 - RNA, 22 nt, Human
uuaaaucaggcaucauuucagu

SEQ ID NO: 234320 - RNA, 22 nt, Human
uuaaaauuguuaacuuugguga

SEQ ID NO: 234321 - RNA, 22 nt, Human
uuaauaaauugugguaccagag

SEQ ID NO: 234322 - RNA, 22 nt, Human
uuguucacuaugaagagguugg

SEQ ID NO: 234323 - RNA, 22 nt, Human
uuguuauuauuauuuucguucu

SEQ ID NO: 234324 - RNA, 22 nt, Human
uuguuccuuucuucuguagucg

SEQ ID NO: 234325 - RNA, 22 nt, Human
uuguuuaaagaacuucugacuu

SEQ ID NO: 234326 - RNA, 22 nt, Human
uuguugcuguugaacccugcug

SEQ ID NO: 234327 - RNA, 22 nt, Human
uuguuucagcuuccuccuccau

SEQ ID NO: 234328 - RNA, 22 nt, Human
uuguuuggcaaaugugugugug

SEQ ID NO: 234329 - RNA, 22 nt, Human
uuguuugcacuuuagagacugu

SEQ ID NO: 234330 - RNA, 22 nt, Human
uuuaaaccuaucuaagaaauag

SEQ ID NO: 234331 - RNA, 22 nt, Human
uuuaaaccuuggaagccacaua

SEQ ID NO: 234332 - RNA, 22 nt, Human
uuuaaauuucugaaucuugagg

SEQ ID NO: 234333 - RNA, 22 nt, Human
uuaauucuugagcugucuuucc

SEQ ID NO: 234334 - RNA, 22 nt, Human
uuaauguuuuagaaugagagug

SEQ ID NO: 234335 - RNA, 22 nt, Human
uuguuuguaaggcucuuagaau

SEQ ID NO: 234336 - RNA, 22 nt, Human
uuguuuuaaaaagaauaacuac

SEQ ID NO: 234337 - RNA, 22 nt, Human
uuaauacugugucuuuuuuaau

SEQ ID NO: 234338 - RNA, 22 nt, Human
uuaauaaggaccugugacaugc

SEQ ID NO: 234339 - RNA, 22 nt, Human
uuaauauuuauugguaaucacu

SEQ ID NO: 234340 - RNA, 22 nt, Human
uuaauauuaagauauugagugg

SEQ ID NO: 234341 - RNA, 22 nt, Human
uuguuuucuaguguuuugaaua

SEQ ID NO: 234342 - RNA, 22 nt, Human
uuguuuucuugaugaaauuauu

SEQ ID NO: 234343 - RNA, 22 nt, Human
uguguguguccucauuugcaga

SEQ ID NO: 234344 - RNA, 22 nt, Human
uguguguaugagcauuuguaug

SEQ ID NO: 234345 - RNA, 22 nt, Human
uguguguguauacauguauaua

SEQ ID NO: 234346 - RNA, 22 nt, Human
ugugucuuuggcgaugucugga

SEQ ID NO: 234347 - RNA, 17 nt, Human
uguguauucuccaggug

SEQ ID NO: 234348 - RNA, 22 nt, Human
uguguguguuguaugaaauuuu

SEQ ID NO: 234349 - RNA, 22 nt, Human
uguguuacaauaauggcaagua

SEQ ID NO: 234350 - RNA, 22 nt, Human
uguguguuguuuugccagaaua

SEQ ID NO: 234351 - RNA, 22 nt, Human
uuggauugugaaaguauucucu

SEQ ID NO: 234352 - RNA, 22 nt, Human
uuggaagacagccgucuuuauu

SEQ ID NO: 234353 - RNA, 22 nt, Human
uuggaagagagauggggagaga

SEQ ID NO: 234354 - RNA, 22 nt, Human
uugcguaucuacauugccugua

SEQ ID NO: 234355 - RNA, 22 nt, Human
uugccuguuugagagcuguguu

SEQ ID NO: 234356 - RNA, 22 nt, Human
uugcggaucuucauggccucag

SEQ ID NO: 234357 - RNA, 22 nt, Human
uugcggauguccacgucacacu

SEQ ID NO: 234358 - RNA, 22 nt, Human
uguguauaugugugugugugug

SEQ ID NO: 234359 - RNA, 21 nt, Human
uuggcuacugcuucagaggga

SEQ ID NO: 234360 - RNA, 22 nt, Human
uuggcguuuccuguucugggug

SEQ ID NO: 234361 - RNA, 22 nt, Human
uguuccacgcguaguuccugcu

SEQ ID NO: 234362 - RNA, 19 nt, Human
uguucuacuugcuaguauu

SEQ ID NO: 234363 - RNA, 22 nt, Human
uguucugaggaggguuucaagg

SEQ ID NO: 234364 - RNA, 22 nt, Human
uguucugauggauuacaugucu

SEQ ID NO: 234365 - RNA, 22 nt, Human
uugggagaaaguuaacuuucua

SEQ ID NO: 234366 - RNA, 22 nt, Human
uuggggagaagagcuggucagg

SEQ ID NO: 234367 - RNA, 22 nt, Human
uuggggaggaagauagggugaa

SEQ ID NO: 234368 - RNA, 20 nt, Human
uuggggacaggagugugaug

SEQ ID NO: 234369 - RNA, 22 nt, Human
uuggauguggggauggaguggg

SEQ ID NO: 234370 - RNA, 22 nt, Human
uuggcaaagagaugcauaagga

SEQ ID NO: 234371 - RNA, 22 nt, Human
uuggcacagagcugcagccugg

SEQ ID NO: 234372 - RNA, 22 nt, Human
uuggcagagaacagaaugauuu

SEQ ID NO: 234373 - RNA, 22 nt, Human
uuggcaaaaauacuguaggccu

SEQ ID NO: 234374 - RNA, 22 nt, Human
uguguucuuugcuuaauuaaag

SEQ ID NO: 234375 - RNA, 22 nt, Human
uuggcaggcugcauguuuaugu

SEQ ID NO: 234376 - RNA, 22 nt, Human
uuggcauuccagaugcuuuucu

SEQ ID NO: 234377 - RNA, 22 nt, Human
uguguuccugucuuauucuuau

SEQ ID NO: 234378 - RNA, 22 nt, Human
uguguuguuuggggauguccau

SEQ ID NO: 234379 - RNA, 22 nt, Human
uguguuguuggggauguuuuca

SEQ ID NO: 234380 - RNA, 22 nt, Human
uugucucuacagagaguaguag

SEQ ID NO: 234381 - RNA, 22 nt, Human
uguuuaguuuugcaccaauaaa

SEQ ID NO: 234382 - RNA, 22 nt, Human
uugucuguacuggcugcaucga

SEQ ID NO: 234383 - RNA, 22 nt, Human
uguuuuguuuagguuuguuuuu

SEQ ID NO: 234384 - RNA, 21 nt, Human
uguuuuguaauagauacuaug

SEQ ID NO: 234385 - RNA, 22 nt, Human
uugucauuuucuuaauguuccu

SEQ ID NO: 234386 - RNA, 22 nt, Human
uugucaugauccuucuguuagg

SEQ ID NO: 234387 - RNA, 22 nt, Human
uguuuucuuuccccuucuuuuc

SEQ ID NO: 234388 - RNA, 22 nt, Human
uguuuucuauuaccugagauug

SEQ ID NO: 234389 - RNA, 22 nt, Human
uguuuucaucucucacccagaa

SEQ ID NO: 234390 - RNA, 22 nt, Human
uguuuuucaagcauuuauuaau

SEQ ID NO: 234391 - RNA, 22 nt, Human
uguuuuuuagagugauacuuuu

SEQ ID NO: 234392 - RNA, 22 nt, Human
uguuuuuucccccccuucuaaa

SEQ ID NO: 234393 - RNA, 22 nt, Human
uuguggcaggauggacagcaga

SEQ ID NO: 234394 - RNA, 22 nt, Human
uuguggagaggaagcaaggagg

SEQ ID NO: 234395 - RNA, 22 nt, Human
uugugauuaauaacuuuucucu

SEQ ID NO: 234396 - RNA, 22 nt, Human
uugugcacauuucauugaccug

SEQ ID NO: 234397 - RNA, 18 nt, Human
uugugccugagaaggugg

SEQ ID NO: 234398 - RNA, 23 nt, Human
uugugcggugcuuuggguuuaca

SEQ ID NO: 234399 - RNA, 22 nt, Human
uguuuuuauucuuaauguuuca

SEQ ID NO: 234400 - RNA, 22 nt, Human
uguuuuuagcuguuuuuuggau

SEQ ID NO: 234401 - RNA, 22 nt, Human
uguuucaguaugauuuucccuc

SEQ ID NO: 234402 - RNA, 22 nt, Human
uugucagcuagugaugcuguuc

SEQ ID NO: 234403 - RNA, 22 nt, Human
uuguauuguuugcgucuguguu

SEQ ID NO: 234404 - RNA, 22 nt, Human
uugucaagauauuuuaggaggc

SEQ ID NO: 234405 - RNA, 22 nt, Human
uuguaaguuuuagguguuucaa

SEQ ID NO: 234406 - RNA, 22 nt, Human
uugguugaaauguguucaugcu

SEQ ID NO: 234407 - RNA, 22 nt, Human
uugguauucaguuggauuugga

SEQ ID NO: 234408 - RNA, 22 nt, Human
uuggucaagacugauaucaaga

SEQ ID NO: 234409 - RNA, 22 nt, Human
uugguauuuguuuaaauuacac

SEQ ID NO: 234410 - RNA, 22 nt, Human
uugguuuacucuggggauaucu

SEQ ID NO: 234411 - RNA, 22 nt, Human
uugguugcugaugagcuuugag

SEQ ID NO: 234412 - RNA, 22 nt, Human
uugguuuuauucguauuuguau

SEQ ID NO: 234413 - RNA, 19 nt, Human
uguugugggccacuaacua

SEQ ID NO: 234414 - RNA, 22 nt, Human
uuggggcugcguauuuccaugu

SEQ ID NO: 234415 - RNA, 22 nt, Human
uugggucagcuuucagguagua

SEQ ID NO: 234416 - RNA, 22 nt, Human
uugggucaugggaucccagcau

SEQ ID NO: 234417 - RNA, 22 nt, Human
uuggguguugguuccugggagg

SEQ ID NO: 234418 - RNA, 22 nt, Human
uugggugcugcacccuucaaca

SEQ ID NO: 234419 - RNA, 22 nt, Human
uucacccaaaucaagcuggccu

SEQ ID NO: 234420 - RNA, 22 nt, Human
uucacugacaguauugaggagg

SEQ ID NO: 234421 - RNA, 22 nt, Human
uucacucagagcaggacagccc

SEQ ID NO: 234422 - RNA, 22 nt, Human
uucacugugauguuuaagagaa

SEQ ID NO: 234423 - RNA, 22 nt, Human
uucagaagguaggaaugucccu

SEQ ID NO: 234424 - RNA, 22 nt, Human
uuugccaucagaugugguaggu

SEQ ID NO: 234425 - RNA, 22 nt, Human
uucaaugcaagggaggucugaa

SEQ ID NO: 234426 - RNA, 20 nt, Human
uucacagaggacucagguca

SEQ ID NO: 234427 - RNA, 22 nt, Human
uucacaauuuuaaaaaguggaa

SEQ ID NO: 234428 - RNA, 21 nt, Human
uucaaccagcaauuggcagaa

SEQ ID NO: 234429 - RNA, 22 nt, Human
uucaaccuucagcuugaguugg

SEQ ID NO: 234430 - RNA, 22 nt, Human
uuagugaagaagcaucuuuagu

SEQ ID NO: 234431 - RNA, 22 nt, Human
uuaguuaccacugcagaucuuu

SEQ ID NO: 234432 - RNA, 22 nt, Human
uucagcauaggcugcucuucaa

SEQ ID NO: 234433 - RNA, 22 nt, Human
uucagcacuggacagcgagucu

SEQ ID NO: 234434 - RNA, 22 nt, Human
uucagcauggcuguuuucccuu

SEQ ID NO: 234435 - RNA, 22 nt, Human
uucagauuuguuuuuguuucug

SEQ ID NO: 234436 - RNA, 22 nt, Human
uucagaugcuugauuauggcaa

SEQ ID NO: 234437 - RNA, 22 nt, Human
uuugcuguaaugcaugucagag

SEQ ID NO: 234438 - RNA, 22 nt, Human
uuugcuguccaauauucagggu

SEQ ID NO: 234439 - RNA, 22 nt, Human
uuugccggaucugucuccagcu

SEQ ID NO: 234440 - RNA, 22 nt, Human
uuugcuccucuucauuuguauc

SEQ ID NO: 234441 - RNA, 22 nt, Human
uuuggcgucucucaggagcuca

SEQ ID NO: 234442 - RNA, 22 nt, Human
uucaggacuauccaguggucuc

SEQ ID NO: 234443 - RNA, 20 nt, Human
uucaggaccuuccaguccau

SEQ ID NO: 234444 - RNA, 22 nt, Human
uuuggcuuugauccuaggauuc

SEQ ID NO: 234445 - RNA, 22 nt, Human
uucaggugguuuaagaauugga

SEQ ID NO: 234446 - RNA, 22 nt, Human
uucauacuguuuaaguucuguu

SEQ ID NO: 234447 - RNA, 22 nt, Human
uucaucauuuuccauuccucuu

SEQ ID NO: 234448 - RNA, 22 nt, Human
uucauaugaauuggguuuuuuu

SEQ ID NO: 234449 - RNA, 22 nt, Human
uuuguuguauuaacccagggua

SEQ ID NO: 234450 - RNA, 21 nt, Human
uuuguucacacacagggcagc

SEQ ID NO: 234451 - RNA, 22 nt, Human
uuccccuucuaauacucaauuu

SEQ ID NO: 234452 - RNA, 22 nt, Human
uucccaggugugagugagguga

SEQ ID NO: 234453 - RNA, 22 nt, Human
uuuguguuacaguccuagaacu

SEQ ID NO: 234454 - RNA, 22 nt, Human
uucauuauuaauaauagcagcu

SEQ ID NO: 234455 - RNA, 22 nt, Human
uucaugcaagagugugaggucc

SEQ ID NO: 234456 - RNA, 22 nt, Human
uuccacaugaucauuguaauaa

SEQ ID NO: 234457 - RNA, 22 nt, Human
uuccaaggcugcuauuuguuuc

SEQ ID NO: 234458 - RNA, 19 nt, Human
uuccacugcuuagcauugc

SEQ ID NO: 234459 - RNA, 22 nt, Human
uuugugguuuugagagaguugc

SEQ ID NO: 234460 - RNA, 22 nt, Human
uuccagcaaagguaguguguua

SEQ ID NO: 234461 - RNA, 22 nt, Human
uuccucauuuuguuaauuuuac

SEQ ID NO: 234462 - RNA, 22 nt, Human
uuccugaucuuuucccagaguu

SEQ ID NO: 234463 - RNA, 22 nt, Human
uuuguugucuucauaauacuuu

SEQ ID NO: 234464 - RNA, 22 nt, Human
uuccugcuggucaaaguugccu

SEQ ID NO: 234465 - RNA, 22 nt, Human
uuuguuuuggugucaugcguga

SEQ ID NO: 234466 - RNA, 22 nt, Human
uuuguuugcuaguauuuuguuu

SEQ ID NO: 234467 - RNA, 19 nt, Human
uuccucaggugugaguuag

SEQ ID NO: 234468 - RNA, 22 nt, Human
uuuuaaaguaauugaagcuugu

SEQ ID NO: 234469 - RNA, 22 nt, Human
uuccuuuucuucuaccacaugu

SEQ ID NO: 234470 - RNA, 22 nt, Human
uuuuaaauggcuuuuacuuuuc

SEQ ID NO: 234471 - RNA, 22 nt, Human
uuuuaacuuuggguucucuuua

SEQ ID NO: 234472 - RNA, 23 nt, Human
uuuuaauaguaugacaugagcug

SEQ ID NO: 234473 - RNA, 22 nt, Human
uuccuuuuuaauuaaucuaauu

SEQ ID NO: 234474 - RNA, 21 nt, Human
uucuauauugagaauuggcua

SEQ ID NO: 234475 - RNA, 22 nt, Human
uucuauaagagaugaauacagu

SEQ ID NO: 234476 - RNA, 22 nt, Human
uuuucaguuccaucucugcucu

SEQ ID NO: 234477 - RNA, 22 nt, Human
uuuuccgaccuuaggaaggaac

SEQ ID NO: 234478 - RNA, 22 nt, Human
uuuuccuuagaaauacauugau

SEQ ID NO: 234479 - RNA, 22 nt, Human
uucucugaagagccagcccuua

SEQ ID NO: 234480 - RNA, 22 nt, Human
uuuuaauucaacauuugcuuuu

SEQ ID NO: 234481 - RNA, 22 nt, Human
uuuuaauccucuugguaucuua

SEQ ID NO: 234482 - RNA, 18 nt, Human
uucgucauggggaucgua

SEQ ID NO: 234483 - RNA, 22 nt, Human
uucggugagcugcgggcgagga

SEQ ID NO: 234484 - RNA, 23 nt, Human
uuuuacaagagugcauuugucuc

SEQ ID NO: 234485 - RNA, 22 nt, Human
uuuuacaaugcaaauucuugcu

SEQ ID NO: 234486 - RNA, 22 nt, Human
uuuuagccagaguuuaucacag

SEQ ID NO: 234487 - RNA, 22 nt, Human
uucugugacgcaaagcugggaa

SEQ ID NO: 234488 - RNA, 22 nt, Human
uuuucuuggaguggcuguccuu

SEQ ID NO: 234489 - RNA, 22 nt, Human
uuuugcuagaaaucaccaauac

SEQ ID NO: 234490 - RNA, 22 nt, Human
uuuugaugaccauucuucuuuu

SEQ ID NO: 234491 - RNA, 22 nt, Human
uucugugacuccucagagauuu

SEQ ID NO: 234492 - RNA, 22 nt, Human
uuuugguauggcuugauagagu

SEQ ID NO: 234493 - RNA, 22 nt, Human
uuuugguauaauuuaaaauuaa

SEQ ID NO: 234494 - RNA, 22 nt, Human
uuuucggagaauguuaaugugu

SEQ ID NO: 234495 - RNA, 22 nt, Human
uuuuccuuaacagagggagaaa

SEQ ID NO: 234496 - RNA, 22 nt, Human
uuuucucucacuucacauauuu

SEQ ID NO: 234497 - RNA, 22 nt, Human
uucuggaguuugaagaucaggu

SEQ ID NO: 234498 - RNA, 22 nt, Human
uuuucuugagucacuccaguga

SEQ ID NO: 234499 - RNA, 22 nt, Human
uuuucuucggugcuggguugau

SEQ ID NO: 234500 - RNA, 22 nt, Human
uucuugagaacaaauuccugga

SEQ ID NO: 234501 - RNA, 22 nt, Human
uucuugcuucucugucugccuc

SEQ ID NO: 234502 - RNA, 22 nt, Human
uuuuuaaaauuaggacggcacg

SEQ ID NO: 234503 - RNA, 22 nt, Human
uucuugugugaauauaauuaca

SEQ ID NO: 234504 - RNA, 21 nt, Human
uucuuugaagacccauuugag

SEQ ID NO: 234505 - RNA, 22 nt, Human
uucuucuucuuccucauccuca

SEQ ID NO: 234506 - RNA, 20 nt, Human
uuuuguccaccugcaggaag

SEQ ID NO: 234507 - RNA, 22 nt, Human
uucuucgacuguauaaaaguau

SEQ ID NO: 234508 - RNA, 22 nt, Human
uuuugguaguccagaguuuagu

SEQ ID NO: 234509 - RNA, 22 nt, Human
uucuuuuaauagagauccugug

SEQ ID NO: 234510 - RNA, 22 nt, Human
uuuuugcccuaaagaagucauu

SEQ ID NO: 234511 - RNA, 22 nt, Human
uuuuugcuuuuuugucaucuaa

SEQ ID NO: 234512 - RNA, 22 nt, Human
uugaaaaaaucugaggaggacc

SEQ ID NO: 234513 - RNA, 22 nt, Human
uucuuugcccauguuuccuaag

SEQ ID NO: 234514 - RNA, 22 nt, Human
uucuuuguccuagcauucuaca

SEQ ID NO: 234515 - RNA, 22 nt, Human
uuuuucugacugcuaacaaaaa

SEQ ID NO: 234516 - RNA, 22 nt, Human
uuuuugaauaagugcaucauca

SEQ ID NO: 234517 - RNA, 21 nt, Human
uugaaguggguagcuggcggg

SEQ ID NO: 234518 - RNA, 22 nt, Human
uuuuuguaaaugaaguuuuauu

SEQ ID NO: 234519 - RNA, 22 nt, Human
uuuuugggccaaauauauuuac

SEQ ID NO: 234520 - RNA, 22 nt, Human
uuuuuggacccaucuucuuuuu

SEQ ID NO: 234521 - RNA, 22 nt, Human
uugaacaguuuugucagguuca

SEQ ID NO: 234522 - RNA, 22 nt, Human
uuuuuuccagcuucuagaggcc

SEQ ID NO: 234523 - RNA, 22 nt, Human
uugacacauggcuucaauugca

SEQ ID NO: 234524 - RNA, 22 nt, Human
uugaauaaggcauaaagauacu

SEQ ID NO: 234525 - RNA, 22 nt, Human
uugaugacuaaagaaagcugcu

SEQ ID NO: 234526 - RNA, 22 nt, Human
uugauagauuuuagaggcaggc

SEQ ID NO: 234527 - RNA, 22 nt, Human
uugagauggccuuuuuuauacu

SEQ ID NO: 234528 - RNA, 21 nt, Human
uugagcuuuuaguacagacag

SEQ ID NO: 234529 - RNA, 20 nt, Human
uugagccucauggauugucu

SEQ ID NO: 234530 - RNA, 22 nt, Human
uugagacucgagucucucagac

SEQ ID NO: 234531 - RNA, 22 nt, Human
uuuuuuuccaguuauucauuuu

SEQ ID NO: 234532 - RNA, 22 nt, Human
uugaccauguggcccaggccaa

SEQ ID NO: 234533 - RNA, 22 nt, Human
uugagcagccauuagcuggggu

SEQ ID NO: 234534 - RNA, 22 nt, Human
uugagaugacuuaaaucacugu

SEQ ID NO: 234535 - RNA, 22 nt, Human
uugauuuccauuguccagcauu

SEQ ID NO: 234536 - RNA, 21 nt, Human
uugauuuagcagaucuagcug

SEQ ID NO: 234537 - RNA, 22 nt, Human
uugauucauuuguucccauuuu

SEQ ID NO: 234538 - RNA, 22 nt, Human
uugauuaauugaugaaccucuc

SEQ ID NO: 234539 - RNA, 22 nt, Human
uuggccauuacugagccuggag

SEQ ID NO: 234540 - RNA, 22 nt, Human
uuggaguucuucaugcucugua

SEQ ID NO: 234541 - RNA, 22 nt, Human
uuggcuguguugaaaacgugga

SEQ ID NO: 234542 - RNA, 22 nt, Human
uuggcuuuucaguuuuaaguua

SEQ ID NO: 234543 - RNA, 22 nt, Human
uuggcgcuauuauuaccacauu

SEQ ID NO: 234544 - RNA, 22 nt, Human
uuggccguuucacugggcaguu

SEQ ID NO: 234545 - RNA, 22 nt, Human
uuggccuaggcacaggcaggug

SEQ ID NO: 234546 - RNA, 20 nt, Human
uugggaagccuacaccauuc

SEQ ID NO: 234547 - RNA, 22 nt, Human
uugggaaauuugaaaauaaaag

SEQ ID NO: 234548 - RNA, 22 nt, Human
uugggcuagaaacaacgugggu

SEQ ID NO: 234549 - RNA, 22 nt, Human
uuggggaauuuggggccguccg

SEQ ID NO: 234550 - RNA, 22 nt, Human
uugggagaggcagcagagucau

SEQ ID NO: 234551 - RNA, 22 nt, Human
uugguuuuuugguguaucuuau

SEQ ID NO: 234552 - RNA, 22 nt, Human
uuguaagacuguagaaugcaaa

SEQ ID NO: 234553 - RNA, 22 nt, Human
uuguaauaguguuuuacguugu

SEQ ID NO: 234554 - RNA, 19 nt, Human
uugguuuguugcuuaggug

SEQ ID NO: 234555 - RNA, 22 nt, Human
uuggugauugggaauggauggg

SEQ ID NO: 234556 - RNA, 22 nt, Human
uugguguaauacaagcaauuug

SEQ ID NO: 234557 - RNA, 22 nt, Human
uugguguuucacuuccuugucg

SEQ ID NO: 234558 - RNA, 22 nt, Human
uuggggaugccccuacgggcua

SEQ ID NO: 234559 - RNA, 22 nt, Human
uugugcauuuuguuuuacuuau

SEQ ID NO: 234560 - RNA, 22 nt, Human
uugugcagugccuggacccagg

SEQ ID NO: 234561 - RNA, 22 nt, Human
uugugaggaugugcuuuuuagu

SEQ ID NO: 234562 - RNA, 22 nt, Human
uugugcauuugcuaugggccau

SEQ ID NO: 234563 - RNA, 22 nt, Human
uugugccuuaauauaggcgcug

SEQ ID NO: 234564 - RNA, 22 nt, Human
uugucaggaacuaugauuaugc

SEQ ID NO: 234565 - RNA, 22 nt, Human
uugucaguggccugaggacaga

SEQ ID NO: 234566 - RNA, 22 nt, Human
uuguauguuucugugcacauga

SEQ ID NO: 234567 - RNA, 22 nt, Human
uuguauuaauacacuccuuuuc

SEQ ID NO: 234568 - RNA, 22 nt, Human
uuucaaguagagggaucgcuag

SEQ ID NO: 234569 - RNA, 22 nt, Human
uuucaagccucacugcguuuug

SEQ ID NO: 234570 - RNA, 22 nt, Human
uuucacauacaguguauaguag

SEQ ID NO: 234571 - RNA, 22 nt, Human
uuucacugaguaggagagcacu

SEQ ID NO: 234572 - RNA, 22 nt, Human
uuucacuucgaucagaguuuuu

SEQ ID NO: 234573 - RNA, 22 nt, Human
uuuauuugggauuucucaucug

SEQ ID NO: 234574 - RNA, 19 nt, Human
uuuauuugagacaugccuu

SEQ ID NO: 234575 - RNA, 22 nt, Human
uuuaugauguagccuagagcug

SEQ ID NO: 234576 - RNA, 22 nt, Human
uuuaucaucuucugaauuugga

SEQ ID NO: 234577 - RNA, 22 nt, Human
uuuauccacucauccaugccuc

SEQ ID NO: 234578 - RNA, 22 nt, Human
uuuauguugagcaaaauaccac

SEQ ID NO: 234579 - RNA, 22 nt, Human
uuuauucacuuaucaggaacga

SEQ ID NO: 234580 - RNA, 22 nt, Human
uuuauguuuguuuuugaaauaa

SEQ ID NO: 234581 - RNA, 22 nt, Human
uuuauaagccagacacugcguu

SEQ ID NO: 234582 - RNA, 22 nt, Human
uuuagugagugugaaucaaaug

SEQ ID NO: 234583 - RNA, 22 nt, Human
uuuauauauauguaggagcaca

SEQ ID NO: 234584 - RNA, 22 nt, Human
uuuaucaggccaucuuaugucu

SEQ ID NO: 234585 - RNA, 22 nt, Human
uuuagguccguguugcaguugg

SEQ ID NO: 234586 - RNA, 22 nt, Human
uuuaggugucugcucauugaag

SEQ ID NO: 234587 - RNA, 22 nt, Human
uuuaguauaguaugugcucaaa

SEQ ID NO: 234588 - RNA, 22 nt, Human
uuuagugaagcuuugcauuuca

SEQ ID NO: 234589 - RNA, 19 nt, Human
uuuagcuacugugguauua

SEQ ID NO: 234590 - RNA, 22 nt, Human
uuuagcaaggagaaauaauccu

SEQ ID NO: 234591 - RNA, 18 nt, Human
uuuacgaacucacuugag

SEQ ID NO: 234592 - RNA, 22 nt, Human
uuguguuuaaucuguuccacua

SEQ ID NO: 234593 - RNA, 20 nt, Human
uuguuagguucaguguuucc

SEQ ID NO: 234594 - RNA, 22 nt, Human
uuguguugaagugguuagggcg

SEQ ID NO: 234595 - RNA, 22 nt, Human
uuguuauaggaucagugucacu

SEQ ID NO: 234596 - RNA, 23 nt, Human
uugugguuauauuugcccauuuu

SEQ ID NO: 234597 - RNA, 22 nt, Human
uuguuccuaguuguccaucaca

SEQ ID NO: 234598 - RNA, 22 nt, Human
uuguuguuguuguuauuuaguu

SEQ ID NO: 234599 - RNA, 22 nt, Human
uuguugcaagccuggaaucugg

SEQ ID NO: 234600 - RNA, 22 nt, Human
uuuaccucguuguguccuuguu

SEQ ID NO: 234601 - RNA, 22 nt, Human
uuuaccugucuguagaacauaa

SEQ ID NO: 234602 - RNA, 22 nt, Human
uuguuccuucuuuuuguaucag

SEQ ID NO: 234603 - RNA, 22 nt, Human
uuugagugccucgaguguggga

SEQ ID NO: 234604 - RNA, 22 nt, Human
uuugaguaagauguugauacug

SEQ ID NO: 234605 - RNA, 22 nt, Human
uuugagaagauaggggaauacu

SEQ ID NO: 234606 - RNA, 22 nt, Human
uuugaagauaaauauggagaaa

SEQ ID NO: 234607 - RNA, 21 nt, Human
uuugacagaccagguauaguu

SEQ ID NO: 234608 - RNA, 23 nt, Human
uuugaaucauuguggggcuuuug

SEQ ID NO: 234609 - RNA, 22 nt, Human
uuugcugaaaaaccacuugagu

SEQ ID NO: 234610 - RNA, 22 nt, Human
uuugcugggaagccuucacucu

SEQ ID NO: 234611 - RNA, 19 nt, Human
uuugccugugguucagaag

SEQ ID NO: 234612 - RNA, 23 nt, Human
uuugccuaaugaagacuauguca

SEQ ID NO: 234613 - RNA, 22 nt, Human
uuugcauuugagagaggaaaca

SEQ ID NO: 234614 - RNA, 23 nt, Human
uuugcaaauuggacacaaccaca

SEQ ID NO: 234615 - RNA, 22 nt, Human
uuugcaggaaauguacugaaug

SEQ ID NO: 234616 - RNA, 22 nt, Human
uuugauuuuguuuauagugccg

SEQ ID NO: 234617 - RNA, 22 nt, Human
uuugauuuuuugagcaguguau

SEQ ID NO: 234618 - RNA, 20 nt, Human
uuugauugccccucugacuu

SEQ ID NO: 234619 - RNA, 22 nt, Human
uuuggugacuguaggaaaggau

SEQ ID NO: 234620 - RNA, 22 nt, Human
uuuggugauuuuuaaucccccu

SEQ ID NO: 234621 - RNA, 20 nt, Human
uuugguuggcuaggggaagc

SEQ ID NO: 234622 - RNA, 22 nt, Human
uuuguaaguuuguucuccuggg

SEQ ID NO: 234623 - RNA, 22 nt, Human
uuugguaccucucgucacaaug

SEQ ID NO: 234624 - RNA, 22 nt, Human
uuuggucuggaaucuucagggu

SEQ ID NO: 234625 - RNA, 22 nt, Human
uuuguaguuguggaugcugaag

SEQ ID NO: 234626 - RNA, 22 nt, Human
uuuguccuguuggcaugaaaau

SEQ ID NO: 234627 - RNA, 22 nt, Human
uuuguauuguuuauuucauuuu

SEQ ID NO: 234628 - RNA, 22 nt, Human
uuuguauuucaaggcacucuca

SEQ ID NO: 234629 - RNA, 22 nt, Human
uuugucaggaauugaaaaguuu

SEQ ID NO: 234630 - RNA, 20 nt, Human
uuugucaacugcauccagca

SEQ ID NO: 234631 - RNA, 22 nt, Human
uuugggguuuuuuggugaaauc

SEQ ID NO: 234632 - RNA, 22 nt, Human
uuuggcugucauuugaaaaugu

SEQ ID NO: 234633 - RNA, 22 nt, Human
uuuggcuccccaggaucugaaa

SEQ ID NO: 234634 - RNA, 22 nt, Human
uuuggcuacucuucauugguga

SEQ ID NO: 234635 - RNA, 22 nt, Human
uuugcuuugacuuugggaguau

SEQ ID NO: 234636 - RNA, 22 nt, Human
uuucauagaggcagcggcggau

SEQ ID NO: 234637 - RNA, 22 nt, Human
uuucagagaaagcccaaagacu

SEQ ID NO: 234638 - RNA, 22 nt, Human
uuucagugaaugaauggcuaac

SEQ ID NO: 234639 - RNA, 22 nt, Human
uuucagguggaaguuuuagaug

SEQ ID NO: 234640 - RNA, 22 nt, Human
uuucagacugcccauguuugcc

SEQ ID NO: 234641 - RNA, 22 nt, Human
uuucacagcgucuuucucuugc

SEQ ID NO: 234642 - RNA, 21 nt, Human
uuuccagaggcagccggacuc

SEQ ID NO: 234643 - RNA, 22 nt, Human
uuuccagacaugguuuuucaaa

SEQ ID NO: 234644 - RNA, 22 nt, Human
uuuccaguuguucuagaaagcu

SEQ ID NO: 234645 - RNA, 21 nt, Human
uuucauuaguacaucaauuug

SEQ ID NO: 234646 - RNA, 22 nt, Human
uuucuaacacccuccuuccaga

SEQ ID NO: 234647 - RNA, 22 nt, Human
uuucuauauucaguuucauaaa

SEQ ID NO: 234648 - RNA, 22 nt, Human
uuucuaaaauuacugcagucgg

SEQ ID NO: 234649 - RNA, 22 nt, Human
uuuccuguccugguacuuggca

SEQ ID NO: 234650 - RNA, 22 nt, Human
uuuccuuuguuuugguauaugu

SEQ ID NO: 234651 - RNA, 22 nt, Human
uuucgcuuguucggagugcuuu

SEQ ID NO: 234652 - RNA, 22 nt, Human
uuucugagccacauauaauuug

SEQ ID NO: 234653 - RNA, 22 nt, Human
uuucucuuguauuugaaucacu

SEQ ID NO: 234654 - RNA, 22 nt, Human
uuucucugggugaugagguggc

SEQ ID NO: 234655 - RNA, 22 nt, Human
uuucucuccucgaaauucuuau

SEQ ID NO: 234656 - RNA, 22 nt, Human
uuucuauuuacagugcuaggua

SEQ ID NO: 234657 - RNA, 20 nt, Human
uuucucccacaaugacccuc

SEQ ID NO: 234658 - RNA, 22 nt, Human
uuucuccauuuuguguguucug

SEQ ID NO: 234659 - RNA, 22 nt, Human
uuucucagcauauugccuuuga

SEQ ID NO: 234660 - RNA, 22 nt, Human
uuucucagccuccuugcuggag

SEQ ID NO: 234661 - RNA, 22 nt, Human
uuucugaugaaguagaaagacc

SEQ ID NO: 234662 - RNA, 22 nt, Human
uuucuggacuaaagggagagau

SEQ ID NO: 234663 - RNA, 22 nt, Human
uuucuggaaacuguaaagagga

SEQ ID NO: 234664 - RNA, 22 nt, Human
uuucugcuuucuaguugguguu

SEQ ID NO: 234665 - RNA, 18 nt, Human
uuucuuuuauuccagguc

SEQ ID NO: 234666 - RNA, 22 nt, Human
uuugaaaggagcuuuauccaga

SEQ ID NO: 234667 - RNA, 22 nt, Human
uuucuguucuguuggauucuuu

SEQ ID NO: 234668 - RNA, 22 nt, Human
uuucugguuuuauucugggguu

SEQ ID NO: 234669 - RNA, 22 nt, Human
uuucuuaaaagcuuuuaaaguu

SEQ ID NO: 234670 - RNA, 22 nt, Human
uuucuuccaucuggcuuuauuu

SEQ ID NO: 234671 - RNA, 22 nt, Human
uggcagccugcgugaaggagcu

SEQ ID NO: 234672 - RNA, 22 nt, Human
ggacauaguugcuauggagagu

SEQ ID NO: 234673 - RNA, 22 nt, Human
ugagggaggggaaugugugcag

SEQ ID NO: 234674 - RNA, 22 nt, Human
agcacagugccugacauauaug

SEQ ID NO: 234675 - RNA, 22 nt, Human
agucugugguccucuguaucuc

SEQ ID NO: 234676 - RNA, 22 nt, Human
ggcagagguagcuggaaccagg

SEQ ID NO: 234677 - RNA, 22 nt, Human
uuuucauuguuaguuucuccuu

SEQ ID NO: 234678 - RNA, 23 nt, Human
ccagcugugccuggcccaggagc

SEQ ID NO: 234679 - RNA, 22 nt, Human
uguuuucuuuccccuucuuuuc

SEQ ID NO: 234680 - RNA, 22 nt, Human
uuuuauuuguauguugaaugua

SEQ ID NO: 234681 - RNA, 22 nt, Human
cugguuuauuucauaguuuguu

SEQ ID NO: 234682 - RNA, 22 nt, Human
agggcaguuaugaaugucucca

SEQ ID NO: 234683 - RNA, 22 nt, Human
aaaauauucuauaucaaagaua

SEQ ID NO: 234684 - RNA, 22 nt, Human
auaaaucaagggcaguauuucc

SEQ ID NO: 234685 - RNA, 22 nt, Human
auuugcuuguucaccaguacuu

SEQ ID NO: 234686 - RNA, 22 nt, Human
gaggagcuucagaggaaucuua

SEQ ID NO: 234687 - RNA, 22 nt, Human
ggcucccccauggcugacagac

SEQ ID NO: 234688 - RNA, 17 nt, Human
ccacuagauagguugug

SEQ ID NO: 234689 - RNA, 22 nt, Human
auguuccaugacuaugcaugaa

SEQ ID NO: 234690 - RNA, 20 nt, Human
uucacagaggacucagguca

SEQ ID NO: 234691 - RNA, 22 nt, Human
uuaaacauuuccacuugccagu

SEQ ID NO: 234692 - RNA, 22 nt, Human
ggagagcuagugagcuggaggu

SEQ ID NO: 234693 - RNA, 22 nt, Human
uucacccuucucuggcuuucag

SEQ ID NO: 234694 - RNA, 22 nt, Human
aguuauuuuucacuauuaggcu

SEQ ID NO: 234695 - RNA, 22 nt, Human
aagaaggaaggcaagagauggg

SEQ ID NO: 234696 - RNA, 22 nt, Human
aagagaggcccaaguggcuggc

SEQ ID NO: 234697 - RNA, 22 nt, Human
ugugugcuaguuuugucaguau

SEQ ID NO: 234698 - RNA, 22 nt, Human
uugcaagcccugaagggcugga

SEQ ID NO: 234699 - RNA, 22 nt, Human
gcagagcugucuaagucacuuc

SEQ ID NO: 234700 - RNA, 22 nt, Human
cuccuuugagcaaaucuuugau

SEQ ID NO: 234701 - RNA, 20 nt, Human
ccuuguggaugucuuuuuug

SEQ ID NO: 234702 - RNA, 20 nt, Human
agaaggagagaugaggcaaa

SEQ ID NO: 234703 - RNA, 22 nt, Human
gugauggucgagcgcuuguugu

SEQ ID NO: 234704 - RNA, 22 nt, Human
uacaagcucuuguagggggaaa

SEQ ID NO: 234705 - RNA, 20 nt, Human
ugauuauuccaacaagaaug

SEQ ID NO: 234706 - RNA, 22 nt, Human
uucuugucuuuguuauguagga

SEQ ID NO: 234707 - RNA, 22 nt, Human
ggacggggagcuggaaagggga

SEQ ID NO: 234708 - RNA, 18 nt, Human
uucucucuggauaguagu

SEQ ID NO: 234709 - RNA, 22 nt, Human
gcuucuguuaggauguggcuua

SEQ ID NO: 234710 - RNA, 22 nt, Human
uugugugugcccaccuguggcc

SEQ ID NO: 234711 - RNA, 22 nt, Human
aggcaguguguagcuggaagag

SEQ ID NO: 234712 - RNA, 22 nt, Human
ccagggcuggaggaggucagga

SEQ ID NO: 234713 - RNA, 22 nt, Human
cugguacuggaggaguucagag

SEQ ID NO: 234714 - RNA, 22 nt, Human
uccauuuacuauucucauaucg

SEQ ID NO: 234715 - RNA, 22 nt, Human
cuucuuuuggggaugaaaaugg

SEQ ID NO: 234716 - RNA, 22 nt, Human
uucacuuuuucucugcuugaga

SEQ ID NO: 234717 - RNA, 22 nt, Human
cacugcaaccuccaccucccgg

SEQ ID NO: 234718 - RNA, 22 nt, Human
cuucuuuucuacuggccuagaa

SEQ ID NO: 234719 - RNA, 22 nt, Human
agaucugucaccauccuggagc

SEQ ID NO: 234720 - RNA, 22 nt, Human
auaaaaauguuuuuguguggua

SEQ ID NO: 234721 - RNA, 22 nt, Human
guucuucagauuccauuucagu

SEQ ID NO: 234722 - RNA, 22 nt, Human
aaaauaauauuauaccacugcu

SEQ ID NO: 234723 - RNA, 22 nt, Human
ucaguggaacacacagaguggg

SEQ ID NO: 234724 - RNA, 22 nt, Human
cuccuugguuccggcguuggag

SEQ ID NO: 234725 - RNA, 22 nt, Human
gaauuagguaauagaacuagua

SEQ ID NO: 234726 - RNA, 22 nt, Human
uuucacugaguaggagagcacu

SEQ ID NO: 234727 - RNA, 19 nt, Human
uagaggagaauggcaaaga

SEQ ID NO: 234728 - RNA, 22 nt, Human
accuccauggcccacaucuagu

SEQ ID NO: 234729 - RNA, 22 nt, Human
auuagugguguauuuggcacua

SEQ ID NO: 234730 - RNA, 22 nt, Human
uuuucaauuuucauuugcaaga

SEQ ID NO: 234731 - RNA, 20 nt, Human
uucacagaucucuaacugag

SEQ ID NO: 234732 - RNA, 22 nt, Human
uuuugcuucuaguauauuuuuu

SEQ ID NO: 234733 - RNA, 22 nt, Human
agcaaaauuccaaaaugcuaau

SEQ ID NO: 234734 - RNA, 22 nt, Human
uauuuuuaccuaauuuaugaga

SEQ ID NO: 234735 - RNA, 22 nt, Human
aucucacuucugucauguggca

SEQ ID NO: 234736 - RNA, 22 nt, Human
uucuuuuaauagagauccugug

SEQ ID NO: 234737 - RNA, 22 nt, Human
uuuuuuaaucaaguaggaaaca

SEQ ID NO: 234738 - RNA, 22 nt, Human
ucugcaugccucaggaggccug

SEQ ID NO: 234739 - RNA, 22 nt, Human
gaggaggcuggagaggccagga

SEQ ID NO: 234740 - RNA, 22 nt, Human
ggagaggaaguuuaaagaauug

SEQ ID NO: 234741 - RNA, 17 nt, Human
ucuuuuacuuucucucc

SEQ ID NO: 234742 - RNA, 22 nt, Human
ccaaggcuguggggcugugcag

SEQ ID NO: 234743 - RNA, 22 nt, Human
auuguuuugugaaacauaguga

SEQ ID NO: 234744 - RNA, 22 nt, Human
aaauuaaaguuuuauuuagagc

SEQ ID NO: 234745 - RNA, 22 nt, Human
gaaccauuuaauggagaugcuc

SEQ ID NO: 234746 - RNA, 22 nt, Human
aagugauuuucccaccaucuac

SEQ ID NO: 234747 - RNA, 22 nt, Human
ugagagggagacagcucuagca

SEQ ID NO: 234748 - RNA, 22 nt, Human
uaaaugauaguauugaagguag

SEQ ID NO: 234749 - RNA, 22 nt, Human
ccugccagaaaagagggaguuc

SEQ ID NO: 234750 - RNA, 22 nt, Human
uucuuuuaauuucugucugcag

SEQ ID NO: 234751 - RNA, 22 nt, Human
uaggauugguguauguagguuu

SEQ ID NO: 234752 - RNA, 22 nt, Human
aaauguuugguggauaaaagga

SEQ ID NO: 234753 - RNA, 22 nt, Human
gcagguggaagcagcagacuca

SEQ ID NO: 234754 - RNA, 22 nt, Human
cagcuggggagagacauggcag

SEQ ID NO: 234755 - RNA, 22 nt, Human
aggcgaagggaccagacgguag

SEQ ID NO: 234756 - RNA, 22 nt, Human
uaaaacuaugcaaccuacuacc

SEQ ID NO: 234757 - RNA, 22 nt, Human
gggcugagagcuggaaucugag

SEQ ID NO: 234758 - RNA, 21 nt, Human
uuccuggaggcagaaacguga

SEQ ID NO: 234759 - RNA, 22 nt, Human
ggaggcccagaaggaagcccag

SEQ ID NO: 234760 - RNA, 22 nt, Human
auuuuguugaaacccuuguugu

SEQ ID NO: 234761 - RNA, 22 nt, Human
ggcugcagggaacaggaugggu

SEQ ID NO: 234762 - RNA, 23 nt, Human
uuucugaguuuuuuaaaagucca

SEQ ID NO: 234763 - RNA, 20 nt, Human
ggcagagcuaugucuguugc

SEQ ID NO: 234764 - RNA, 22 nt, Human
uggguauauauguugcuacaga

SEQ ID NO: 234765 - RNA, 22 nt, Human
ucucucugcuguccagcguuau

SEQ ID NO: 234766 - RNA, 18 nt, Human
guucaagcauuuugcucu

SEQ ID NO: 234767 - RNA, 22 nt, Human
gccucucuggcaaagcggugau

SEQ ID NO: 234768 - RNA, 22 nt, Human
uggcucaguaaucgagucuccu

SEQ ID NO: 234769 - RNA, 20 nt, Human
gaacauaaauaacucuuuac

SEQ ID NO: 234770 - RNA, 22 nt, Human
uucauaugaauuggguuuuuuu

SEQ ID NO: 234771 - RNA, 22 nt, Human
aggcaguggagcuggaauaggc

SEQ ID NO: 234772 - RNA, 22 nt, Human
gcuggggaucgaaggcagagcc

SEQ ID NO: 234773 - RNA, 22 nt, Human
aaugcuuuuugcgaaaugugca

SEQ ID NO: 234774 - RNA, 22 nt, Human
uuuuccuucuuccugccuugcc

SEQ ID NO: 234775 - RNA, 22 nt, Human
uucccugugcaguauguuccaa

SEQ ID NO: 234776 - RNA, 22 nt, Human
agcagggagacagugcagcauu

SEQ ID NO: 234777 - RNA, 22 nt, Human
ggcagagcugugcgcccaccca

SEQ ID NO: 234778 - RNA, 22 nt, Human
guuuuucuuugauuuagaacca

SEQ ID NO: 234779 - RNA, 22 nt, Human
uuuuaaaacaugucaaaaugug

SEQ ID NO: 234780 - RNA, 22 nt, Human
ugcuuucaaaacucagaggaau

SEQ ID NO: 234781 - RNA, 22 nt, Human
agggcaggguuggugcuggugc

SEQ ID NO: 234782 - RNA, 22 nt, Human
uuucuaaaaccagaguuuauaa

SEQ ID NO: 234783 - RNA, 22 nt, Human
ugaggaagugguuguaugguuu

SEQ ID NO: 234784 - RNA, 22 nt, Human
ggcuccaggguaccccuggaug

SEQ ID NO: 234785 - RNA, 22 nt, Human
cucucugcugucuuucgggaaa

SEQ ID NO: 234786 - RNA, 22 nt, Human
uucacugugauguuuaagagaa

SEQ ID NO: 234787 - RNA, 22 nt, Human
uuuuccuuagaaauacauugau

SEQ ID NO: 234788 - RNA, 22 nt, Human
ccuuuuaucgcgaagaacucca

SEQ ID NO: 234789 - RNA, 22 nt, Human
uuuccuaggaaaugauugaagu

SEQ ID NO: 234790 - RNA, 22 nt, Human
uagcacauaguaggcacaggcu

SEQ ID NO: 234791 - RNA, 22 nt, Human
uauuguuuuaagguguauuaau

SEQ ID NO: 234792 - RNA, 22 nt, Human
cugggggacagagagaggcggu

SEQ ID NO: 234793 - RNA, 22 nt, Human
cagggcagaguuaagaugcugg

SEQ ID NO: 234794 - RNA, 22 nt, Human
uaguauuuguaauuaucaaagc

SEQ ID NO: 234795 - RNA, 22 nt, Human
cauaggcucuucagagaacuga

SEQ ID NO: 234796 - RNA, 18 nt, Human
ggccucagccuggccgga

SEQ ID NO: 234797 - RNA, 22 nt, Human
ucugagugacguccugacagga

SEQ ID NO: 234798 - RNA, 22 nt, Human
gcucucuggccugggaggagga

SEQ ID NO: 234799 - RNA, 22 nt, Human
ugaaauuuuuuggagauaauuu

SEQ ID NO: 234800 - RNA, 22 nt, Human
uuuaaaauguuuuauuuauuua

SEQ ID NO: 234801 - RNA, 22 nt, Human
cugucucugauaagcucgaggg

SEQ ID NO: 234802 - RNA, 23 nt, Human
uucuuuccuuaucccauuuacuu

SEQ ID NO: 234803 - RNA, 22 nt, Human
uauuucaugagugaauaucuag

SEQ ID NO: 234804 - RNA, 21 nt, Human
gcagcucaggauauagacuug

SEQ ID NO: 234805 - RNA, 22 nt, Human
ccauuuggccauucaguuguuc

SEQ ID NO: 234806 - RNA, 22 nt, Human
cauuucaaacaguuacagcugc

SEQ ID NO: 234807 - RNA, 22 nt, Human
ugcuuggagaaucagucccagc

SEQ ID NO: 234808 - RNA, 22 nt, Human
uuuacuguuuacagcuaaugca

SEQ ID NO: 234809 - RNA, 22 nt, Human
aacacuaaaggucaguuagaag

SEQ ID NO: 234810 - RNA, 22 nt, Human
uggaguuuuaaucuguacagaa

SEQ ID NO: 234811 - RNA, 22 nt, Human
ggccugcuaccagcugugaccu

SEQ ID NO: 234812 - RNA, 22 nt, Human
uaguggaaccuucuaaaugacg

SEQ ID NO: 234813 - RNA, 22 nt, Human
ugguucuagaugagaugaugag

SEQ ID NO: 234814 - RNA, 22 nt, Human
aaucauaacaaaagcaauuaua

SEQ ID NO: 234815 - RNA, 22 nt, Human
uuucagaaauggcacugaaauc

SEQ ID NO: 234816 - RNA, 22 nt, Human
agugagaguauuaaugugaacu

SEQ ID NO: 234817 - RNA, 22 nt, Human
augggagggagcagugaguguu

SEQ ID NO: 234818 - RNA, 22 nt, Human
ggggaaggaaggggagggcacg

SEQ ID NO: 234819 - RNA, 21 nt, Human
aggugaaggcgagggggacag

SEQ ID NO: 234820 - RNA, 22 nt, Human
guuauuguuauugcguugucga

SEQ ID NO: 234821 - RNA, 22 nt, Human
aaauauuugaaugguguaagau

SEQ ID NO: 234822 - RNA, 22 nt, Human
ucuugugguggaucccucauuu

SEQ ID NO: 234823 - RNA, 22 nt, Human
ugcuuucaaugaauuguauacu

SEQ ID NO: 234824 - RNA, 22 nt, Human
gcucagccuuuuguucuauuca

SEQ ID NO: 234825 - RNA, 22 nt, Human
uauuuaaagucagcaacuuuuc

SEQ ID NO: 234826 - RNA, 22 nt, Human
uucucugcgcuccggcccaguu

SEQ ID NO: 234827 - RNA, 22 nt, Human
cuccucccagcccaggcgccac

SEQ ID NO: 234828 - RNA, 22 nt, Human
gucuuuguaguuuuaauuugag

SEQ ID NO: 234829 - RNA, 22 nt, Human
ugccagcuccgaggagcugcag

SEQ ID NO: 234830 - RNA, 22 nt, Human
gucacuuugcuugcgaugcucc

SEQ ID NO: 234831 - RNA, 22 nt, Human
gcugcaggaggugguagggucu

SEQ ID NO: 234832 - RNA, 22 nt, Human
aggggcugagaguuugaugugg

SEQ ID NO: 234833 - RNA, 22 nt, Human
aggguggaggacaggccaguga

SEQ ID NO: 234834 - RNA, 22 nt, Human
ccccauggaaaacccaccuagg

SEQ ID NO: 234835 - RNA, 22 nt, Human
cuuggggauuuuaaagaccucu

SEQ ID NO: 234836 - RNA, 22 nt, Human
uagcugucauuggaucagaagg

SEQ ID NO: 234837 - RNA, 22 nt, Human
ugugaagaauuaaugugaauca

SEQ ID NO: 234838 - RNA, 22 nt, Human
cagcucugcugggaggaugcag

SEQ ID NO: 234839 - RNA, 22 nt, Human
aaauuuuguugaaaaauauuuu

SEQ ID NO: 234840 - RNA, 22 nt, Human
auauauguauauaugugugugu

SEQ ID NO: 234841 - RNA, 22 nt, Human
uuuguuugcugagugaauucaa

SEQ ID NO: 234842 - RNA, 20 nt, Human
ucacuguaauugccuacauu

SEQ ID NO: 234843 - RNA, 22 nt, Human
ugucuuugaccuuaagaaguuu

SEQ ID NO: 234844 - RNA, 22 nt, Human
auauguuaugccauuuucaagg

SEQ ID NO: 234845 - RNA, 20 nt, Human
aauaaauauaacccauaauu

SEQ ID NO: 234846 - RNA, 23 nt, Human
cagagaaaauagaauaugcugug

SEQ ID NO: 234847 - RNA, 22 nt, Human
ucagcucucucuuggugaucuc

SEQ ID NO: 234848 - RNA, 22 nt, Human
uugucaggaacuaugauuaugc

SEQ ID NO: 234849 - RNA, 22 nt, Human
uuuuuuuuacuccggacagcuc

SEQ ID NO: 234850 - RNA, 22 nt, Human
cagaccuggaaaacaggcuugc

SEQ ID NO: 234851 - RNA, 22 nt, Human
gugaucagaagaaccugccgaa

SEQ ID NO: 234852 - RNA, 22 nt, Human
aguaggauguuuagcccuucuu

SEQ ID NO: 234853 - RNA, 22 nt, Human
uccucccugcacucagugaagu

SEQ ID NO: 234854 - RNA, 22 nt, Human
ggcucagaggagcuggaacggu

SEQ ID NO: 234855 - RNA, 22 nt, Human
cucuuucauucuguccuuguuu

SEQ ID NO: 234856 - RNA, 22 nt, Human
cucuguguguuugugugugugu

SEQ ID NO: 234857 - RNA, 22 nt, Human
caguggagaccugccugcugga

SEQ ID NO: 234858 - RNA, 22 nt, Human
uugccaggggacaucuggagcc

SEQ ID NO: 234859 - RNA, 22 nt, Human
aauaucuugaguuauaaauuca

SEQ ID NO: 234860 - RNA, 22 nt, Human
agagcuccaggguuuuguagug

SEQ ID NO: 234861 - RNA, 22 nt, Human
uuucacuucgaucagaguuuuu

SEQ ID NO: 234862 - RNA, 22 nt, Human
gaggagggagcuggaagcucuu

SEQ ID NO: 234863 - RNA, 22 nt, Human
uucuccaccugcuccucccacc

SEQ ID NO: 234864 - RNA, 23 nt, Human
uugcuuuugccccaaaagaguua

SEQ ID NO: 234865 - RNA, 22 nt, Human
uuauuuuuguaacacuguauag

SEQ ID NO: 234866 - RNA, 22 nt, Human
ggaggccgugcugugcugccag

SEQ ID NO: 234867 - RNA, 22 nt, Human
guaaauaucucacgaaugauuc

SEQ ID NO: 234868 - RNA, 18 nt, Human
aggcuggggaucacaggg

SEQ ID NO: 234869 - RNA, 22 nt, Human
guuuauuucuuaucaucacuau

SEQ ID NO: 234870 - RNA, 22 nt, Human
aauucuguugguuagaguugga

SEQ ID NO: 234871 - RNA, 20 nt, Human
cuccuccccucggccccacc

SEQ ID NO: 234872 - RNA, 22 nt, Human
aaauguauuagccuaugugaga

SEQ ID NO: 234873 - RNA, 22 nt, Human
aauuauguugaaauaugagaac

SEQ ID NO: 234874 - RNA, 22 nt, Human
aauguugaaccuuuuuggccug

SEQ ID NO: 234875 - RNA, 22 nt, Human
aggcauauaguguuuaaaaaaa

SEQ ID NO: 234876 - RNA, 22 nt, Human
cuguguguauaauguuugauaa

SEQ ID NO: 234877 - RNA, 22 nt, Human
uuuaaaacagcauuuaaaaggu

SEQ ID NO: 234878 - RNA, 22 nt, Human
cacugguugccucuuucuguuc

SEQ ID NO: 234879 - RNA, 23 nt, Human
aggcugcagaagaauagggucau

SEQ ID NO: 234880 - RNA, 22 nt, Human
aggggaggcugcgggcugccgu

SEQ ID NO: 234881 - RNA, 22 nt, Human
ucccugcugggcgaucuucucu

SEQ ID NO: 234882 - RNA, 22 nt, Human
ugcccacuucaaaaucuucauu

SEQ ID NO: 234883 - RNA, 22 nt, Human
gcccagccucagggcaucagcu

SEQ ID NO: 234884 - RNA, 22 nt, Human
uuuaucaggccaucuuaugucu

SEQ ID NO: 234885 - RNA, 22 nt, Human
uacaaaugaucaucucuuugaa

SEQ ID NO: 234886 - RNA, 22 nt, Human
auguguguaugacugaaucuau

SEQ ID NO: 234887 - RNA, 22 nt, Human
agugccaucuuuaacuguccca

SEQ ID NO: 234888 - RNA, 22 nt, Human
aaauucuuccaggaggaaauac

SEQ ID NO: 234889 - RNA, 22 nt, Human
aagaggcuacagcccugugucu

SEQ ID NO: 234890 - RNA, 20 nt, Human
uggguucaguuguuucuggc

SEQ ID NO: 234891 - RNA, 22 nt, Human
uuuacaaggcaguuauuuuccu

SEQ ID NO: 234892 - RNA, 22 nt, Human
cccuguccugcuaggcccuggu

SEQ ID NO: 234893 - RNA, 19 nt, Human
agcaucuccacagaaaaag

SEQ ID NO: 234894 - RNA, 17 nt, Human
ucuguguccgcucaguc

SEQ ID NO: 234895 - RNA, 22 nt, Human
uccuuuauuuaugggcagugua

SEQ ID NO: 234896 - RNA, 22 nt, Human
uuguuuucuaguguuuugaaua

SEQ ID NO: 234897 - RNA, 22 nt, Human
cuccaugagccaggagggcuac

SEQ ID NO: 234898 - RNA, 22 nt, Human
aagccucaugccagauccaggu

SEQ ID NO: 234899 - RNA, 22 nt, Human
uuccgcuuucaauggcuuggcu

SEQ ID NO: 234900 - RNA, 22 nt, Human
uguguuguuuggggauguccau

SEQ ID NO: 234901 - RNA, 17 nt, Human
ugucuuuuuccuccucc

SEQ ID NO: 234902 - RNA, 22 nt, Human
uuuuuaaaauuaggacggcacg

SEQ ID NO: 234903 - RNA, 22 nt, Human
augaaaacggaccagagcuauu

SEQ ID NO: 234904 - RNA, 22 nt, Human
cuguggcuaggaagcuguggga

SEQ ID NO: 234905 - RNA, 22 nt, Human
cuaaaccaauauauuuucuucc

SEQ ID NO: 234906 - RNA, 22 nt, Human
gggggagcuacaggucccuugg

SEQ ID NO: 234907 - RNA, 22 nt, Human
uugccaggagacaucuggagcc

SEQ ID NO: 234908 - RNA, 22 nt, Human
uuuguacuuucuaauguauuua

SEQ ID NO: 234909 - RNA, 22 nt, Human
ggaggccagagaagagccaggc

SEQ ID NO: 234910 - RNA, 22 nt, Human
uaauaaaaauuuaauucacauu

SEQ ID NO: 234911 - RNA, 20 nt, Human
cuuauuuuggagaacuuuuc

SEQ ID NO: 234912 - RNA, 22 nt, Human
gagggaggugacaaggacauag

SEQ ID NO: 234913 - RNA, 22 nt, Human
uauuuuauuuagguuuaguugu

SEQ ID NO: 234914 - RNA, 22 nt, Human
uuuauaauuacguaaaauauuu

SEQ ID NO: 234915 - RNA, 22 nt, Human
uuaacauuguccuuagcagauu

SEQ ID NO: 234916 - RNA, 22 nt, Human
uugaaaauuaauagguguacaa

SEQ ID NO: 234917 - RNA, 21 nt, Human
caguucuaagugucaucuuuu

SEQ ID NO: 234918 - RNA, 22 nt, Human
gaauucuaguucuguaucucug

SEQ ID NO: 234919 - RNA, 22 nt, Human
uucauuagcacauuuccuuggu

SEQ ID NO: 234920 - RNA, 22 nt, Human
uauuaaaagagaaaaagccacc

SEQ ID NO: 234921 - RNA, 22 nt, Human
ugaauucaaacuuuuuaacaag

SEQ ID NO: 234922 - RNA, 22 nt, Human
ugauucacagacuucacaaggc

SEQ ID NO: 234923 - RNA, 22 nt, Human
uggcucagcgcggccuggucuu

SEQ ID NO: 234924 - RNA, 22 nt, Human
gugguuuagccuucauuaaccu

SEQ ID NO: 234925 - RNA, 22 nt, Human
ccagggaggucauagugcuggu

SEQ ID NO: 234926 - RNA, 22 nt, Human
acauaaaccccccuuccccagg

SEQ ID NO: 234927 - RNA, 22 nt, Human
auuuaaaaacugguacaacagg

SEQ ID NO: 234928 - RNA, 17 nt, Human
uuagagcuacauguuga

SEQ ID NO: 234929 - RNA, 22 nt, Human
uuuauuuuccaugucucuaggu

SEQ ID NO: 234930 - RNA, 19 nt, Human
ggaggguguccucaguguc

SEQ ID NO: 234931 - RNA, 22 nt, Human
cuucuuucuuuucuucuucucu

SEQ ID NO: 234932 - RNA, 22 nt, Human
uuggugauguagcagcaauugu

SEQ ID NO: 234933 - RNA, 22 nt, Human
auacaucuuaacgcgcucuugg

SEQ ID NO: 234934 - RNA, 22 nt, Human
acuuuuccuggguagcuccugg

SEQ ID NO: 234935 - RNA, 22 nt, Human
cccagagggcugaggauaugaa

SEQ ID NO: 234936 - RNA, 22 nt, Human
uggccccauuuuucuggagccu

SEQ ID NO: 234937 - RNA, 22 nt, Human
ggagcucacuacgaaauaagcu

SEQ ID NO: 234938 - RNA, 22 nt, Human
agucacuguucugucaugucaa

SEQ ID NO: 234939 - RNA, 22 nt, Human
aaggucuucgaaccuuauguua

SEQ ID NO: 234940 - RNA, 22 nt, Human
gcuguggagaagcugccuaugg

SEQ ID NO: 234941 - RNA, 20 nt, Human
aggggcuguaguuagaugac

SEQ ID NO: 234942 - RNA, 22 nt, Human
aaggugggacugagaggggaca

SEQ ID NO: 234943 - RNA, 22 nt, Human
guguucuuuguagaggaucuug

SEQ ID NO: 234944 - RNA, 22 nt, Human
ccagcugggucccugcuggggc

SEQ ID NO: 234945 - RNA, 22 nt, Human
cagaccagaaggaagccgacaa

SEQ ID NO: 234946 - RNA, 22 nt, Human
ugggggagggagaguugauggg

SEQ ID NO: 234947 - RNA, 22 nt, Human
auagggaggcggagggagcugg

SEQ ID NO: 234948 - RNA, 22 nt, Human
ugugucuuuggcgaugucugga

SEQ ID NO: 234949 - RNA, 22 nt, Human
ccagcaggagacuagcaacaua

SEQ ID NO: 234950 - RNA, 22 nt, Human
ucagccuugguuuugguguugg

SEQ ID NO: 234951 - RNA, 22 nt, Human
uguccuuuauauguuuuuuagu

SEQ ID NO: 234952 - RNA, 22 nt, Human
ucacucuuuaucuuuuaugucu

SEQ ID NO: 234953 - RNA, 23 nt, Human
uuuuccaaaucgacucucuaguu

SEQ ID NO: 234954 - RNA, 19 nt, Human
agcucaggcccaucguccc

SEQ ID NO: 234955 - RNA, 22 nt, Human
uugauagauuuuagaggcaggc

SEQ ID NO: 234956 - RNA, 22 nt, Human
ucgcccagguuggagugcagug

SEQ ID NO: 234957 - RNA, 22 nt, Human
uuaucuuuuaaaaacacuugug

SEQ ID NO: 234958 - RNA, 22 nt, Human
cagagcugucauuugccaguga

SEQ ID NO: 234959 - RNA, 22 nt, Human
auucuucauguugaagcuguca

SEQ ID NO: 234960 - RNA, 22 nt, Human
uuguuauaggaucagugucacu

SEQ ID NO: 234961 - RNA, 22 nt, Human
agauucucccuccuggcgcugu

SEQ ID NO: 234962 - RNA, 22 nt, Human
cuguggcugcgcccugggggag

SEQ ID NO: 234963 - RNA, 22 nt, Human
uauaagaaaagucauuaucaaa

SEQ ID NO: 234964 - RNA, 22 nt, Human
cacugcacuccagccugggcaa

SEQ ID NO: 234965 - RNA, 22 nt, Human
cuuuaaaaauguauuuuugugg

SEQ ID NO: 234966 - RNA, 22 nt, Human
agucaccuacagcucaugcuuc

SEQ ID NO: 234967 - RNA, 22 nt, Human
uggaaaauuuagaaagauuuau

SEQ ID NO: 234968 - RNA, 22 nt, Human
guccuguguaaguacuugcuca

SEQ ID NO: 234969 - RNA, 22 nt, Human
ucauuauuuugauguauuuccu

SEQ ID NO: 234970 - RNA, 22 nt, Human
aggauggauagcaaggaagccg

SEQ ID NO: 234971 - RNA, 22 nt, Human
agauggaggaaagcaguuagaa

SEQ ID NO: 234972 - RNA, 22 nt, Human
guuguuuucagcccagcauuag

SEQ ID NO: 234973 - RNA, 22 nt, Human
augaagguggacagauuuuuuu

SEQ ID NO: 234974 - RNA, 22 nt, Human
uuuucucaguuuuuuucaaaag

SEQ ID NO: 234975 - RNA, 22 nt, Human
agguggucccaauggcugggca

SEQ ID NO: 234976 - RNA, 22 nt, Human
uguacauacauagauauacaca

SEQ ID NO: 234977 - RNA, 22 nt, Human
uuuucacugacuuggucuggaa

SEQ ID NO: 234978 - RNA, 22 nt, Human
uuuucucuuugcuucucuaaaa

SEQ ID NO: 234979 - RNA, 22 nt, Human
acauauaugugcauacaacuau

SEQ ID NO: 234980 - RNA, 22 nt, Human
auuucacucuuaauugcuuccu

SEQ ID NO: 234981 - RNA, 22 nt, Human
uggcucaggccuacgacgccuu

SEQ ID NO: 234982 - RNA, 22 nt, Human
uacagaccaguaguucucagcg

SEQ ID NO: 234983 - RNA, 22 nt, Human
gagaaaaauuucuuugcugcac

SEQ ID NO: 234984 - RNA, 22 nt, Human
cguuuugaguagauagccauau

SEQ ID NO: 234985 - RNA, 22 nt, Human
gcagaggcugccgugggcagga

SEQ ID NO: 234986 - RNA, 21 nt, Human
uuucauuaguacaucaauuug

SEQ ID NO: 234987 - RNA, 22 nt, Human
agagacaggguuuugucguguu

SEQ ID NO: 234988 - RNA, 22 nt, Human
ccagucuuggugucuguagcac

SEQ ID NO: 234989 - RNA, 19 nt, Human
acuggggcaggcugggcuu

SEQ ID NO: 234990 - RNA, 22 nt, Human
uuauuuuauaaagagaagacuu

SEQ ID NO: 234991 - RNA, 22 nt, Human
agucccugauggacuggaugag

SEQ ID NO: 234992 - RNA, 22 nt, Human
acuguugagggaagcagaugaa

SEQ ID NO: 234993 - RNA, 22 nt, Human
gaggagcugggucagggagaca

SEQ ID NO: 234994 - RNA, 22 nt, Human
uggaggcccagcugggggccgg

SEQ ID NO: 234995 - RNA, 22 nt, Human
uuguuauuauuauuuucguucu

SEQ ID NO: 234996 - RNA, 20 nt, Human
cauuccaugcaucuuggucc

SEQ ID NO: 234997 - RNA, 22 nt, Human
aacgagcugggggggccggggg

SEQ ID NO: 234998 - RNA, 22 nt, Human
guggaaggaauuaacagacuag

SEQ ID NO: 234999 - RNA, 22 nt, Human
gggcagagagcuggaacuccuu

SEQ ID NO: 235000 - RNA, 18 nt, Human
auucauuugcguuuggcu

SEQ ID NO: 235001 - RNA, 22 nt, Human
gaauuccaggugagagaaggua

SEQ ID NO: 235002 - RNA, 22 nt, Human
uuauuuaagaucuuaauauaua

SEQ ID NO: 235003 - RNA, 22 nt, Human
gcucagagaaaacuggggcuug

SEQ ID NO: 235004 - RNA, 22 nt, Human
aguaaaugaaagcaauuuuaga

SEQ ID NO: 235005 - RNA, 22 nt, Human
aaauauagugacacuuauaguc

SEQ ID NO: 235006 - RNA, 22 nt, Human
ucucucucucuuccagcauguu

SEQ ID NO: 235007 - RNA, 19 nt, Human
ucaggaggucgaccuggca

SEQ ID NO: 235008 - RNA, 22 nt, Human
aauauuuugggacugaggaauu

SEQ ID NO: 235009 - RNA, 22 nt, Human
gguagacugagcuccuugagga

SEQ ID NO: 235010 - RNA, 22 nt, Human
guuuucuccugcuauacagugc

SEQ ID NO: 235011 - RNA, 22 nt, Human
uacuauuuugacaugaaauuga

SEQ ID NO: 235012 - RNA, 22 nt, Human
gaggcaggaagggaggguugug

SEQ ID NO: 235013 - RNA, 22 nt, Human
ugggcagggagcuggaaccaca

SEQ ID NO: 235014 - RNA, 22 nt, Human
auggugaugaugaugaugauaa

SEQ ID NO: 235015 - RNA, 22 nt, Human
ggcagggagagcgccgccaugc

SEQ ID NO: 235016 - RNA, 22 nt, Human
aacugcauaagcuucgggaccu

SEQ ID NO: 235017 - RNA, 22 nt, Human
gccugggguuugcggggcugca

SEQ ID NO: 235018 - RNA, 22 nt, Human
ccuucugcuggucaucccagug

SEQ ID NO: 235019 - RNA, 22 nt, Human
aagugugugugcgcaugugcau

SEQ ID NO: 235020 - RNA, 22 nt, Human
ugagguauuuggauuuauauuu

SEQ ID NO: 235021 - RNA, 22 nt, Human
gauuuuaaaagauguauaaggu

SEQ ID NO: 235022 - RNA, 22 nt, Human
uacauuugauuuuugcuucuuu

SEQ ID NO: 235023 - RNA, 22 nt, Human
aggcaguguggagggcuguugc

SEQ ID NO: 235024 - RNA, 21 nt, Human
agaugaggauacugaggccua

SEQ ID NO: 235025 - RNA, 22 nt, Human
gcuggccugcgagggcaggcug

SEQ ID NO: 235026 - RNA, 23 nt, Human
ucagaccaaccucuugcuggaac

SEQ ID NO: 235027 - RNA, 21 nt, Human
cuauaaaaaugguucuuugcg

SEQ ID NO: 235028 - RNA, 22 nt, Human
cccagaggcugaguugggagca

SEQ ID NO: 235029 - RNA, 22 nt, Human
guuuaaaagcaaccaacaggcu

SEQ ID NO: 235030 - RNA, 22 nt, Human
cugcugugcagacagacucucu

SEQ ID NO: 235031 - RNA, 22 nt, Human
ggcagucuuucccuugagcucu

SEQ ID NO: 235032 - RNA, 22 nt, Human
uggaugccuugggggaggagga

SEQ ID NO: 235033 - RNA, 22 nt, Human
uauuuucucugccacacuucca

SEQ ID NO: 235034 - RNA, 22 nt, Human
uuuaaucaguugguaauauuga

SEQ ID NO: 235035 - RNA, 22 nt, Human
uucuagcucauggugacagauc

SEQ ID NO: 235036 - RNA, 19 nt, Human
gauauugagcugagaauuc

SEQ ID NO: 235037 - RNA, 22 nt, Human
uugucuuucguauggaacacua

SEQ ID NO: 235038 - RNA, 22 nt, Human
uuauuuuuguuuguuaagccua

SEQ ID NO: 235039 - RNA, 22 nt, Human
gaggugauuccucccauguaau

SEQ ID NO: 235040 - RNA, 22 nt, Human
uuauauuuuauuuaauuaaaua

SEQ ID NO: 235041 - RNA, 22 nt, Human
caauccccaggucccagaacag

SEQ ID NO: 235042 - RNA, 22 nt, Human
agccccaauuacagcugugcug

SEQ ID NO: 235043 - RNA, 22 nt, Human
gaggcucagagggacuuucaag

SEQ ID NO: 235044 - RNA, 22 nt, Human
ggcuagggagacagagggcaug

SEQ ID NO: 235045 - RNA, 22 nt, Human
caggccccagggacugggcgcu

SEQ ID NO: 235046 - RNA, 22 nt, Human
ucccuguggauuaaggagaugu

SEQ ID NO: 235047 - RNA, 22 nt, Human
ucgagcucagcagggaggugcg

SEQ ID NO: 235048 - RNA, 22 nt, Human
gggcaagaagcuggaagcauuc

SEQ ID NO: 235049 - RNA, 22 nt, Human
gcuggaaauaacuuguguagaa

SEQ ID NO: 235050 - RNA, 22 nt, Human
uggguucaaauccugguuccac

SEQ ID NO: 235051 - RNA, 20 nt, Human
ucucuuuuucuucuuuucuc

SEQ ID NO: 235052 - RNA, 22 nt, Human
ggcugggagguggcgaggaggc

SEQ ID NO: 235053 - RNA, 21 nt, Human
uccccugugccuggcauacag

SEQ ID NO: 235054 - RNA, 21 nt, Human
auauuguugggguuuucuuuu

SEQ ID NO: 235055 - RNA, 22 nt, Human
ccuaggcuggcugucuucaggu

SEQ ID NO: 235056 - RNA, 22 nt, Human
cggcugcagcggagcaggcugg

SEQ ID NO: 235057 - RNA, 22 nt, Human
aaauguaaacuguauuuauaaa

SEQ ID NO: 235058 - RNA, 22 nt, Human
uauuuuaaaagcauuaauucuu

SEQ ID NO: 235059 - RNA, 22 nt, Human
cagcuguggagauggggugcau

SEQ ID NO: 235060 - RNA, 22 nt, Human
acauuccugaagguaaugagaa

SEQ ID NO: 235061 - RNA, 22 nt, Human
auuuuagagaaacaaacguagg

SEQ ID NO: 235062 - RNA, 22 nt, Human
gccagggcucgagcaggccagc

SEQ ID NO: 235063 - RNA, 22 nt, Human
guuuauucuuuuauuugugaga

SEQ ID NO: 235064 - RNA, 22 nt, Human
cuguuaauugugaauuuuacau

SEQ ID NO: 235065 - RNA, 22 nt, Human
ggggcucauuugcaggggggag

SEQ ID NO: 235066 - RNA, 22 nt, Human
ggcugugguggacgcgggaaac

SEQ ID NO: 235067 - RNA, 22 nt, Human
uguaaauucuauacacuuaaaa

SEQ ID NO: 235068 - RNA, 22 nt, Human
aggggaggcugggcuggggggc

SEQ ID NO: 235069 - RNA, 22 nt, Human
gggggcagguuccaggccagcu

SEQ ID NO: 235070 - RNA, 22 nt, Human
cuacuucucccuagaucagaaa

SEQ ID NO: 235071 - RNA, 22 nt, Human
uuuuaaauggcuuuuacuuuuc

SEQ ID NO: 235072 - RNA, 21 nt, Human
gggagaguagcgguagggagg

SEQ ID NO: 235073 - RNA, 22 nt, Human
uucauagaagggaguuuuuccu

SEQ ID NO: 235074 - RNA, 22 nt, Human
cuggaagcgucggaggaagggc

SEQ ID NO: 235075 - RNA, 22 nt, Human
gcucagcuggagagggacgggu

SEQ ID NO: 235076 - RNA, 22 nt, Human
auauucaaugaggucauauaag

SEQ ID NO: 235077 - RNA, 22 nt, Human
cucagcgagggaaagaggccgc

SEQ ID NO: 235078 - RNA, 22 nt, Human
uuuuagaagcauuuaugagauu

SEQ ID NO: 235079 - RNA, 22 nt, Human
uggggagacauggaguaaaaga

SEQ ID NO: 235080 - RNA, 22 nt, Human
uucuucuucuuccucauccuca

SEQ ID NO: 235081 - RNA, 22 nt, Human
uuguuuuaguagaaguuacaug

SEQ ID NO: 235082 - RNA, 22 nt, Human
uuuuguuuacauuaaauuuuga

SEQ ID NO: 235083 - RNA, 22 nt, Human
guugagaaucucuagcuuagga

SEQ ID NO: 235084 - RNA, 22 nt, Human
ucuuucugaugggaagggucaa

SEQ ID NO: 235085 - RNA, 21 nt, Human
ugagcccaaagcuguauuggu

SEQ ID NO: 235086 - RNA, 22 nt, Human
uuuuucuuugcuuuccacuggc

SEQ ID NO: 235087 - RNA, 22 nt, Human
ggaggaagagaccagggggcuu

SEQ ID NO: 235088 - RNA, 22 nt, Human
gggagguaaugggggugcaggg

SEQ ID NO: 235089 - RNA, 22 nt, Human
ggcuggagcaggcugcacagug

SEQ ID NO: 235090 - RNA, 22 nt, Human
uguauuuuuucccugaaauaaa

SEQ ID NO: 235091 - RNA, 22 nt, Human
aacccugaacuuaguucuagga

SEQ ID NO: 235092 - RNA, 22 nt, Human
uggggcugguaccguaauauau

SEQ ID NO: 235093 - RNA, 22 nt, Human
gcuuucacugcaauagaugaau

SEQ ID NO: 235094 - RNA, 22 nt, Human
auuuuacuaugauaguugagaa

SEQ ID NO: 235095 - RNA, 22 nt, Human
agcugaggccccgcagcagggu

SEQ ID NO: 235096 - RNA, 22 nt, Human
ucacaucugugugauugucauu

SEQ ID NO: 235097 - RNA, 22 nt, Human
acuuuauacuagugauaguuug

SEQ ID NO: 235098 - RNA, 22 nt, Human
uuaggggcuuaggcagaguuug

SEQ ID NO: 235099 - RNA, 22 nt, Human
uuauuugcccauguuuagcaga

SEQ ID NO: 235100 - RNA, 20 nt, Human
ucugugugccaucaccuaac

SEQ ID NO: 235101 - RNA, 22 nt, Human
uacugcaguuccugcugucucc

SEQ ID NO: 235102 - RNA, 22 nt, Human
uuuuccuuccugucucuuuauu

SEQ ID NO: 235103 - RNA, 22 nt, Human
ucuucaugaaauugauugcuua

SEQ ID NO: 235104 - RNA, 22 nt, Human
uggucuuuccuucauuguccag

SEQ ID NO: 235105 - RNA, 18 nt, Human
uucaggcucuugcaugaa

SEQ ID NO: 235106 - RNA, 22 nt, Human
agggggaauccugcuuauggau

SEQ ID NO: 235107 - RNA, 22 nt, Human
aaaugcuuuaauugaguucaug

SEQ ID NO: 235108 - RNA, 22 nt, Human
ucagucucuggggcuucuguuu

SEQ ID NO: 235109 - RNA, 22 nt, Human
agggcaguuuuacugaaaggug

SEQ ID NO: 235110 - RNA, 22 nt, Human
uguugaagcaccucugucuuuc

SEQ ID NO: 235111 - RNA, 22 nt, Human
ugggcagggauuuggggaaacu

SEQ ID NO: 235112 - RNA, 22 nt, Human
auuuucuucauuuugauuguau

SEQ ID NO: 235113 - RNA, 22 nt, Human
cuuucuuucaaguucugcuuua

SEQ ID NO: 235114 - RNA, 22 nt, Human
gucuuucuuuuacauauuugug

SEQ ID NO: 235115 - RNA, 22 nt, Human
uucaaaaugcagaauaguuugg

SEQ ID NO: 235116 - RNA, 22 nt, Human
uaauauaacugccaguuaaggu

SEQ ID NO: 235117 - RNA, 22 nt, Human
cacagcuggggaagcugaggcc

SEQ ID NO: 235118 - RNA, 22 nt, Human
uuauuuuuaggaauguagaggu

SEQ ID NO: 235119 - RNA, 22 nt, Human
ccucaggaauuuauucuucugu

SEQ ID NO: 235120 - RNA, 22 nt, Human
guccccugcguguucauccugg

SEQ ID NO: 235121 - RNA, 22 nt, Human
auagagcuggggaagaagcugg

SEQ ID NO: 235122 - RNA, 22 nt, Human
guggguauauauaugugugcug

SEQ ID NO: 235123 - RNA, 17 nt, Human
auucaugaacauguccu

SEQ ID NO: 235124 - RNA, 22 nt, Human
ggggaggugugcaggacaccuc

SEQ ID NO: 235125 - RNA, 22 nt, Human
guuuggguggcuagagaaagaa

SEQ ID NO: 235126 - RNA, 22 nt, Human
uuagaaauguccuacuaauaug

SEQ ID NO: 235127 - RNA, 22 nt, Human
uucuaauauuaugauuucuaag

SEQ ID NO: 235128 - RNA, 22 nt, Human
ugcuuucagauaucuguuucaa

SEQ ID NO: 235129 - RNA, 22 nt, Human
acgugugugugcacguguguau

SEQ ID NO: 235130 - RNA, 22 nt, Human
gggagggucugagagcugcacc

SEQ ID NO: 235131 - RNA, 22 nt, Human
guuuccaggcuuugguaugguu

SEQ ID NO: 235132 - RNA, 20 nt, Human
uuguacuuaugugagaagga

SEQ ID NO: 235133 - RNA, 22 nt, Human
uuuucauagccagaaacugaaa

SEQ ID NO: 235134 - RNA, 22 nt, Human
uggagccugauggauaggaacg

SEQ ID NO: 235135 - RNA, 22 nt, Human
auucauucugaccucaagagaa

SEQ ID NO: 235136 - RNA, 22 nt, Human
cacauuuuccagaagaaucaga

SEQ ID NO: 235137 - RNA, 22 nt, Human
cugcaucacagcaggaggcaca

SEQ ID NO: 235138 - RNA, 22 nt, Human
ggcuguggcagcuggaaguggu

SEQ ID NO: 235139 - RNA, 22 nt, Human
gaggcuugccacuguccauggc

SEQ ID NO: 235140 - RNA, 22 nt, Human
aaugaauaaauuuuaaagacag

SEQ ID NO: 235141 - RNA, 22 nt, Human
acagagcucccagccaucuccu

SEQ ID NO: 235142 - RNA, 23 nt, Human
caggggacaggugaccugggcuc

SEQ ID NO: 235143 - RNA, 22 nt, Human
gacuggggcauuagaguagcuu

SEQ ID NO: 235144 - RNA, 22 nt, Human
uuuauguuuguuuuugaaauaa

SEQ ID NO: 235145 - RNA, 22 nt, Human
uuuuaaaguaauugaagcuugu

SEQ ID NO: 235146 - RNA, 22 nt, Human
uacuuuaauugcaaaaauaaau

SEQ ID NO: 235147 - RNA, 22 nt, Human
guucaaucucucaugcauuuuc

SEQ ID NO: 235148 - RNA, 22 nt, Human
uccauguauugcuaacaaauag

SEQ ID NO: 235149 - RNA, 22 nt, Human
augaggaacagcaagaauauuu

SEQ ID NO: 235150 - RNA, 22 nt, Human
auuuuuauuugccuaugauaua

SEQ ID NO: 235151 - RNA, 22 nt, Human
agauggggccugaggacacugu

SEQ ID NO: 235152 - RNA, 22 nt, Human
uauuucuagggcaugaaaauaa

SEQ ID NO: 235153 - RNA, 22 nt, Human
ugggggaggaggagacagacug

SEQ ID NO: 235154 - RNA, 22 nt, Human
gaagaaggaagaucaugcuuga

SEQ ID NO: 235155 - RNA, 22 nt, Human
uucauggauuugugaaauuuag

SEQ ID NO: 235156 - RNA, 22 nt, Human
uucuuuucuucccuguuuauua

SEQ ID NO: 235157 - RNA, 22 nt, Human
uauaaagaccuuauccuucaua

SEQ ID NO: 235158 - RNA, 22 nt, Human
gaaacauuuguugaguacuugc

SEQ ID NO: 235159 - RNA, 22 nt, Human
uuauuucaggcauuuguaaaug

SEQ ID NO: 235160 - RNA, 22 nt, Human
aucauguauauuuuugcuauua

SEQ ID NO: 235161 - RNA, 22 nt, Human
cauuuugguaauguucguuugc

SEQ ID NO: 235162 - RNA, 22 nt, Human
aagcucuuuccacuaaaccacu

SEQ ID NO: 235163 - RNA, 22 nt, Human
aaugauuuucugcaaacaguga

SEQ ID NO: 235164 - RNA, 22 nt, Human
cuaaauucuauauccuugcuuc

SEQ ID NO: 235165 - RNA, 22 nt, Human
cuccacagccccuccaguggca

SEQ ID NO: 235166 - RNA, 22 nt, Human
gggagccucccacugggggaag

SEQ ID NO: 235167 - RNA, 22 nt, Human
auuuucauauggguuauuugua

SEQ ID NO: 235168 - RNA, 22 nt, Human
ucccuucccaccccugccuuuu

SEQ ID NO: 235169 - RNA, 22 nt, Human
cuccugcuuuuucuucuuccga

SEQ ID NO: 235170 - RNA, 22 nt, Human
guuuuaucuauguaauuauaaa

SEQ ID NO: 235171 - RNA, 22 nt, Human
ucauuguuuacugucuuuuuuc

SEQ ID NO: 235172 - RNA, 22 nt, Human
caaaucuguuaauuucaaguug

SEQ ID NO: 235173 - RNA, 22 nt, Human
gucuugugaagacggcagaaag

SEQ ID NO: 235174 - RNA, 22 nt, Human
ucuuuuucccugguuccuuuuu

SEQ ID NO: 235175 - RNA, 22 nt, Human
agagggagagauuggcaaucag

SEQ ID NO: 235176 - RNA, 22 nt, Human
auguacugacuguacuuuuaaa

SEQ ID NO: 235177 - RNA, 22 nt, Human
ugguugauuaauuuugccaagc

SEQ ID NO: 235178 - RNA, 22 nt, Human
guuauuuugucuuguucaugaa

SEQ ID NO: 235179 - RNA, 22 nt, Human
uuggugaugcccaccuuuucau

SEQ ID NO: 235180 - RNA, 22 nt, Human
uggacacugguggauauggaau

SEQ ID NO: 235181 - RNA, 22 nt, Human
cugccucucaugccugcuugcu

SEQ ID NO: 235182 - RNA, 21 nt, Human
guucuuaguuauauucucaau

SEQ ID NO: 235183 - RNA, 22 nt, Human
ggggaggguuuggaugagaguc

SEQ ID NO: 235184 - RNA, 22 nt, Human
uaaaaucaugacagauugacau

SEQ ID NO: 235185 - RNA, 22 nt, Human
uucaugucuuugauucugauaa

SEQ ID NO: 235186 - RNA, 22 nt, Human
aucguuaugauagagaaagaga

SEQ ID NO: 235187 - RNA, 22 nt, Human
caauggagccaagaggaggaaa

SEQ ID NO: 235188 - RNA, 22 nt, Human
uccagcugugcuccaggaggug

SEQ ID NO: 235189 - RNA, 20 nt, Human
uuggagaucacguguccagg

SEQ ID NO: 235190 - RNA, 22 nt, Human
uuaucaaaaaauaguacuuuga

SEQ ID NO: 235191 - RNA, 22 nt, Human
gagggggaaaagggcagcagag

SEQ ID NO: 235192 - RNA, 22 nt, Human
uuuuuaaaagaugauuuaauga

SEQ ID NO: 235193 - RNA, 22 nt, Human
aggcuccucugggggccccgga

SEQ ID NO: 235194 - RNA, 20 nt, Human
gacaugagggagcaaagagc

SEQ ID NO: 235195 - RNA, 22 nt, Human
ccucccuucccggcauggcucu

SEQ ID NO: 235196 - RNA, 22 nt, Human
cuguuucucugccugcacacau

SEQ ID NO: 235197 - RNA, 22 nt, Human
ggcuggggccuguugaagaugc

SEQ ID NO: 235198 - RNA, 22 nt, Human
uauauuaaagugcuuugcagug

SEQ ID NO: 235199 - RNA, 22 nt, Human
ucuccucucugaucuugcuccg

SEQ ID NO: 235200 - RNA, 22 nt, Human
ugagggaguguggauacaguag

SEQ ID NO: 235201 - RNA, 20 nt, Human
ucagugggaaagugagagug

SEQ ID NO: 235202 - RNA, 22 nt, Human
auuuucuugucucuguuguagg

SEQ ID NO: 235203 - RNA, 22 nt, Human
uugcuuucuuuguagguuuucc

SEQ ID NO: 235204 - RNA, 22 nt, Human
uuauuuaaguauuuauugaagu

SEQ ID NO: 235205 - RNA, 22 nt, Human
uaguuucuucaacugucccagc

SEQ ID NO: 235206 - RNA, 22 nt, Human
acucugcaguaaggaauuguuu

SEQ ID NO: 235207 - RNA, 22 nt, Human
caauaccucuuggugauugggc

SEQ ID NO: 235208 - RNA, 22 nt, Human
agcggccucgcugccugcucag

SEQ ID NO: 235209 - RNA, 22 nt, Human
uucaaacaguguagaauauaug

SEQ ID NO: 235210 - RNA, 22 nt, Human
acuggagcccguggaggcgcag

SEQ ID NO: 235211 - RNA, 22 nt, Human
acugucuuguuguaugugagcu

SEQ ID NO: 235212 - RNA, 22 nt, Human
cucugugucugauucugggaag

SEQ ID NO: 235213 - RNA, 22 nt, Human
caguagcuuuuugcagacaaga

SEQ ID NO: 235214 - RNA, 22 nt, Human
augggagggugaggaggcagcu

SEQ ID NO: 235215 - RNA, 22 nt, Human
uuauuguuuggguauaauuuga

SEQ ID NO: 235216 - RNA, 22 nt, Human
gaggccagcacccagaugcaug

SEQ ID NO: 235217 - RNA, 19 nt, Human
uccuacaugagacagagag

SEQ ID NO: 235218 - RNA, 22 nt, Human
guuguuuuuguuaaaacaguga

SEQ ID NO: 235219 - RNA, 22 nt, Human
gcugucccccaaagaugcuccu

SEQ ID NO: 235220 - RNA, 22 nt, Human
guucuacaugacacucaacauu

SEQ ID NO: 235221 - RNA, 22 nt, Human
uucucuugccuucucuuuuauc

SEQ ID NO: 235222 - RNA, 22 nt, Human
ggcaaggaagaaagcagaaguu

SEQ ID NO: 235223 - RNA, 22 nt, Human
cagggggacuuguuagguuuua

SEQ ID NO: 235224 - RNA, 22 nt, Human
auucuuuucucuaaaugaugaa

SEQ ID NO: 235225 - RNA, 22 nt, Human
gaauauuuaucucagcugcaga

SEQ ID NO: 235226 - RNA, 22 nt, Human
uaauuccacacucccgcaagcg

SEQ ID NO: 235227 - RNA, 18 nt, Human
cccagaggaaugccugga

SEQ ID NO: 235228 - RNA, 22 nt, Human
agggagucuggccgucggcugg

SEQ ID NO: 235229 - RNA, 22 nt, Human
aggauggaaguaacuggauaau

SEQ ID NO: 235230 - RNA, 20 nt, Human
uaguggaccuugaaggccuc

SEQ ID NO: 235231 - RNA, 22 nt, Human
gucucacuucauuuucuuagcc

SEQ ID NO: 235232 - RNA, 22 nt, Human
agcaagggucucucauggcuug

SEQ ID NO: 235233 - RNA, 22 nt, Human
gagcagcucgagaaggaagcag

SEQ ID NO: 235234 - RNA, 22 nt, Human
auauuuuugcagaauuuuucgu

SEQ ID NO: 235235 - RNA, 22 nt, Human
agcuuucuauauaugaguugcu

SEQ ID NO: 235236 - RNA, 22 nt, Human
cauaaauuuuaccuuguaagug

SEQ ID NO: 235237 - RNA, 22 nt, Human
acauuuuaaaaacaguaccugg

SEQ ID NO: 235238 - RNA, 22 nt, Human
uuuugaauaauucagaaacagc

SEQ ID NO: 235239 - RNA, 22 nt, Human
auguaugagagauucuuuuauu

SEQ ID NO: 235240 - RNA, 22 nt, Human
ggugaguagaaguaguuggcuu

SEQ ID NO: 235241 - RNA, 22 nt, Human
cauggcggcgcucucccugccu

SEQ ID NO: 235242 - RNA, 18 nt, Human
acaaaaauagugcuuugg

SEQ ID NO: 235243 - RNA, 23 nt, Human
aaggugaagccaccaggugagga

SEQ ID NO: 235244 - RNA, 22 nt, Human
uguguuguuggggauguuuuca

SEQ ID NO: 235245 - RNA, 20 nt, Human
acuagaaagucacugggggg

SEQ ID NO: 235246 - RNA, 22 nt, Human
ugucccaucacagaggagacua

SEQ ID NO: 235247 - RNA, 22 nt, Human
gcuguggaaaaugggucuccaa

SEQ ID NO: 235248 - RNA, 22 nt, Human
aagugaggagaccucuucuuca

SEQ ID NO: 235249 - RNA, 22 nt, Human
auggagugggaggacaugaagg

SEQ ID NO: 235250 - RNA, 22 nt, Human
caaauguuugguggcauuuugu

SEQ ID NO: 235251 - RNA, 22 nt, Human
cuucuucaucuuuuggaggaac

SEQ ID NO: 235252 - RNA, 22 nt, Human
ucccaaguguuuggcgaggaga

SEQ ID NO: 235253 - RNA, 22 nt, Human
uguuggaaucuucuagucuucc

SEQ ID NO: 235254 - RNA, 22 nt, Human
ugucuuuuaaaaauguguaaaa

SEQ ID NO: 235255 - RNA, 22 nt, Human
ggaggaugaggguggugguguu

SEQ ID NO: 235256 - RNA, 22 nt, Human
gugugucucaguugcuccgaag

SEQ ID NO: 235257 - RNA, 21 nt, Human
ugcuuucugugcuuuuucugc

SEQ ID NO: 235258 - RNA, 20 nt, Human
ugccagagagcucauacccu

SEQ ID NO: 235259 - RNA, 22 nt, Human
uucauuuccauuuuauagauaa

SEQ ID NO: 235260 - RNA, 22 nt, Human
auccugugggguauugcugcau

SEQ ID NO: 235261 - RNA, 22 nt, Human
aaaucauagccaugaacauuug

SEQ ID NO: 235262 - RNA, 22 nt, Human
augcuuucucuucuauuucuca

SEQ ID NO: 235263 - RNA, 22 nt, Human
cucacugucagcugcagggcuu

SEQ ID NO: 235264 - RNA, 22 nt, Human
guguugaugugucuguauucua

SEQ ID NO: 235265 - RNA, 22 nt, Human
cuucuuaaaguugucacagcug

SEQ ID NO: 235266 - RNA, 22 nt, Human
aaagggagauaaaguaauuuua

SEQ ID NO: 235267 - RNA, 22 nt, Human
cagcuuguucugaccugugauu

SEQ ID NO: 235268 - RNA, 22 nt, Human
aggggaggggaguaucaggauu

SEQ ID NO: 235269 - RNA, 22 nt, Human
ggagacagauggcgucucaguu

SEQ ID NO: 235270 - RNA, 22 nt, Human
cugcagagaccuaggucagguu

SEQ ID NO: 235271 - RNA, 22 nt, Human
augcugugccuggaaagcggcu

SEQ ID NO: 235272 - RNA, 22 nt, Human
ucuuuuaucuguuguguaacaa

SEQ ID NO: 235273 - RNA, 22 nt, Human
gcacaaaagguacuucauguag

SEQ ID NO: 235274 - RNA, 20 nt, Human
uugauucacaaaaagcuuag

SEQ ID NO: 235275 - RNA, 22 nt, Human
caagaaaaaacaugaugagugu

SEQ ID NO: 235276 - RNA, 22 nt, Human
ggggcaucguugauugcauggu

SEQ ID NO: 235277 - RNA, 22 nt, Human
uucuucuuuccuauaauuaauu

SEQ ID NO: 235278 - RNA, 22 nt, Human
uaugggcaagagauaggugguc

SEQ ID NO: 235279 - RNA, 23 nt, Human
ucugccuccuaauuguugguguc

SEQ ID NO: 235280 - RNA, 22 nt, Human
augcggcugugggggaauggga

SEQ ID NO: 235281 - RNA, 16 nt, Human
gaauuccauugcucug

SEQ ID NO: 235282 - RNA, 22 nt, Human
uaagggagcagaagcugugaaa

SEQ ID NO: 235283 - RNA, 22 nt, Human
auggaguguggccaggcaguaa

SEQ ID NO: 235284 - RNA, 22 nt, Human
cucuugugucaccauggauaaa

SEQ ID NO: 235285 - RNA, 22 nt, Human
gaggggacugucuggcuccgag

SEQ ID NO: 235286 - RNA, 19 nt, Human
ccaguuuuuuaauauucaa

SEQ ID NO: 235287 - RNA, 20 nt, Human
agugauuuguuaguacauug

SEQ ID NO: 235288 - RNA, 22 nt, Human
ugaaaaauauuuuuagaaauaa

SEQ ID NO: 235289 - RNA, 22 nt, Human
uguuuagcucugacuaugugau

SEQ ID NO: 235290 - RNA, 22 nt, Human
aucuucuuucaucagccccuca

SEQ ID NO: 235291 - RNA, 22 nt, Human
ggcucccgugggaugguggagc

SEQ ID NO: 235292 - RNA, 22 nt, Human
ugaaguuuagaaaaagugccuu

SEQ ID NO: 235293 - RNA, 22 nt, Human
uuaaaagaauccuguuauccuc

SEQ ID NO: 235294 - RNA, 22 nt, Human
cucugcuuguaucacauuugcu

SEQ ID NO: 235295 - RNA, 22 nt, Human
ucuucaucucuaaaaugggaac

SEQ ID NO: 235296 - RNA, 22 nt, Human
uucacugugauugggguggauu

SEQ ID NO: 235297 - RNA, 22 nt, Human
acucauuuggauuuuggaguuu

SEQ ID NO: 235298 - RNA, 22 nt, Human
aauguaaauaauuguaaaauuu

SEQ ID NO: 235299 - RNA, 22 nt, Human
ccaggcucaccuggagccccug

SEQ ID NO: 235300 - RNA, 23 nt, Human
uccuccccaccuuuguccccucc

SEQ ID NO: 235301 - RNA, 22 nt, Human
cccuguccuucccuccaucuga

SEQ ID NO: 235302 - RNA, 22 nt, Human
ugcagcuuuugguuucuagaug

SEQ ID NO: 235303 - RNA, 22 nt, Human
gugugugucuacuuucaucucu

SEQ ID NO: 235304 - RNA, 21 nt, Human
uggcaggcagcuggaagcuug

SEQ ID NO: 235305 - RNA, 22 nt, Human
gagggcugccacguugggcgag

SEQ ID NO: 235306 - RNA, 22 nt, Human
ucauuguuucugcuuuucauga

SEQ ID NO: 235307 - RNA, 22 nt, Human
auuaaaaaaagauaaugaguua

SEQ ID NO: 235308 - RNA, 22 nt, Human
aggugagaacguggaggggcgg

SEQ ID NO: 235309 - RNA, 20 nt, Human
uucucugcagcaggcggccc

SEQ ID NO: 235310 - RNA, 22 nt, Human
ucacuuccuugcagcuguagaa

SEQ ID NO: 235311 - RNA, 22 nt, Human
cauggcaggugcagauucugug

SEQ ID NO: 235312 - RNA, 22 nt, Human
aaugaaaaucugucaguucaag

SEQ ID NO: 235313 - RNA, 22 nt, Human
uacuuacacugaagcaaagaua

SEQ ID NO: 235314 - RNA, 22 nt, Human
uuucucuuguauuugaaucacu

SEQ ID NO: 235315 - RNA, 22 nt, Human
uggggcuccuccuggcaggagg

SEQ ID NO: 235316 - RNA, 22 nt, Human
aaauguuucauucuauuuuuag

SEQ ID NO: 235317 - RNA, 22 nt, Human
gggcuguggggccugcagaagg

SEQ ID NO: 235318 - RNA, 22 nt, Human
auuuuugguuucaccugcacgc

SEQ ID NO: 235319 - RNA, 22 nt, Human
caguggacacuuccucuacaau

SEQ ID NO: 235320 - RNA, 22 nt, Human
uuucuugugauuuugaugaacu

SEQ ID NO: 235321 - RNA, 22 nt, Human
uuuuucuccucucucuuucauu

SEQ ID NO: 235322 - RNA, 23 nt, Human
ucucacucauucuccucugucca

SEQ ID NO: 235323 - RNA, 22 nt, Human
uuauuucauguaaaauuuaugu

SEQ ID NO: 235324 - RNA, 20 nt, Human
cuggaguguagcaguggcug

SEQ ID NO: 235325 - RNA, 22 nt, Human
agggcugcugcuccgggcccag

SEQ ID NO: 235326 - RNA, 22 nt, Human
auuuuuuuuccugucucuuuca

SEQ ID NO: 235327 - RNA, 22 nt, Human
gagggugguggcggccggcacc

SEQ ID NO: 235328 - RNA, 22 nt, Human
gcuucucacccuuacuaucucu

SEQ ID NO: 235329 - RNA, 22 nt, Human
uccaugaguuuuuuaguuucac

SEQ ID NO: 235330 - RNA, 22 nt, Human
acucacuguuuugaaauugaac

SEQ ID NO: 235331 - RNA, 22 nt, Human
auucuuuauuuucuguacuugc

SEQ ID NO: 235332 - RNA, 22 nt, Human
cuuuuuuucuccauauuucugg

SEQ ID NO: 235333 - RNA, 22 nt, Human
uuucuggacuaaagggagagau

SEQ ID NO: 235334 - RNA, 22 nt, Human
uuauuuucgugugugugugugu

SEQ ID NO: 235335 - RNA, 22 nt, Human
cacuguugagcaauguacagug

SEQ ID NO: 235336 - RNA, 22 nt, Human
auuaauaucaauauauuauaug

SEQ ID NO: 235337 - RNA, 19 nt, Human
augaaauagcauuuucuga

SEQ ID NO: 235338 - RNA, 22 nt, Human
uagggaggguuugggguggagg

SEQ ID NO: 235339 - RNA, 21 nt, Human
gggagugaguaaugauggggg

SEQ ID NO: 235340 - RNA, 22 nt, Human
agagauacugcaggccauaaau

SEQ ID NO: 235341 - RNA, 22 nt, Human
agagacuguaaugagagguaca

SEQ ID NO: 235342 - RNA, 22 nt, Human
gagccucaggguuuuguugaca

SEQ ID NO: 235343 - RNA, 22 nt, Human
aggcaggggagcuggaagggua

SEQ ID NO: 235344 - RNA, 22 nt, Human
gaggggaacaggcauucuuaag

SEQ ID NO: 235345 - RNA, 22 nt, Human
cagagagcguccauccggugcc

SEQ ID NO: 235346 - RNA, 22 nt, Human
ggcagaggagcuggaaacaugg

SEQ ID NO: 235347 - RNA, 22 nt, Human
aagcucagcugguggugauugc

SEQ ID NO: 235348 - RNA, 22 nt, Human
aggaaauaggaccagacaaagc

SEQ ID NO: 235349 - RNA, 22 nt, Human
agagggagagaccuccgugccu

SEQ ID NO: 235350 - RNA, 22 nt, Human
agcgcucauuuuccuccugcuc

SEQ ID NO: 235351 - RNA, 22 nt, Human
aaaauacuaggaaaauaaauca

SEQ ID NO: 235352 - RNA, 22 nt, Human
ggaaggggagcuggaaagggua

SEQ ID NO: 235353 - RNA, 22 nt, Human
uuugcaggaaauguacugaaug

SEQ ID NO: 235354 - RNA, 22 nt, Human
uggcaaggccacaggugcaguu

SEQ ID NO: 235355 - RNA, 22 nt, Human
cagcuccaucuugcuuauacca

SEQ ID NO: 235356 - RNA, 22 nt, Human
uguuuuuuagagugauacuuuu

SEQ ID NO: 235357 - RNA, 22 nt, Human
gugucccaaagauuagaaauca

SEQ ID NO: 235358 - RNA, 22 nt, Human
gggggcugugugcccgcucccc

SEQ ID NO: 235359 - RNA, 22 nt, Human
ucacuguuucaccgucugaagg

SEQ ID NO: 235360 - RNA, 22 nt, Human
uuuuaaaagguugcuguuauaa

SEQ ID NO: 235361 - RNA, 22 nt, Human
gcuuucagggucacugucaaca

SEQ ID NO: 235362 - RNA, 22 nt, Human
gccaguggucagugggagggug

SEQ ID NO: 235363 - RNA, 22 nt, Human
ugcuuggauuuccaaaugguuu

SEQ ID NO: 235364 - RNA, 22 nt, Human
ucccuugacauuacuugggagg

SEQ ID NO: 235365 - RNA, 22 nt, Human
aagagaggaaagggugugaggu

SEQ ID NO: 235366 - RNA, 22 nt, Human
caaaaaauccauagaaagaggu

SEQ ID NO: 235367 - RNA, 22 nt, Human
gcccugucagcucucauggaca

SEQ ID NO: 235368 - RNA, 22 nt, Human
uuacuuuuuucccccuuagaug

SEQ ID NO: 235369 - RNA, 22 nt, Human
uggagucuugcuuugggagugc

SEQ ID NO: 235370 - RNA, 22 nt, Human
uguuuuuauucuuaauguuuca

SEQ ID NO: 235371 - RNA, 22 nt, Human
aggcagagaggucuuccuggaa

SEQ ID NO: 235372 - RNA, 17 nt, Human
auuguuuuuaauuugca

SEQ ID NO: 235373 - RNA, 22 nt, Human
ggcuagggaucuagaccaggac

SEQ ID NO: 235374 - RNA, 22 nt, Human
gcauaauauugagaaauuauua

SEQ ID NO: 235375 - RNA, 20 nt, Human
ugcugugugucuacuguggg

SEQ ID NO: 235376 - RNA, 22 nt, Human
cuuuuuaaaguaaauggcuaga

SEQ ID NO: 235377 - RNA, 22 nt, Human
aaggcuguuugagcacuggagc

SEQ ID NO: 235378 - RNA, 22 nt, Human
augugugugcgagcgugugugu

SEQ ID NO: 235379 - RNA, 22 nt, Human
gcuuauuagguuauuucaagga

SEQ ID NO: 235380 - RNA, 23 nt, Human
agagggaagagcuuagaugggga

SEQ ID NO: 235381 - RNA, 22 nt, Human
uggaagugggcaucaccaucca

SEQ ID NO: 235382 - RNA, 22 nt, Human
aaaacauuuaggguuuuuuuua

SEQ ID NO: 235383 - RNA, 22 nt, Human
ugcauucugaacguaaauguga

SEQ ID NO: 235384 - RNA, 22 nt, Human
uuuuacaaugcaaauucuugcu

SEQ ID NO: 235385 - RNA, 22 nt, Human
uucacuguucuuagagaagacc

SEQ ID NO: 235386 - RNA, 22 nt, Human
guuaaaaugauuugugauuuau

SEQ ID NO: 235387 - RNA, 22 nt, Human
auuuuauuuugggaucuuuuua

SEQ ID NO: 235388 - RNA, 22 nt, Human
cuguccauuuucgugccuccuu

SEQ ID NO: 235389 - RNA, 22 nt, Human
agugaggggagaaugaggugga

SEQ ID NO: 235390 - RNA, 22 nt, Human
ucucugaccuccaccccaggag

SEQ ID NO: 235391 - RNA, 22 nt, Human
gugucacuuucaggagcucuaa

SEQ ID NO: 235392 - RNA, 22 nt, Human
gggauggggagcuggaaagggg

SEQ ID NO: 235393 - RNA, 22 nt, Human
aguaggaauucaaagagacaaa

SEQ ID NO: 235394 - RNA, 22 nt, Human
cuauguuucagauauauauaua

SEQ ID NO: 235395 - RNA, 22 nt, Human
cagguggauggcgagcccugca

SEQ ID NO: 235396 - RNA, 22 nt, Human
aggccccacaaacucgccuuug

SEQ ID NO: 235397 - RNA, 22 nt, Human
uaccuggauaaauguacaaccg

SEQ ID NO: 235398 - RNA, 22 nt, Human
guuuuguagucuggagacuguc

SEQ ID NO: 235399 - RNA, 22 nt, Human
uuuaaauuucugaaucuugagg

SEQ ID NO: 235400 - RNA, 22 nt, Human
ccagaugggggcugugggaggg

SEQ ID NO: 235401 - RNA, 22 nt, Human
cggggcuggcguuagggaggca

SEQ ID NO: 235402 - RNA, 19 nt, Human
agagucuccacuccacuug

SEQ ID NO: 235403 - RNA, 22 nt, Human
agauggaguccugaagccagaa

SEQ ID NO: 235404 - RNA, 22 nt, Human
aucacuagaguuacauugccag

SEQ ID NO: 235405 - RNA, 22 nt, Human
gaguucuagauguauuauuaau

SEQ ID NO: 235406 - RNA, 22 nt, Human
uuauaucagaaggugagauuga

SEQ ID NO: 235407 - RNA, 22 nt, Human
uucugcuuuaaagcucauguuu

SEQ ID NO: 235408 - RNA, 22 nt, Human
auauaguacauguauauauaua

SEQ ID NO: 235409 - RNA, 22 nt, Human
uagacugugagcuccuugaggg

SEQ ID NO: 235410 - RNA, 22 nt, Human
agauuuucuuuuccaucuuugu

SEQ ID NO: 235411 - RNA, 22 nt, Human
uuuaacauaugaaagaauauuu

SEQ ID NO: 235412 - RNA, 19 nt, Human
agugaacuccauaucaggu

SEQ ID NO: 235413 - RNA, 22 nt, Human
guacauauccuuuacguuuugu

SEQ ID NO: 235414 - RNA, 22 nt, Human
cuagcacagugcuuggcacaca

SEQ ID NO: 235415 - RNA, 22 nt, Human
aucuguuccccuaugcucucua

SEQ ID NO: 235416 - RNA, 22 nt, Human
uuuuauaauacccuugacuaau

SEQ ID NO: 235417 - RNA, 22 nt, Human
gugcugggaggcccaggaugga

SEQ ID NO: 235418 - RNA, 22 nt, Human
agggaguuccgaucugugcacc

SEQ ID NO: 235419 - RNA, 22 nt, Human
ugaguucugacugagcaugggg

SEQ ID NO: 235420 - RNA, 22 nt, Human
agggaggagggacagaaagagg

SEQ ID NO: 235421 - RNA, 22 nt, Human
gagggagugggcccgugggcac

SEQ ID NO: 235422 - RNA, 22 nt, Human
agggcucacuacaacccuggga

SEQ ID NO: 235423 - RNA, 22 nt, Human
uauauacacgcacauauacaua

SEQ ID NO: 235424 - RNA, 22 nt, Human
uucacauucauuucuuauguuu

SEQ ID NO: 235425 - RNA, 22 nt, Human
cagcuccagcccaggcagcucc

SEQ ID NO: 235426 - RNA, 22 nt, Human
uuuguuuccagccuuuugucuu

SEQ ID NO: 235427 - RNA, 22 nt, Human
uccuuucaaauuuauuugacau

SEQ ID NO: 235428 - RNA, 22 nt, Human
aagggagagggagaagguggga

SEQ ID NO: 235429 - RNA, 22 nt, Human
ggcucacuguaccugccgccgc

SEQ ID NO: 235430 - RNA, 22 nt, Human
gaggcaggcggggcccaggugg

SEQ ID NO: 235431 - RNA, 22 nt, Human
uggggcuggccaggaggagucu

SEQ ID NO: 235432 - RNA, 22 nt, Human
gaaggagaggauugugaggcug

SEQ ID NO: 235433 - RNA, 22 nt, Human
augcaaaaucuuauuuuuucua

SEQ ID NO: 235434 - RNA, 22 nt, Human
ggagugaguauguucugaugca

SEQ ID NO: 235435 - RNA, 20 nt, Human
ccugggcuccaggagccccg

SEQ ID NO: 235436 - RNA, 22 nt, Human
uauuuuuacuguuugaugauuc

SEQ ID NO: 235437 - RNA, 20 nt, Human
uuuuuuaaauagagcuguug

SEQ ID NO: 235438 - RNA, 22 nt, Human
caagggcagaggcagggccccg

SEQ ID NO: 235439 - RNA, 22 nt, Human
aggauagacuucagaaggcaua

SEQ ID NO: 235440 - RNA, 22 nt, Human
auagaaauagacaaugcaaaga

SEQ ID NO: 235441 - RNA, 22 nt, Human
guuuucuuguuaauuuugaacg

SEQ ID NO: 235442 - RNA, 22 nt, Human
ggcugugaaguacguugaaggu

SEQ ID NO: 235443 - RNA, 22 nt, Human
ccauuucacaucccugacaugu

SEQ ID NO: 235444 - RNA, 23 nt, Human
uggaaguugagagucugcuuugu

SEQ ID NO: 235445 - RNA, 22 nt, Human
uuucauguuggauacuguuuca

SEQ ID NO: 235446 - RNA, 22 nt, Human
gguuuucacgauccucccuuuu

SEQ ID NO: 235447 - RNA, 22 nt, Human
gcuguggacacagcucucuuca

SEQ ID NO: 235448 - RNA, 22 nt, Human
ggugucuuugauguugggcuga

SEQ ID NO: 235449 - RNA, 22 nt, Human
aucuaaaacuacgaauacuacc

SEQ ID NO: 235450 - RNA, 22 nt, Human
aaucacuucuuugucuucuuca

SEQ ID NO: 235451 - RNA, 22 nt, Human
uuuuuaagguuuguuuauauau

SEQ ID NO: 235452 - RNA, 22 nt, Human
aggggcugugucauuuguccua

SEQ ID NO: 235453 - RNA, 22 nt, Human
ccaggcuccccaggaggcccuu

SEQ ID NO: 235454 - RNA, 22 nt, Human
gcuguugugaggaucagcauau

SEQ ID NO: 235455 - RNA, 22 nt, Human
guucuucagcccucagguccua

SEQ ID NO: 235456 - RNA, 21 nt, Human
acugggcuagccugacuucug

SEQ ID NO: 235457 - RNA, 22 nt, Human
gcagggcucuggagucaggcug

SEQ ID NO: 235458 - RNA, 22 nt, Human
auuuccagcagcauauuugucu

SEQ ID NO: 235459 - RNA, 22 nt, Human
uggagccuugugagaccacaau

SEQ ID NO: 235460 - RNA, 22 nt, Human
uauauaauacacaaauauguac

SEQ ID NO: 235461 - RNA, 22 nt, Human
auauuuuacagcucucguugaa

SEQ ID NO: 235462 - RNA, 22 nt, Human
uucuugugugaauauaauuaca

SEQ ID NO: 235463 - RNA, 22 nt, Human
cuccccuuauuccucaacauga

SEQ ID NO: 235464 - RNA, 22 nt, Human
gcagggcucagccgcucccacc

SEQ ID NO: 235465 - RNA, 22 nt, Human
gcaggggguaaggggcagggcu

SEQ ID NO: 235466 - RNA, 22 nt, Human
uuuuaaauaaacuacacugauu

SEQ ID NO: 235467 - RNA, 22 nt, Human
ugagauguaauguaguacuuug

SEQ ID NO: 235468 - RNA, 22 nt, Human
gcuguguaugaugcaggcaccu

SEQ ID NO: 235469 - RNA, 22 nt, Human
uguugaaacagcuauugacuuu

SEQ ID NO: 235470 - RNA, 22 nt, Human
augaaaacgugugugugugugu

SEQ ID NO: 235471 - RNA, 22 nt, Human
ucuucacagaugcauauacuuc

SEQ ID NO: 235472 - RNA, 22 nt, Human
ucuucaaauacagucauauuga

SEQ ID NO: 235473 - RNA, 22 nt, Human
uugguuuacucuggggauaucu

SEQ ID NO: 235474 - RNA, 22 nt, Human
uggggggacagauggagaggac

SEQ ID NO: 235475 - RNA, 22 nt, Human
auacauauaugcacauuaauau

SEQ ID NO: 235476 - RNA, 22 nt, Human
aguuuccacuggagacacugug

SEQ ID NO: 235477 - RNA, 22 nt, Human
ucauacuuuuuugacccuugug

SEQ ID NO: 235478 - RNA, 22 nt, Human
uuuuuuccuguuugucuuuggg

SEQ ID NO: 235479 - RNA, 22 nt, Human
uggaagcccagaaggaagcaga

SEQ ID NO: 235480 - RNA, 22 nt, Human
ccuccuuuccuguuuuccugag

SEQ ID NO: 235481 - RNA, 22 nt, Human
ucugaggacagugcugugccug

SEQ ID NO: 235482 - RNA, 22 nt, Human
auuuuuuuggucauaugagaua

SEQ ID NO: 235483 - RNA, 22 nt, Human
uuuuuuuaaguuuugauuuuag

SEQ ID NO: 235484 - RNA, 22 nt, Human
auuuuucuuucacauuuucuua

SEQ ID NO: 235485 - RNA, 23 nt, Human
cuuauauaaucauuagaaaccau

SEQ ID NO: 235486 - RNA, 22 nt, Human
aaaauauaaaggauguggguuu

SEQ ID NO: 235487 - RNA, 22 nt, Human
ugcucacugcuuguguucaguu

SEQ ID NO: 235488 - RNA, 22 nt, Human
agcaaggguugguuuucugaca

SEQ ID NO: 235489 - RNA, 22 nt, Human
uauuuguauugucuuaucacuu

SEQ ID NO: 235490 - RNA, 22 nt, Human
gugaaauuguacacucaguacc

SEQ ID NO: 235491 - RNA, 22 nt, Human
cuggagaacucugugcuucacu

SEQ ID NO: 235492 - RNA, 22 nt, Human
gagcagcugagcuggaaugaga

SEQ ID NO: 235493 - RNA, 22 nt, Human
uuauuuaaaauguagguuggga

SEQ ID NO: 235494 - RNA, 22 nt, Human
uauuuuuuuaacauuuauugua

SEQ ID NO: 235495 - RNA, 22 nt, Human
uauuuuagccaacagaaugaug

SEQ ID NO: 235496 - RNA, 22 nt, Human
auggauggaagcagccugaacu

SEQ ID NO: 235497 - RNA, 23 nt, Human
aaguggugacugugcuacugaga

SEQ ID NO: 235498 - RNA, 22 nt, Human
agggcugggcuuggcaggcugg

SEQ ID NO: 235499 - RNA, 22 nt, Human
aggcucagcaucugauucauau

SEQ ID NO: 235500 - RNA, 22 nt, Human
ucaaauaugggccagaggaaau

SEQ ID NO: 235501 - RNA, 19 nt, Human
caggucuucuuggaggacu

SEQ ID NO: 235502 - RNA, 22 nt, Human
uggggcauacgugaaauaauuu

SEQ ID NO: 235503 - RNA, 22 nt, Human
gucugcagcacugugcacgguc

SEQ ID NO: 235504 - RNA, 22 nt, Human
ggagccucuaaacaguuaucaa

SEQ ID NO: 235505 - RNA, 22 nt, Human
gggggacagugugccuggugug

SEQ ID NO: 235506 - RNA, 19 nt, Shigella flexneri 2a str. 301
ugcaggguuuuuaaucgga

SEQ ID NO: 235507 - RNA, 22 nt, Shigella flexneri 2a str. 301
ugaugacgcugcggcaguucgc

SEQ ID NO: 235508 - RNA, 19 nt, Shigella flexneri 2a str. 301
uggcgaccauugacuucug

SEQ ID NO: 235509 - RNA, 23 nt, Shigella flexneri 2a str. 301
uacucggcagcauuuuuaaccgg

SEQ ID NO: 235510 - RNA, 20 nt, Shigella flexneri 2a str. 301
cgccguucuggcggauguug

SEQ ID NO: 235511 - RNA, 22 nt, Shigella flexneri 2a str. 301
aagcgacaucuugccuguggau

SEQ ID NO: 235512 - RNA, 22 nt, Shigella flexneri 2a str. 301
gucgagaaaacgggauagcacc

SEQ ID NO: 235513 - RNA, 22 nt, Shigella flexneri 2a str. 301
ucauugcugagacaggcucugu

SEQ ID NO: 235514 - RNA, 22 nt, Shigella flexneri 2a str. 301
gggaucgucuuaccgcguucga

SEQ ID NO: 235515 - RNA, 22 nt, Shigella flexneri 2a str. 301
gauggcggugguucuguucguc

SEQ ID NO: 235516 - RNA, 22 nt, Shigella flexneri 2a str. 301
caccgucaggguacggaaugua

SEQ ID NO: 235517 - RNA, 22 nt, Shigella flexneri 2a str. 301
accggaaagaauaugcgccagc

SEQ ID NO: 235518 - RNA, 19 nt, Shigella flexneri 2a str. 301
agguaaacgucgucugguu

SEQ ID NO: 235519 - RNA, 23 nt, Shigella flexneri 2a str. 301
uggaugccacuaauacugcugug

SEQ ID NO: 235520 - RNA, 22 nt, Shigella flexneri 2a str. 301
agcgcugggccugucgcagccg

SEQ ID NO: 235521 - RNA, 22 nt, Shigella flexneri 2a str. 301
uucguugcgugagguugcuggc

SEQ ID NO: 235522 - RNA, 22 nt, Shigella flexneri 2a str. 301
cauucgcugcugcuuugcuucc

SEQ ID NO: 235523 - RNA, 22 nt, Shigella flexneri 2a str. 301
gacaccugacgauacuguguug

SEQ ID NO: 235524 - RNA, 22 nt, Shigella flexneri 2a str. 301
aucggauggucgaacggcggca

SEQ ID NO: 235525 - RNA, 22 nt, Shigella flexneri 2a str. 301
gagugcgugauuucgccgaagu

SEQ ID NO: 235526 - RNA, 22 nt, Shigella flexneri 2a str. 301
accgcucaucgcccggaacuug

SEQ ID NO: 235527 - RNA, 18 nt, Shigella flexneri 2a str. 301
gucuugccauugaccugg

SEQ ID NO: 235528 - RNA, 22 nt, Shigella flexneri 2a str. 301
cugagggacuuucagcucaaga

SEQ ID NO: 235529 - RNA, 22 nt, Shigella flexneri 2a str. 301
uucccggcgaucacggcaugau

SEQ ID NO: 235530 - RNA, 22 nt, Shigella flexneri 2a str. 301
ggcguggauguucgucaguuaa

SEQ ID NO: 235531 - RNA, 22 nt, Shigella flexneri 2a str. 301
gaugcgccaugaguuuauuuua

SEQ ID NO: 235532 - RNA, 22 nt, Shigella flexneri 2a str. 301
uuagccgaccagguggcgauga

SEQ ID NO: 235533 - RNA, 22 nt, Shigella flexneri 2a str. 301
ccgagaagaagugaacauuacu

SEQ ID NO: 235534 - RNA, 20 nt, Shigella flexneri 2a str. 301
uaucgugauuuguaaucgcc

SEQ ID NO: 235535 - RNA, 22 nt, Shigella flexneri 2a str. 301
uugcggaaguuuaucuggcgau

SEQ ID NO: 235536 - RNA, 22 nt, Shigella flexneri 2a str. 301
cgucugcuuaccauugcgugcc

SEQ ID NO: 235537 - RNA, 20 nt, Shigella flexneri 2a str. 301
agccugucacugggcgcagc

SEQ ID NO: 235538 - RNA, 21 nt, Shigella flexneri 2a str. 301
acgugagcuggaaggggcgcu

SEQ ID NO: 235539 - RNA, 22 nt, Shigella flexneri 2a str. 301
cuugagauuaaagaagaacggc

SEQ ID NO: 235540 - RNA, 22 nt, Shigella flexneri 2a str. 301
aucuaugugaauaaacaugacg

SEQ ID NO: 235541 - RNA, 22 nt, Shigella flexneri 2a str. 301
cgguucgaugauuggucugaau

SEQ ID NO: 235542 - RNA, 22 nt, Shigella flexneri 2a str. 301
agcaggauacgaaggcuaugug

SEQ ID NO: 235543 - RNA, 23 nt, Shigella flexneri 2a str. 301
ccguaucgaccugcaaccgggcg

SEQ ID NO: 235544 - RNA, 22 nt, Shigella flexneri 2a str. 301
accgaagaguaccgcggcggca

SEQ ID NO: 235545 - RNA, 22 nt, Shigella flexneri 2a str. 301
ucgucgcuacgcauucucgguu

SEQ ID NO: 235546 - RNA, 22 nt, Shigella flexneri 2a str. 301
uacggcuguuucugacgguaag

SEQ ID NO: 235547 - RNA, 22 nt, Shigella flexneri 2a str. 301
ucauaaugggaguuuugauacu

SEQ ID NO: 235548 - RNA, 22 nt, Shigella flexneri 2a str. 301
aucaggcuugggcaguguuaga

SEQ ID NO: 235549 - RNA, 22 nt, Shigella flexneri 2a str. 301
gggccagaaaaucugugucuug

SEQ ID NO: 235550 - RNA, 22 nt, Shigella flexneri 2a str. 301
agaugguuccggcguucgauaa

SEQ ID NO: 235551 - RNA, 22 nt, Shigella flexneri 2a str. 301
gauagauuggauaagaaacgcg

SEQ ID NO: 235552 - RNA, 22 nt, Shigella flexneri 2a str. 301
agcagccguauuaugcaccugc

SEQ ID NO: 235553 - RNA, 21 nt, Shigella flexneri 2a str. 301
gauagucgaggaucugccguu

SEQ ID NO: 235554 - RNA, 22 nt, Shigella flexneri 2a str. 301
acgucgcggaucaccgcuuucg

SEQ ID NO: 235555 - RNA, 22 nt, Shigella flexneri 2a str. 301
cgggcgaaaagccagcguggca

SEQ ID NO: 235556 - RNA, 22 nt, Shigella flexneri 2a str. 301
acacgguagcgcgaccugcaac

SEQ ID NO: 235557 - RNA, 22 nt, Shigella flexneri 2a str. 301
uucgucagucaggacaaacugc

SEQ ID NO: 235558 - RNA, 22 nt, Shigella flexneri 2a str. 301
cggucaccuggauccagccugc

SEQ ID NO: 235559 - RNA, 22 nt, Shigella flexneri 2a str. 301
ucaggcguucuuccaucaguug

SEQ ID NO: 235560 - RNA, 22 nt, Shigella flexneri 2a str. 301
ucguuaaucgccaguuucugcc

SEQ ID NO: 235561 - RNA, 22 nt, Shigella flexneri 2a str. 301
uuggcuaaguuugcgguauugu

SEQ ID NO: 235562 - RNA, 20 nt, Shigella flexneri 2a str. 301
uguggcgcaguauuccgcac

SEQ ID NO: 235563 - RNA, 22 nt, Shigella flexneri 2a str. 301
gagcauucccauaaacucagau

SEQ ID NO: 235564 - RNA, 22 nt, Shigella flexneri 2a str. 301
caggcuuucugcucgucgauaa

SEQ ID NO: 235565 - RNA, 22 nt, Shigella flexneri 2a str. 301
uugcugaugcgcugccaggcgu

SEQ ID NO: 235566 - RNA, 22 nt, Shigella flexneri 2a str. 301
ugggcgauaggugcgguagugc

SEQ ID NO: 235567 - RNA, 22 nt, Shigella flexneri 2a str. 301
gguagcuuaugcccuugcacca

SEQ ID NO: 235568 - RNA, 22 nt, Shigella flexneri 2a str. 301
caccguggccuuuuccgguaua

SEQ ID NO: 235569 - RNA, 22 nt, Shigella flexneri 2a str. 301
gucugcaucccuacucgggcaa

SEQ ID NO: 235570 - RNA, 22 nt, Shigella flexneri 2a str. 301
ucugcugccugacguugcagcu

SEQ ID NO: 235571 - RNA, 22 nt, Shigella flexneri 2a str. 301
gucugcugauuuugcuguuuac

SEQ ID NO: 235572 - RNA, 22 nt, Shigella flexneri 2a str. 301
caacgcgcggugaugaugcagg

SEQ ID NO: 235573 - RNA, 22 nt, Shigella flexneri 2a str. 301
uguugcuaagucuagggccgau

SEQ ID NO: 235574 - RNA, 23 nt, Shigella flexneri 2a str. 301
aacgcguucuuuaguggugaaga

SEQ ID NO: 235575 - RNA, 22 nt, Shigella flexneri 2a str. 301
gcgaacuuacgucugguuauuu

SEQ ID NO: 235576 - RNA, 22 nt, Shigella flexneri 2a str. 301
ggcgauggaggauggauaauga

SEQ ID NO: 235577 - RNA, 22 nt, Shigella flexneri 2a str. 301
agacgcgaugcauugcucugaa

SEQ ID NO: 235578 - RNA, 22 nt, Shigella flexneri 2a str. 301
uggaagcgaucaaacugcuggc

SEQ ID NO: 235579 - RNA, 22 nt, Shigella flexneri 2a str. 301
uuagcaucuuuuguucagcugg

SEQ ID NO: 235580 - RNA, 22 nt, Shigella flexneri 2a str. 301
augaaacgcauauuuaccgcag

SEQ ID NO: 235581 - RNA, 20 nt, Shigella flexneri 2a str. 301
cggaacugggaagagcaacg

SEQ ID NO: 235582 - RNA, 22 nt, Shigella flexneri 2a str. 301
cugggcuaacgccgaugaaagc

SEQ ID NO: 235583 - RNA, 22 nt, Shigella flexneri 2a str. 301
guucgauucaccgauaugcauc

SEQ ID NO: 235584 - RNA, 22 nt, Shigella flexneri 2a str. 301
gcacauaacucauacugagcaa

SEQ ID NO: 235585 - RNA, 22 nt, Shigella flexneri 2a str. 301
aucccuauaacaguagaacccu

SEQ ID NO: 235586 - RNA, 22 nt, Shigella flexneri 2a str. 301
gagccggaacuuugcugcaaug

SEQ ID NO: 235587 - RNA, 22 nt, Shigella flexneri 2a str. 301
agugacgugauaaucgcuggaa

SEQ ID NO: 235588 - RNA, 22 nt, Shigella flexneri 2a str. 301
aggccggauaagcgaagcgcau

SEQ ID NO: 235589 - RNA, 22 nt, Shigella flexneri 2a str. 301
augcaaugaaaguaccguucua

SEQ ID NO: 235590 - RNA, 22 nt, Shigella flexneri 2a str. 301
gcuuugcggccuucaggcagaa

SEQ ID NO: 235591 - RNA, 22 nt, Shigella flexneri 2a str. 301
aagaugauguuaagcugcuaaa

SEQ ID NO: 235592 - RNA, 22 nt, Shigella flexneri 2a str. 301
uuguaggccggauaaggcguuu

SEQ ID NO: 235593 - RNA, 22 nt, Shigella flexneri 2a str. 301
aacgccuuauccggccuacaaa

SEQ ID NO: 235594 - RNA, 22 nt, Shigella flexneri 2a str. 301
ugcagcagcugcuggagaucau

SEQ ID NO: 235595 - RNA, 22 nt, Shigella flexneri 2a str. 301
gguucgaggccgagcauuuuca

SEQ ID NO: 235596 - RNA, 22 nt, Shigella flexneri 2a str. 301
ugaccauuggugcaauauaccu

SEQ ID NO: 235597 - RNA, 22 nt, Shigella flexneri 2a str. 301
ucgcguguuccaaaggucgcau

SEQ ID NO: 235598 - RNA, 22 nt, Shigella flexneri 2a str. 301
ucuuugaugcggugccagcucu

SEQ ID NO: 235599 - RNA, 23 nt, Shigella flexneri 2a str. 301
ggccauugacgcaucgcccgguu

SEQ ID NO: 235600 - RNA, 23 nt, Shigella flexneri 2a str. 301
ucaccgguauuugaggcuguuuc

SEQ ID NO: 235601 - RNA, 22 nt, Shigella flexneri 2a str. 301
aucuugauugcagccagaguuu

SEQ ID NO: 235602 - RNA, 22 nt, Shigella flexneri 2a str. 301
uuguaggccggauugggcguuu

SEQ ID NO: 235603 - RNA, 22 nt, Shigella flexneri 2a str. 301
uaccguuacgcugcggugccag

SEQ ID NO: 235604 - RNA, 22 nt, Shigella flexneri 2a str. 301
uugcaguugcaguccauuguuu

SEQ ID NO: 235605 - RNA, 22 nt, Shigella flexneri 2a str. 301
cccaugucaccuuucaacacgg

SEQ ID NO: 235606 - RNA, 22 nt, Shigella flexneri 2a str. 301
auuggcaucugguacaacaauu

SEQ ID NO: 235607 - RNA, 22 nt, Shigella flexneri 2a str. 301
gauugaugaccugagcuucucg

SEQ ID NO: 235608 - RNA, 22 nt, Shigella flexneri 2a str. 301
cggcgguugcgugguggaugag

SEQ ID NO: 235609 - RNA, 22 nt, Shigella flexneri 2a str. 301
augucgaccuauguugauuaua

SEQ ID NO: 235610 - RNA, 22 nt, Shigella flexneri 2a str. 301
gaucaggaauugcuuacuuggu

SEQ ID NO: 235611 - RNA, 22 nt, Shigella flexneri 2a str. 301
gccgcuucuuccagcaggaucu

SEQ ID NO: 235612 - RNA, 18 nt, Shigella flexneri 2a str. 301
accaauguauauugcgga

SEQ ID NO: 235613 - RNA, 22 nt, Shigella flexneri 2a str. 301
agcagcauaauauuucgcgcag

SEQ ID NO: 235614 - RNA, 22 nt, Shigella flexneri 2a str. 301
uggacgcugauuuucugcgccc

SEQ ID NO: 235615 - RNA, 22 nt, Shigella flexneri 2a str. 301
aucgauuauaugcaggguuauc

SEQ ID NO: 235616 - RNA, 19 nt, Shigella flexneri 2a str. 301
ccugcucgaugaagccaga

SEQ ID NO: 235617 - RNA, 22 nt, Shigella flexneri 2a str. 301
cgcccgaaugugucaacggcaa

SEQ ID NO: 235618 - RNA, 22 nt, Shigella flexneri 2a str. 301
acgcacguuuugcacgccaguu

SEQ ID NO: 235619 - RNA, 17 nt, Shigella flexneri 2a str. 301
ucgacgaucggguugaa

SEQ ID NO: 235620 - RNA, 22 nt, Shigella flexneri 2a str. 301
cgaguaggcgggauaaggcguu

SEQ ID NO: 235621 - RNA, 22 nt, Shigella flexneri 2a str. 301
guaauagcacaugacaaaaaug

SEQ ID NO: 235622 - RNA, 22 nt, Shigella flexneri 2a str. 301
uugcccgcuuacugauuauugg

SEQ ID NO: 235623 - RNA, 22 nt, Shigella flexneri 2a str. 301
caggccuacgugguuuaugcaa

SEQ ID NO: 235624 - RNA, 22 nt, Shigella flexneri 2a str. 301
ucgaaguuuauccgcaagguuu

SEQ ID NO: 235625 - RNA, 22 nt, Shigella flexneri 2a str. 301
agaagugugguuuuguagauau

SEQ ID NO: 235626 - RNA, 22 nt, Shigella flexneri 2a str. 301
uguuaccgccggauuuacgccg

SEQ ID NO: 235627 - RNA, 22 nt, Shigella flexneri 2a str. 301
uagcggacgucgacuacuggaa

SEQ ID NO: 235628 - RNA, 21 nt, Shigella flexneri 2a str. 301
uacguucuacaaaccugugcc

SEQ ID NO: 235629 - RNA, 22 nt, Shigella flexneri 2a str. 301
cgacuacguuaacacucgccga

SEQ ID NO: 235630 - RNA, 22 nt, Shigella flexneri 2a str. 301
ccguugcugaugaagcuggugg

SEQ ID NO: 235631 - RNA, 22 nt, Shigella flexneri 2a str. 301
cagccgguaagccugcuuuuca

SEQ ID NO: 235632 - RNA, 22 nt, Shigella flexneri 2a str. 301
agcaacugacgcuucggauccc

SEQ ID NO: 235633 - RNA, 22 nt, Shigella flexneri 2a str. 301
cucguaggccugauaagcgcag

SEQ ID NO: 235634 - RNA, 22 nt, Shigella flexneri 2a str. 301
uacccgcgugcuggcagggaug

SEQ ID NO: 235635 - RNA, 22 nt, Shigella flexneri 2a str. 301
aaugccagcgccacagcgauaa

SEQ ID NO: 235636 - RNA, 22 nt, Shigella flexneri 2a str. 301
uaaucccgauugaagagaaguu

SEQ ID NO: 235637 - RNA, 23 nt, Shigella flexneri 2a str. 301
acgaugaagccuuccugcaacag

SEQ ID NO: 235638 - RNA, 22 nt, Shigella flexneri 2a str. 301
ucaccgccucucgcguggcagg

SEQ ID NO: 235639 - RNA, 22 nt, Shigella flexneri 2a str. 301
ugcacgcgguggaagcuuucuu

SEQ ID NO: 235640 - RNA, 22 nt, Shigella flexneri 2a str. 301
ggagacauucucgccaccgcgu

SEQ ID NO: 235641 - RNA, 22 nt, Shigella flexneri 2a str. 301
cggaaggcgauaaagcgauuga

SEQ ID NO: 235642 - RNA, 21 nt, Shigella flexneri 2a str. 301
gagcgcaggcggaauggcggc

SEQ ID NO: 235643 - RNA, 22 nt, Shigella flexneri 2a str. 301
gucgagaaagaagagaauggcg

SEQ ID NO: 235644 - RNA, 22 nt, Shigella flexneri 2a str. 301
agccgcuguaucaccaguucug

SEQ ID NO: 235645 - RNA, 22 nt, Shigella flexneri 2a str. 301
uucuucagucagccgcaugagc

SEQ ID NO: 235646 - RNA, 22 nt, Shigella flexneri 2a str. 301
aguuugcuauugaccaggaaaa

SEQ ID NO: 235647 - RNA, 22 nt, Shigella flexneri 2a str. 301
cgcguucuuuaagccauggcga

SEQ ID NO: 235648 - RNA, 22 nt, Shigella flexneri 2a str. 301
accggcacacugcgcgccucau

SEQ ID NO: 235649 - RNA, 22 nt, Shigella flexneri 2a str. 301
ucugcccgaagaggugauuccu

SEQ ID NO: 235650 - RNA, 22 nt, Shigella flexneri 2a str. 301
ucugccaucaaauaugcccgcg

SEQ ID NO: 235651 - RNA, 22 nt, Shigella flexneri 2a str. 301
cagauugauuaucaacuggaug

SEQ ID NO: 235652 - RNA, 22 nt, Shigella flexneri 2a str. 301
gcauucaucaugguucucgguu

SEQ ID NO: 235653 - RNA, 22 nt, Shigella flexneri 2a str. 301
uugcacgauuuuguaggccgga

SEQ ID NO: 235654 - RNA, 22 nt, Shigella flexneri 2a str. 301
agugaucaggacgauauuuggu

SEQ ID NO: 235655 - RNA, 21 nt, Shigella flexneri 2a str. 301
cgggaacaucguuaccucuga

SEQ ID NO: 235656 - RNA, 22 nt, Shigella flexneri 2a str. 301
gccacucaaacucaaccauacg

SEQ ID NO: 235657 - RNA, 22 nt, Shigella flexneri 2a str. 301
gugccguuguucuacgccgaga

SEQ ID NO: 235658 - RNA, 18 nt, Shigella flexneri 2a str. 301
acgaaucagcgccauaaa

SEQ ID NO: 235659 - RNA, 22 nt, Shigella flexneri 2a str. 301
gaucgacgccguucgcgcugaa

SEQ ID NO: 235660 - RNA, 22 nt, Shigella flexneri 2a str. 301
ugcaggccaaaaucgucaccua

SEQ ID NO: 235661 - RNA, 22 nt, Shigella flexneri 2a str. 301
cuucacaguauauuugaaaaag

SEQ ID NO: 235662 - RNA, 18 nt, Shigella flexneri 2a str. 301
ccugcugggguuacugcc

SEQ ID NO: 235663 - RNA, 22 nt, Shigella flexneri 2a str. 301
accggugcuuuaaaguguucuu

SEQ ID NO: 235664 - RNA, 22 nt, Shigella flexneri 2a str. 301
ccugggaagauguaagccgcca

SEQ ID NO: 235665 - RNA, 22 nt, Shigella flexneri 2a str. 301
caggccuacaagaugauugcaa

SEQ ID NO: 235666 - RNA, 22 nt, Shigella flexneri 2a str. 301
gauugcgggugaaaaacugacg

SEQ ID NO: 235667 - RNA, 22 nt, Shigella flexneri 2a str. 301
cuguugcaguacuuucguggug

SEQ ID NO: 235668 - RNA, 22 nt, Shigella flexneri 2a str. 301
cuugccgugacaaauaaugaug

SEQ ID NO: 235669 - RNA, 22 nt, Shigella flexneri 2a str. 301
cguaauguuaacuggggcuuuu

SEQ ID NO: 235670 - RNA, 22 nt, Shigella flexneri 2a str. 301
cagcgacgcgccagcaggaaag

SEQ ID NO: 235671 - RNA, 22 nt, Shigella flexneri 2a str. 301
ucuggcgguagugacgaucaaa

SEQ ID NO: 235672 - RNA, 22 nt, Shigella flexneri 2a str. 301
uccggccuacaaaguccugcag

SEQ ID NO: 235673 - RNA, 22 nt, Shigella flexneri 2a str. 301
uugaugaccgguauugaugaac

SEQ ID NO: 235674 - RNA, 22 nt, Shigella flexneri 2a str. 301
aucuuugcacugcuuaaccaug

SEQ ID NO: 235675 - RNA, 21 nt, Shigella flexneri 2a str. 301
aucaggaacaaccggcgcgac

SEQ ID NO: 235676 - RNA, 22 nt, Shigella flexneri 2a str. 301
ggaaguguuacagcgauugcga

SEQ ID NO: 235677 - RNA, 22 nt, Shigella flexneri 2a str. 301
gagguaaucugaaaaaggugca

SEQ ID NO: 235678 - RNA, 22 nt, Shigella flexneri 2a str. 301
ccgguaagaccaccacuuucua

SEQ ID NO: 235679 - RNA, 22 nt, Shigella flexneri 2a str. 301
aacugaauguauuuacccacgg

SEQ ID NO: 235680 - RNA, 21 nt, Shigella flexneri 2a str. 301
aucacgauccgcgcguugcag

SEQ ID NO: 235681 - RNA, 22 nt, Shigella flexneri 2a str. 301
uggcaggccauuggguugagaa

SEQ ID NO: 235682 - RNA, 22 nt, Shigella flexneri 2a str. 301
ucacugaugagccagguucugg

SEQ ID NO: 235683 - RNA, 22 nt, Shigella flexneri 2a str. 301
uguaccuucaccguuggcggca

SEQ ID NO: 235684 - RNA, 22 nt, Shigella flexneri 2a str. 301
accguuuggcuguuucacgccg

SEQ ID NO: 235685 - RNA, 22 nt, Shigella flexneri 2a str. 301
cagucagugguuugcccuucuu

SEQ ID NO: 235686 - RNA, 22 nt, Shigella flexneri 2a str. 301
cuaucaauauuuugcguauuca

SEQ ID NO: 235687 - RNA, 22 nt, Shigella flexneri 2a str. 301
agaagcugaaaucauacgguuu

SEQ ID NO: 235688 - RNA, 20 nt, Shigella flexneri 2a str. 301
cgcugauauuggcgcgcaug

SEQ ID NO: 235689 - RNA, 23 nt, Shigella flexneri 2a str. 301
uauccgaccuacaaaaccgugca

SEQ ID NO: 235690 - RNA, 22 nt, Shigella flexneri 2a str. 301
caguuucgaggcgaugggcguu

SEQ ID NO: 235691 - RNA, 22 nt, Shigella flexneri 2a str. 301
uaaaccgaugguggugaugacc

SEQ ID NO: 235692 - RNA, 22 nt, Shigella flexneri 2a str. 301
aacggcgaugaagugucgauca

SEQ ID NO: 235693 - RNA, 22 nt, Shigella flexneri 2a str. 301
guugcgucugcuccugaaugac

SEQ ID NO: 235694 - RNA, 22 nt, Shigella flexneri 2a str. 301
gcggugaccaguuaaacucucg

SEQ ID NO: 235695 - RNA, 22 nt, Shigella flexneri 2a str. 301
gaagcguuggucaguaguuguu

SEQ ID NO: 235696 - RNA, 22 nt, Shigella flexneri 2a str. 301
ugcuaaagauuugauuaccgug

SEQ ID NO: 235697 - RNA, 22 nt, Shigella flexneri 2a str. 301
aaugcaguagucgcagcggaag

SEQ ID NO: 235698 - RNA, 22 nt, Shigella flexneri 2a str. 301
agcagacaaacagcgucgaggu

SEQ ID NO: 235699 - RNA, 22 nt, Shigella flexneri 2a str. 301
ucugguaaucgcaacuuuggug

SEQ ID NO: 235700 - RNA, 22 nt, Shigella flexneri 2a str. 301
cuggugauuggcgcaggcaugg

SEQ ID NO: 235701 - RNA, 22 nt, Shigella flexneri 2a str. 301
guugagcuguuuuagcgaaaca

SEQ ID NO: 235702 - RNA, 22 nt, Shigella flexneri 2a str. 301
cgccguugaugauacauaucaa

SEQ ID NO: 235703 - RNA, 22 nt, Shigella flexneri 2a str. 301
gcugaugggcgugcugccagug

SEQ ID NO: 235704 - RNA, 22 nt, Shigella flexneri 2a str. 301
auuagcgacaacauucgugcca

SEQ ID NO: 235705 - RNA, 22 nt, Shigella flexneri 2a str. 301
gaaugguguuccgacuggaaau

SEQ ID NO: 235706 - RNA, 23 nt, Shigella flexneri 2a str. 301
gacauuacaggguuugcgucagc

SEQ ID NO: 235707 - RNA, 22 nt, Shigella flexneri 2a str. 301
ugccggucuggucaucggcagu

SEQ ID NO: 235708 - RNA, 22 nt, Shigella flexneri 2a str. 301
ccgcugcaguuaauacgccgcu

SEQ ID NO: 235709 - RNA, 22 nt, Shigella flexneri 2a str. 301
acgcgaaguauauuuguucggc

SEQ ID NO: 235710 - RNA, 22 nt, Shigella flexneri 2a str. 301
uuugucaauaaucugaaacccc

SEQ ID NO: 235711 - RNA, 20 nt, Shigella flexneri 2a str. 301
ugcgcagaaagucgccuucu

SEQ ID NO: 235712 - RNA, 22 nt, Shigella flexneri 2a str. 301
acagagauguuuaauccuggcg

SEQ ID NO: 235713 - RNA, 23 nt, Shigella flexneri 2a str. 301
cguaauguuaacuggggcuuuuc

SEQ ID NO: 235714 - RNA, 22 nt, Shigella flexneri 2a str. 301
ucaguuugcccugauauucguc

SEQ ID NO: 235715 - RNA, 22 nt, Shigella flexneri 2a str. 301
caggcauggaggucacgguuga

SEQ ID NO: 235716 - RNA, 22 nt, Shigella flexneri 2a str. 301
aaucgguagcaguuguuugcuc

SEQ ID NO: 235717 - RNA, 22 nt, Shigella flexneri 2a str. 301
accuggucuuuuccaucuugcg

SEQ ID NO: 235718 - RNA, 22 nt, Shigella flexneri 2a str. 301
agcggcuuuccggcgagguggc

SEQ ID NO: 235719 - RNA, 22 nt, Shigella flexneri 2a str. 301
cugaaccaauccagauccagau

SEQ ID NO: 235720 - RNA, 23 nt, Shigella flexneri 2a str. 301
guuuacccaaugaagaugcgccg

SEQ ID NO: 235721 - RNA, 22 nt, Shigella flexneri 2a str. 301
ucagacaauugacggcuugacg

SEQ ID NO: 235722 - RNA, 22 nt, Shigella flexneri 2a str. 301
ugaauugauuaaaaauaagcca

SEQ ID NO: 235723 - RNA, 22 nt, Shigella flexneri 2a str. 301
gcucuucgacaucuuugucugc

SEQ ID NO: 235724 - RNA, 23 nt, Shigella flexneri 2a str. 301
uccgccugccaguaggcaaugaa

SEQ ID NO: 235725 - RNA, 23 nt, Shigella flexneri 2a str. 301
aucaauugccgcuucgacguaaa

SEQ ID NO: 235726 - RNA, 22 nt, Shigella flexneri 2a str. 301
cguuccugcuccugcuccaucc

SEQ ID NO: 235727 - RNA, 23 nt, Shigella flexneri 2a str. 301
gaaauccggacgcguuaacaccg

SEQ ID NO: 235728 - RNA, 22 nt, Shigella flexneri 2a str. 301
gcgcaaugucgacacuuuuugc

SEQ ID NO: 235729 - RNA, 22 nt, Shigella flexneri 2a str. 301
ccauccgggcgaagccauggac

SEQ ID NO: 235730 - RNA, 22 nt, Shigella flexneri 2a str. 301
ucaucgguuucaaugacuuuug

SEQ ID NO: 235731 - RNA, 20 nt, Shigella flexneri 2a str. 301
gugugaccgccgucauauua

SEQ ID NO: 235732 - RNA, 22 nt, Shigella flexneri 2a str. 301
ucugguauggauguggcgcgua

SEQ ID NO: 235733 - RNA, 22 nt, Shigella flexneri 2a str. 301
caacggugagcguagcgugcug

SEQ ID NO: 235734 - RNA, 22 nt, Shigella flexneri 2a str. 301
aacaggcuuaagacgcucgaac

SEQ ID NO: 235735 - RNA, 22 nt, Shigella flexneri 2a str. 301
aucguuguagaguuugaucagg

SEQ ID NO: 235736 - RNA, 22 nt, Shigella flexneri 2a str. 301
agcgggauuaucucaagcuggu

SEQ ID NO: 235737 - RNA, 22 nt, Shigella flexneri 2a str. 301
ugcugacuuuaaggcaguaugu

SEQ ID NO: 235738 - RNA, 22 nt, Shigella flexneri 2a str. 301
cugauucugguaaccauaauuu

SEQ ID NO: 235739 - RNA, 22 nt, Shigella flexneri 2a str. 301
caccgcuguuagucagaacugu

SEQ ID NO: 235740 - RNA, 22 nt, Shigella flexneri 2a str. 301
uuggcacuacgcuuucuggcua

SEQ ID NO: 235741 - RNA, 22 nt, Shigella flexneri 2a str. 301
aucaguaaguuggagucauuac

SEQ ID NO: 235742 - RNA, 22 nt, Shigella flexneri 2a str. 301
cgauggaucgcugggaucaugg

SEQ ID NO: 235743 - RNA, 22 nt, Shigella flexneri 2a str. 301
gccaccuuccaugccaacgccu

SEQ ID NO: 235744 - RNA, 22 nt, Shigella flexneri 2a str. 301
auuuccagaaacauuaucagac

SEQ ID NO: 235745 - RNA, 22 nt, Shigella flexneri 2a str. 301
cgcucauuuuuguucggugugg

SEQ ID NO: 235746 - RNA, 22 nt, Shigella flexneri 2a str. 301
cgggcuauuuuucaccgaguuc

SEQ ID NO: 235747 - RNA, 19 nt, Shigella flexneri 2a str. 301
ccagguuggcguccagcug

SEQ ID NO: 235748 - RNA, 22 nt, Shigella flexneri 2a str. 301
cgcuucaugcagggcuuuacga

SEQ ID NO: 235749 - RNA, 22 nt, Shigella flexneri 2a str. 301
gaguuuaucuucuacuacguga

SEQ ID NO: 235750 - RNA, 21 nt, Shigella flexneri 2a str. 301
caccggaagguaacugcgcgg

SEQ ID NO: 235751 - RNA, 22 nt, Shigella flexneri 2a str. 301
caaagugugucgucggcauggu

SEQ ID NO: 235752 - RNA, 22 nt, Shigella flexneri 2a str. 301
guuaucgacguauuccagacgg

SEQ ID NO: 235753 - RNA, 22 nt, Shigella flexneri 2a str. 301
gaugugauugucugcgcugaaa

SEQ ID NO: 235754 - RNA, 22 nt, Shigella flexneri 2a str. 301
uaucauguucucguucgguggu

SEQ ID NO: 235755 - RNA, 22 nt, Shigella flexneri 2a str. 301
gagcacggcuugcgcugcuuca

SEQ ID NO: 235756 - RNA, 22 nt, Shigella flexneri 2a str. 301
ugcaggaagggcaacagccguc

SEQ ID NO: 235757 - RNA, 22 nt, Shigella flexneri 2a str. 301
ggcgacagugcgcagcggucag

SEQ ID NO: 235758 - RNA, 22 nt, Shigella flexneri 2a str. 301
guaccaaauuccagaaaagaga

SEQ ID NO: 235759 - RNA, 22 nt, Shigella flexneri 2a str. 301
ugcaagugaaaaagagcggcau

SEQ ID NO: 235760 - RNA, 22 nt, Shigella flexneri 2a str. 301
ucaucuacaucgguuguuuaaa

SEQ ID NO: 235761 - RNA, 22 nt, Shigella flexneri 2a str. 301
uaucgagaucggcauacgccgu

SEQ ID NO: 235762 - RNA, 21 nt, Shigella flexneri 2a str. 301
gucgcgucuucucgcggauga

SEQ ID NO: 235763 - RNA, 22 nt, Shigella flexneri 2a str. 301
aucggugguguauuccgcaucg

SEQ ID NO: 235764 - RNA, 22 nt, Shigella flexneri 2a str. 301
cucagaaaagaucgcuacgagu

SEQ ID NO: 235765 - RNA, 22 nt, Shigella flexneri 2a str. 301
cagauauaaacacgcgccguau

SEQ ID NO: 235766 - RNA, 22 nt, Shigella flexneri 2a str. 301
aaggcguugcagugcauggaug

SEQ ID NO: 235767 - RNA, 22 nt, Shigella flexneri 2a str. 301
gugucgaugcguugcucuugca

SEQ ID NO: 235768 - RNA, 20 nt, Shigella flexneri 2a str. 301
ugucuaugguucagagcugu

SEQ ID NO: 235769 - RNA, 22 nt, Shigella flexneri 2a str. 301
uuaacgccauuugcgccauuga

SEQ ID NO: 235770 - RNA, 22 nt, Shigella flexneri 2a str. 301
ugcaaaugcugaucuuuaccgu

SEQ ID NO: 235771 - RNA, 21 nt, Shigella flexneri 2a str. 301
aacugcuccauucguuguuga

SEQ ID NO: 235772 - RNA, 22 nt, Shigella flexneri 2a str. 301
ucaggccuacacggagauugca

SEQ ID NO: 235773 - RNA, 22 nt, Shigella flexneri 2a str. 301
cacggugugcguuucgccagug

SEQ ID NO: 235774 - RNA, 22 nt, Shigella flexneri 2a str. 301
ucgcgccugacgauuauucgua

SEQ ID NO: 235775 - RNA, 22 nt, Shigella flexneri 2a str. 301
ucaaccagaacauaucgccgcc

SEQ ID NO: 235776 - RNA, 20 nt, Shigella flexneri 2a str. 301
aauugccugagaaucagcaa

SEQ ID NO: 235777 - RNA, 22 nt, Shigella flexneri 2a str. 301
ugucguuaucaauugcuccggu

SEQ ID NO: 235778 - RNA, 22 nt, Shigella flexneri 2a str. 301
gcugauggccggucuugauggu

SEQ ID NO: 235779 - RNA, 22 nt, Shigella flexneri 2a str. 301
uugcgaauugccgaagugauua

SEQ ID NO: 235780 - RNA, 22 nt, Shigella flexneri 2a str. 301
accgcgacgcagaccgucggag

SEQ ID NO: 235781 - RNA, 22 nt, Shigella flexneri 2a str. 301
ugcccgucagguccguguggua

SEQ ID NO: 235782 - RNA, 22 nt, Shigella flexneri 2a str. 301
aacgagaucugcggcuugucgu

SEQ ID NO: 235783 - RNA, 22 nt, Shigella flexneri 2a str. 301
cuacgcuuaucaggccuacgug

SEQ ID NO: 235784 - RNA, 23 nt, Shigella flexneri 2a str. 301
gccuacuguuaggucaugccagc

SEQ ID NO: 235785 - RNA, 22 nt, Shigella flexneri 2a str. 301
aacuggaagaacuggcgacgcg

SEQ ID NO: 235786 - RNA, 22 nt, Shigella flexneri 2a str. 301
gaugccguuuuagacgcgaucc

SEQ ID NO: 235787 - RNA, 22 nt, Shigella flexneri 2a str. 301
cacgcucaauaucggcaucuuc

SEQ ID NO: 235788 - RNA, 19 nt, Shigella flexneri 2a str. 301
agcucaaucugguacagcu

SEQ ID NO: 235789 - RNA, 22 nt, Shigella flexneri 2a str. 301
agcguaucaggauaucuauaca

SEQ ID NO: 235790 - RNA, 22 nt, Shigella flexneri 2a str. 301
ucgcagacgcugaaugaucugu

SEQ ID NO: 235791 - RNA, 22 nt, Shigella flexneri 2a str. 301
gacuggaaacccgugccaugcu

SEQ ID NO: 235792 - RNA, 22 nt, Shigella flexneri 2a str. 301
uagaacuggugcgucagcagcu

SEQ ID NO: 235793 - RNA, 20 nt, Shigella flexneri 2a str. 301
gcgucuggaagaagaacgcc

SEQ ID NO: 235794 - RNA, 22 nt, Shigella flexneri 2a str. 301
aacagguuacggucgccguaaa

SEQ ID NO: 235795 - RNA, 18 nt, Shigella flexneri 2a str. 301
uccgagcuggucauucgc

SEQ ID NO: 235796 - RNA, 22 nt, Shigella flexneri 2a str. 301
cacgguuuccuguaaaguggug

SEQ ID NO: 235797 - RNA, 22 nt, Shigella flexneri 2a str. 301
ccaguaaucaagacaguaccag

SEQ ID NO: 235798 - RNA, 22 nt, Shigella flexneri 2a str. 301
ggccuggacguugcagggcagc

SEQ ID NO: 235799 - RNA, 22 nt, Shigella flexneri 2a str. 301
cgcacaauuuucagcgcaaucu

SEQ ID NO: 235800 - RNA, 22 nt, Shigella flexneri 2a str. 301
gauuaucaccuguugcccuuug

SEQ ID NO: 235801 - RNA, 22 nt, Shigella flexneri 2a str. 301
aaggcguuauuauuaauugccg

SEQ ID NO: 235802 - RNA, 22 nt, Shigella flexneri 2a str. 301
ccaucgccuguacgaugcgcuc

SEQ ID NO: 235803 - RNA, 22 nt, Shigella flexneri 2a str. 301
uacguuauccaucaccagaauc

SEQ ID NO: 235804 - RNA, 22 nt, Shigella flexneri 2a str. 301
cauugcgcagguuuggagugau

SEQ ID NO: 235805 - RNA, 22 nt, Shigella flexneri 2a str. 301
cugugcgccaaauccacugacc

SEQ ID NO: 235806 - RNA, 22 nt, Shigella flexneri 2a str. 301
agcugcugacgcaccaguucua

SEQ ID NO: 235807 - RNA, 22 nt, Shigella flexneri 2a str. 301
ugugacgaaaaccuuuaauugu

SEQ ID NO: 235808 - RNA, 22 nt, Shigella flexneri 2a str. 301
ggugauagcguuccugcaauuc

SEQ ID NO: 235809 - RNA, 22 nt, Shigella flexneri 2a str. 301
gugggaauacgugucagcgauc

SEQ ID NO: 235810 - RNA, 22 nt, Shigella flexneri 2a str. 301
cagaacuggugauacagcggcu

SEQ ID NO: 235811 - RNA, 22 nt, Shigella flexneri 2a str. 301
cuggcgauguucuaugaagugg

SEQ ID NO: 235812 - RNA, 22 nt, Shigella flexneri 2a str. 301
acuuccuguuccgaggaggcga

SEQ ID NO: 235813 - RNA, 22 nt, Shigella flexneri 2a str. 301
cuccagcuuacgguuaccagac

SEQ ID NO: 235814 - RNA, 22 nt, Shigella flexneri 2a str. 301
ccauggcaacuaaaacguacag

SEQ ID NO: 235815 - RNA, 22 nt, Shigella flexneri 2a str. 301
cgaugcaggcacaccgcuauga

SEQ ID NO: 235816 - RNA, 22 nt, Shigella flexneri 2a str. 301
cugauuucccagugacaacaua

SEQ ID NO: 235817 - RNA, 22 nt, Shigella flexneri 2a str. 301
aagugcaacggcuugcagauca

SEQ ID NO: 235818 - RNA, 22 nt, Shigella flexneri 2a str. 301
agcaaaugguugaaaucgccaa

SEQ ID NO: 235819 - RNA, 18 nt, Shigella flexneri 2a str. 301
uguacggugucagcccag

SEQ ID NO: 235820 - RNA, 22 nt, Shigella flexneri 2a str. 301
cguucacgaugauuacaaccgu

SEQ ID NO: 235821 - RNA, 22 nt, Shigella flexneri 2a str. 301
aucgcaaucgaaacaaucggug

SEQ ID NO: 235822 - RNA, 22 nt, Shigella flexneri 2a str. 301
agcguguuacugaauaccugac

SEQ ID NO: 235823 - RNA, 22 nt, Shigella flexneri 2a str. 301
uuaaacugaacauugaagcuaa

SEQ ID NO: 235824 - RNA, 22 nt, Shigella flexneri 2a str. 301
ugcuagaacgucaucggcuacu

SEQ ID NO: 235825 - RNA, 22 nt, Shigella flexneri 2a str. 301
gaugcgaagcagggcggcgguu

SEQ ID NO: 235826 - RNA, 22 nt, Shigella flexneri 2a str. 301
ugccaggcguaauucgcugaaa

SEQ ID NO: 235827 - RNA, 22 nt, Shigella flexneri 2a str. 301
uucgaguugaucgucagagaug

SEQ ID NO: 235828 - RNA, 22 nt, Shigella flexneri 2a str. 301
cagcccguuauguacgaaggcc

SEQ ID NO: 235829 - RNA, 22 nt, Shigella flexneri 2a str. 301
uauccgaugguuuagccuguau

SEQ ID NO: 235830 - RNA, 22 nt, Shigella flexneri 2a str. 301
agcggauaauaaaucaucgguu

SEQ ID NO: 235831 - RNA, 22 nt, Shigella flexneri 2a str. 301
gaugcguaucccgaucuugauc

SEQ ID NO: 235832 - RNA, 22 nt, Shigella flexneri 2a str. 301
aucguugucagaccuauuagcg

SEQ ID NO: 235833 - RNA, 22 nt, Shigella flexneri 2a str. 301
ucgcaaaccgggccugacgcug

SEQ ID NO: 235834 - RNA, 22 nt, Shigella flexneri 2a str. 301
uuuaugacaguccagacaggcg

SEQ ID NO: 235835 - RNA, 22 nt, Shigella flexneri 2a str. 301
ucacugcgaucugaaagacaac

SEQ ID NO: 235836 - RNA, 22 nt, Shigella flexneri 2a str. 301
ggaguugaucuuucgcgcguca

SEQ ID NO: 235837 - RNA, 22 nt, Shigella flexneri 2a str. 301
uggcucucccccauuuacggau

SEQ ID NO: 235838 - RNA, 22 nt, Shigella flexneri 2a str. 301
ugauugauccuugcgcgcggca

SEQ ID NO: 235839 - RNA, 22 nt, Shigella flexneri 2a str. 301
ggcaguggguacgcagcgccag

SEQ ID NO: 235840 - RNA, 22 nt, Shigella flexneri 2a str. 301
caucguuuccgauggaagcaua

SEQ ID NO: 235841 - RNA, 22 nt, Shigella flexneri 2a str. 301
ucaggcaaaugccaguaaaaac

SEQ ID NO: 235842 - RNA, 22 nt, Shigella flexneri 2a str. 301
accagcagcagcguauucaguu

SEQ ID NO: 235843 - RNA, 22 nt, Shigella flexneri 2a str. 301
caucggcuacagcagcagccug

SEQ ID NO: 235844 - RNA, 22 nt, Shigella flexneri 2a str. 301
ugccacguaauucugcuucgcu

SEQ ID NO: 235845 - RNA, 22 nt, Shigella flexneri 2a str. 301
ugccgcucuucuuuaccgguug

SEQ ID NO: 235846 - RNA, 22 nt, Shigella flexneri 2a str. 301
ucgccgcaauggaccgggaucu

SEQ ID NO: 235847 - RNA, 22 nt, Shigella flexneri 2a str. 301
auggagcgagaaaacccgcaca

SEQ ID NO: 235848 - RNA, 22 nt, Shigella flexneri 2a str. 301
ggcuucgucauuccgaaaggcu

SEQ ID NO: 235849 - RNA, 22 nt, Shigella flexneri 2a str. 301
ucgacgaauuugcuauauuugc

SEQ ID NO: 235850 - RNA, 19 nt, Shigella flexneri 2a str. 301
aagauacgaaacgggugcu

SEQ ID NO: 235851 - RNA, 22 nt, Shigella flexneri 2a str. 301
agacguaauaguugagccaguu

SEQ ID NO: 235852 - RNA, 22 nt, Shigella flexneri 2a str. 301
aucugacggauaaaaaucgcga

SEQ ID NO: 235853 - RNA, 22 nt, Shigella flexneri 2a str. 301
cucgacgcugcucggucaguug

SEQ ID NO: 235854 - RNA, 22 nt, Shigella flexneri 2a str. 301
ugcagacguugauugaacagcu

SEQ ID NO: 235855 - RNA, 22 nt, Shigella flexneri 2a str. 301
gcgucuuaucaggccuacgaag

SEQ ID NO: 235856 - RNA, 22 nt, Shigella flexneri 2a str. 301
aaagcgucaauauuugcgccug

SEQ ID NO: 235857 - RNA, 20 nt, Shigella flexneri 2a str. 301
aucuggcauaaacaaagcgc

SEQ ID NO: 235858 - RNA, 22 nt, Shigella flexneri 2a str. 301
caagcagauugugcucuccacg

SEQ ID NO: 235859 - RNA, 22 nt, Shigella flexneri 2a str. 301
gcaggcgagugaaacauagaga

SEQ ID NO: 235860 - RNA, 22 nt, Shigella flexneri 2a str. 301
cuggcaggcuguaaauuauugc

SEQ ID NO: 235861 - RNA, 22 nt, Shigella flexneri 2a str. 301
gaugaucaugaugucggcaucu

SEQ ID NO: 235862 - RNA, 18 nt, Shigella flexneri 2a str. 301
cggcaacuaccagaccca

SEQ ID NO: 235863 - RNA, 22 nt, Shigella flexneri 2a str. 301
ucggauacgcaacucagcugcg

SEQ ID NO: 235864 - RNA, 22 nt, Shigella flexneri 2a str. 301
cucaggcaagagugguuauaca

SEQ ID NO: 235865 - RNA, 22 nt, Shigella flexneri 2a str. 301
cgaggccuguaugcucggcggg

SEQ ID NO: 235866 - RNA, 22 nt, Shigella flexneri 2a str. 301
uucugaaaacaaccgaugguaa

SEQ ID NO: 235867 - RNA, 22 nt, Shigella flexneri 2a str. 301
aguugcaauugucuggucaaua

SEQ ID NO: 235868 - RNA, 22 nt, Shigella flexneri 2a str. 301
aauaccguggaauaugccgggg

SEQ ID NO: 235869 - RNA, 23 nt, Shigella flexneri 2a str. 301
ugacuuucagcaguugcugacgg

SEQ ID NO: 235870 - RNA, 22 nt, Shigella flexneri 2a str. 301
aacggcgaagagcugaaagcgu

SEQ ID NO: 235871 - RNA, 22 nt, Shigella flexneri 2a str. 301
cagaauauuugccauaagggaa

SEQ ID NO: 235872 - RNA, 22 nt, Shigella flexneri 2a str. 301
auccagugcuucaucaucgaca

SEQ ID NO: 235873 - RNA, 22 nt, Shigella flexneri 2a str. 301
ccggaagacgaacuugccagcg

SEQ ID NO: 235874 - RNA, 22 nt, Shigella flexneri 2a str. 301
augcuugcuucauggcugcgga

SEQ ID NO: 235875 - RNA, 22 nt, Shigella flexneri 2a str. 301
ccauuaccuuuaacggacuguc

SEQ ID NO: 235876 - RNA, 22 nt, Shigella flexneri 2a str. 301
cugaugcgucuuaucaggccua

SEQ ID NO: 235877 - RNA, 22 nt, Shigella flexneri 2a str. 301
auuccaggagugaguauucagg

SEQ ID NO: 235878 - RNA, 22 nt, Shigella flexneri 2a str. 301
cugccggacugaaaauugauga

SEQ ID NO: 235879 - RNA, 23 nt, Shigella flexneri 2a str. 301
cuucaacgcagcguugccacuuc

SEQ ID NO: 235880 - RNA, 22 nt, Shigella flexneri 2a str. 301
aucaggccuacauagucccugc

SEQ ID NO: 235881 - RNA, 22 nt, Shigella flexneri 2a str. 301
ucgcuucgguuaaaaaaaggca

SEQ ID NO: 235882 - RNA, 22 nt, Shigella flexneri 2a str. 301
agcuguaauuucccgcguuugu

SEQ ID NO: 235883 - RNA, 22 nt, Shigella flexneri 2a str. 301
uaugcugcugacuacucuucgu

SEQ ID NO: 235884 - RNA, 22 nt, Shigella flexneri 2a str. 301
aaucacaguagucgaaguuuuu

SEQ ID NO: 235885 - RNA, 22 nt, Shigella flexneri 2a str. 301
uugccguagccgaccaccgcaa

SEQ ID NO: 235886 - RNA, 22 nt, Shigella flexneri 2a str. 301
gcuguucaacuccaaacucucu

SEQ ID NO: 235887 - RNA, 22 nt, Shigella flexneri 2a str. 301
agcguauuaagaaugagcugga

SEQ ID NO: 235888 - RNA, 22 nt, Shigella flexneri 2a str. 301
cguccggucgggcaggugugcu

SEQ ID NO: 235889 - RNA, 22 nt, Shigella flexneri 2a str. 301
gcgacggaaagaaggcguuuuc

SEQ ID NO: 235890 - RNA, 22 nt, Shigella flexneri 2a str. 301
ucaaugauggugccucgcuguu

SEQ ID NO: 235891 - RNA, 22 nt, Shigella flexneri 2a str. 301
gaagguuucgguguuuauacaa

SEQ ID NO: 235892 - RNA, 22 nt, Shigella flexneri 2a str. 301
cguggaugauacuccagcugca

SEQ ID NO: 235893 - RNA, 22 nt, Shigella flexneri 2a str. 301
cgcuguugccaacgccgcaaag

SEQ ID NO: 235894 - RNA, 22 nt, Shigella flexneri 2a str. 301
augaguauuuagacuaaagagu

SEQ ID NO: 235895 - RNA, 22 nt, Shigella flexneri 2a str. 301
aggccggauaaggcguucacgc

SEQ ID NO: 235896 - RNA, 22 nt, Shigella flexneri 2a str. 301
cgcguugaaaucugccgacgua

SEQ ID NO: 235897 - RNA, 22 nt, Shigella flexneri 2a str. 301
ucacgauaaacagcccugcguu

SEQ ID NO: 235898 - RNA, 22 nt, Shigella flexneri 2a str. 301
uacgcgcgaccaacggguagua

SEQ ID NO: 235899 - RNA, 22 nt, Shigella flexneri 2a str. 301
ugcaccaggaacgauccuugaa

SEQ ID NO: 235900 - RNA, 22 nt, Shigella flexneri 2a str. 301
gucgaaauguguuuauaaagua

SEQ ID NO: 235901 - RNA, 22 nt, Shigella flexneri 2a str. 301
guugugaaguaauacaaaacag

SEQ ID NO: 235902 - RNA, 22 nt, Shigella flexneri 2a str. 301
ucugggaauggaaguggguuau

SEQ ID NO: 235903 - RNA, 22 nt, Shigella flexneri 2a str. 301
auuuccgcgaacacuucgaagc

SEQ ID NO: 235904 - RNA, 22 nt, Shigella flexneri 2a str. 301
ucgcgccauuauggaacgcuug

SEQ ID NO: 235905 - RNA, 22 nt, Shigella flexneri 2a str. 301
gcuuugcugaaaucgauacgga

SEQ ID NO: 235906 - RNA, 21 nt, Shigella flexneri 2a str. 301
aaguuguuaaaaugugcacag

SEQ ID NO: 235907 - RNA, 22 nt, Shigella flexneri 2a str. 301
uuccaccguugcuguugcgucg

SEQ ID NO: 235908 - RNA, 18 nt, Shigella flexneri 2a str. 301
agcugcugcgcaucaaca

SEQ ID NO: 235909 - RNA, 22 nt, Shigella flexneri 2a str. 301
ccucgcugaucccaggacuucu

SEQ ID NO: 235910 - RNA, 22 nt, Shigella flexneri 2a str. 301
cgacgguggugucauuguccag

SEQ ID NO: 235911 - RNA, 20 nt, Shigella flexneri 2a str. 301
cgcauaugaccaucgucgau

SEQ ID NO: 235912 - RNA, 22 nt, Shigella flexneri 2a str. 301
auaagacgcuuccgcgucgcau

SEQ ID NO: 235913 - RNA, 22 nt, Shigella flexneri 2a str. 301
gauaggcuaacaauuaccggau

SEQ ID NO: 235914 - RNA, 22 nt, Shigella flexneri 2a str. 301
cagcgaaaugcuguugcagcgc

SEQ ID NO: 235915 - RNA, 22 nt, Shigella flexneri 2a str. 301
cgccguauguugauuauuaccg

SEQ ID NO: 235916 - RNA, 22 nt, Shigella flexneri 2a str. 301
aaguuggcgaugauggcaaagc

SEQ ID NO: 235917 - RNA, 22 nt, Shigella flexneri 2a str. 301
uuguccgguacuggagccaacc

SEQ ID NO: 235918 - RNA, 22 nt, Shigella flexneri 2a str. 301
uggcguauuucuaucuucuauu

SEQ ID NO: 235919 - RNA, 22 nt, Shigella flexneri 2a str. 301
caucgcuggggauugguauuuu

SEQ ID NO: 235920 - RNA, 22 nt, Shigella flexneri 2a str. 301
uugcagggacuauguaggccug

SEQ ID NO: 235921 - RNA, 22 nt, Shigella flexneri 2a str. 301
accaaaugucgauaauuuuguu

SEQ ID NO: 235922 - RNA, 22 nt, Shigella flexneri 2a str. 301
caugagaaagaguaucugguga

SEQ ID NO: 235923 - RNA, 22 nt, Shigella flexneri 2a str. 301
aauggcggaguguuggucaaaa

SEQ ID NO: 235924 - RNA, 22 nt, Shigella flexneri 2a str. 301
cugguauagguauggagcuuau

SEQ ID NO: 235925 - RNA, 22 nt, Shigella flexneri 2a str. 301
aacguaaaguacguagcagaga

SEQ ID NO: 235926 - RNA, 22 nt, Shigella flexneri 2a str. 301
cugugcguauggaacuccaggc

SEQ ID NO: 235927 - RNA, 22 nt, Shigella flexneri 2a str. 301
ccgucaccgaugcagaagggga

SEQ ID NO: 235928 - RNA, 22 nt, Shigella flexneri 2a str. 301
ucugcggcaaauacagcgguga

SEQ ID NO: 235929 - RNA, 22 nt, Shigella flexneri 2a str. 301
uaggccggauaaggcguagacg

SEQ ID NO: 235930 - RNA, 17 nt, Shigella flexneri 2a str. 301
ugaagcggagcuauuac

SEQ ID NO: 235931 - RNA, 22 nt, Shigella flexneri 2a str. 301
gugauagcggguuuacucauua

SEQ ID NO: 235932 - RNA, 22 nt, Shigella flexneri 2a str. 301
acagcgcgugauguuugucaga

SEQ ID NO: 235933 - RNA, 22 nt, Shigella flexneri 2a str. 301
cgaugcuggcggaagugggccu

SEQ ID NO: 235934 - RNA, 22 nt, Shigella flexneri 2a str. 301
caagagauugcaggugcgguug

SEQ ID NO: 235935 - RNA, 23 nt, Shigella flexneri 2a str. 301
acccaucgacggacgcgcggcga

SEQ ID NO: 235936 - RNA, 22 nt, Shigella flexneri 2a str. 301
caguacguuucuauuccgguug

SEQ ID NO: 235937 - RNA, 22 nt, Shigella flexneri 2a str. 301
auggaugcuugucgggaaguga

SEQ ID NO: 235938 - RNA, 22 nt, Shigella flexneri 2a str. 301
ucggugcuaaaucacgucagcg

SEQ ID NO: 235939 - RNA, 22 nt, Shigella flexneri 2a str. 301
gaguaagugugaaguugccgga

SEQ ID NO: 235940 - RNA, 22 nt, Shigella flexneri 2a str. 301
gugcaggcggucguuaugacgg

SEQ ID NO: 235941 - RNA, 22 nt, Shigella flexneri 2a str. 301
auccaauggcaguagauaaacu

SEQ ID NO: 235942 - RNA, 22 nt, Shigella flexneri 2a str. 301
caggugguuagagcgcaccccu

SEQ ID NO: 235943 - RNA, 22 nt, Shigella flexneri 2a str. 301
ugccacaaauacugaaagccgc

SEQ ID NO: 235944 - RNA, 22 nt, Shigella flexneri 2a str. 301
ugcaccuuuaacagguuagcuc

SEQ ID NO: 235945 - RNA, 22 nt, Shigella flexneri 2a str. 301
cucguucacguaucaccgcauc

SEQ ID NO: 235946 - RNA, 22 nt, Shigella flexneri 2a str. 301
cgguuaaagauauucgcguguu

SEQ ID NO: 235947 - RNA, 22 nt, Shigella flexneri 2a str. 301
ccuggcgagcaucccccacaau

SEQ ID NO: 235948 - RNA, 22 nt, Shigella flexneri 2a str. 301
ugcgcuuuguuuaugucggaug

SEQ ID NO: 235949 - RNA, 22 nt, Shigella flexneri 2a str. 301
aagcuggaucucugaaaggauu

SEQ ID NO: 235950 - RNA, 22 nt, Shigella flexneri 2a str. 301
cggucugggugucgaugccuau

SEQ ID NO: 235951 - RNA, 22 nt, Shigella flexneri 2a str. 301
auuggcguugauuccgcaccgg

SEQ ID NO: 235952 - RNA, 19 nt, Shigella flexneri 2a str. 301
cgaagguaaacuguucggu

SEQ ID NO: 235953 - RNA, 20 nt, Shigella flexneri 2a str. 301
aaucaacugaguuucucaga

SEQ ID NO: 235954 - RNA, 22 nt, Shigella flexneri 2a str. 301
aaauugccgaugcacgcuggcg

SEQ ID NO: 235955 - RNA, 22 nt, Shigella flexneri 2a str. 301
gguucguagucgcucugaacuu

SEQ ID NO: 235956 - RNA, 22 nt, Shigella flexneri 2a str. 301
cgagaucuggcugaggugaaac

SEQ ID NO: 235957 - RNA, 22 nt, Shigella flexneri 2a str. 301
cggcugguuaaguauuucguuu

SEQ ID NO: 235958 - RNA, 22 nt, Shigella flexneri 2a str. 301
cagugccaguucguuuaucggc

SEQ ID NO: 235959 - RNA, 22 nt, Shigella flexneri 2a str. 301
gugaauaaucagcuccgaaccu

SEQ ID NO: 235960 - RNA, 22 nt, Shigella flexneri 2a str. 301
aacgcuuuaauaucuuucggau

SEQ ID NO: 235961 - RNA, 22 nt, Shigella flexneri 2a str. 301
uacgugcccaauaucggcgcgg

SEQ ID NO: 235962 - RNA, 22 nt, Shigella flexneri 2a str. 301
ccguauugauggcaacgcacga

SEQ ID NO: 235963 - RNA, 22 nt, Shigella flexneri 2a str. 301
caucggugcugacggguugauu

SEQ ID NO: 235964 - RNA, 17 nt, Shigella flexneri 2a str. 301
gcaccgugcagcucuug

SEQ ID NO: 235965 - RNA, 22 nt, Shigella flexneri 2a str. 301
agucgcgauagugcuuuuucag

SEQ ID NO: 235966 - RNA, 22 nt, Shigella flexneri 2a str. 301
ugccucugauaauuagcuaagu

SEQ ID NO: 235967 - RNA, 22 nt, Shigella flexneri 2a str. 301
aucgcgggccugucgguggcga

SEQ ID NO: 235968 - RNA, 22 nt, Shigella flexneri 2a str. 301
aggucaaugcguuugagaaugu

SEQ ID NO: 235969 - RNA, 22 nt, Shigella flexneri 2a str. 301
uuucgguauuaccuguucgacg

SEQ ID NO: 235970 - RNA, 22 nt, Shigella flexneri 2a str. 301
gccguuggcaccaacaccauug

SEQ ID NO: 235971 - RNA, 22 nt, Shigella flexneri 2a str. 301
accugauuaaaucugcccgugu

SEQ ID NO: 235972 - RNA, 22 nt, Shigella flexneri 2a str. 301
uugacuguuugucaaagaauga

SEQ ID NO: 235973 - RNA, 22 nt, Shigella flexneri 2a str. 301
acauagugaaaaaaggcgugga

SEQ ID NO: 235974 - RNA, 22 nt, Shigella flexneri 2a str. 301
ucgaacagccgagcgacuucug

SEQ ID NO: 235975 - RNA, 22 nt, Shigella flexneri 2a str. 301
ucggcaccgucagcgcccaggu

SEQ ID NO: 235976 - RNA, 22 nt, Shigella flexneri 2a str. 301
gaaauucuucgcugaacgcgua

SEQ ID NO: 235977 - RNA, 22 nt, Shigella flexneri 2a str. 301
caaugaaauccggguugcugua

SEQ ID NO: 235978 - RNA, 22 nt, Shigella flexneri 2a str. 301
aaacgcaucgguaugauugcgc

SEQ ID NO: 235979 - RNA, 22 nt, Shigella flexneri 2a str. 301
ugccguauuucguaccggcaac

SEQ ID NO: 235980 - RNA, 22 nt, Shigella flexneri 2a str. 301
gcgcgaucacagugagcaagaa

SEQ ID NO: 235981 - RNA, 22 nt, Shigella flexneri 2a str. 301
cuucgcgcuccagcugacggca

SEQ ID NO: 235982 - RNA, 22 nt, Shigella flexneri 2a str. 301
cagugcaauauaaugagccgcu

SEQ ID NO: 235983 - RNA, 22 nt, Shigella flexneri 2a str. 301
uccgguuuugggaucaccugau

SEQ ID NO: 235984 - RNA, 22 nt, Shigella flexneri 2a str. 301
guccgguucuggaacgcgacgg

SEQ ID NO: 235985 - RNA, 22 nt, Shigella flexneri 2a str. 301
cggucgugcaacaccggcuguc

SEQ ID NO: 235986 - RNA, 22 nt, Shigella flexneri 2a str. 301
uaaggcaacaaaaaauggauag

SEQ ID NO: 235987 - RNA, 22 nt, Shigella flexneri 2a str. 301
guagcgucugauuagcggaaag

SEQ ID NO: 235988 - RNA, 22 nt, Shigella flexneri 2a str. 301
gguaugcguggcgcgcguguuc

SEQ ID NO: 235989 - RNA, 19 nt, Shigella flexneri 2a str. 301
gccguuugcgucaguuuuu

SEQ ID NO: 235990 - RNA, 22 nt, Shigella flexneri 2a str. 301
ugcaaguaaacagugauuugcg

SEQ ID NO: 235991 - RNA, 21 nt, Shigella flexneri 2a str. 301
ucgguggcugaccaguuuggu

SEQ ID NO: 235992 - RNA, 22 nt, Shigella flexneri 2a str. 301
uguugccacugcacauggugaa

SEQ ID NO: 235993 - RNA, 22 nt, Shigella flexneri 2a str. 301
gggagucauugcaucgucaacu

SEQ ID NO: 235994 - RNA, 22 nt, Shigella flexneri 2a str. 301
accauguugauguccagggcaa

SEQ ID NO: 235995 - RNA, 22 nt, Shigella flexneri 2a str. 301
cccgagcuaaccuguuaaaggu

SEQ ID NO: 235996 - RNA, 22 nt, Shigella flexneri 2a str. 301
ugcacgguaaauucgccaggac

SEQ ID NO: 235997 - RNA, 22 nt, Shigella flexneri 2a str. 301
ucuccgguaaggcugcgauaau

SEQ ID NO: 235998 - RNA, 22 nt, Shigella flexneri 2a str. 301
cucaggccuacaaaaucuugca

SEQ ID NO: 235999 - RNA, 22 nt, Shigella flexneri 2a str. 301
ucagcaaugucuucguccuucg

SEQ ID NO: 236000 - RNA, 22 nt, Shigella flexneri 2a str. 301
guggcugaugccauguagcuca

SEQ ID NO: 236001 - RNA, 22 nt, Shigella flexneri 2a str. 301
ucaggcugaugguggcacucgu

SEQ ID NO: 236002 - RNA, 22 nt, Shigella flexneri 2a str. 301
cuggagccuguugggugacacg

SEQ ID NO: 236003 - RNA, 22 nt, Shigella flexneri 2a str. 301
ccugccacuguuucaccauccc

SEQ ID NO: 236004 - RNA, 22 nt, Shigella flexneri 2a str. 301
ugauuaugucuggaacacggug

SEQ ID NO: 236005 - RNA, 22 nt, Shigella flexneri 2a str. 301
ccggugcugaugggcguggcga

SEQ ID NO: 236006 - RNA, 18 nt, Shigella flexneri 2a str. 301
ucguaccgauugaaaaua

SEQ ID NO: 236007 - RNA, 22 nt, Shigella flexneri 2a str. 301
gcaagcugguucagguucgucg

SEQ ID NO: 236008 - RNA, 22 nt, Shigella flexneri 2a str. 301
uagcaacuuccgcuuccaugac

SEQ ID NO: 236009 - RNA, 22 nt, Shigella flexneri 2a str. 301
ugguaugcgcgaauuauuaccg

SEQ ID NO: 236010 - RNA, 22 nt, Shigella flexneri 2a str. 301
ccggaacaaucgugaauagcgc

SEQ ID NO: 236011 - RNA, 22 nt, Shigella flexneri 2a str. 301
ccaguaauagcgcguugauccc

SEQ ID NO: 236012 - RNA, 22 nt, Shigella flexneri 2a str. 301
uggcgucguguagcgaugacca

SEQ ID NO: 236013 - RNA, 22 nt, Shigella flexneri 2a str. 301
ucugaaugaagccaguaauguu

SEQ ID NO: 236014 - RNA, 22 nt, Shigella flexneri 2a str. 301
ccguugagagcaaauuguuugg

SEQ ID NO: 236015 - RNA, 22 nt, Shigella flexneri 2a str. 301
cuacgcuuaucaggccuacgca

SEQ ID NO: 236016 - RNA, 22 nt, Shigella flexneri 2a str. 301
accuggcauucauucuucugca

SEQ ID NO: 236017 - RNA, 22 nt, Shigella flexneri 2a str. 301
ucaugcgcgaagcgguagcgau

SEQ ID NO: 236018 - RNA, 22 nt, Shigella flexneri 2a str. 301
ccgcuguaugccaucugcgcau

SEQ ID NO: 236019 - RNA, 22 nt, Shigella flexneri 2a str. 301
cggcaauuucacacaccaguug

SEQ ID NO: 236020 - RNA, 22 nt, Shigella flexneri 2a str. 301
acgguggaaggcgcggagcugg

SEQ ID NO: 236021 - RNA, 22 nt, Shigella flexneri 2a str. 301
gauaaucccugauucgcaguca

SEQ ID NO: 236022 - RNA, 22 nt, Shigella flexneri 2a str. 301
cggacaggucugcggcugugua

SEQ ID NO: 236023 - RNA, 22 nt, Shigella flexneri 2a str. 301
ggcagugcguagaauuuaccuu

SEQ ID NO: 236024 - RNA, 22 nt, Shigella flexneri 2a str. 301
ucuggugagauaucagaugauu

SEQ ID NO: 236025 - RNA, 22 nt, Shigella flexneri 2a str. 301
uuuggcagcuucaugcauuaca

SEQ ID NO: 236026 - RNA, 22 nt, Shigella flexneri 2a str. 301
gcggaaauacucgccacggaac

SEQ ID NO: 236027 - RNA, 22 nt, Shigella flexneri 2a str. 301
gagaugauucaggcagacuggg

SEQ ID NO: 236028 - RNA, 23 nt, Shigella flexneri 2a str. 301
ugaaguaguuccgcuugugcacg

SEQ ID NO: 236029 - RNA, 22 nt, Shigella flexneri 2a str. 301
agcauucaguugaugaaaucgc

SEQ ID NO: 236030 - RNA, 22 nt, Shigella flexneri 2a str. 301
gugcaaccgguuguugcggcug

SEQ ID NO: 236031 - RNA, 22 nt, Shigella flexneri 2a str. 301
caaggcauggaagggagcguua

SEQ ID NO: 236032 - RNA, 22 nt, Shigella flexneri 2a str. 301
augugugcguuaccacuacuga

SEQ ID NO: 236033 - RNA, 20 nt, Shigella flexneri 2a str. 301
gaugugccuuuagacucagc

SEQ ID NO: 236034 - RNA, 22 nt, Shigella flexneri 2a str. 301
uaggccggauaaggcguuuacg

SEQ ID NO: 236035 - RNA, 22 nt, Shigella flexneri 2a str. 301
gccugcucaaaacucaaaccag

SEQ ID NO: 236036 - RNA, 22 nt, Shigella flexneri 2a str. 301
gaagguuaacccgcugggcggc

SEQ ID NO: 236037 - RNA, 22 nt, Shigella flexneri 2a str. 301
ggaauaccaucaauaucgugag

SEQ ID NO: 236038 - RNA, 22 nt, Shigella flexneri 2a str. 301
gcaguacgugccuaaaaugcug

SEQ ID NO: 236039 - RNA, 22 nt, Shigella flexneri 2a str. 301
accgggugauggcguugaccau

SEQ ID NO: 236040 - RNA, 22 nt, Shigella flexneri 2a str. 301
gaacagcccgguuuucaguugc

SEQ ID NO: 236041 - RNA, 18 nt, Shigella flexneri 2a str. 301
gauguuagacucgauaaa

SEQ ID NO: 236042 - RNA, 22 nt, Shigella flexneri 2a str. 301
auccggccuacaaaagcacgca

SEQ ID NO: 236043 - RNA, 22 nt, Shigella flexneri 2a str. 301
guccggaagagaucaccgcuga

SEQ ID NO: 236044 - RNA, 22 nt, Shigella flexneri 2a str. 301
gagaugcggguucgucaaaggu

SEQ ID NO: 236045 - RNA, 22 nt, Shigella flexneri 2a str. 301
uuacgcucuugauccuguuccg

SEQ ID NO: 236046 - RNA, 22 nt, Shigella flexneri 2a str. 301
uugcgcagcgugacuucgccgu

SEQ ID NO: 236047 - RNA, 22 nt, Shigella flexneri 2a str. 301
auuucggcgcauugccgggagc

SEQ ID NO: 236048 - RNA, 22 nt, Shigella flexneri 2a str. 301
cugggcgaggauuacauccgca

SEQ ID NO: 236049 - RNA, 22 nt, Shigella flexneri 2a str. 301
ugcagagaucauguaggccgga

SEQ ID NO: 236050 - RNA, 22 nt, Shigella flexneri 2a str. 301
uagccgcugaccacuaccuggg

SEQ ID NO: 236051 - RNA, 22 nt, Shigella flexneri 2a str. 301
ggaguacaucgugcgcggcagu

SEQ ID NO: 236052 - RNA, 22 nt, Shigella flexneri 2a str. 301
cguaccaucaccgacguguuug

SEQ ID NO: 236053 - RNA, 22 nt, Shigella flexneri 2a str. 301
uaucugggaagugccaggcggu

SEQ ID NO: 236054 - RNA, 22 nt, Shigella flexneri 2a str. 301
cagcgauuguugccguagaggu

SEQ ID NO: 236055 - RNA, 22 nt, Shigella flexneri 2a str. 301
uaucacgcacagauuuggcauc

SEQ ID NO: 236056 - RNA, 22 nt, Shigella flexneri 2a str. 301
ugcauaaguucagcaacacaaa

SEQ ID NO: 236057 - RNA, 22 nt, Shigella flexneri 2a str. 301
agauuggugucaaucauguguu

SEQ ID NO: 236058 - RNA, 22 nt, Shigella flexneri 2a str. 301
ucugauauaaaauugaacauug

SEQ ID NO: 236059 - RNA, 22 nt, Shigella flexneri 2a str. 301
gcgaguauccagauuagugacc

SEQ ID NO: 236060 - RNA, 21 nt, Shigella flexneri 2a str. 301
caggaauugcaggguaaaauu

SEQ ID NO: 236061 - RNA, 22 nt, Shigella flexneri 2a str. 301
acagagccugucucagcaauga

SEQ ID NO: 236062 - RNA, 22 nt, Shigella flexneri 2a str. 301
uuugccgaaaguggacgguaaa

SEQ ID NO: 236063 - RNA, 22 nt, Shigella flexneri 2a str. 301
ucgcgguaauuauuccuugcug

SEQ ID NO: 236064 - RNA, 22 nt, Shigella flexneri 2a str. 301
uggcacaaugguuaacguguca

SEQ ID NO: 236065 - RNA, 22 nt, Shigella flexneri 2a str. 301
cugccaguuccgcugauuuacg

SEQ ID NO: 236066 - RNA, 22 nt, Shigella flexneri 2a str. 301
cgccugauuaacguuuuuguac

SEQ ID NO: 236067 - RNA, 22 nt, Shigella flexneri 2a str. 301
ucaaacucccuuuacuuaccuu

SEQ ID NO: 236068 - RNA, 22 nt, Shigella flexneri 2a str. 301
ccagucaacgguaauucaggcc

SEQ ID NO: 236069 - RNA, 22 nt, Shigella flexneri 2a str. 301
cggguggaacugaggcaauucg

SEQ ID NO: 236070 - RNA, 22 nt, Shigella flexneri 2a str. 301
aucacgucaccucgacgcuguu

SEQ ID NO: 236071 - RNA, 17 nt, Shigella flexneri 2a str. 301
uggcauuuauuuuuacc

SEQ ID NO: 236072 - RNA, 22 nt, Shigella flexneri 2a str. 301
ggcagugccuucagcauggaag

SEQ ID NO: 236073 - RNA, 22 nt, Shigella flexneri 2a str. 301
ucggcucgcccagcggaguuuc

SEQ ID NO: 236074 - RNA, 22 nt, Shigella flexneri 2a str. 301
agucaucaggcucuuucuuaaa

SEQ ID NO: 236075 - RNA, 22 nt, Shigella flexneri 2a str. 301
acgguuauggcauucguugugc

SEQ ID NO: 236076 - RNA, 22 nt, Shigella flexneri 2a str. 301
cugacagauguggcacuucccg

SEQ ID NO: 236077 - RNA, 22 nt, Shigella flexneri 2a str. 301
uaguggacgcugauguacagga

SEQ ID NO: 236078 - RNA, 19 nt, Shigella flexneri 2a str. 301
guuccguagauccgccgcc

SEQ ID NO: 236079 - RNA, 19 nt, Shigella flexneri 2a str. 301
uuaacgccgaucgcaucgg

SEQ ID NO: 236080 - RNA, 16 nt, Shigella flexneri 2a str. 301
aagcugaauugugguc

SEQ ID NO: 236081 - RNA, 22 nt, Shigella flexneri 2a str. 301
cucgccauuuucgucuggaccg

SEQ ID NO: 236082 - RNA, 22 nt, Shigella flexneri 2a str. 301
gacgaacauuacuggcuucauu

SEQ ID NO: 236083 - RNA, 22 nt, Shigella flexneri 2a str. 301
gugccaguaacuguaaaauguu

SEQ ID NO: 236084 - RNA, 22 nt, Shigella flexneri 2a str. 301
auaaacgccuggcuggcugguu

SEQ ID NO: 236085 - RNA, 21 nt, Shigella flexneri 2a str. 301
uugaugcgcgagcgacguucc

SEQ ID NO: 236086 - RNA, 20 nt, Shigella flexneri 2a str. 301
aaaucguccggggaaaccuu

SEQ ID NO: 236087 - RNA, 22 nt, Shigella flexneri 2a str. 301
aaugcgcugguugaaguguuac

SEQ ID NO: 236088 - RNA, 22 nt, Shigella flexneri 2a str. 301
ccagaucggaaccacggacgau

SEQ ID NO: 236089 - RNA, 20 nt, Shigella flexneri 2a str. 301
ucgacggcaaauuugugcag

SEQ ID NO: 236090 - RNA, 22 nt, Shigella flexneri 2a str. 301
ugccgucggagaggaaaucgau

SEQ ID NO: 236091 - RNA, 22 nt, Shigella flexneri 2a str. 301
gacuucauggagucgaguugca

SEQ ID NO: 236092 - RNA, 22 nt, Shigella flexneri 2a str. 301
uucgaucgcguuguuuugcagg

SEQ ID NO: 236093 - RNA, 22 nt, Shigella flexneri 2a str. 301
guucagcagauuuggcgcaccu

SEQ ID NO: 236094 - RNA, 22 nt, Shigella flexneri 2a str. 301
ucugaagaguuauaagcaguug

SEQ ID NO: 236095 - RNA, 22 nt, Shigella flexneri 2a str. 301
ucagaccuucuucgauuucgcg

SEQ ID NO: 236096 - RNA, 22 nt, Shigella flexneri 2a str. 301
uuauacccuggcgcugcaucgu

SEQ ID NO: 236097 - RNA, 22 nt, Shigella flexneri 2a str. 301
acgacgcagauccugggcgauu

SEQ ID NO: 236098 - RNA, 22 nt, Shigella flexneri 2a str. 301
ggauuaacgucugggaacugau

SEQ ID NO: 236099 - RNA, 19 nt, Shigella flexneri 2a str. 301
gucaggcuuccuugcgguc

SEQ ID NO: 236100 - RNA, 22 nt, Shigella flexneri 2a str. 301
acgaaggcgacaucagcagccg

SEQ ID NO: 236101 - RNA, 22 nt, Shigella flexneri 2a str. 301
ugcgcuuuguuuaugccagaug

SEQ ID NO: 236102 - RNA, 22 nt, Shigella flexneri 2a str. 301
auugcuguuaacgcuggugcug

SEQ ID NO: 236103 - RNA, 21 nt, Shigella flexneri 2a str. 301
uggcuggaucaacggcgguau

SEQ ID NO: 236104 - RNA, 22 nt, Shigella flexneri 2a str. 301
uacgcuuaucaggccuacagag

SEQ ID NO: 236105 - RNA, 22 nt, Shigella flexneri 2a str. 301
uugggucaauuugucugcuugc

SEQ ID NO: 236106 - RNA, 22 nt, Shigella flexneri 2a str. 301
gguuaucggcaugcgaggggcu

SEQ ID NO: 236107 - RNA, 22 nt, Shigella flexneri 2a str. 301
cguggcuuucagaaugguggcg

SEQ ID NO: 236108 - RNA, 22 nt, Shigella flexneri 2a str. 301
cuauggcgcgcuuuuuauacug

SEQ ID NO: 236109 - RNA, 22 nt, Shigella flexneri 2a str. 301
agcacggcgcagcaggguguua

SEQ ID NO: 236110 - RNA, 22 nt, Shigella flexneri 2a str. 301
cuacgcaucuuucauuuauaaa

SEQ ID NO: 236111 - RNA, 22 nt, Shigella flexneri 2a str. 301
gucaauuuuuaauugaggugga

SEQ ID NO: 236112 - RNA, 23 nt, Shigella flexneri 2a str. 301
ucggugcuaaaucacgucagcgc

SEQ ID NO: 236113 - RNA, 22 nt, Shigella flexneri 2a str. 301
auacaccgggccugcauaugga

SEQ ID NO: 236114 - RNA, 22 nt, Shigella flexneri 2a str. 301
ugucaggacacggggcuuguag

SEQ ID NO: 236115 - RNA, 22 nt, Shigella flexneri 2a str. 301
ucacccguuagcacuaucugaa

SEQ ID NO: 236116 - RNA, 20 nt, Shigella flexneri 2a str. 301
cugaugaacuguccaccgca

SEQ ID NO: 236117 - RNA, 22 nt, Shigella flexneri 2a str. 301
accaugauaccuuguuccgaca

SEQ ID NO: 236118 - RNA, 22 nt, Shigella flexneri 2a str. 301
cgccaguugauuuugacaccgc

SEQ ID NO: 236119 - RNA, 22 nt, Shigella flexneri 2a str. 301
acgccuuauccggccuacaagu

SEQ ID NO: 236120 - RNA, 22 nt, Shigella flexneri 2a str. 301
ugguacgcacguuauguacgug

SEQ ID NO: 236121 - RNA, 22 nt, Shigella flexneri 2a str. 301
uuacugcgucagggaaaaccag

SEQ ID NO: 236122 - RNA, 23 nt, Shigella flexneri 2a str. 301
ucuggcuuguuucugcucaccgu

SEQ ID NO: 236123 - RNA, 22 nt, Shigella flexneri 2a str. 301
cugcgagcgaagaaagugauca

SEQ ID NO: 236124 - RNA, 22 nt, Shigella flexneri 2a str. 301
ccguguggaauagcaauaccau

SEQ ID NO: 236125 - RNA, 22 nt, Shigella flexneri 2a str. 301
cauggaguucguuggaccgggc

SEQ ID NO: 236126 - RNA, 22 nt, Shigella flexneri 2a str. 301
cggugcuggcugcugacaucgu

SEQ ID NO: 236127 - RNA, 22 nt, Shigella flexneri 2a str. 301
uagcgucaggcgcauugccugc

SEQ ID NO: 236128 - RNA, 22 nt, Shigella flexneri 2a str. 301
gcuggaaagcaccugcgcggcg

SEQ ID NO: 236129 - RNA, 21 nt, Shigella flexneri 2a str. 301
agugcguuuucggguagaugg

SEQ ID NO: 236130 - RNA, 22 nt, Shigella flexneri 2a str. 301
uggugaauuuacggaaauucua

SEQ ID NO: 236131 - RNA, 22 nt, Shigella flexneri 2a str. 301
uugaucgggaugaugauauuaa

SEQ ID NO: 236132 - RNA, 22 nt, Shigella flexneri 2a str. 301
ugaguaaauacuguauggccug

SEQ ID NO: 236133 - RNA, 22 nt, Shigella flexneri 2a str. 301
ugcaggacgcacagauucugca

SEQ ID NO: 236134 - RNA, 22 nt, Shigella flexneri 2a str. 301
uaaucaguggucuguuauuuau

SEQ ID NO: 236135 - RNA, 21 nt, Shigella flexneri 2a str. 301
ugcaggugcgguuguuuuccc

SEQ ID NO: 236136 - RNA, 22 nt, Shigella flexneri 2a str. 301
uauccacugugcgccagccuuc

SEQ ID NO: 236137 - RNA, 22 nt, Shigella flexneri 2a str. 301
cauaagagauggaaugagcauc

SEQ ID NO: 236138 - RNA, 22 nt, Shigella flexneri 2a str. 301
ucucgaucuggugcagaaaaaa

SEQ ID NO: 236139 - RNA, 22 nt, Shigella flexneri 2a str. 301
ccgagaucuuucgcugcuuuua

SEQ ID NO: 236140 - RNA, 22 nt, Shigella flexneri 2a str. 301
uaucgucugauuaugaagagcg

SEQ ID NO: 236141 - RNA, 22 nt, Shigella flexneri 2a str. 301
guuugcagguagagcagauuau

SEQ ID NO: 236142 - RNA, 20 nt, Shigella flexneri 2a str. 301
gucgccugaaguugaggagg

SEQ ID NO: 236143 - RNA, 22 nt, Shigella flexneri 2a str. 301
ucagcgccagcagcagcgggau

SEQ ID NO: 236144 - RNA, 22 nt, Shigella flexneri 2a str. 301
gcagcagaucaccacggcugau

SEQ ID NO: 236145 - RNA, 22 nt, Shigella flexneri 2a str. 301
uugcauggucuuguaggccaga

SEQ ID NO: 236146 - RNA, 22 nt, Shigella flexneri 2a str. 301
caagcgccaguugucaucuucc

SEQ ID NO: 236147 - RNA, 22 nt, Shigella flexneri 2a str. 301
uuugcgauucaaaaggcguuau

SEQ ID NO: 236148 - RNA, 22 nt, Shigella flexneri 2a str. 301
cuggcgauggucggugauggua

SEQ ID NO: 236149 - RNA, 21 nt, Shigella flexneri 2a str. 301
cgaucgucgggaucaucgguc

SEQ ID NO: 236150 - RNA, 22 nt, Shigella flexneri 2a str. 301
cgcguuaacuggaaccggguga

SEQ ID NO: 236151 - RNA, 22 nt, Shigella flexneri 2a str. 301
uuuaccgacggugauuuacgcc

SEQ ID NO: 236152 - RNA, 22 nt, Shigella flexneri 2a str. 301
ucugagcguaccaaauauuauu

SEQ ID NO: 236153 - RNA, 22 nt, Shigella flexneri 2a str. 301
ugccggucuuccuguugggcga

SEQ ID NO: 236154 - RNA, 22 nt, Shigella flexneri 2a str. 301
gagacgugcaaucucgguagac

SEQ ID NO: 236155 - RNA, 19 nt, Shigella flexneri 2a str. 301
aucaguaucguuuucuucc

SEQ ID NO: 236156 - RNA, 18 nt, Shigella flexneri 2a str. 301
uuacugcgugcuuauccu

SEQ ID NO: 236157 - RNA, 22 nt, Shigella flexneri 2a str. 301
aguuacacgcccguauccgcgc

SEQ ID NO: 236158 - RNA, 22 nt, Shigella flexneri 2a str. 301
guuccggcaguuauuguggcga

SEQ ID NO: 236159 - RNA, 22 nt, Shigella flexneri 2a str. 301
uugacaaugacgcuguggggac

SEQ ID NO: 236160 - RNA, 22 nt, Shigella flexneri 2a str. 301
auggcuggcagguaauuuugcg

SEQ ID NO: 236161 - RNA, 22 nt, Shigella flexneri 2a str. 301
uacgugcguucggaaaugcagg

SEQ ID NO: 236162 - RNA, 22 nt, Shigella flexneri 2a str. 301
uucaccagcgccagcgcuucug

SEQ ID NO: 236163 - RNA, 23 nt, Shigella flexneri 2a str. 301
uucagguugcgacuggugauggc

SEQ ID NO: 236164 - RNA, 22 nt, Shigella flexneri 2a str. 301
ccauugcccggcucacucgcua

SEQ ID NO: 236165 - RNA, 22 nt, Shigella flexneri 2a str. 301
ccgcugguuauuguuauugccg

SEQ ID NO: 236166 - RNA, 22 nt, Shigella flexneri 2a str. 301
cgguugcuuucgucgagaaugu

SEQ ID NO: 236167 - RNA, 22 nt, Shigella flexneri 2a str. 301
uugcacgaacuuguaggccgga

SEQ ID NO: 236168 - RNA, 21 nt, Shigella flexneri 2a str. 301
uauuccggccuguucaauaug

SEQ ID NO: 236169 - RNA, 22 nt, Shigella flexneri 2a str. 301
uuugccauggucaaugagcgca

SEQ ID NO: 236170 - RNA, 22 nt, Shigella flexneri 2a str. 301
ugauggauauucuggccacacu

SEQ ID NO: 236171 - RNA, 22 nt, Shigella flexneri 2a str. 301
gcccggaucgccuacgggcuga

SEQ ID NO: 236172 - RNA, 22 nt, Shigella flexneri 2a str. 301
cuugaaguaugacgaguauagc

SEQ ID NO: 236173 - RNA, 22 nt, Shigella flexneri 2a str. 301
gaucaucugucaacugacguga

SEQ ID NO: 236174 - RNA, 22 nt, Shigella flexneri 2a str. 301
ugucgaauaugauuaucggcgc

SEQ ID NO: 236175 - RNA, 19 nt, Shigella flexneri 2a str. 301
ugaaccaaaauugcuugag

SEQ ID NO: 236176 - RNA, 19 nt, Shigella flexneri 2a str. 301
auggugaugaucgauuucc

SEQ ID NO: 236177 - RNA, 22 nt, Shigella flexneri 2a str. 301
auccgcgcuguguguggaaccu

SEQ ID NO: 236178 - RNA, 22 nt, Shigella flexneri 2a str. 301
uugagucgaaagucaucauuau

SEQ ID NO: 236179 - RNA, 22 nt, Shigella flexneri 2a str. 301
acuacuucauuaugagcaaacu

SEQ ID NO: 236180 - RNA, 22 nt, Shigella flexneri 2a str. 301
gguauucgcuuugccuuuacga

SEQ ID NO: 236181 - RNA, 22 nt, Shigella flexneri 2a str. 301
uuccaugaagcaucgcgcaugg

SEQ ID NO: 236182 - RNA, 22 nt, Shigella flexneri 2a str. 301
augcacugucagauccggcgug

SEQ ID NO: 236183 - RNA, 20 nt, Shigella flexneri 2a str. 301
guagcggguacggugcugug

SEQ ID NO: 236184 - RNA, 22 nt, Shigella flexneri 2a str. 301
uuugacgauggcuuucaggucg

SEQ ID NO: 236185 - RNA, 21 nt, Shigella flexneri 2a str. 301
gcguuugaacgugguucgcug

SEQ ID NO: 236186 - RNA, 22 nt, Shigella flexneri 2a str. 301
ggcgcuugccugcuccccucac

SEQ ID NO: 236187 - RNA, 22 nt, Shigella flexneri 2a str. 301
ucacggcguuccuaucgcaugc

SEQ ID NO: 236188 - RNA, 22 nt, Shigella flexneri 2a str. 301
caggucauucaugcggguuuuc

SEQ ID NO: 236189 - RNA, 22 nt, Shigella flexneri 2a str. 301
gaccgcuuccgccagcgauuuu

SEQ ID NO: 236190 - RNA, 22 nt, Shigella flexneri 2a str. 301
acagcugcugaugcugacagau

SEQ ID NO: 236191 - RNA, 22 nt, Shigella flexneri 2a str. 301
augcugaccaugggcgauucgg

SEQ ID NO: 236192 - RNA, 18 nt, Shigella flexneri 2a str. 301
ccaguuccggcaccacag

SEQ ID NO: 236193 - RNA, 22 nt, Shigella flexneri 2a str. 301
uacugaauguuguugguauccu

SEQ ID NO: 236194 - RNA, 22 nt, Shigella flexneri 2a str. 301
augcguuucagccacgcguuug

SEQ ID NO: 236195 - RNA, 22 nt, Shigella flexneri 2a str. 301
ggcuauuacggcgguaaagucg

SEQ ID NO: 236196 - RNA, 22 nt, Shigella flexneri 2a str. 301
gccugauguacaugucuucaac

SEQ ID NO: 236197 - RNA, 22 nt, Shigella flexneri 2a str. 301
acggugacagaacgcuaagauu

SEQ ID NO: 236198 - RNA, 22 nt, Shigella flexneri 2a str. 301
gagccggacuuuauugauauac

SEQ ID NO: 236199 - RNA, 23 nt, Shigella flexneri 2a str. 301
agcgcaccagcaccgacugagcg

SEQ ID NO: 236200 - RNA, 21 nt, Shigella flexneri 2a str. 301
aaacucucggggucagcgagg

SEQ ID NO: 236201 - RNA, 22 nt, Shigella flexneri 2a str. 301
aucggcguggcggucaugauca

SEQ ID NO: 236202 - RNA, 22 nt, Shigella flexneri 2a str. 301
uccggccuacaaaaucgugcua

SEQ ID NO: 236203 - RNA, 22 nt, Shigella flexneri 2a str. 301
ugguaagcgcggcaugacguau

SEQ ID NO: 236204 - RNA, 22 nt, Shigella flexneri 2a str. 301
cgcuuacgcuaucgaucugcug

SEQ ID NO: 236205 - RNA, 22 nt, Shigella flexneri 2a str. 301
aguggcgcagggcgaugauguu

SEQ ID NO: 236206 - RNA, 22 nt, Shigella flexneri 2a str. 301
gcagcgacgauggaaaaaggga

SEQ ID NO: 236207 - RNA, 22 nt, Shigella flexneri 2a str. 301
cagcaauagcuucuggguuacg

SEQ ID NO: 236208 - RNA, 22 nt, Shigella flexneri 2a str. 301
aucugguugaauuugaucagga

SEQ ID NO: 236209 - RNA, 22 nt, Shigella flexneri 2a str. 301
cacggcugagagcaccaccaga

SEQ ID NO: 236210 - RNA, 22 nt, Shigella flexneri 2a str. 301
ucccgguaaucgaugacgacga

SEQ ID NO: 236211 - RNA, 20 nt, Shigella flexneri 2a str. 301
accugcugccaucuguuguu

SEQ ID NO: 236212 - RNA, 22 nt, Shigella flexneri 2a str. 301
ccgauaucacgcacuuuuccca

SEQ ID NO: 236213 - RNA, 22 nt, Shigella flexneri 2a str. 301
uggccguuggggaagugacucc

SEQ ID NO: 236214 - RNA, 22 nt, Shigella flexneri 2a str. 301
uucagggucuggauugccugca

SEQ ID NO: 236215 - RNA, 22 nt, Shigella flexneri 2a str. 301
aaugaccaguaaugcuuugccc

SEQ ID NO: 236216 - RNA, 22 nt, Shigella flexneri 2a str. 301
aagcgguuugcgccaggugagc

SEQ ID NO: 236217 - RNA, 22 nt, Shigella flexneri 2a str. 301
ggcaaagugcauagcgucgcaa

SEQ ID NO: 236218 - RNA, 22 nt, Shigella flexneri 2a str. 301
ucugcguauuuaucuuuugcaa

SEQ ID NO: 236219 - RNA, 22 nt, Shigella flexneri 2a str. 301
gugaguucaccauuacgcugga

SEQ ID NO: 236220 - RNA, 22 nt, Shigella flexneri 2a str. 301
gcguuaccggcuucgagaggca

SEQ ID NO: 236221 - RNA, 22 nt, Shigella flexneri 2a str. 301
aucacucaucaauaaauauuau

SEQ ID NO: 236222 - RNA, 23 nt, Shigella flexneri 2a str. 301
gugaagccauccaguucguuuuc

SEQ ID NO: 236223 - RNA, 22 nt, Shigella flexneri 2a str. 301
ggaacuguucgccgugcaaauc

SEQ ID NO: 236224 - RNA, 23 nt, Shigella flexneri 2a str. 301
agccguaacccugcugcaucaga

SEQ ID NO: 236225 - RNA, 22 nt, Shigella flexneri 2a str. 301
ggccgguaaaucuucacucugu

SEQ ID NO: 236226 - RNA, 22 nt, Shigella flexneri 2a str. 301
guuucacuccaaccuguucaag

SEQ ID NO: 236227 - RNA, 22 nt, Shigella flexneri 2a str. 301
cggcggauuuauuacugcaucc

SEQ ID NO: 236228 - RNA, 22 nt, Shigella flexneri 2a str. 301
ggcauguucccaagccagaugu

SEQ ID NO: 236229 - RNA, 22 nt, Shigella flexneri 2a str. 301
uuacgguaacgucguucuacuu

SEQ ID NO: 236230 - RNA, 22 nt, Shigella flexneri 2a str. 301
caucugucugauaaaaaacccg

SEQ ID NO: 236231 - RNA, 22 nt, Shigella flexneri 2a str. 301
gcgugcugggcgacuggucgca

SEQ ID NO: 236232 - RNA, 22 nt, Shigella flexneri 2a str. 301
gucagcauaauggcaaagaucg

SEQ ID NO: 236233 - RNA, 21 nt, Shigella flexneri 2a str. 301
uuaaucucauucggaugucgu

SEQ ID NO: 236234 - RNA, 22 nt, Shigella flexneri 2a str. 301
aaagcggugaccgcuaugucga

SEQ ID NO: 236235 - RNA, 22 nt, Shigella flexneri 2a str. 301
augcaguguaaacgucuuaucc

SEQ ID NO: 236236 - RNA, 22 nt, Shigella flexneri 2a str. 301
auaugguaaucaacaauggccg

SEQ ID NO: 236237 - RNA, 23 nt, Shigella flexneri 2a str. 301
ggcuuccgucagggguggauggu

SEQ ID NO: 236238 - RNA, 23 nt, Shigella flexneri 2a str. 301
uaacugaggugauuaugggcuuc

SEQ ID NO: 236239 - RNA, 22 nt, Shigella flexneri 2a str. 301
uuucaacauagucuucuccuuu

SEQ ID NO: 236240 - RNA, 22 nt, Shigella flexneri 2a str. 301
uggcauaagagauaucuuuauu

SEQ ID NO: 236241 - RNA, 22 nt, Shigella flexneri 2a str. 301
aauaugcugcaacccggcgugu

SEQ ID NO: 236242 - RNA, 22 nt, Shigella flexneri 2a str. 301
cggcugauuguguaaugcacag

SEQ ID NO: 236243 - RNA, 20 nt, Shigella flexneri 2a str. 301
ugguuaccggcaaaacaauc

SEQ ID NO: 236244 - RNA, 22 nt, Shigella flexneri 2a str. 301
auccggccuacauaaucacgca

SEQ ID NO: 236245 - RNA, 22 nt, Shigella flexneri 2a str. 301
uugcagguuuaugaaguuggca

SEQ ID NO: 236246 - RNA, 22 nt, Shigella flexneri 2a str. 301
uacggcaggcgaggcggaucau

SEQ ID NO: 236247 - RNA, 22 nt, Shigella flexneri 2a str. 301
cagcggaucacccaccguuuug

SEQ ID NO: 236248 - RNA, 22 nt, Shigella flexneri 2a str. 301
acaggcaguugcguagauuucu

SEQ ID NO: 236249 - RNA, 22 nt, Shigella flexneri 2a str. 301
ggcagcaagugcagcucgcugg

SEQ ID NO: 236250 - RNA, 22 nt, Shigella flexneri 2a str. 301
ugccgacaggguggcugugcga

SEQ ID NO: 236251 - RNA, 22 nt, Shigella flexneri 2a str. 301
acguucauuaccggcgcauaca

SEQ ID NO: 236252 - RNA, 22 nt, Shigella flexneri 2a str. 301
uacagguacugcguaggccuga

SEQ ID NO: 236253 - RNA, 22 nt, Shigella flexneri 2a str. 301
aucuguugaugccaacguaucg

SEQ ID NO: 236254 - RNA, 22 nt, Shigella flexneri 2a str. 301
aucgacgaacaucaugcgguac

SEQ ID NO: 236255 - RNA, 23 nt, Shigella flexneri 2a str. 301
aaugcgccaaccuuccagcgaug

SEQ ID NO: 236256 - RNA, 22 nt, Shigella flexneri 2a str. 301
acacuguugugaaugaaagcau

SEQ ID NO: 236257 - RNA, 22 nt, Shigella flexneri 2a str. 301
agagacgccaauuuguugugcu

SEQ ID NO: 236258 - RNA, 22 nt, Shigella flexneri 2a str. 301
cugcgcaaaugcagguuguuga

SEQ ID NO: 236259 - RNA, 22 nt, Shigella flexneri 2a str. 301
gcguuucuucgaaaaagaacug

SEQ ID NO: 236260 - RNA, 22 nt, Shigella flexneri 2a str. 301
cgauaugcuucgauugccugga

SEQ ID NO: 236261 - RNA, 22 nt, Shigella flexneri 2a str. 301
accugcauuuccgaacgcacgu

SEQ ID NO: 236262 - RNA, 22 nt, Shigella flexneri 2a str. 301
ucugguuaaccgcgagcaggau

SEQ ID NO: 236263 - RNA, 22 nt, Shigella flexneri 2a str. 301
caggccuacaugauuucugcaa

SEQ ID NO: 236264 - RNA, 22 nt, Shigella flexneri 2a str. 301
augccguagaagccgccagugc

SEQ ID NO: 236265 - RNA, 22 nt, Shigella flexneri 2a str. 301
uauugugaggauaucaaaauga

SEQ ID NO: 236266 - RNA, 22 nt, Shigella flexneri 2a str. 301
uggcauucgcgugauccagcug

SEQ ID NO: 236267 - RNA, 22 nt, Shigella flexneri 2a str. 301
uucgcguaaacgccaggcgugu

SEQ ID NO: 236268 - RNA, 19 nt, Shigella flexneri 2a str. 301
cccagggugucgagcgcua

SEQ ID NO: 236269 - RNA, 22 nt, Shigella flexneri 2a str. 301
ucaccguauucuggaaagcaug

SEQ ID NO: 236270 - RNA, 18 nt, Shigella flexneri 2a str. 301
gagcauugaccuuguuga

SEQ ID NO: 236271 - RNA, 20 nt, Shigella flexneri 2a str. 301
aucguguaaaccggucguua

SEQ ID NO: 236272 - RNA, 22 nt, Shigella flexneri 2a str. 301
aucgcugauauuaaagccacaa

SEQ ID NO: 236273 - RNA, 22 nt, Shigella flexneri 2a str. 301
uaucuggccuacaaagggcuaa

SEQ ID NO: 236274 - RNA, 22 nt, Shigella flexneri 2a str. 301
acgcuucccauucugguugugc

SEQ ID NO: 236275 - RNA, 22 nt, Shigella flexneri 2a str. 301
gucaugaugucuucagauuguu

SEQ ID NO: 236276 - RNA, 22 nt, Shigella flexneri 2a str. 301
cguaaugucauccuggucacga

SEQ ID NO: 236277 - RNA, 22 nt, Shigella flexneri 2a str. 301
augacgcagaucuucacuggga

SEQ ID NO: 236278 - RNA, 22 nt, Shigella flexneri 2a str. 301
auugcauugcguaaacgcuuuu

SEQ ID NO: 236279 - RNA, 22 nt, Shigella flexneri 2a str. 301
gcuaccaccuuucgccaagauc

SEQ ID NO: 236280 - RNA, 22 nt, Shigella flexneri 2a str. 301
accgcaucggccugguguaccg

SEQ ID NO: 236281 - RNA, 22 nt, Shigella flexneri 2a str. 301
ucaauacuuuggucagcauggg

SEQ ID NO: 236282 - RNA, 22 nt, Shigella flexneri 2a str. 301
ugcuggagcuuggcaccagcga

SEQ ID NO: 236283 - RNA, 22 nt, Shigella flexneri 2a str. 301
cgauuguggcaauuucuuccau

SEQ ID NO: 236284 - RNA, 22 nt, Shigella flexneri 2a str. 301
acugauaguguuuuauguucag

SEQ ID NO: 236285 - RNA, 22 nt, Shigella flexneri 2a str. 301
cugaugcgacgcugacgcgucu

SEQ ID NO: 236286 - RNA, 22 nt, Shigella flexneri 2a str. 301
gccugcuugcgacucucgaacc

SEQ ID NO: 236287 - RNA, 22 nt, Shigella flexneri 2a str. 301
gcugauauggcugcugcagagc

SEQ ID NO: 236288 - RNA, 22 nt, Shigella flexneri 2a str. 301
augcgacgcggaagcgucuuau

SEQ ID NO: 236289 - RNA, 22 nt, Shigella flexneri 2a str. 301
ucaggucguucugccacgaacu

SEQ ID NO: 236290 - RNA, 22 nt, Shigella flexneri 2a str. 301
uccggagccauuaaagucuguu

SEQ ID NO: 236291 - RNA, 22 nt, Shigella flexneri 2a str. 301
ucgaccugauacggcgcaucga

SEQ ID NO: 236292 - RNA, 22 nt, Shigella flexneri 2a str. 301
cgaaggugauaaucugcgauac

SEQ ID NO: 236293 - RNA, 22 nt, Shigella flexneri 2a str. 301
ugcgauuauucaccccacguuu

SEQ ID NO: 236294 - RNA, 19 nt, Shigella flexneri 2a str. 301
ucaacuggcgcaaaacugg

SEQ ID NO: 236295 - RNA, 22 nt, Shigella flexneri 2a str. 301
gguucguaguugcucugaacuu

SEQ ID NO: 236296 - RNA, 22 nt, Shigella flexneri 2a str. 301
uaaagaugucguuuuguugcua

SEQ ID NO: 236297 - RNA, 22 nt, Shigella flexneri 2a str. 301
uucagucauuggcgugcaucag

SEQ ID NO: 236298 - RNA, 22 nt, Shigella flexneri 2a str. 301
gcccgguagguggaugcugagu

SEQ ID NO: 236299 - RNA, 22 nt, Shigella flexneri 2a str. 301
cagaaguaaucccucauucccg

SEQ ID NO: 236300 - RNA, 20 nt, Shigella flexneri 2a str. 301
gaguggcaucuuccugcuga

SEQ ID NO: 236301 - RNA, 22 nt, Shigella flexneri 2a str. 301
ugaauacuuacuggcgacgucg

SEQ ID NO: 236302 - RNA, 22 nt, Shigella flexneri 2a str. 301
cgcuucaaaggugucgucagga

SEQ ID NO: 236303 - RNA, 22 nt, Shigella flexneri 2a str. 301
gaucugaguuuaugggaaugcu

SEQ ID NO: 236304 - RNA, 22 nt, Shigella flexneri 2a str. 301
gugcggaugagaucgugaaacu

SEQ ID NO: 236305 - RNA, 22 nt, Shigella flexneri 2a str. 301
aucaggcaaaauaugucggaug

SEQ ID NO: 236306 - RNA, 22 nt, Shigella flexneri 2a str. 301
uggcguacucuuuuuccagcgc

SEQ ID NO: 236307 - RNA, 22 nt, Shigella flexneri 2a str. 301
auuaucaggucaugcguaccga

SEQ ID NO: 236308 - RNA, 22 nt, Shigella flexneri 2a str. 301
augcguuucgcuuaucugaccu

SEQ ID NO: 236309 - RNA, 22 nt, Shigella flexneri 2a str. 301
cugccgugucaccacuguucag

SEQ ID NO: 236310 - RNA, 21 nt, Shigella flexneri 2a str. 301
acgccagcuucgcgaccugcu

SEQ ID NO: 236311 - RNA, 22 nt, Shigella flexneri 2a str. 301
gagcgacguuugucacccaccg

SEQ ID NO: 236312 - RNA, 22 nt, Shigella flexneri 2a str. 301
ggcugguagaacgcgccaauca

SEQ ID NO: 236313 - RNA, 22 nt, Shigella flexneri 2a str. 301
ugcauuauaugcuguaggccug

SEQ ID NO: 236314 - RNA, 22 nt, Shigella flexneri 2a str. 301
acugucguggggaagaauuugc

SEQ ID NO: 236315 - RNA, 22 nt, Shigella flexneri 2a str. 301
aguuccggcaguuauuguggcg

SEQ ID NO: 236316 - RNA, 22 nt, Shigella flexneri 2a str. 301
ugagcuuuguucaugccggaug

SEQ ID NO: 236317 - RNA, 22 nt, Shigella flexneri 2a str. 301
uucguaggcgcucugaacuugc

SEQ ID NO: 236318 - RNA, 22 nt, Shigella flexneri 2a str. 301
gauuucaccaauuaagccgagg

SEQ ID NO: 236319 - RNA, 22 nt, Shigella flexneri 2a str. 301
caauccggccuacaaauucaau

SEQ ID NO: 236320 - RNA, 22 nt, Shigella flexneri 2a str. 301
ggaaguccccgucaccaucgca

SEQ ID NO: 236321 - RNA, 20 nt, Shigella flexneri 2a str. 301
aacugggcggcgagcguauc

SEQ ID NO: 236322 - RNA, 22 nt, Shigella flexneri 2a str. 301
uuacggaacauagcacgaccca

SEQ ID NO: 236323 - RNA, 22 nt, Shigella flexneri 2a str. 301
uaaagcaccgcggccuuuuuug

SEQ ID NO: 236324 - RNA, 22 nt, Shigella flexneri 2a str. 301
gugcugccgaauccguuuuauc

SEQ ID NO: 236325 - RNA, 22 nt, Shigella flexneri 2a str. 301
cgucgaguacuucguggaaggc

SEQ ID NO: 236326 - RNA, 22 nt, Shigella flexneri 2a str. 301
ggcaucguuacgcgugucagca

SEQ ID NO: 236327 - RNA, 22 nt, Shigella flexneri 2a str. 301
ugagucacaucagcguccgcug

SEQ ID NO: 236328 - RNA, 22 nt, Shigella flexneri 2a str. 301
ggucauugacaaugcugccgcu

SEQ ID NO: 236329 - RNA, 22 nt, Shigella flexneri 2a str. 301
gacuggugacgggcguucucga

SEQ ID NO: 236330 - RNA, 22 nt, Shigella flexneri 2a str. 301
agcggcacgcugaugcgaacgg

SEQ ID NO: 236331 - RNA, 22 nt, Shigella flexneri 2a str. 301
augcaacugcacagccagauca

SEQ ID NO: 236332 - RNA, 22 nt, Shigella flexneri 2a str. 301
gugacagugauugaacuggcgg

SEQ ID NO: 236333 - RNA, 22 nt, Shigella flexneri 2a str. 301
ugcaaucaucuuguaggccuga

SEQ ID NO: 236334 - RNA, 22 nt, Shigella flexneri 2a str. 301
aggugucgagcagauccagcgc

SEQ ID NO: 236335 - RNA, 22 nt, Shigella flexneri 2a str. 301
cgcggaugguauggcuguuggu

SEQ ID NO: 236336 - RNA, 22 nt, Shigella flexneri 2a str. 301
ucauugacagaaagcagcggag

SEQ ID NO: 236337 - RNA, 22 nt, Shigella flexneri 2a str. 301
auucagcagugccgguaaugca

SEQ ID NO: 236338 - RNA, 22 nt, Shigella flexneri 2a str. 301
agcuuguucgacaaagcuuugc

SEQ ID NO: 236339 - RNA, 22 nt, Shigella flexneri 2a str. 301
uccggaugauuaauguuggccg

SEQ ID NO: 236340 - RNA, 22 nt, Shigella flexneri 2a str. 301
agcgccguguuugguacgggua

SEQ ID NO: 236341 - RNA, 22 nt, Shigella flexneri 2a str. 301
gcccgcuaagcaggcgcauuac

SEQ ID NO: 236342 - RNA, 22 nt, Shigella flexneri 2a str. 301
aaauggguuauaccgaaccgga

SEQ ID NO: 236343 - RNA, 22 nt, Shigella flexneri 2a str. 301
ccggucugccgaauaugccugg

SEQ ID NO: 236344 - RNA, 21 nt, Shigella flexneri 2a str. 301
auuggucuggaaaucaugauu

SEQ ID NO: 236345 - RNA, 22 nt, Shigella flexneri 2a str. 301
aggcuuugugcucuucugugaa

SEQ ID NO: 236346 - RNA, 22 nt, Shigella flexneri 2a str. 301
uaugcauaaaaagcagcggcug

SEQ ID NO: 236347 - RNA, 22 nt, Shigella flexneri 2a str. 301
gucuggauuuaguacgucgcug

SEQ ID NO: 236348 - RNA, 22 nt, Shigella flexneri 2a str. 301
gauauguuuaccaucaucggug

SEQ ID NO: 236349 - RNA, 22 nt, Shigella flexneri 2a str. 301
gcagcacguugcggcugcguuu

SEQ ID NO: 236350 - RNA, 22 nt, Shigella flexneri 2a str. 301
uugcucugguuguaugcguagu

SEQ ID NO: 236351 - RNA, 22 nt, Shigella flexneri 2a str. 301
gcucgauaaacccuuuuucauc

SEQ ID NO: 236352 - RNA, 22 nt, Shigella flexneri 2a str. 301
gcaggagccagcucacucgcug

SEQ ID NO: 236353 - RNA, 22 nt, Shigella flexneri 2a str. 301
cgaauggauuuugugaugucag

SEQ ID NO: 236354 - RNA, 21 nt, Shigella flexneri 2a str. 301
acgguucuggucuggcuguug

SEQ ID NO: 236355 - RNA, 23 nt, Shigella flexneri 2a str. 301
gagcguggaucuggaguucagca

SEQ ID NO: 236356 - RNA, 22 nt, Shigella flexneri 2a str. 301
aaauacgguuuaugaaaauagg

SEQ ID NO: 236357 - RNA, 22 nt, Shigella flexneri 2a str. 301
cugaaugcagaauaggccagac

SEQ ID NO: 236358 - RNA, 22 nt, Shigella flexneri 2a str. 301
agcaggugcaucgccagcauuu

SEQ ID NO: 236359 - RNA, 22 nt, Shigella flexneri 2a str. 301
uccgcgaccguggcagguuggg

SEQ ID NO: 236360 - RNA, 22 nt, Shigella flexneri 2a str. 301
cggugaucaacauccacuuauc

SEQ ID NO: 236361 - RNA, 22 nt, Shigella flexneri 2a str. 301
uugagaagauucgcguuauugc

SEQ ID NO: 236362 - RNA, 22 nt, Shigella flexneri 2a str. 301
cuggucgaaaccgguggagaga

SEQ ID NO: 236363 - RNA, 23 nt, Shigella flexneri 2a str. 301
uggagugaaacgauggcgauugc

SEQ ID NO: 236364 - RNA, 22 nt, Shigella flexneri 2a str. 301
acgucuaguuguuguauuugaa

SEQ ID NO: 236365 - RNA, 22 nt, Shigella flexneri 2a str. 301
cguuuaggaagauuugaaauug

SEQ ID NO: 236366 - RNA, 22 nt, Shigella flexneri 2a str. 301
uccauacugaaggcgcguauca

SEQ ID NO: 236367 - RNA, 22 nt, Shigella flexneri 2a str. 301
ugguaaugacaagccgcgucuc

SEQ ID NO: 236368 - RNA, 22 nt, Shigella flexneri 2a str. 301
auugcaggaacgcuaucaccgu

SEQ ID NO: 236369 - RNA, 21 nt, Shigella flexneri 2a str. 301
caaacguggggugaauaaucg

SEQ ID NO: 236370 - RNA, 22 nt, Shigella flexneri 2a str. 301
ugcucaaauccgcguucaagga

SEQ ID NO: 236371 - RNA, 22 nt, Shigella flexneri 2a str. 301
ccagguuauugggcgauacacc

SEQ ID NO: 236372 - RNA, 22 nt, Shigella flexneri 2a str. 301
cggcugcuccugggcguugauc

SEQ ID NO: 236373 - RNA, 22 nt, Shigella flexneri 2a str. 301
cagggcaugaccaucagggcag

SEQ ID NO: 236374 - RNA, 22 nt, Shigella flexneri 2a str. 301
uguugcccaucucaacguacug

SEQ ID NO: 236375 - RNA, 22 nt, Shigella flexneri 2a str. 301
ucgccgaugucagauaaaaccu

SEQ ID NO: 236376 - RNA, 22 nt, Shigella flexneri 2a str. 301
gauugcgacucuggucguggga

SEQ ID NO: 236377 - RNA, 22 nt, Shigella flexneri 2a str. 301
ugaugggcaaggcuuccugugg

SEQ ID NO: 236378 - RNA, 18 nt, Shigella flexneri 2a str. 301
ugcaggucagccaucggg

SEQ ID NO: 236379 - RNA, 22 nt, Shigella flexneri 2a str. 301
aagcuugucgaguugacgggcg

SEQ ID NO: 236380 - RNA, 22 nt, Shigella flexneri 2a str. 301
cgugauaacuaucgucugguug

SEQ ID NO: 236381 - RNA, 22 nt, Shigella flexneri 2a str. 301
ggcgcagugccaggguuuugau

SEQ ID NO: 236382 - RNA, 22 nt, Shigella flexneri 2a str. 301
aaagaugucgaucuugaaaacu

SEQ ID NO: 236383 - RNA, 22 nt, Shigella flexneri 2a str. 301
cggcuggaaaucauucaauacu

SEQ ID NO: 236384 - RNA, 22 nt, Shigella flexneri 2a str. 301
uuugcacaaccaacuggcgcgu

SEQ ID NO: 236385 - RNA, 22 nt, Shigella flexneri 2a str. 301
ugccgcaggaaagcacuuugcc

SEQ ID NO: 236386 - RNA, 22 nt, Shigella flexneri 2a str. 301
ccacguagucuuuaccgcuguc

SEQ ID NO: 236387 - RNA, 19 nt, Shigella flexneri 2a str. 301
cgaugccaggcgguucggu

SEQ ID NO: 236388 - RNA, 22 nt, Shigella flexneri 2a str. 301
cuagauccgggcugauuugcug

SEQ ID NO: 236389 - RNA, 22 nt, Shigella flexneri 2a str. 301
gaauuucauugcuuucuucugu

SEQ ID NO: 236390 - RNA, 22 nt, Shigella flexneri 2a str. 301
cuaucgguggucgucgagcaac

SEQ ID NO: 236391 - RNA, 22 nt, Shigella flexneri 2a str. 301
gacggcaccugguccaccggcg

SEQ ID NO: 236392 - RNA, 22 nt, Shigella flexneri 2a str. 301
uagaugcguuuucacccgcugg

SEQ ID NO: 236393 - RNA, 22 nt, Shigella flexneri 2a str. 301
gcgucuuaucuggccuacgaag

SEQ ID NO: 236394 - RNA, 22 nt, Shigella flexneri 2a str. 301
uguugaaacuguagcccguucc

SEQ ID NO: 236395 - RNA, 22 nt, Shigella flexneri 2a str. 301
ucccagguaguggucagcggcu

SEQ ID NO: 236396 - RNA, 22 nt, Shigella flexneri 2a str. 301
cggauacgugguuuuaaaagau

SEQ ID NO: 236397 - RNA, 22 nt, Shigella flexneri 2a str. 301
cugagaagugaugcugucagca

SEQ ID NO: 236398 - RNA, 22 nt, Shigella flexneri 2a str. 301
uuaucggcaggcggaaagccuu

SEQ ID NO: 236399 - RNA, 22 nt, Shigella flexneri 2a str. 301
gauacgcugaaugaaaucgaac

SEQ ID NO: 236400 - RNA, 22 nt, Shigella flexneri 2a str. 301
aaaggccaucaucgcagucaua

SEQ ID NO: 236401 - RNA, 22 nt, Shigella flexneri 2a str. 301
acguggaugcuucccguaucgu

SEQ ID NO: 236402 - RNA, 22 nt, Shigella flexneri 2a str. 301
uauagcaaccgaccauauuggu

SEQ ID NO: 236403 - RNA, 22 nt, Shigella flexneri 2a str. 301
ggcagugaauuucuacguuauu

SEQ ID NO: 236404 - RNA, 22 nt, Shigella flexneri 2a str. 301
aaguuugccguggcaguggcga

SEQ ID NO: 236405 - RNA, 22 nt, Shigella flexneri 2a str. 301
caucaggcaauguugcguuugu

SEQ ID NO: 236406 - RNA, 22 nt, Shigella flexneri 2a str. 301
ccggauucuuuuaugcacauug

SEQ ID NO: 236407 - RNA, 22 nt, Shigella flexneri 2a str. 301
ucaccacguuucaggacaaacg

SEQ ID NO: 236408 - RNA, 22 nt, Shigella flexneri 2a str. 301
caaauaggccaguugaugcuuu

SEQ ID NO: 236409 - RNA, 22 nt, Shigella flexneri 2a str. 301
cgcacguuggcaugagcgaugg

SEQ ID NO: 236410 - RNA, 22 nt, Shigella flexneri 2a str. 301
guuaaugacuaacacaccggca

SEQ ID NO: 236411 - RNA, 22 nt, Shigella flexneri 2a str. 301
aaucggucacuuaugauauugc

SEQ ID NO: 236412 - RNA, 22 nt, Shigella flexneri 2a str. 301
uacccguugcggcggucaguga

SEQ ID NO: 236413 - RNA, 22 nt, Shigella flexneri 2a str. 301
caacauuuuuugcaaguacagc

SEQ ID NO: 236414 - RNA, 22 nt, Shigella flexneri 2a str. 301
acuggaaacuguuaccaucgcg

SEQ ID NO: 236415 - RNA, 22 nt, Shigella flexneri 2a str. 301
uuggaagaauuuguaggccgga

SEQ ID NO: 236416 - RNA, 22 nt, Shigella flexneri 2a str. 301
caagcgcgcuuaacgccguuuu

SEQ ID NO: 236417 - RNA, 22 nt, Shigella flexneri 2a str. 301
augaucugggcuauggcaauac

SEQ ID NO: 236418 - RNA, 22 nt, Shigella flexneri 2a str. 301
guugaaggauugcaggaacugg

SEQ ID NO: 236419 - RNA, 22 nt, Shigella flexneri 2a str. 301
gccggguaauccggucaucugg

SEQ ID NO: 236420 - RNA, 22 nt, Shigella flexneri 2a str. 301
gugaagguuaaggcugauuuaa

SEQ ID NO: 236421 - RNA, 22 nt, Shigella flexneri 2a str. 301
gacgcgguuuaaccgacgcgga

SEQ ID NO: 236422 - RNA, 22 nt, Shigella flexneri 2a str. 301
gccguggugggaucgccaguug

SEQ ID NO: 236423 - RNA, 22 nt, Shigella flexneri 2a str. 301
uucgagagucagugguacgucu

SEQ ID NO: 236424 - RNA, 22 nt, Shigella flexneri 2a str. 301
aggugcaggucagcacguugcu

SEQ ID NO: 236425 - RNA, 22 nt, Shigella flexneri 2a str. 301
gacacuuaaaugauugauuuua

SEQ ID NO: 236426 - RNA, 22 nt, Shigella flexneri 2a str. 301
acuaugugacccaucaacacgc

SEQ ID NO: 236427 - RNA, 23 nt, Shigella flexneri 2a str. 301
ucggaauugccgugcaaaauccg

SEQ ID NO: 236428 - RNA, 22 nt, Shigella flexneri 2a str. 301
aucgcuucgcggauaauuuccc

SEQ ID NO: 236429 - RNA, 22 nt, Shigella flexneri 2a str. 301
cagcacuuuuugcugauugcca

SEQ ID NO: 236430 - RNA, 23 nt, Shigella flexneri 2a str. 301
auccuaucguugguguggacuuu

SEQ ID NO: 236431 - RNA, 22 nt, Shigella flexneri 2a str. 301
ucauaauggcgucagcacguuu

SEQ ID NO: 236432 - RNA, 20 nt, Shigella flexneri 2a str. 301
uccguuaucuccacccgacc

SEQ ID NO: 236433 - RNA, 22 nt, Shigella flexneri 2a str. 301
aguggcaacgcugcguugaagc

SEQ ID NO: 236434 - RNA, 22 nt, Shigella flexneri 2a str. 301
uccggcauggcauuuuuauuug

SEQ ID NO: 236435 - RNA, 22 nt, Shigella flexneri 2a str. 301
gcgaagcggcguuuuacggccu

SEQ ID NO: 236436 - RNA, 21 nt, Shigella flexneri 2a str. 301
gaaugcugaaaaugccgcgcu

SEQ ID NO: 236437 - RNA, 22 nt, Shigella flexneri 2a str. 301
augaccggacgccuggcgcugg

SEQ ID NO: 236438 - RNA, 22 nt, Shigella flexneri 2a str. 301
ugcaugugggugaagcgccaaa

SEQ ID NO: 236439 - RNA, 22 nt, Shigella flexneri 2a str. 301
aggaauauucaggcucugacug

SEQ ID NO: 236440 - RNA, 22 nt, Shigella flexneri 2a str. 301
uaaauggugggagugcgcuucc

SEQ ID NO: 236441 - RNA, 18 nt, Shigella flexneri 2a str. 301
aucggcauggcauucgcc

SEQ ID NO: 236442 - RNA, 22 nt, Shigella flexneri 2a str. 301
gguaucggaaugauucguguau

SEQ ID NO: 236443 - RNA, 22 nt, Shigella flexneri 2a str. 301
uucgcgaacgucgaggaucugg

SEQ ID NO: 236444 - RNA, 22 nt, Shigella flexneri 2a str. 301
aguucuaccugcuugccgaguu

SEQ ID NO: 236445 - RNA, 22 nt, Shigella flexneri 2a str. 301
uguuaucguugaugucgugcuc

SEQ ID NO: 236446 - RNA, 22 nt, Shigella flexneri 2a str. 301
aagcggcguuacagauauucgg

SEQ ID NO: 236447 - RNA, 22 nt, Shigella flexneri 2a str. 301
ucaggccuacgucauauugcaa

SEQ ID NO: 236448 - RNA, 22 nt, Shigella flexneri 2a str. 301
auccauaaaagccacaaucggu

SEQ ID NO: 236449 - RNA, 22 nt, Shigella flexneri 2a str. 301
acgcggcagcaccgucaggcca

SEQ ID NO: 236450 - RNA, 22 nt, Shigella flexneri 2a str. 301
uauucucguuccgcgcaacacg

SEQ ID NO: 236451 - RNA, 22 nt, Shigella flexneri 2a str. 301
auggcuuccugaaacaguuugg

SEQ ID NO: 236452 - RNA, 22 nt, Shigella flexneri 2a str. 301
uaggccagauaaggcguuuacg

SEQ ID NO: 236453 - RNA, 22 nt, Shigella flexneri 2a str. 301
aacugcugguuguuggcugcua

SEQ ID NO: 236454 - RNA, 19 nt, Shigella flexneri 2a str. 301
auccggccuacaaaagcau

SEQ ID NO: 236455 - RNA, 20 nt, Shigella flexneri 2a str. 301
aaguccugggaucagcgagg

SEQ ID NO: 236456 - RNA, 22 nt, Shigella flexneri 2a str. 301
accguuucuugauggcgaguau

SEQ ID NO: 236457 - RNA, 22 nt, Shigella flexneri 2a str. 301
agcucgcucgcgguuuguuuug

SEQ ID NO: 236458 - RNA, 21 nt, Shigella flexneri 2a str. 301
uccgcgguguuuucagccagc

SEQ ID NO: 236459 - RNA, 22 nt, Shigella flexneri 2a str. 301
cuuacauuaaugaagcuauccg

SEQ ID NO: 236460 - RNA, 20 nt, Shigella flexneri 2a str. 301
uggcguaggcaagugaaauc

SEQ ID NO: 236461 - RNA, 22 nt, Shigella flexneri 2a str. 301
ugagcgcggccuguaccgccca

SEQ ID NO: 236462 - RNA, 22 nt, Shigella flexneri 2a str. 301
cgcggucuucguuggcguaggc

SEQ ID NO: 236463 - RNA, 22 nt, Shigella flexneri 2a str. 301
uuguagccaucauuuagcgcuu

SEQ ID NO: 236464 - RNA, 22 nt, Shigella flexneri 2a str. 301
guguugaaguucgucauaucgu

SEQ ID NO: 236465 - RNA, 22 nt, Shigella flexneri 2a str. 301
gcuggcagguccagucguugac

SEQ ID NO: 236466 - RNA, 22 nt, Shigella flexneri 2a str. 301
cugcuguacauggcugccgcug

SEQ ID NO: 236467 - RNA, 22 nt, Shigella flexneri 2a str. 301
ugacgcugaccggcgacgucca

SEQ ID NO: 236468 - RNA, 19 nt, Shigella flexneri 2a str. 301
cagccugucaggucugggc

SEQ ID NO: 236469 - RNA, 22 nt, Shigella flexneri 2a str. 301
augacguaggccugauaagcgu

SEQ ID NO: 236470 - RNA, 22 nt, Shigella flexneri 2a str. 301
ugcgacagcguuguccucgcgg

SEQ ID NO: 236471 - RNA, 22 nt, Shigella flexneri 2a str. 301
accauugccgcagcaauagcug

SEQ ID NO: 236472 - RNA, 22 nt, Shigella flexneri 2a str. 301
cgaacuggagcgggcguugagu

SEQ ID NO: 236473 - RNA, 22 nt, Shigella flexneri 2a str. 301
gcugacgcaaauugguuauguu

SEQ ID NO: 236474 - RNA, 22 nt, Shigella flexneri 2a str. 301
ucaguugauacuccaccugcga

SEQ ID NO: 236475 - RNA, 22 nt, Shigella flexneri 2a str. 301
ccugaacgauuucuucuacaac

SEQ ID NO: 236476 - RNA, 22 nt, Shigella flexneri 2a str. 301
cgauaugucgcguucacguaag

SEQ ID NO: 236477 - RNA, 22 nt, Shigella flexneri 2a str. 301
cgaaagacggcugguuauucac

SEQ ID NO: 236478 - RNA, 22 nt, Shigella flexneri 2a str. 301
cuuguucagaagccuucgcagg

SEQ ID NO: 236479 - RNA, 22 nt, Shigella flexneri 2a str. 301
ucgcgccuggcugccagugccg

SEQ ID NO: 236480 - RNA, 22 nt, Shigella flexneri 2a str. 301
guucucaucgcucuuaccgggg

SEQ ID NO: 236481 - RNA, 20 nt, Shigella flexneri 2a str. 301
gguaagugaagggaguguga

SEQ ID NO: 236482 - RNA, 22 nt, Shigella flexneri 2a str. 301
ugagaacggacguuugucgcgc

SEQ ID NO: 236483 - RNA, 22 nt, Shigella flexneri 2a str. 301
uacgccuuauccggccuacggg

SEQ ID NO: 236484 - RNA, 22 nt, Shigella flexneri 2a str. 301
ucguuguaauauuucagggugu

SEQ ID NO: 236485 - RNA, 22 nt, Shigella flexneri 2a str. 301
cauccugagaagcuugcaguga

SEQ ID NO: 236486 - RNA, 22 nt, Shigella flexneri 2a str. 301
aaucagcgguaucguuuccuuc

SEQ ID NO: 236487 - RNA, 22 nt, Shigella flexneri 2a str. 301
ugaagcggcgagcauuguugau

SEQ ID NO: 236488 - RNA, 22 nt, Shigella flexneri 2a str. 301
ucgauauggugcagucgcugac

SEQ ID NO: 236489 - RNA, 22 nt, Shigella flexneri 2a str. 301
augcuggcgauguacuacguca

SEQ ID NO: 236490 - RNA, 22 nt, Shigella flexneri 2a str. 301
ucugacuggccguggcgucacu

SEQ ID NO: 236491 - RNA, 22 nt, Shigella flexneri 2a str. 301
uaggccggacaaggcguucacg

SEQ ID NO: 236492 - RNA, 22 nt, Shigella flexneri 2a str. 301
cgguuacuggaagaaguggugu

SEQ ID NO: 236493 - RNA, 22 nt, Shigella flexneri 2a str. 301
gcucaggucguuagucacaucg

SEQ ID NO: 236494 - RNA, 22 nt, Shigella flexneri 2a str. 301
ccugaacaaagcgcucggagug

SEQ ID NO: 236495 - RNA, 22 nt, Shigella flexneri 2a str. 301
auuacagacugcccgcuugugg

SEQ ID NO: 236496 - RNA, 22 nt, Shigella flexneri 2a str. 301
aaggguauuuucgcaaaucagg

SEQ ID NO: 236497 - RNA, 22 nt, Shigella flexneri 2a str. 301
cgugcgucuucuauucagggga

SEQ ID NO: 236498 - RNA, 22 nt, Shigella flexneri 2a str. 301
uacuggugauugugcaaucgua

SEQ ID NO: 236499 - RNA, 23 nt, Shigella flexneri 2a str. 301
gcguuauagccgccaaauucugc

SEQ ID NO: 236500 - RNA, 22 nt, Shigella flexneri 2a str. 301
auacaucguggggugccaugga

SEQ ID NO: 236501 - RNA, 22 nt, Shigella flexneri 2a str. 301
acacgucgccaauccuggaaag

SEQ ID NO: 236502 - RNA, 22 nt, Shigella flexneri 2a str. 301
aacagguuuauuuagcuggcau

SEQ ID NO: 236503 - RNA, 22 nt, Shigella flexneri 2a str. 301
ugcuacgcgcuguuguugcagu

SEQ ID NO: 236504 - RNA, 22 nt, Shigella flexneri 2a str. 301
aggucagauaagcgaaacgcau

SEQ ID NO: 236505 - RNA, 22 nt, Shigella flexneri 2a str. 301
guccugcuugccagauacgaug

SEQ ID NO: 236506 - RNA, 23 nt, Shigella flexneri 2a str. 301
agucaugaauucacuacguccgg

SEQ ID NO: 236507 - RNA, 19 nt, Shigella flexneri 2a str. 301
uuaucaugaucgauggcgg

SEQ ID NO: 236508 - RNA, 22 nt, Shigella flexneri 2a str. 301
cucaaugcuuucgcgggugcgu

SEQ ID NO: 236509 - RNA, 22 nt, Shigella flexneri 2a str. 301
aucgcuggaagguuggcgcauu

SEQ ID NO: 236510 - RNA, 21 nt, Shigella flexneri 2a str. 301
uucagccuggcgucgcccacu

SEQ ID NO: 236511 - RNA, 22 nt, Shigella flexneri 2a str. 301
auccgguaucguggcuuauuca

SEQ ID NO: 236512 - RNA, 20 nt, Shigella flexneri 2a str. 301
ccacagcgaucuuuccacca

SEQ ID NO: 236513 - RNA, 22 nt, Shigella flexneri 2a str. 301
cagcaguucgcgaauacgcugc

SEQ ID NO: 236514 - RNA, 22 nt, Shigella flexneri 2a str. 301
aagccucaguuucuaugcaaau

SEQ ID NO: 236515 - RNA, 22 nt, Shigella flexneri 2a str. 301
gucgccgauaccgagguagcgg

SEQ ID NO: 236516 - RNA, 22 nt, Shigella flexneri 2a str. 301
uagcgaacugucgcugcuggaa

SEQ ID NO: 236517 - RNA, 22 nt, Shigella flexneri 2a str. 301
ugcaucacaaaccugaaaagaa

SEQ ID NO: 236518 - RNA, 22 nt, Shigella flexneri 2a str. 301
uuuaucggguacuaaaguucug

SEQ ID NO: 236519 - RNA, 22 nt, Shigella flexneri 2a str. 301
uaacggcgaucgcgccagcgga

SEQ ID NO: 236520 - RNA, 22 nt, Shigella flexneri 2a str. 301
aucugaguuuaugggaauaaau

SEQ ID NO: 236521 - RNA, 22 nt, Shigella flexneri 2a str. 301
ugcugucgguauuaaaagccaa

SEQ ID NO: 236522 - RNA, 22 nt, Shigella flexneri 2a str. 301
agcaguuucguggcggcaccga

SEQ ID NO: 236523 - RNA, 22 nt, Shigella flexneri 2a str. 301
auccgacaaaacauccggcaca

SEQ ID NO: 236524 - RNA, 23 nt, Shigella flexneri 2a str. 301
cgacuucggucagggugucguuc

SEQ ID NO: 236525 - RNA, 22 nt, Shigella flexneri 2a str. 301
gccggucaaucgcauucugggg

SEQ ID NO: 236526 - RNA, 22 nt, Shigella flexneri 2a str. 301
ccgaaggggcgaaaacuaaauc

SEQ ID NO: 236527 - RNA, 22 nt, Shigella flexneri 2a str. 301
auuggcaaucaucacgucguuu

SEQ ID NO: 236528 - RNA, 22 nt, Shigella flexneri 2a str. 301
gugaacguguaggccugauaag

SEQ ID NO: 236529 - RNA, 22 nt, Shigella flexneri 2a str. 301
guuugcgcugaugugggcagua

SEQ ID NO: 236530 - RNA, 22 nt, Shigella flexneri 2a str. 301
cgacgcagcagagcaaggaguu

SEQ ID NO: 236531 - RNA, 23 nt, Shigella flexneri 2a str. 301
ggcuggagagcggguagucguau

SEQ ID NO: 236532 - RNA, 22 nt, Shigella flexneri 2a str. 301
cauugcaccaauauggugcuua

SEQ ID NO: 236533 - RNA, 22 nt, Shigella flexneri 2a str. 301
gcggaucugcggaggcgcgguu

SEQ ID NO: 236534 - RNA, 22 nt, Shigella flexneri 2a str. 301
auggccgccccgguuggggacg

SEQ ID NO: 236535 - RNA, 22 nt, Shigella flexneri 2a str. 301
ugcugcacgccggucauaauga

SEQ ID NO: 236536 - RNA, 22 nt, Shigella flexneri 2a str. 301
cgucacguuccucggcgcgccg

SEQ ID NO: 236537 - RNA, 22 nt, Shigella flexneri 2a str. 301
agcauugaggaacagcguaauc

SEQ ID NO: 236538 - RNA, 22 nt, Shigella flexneri 2a str. 301
gggaauugugguucugggcacg

SEQ ID NO: 236539 - RNA, 21 nt, Shigella flexneri 2a str. 301
uggucagcaguuaucgcugac

SEQ ID NO: 236540 - RNA, 22 nt, Shigella flexneri 2a str. 301
cuggagauuaugcguaaagcca

SEQ ID NO: 236541 - RNA, 22 nt, Shigella flexneri 2a str. 301
ggauugacuggcauugcguagc

SEQ ID NO: 236542 - RNA, 22 nt, Shigella flexneri 2a str. 301
uacaaaugccauuauugacgau

SEQ ID NO: 236543 - RNA, 22 nt, Shigella flexneri 2a str. 301
agagugauguggaugcgcuggu

SEQ ID NO: 236544 - RNA, 22 nt, Shigella flexneri 2a str. 301
ggcguaggccgaaagcuggcaa

SEQ ID NO: 236545 - RNA, 22 nt, Shigella flexneri 2a str. 301
auucucugccaguacguugaau

SEQ ID NO: 236546 - RNA, 22 nt, Shigella flexneri 2a str. 301
augggcggauucuugcgacagg

SEQ ID NO: 236547 - RNA, 22 nt, Shigella flexneri 2a str. 301
ucaucaugucuucaacacguau

SEQ ID NO: 236548 - RNA, 22 nt, Shigella flexneri 2a str. 301
uccguggaugaucucguuggcg

SEQ ID NO: 236549 - RNA, 22 nt, Shigella flexneri 2a str. 301
ucacugcaagcuucucaggaug

SEQ ID NO: 236550 - RNA, 22 nt, Shigella flexneri 2a str. 301
cgccggaagagagauugcggua

SEQ ID NO: 236551 - RNA, 22 nt, Shigella flexneri 2a str. 301
ucggucacccggaucuggugau

SEQ ID NO: 236552 - RNA, 22 nt, Shigella flexneri 2a str. 301
ccugugggaaucucgcaucauu

SEQ ID NO: 236553 - RNA, 22 nt, Shigella flexneri 2a str. 301
cugcgucauuccggaguuuaug

SEQ ID NO: 236554 - RNA, 22 nt, Shigella flexneri 2a str. 301
uucgccggugguuaugcggcag

SEQ ID NO: 236555 - RNA, 22 nt, Shigella flexneri 2a str. 301
uugcugacuaucggaacuuuuu

SEQ ID NO: 236556 - RNA, 22 nt, Shigella flexneri 2a str. 301
ugcggugauugaacguaguauc

SEQ ID NO: 236557 - RNA, 22 nt, Shigella flexneri 2a str. 301
uggaaagucacagcccgcgccg

SEQ ID NO: 236558 - RNA, 19 nt, Shigella flexneri 2a str. 301
uauuacggcugauuugcaa

SEQ ID NO: 236559 - RNA, 22 nt, Shigella flexneri 2a str. 301
gguuucucggugaugaucgagg

SEQ ID NO: 236560 - RNA, 22 nt, Shigella flexneri 2a str. 301
uaacggcagugaagauucgugg

SEQ ID NO: 236561 - RNA, 19 nt, Shigella flexneri 2a str. 301
auucugccguaugaccagu

SEQ ID NO: 236562 - RNA, 22 nt, Shigella flexneri 2a str. 301
acugcauccagaggcgaaugca

SEQ ID NO: 236563 - RNA, 22 nt, Shigella flexneri 2a str. 301
guucaggauaagaaauuuagcg

SEQ ID NO: 236564 - RNA, 22 nt, Shigella flexneri 2a str. 301
cgucggcuggccucaccgcaga

SEQ ID NO: 236565 - RNA, 21 nt, Shigella flexneri 2a str. 301
agcguuauggcguacgucugc

SEQ ID NO: 236566 - RNA, 22 nt, Shigella flexneri 2a str. 301
aucaucacaaguggucagaccu

SEQ ID NO: 236567 - RNA, 22 nt, Shigella flexneri 2a str. 301
aggguugacguaauagagguuu

SEQ ID NO: 236568 - RNA, 22 nt, Shigella flexneri 2a str. 301
ucugcagaaaagaauauggcuu

SEQ ID NO: 236569 - RNA, 22 nt, Shigella flexneri 2a str. 301
guuugaucagaauacgaucguu

SEQ ID NO: 236570 - RNA, 22 nt, Shigella flexneri 2a str. 301
cgggugcaguaauaucgcccug

SEQ ID NO: 236571 - RNA, 22 nt, Shigella flexneri 2a str. 301
gugcgcuggguaucagaaaugg

SEQ ID NO: 236572 - RNA, 22 nt, Shigella flexneri 2a str. 301
gcgcugguggcgauggucgggg

SEQ ID NO: 236573 - RNA, 19 nt, Shigella flexneri 2a str. 301
cgccagugggaucgugccg

SEQ ID NO: 236574 - RNA, 22 nt, Shigella flexneri 2a str. 301
cacgcgagaucgacaaaaucgc

SEQ ID NO: 236575 - RNA, 22 nt, Shigella flexneri 2a str. 301
auggugcugccaucaucgguca

SEQ ID NO: 236576 - RNA, 22 nt, Shigella flexneri 2a str. 301
agguucguaccgguguggcgcg

SEQ ID NO: 236577 - RNA, 22 nt, Shigella flexneri 2a str. 301
gcugggucugguaguugccgcc

SEQ ID NO: 236578 - RNA, 22 nt, Shigella flexneri 2a str. 301
gacggcuauaucuacugcguga

SEQ ID NO: 236579 - RNA, 20 nt, Shigella flexneri 2a str. 301
ugugcugccccguggcuuuu

SEQ ID NO: 236580 - RNA, 22 nt, Shigella flexneri 2a str. 301
cuguugcaggaaggcuucaucg

SEQ ID NO: 236581 - RNA, 22 nt, Shigella flexneri 2a str. 301
aacgucggcaucgcggaaggcu

SEQ ID NO: 236582 - RNA, 22 nt, Shigella flexneri 2a str. 301
cauguucugaggugucuuccug

SEQ ID NO: 236583 - RNA, 22 nt, Shigella flexneri 2a str. 301
ugacguugaugucgcuugccgg

SEQ ID NO: 236584 - RNA, 22 nt, Shigella flexneri 2a str. 301
aguuugaucgcaaagguauggu

SEQ ID NO: 236585 - RNA, 22 nt, Shigella flexneri 2a str. 301
gaacaccgauacugucgcugcg

SEQ ID NO: 236586 - RNA, 22 nt, Shigella flexneri 2a str. 301
augcgcuucgcuuauccggccu

SEQ ID NO: 236587 - RNA, 22 nt, Shigella flexneri 2a str. 301
uagcucugcuacgucgcaugga

SEQ ID NO: 236588 - RNA, 18 nt, Shigella flexneri 2a str. 301
ucggugcuaaaucacguc

SEQ ID NO: 236589 - RNA, 22 nt, Shigella flexneri 2a str. 301
ggaaaucacggaagaaugcgca

SEQ ID NO: 236590 - RNA, 22 nt, Shigella flexneri 2a str. 301
ggaaugaugugauacgccccgg

SEQ ID NO: 236591 - RNA, 22 nt, Shigella flexneri 2a str. 301
ggcgauuauagccauauguugg

SEQ ID NO: 236592 - RNA, 22 nt, Shigella flexneri 2a str. 301
ucgugauguucgcacuggaccc

SEQ ID NO: 236593 - RNA, 19 nt, Shigella flexneri 2a str. 301
guugccgcuuuccagcccg

SEQ ID NO: 236594 - RNA, 22 nt, Shigella flexneri 2a str. 301
accaucugcggcauacuuucgc

SEQ ID NO: 236595 - RNA, 22 nt, Shigella flexneri 2a str. 301
cggaauaaacgauacaacccag

SEQ ID NO: 236596 - RNA, 22 nt, Shigella flexneri 2a str. 301
ugucaguggcgguucaaugcgg

SEQ ID NO: 236597 - RNA, 20 nt, Shigella flexneri 2a str. 301
acugcacgugucucaggaug

SEQ ID NO: 236598 - RNA, 22 nt, Shigella flexneri 2a str. 301
uggcuggcgacgccaagacggc

SEQ ID NO: 236599 - RNA, 22 nt, Shigella flexneri 2a str. 301
ugcaagauuuuguaggccugag

SEQ ID NO: 236600 - RNA, 18 nt, Shigella flexneri 2a str. 301
uugcuguaagcguucaac

SEQ ID NO: 236601 - RNA, 22 nt, Shigella flexneri 2a str. 301
auggcaaucgcaucuaucuggu

SEQ ID NO: 236602 - RNA, 20 nt, Shigella flexneri 2a str. 301
ugcgauuucaccguuagcgu

SEQ ID NO: 236603 - RNA, 22 nt, Shigella flexneri 2a str. 301
cguguugccugccgcgucggua

SEQ ID NO: 236604 - RNA, 22 nt, Shigella flexneri 2a str. 301
uucgcaagugacaucuuuuggc

SEQ ID NO: 236605 - RNA, 22 nt, Shigella flexneri 2a str. 301
ucaccugaucgucgccguacug

SEQ ID NO: 236606 - RNA, 22 nt, Shigella flexneri 2a str. 301
acaugccgacauauuugccgaa

SEQ ID NO: 236607 - RNA, 22 nt, Shigella flexneri 2a str. 301
uugguaucguugggcugguguu

SEQ ID NO: 236608 - RNA, 22 nt, Shigella flexneri 2a str. 301
uggaacggugcaggagcagguu

SEQ ID NO: 236609 - RNA, 22 nt, Shigella flexneri 2a str. 301
uaaggcguuuacgccgcauccg

SEQ ID NO: 236610 - RNA, 22 nt, Shigella flexneri 2a str. 301
gaugcaacauuugucgccgcag

SEQ ID NO: 236611 - RNA, 22 nt, Shigella flexneri 2a str. 301
cgguacgccggacgauuugaaa

SEQ ID NO: 236612 - RNA, 22 nt, Shigella flexneri 2a str. 301
ucgucgauauagcuacggaaua

SEQ ID NO: 236613 - RNA, 22 nt, Shigella flexneri 2a str. 301
cagguuguuucaucccacagcu

SEQ ID NO: 236614 - RNA, 22 nt, Shigella flexneri 2a str. 301
uagcaagugccaugcucaguca

SEQ ID NO: 236615 - RNA, 20 nt, Shigella flexneri 2a str. 301
ugccgugggacaguuugcug

SEQ ID NO: 236616 - RNA, 22 nt, Shigella flexneri 2a str. 301
uagaagacucggucacucaggu

SEQ ID NO: 236617 - RNA, 22 nt, Shigella flexneri 2a str. 301
uucuuguaguuucaacgcugcg

SEQ ID NO: 236618 - RNA, 22 nt, Shigella flexneri 2a str. 301
ucgccgcaccacaacugucagc

SEQ ID NO: 236619 - RNA, 22 nt, Shigella flexneri 2a str. 301
aggcgcauuuccgguauccaua

SEQ ID NO: 236620 - RNA, 22 nt, Shigella flexneri 2a str. 301
accgggugaugcaaaaguagcc

SEQ ID NO: 236621 - RNA, 22 nt, Shigella flexneri 2a str. 301
aaaugggugagaugacaacgau

SEQ ID NO: 236622 - RNA, 22 nt, Shigella flexneri 2a str. 301
cggaaugcuggacuuguugugu

SEQ ID NO: 236623 - RNA, 21 nt, Shigella flexneri 2a str. 301
aguugcagacguacacgggug

SEQ ID NO: 236624 - RNA, 22 nt, Shigella flexneri 2a str. 301
acguuaccggucagaaucgcca

SEQ ID NO: 236625 - RNA, 22 nt, Shigella flexneri 2a str. 301
uugccgcguuuucgacgagguu

SEQ ID NO: 236626 - RNA, 22 nt, Shigella flexneri 2a str. 301
uaucgccugcgaaucuaaauca

SEQ ID NO: 236627 - RNA, 18 nt, Shigella flexneri 2a str. 301
agcagcggcgcaauggca

SEQ ID NO: 236628 - RNA, 22 nt, Shigella flexneri 2a str. 301
guguugaauaauuccacugcag

SEQ ID NO: 236629 - RNA, 22 nt, Shigella flexneri 2a str. 301
caggaguuggcgaugaaugacc

SEQ ID NO: 236630 - RNA, 22 nt, Shigella flexneri 2a str. 301
aacgaugaacuuuuuugccauu

SEQ ID NO: 236631 - RNA, 22 nt, Shigella flexneri 2a str. 301
uacucaaacauuagcugggccu

SEQ ID NO: 236632 - RNA, 22 nt, Shigella flexneri 2a str. 301
aucucggcagauaucgcugcuc

SEQ ID NO: 236633 - RNA, 22 nt, Shigella flexneri 2a str. 301
caggaugguaucgacauggcgu

SEQ ID NO: 236634 - RNA, 22 nt, Shigella flexneri 2a str. 301
aaacgucgauggcuuuugcgau

SEQ ID NO: 236635 - RNA, 22 nt, Shigella flexneri 2a str. 301
ugcuggauaugaccaucgaaga

SEQ ID NO: 236636 - RNA, 22 nt, Shigella flexneri 2a str. 301
uuggcgaucauccgcaaaaucc

SEQ ID NO: 236637 - RNA, 17 nt, Shigella flexneri 2a str. 301
aagcggcgaugacuuaa

SEQ ID NO: 236638 - RNA, 22 nt, Shigella flexneri 2a str. 301
uggcagcgauguuccauaauca

SEQ ID NO: 236639 - RNA, 22 nt, Shigella flexneri 2a str. 301
ccgcgucuuaucaggccuacag

SEQ ID NO: 236640 - RNA, 22 nt, Shigella flexneri 2a str. 301
uuguaggccggauaaggcguuc

SEQ ID NO: 236641 - RNA, 22 nt, Shigella flexneri 2a str. 301
acacgcgguugcuuuugcccaa

SEQ ID NO: 236642 - RNA, 19 nt, Shigella flexneri 2a str. 301
aacuguccaaccagcauca

SEQ ID NO: 236643 - RNA, 18 nt, Shigella flexneri 2a str. 301
gagauuguugaagaauuc

SEQ ID NO: 236644 - RNA, 22 nt, Shigella flexneri 2a str. 301
ccuuccggcccacagaucgcuu

SEQ ID NO: 236645 - RNA, 22 nt, Shigella flexneri 2a str. 301
guguuaucgauauuggugaguu

SEQ ID NO: 236646 - RNA, 20 nt, Shigella flexneri 2a str. 301
agcgccuuuuuuauaggugu

SEQ ID NO: 236647 - RNA, 22 nt, Shigella flexneri 2a str. 301
uggcagcgaaucggcguuggcg

SEQ ID NO: 236648 - RNA, 22 nt, Shigella flexneri 2a str. 301
gcugccguaugccguggcuccc

SEQ ID NO: 236649 - RNA, 22 nt, Shigella flexneri 2a str. 301
ccgcuuugaucaccaguucaca

SEQ ID NO: 236650 - RNA, 22 nt, Shigella flexneri 2a str. 301
gcgcuguucugcgcuuuuucug

SEQ ID NO: 236651 - RNA, 22 nt, Shigella flexneri 2a str. 301
acggcgguauacaucgcgguga

SEQ ID NO: 236652 - RNA, 22 nt, Shigella flexneri 2a str. 301
uggcggcaaucggugcugcgau

SEQ ID NO: 236653 - RNA, 22 nt, Shigella flexneri 2a str. 301
uggcaauauuccagucgaucgg

SEQ ID NO: 236654 - RNA, 22 nt, Shigella flexneri 2a str. 301
cuucaccggacuggugaugaug

SEQ ID NO: 236655 - RNA, 22 nt, Shigella flexneri 2a str. 301
ggcguucuuuaucgccaagcgu

SEQ ID NO: 236656 - RNA, 22 nt, Shigella flexneri 2a str. 301
cugguagguauaacguuggcgu

SEQ ID NO: 236657 - RNA, 22 nt, Shigella flexneri 2a str. 301
ccgacgacgguuuacagcauua

SEQ ID NO: 236658 - RNA, 22 nt, Shigella flexneri 2a str. 301
uauggcaccaacgcguuacugg

SEQ ID NO: 236659 - RNA, 22 nt, Shigella flexneri 2a str. 301
gcuucugcacugugguuuuucu

SEQ ID NO: 236660 - RNA, 22 nt, Shigella flexneri 2a str. 301
cgguuuauguuucgccugugcg

SEQ ID NO: 236661 - RNA, 22 nt, Shigella flexneri 2a str. 301
uggcgcaucugcaccugaccag

SEQ ID NO: 236662 - RNA, 22 nt, Shigella flexneri 2a str. 301
augcuugauuaaaaaggcgcua

SEQ ID NO: 236663 - RNA, 22 nt, Shigella flexneri 2a str. 301
ggugaagucguagcgaggccag

SEQ ID NO: 236664 - RNA, 19 nt, Shigella flexneri 2a str. 301
accugggcggcuugccugc

SEQ ID NO: 236665 - RNA, 22 nt, Shigella flexneri 2a str. 301
agcgugugaaugccgauaucgu

SEQ ID NO: 236666 - RNA, 22 nt, Shigella flexneri 2a str. 301
cgggcguucgagaguguucuua

SEQ ID NO: 236667 - RNA, 22 nt, Shigella flexneri 2a str. 301
acguuccuccccaccagcuugu

SEQ ID NO: 236668 - RNA, 22 nt, Shigella flexneri 2a str. 301
gccgacagaucguuaaccugca

SEQ ID NO: 236669 - RNA, 22 nt, Shigella flexneri 2a str. 301
ugcauugcugguacuuucacag

SEQ ID NO: 236670 - RNA, 22 nt, Shigella flexneri 2a str. 301
caucuuauccagcaaccagguc

SEQ ID NO: 236671 - RNA, 16 nt, Shigella flexneri 2a str. 301
uccggccuggcaccgu

SEQ ID NO: 236672 - RNA, 22 nt, Shigella flexneri 2a str. 301
acccugcugcaccugcuggccg

SEQ ID NO: 236673 - RNA, 22 nt, Shigella flexneri 2a str. 301
cauccugagacacgugcagugg

SEQ ID NO: 236674 - RNA, 22 nt, Shigella flexneri 2a str. 301
augccgcuuacucaagaagaaa

SEQ ID NO: 236675 - RNA, 22 nt, Shigella flexneri 2a str. 301
augccauugcugaauuugagaa

SEQ ID NO: 236676 - RNA, 19 nt, Shigella flexneri 2a str. 301
aggugauugaaaccgaucu

SEQ ID NO: 236677 - RNA, 22 nt, Shigella flexneri 2a str. 301
ugcgugauuauguaggccggau

SEQ ID NO: 236678 - RNA, 22 nt, Shigella flexneri 2a str. 301
gucagcaccagggugaucgcuu

SEQ ID NO: 236679 - RNA, 22 nt, Shigella flexneri 2a str. 301
cucgcguaauuuauccggcagg

SEQ ID NO: 236680 - RNA, 22 nt, Shigella flexneri 2a str. 301
cacgccguggcgugcagcaugg

SEQ ID NO: 236681 - RNA, 22 nt, Shigella flexneri 2a str. 301
aaccuguuuguuaccaggcugg

SEQ ID NO: 236682 - RNA, 22 nt, Shigella flexneri 2a str. 301
uugaggaugugcgcacgguccg

SEQ ID NO: 236683 - RNA, 22 nt, Shigella flexneri 2a str. 301
aucaggucaucgaucacuuucu

SEQ ID NO: 236684 - RNA, 22 nt, Shigella flexneri 2a str. 301
gcugcgcuuaucaggccuacag

SEQ ID NO: 236685 - RNA, 22 nt, Shigella flexneri 2a str. 301
aggcgcugaacgugguggugcg

SEQ ID NO: 236686 - RNA, 22 nt, Shigella flexneri 2a str. 301
cggguagagcacauugaugccg

SEQ ID NO: 236687 - RNA, 22 nt, Shigella flexneri 2a str. 301
agguuugcuguucgcgcgccag

SEQ ID NO: 236688 - RNA, 22 nt, Shigella flexneri 2a str. 301
acugaccgacucagggcagaca

SEQ ID NO: 236689 - RNA, 22 nt, Shigella flexneri 2a str. 301
cgggcacacgaaaggagauauu

SEQ ID NO: 236690 - RNA, 22 nt, Shigella flexneri 2a str. 301
cugugggcugacguacuggcgg

SEQ ID NO: 236691 - RNA, 21 nt, Shigella flexneri 2a str. 301
ugacgguacgcugaaagguuc

SEQ ID NO: 236692 - RNA, 23 nt, Shigella flexneri 2a str. 301
ccauccgcgaacugucuuucacc

SEQ ID NO: 236693 - RNA, 22 nt, Shigella flexneri 2a str. 301
uuacguucggcgagcaguuguu

SEQ ID NO: 236694 - RNA, 22 nt, Shigella flexneri 2a str. 301
uucuggucuucuuuacugacgc

SEQ ID NO: 236695 - RNA, 22 nt, Shigella flexneri 2a str. 301
aagucacugacaucguuacgau

SEQ ID NO: 236696 - RNA, 22 nt, Shigella flexneri 2a str. 301
cugggcugacaccguacaggag

SEQ ID NO: 236697 - RNA, 22 nt, Shigella flexneri 2a str. 301
ccgauaguuaagucaaaaccga

SEQ ID NO: 236698 - RNA, 20 nt, Shigella flexneri 2a str. 301
augauggacggcaacagcgg

SEQ ID NO: 236699 - RNA, 20 nt, Shigella flexneri 2a str. 301
uuguucaguugaaggugugc

SEQ ID NO: 236700 - RNA, 22 nt, Shigella flexneri 2a str. 301
cgcugcuggguaacuucguagc

SEQ ID NO: 236701 - RNA, 22 nt, Shigella flexneri 2a str. 301
acgaagugaaguuuguugauuu

SEQ ID NO: 236702 - RNA, 22 nt, Shigella flexneri 2a str. 301
aggccguugcuguuggucaagc

SEQ ID NO: 236703 - RNA, 22 nt, Shigella flexneri 2a str. 301
ccugggaaaaaaucgcuggcgg

SEQ ID NO: 236704 - RNA, 22 nt, Shigella flexneri 2a str. 301
agugaccgggguggagaaacgc

SEQ ID NO: 236705 - RNA, 22 nt, Shigella flexneri 2a str. 301
uaucgaaacgcaucuggugaug

SEQ ID NO: 236706 - RNA, 22 nt, Shigella flexneri 2a str. 301
auucauguggcguuauuucggc

SEQ ID NO: 236707 - RNA, 22 nt, Shigella flexneri 2a str. 301
gcucugccuauuuugaaaacgc

SEQ ID NO: 236708 - RNA, 22 nt, Shigella flexneri 2a str. 301
uucugaauauuccgaauaguua

SEQ ID NO: 236709 - RNA, 22 nt, Shigella flexneri 2a str. 301
auuucgauaauaucguguuggu

SEQ ID NO: 236710 - RNA, 22 nt, Shigella flexneri 2a str. 301
uucgcccguaugucauuccggu

SEQ ID NO: 236711 - RNA, 22 nt, Shigella flexneri 2a str. 301
uggcgcguggccacaucaucaa

SEQ ID NO: 236712 - RNA, 22 nt, Shigella flexneri 2a str. 301
acuccagcaccuguuugaucug

SEQ ID NO: 236713 - RNA, 22 nt, Shigella flexneri 2a str. 301
augcgucucugaacaggcggcc

SEQ ID NO: 236714 - RNA, 22 nt, Shigella flexneri 2a str. 301
uugaugauaucgaucucaaccu

SEQ ID NO: 236715 - RNA, 20 nt, Shigella flexneri 2a str. 301
ugagaagcuggaaggguuga

SEQ ID NO: 236716 - RNA, 22 nt, Shigella flexneri 2a str. 301
aucccgauggucgauuuccagc

SEQ ID NO: 236717 - RNA, 22 nt, Shigella flexneri 2a str. 301
cgucacgcugguggaucagggc

SEQ ID NO: 236718 - RNA, 22 nt, Shigella flexneri 2a str. 301
ucgcuuugauggcugcggcauu

SEQ ID NO: 236719 - RNA, 22 nt, Shigella flexneri 2a str. 301
auggcgauguagucuuucacgc

SEQ ID NO: 236720 - RNA, 22 nt, Shigella flexneri 2a str. 301
uguuugaauauucaggugcuug

SEQ ID NO: 236721 - RNA, 20 nt, Shigella flexneri 2a str. 301
gacugggccgcuggagguaa

SEQ ID NO: 236722 - RNA, 22 nt, Shigella flexneri 2a str. 301
gcguaucaucaacccgaugcgc

SEQ ID NO: 236723 - RNA, 22 nt, Shigella flexneri 2a str. 301
auugcccguuuuacagcguuac

SEQ ID NO: 236724 - RNA, 22 nt, Shigella flexneri 2a str. 301
cugcgcaucaaaaagauaaaag

SEQ ID NO: 236725 - RNA, 22 nt, Shigella flexneri 2a str. 301
aggugcguaauaagcugguggc

SEQ ID NO: 236726 - RNA, 22 nt, Shigella flexneri 2a str. 301
uguaccaccgguaagcugaauu

SEQ ID NO: 236727 - RNA, 22 nt, Shigella flexneri 2a str. 301
gaugagcguuucccgcauccgc

SEQ ID NO: 236728 - RNA, 22 nt, Shigella flexneri 2a str. 301
auggcggaaguccgaccuucag

SEQ ID NO: 236729 - RNA, 22 nt, Shigella flexneri 2a str. 301
aagugccgcuguuuggucgugc

SEQ ID NO: 236730 - RNA, 22 nt, Shigella flexneri 2a str. 301
gcuucgcggagguaucggagau

SEQ ID NO: 236731 - RNA, 22 nt, Shigella flexneri 2a str. 301
gggacauaaccacgggcauuac

SEQ ID NO: 236732 - RNA, 22 nt, Shigella flexneri 2a str. 301
ggugacuguacuggaaggucug

SEQ ID NO: 236733 - RNA, 22 nt, Shigella flexneri 2a str. 301
cgagacgccguauauuaaauug

SEQ ID NO: 236734 - RNA, 22 nt, Shigella flexneri 2a str. 301
ucgaucagcgauuuuauuaagu

SEQ ID NO: 236735 - RNA, 22 nt, Shigella flexneri 2a str. 301
augcuggcgggcguugguggua

SEQ ID NO: 236736 - RNA, 22 nt, Shigella flexneri 2a str. 301
ccgccagaacuggcgaaacuag

SEQ ID NO: 236737 - RNA, 22 nt, Shigella flexneri 2a str. 301
caguauuugccgccagagauga

SEQ ID NO: 236738 - RNA, 22 nt, Shigella flexneri 2a str. 301
uucuguacagcacgcuucauag

SEQ ID NO: 236739 - RNA, 22 nt, Shigella flexneri 2a str. 301
ugcaaucuccguguaggccuga

SEQ ID NO: 236740 - RNA, 22 nt, Shigella flexneri 2a str. 301
uggcauuuugccuuuaggaugu

SEQ ID NO: 236741 - RNA, 22 nt, Shigella flexneri 2a str. 301
ugucugucucugggccuugaua

SEQ ID NO: 236742 - RNA, 22 nt, Shigella flexneri 2a str. 301
caggccuacgcguccccugcaa

SEQ ID NO: 236743 - RNA, 22 nt, Shigella flexneri 2a str. 301
agcaucgcucaucaugaugucg

SEQ ID NO: 236744 - RNA, 22 nt, Shigella flexneri 2a str. 301
ugcguuauucuuucauguuucc

SEQ ID NO: 236745 - RNA, 22 nt, Shigella flexneri 2a str. 301
ugcugaccaaaagugcguccga

SEQ ID NO: 236746 - RNA, 22 nt, Shigella flexneri 2a str. 301
ugaguuuaucuuguuauggauu

SEQ ID NO: 236747 - RNA, 22 nt, Shigella flexneri 2a str. 301
auggcgauguguuucaccugcu

SEQ ID NO: 236748 - RNA, 22 nt, Shigella flexneri 2a str. 301
uuagccguagaggcuguuucug

SEQ ID NO: 236749 - RNA, 22 nt, Shigella flexneri 2a str. 301
aucacuuuacgcuuaguggcaa

SEQ ID NO: 236750 - RNA, 22 nt, Shigella flexneri 2a str. 301
gcgucggaguuuguugauguaa

SEQ ID NO: 236751 - RNA, 22 nt, Shigella flexneri 2a str. 301
gccgaucgacaguggcguuauu

SEQ ID NO: 236752 - RNA, 22 nt, Shigella flexneri 2a str. 301
cggcggaucaguuacaggcguu

SEQ ID NO: 236753 - RNA, 22 nt, Shigella flexneri 2a str. 301
cuggaugucggugccgaugacu

SEQ ID NO: 236754 - RNA, 22 nt, Shigella flexneri 2a str. 301
cugccgaggaauuaccugauuc

SEQ ID NO: 236755 - RNA, 19 nt, Shigella flexneri 2a str. 301
ugaaagcgguugcaggcgg

SEQ ID NO: 236756 - RNA, 22 nt, Shigella flexneri 2a str. 301
auaggucagugacacauuauga

SEQ ID NO: 236757 - RNA, 22 nt, Shigella flexneri 2a str. 301
ccgguuagaagaaugcuauucg

SEQ ID NO: 236758 - RNA, 22 nt, Shigella flexneri 2a str. 301
cggagcgaaacggcacaaccau

SEQ ID NO: 236759 - RNA, 22 nt, Shigella flexneri 2a str. 301
ccggccuacaaacccuugcuaa

SEQ ID NO: 236760 - RNA, 22 nt, Shigella flexneri 2a str. 301
ggcggcuuucaacgagaauagg

SEQ ID NO: 236761 - RNA, 22 nt, Shigella flexneri 2a str. 301
gccauugugucucugucuccaa

SEQ ID NO: 236762 - RNA, 22 nt, Shigella flexneri 2a str. 301
gugauuauggaugaaccgacuu

SEQ ID NO: 236763 - RNA, 22 nt, Shigella flexneri 2a str. 301
acggugccgucguacuguucga

SEQ ID NO: 236764 - RNA, 22 nt, Shigella flexneri 2a str. 301
uagcgacccauuuugccgguuc

SEQ ID NO: 236765 - RNA, 22 nt, Shigella flexneri 2a str. 301
gguucugcgggaauacgguuuu

SEQ ID NO: 236766 - RNA, 22 nt, Shigella flexneri 2a str. 301
acgcuucauugaagccgauuuc

SEQ ID NO: 236767 - RNA, 22 nt, Shigella flexneri 2a str. 301
auggauuacaaaauaaaccaca

SEQ ID NO: 236768 - RNA, 22 nt, Shigella flexneri 2a str. 301
agcggugcgauaacgaaccgcu

SEQ ID NO: 236769 - RNA, 22 nt, Shigella flexneri 2a str. 301
agcaguuguuauuaaaggauac

SEQ ID NO: 236770 - RNA, 22 nt, Shigella flexneri 2a str. 301
cgcguuaacgucuggcugcaua

SEQ ID NO: 236771 - RNA, 22 nt, Shigella flexneri 2a str. 301
ucauguaggcggugaugagcug

SEQ ID NO: 236772 - RNA, 22 nt, Shigella flexneri 2a str. 301
uaaagugaugguagucacauaa

SEQ ID NO: 236773 - RNA, 22 nt, Shigella flexneri 2a str. 301
ggcacugaaaccguggguguua

SEQ ID NO: 236774 - RNA, 22 nt, Shigella flexneri 2a str. 301
aaucagaauuuauuuuagcuaa

SEQ ID NO: 236775 - RNA, 22 nt, Shigella flexneri 2a str. 301
uccagcaaauugugauagcgca

SEQ ID NO: 236776 - RNA, 22 nt, Shigella flexneri 2a str. 301
ucaauaagcgcaggcuguugag

SEQ ID NO: 236777 - RNA, 22 nt, Shigella flexneri 2a str. 301
gugugcaaagacugauagccgu

SEQ ID NO: 236778 - RNA, 22 nt, Shigella flexneri 2a str. 301
gcuggcguugcgcggaguacgu

SEQ ID NO: 236779 - RNA, 22 nt, Shigella flexneri 2a str. 301
ugcgccaagagccagcgugucg

SEQ ID NO: 236780 - RNA, 21 nt, Shigella flexneri 2a str. 301
uauuccugcggaucgagagaa

SEQ ID NO: 236781 - RNA, 21 nt, Shigella flexneri 2a str. 301
cggcagcaacuucaucacgga

SEQ ID NO: 236782 - RNA, 22 nt, Shigella flexneri 2a str. 301
ugaagcacuauauuggugcaac

SEQ ID NO: 236783 - RNA, 22 nt, Shigella flexneri 2a str. 301
augcgcuuaagcgucuggaugu

SEQ ID NO: 236784 - RNA, 22 nt, Shigella flexneri 2a str. 301
caucacgcggucuacguaguca

SEQ ID NO: 236785 - RNA, 22 nt, Shigella flexneri 2a str. 301
gccguggaaaucggugauugau

SEQ ID NO: 236786 - RNA, 22 nt, Shigella flexneri 2a str. 301
uucagggcuucucccaguacau

SEQ ID NO: 236787 - RNA, 22 nt, Shigella flexneri 2a str. 301
aucgguaaauuagccgcgcgug

SEQ ID NO: 236788 - RNA, 22 nt, Shigella flexneri 2a str. 301
gugggcgacgccaggcugaaug

SEQ ID NO: 236789 - RNA, 22 nt, Shigella flexneri 2a str. 301
acgcugaaguaccgcugucuga

SEQ ID NO: 236790 - RNA, 22 nt, Shigella flexneri 2a str. 301
ugacggcguucuggacgcucuc

SEQ ID NO: 236791 - RNA, 22 nt, Shigella flexneri 2a str. 301
ucgguucugguucuuuaaccgg

SEQ ID NO: 236792 - RNA, 22 nt, Shigella flexneri 2a str. 301
uugacuuucugacccacuucga

SEQ ID NO: 236793 - RNA, 22 nt, Shigella flexneri 2a str. 301
guauaucaauaaaguccggcuc

SEQ ID NO: 236794 - RNA, 22 nt, Shigella flexneri 2a str. 301
uucucgguuugcuggucacgau

SEQ ID NO: 236795 - RNA, 20 nt, Shigella flexneri 2a str. 301
gugcgagucgccugaacagu

SEQ ID NO: 236796 - RNA, 22 nt, Shigella flexneri 2a str. 301
guucagcagauuuggcgcaacu

SEQ ID NO: 236797 - RNA, 22 nt, Shigella flexneri 2a str. 301
ccugaugcugguauuggugauu

SEQ ID NO: 236798 - RNA, 22 nt, Shigella flexneri 2a str. 301
ggccguugagauccuuuacaac

SEQ ID NO: 236799 - RNA, 22 nt, Shigella flexneri 2a str. 301
uuacugauguugcgaaaacgcu

SEQ ID NO: 236800 - RNA, 22 nt, Shigella flexneri 2a str. 301
gugaugaagauugguaccgggc

SEQ ID NO: 236801 - RNA, 22 nt, Shigella flexneri 2a str. 301
uggcuggcaauacuggcagcag

SEQ ID NO: 236802 - RNA, 22 nt, Shigella flexneri 2a str. 301
gaugccugcaaacgucuggcag

SEQ ID NO: 236803 - RNA, 23 nt, Shigella flexneri 2a str. 301
ugguugaccgcaguuuugccgcc

SEQ ID NO: 236804 - RNA, 21 nt, Shigella flexneri 2a str. 301
ccauccgauuugauauuacgc

SEQ ID NO: 236805 - RNA, 22 nt, Shigella flexneri 2a str. 301
uacgacgcacuuuaugaggucc

SEQ ID NO: 236806 - RNA, 22 nt, Shigella flexneri 2a str. 301
uuuccagguguucggcgcugac

SEQ ID NO: 236807 - RNA, 22 nt, Shigella flexneri 2a str. 301
ccagcgcuucgguauggcgggu

SEQ ID NO: 236808 - RNA, 22 nt, Shigella flexneri 2a str. 301
acuggcaggucuggcggugauc

SEQ ID NO: 236809 - RNA, 22 nt, Shigella flexneri 2a str. 301
uaagauugugaaugacggccgg

SEQ ID NO: 236810 - RNA, 22 nt, Shigella flexneri 2a str. 301
augucguucggcgaggugguga

SEQ ID NO: 236811 - RNA, 22 nt, Shigella flexneri 2a str. 301
cugaauuugucguucagccaga

SEQ ID NO: 236812 - RNA, 20 nt, Shigella flexneri 2a str. 301
gaugaacaguucuucucugu

SEQ ID NO: 236813 - RNA, 22 nt, Shigella flexneri 2a str. 301
acgucguuuugauauuauuaug

SEQ ID NO: 236814 - RNA, 22 nt, Shigella flexneri 2a str. 301
aauccagcgcaggcuacggugg

SEQ ID NO: 236815 - RNA, 22 nt, Shigella flexneri 2a str. 301
ugccgccaucgggauugcuaug

SEQ ID NO: 236816 - RNA, 20 nt, Shigella flexneri 2a str. 301
cgucgaucagcuccagcgcc

SEQ ID NO: 236817 - RNA, 22 nt, Shigella flexneri 2a str. 301
uuggccugaauaucuccacugg

SEQ ID NO: 236818 - RNA, 22 nt, Shigella flexneri 2a str. 301
gcgcacguaauugauccagaag

SEQ ID NO: 236819 - RNA, 22 nt, Shigella flexneri 2a str. 301
ucaucgucgaguugcagguuca

SEQ ID NO: 236820 - RNA, 22 nt, Shigella flexneri 2a str. 301
uccggccuacaugaucucugca

SEQ ID NO: 236821 - RNA, 22 nt, Shigella flexneri 2a str. 301
cuuuggcaaaccgccagcuagg

SEQ ID NO: 236822 - RNA, 22 nt, Shigella flexneri 2a str. 301
cguaugguugaguuugaguggc

SEQ ID NO: 236823 - RNA, 22 nt, Shigella flexneri 2a str. 301
uauaucgacguuggugcgacgu

SEQ ID NO: 236824 - RNA, 22 nt, Shigella flexneri 2a str. 301
aggagcgcuccagccccuucga

SEQ ID NO: 236825 - RNA, 22 nt, Shigella flexneri 2a str. 301
uugccgagugcgaccgugacag

SEQ ID NO: 236826 - RNA, 22 nt, Shigella flexneri 2a str. 301
uaacccgcugcauugccaccgc

SEQ ID NO: 236827 - RNA, 22 nt, Shigella flexneri 2a str. 301
agcaggccacaguuccgguggu

SEQ ID NO: 236828 - RNA, 20 nt, Shigella flexneri 2a str. 301
ucgcgaccuucauugcgguc

SEQ ID NO: 236829 - RNA, 22 nt, Shigella flexneri 2a str. 301
uuacccgaccgagccgcgccau

SEQ ID NO: 236830 - RNA, 20 nt, Shigella flexneri 2a str. 301
uuucaucggcguuagcccag

SEQ ID NO: 236831 - RNA, 22 nt, Shigella flexneri 2a str. 301
uuaacugcugagccggugcguu

SEQ ID NO: 236832 - RNA, 22 nt, Shigella flexneri 2a str. 301
aucgucgaaacgccggagcagg

SEQ ID NO: 236833 - RNA, 22 nt, Shigella flexneri 2a str. 301
ucugccagagcuucaaugcguu

SEQ ID NO: 236834 - RNA, 22 nt, Shigella flexneri 2a str. 301
auuucuggcggcauggugccag

SEQ ID NO: 236835 - RNA, 22 nt, Shigella flexneri 2a str. 301
uaucaauggcuggcuuauugug

SEQ ID NO: 236836 - RNA, 19 nt, Shigella flexneri 2a str. 301
cuugcggugaagaagaggu

SEQ ID NO: 236837 - RNA, 22 nt, Shigella flexneri 2a str. 301
gcccuuuguaggccagauaaga

SEQ ID NO: 236838 - RNA, 22 nt, Shigella flexneri 2a str. 301
gugagcguauuggugaauugca

SEQ ID NO: 236839 - RNA, 22 nt, Shigella flexneri 2a str. 301
ugagaucauguuguagcgcccg

SEQ ID NO: 236840 - RNA, 22 nt, Shigella flexneri 2a str. 301
ucucugcgauaaaaccgccugu

SEQ ID NO: 236841 - RNA, 23 nt, Shigella flexneri 2a str. 301
ucggcggugcgacggucgaauuu

SEQ ID NO: 236842 - RNA, 22 nt, Shigella flexneri 2a str. 301
acgaaacuggacggcacggcga

SEQ ID NO: 236843 - RNA, 22 nt, Shigella flexneri 2a str. 301
agcgcaggcagaacggaauuac

SEQ ID NO: 236844 - RNA, 22 nt, Shigella flexneri 2a str. 301
cugguagcgcuggggcugcaaa

SEQ ID NO: 236845 - RNA, 22 nt, Shigella flexneri 2a str. 301
aagcgguuguacccgugccggu

SEQ ID NO: 236846 - RNA, 22 nt, Shigella flexneri 2a str. 301
cauggugucaauauccugcggc

SEQ ID NO: 236847 - RNA, 22 nt, Shigella flexneri 2a str. 301
acaacggagaacaguauccugu

SEQ ID NO: 236848 - RNA, 22 nt, Shigella flexneri 2a str. 301
aggaaacuuauuucuuaucguu

SEQ ID NO: 236849 - RNA, 22 nt, Shigella flexneri 2a str. 301
ugcgcugcgcuuaucaggccua

SEQ ID NO: 236850 - RNA, 22 nt, Shigella flexneri 2a str. 301
aggccgcaucaucgcuugcgau

SEQ ID NO: 236851 - RNA, 22 nt, Shigella flexneri 2a str. 301
acggccauuuuaugugcuaugu

SEQ ID NO: 236852 - RNA, 22 nt, Shigella flexneri 2a str. 301
aaugguuuacccaugcagguag

SEQ ID NO: 236853 - RNA, 22 nt, Shigella flexneri 2a str. 301
ugcgagcgaugucugccggguu

SEQ ID NO: 236854 - RNA, 22 nt, Shigella flexneri 2a str. 301
gcgaugugcaaauacuucugcg

SEQ ID NO: 236855 - RNA, 22 nt, Shigella flexneri 2a str. 301
ggcuuuccaguucaccagauug

SEQ ID NO: 236856 - RNA, 22 nt, Shigella flexneri 2a str. 301
uugcagcgucuuaucaggccua

SEQ ID NO: 236857 - RNA, 22 nt, Shigella flexneri 2a str. 301
ugcacgcugggugagaaacugc

SEQ ID NO: 236858 - RNA, 22 nt, Shigella flexneri 2a str. 301
ugacugcguaauacagcccguc

SEQ ID NO: 236859 - RNA, 22 nt, Shigella flexneri 2a str. 301
ucguuauucuucgguaucggca

SEQ ID NO: 236860 - RNA, 22 nt, Shigella flexneri 2a str. 301
gcgucuggcauuaggaacgcug

SEQ ID NO: 236861 - RNA, 22 nt, Shigella flexneri 2a str. 301
gcaacucucuacuguuucucca

SEQ ID NO: 236862 - RNA, 22 nt, Shigella flexneri 2a str. 301
gggucgcuacaaccugcaucuu

SEQ ID NO: 236863 - RNA, 22 nt, Shigella flexneri 2a str. 301
caguguuucggucugauaugga

SEQ ID NO: 236864 - RNA, 22 nt, Shigella flexneri 2a str. 301
uacgaggucaacggagcggaca

SEQ ID NO: 236865 - RNA, 22 nt, Shigella flexneri 2a str. 301
cguuuacagauggguaaugugu

SEQ ID NO: 236866 - RNA, 22 nt, Shigella flexneri 2a str. 301
ugauaguguuuuauguucagau

SEQ ID NO: 236867 - RNA, 22 nt, Shigella flexneri 2a str. 301
cagacguugaucuucaggcuga

SEQ ID NO: 236868 - RNA, 22 nt, Shigella flexneri 2a str. 301
aauuccaauaagaagaacuuua

SEQ ID NO: 236869 - RNA, 22 nt, Shigella flexneri 2a str. 301
gauagguguugucgucaucuuu

SEQ ID NO: 236870 - RNA, 22 nt, Shigella flexneri 2a str. 301
auccggccuacaaaaucgugca

SEQ ID NO: 236871 - RNA, 22 nt, Shigella flexneri 2a str. 301
aagguguuaaacuggaaaaccg

SEQ ID NO: 236872 - RNA, 22 nt, Shigella flexneri 2a str. 301
acagcggaaaccaggguagcca

SEQ ID NO: 236873 - RNA, 20 nt, Shigella flexneri 2a str. 301
ugcugcugugacaguucgau

SEQ ID NO: 236874 - RNA, 22 nt, Shigella flexneri 2a str. 301
cuggagauggcaaaaucgcucg

SEQ ID NO: 236875 - RNA, 22 nt, Shigella flexneri 2a str. 301
uucgcggaauguguucgcugau

SEQ ID NO: 236876 - RNA, 23 nt, Shigella flexneri 2a str. 301
cuggagacaggaaaaauuaugcu

SEQ ID NO: 236877 - RNA, 23 nt, Shigella flexneri 2a str. 301
uuaccgaugaauuuauucguggu

SEQ ID NO: 236878 - RNA, 22 nt, Shigella flexneri 2a str. 301
ugauggcugccgccgucugcgc

SEQ ID NO: 236879 - RNA, 22 nt, Shigella flexneri 2a str. 301
cgagaucgguaccgucacgcca

SEQ ID NO: 236880 - RNA, 22 nt, Shigella flexneri 2a str. 301
aggauauugguaaaacguucgc

SEQ ID NO: 236881 - RNA, 19 nt, Shigella flexneri 2a str. 301
ccaugcucguucuucugcu

SEQ ID NO: 236882 - RNA, 22 nt, Shigella flexneri 2a str. 301
uuauggcaaaacauuucacucc

SEQ ID NO: 236883 - RNA, 22 nt, Shigella flexneri 2a str. 301
gaaggccagccggucaucagcg

SEQ ID NO: 236884 - RNA, 22 nt, Shigella flexneri 2a str. 301
uugagcaugaacccgguugagc

SEQ ID NO: 236885 - RNA, 22 nt, Shigella flexneri 2a str. 301
uaccggugcgcuggcggugaug

SEQ ID NO: 236886 - RNA, 18 nt, Shigella flexneri 2a str. 301
gugaauggaaaaugcugg

SEQ ID NO: 236887 - RNA, 22 nt, Shigella flexneri 2a str. 301
gccagcgagucuucaccaacgg

SEQ ID NO: 236888 - RNA, 22 nt, Shigella flexneri 2a str. 301
acggcuggcgcuaucaggaaca

SEQ ID NO: 236889 - RNA, 22 nt, Shigella flexneri 2a str. 301
aauggucguuauucaucaccca

SEQ ID NO: 236890 - RNA, 22 nt, Shigella flexneri 2a str. 301
ugccggaugucuggagcuggcu

SEQ ID NO: 236891 - RNA, 22 nt, Shigella flexneri 2a str. 301
gagcagaucgaaaaaguggcga

SEQ ID NO: 236892 - RNA, 21 nt, Shigella flexneri 2a str. 301
auucaagucggugcgacgaua

SEQ ID NO: 236893 - RNA, 22 nt, Shigella flexneri 2a str. 301
aagcauuacuggucauugcaga

SEQ ID NO: 236894 - RNA, 22 nt, Shigella flexneri 2a str. 301
acuggcaauugccagccacggu

SEQ ID NO: 236895 - RNA, 22 nt, Shigella flexneri 2a str. 301
caugguguucucuauguugcug

SEQ ID NO: 236896 - RNA, 22 nt, Shigella flexneri 2a str. 301
cuauguugagaugcuggcgcgu

SEQ ID NO: 236897 - RNA, 22 nt, Shigella flexneri 2a str. 301
cagcagugccaguucauggcau

SEQ ID NO: 236898 - RNA, 20 nt, Shigella flexneri 2a str. 301
ccagcugacgccaaagugau

SEQ ID NO: 236899 - RNA, 22 nt, Shigella flexneri 2a str. 301
gccgucaaguugucauaauugg

SEQ ID NO: 236900 - RNA, 22 nt, Shigella flexneri 2a str. 301
gccgcgauguacuuccgccagu

SEQ ID NO: 236901 - RNA, 22 nt, Shigella flexneri 2a str. 301
uuacgugaucgccuugcucaau

SEQ ID NO: 236902 - RNA, 22 nt, Shigella flexneri 2a str. 301
gcgcacugcucgaaggcuuucg

SEQ ID NO: 236903 - RNA, 20 nt, Shigella flexneri 2a str. 301
ugcguaggccugauaagcgu

SEQ ID NO: 236904 - RNA, 22 nt, Shigella flexneri 2a str. 301
ucaugugaccaaacaggcggcg

SEQ ID NO: 236905 - RNA, 22 nt, Shigella flexneri 2a str. 301
uuugccagccgguuuucaccca

SEQ ID NO: 236906 - RNA, 22 nt, Shigella flexneri 2a str. 301
gaaacgcucgaaaaacuggcag

SEQ ID NO: 236907 - RNA, 22 nt, Shigella flexneri 2a str. 301
cgacuggccgacaacgcuugcu

SEQ ID NO: 236908 - RNA, 22 nt, Shigella flexneri 2a str. 301
uuucaccgucggccaguauuug

SEQ ID NO: 236909 - RNA, 22 nt, Shigella flexneri 2a str. 301
ugggcgaagcguuaaccggcau

SEQ ID NO: 236910 - RNA, 22 nt, Shigella flexneri 2a str. 301
ggcgacaucguuauuuucaacg

SEQ ID NO: 236911 - RNA, 19 nt, Shigella flexneri 2a str. 301
gcgcggauugaugccgccc

SEQ ID NO: 236912 - RNA, 22 nt, Shigella flexneri 2a str. 301
aaacgaaugacugauugccgau

SEQ ID NO: 236913 - RNA, 22 nt, Shigella flexneri 2a str. 301
gugauuucgcgaccuucccggu

SEQ ID NO: 236914 - RNA, 22 nt, Shigella flexneri 2a str. 301
uugagcgugccgguggcgaaca

SEQ ID NO: 236915 - RNA, 22 nt, Shigella flexneri 2a str. 301
ucuugucgagcucgguggaacu

SEQ ID NO: 236916 - RNA, 22 nt, Shigella flexneri 2a str. 301
cgucuggcugagccgcaucgaa

SEQ ID NO: 236917 - RNA, 22 nt, Shigella flexneri 2a str. 301
cgcugcuggcaacccacgcgga

SEQ ID NO: 236918 - RNA, 22 nt, Shigella flexneri 2a str. 301
uagggcagauguauaccgacuc

SEQ ID NO: 236919 - RNA, 22 nt, Shigella flexneri 2a str. 301
cuuucagagcaaugcaucgcgu

SEQ ID NO: 236920 - RNA, 22 nt, Shigella flexneri 2a str. 301
aagagcgucucucuucgcguca

SEQ ID NO: 236921 - RNA, 22 nt, Shigella flexneri 2a str. 301
ucgguugauaccaggccgcaag

SEQ ID NO: 236922 - RNA, 22 nt, Shigella flexneri 2a str. 301
uuuagcgcucgacacccuggga

SEQ ID NO: 236923 - RNA, 21 nt, Shigella flexneri 2a str. 301
aggaaucacggcgcugaaagc

SEQ ID NO: 236924 - RNA, 22 nt, Shigella flexneri 2a str. 301
aaaggccaucaucgcagucaua

SEQ ID NO: 236925 - RNA, 22 nt, Shigella flexneri 2a str. 301
aagcuggaucucugaaaggauu

SEQ ID NO: 236926 - RNA, 22 nt, Shigella flexneri 2a str. 301
acugcauccagaggcgaaugca

SEQ ID NO: 236927 - RNA, 22 nt, Shigella flexneri 2a str. 301
auugcaggaacgcuaucaccgu

SEQ ID NO: 236928 - RNA, 22 nt, Shigella flexneri 2a str. 301
auuuccagaaacauuaucagac

SEQ ID NO: 236929 - RNA, 21 nt, Shigella flexneri 2a str. 301
auucaagucggugcgacgaua

SEQ ID NO: 236930 - RNA, 22 nt, Shigella flexneri 2a str. 301
auucauguggcguuauuucggc

SEQ ID NO: 236931 - RNA, 22 nt, Shigella flexneri 2a str. 301
auucagcagugccgguaaugca

SEQ ID NO: 236932 - RNA, 22 nt, Shigella flexneri 2a str. 301
cagaaguaaucccucauucccg

SEQ ID NO: 236933 - RNA, 22 nt, Shigella flexneri 2a str. 301
caggaugguaucgacauggcgu

SEQ ID NO: 236934 - RNA, 22 nt, Shigella flexneri 2a str. 301
aucaggcuugggcaguguuaga

SEQ ID NO: 236935 - RNA, 22 nt, Shigella flexneri 2a str. 301
aucucggcagauaucgcugcuc

SEQ ID NO: 236936 - RNA, 22 nt, Shigella flexneri 2a str. 301
auacaucguggggugccaugga

SEQ ID NO: 236937 - RNA, 22 nt, Shigella flexneri 2a str. 301
aguggcgcagggcgaugauguu

SEQ ID NO: 236938 - RNA, 22 nt, Shigella flexneri 2a str. 301
aggcuuugugcucuucugugaa

SEQ ID NO: 236939 - RNA, 22 nt, Shigella flexneri 2a str. 301
caguauuugccgccagagauga

SEQ ID NO: 236940 - RNA, 22 nt, Shigella flexneri 2a str. 301
cguuccugcuccugcuccaucc

SEQ ID NO: 236941 - RNA, 22 nt, Shigella flexneri 2a str. 301
cucugugauggcaguaauuuuu

SEQ ID NO: 236942 - RNA, 22 nt, Shigella flexneri 2a str. 301
cugauuucccagugacaacaua

SEQ ID NO: 236943 - RNA, 22 nt, Shigella flexneri 2a str. 301
gaaggccagccggucaucagcg

SEQ ID NO: 236944 - RNA, 22 nt, Shigella flexneri 2a str. 301
gcauucaucaugguucucgguu

SEQ ID NO: 236945 - RNA, 22 nt, Shigella flexneri 2a str. 301
gaauuucauugcuuucuucugu

SEQ ID NO: 236946 - RNA, 22 nt, Shigella flexneri 2a str. 301
ggcagugccuucagcauggaag

SEQ ID NO: 236947 - RNA, 22 nt, Shigella flexneri 2a str. 301
gcuggaaagcaccugcgcggcg

SEQ ID NO: 236948 - RNA, 22 nt, Shigella flexneri 2a str. 301
gcuguucaacuccaaacucucu

SEQ ID NO: 236949 - RNA, 22 nt, Shigella flexneri 2a str. 301
gcuucugcacugugguuuuucu

SEQ ID NO: 236950 - RNA, 22 nt, Shigella flexneri 2a str. 301
gcugggucugguaguugccgcc

SEQ ID NO: 236951 - RNA, 22 nt, Shigella flexneri 2a str. 301
gggccagaaaaucugugucuug

SEQ ID NO: 236952 - RNA, 22 nt, Shigella flexneri 2a str. 301
ggcuuuccaguucaccagauug

SEQ ID NO: 236953 - RNA, 23 nt, Shigella flexneri 2a str. 301
ggcuggagagcggguagucguau

SEQ ID NO: 236954 - RNA, 22 nt, Shigella flexneri 2a str. 301
gugccaguaacuguaaaauguu

SEQ ID NO: 236955 - RNA, 22 nt, Shigella flexneri 2a str. 301
ucaggcugaugguggcacucgu

SEQ ID NO: 236956 - RNA, 22 nt, Shigella flexneri 2a str. 301
uaguggacgcugauguacagga

SEQ ID NO: 236957 - RNA, 22 nt, Shigella flexneri 2a str. 301
ugugaccugcuggaagagaacu

SEQ ID NO: 236958 - RNA, 22 nt, Shigella flexneri 2a str. 301
uguaccaccgguaagcugaauu

SEQ ID NO: 236959 - RNA, 22 nt, Shigella flexneri 2a str. 301
ugagccucagauuaauguuaag

SEQ ID NO: 236960 - RNA, 22 nt, Shigella flexneri 2a str. 301
ucugcugccugacguugcagcu

SEQ ID NO: 236961 - RNA, 22 nt, Shigella flexneri 2a str. 301
ucugguaaucgcaacuuuggug

SEQ ID NO: 236962 - RNA, 22 nt, Shigella flexneri 2a str. 301
uccagcaaauugugauagcgca

SEQ ID NO: 236963 - RNA, 22 nt, Shigella flexneri 2a str. 301
uguugaaacuguagcccguucc

SEQ ID NO: 236964 - RNA, 22 nt, Shigella flexneri 2a str. 301
uguuugaauauucaggugcuug

SEQ ID NO: 236965 - RNA, 22 nt, Shigella flexneri 2a str. 301
uuagcaucuuuuguucagcugg

SEQ ID NO: 236966 - RNA, 22 nt, Shigella flexneri 2a str. 301
aagccucaguuucuaugcaaau

SEQ ID NO: 236967 - RNA, 19 nt, Shigella flexneri 2a str. 301
aacuguccaaccagcauca

SEQ ID NO: 236968 - RNA, 22 nt, Shigella flexneri 2a str. 301
aagagcgucucucuucgcguca

SEQ ID NO: 236969 - RNA, 22 nt, Shigella flexneri 2a str. 301
aaugccagcgccacagcgauaa

SEQ ID NO: 236970 - RNA, 22 nt, Shigella flexneri 2a str. 301
acgaaggcgacaucagcagccg

SEQ ID NO: 236971 - RNA, 22 nt, Shigella flexneri 2a str. 301
agagcggcggucugaucacccg

SEQ ID NO: 236972 - RNA, 22 nt, Shigella flexneri 2a str. 301
agcaggauacgaaggcuaugug

SEQ ID NO: 236973 - RNA, 22 nt, Shigella flexneri 2a str. 301
uuuccagguguucggcgcugac

SEQ ID NO: 236974 - RNA, 21 nt, Shigella flexneri 2a str. 301
uucagccuggcgucgcccacu

SEQ ID NO: 236975 - RNA, 22 nt, Shigella flexneri 2a str. 301
uuccaugaagcaucgcgcaugg

SEQ ID NO: 236976 - RNA, 22 nt, Shigella flexneri 2a str. 301
uucuucagucagccgcaugagc

SEQ ID NO: 236977 - RNA, 22 nt, Shigella flexneri 2a str. 301
uucuuguaguuucaacgcugcg

SEQ ID NO: 236978 - RNA, 22 nt, Shigella flexneri 2a str. 301
uugggucaauuugucugcuugc

SEQ ID NO: 236979 - RNA, 18 nt, Shigella flexneri 2a str. 301
uugcuguaagcguucaac

SEQ ID NO: 236980 - RNA, 22 nt, Shigella flexneri 2a str. 301
uuggcgaucauccgcaaaaucc

SEQ ID NO: 236981 - RNA, 22 nt, Shigella flexneri 2a str. 301
uugagaagauucgcguuauugc

SEQ ID NO: 236982 - RNA, 22 nt, Shigella flexneri 2a str. 301
ucguuauucuucgguaucggca

SEQ ID NO: 236983 - RNA, 17 nt, Shigella flexneri 2a str. 301
ucacuacaccgaucucg

SEQ ID NO: 236984 - RNA, 22 nt, Shigella flexneri 2a str. 301
ugcagcagcugcuggagaucau

SEQ ID NO: 236985 - RNA, 22 nt, Shigella flexneri 2a str. 301
ugcucaaauccgcguucaagga

SEQ ID NO: 236986 - RNA, 22 nt, Shigella flexneri 2a str. 301
uaggccagauaaggcguuuacg

SEQ ID NO: 236987 - RNA, 20 nt, Shigella flexneri 2a str. 301
uagccucagcuccuuacgaa

SEQ ID NO: 236988 - RNA, 22 nt, Shigella flexneri 2a str. 301
guuucacuccaaccuguucaag

SEQ ID NO: 236989 - RNA, 22 nt, Shigella flexneri 2a str. 301
uacaaaugccauuauugacgau

SEQ ID NO: 236990 - RNA, 22 nt, Shigella flexneri 2a str. 301
guucagcagauuuggcgcaacu

SEQ ID NO: 236991 - RNA, 22 nt, Shigella flexneri 2a str. 301
guugaaggauugcaggaacugg

SEQ ID NO: 236992 - RNA, 19 nt, Shigella flexneri 2a str. 301
gucaggcuuccuugcgguc

SEQ ID NO: 236993 - RNA, 22 nt, Shigella flexneri 2a str. 301
ggugacuguacuggaaggucug

SEQ ID NO: 236994 - RNA, 22 nt, Shigella flexneri 2a str. 301
cggaaggcgauaaagcgauuga

SEQ ID NO: 236995 - RNA, 22 nt, Shigella flexneri 2a str. 301
ccgaacggauaaagcgcuccgu

SEQ ID NO: 236996 - RNA, 22 nt, Shigella flexneri 2a str. 301
aggccggauaagcgaagcgcau

SEQ ID NO: 236997 - RNA, 22 nt, Shigella flexneri 2a str. 301
aggccggauaaggcguucacgc

SEQ ID NO: 236998 - RNA, 22 nt, Shigella flexneri 2a str. 301
cccaugucaccuuucaacacgg

SEQ ID NO: 236999 - RNA, 22 nt, Shigella flexneri 2a str. 301
ccauggcaacuaaaacguacag

SEQ ID NO: 237000 - RNA, 22 nt, Shigella flexneri 2a str. 301
cuggagccuguugggugacacg

SEQ ID NO: 237001 - RNA, 22 nt, Shigella flexneri 2a str. 301
cuggagauuaugcguaaagcca

SEQ ID NO: 237002 - RNA, 22 nt, Shigella flexneri 2a str. 301
cuggugauuggcgcaggcaugg

SEQ ID NO: 237003 - RNA, 22 nt, Shigella flexneri 2a str. 301
gaugagcguuucccgcauccgc

SEQ ID NO: 237004 - RNA, 22 nt, Human
aaaaaauugcuggcagagcugu

SEQ ID NO: 237005 - RNA, 22 nt, Human
aaaaaaacuaauuuuaaaugug

SEQ ID NO: 237006 - RNA, 22 nt, Human
aaaaaguaccacuuggacacuu

SEQ ID NO: 237007 - RNA, 22 nt, Human
aaaaaggagaaagagagggaga

SEQ ID NO: 237008 - RNA, 22 nt, Human
aaaaccugcaagaugaaaucag

SEQ ID NO: 237009 - RNA, 22 nt, Human
aaaacauuuuacugccaucuca

SEQ ID NO: 237010 - RNA, 22 nt, Human
aaaacuuucagggauacagaaa

SEQ ID NO: 237011 - RNA, 22 nt, Human
aaaagaaugaugggagcugggu

SEQ ID NO: 237012 - RNA, 20 nt, Human
aaaaacaguaaugcugaaga

SEQ ID NO: 237013 - RNA, 22 nt, Human
aaaaacuuaccccagggcaagg

SEQ ID NO: 237014 - RNA, 20 nt, Human
aaaaauguguuuauggagau

SEQ ID NO: 237015 - RNA, 22 nt, Human
aaaacauuuaggguuuuuuuua

SEQ ID NO: 237016 - RNA, 22 nt, Human
aaagacuaaccaguugucaaaa

SEQ ID NO: 237017 - RNA, 22 nt, Human
aaagacagccuguuggcuuucu

SEQ ID NO: 237018 - RNA, 22 nt, Human
aaacuuuaggcacauggaucua

SEQ ID NO: 237019 - RNA, 22 nt, Human
aaagagccaacuaccgcaaauu

SEQ ID NO: 237020 - RNA, 22 nt, Human
aaagagcugccaagguuacagu

SEQ ID NO: 237021 - RNA, 22 nt, Human
aaagagacaacaacaacuucua

SEQ ID NO: 237022 - RNA, 22 nt, Human
aaacuuuaucaaguacucuuca

SEQ ID NO: 237023 - RNA, 22 nt, Human
aaacuagaacagagagagaagc

SEQ ID NO: 237024 - RNA, 22 nt, Human
aaacucuaagacuaaaauugaa

SEQ ID NO: 237025 - RNA, 22 nt, Human
aaacugacugaugugaucuuau

SEQ ID NO: 237026 - RNA, 21 nt, Human
aaagaaguuaguucagugguu

SEQ ID NO: 237027 - RNA, 22 nt, Human
aaacugugcagucacauaagga

SEQ ID NO: 237028 - RNA, 22 nt, Human
aaacuugaggcaaugaaggugu

SEQ ID NO: 237029 - RNA, 22 nt, Human
aaacucaugccagagaacuuaa

SEQ ID NO: 237030 - RNA, 20 nt, Human
aaacucucugaucuuacagu

SEQ ID NO: 237031 - RNA, 22 nt, Human
aaacucaucaguuuagaaaccu

SEQ ID NO: 237032 - RNA, 22 nt, Human
aaagaauuucaagauucccaca

SEQ ID NO: 237033 - RNA, 22 nt, Human
aaaaggaacaauaugguauuuu

SEQ ID NO: 237034 - RNA, 22 nt, Human
aaaauaaccuucauuugcauug

SEQ ID NO: 237035 - RNA, 22 nt, Human
aaaauaauauuauaccacugcu

SEQ ID NO: 237036 - RNA, 22 nt, Human
aaaauacuaggaaaauaaauca

SEQ ID NO: 237037 - RNA, 22 nt, Human
aaaauauguugagauacugaaa

SEQ ID NO: 237038 - RNA, 22 nt, Human
aaacagguuugaacuucuuaac

SEQ ID NO: 237039 - RNA, 22 nt, Human
aaacauaugccuucuuuuguaa

SEQ ID NO: 237040 - RNA, 22 nt, Human
aaacauguagugcaugaggauc

SEQ ID NO: 237041 - RNA, 18 nt, Human
aaacauggcuuaaaggcu

SEQ ID NO: 237042 - RNA, 21 nt, Human
aaacaugcagccugccaauuc

SEQ ID NO: 237043 - RNA, 22 nt, Human
aaaccagaguucauaguauuca

SEQ ID NO: 237044 - RNA, 18 nt, Human
aaacccacguauucaggc

SEQ ID NO: 237045 - RNA, 22 nt, Human
aaaauauaaaggauguggguuu

SEQ ID NO: 237046 - RNA, 21 nt, Human
aauuauuugcauuuuucuugu

SEQ ID NO: 237047 - RNA, 22 nt, Human
aauuauugucuuuuuuaaaagc

SEQ ID NO: 237048 - RNA, 22 nt, Human
aauucagguuauauuugcaacu

SEQ ID NO: 237049 - RNA, 22 nt, Human
aauucaggacaaauguuuucaa

SEQ ID NO: 237050 - RNA, 22 nt, Human
aauucaacagucaguuaucuca

SEQ ID NO: 237051 - RNA, 22 nt, Human
aauuagaagcuguuagcaaaau

SEQ ID NO: 237052 - RNA, 22 nt, Human
aauuaaggccuuuaaaugucuu

SEQ ID NO: 237053 - RNA, 22 nt, Human
aauuacuuuaggaaaacuccuc

SEQ ID NO: 237054 - RNA, 22 nt, Human
aauguuuaagcuuuuauuuaca

SEQ ID NO: 237055 - RNA, 22 nt, Human
aauguuuaguuuuauuuuagua

SEQ ID NO: 237056 - RNA, 22 nt, Human
aauguuguaaauauucuuugag

SEQ ID NO: 237057 - RNA, 22 nt, Human
aauguuugaacuuugcauauuu

SEQ ID NO: 237058 - RNA, 22 nt, Human
aauguuuaacuguggucagcag

SEQ ID NO: 237059 - RNA, 23 nt, Human
aauguugaggguggguuuuuaac

SEQ ID NO: 237060 - RNA, 22 nt, Human
aauguucucuaaucuuucucuu

SEQ ID NO: 237061 - RNA, 22 nt, Human
aauguugacguuggccagggcc

SEQ ID NO: 237062 - RNA, 22 nt, Human
aauguugaaccuuuuuggccug

SEQ ID NO: 237063 - RNA, 22 nt, Human
aauguauuuuuaggcagaauau

SEQ ID NO: 237064 - RNA, 22 nt, Human
aauggugaggagugcauugaga

SEQ ID NO: 237065 - RNA, 22 nt, Human
aaugguaauauuucauaguugu

SEQ ID NO: 237066 - RNA, 22 nt, Human
aauguaaauaauuguaaaauuu

SEQ ID NO: 237067 - RNA, 22 nt, Human
aauguacucgaaugauguuaag

SEQ ID NO: 237068 - RNA, 22 nt, Human
aauguacucuguguuucucaug

SEQ ID NO: 237069 - RNA, 22 nt, Human
aauggcaauagugcauuaugua

SEQ ID NO: 237070 - RNA, 22 nt, Human
aauggcaagccacaugcuuuuc

SEQ ID NO: 237071 - RNA, 22 nt, Human
aaugcuaaagaagaaggaguag

SEQ ID NO: 237072 - RNA, 22 nt, Human
aauggaaaaauccacagggaac

SEQ ID NO: 237073 - RNA, 22 nt, Human
aauggaaaggagccugacuaua

SEQ ID NO: 237074 - RNA, 22 nt, Human
aaugaauaaauuuuaaagacag

SEQ ID NO: 237075 - RNA, 22 nt, Human
aaugaacuuucaguucagagag

SEQ ID NO: 237076 - RNA, 22 nt, Human
aaugaaacuaguagaaucuuug

SEQ ID NO: 237077 - RNA, 22 nt, Human
aaucugaccguggagaucucca

SEQ ID NO: 237078 - RNA, 22 nt, Human
aaucuguugucaggaauccaca

SEQ ID NO: 237079 - RNA, 22 nt, Human
aaucuuguucaacauuaucugu

SEQ ID NO: 237080 - RNA, 22 nt, Human
aaucaaagccugcaaguugacu

SEQ ID NO: 237081 - RNA, 22 nt, Human
aaucaugagguguuucuuugca

SEQ ID NO: 237082 - RNA, 19 nt, Human
aaucacaagcaauaggggu

SEQ ID NO: 237083 - RNA, 22 nt, Human
aaucugacaaaauauuuccagu

SEQ ID NO: 237084 - RNA, 22 nt, Human
aaucuagagaacuguggggcag

SEQ ID NO: 237085 - RNA, 22 nt, Human
aaucucguuaugaagaugguug

SEQ ID NO: 237086 - RNA, 22 nt, Human
aaucauguguaaugggcagacc

SEQ ID NO: 237087 - RNA, 23 nt, Human
aaugaguugggcagcauacaggc

SEQ ID NO: 237088 - RNA, 22 nt, Human
aaugaguuuguucuauuauuug

SEQ ID NO: 237089 - RNA, 22 nt, Human
aaugcauacguguuuguggcaa

SEQ ID NO: 237090 - RNA, 22 nt, Human
aaugcauaaugguuugugacaa

SEQ ID NO: 237091 - RNA, 22 nt, Human
aaugcagaugugucuuuaauuu

SEQ ID NO: 237092 - RNA, 22 nt, Human
aaugauuuucugcaaacaguga

SEQ ID NO: 237093 - RNA, 22 nt, Human
aaugacagccuauacugucugc

SEQ ID NO: 237094 - RNA, 22 nt, Human
aaugaguucaucugaauucugg

SEQ ID NO: 237095 - RNA, 22 nt, Human
aaugagaauguaagugaagaga

SEQ ID NO: 237096 - RNA, 22 nt, Human
aaugagauggaggacucuuaau

SEQ ID NO: 237097 - RNA, 22 nt, Human
aaugaacuuugaagauggugaa

SEQ ID NO: 237098 - RNA, 22 nt, Human
aaugaaugaaugaaugauuaug

SEQ ID NO: 237099 - RNA, 22 nt, Human
aaugaaaaucugucaguucaag

SEQ ID NO: 237100 - RNA, 22 nt, Human
aaguuaaaaaagcuggguaaaa

SEQ ID NO: 237101 - RNA, 22 nt, Human
aaguugacuguuuuacuuaugu

SEQ ID NO: 237102 - RNA, 22 nt, Human
aaguuaugauuggcguggacaa

SEQ ID NO: 237103 - RNA, 22 nt, Human
aaguuaauugcuucuaguuaau

SEQ ID NO: 237104 - RNA, 22 nt, Human
aagugguuuauuguaugguuuu

SEQ ID NO: 237105 - RNA, 17 nt, Human
aagugggcaaagugaga

SEQ ID NO: 237106 - RNA, 20 nt, Human
aaguagguuucaguugcugu

SEQ ID NO: 237107 - RNA, 22 nt, Human
aaguggugagacccugcugaaa

SEQ ID NO: 237108 - RNA, 23 nt, Human
aaguggucaucuaucccaugguu

SEQ ID NO: 237109 - RNA, 22 nt, Human
aauaagacugucauggaguaaa

SEQ ID NO: 237110 - RNA, 22 nt, Human
aauaagagaauaaaaucuguua

SEQ ID NO: 237111 - RNA, 22 nt, Human
aauaacuuaaugacuguguaca

SEQ ID NO: 237112 - RNA, 22 nt, Human
aaguugaaugucuugcugaaug

SEQ ID NO: 237113 - RNA, 23 nt, Human
aaguugucauguaaaaugggcua

SEQ ID NO: 237114 - RNA, 22 nt, Human
aauaauacaauuggugucaugu

SEQ ID NO: 237115 - RNA, 22 nt, Human
aauacagauggcaugugaagau

SEQ ID NO: 237116 - RNA, 22 nt, Human
aauaauuuuuuugugauuaugu

SEQ ID NO: 237117 - RNA, 22 nt, Human
aauagagacaguuuaacaauau

SEQ ID NO: 237118 - RNA, 22 nt, Human
aauagcuuuuuguuugguguau

SEQ ID NO: 237119 - RNA, 22 nt, Human
aauaguggcuuggacuaaauau

SEQ ID NO: 237120 - RNA, 22 nt, Human
aauauauaugggugcaugucug

SEQ ID NO: 237121 - RNA, 22 nt, Human
aaguaacuggguggccccaguu

SEQ ID NO: 237122 - RNA, 21 nt, Human
aaguaaauuuuuacuuaggcc

SEQ ID NO: 237123 - RNA, 22 nt, Human
aaguaaaucuuaugucagggag

SEQ ID NO: 237124 - RNA, 22 nt, Human
aagguuuuguuuucgguuuuuu

SEQ ID NO: 237125 - RNA, 22 nt, Human
aagguuuuguaugaaaucucug

SEQ ID NO: 237126 - RNA, 22 nt, Human
aagguauaaauaacucgggagg

SEQ ID NO: 237127 - RNA, 22 nt, Human
aagguauaucuuuaaaagugaa

SEQ ID NO: 237128 - RNA, 22 nt, Human
aagguccaugaauaucuaagcc

SEQ ID NO: 237129 - RNA, 22 nt, Human
aagggaauagagcagcaaaaau

SEQ ID NO: 237130 - RNA, 22 nt, Human
aaggcgaggggcacagcugaga

SEQ ID NO: 237131 - RNA, 22 nt, Human
aaggauuuccaggccugcgccu

SEQ ID NO: 237132 - RNA, 22 nt, Human
aaggcugaccaguuuacacuuu

SEQ ID NO: 237133 - RNA, 19 nt, Human
aaggcuuucugagugaaaa

SEQ ID NO: 237134 - RNA, 22 nt, Human
aaggaguggugaagucagaugu

SEQ ID NO: 237135 - RNA, 22 nt, Human
aagcagacugggccauaaggaa

SEQ ID NO: 237136 - RNA, 22 nt, Human
aagcaggaaaugaaaugcuugc

SEQ ID NO: 237137 - RNA, 22 nt, Human
aagcauaucaaguuuuaugugc

SEQ ID NO: 237138 - RNA, 22 nt, Human
aacucugacgcugucaaauaca

SEQ ID NO: 237139 - RNA, 22 nt, Human
aacgcagagaguaaugcugaac

SEQ ID NO: 237140 - RNA, 22 nt, Human
aacuuauacccagggcagaaau

SEQ ID NO: 237141 - RNA, 22 nt, Human
aacugguaauuuaguauuacug

SEQ ID NO: 237142 - RNA, 22 nt, Human
aacuuaacucugcaauccagcu

SEQ ID NO: 237143 - RNA, 22 nt, Human
aacuuagagcucuccuaaauga

SEQ ID NO: 237144 - RNA, 22 nt, Human
aacuguugucacgaauguggcu

SEQ ID NO: 237145 - RNA, 21 nt, Human
aacuauuaauaccauuagcaa

SEQ ID NO: 237146 - RNA, 22 nt, Human
aacugaaguuuucagauuuugc

SEQ ID NO: 237147 - RNA, 22 nt, Human
aacuuguaaugaaaggcaauag

SEQ ID NO: 237148 - RNA, 22 nt, Human
aacuugaagacaccccacauuc

SEQ ID NO: 237149 - RNA, 22 nt, Human
aacuuuuaugaaggaaaucaua

SEQ ID NO: 237150 - RNA, 19 nt, Human
aagaacaguucuaauuuca

SEQ ID NO: 237151 - RNA, 22 nt, Human
aacuuaaacaagcucccaaguu

SEQ ID NO: 237152 - RNA, 22 nt, Human
aagaaaagcaucuuuguaguag

SEQ ID NO: 237153 - RNA, 22 nt, Human
aacuuuuucuuaggggaaagca

SEQ ID NO: 237154 - RNA, 20 nt, Human
aacuuugagugcaugacuuu

SEQ ID NO: 237155 - RNA, 22 nt, Human
aacuuucugaaaagcuugauca

SEQ ID NO: 237156 - RNA, 22 nt, Human
aacuuucuuugcaucuaaguuu

SEQ ID NO: 237157 - RNA, 22 nt, Human
aacuuucagaauccuaugcauu

SEQ ID NO: 237158 - RNA, 22 nt, Human
aagcaugaaauaauguccuugu

SEQ ID NO: 237159 - RNA, 22 nt, Human
aagcauuuuagauaaagcauca

SEQ ID NO: 237160 - RNA, 22 nt, Human
aagccgagggaggugauggaga

SEQ ID NO: 237161 - RNA, 22 nt, Human
aagcaugagguggugagugaca

SEQ ID NO: 237162 - RNA, 22 nt, Human
aagcaguuuagucaucgggauu

SEQ ID NO: 237163 - RNA, 22 nt, Human
aagcagaaaaacugagcuccaa

SEQ ID NO: 237164 - RNA, 22 nt, Human
aagauucaguugguuuuggaaa

SEQ ID NO: 237165 - RNA, 22 nt, Human
aagaggaauaauaaaaauugca

SEQ ID NO: 237166 - RNA, 22 nt, Human
aagagaaacauauggccagauu

SEQ ID NO: 237167 - RNA, 22 nt, Human
aagaggacagucaaauggccgg

SEQ ID NO: 237168 - RNA, 22 nt, Human
aagaggaggcuggaauccuaaa

SEQ ID NO: 237169 - RNA, 22 nt, Human
aagagaaaugcuuuaacuuuau

SEQ ID NO: 237170 - RNA, 22 nt, Human
aagcaauucacaguucacuuaa

SEQ ID NO: 237171 - RNA, 22 nt, Human
aagauguuguagauuagugaga

SEQ ID NO: 237172 - RNA, 22 nt, Human
aagaugcuucaugagaguuggg

SEQ ID NO: 237173 - RNA, 22 nt, Human
aagaguggagcuggaaaguggg

SEQ ID NO: 237174 - RNA, 22 nt, Human
aagagaaagggaaaaugguaaa

SEQ ID NO: 237175 - RNA, 22 nt, Human
aagagaaaaaucuuaaucuagu

SEQ ID NO: 237176 - RNA, 22 nt, Human
aagaccacaggaaucaaacagg

SEQ ID NO: 237177 - RNA, 22 nt, Human
aagaggcagcuugguaggcauc

SEQ ID NO: 237178 - RNA, 22 nt, Human
aagacagugacagucacaauug

SEQ ID NO: 237179 - RNA, 22 nt, Human
aagaagagaauauauuuacguc

SEQ ID NO: 237180 - RNA, 22 nt, Human
aagaacaugggugugggcauuc

SEQ ID NO: 237181 - RNA, 22 nt, Human
aagaaugaaaugaaagaacuaa

SEQ ID NO: 237182 - RNA, 22 nt, Human
aagaagguugaaugacuacuuu

SEQ ID NO: 237183 - RNA, 22 nt, Human
aaccugaggguagacaaguuca

SEQ ID NO: 237184 - RNA, 22 nt, Human
aaccauauugauuauguuuuau

SEQ ID NO: 237185 - RNA, 22 nt, Human
aacauuguuuaaguuaaauugu

SEQ ID NO: 237186 - RNA, 22 nt, Human
aacauuguggacaagggcaggu

SEQ ID NO: 237187 - RNA, 22 nt, Human
aaccagaagucaucagagcuga

SEQ ID NO: 237188 - RNA, 22 nt, Human
aacaguaugugagauuuacaca

SEQ ID NO: 237189 - RNA, 22 nt, Human
aacaguuaagaggaggcagaga

SEQ ID NO: 237190 - RNA, 22 nt, Human
aacagguucaucuuggaagcag

SEQ ID NO: 237191 - RNA, 20 nt, Human
aaccuauuguaauauucuaa

SEQ ID NO: 237192 - RNA, 22 nt, Human
aacccguagaucaguucuaggu

SEQ ID NO: 237193 - RNA, 22 nt, Human
aaccaguacuucucuauucagu

SEQ ID NO: 237194 - RNA, 22 nt, Human
aacgauuugaguuaguuuuuag

SEQ ID NO: 237195 - RNA, 22 nt, Human
aacguaauuuguggaaggggua

SEQ ID NO: 237196 - RNA, 22 nt, Human
aaccugagggcaggaccccaua

SEQ ID NO: 237197 - RNA, 22 nt, Human
aacuagugucuguaugauaagg

SEQ ID NO: 237198 - RNA, 22 nt, Human
aaccuuauuguguaucaccaua

SEQ ID NO: 237199 - RNA, 22 nt, Human
aaagagggaaggaaggagugaa

SEQ ID NO: 237200 - RNA, 22 nt, Human
aaagaguuguauucuuuuugag

SEQ ID NO: 237201 - RNA, 22 nt, Human
aaaugcuuuaauugaguucaug

SEQ ID NO: 237202 - RNA, 22 nt, Human
aaaugggagucacacagguuua

SEQ ID NO: 237203 - RNA, 22 nt, Human
aaauucagcagguuucaaaagc

SEQ ID NO: 237204 - RNA, 22 nt, Human
aaauucuuccaggaggaaauac

SEQ ID NO: 237205 - RNA, 22 nt, Human
aaauguuugguggauaaaagga

SEQ ID NO: 237206 - RNA, 22 nt, Human
aaauucagauggcuuucuuuuc

SEQ ID NO: 237207 - RNA, 22 nt, Human
aaauggaaguuuguucucagcc

SEQ ID NO: 237208 - RNA, 22 nt, Human
aaaugucugagacuucugaacu

SEQ ID NO: 237209 - RNA, 22 nt, Human
aaauuaaaguuuuauuuagagc

SEQ ID NO: 237210 - RNA, 22 nt, Human
aaauguuucauucuauuuuuag

SEQ ID NO: 237211 - RNA, 22 nt, Human
aacaucaaaggaagaaugauau

SEQ ID NO: 237212 - RNA, 21 nt, Human
aacaaaagggaagaacagcug

SEQ ID NO: 237213 - RNA, 22 nt, Human
aacagaaaucauuuagggcucu

SEQ ID NO: 237214 - RNA, 22 nt, Human
aacagaauaucaaaagauuaug

SEQ ID NO: 237215 - RNA, 22 nt, Human
aacacuguaucagucuucaaua

SEQ ID NO: 237216 - RNA, 22 nt, Human
aaccaauaagaggaugccauuu

SEQ ID NO: 237217 - RNA, 22 nt, Human
aacagagauucuucccuucuuu

SEQ ID NO: 237218 - RNA, 22 nt, Human
aacacugaaaugucuuaagauu

SEQ ID NO: 237219 - RNA, 22 nt, Human
aacacuaaaggucaguuagaag

SEQ ID NO: 237220 - RNA, 22 nt, Human
aaauuuauaacuuaaagugaau

SEQ ID NO: 237221 - RNA, 22 nt, Human
aaauugcauuuuaaagguagau

SEQ ID NO: 237222 - RNA, 22 nt, Human
aaauuuuguugaaaaauauuuu

SEQ ID NO: 237223 - RNA, 21 nt, Human
aaauuucauauggccaaccua

SEQ ID NO: 237224 - RNA, 22 nt, Human
aacaaguagaauagguuuuuuu

SEQ ID NO: 237225 - RNA, 22 nt, Human
aacacaucagcacacuaacgga

SEQ ID NO: 237226 - RNA, 22 nt, Human
aacacguuuauccuaagaacuc

SEQ ID NO: 237227 - RNA, 19 nt, Human
agucugugacaaggagugg

SEQ ID NO: 237228 - RNA, 22 nt, Human
agucuauguuuuuguucuuauu

SEQ ID NO: 237229 - RNA, 22 nt, Human
agucauuugaggcaugauuaug

SEQ ID NO: 237230 - RNA, 22 nt, Human
agucuaaguuuuguaugcuaac

SEQ ID NO: 237231 - RNA, 22 nt, Human
aguccauccagaaaacaaagcu

SEQ ID NO: 237232 - RNA, 22 nt, Human
agucauuguguucaguaaaauc

SEQ ID NO: 237233 - RNA, 22 nt, Human
agucauuugucauuuuuuugag

SEQ ID NO: 237234 - RNA, 22 nt, Human
agucacuguucugucaugucaa

SEQ ID NO: 237235 - RNA, 22 nt, Human
agucaacauuugagaugcaaug

SEQ ID NO: 237236 - RNA, 22 nt, Human
agucagaaggugucagaucuug

SEQ ID NO: 237237 - RNA, 22 nt, Human
agucaguaugacuuauaguucu

SEQ ID NO: 237238 - RNA, 22 nt, Human
agucauaaagccagugggaggc

SEQ ID NO: 237239 - RNA, 22 nt, Human
agucaaaaaaccuagaaacacc

SEQ ID NO: 237240 - RNA, 23 nt, Human
aguauuguucaucuucaagacag

SEQ ID NO: 237241 - RNA, 22 nt, Human
aguauuggauauaaucuaggaa

SEQ ID NO: 237242 - RNA, 22 nt, Human
aguauuuuaaaauacauuaucc

SEQ ID NO: 237243 - RNA, 22 nt, Human
aguauuuucuuuaguuuguuag

SEQ ID NO: 237244 - RNA, 22 nt, Human
aguauuuaguauucuauauuag

SEQ ID NO: 237245 - RNA, 23 nt, Human
aguaucuugguguggugcagaga

SEQ ID NO: 237246 - RNA, 22 nt, Human
aguauccauccugcuguuucua

SEQ ID NO: 237247 - RNA, 22 nt, Human
aguaucgcuuuguaucaugagg

SEQ ID NO: 237248 - RNA, 22 nt, Human
aguaucuauaucaaaaauggcu

SEQ ID NO: 237249 - RNA, 22 nt, Human
aguauucaguuagugagcuaag

SEQ ID NO: 237250 - RNA, 22 nt, Human
aguaauaaacaacucauuuugg

SEQ ID NO: 237251 - RNA, 22 nt, Human
aguaacagguguacagacuauc

SEQ ID NO: 237252 - RNA, 22 nt, Human
aguaauuucuuacggagaccuu

SEQ ID NO: 237253 - RNA, 20 nt, Human
aguacauauuugugauuuuu

SEQ ID NO: 237254 - RNA, 22 nt, Human
aguaauggucucaauaaauucu

SEQ ID NO: 237255 - RNA, 22 nt, Human
aguauaagugaugcuaucuucu

SEQ ID NO: 237256 - RNA, 22 nt, Human
aguaggagcucaauuaaauguu

SEQ ID NO: 237257 - RNA, 22 nt, Human
aguaggaauucaaagagacaaa

SEQ ID NO: 237258 - RNA, 22 nt, Human
aguauagacaucaaacugaaga

SEQ ID NO: 237259 - RNA, 22 nt, Human
aguacuuuuuguucaauugugc

SEQ ID NO: 237260 - RNA, 19 nt, Human
aguauauaucuuuaccuca

SEQ ID NO: 237261 - RNA, 22 nt, Human
aggucuugguaggccagagucu

SEQ ID NO: 237262 - RNA, 21 nt, Human
aggugaaggcgagggggacag

SEQ ID NO: 237263 - RNA, 22 nt, Human
aggucuugcggaagauauggcu

SEQ ID NO: 237264 - RNA, 21 nt, Human
aggugcccaggauuauuuuuu

SEQ ID NO: 237265 - RNA, 21 nt, Human
aggugguuccaauaaguaggu

SEQ ID NO: 237266 - RNA, 22 nt, Human
agguuuuugucauuuucuggua

SEQ ID NO: 237267 - RNA, 22 nt, Human
agguuuuagaagcugaagccaa

SEQ ID NO: 237268 - RNA, 22 nt, Human
agguuuuacuuuuuuuggaggu

SEQ ID NO: 237269 - RNA, 19 nt, Human
aguaaagugguggcauuuu

SEQ ID NO: 237270 - RNA, 22 nt, Human
agguuaaaagagugaguggaua

SEQ ID NO: 237271 - RNA, 22 nt, Human
agguuguaucauaugaaacugu

SEQ ID NO: 237272 - RNA, 22 nt, Human
agguuaggaggggagugccaca

SEQ ID NO: 237273 - RNA, 22 nt, Human
aggauauguccuuuuuuucccc

SEQ ID NO: 237274 - RNA, 22 nt, Human
aggcgaagggaccagacgguag

SEQ ID NO: 237275 - RNA, 22 nt, Human
agggaugcaguaaaaacuguag

SEQ ID NO: 237276 - RNA, 22 nt, Human
aggcuuaacuacaauuuuugcc

SEQ ID NO: 237277 - RNA, 21 nt, Human
aggcuuggaucuagacaggcc

SEQ ID NO: 237278 - RNA, 22 nt, Human
agggaaauuaaugugagcaaug

SEQ ID NO: 237279 - RNA, 22 nt, Human
agggaagaggaccagagucucu

SEQ ID NO: 237280 - RNA, 22 nt, Human
aggggagaguuaaugugaaugu

SEQ ID NO: 237281 - RNA, 22 nt, Human
agguagaaggaccagaauuuau

SEQ ID NO: 237282 - RNA, 22 nt, Human
agguaagaagugagcaaguuua

SEQ ID NO: 237283 - RNA, 22 nt, Human
aggucguauaguuaccuccuug

SEQ ID NO: 237284 - RNA, 22 nt, Human
agguauaguuauuucugcuccc

SEQ ID NO: 237285 - RNA, 22 nt, Human
agguaugucccccgagugcagc

SEQ ID NO: 237286 - RNA, 22 nt, Human
agcugugaccaguuacgaaauu

SEQ ID NO: 237287 - RNA, 22 nt, Human
aggaacaacagccuuuauaucc

SEQ ID NO: 237288 - RNA, 22 nt, Human
agcugugaccuucaagagcuac

SEQ ID NO: 237289 - RNA, 22 nt, Human
aggaaauaggaccagacaaagc

SEQ ID NO: 237290 - RNA, 22 nt, Human
agcuuugcccaaugaguuaugu

SEQ ID NO: 237291 - RNA, 22 nt, Human
aggaaaaugaaggaagugggaa

SEQ ID NO: 237292 - RNA, 22 nt, Human
aggaaaaagaagaaaagaauca

SEQ ID NO: 237293 - RNA, 22 nt, Human
agcuuugucccaagugcucugg

SEQ ID NO: 237294 - RNA, 22 nt, Human
aggaagaagggacagaauuuug

SEQ ID NO: 237295 - RNA, 19 nt, Human
aggaaggggauaaguaaca

SEQ ID NO: 237296 - RNA, 22 nt, Human
agcuguaacagguuaauaugga

SEQ ID NO: 237297 - RNA, 22 nt, Human
aggaaguucuggaauuacuagg

SEQ ID NO: 237298 - RNA, 22 nt, Human
aggauaaaugggucauuaggca

SEQ ID NO: 237299 - RNA, 22 nt, Human
aggaaaauggaccagaguuguu

SEQ ID NO: 237300 - RNA, 22 nt, Human
agcuuucaagaaauugucacaa

SEQ ID NO: 237301 - RNA, 22 nt, Human
agcugauugucuuuuuaaaagu

SEQ ID NO: 237302 - RNA, 22 nt, Human
agcuggaaucucggcaaagcgu

SEQ ID NO: 237303 - RNA, 22 nt, Human
agcuugagauaauucaagcuga

SEQ ID NO: 237304 - RNA, 22 nt, Human
agcuugaaccuaaaacaauaau

SEQ ID NO: 237305 - RNA, 20 nt, Human
agcugaauaguuuugugaaa

SEQ ID NO: 237306 - RNA, 22 nt, Human
agcugcauucguaucauauugu

SEQ ID NO: 237307 - RNA, 22 nt, Human
agcuaguucacugaagccuaug

SEQ ID NO: 237308 - RNA, 22 nt, Human
agcuccauauggcacaccauuu

SEQ ID NO: 237309 - RNA, 22 nt, Human
agcucuuuggacuuuguuuuau

SEQ ID NO: 237310 - RNA, 22 nt, Human
agcuaauguauguugaaagcac

SEQ ID NO: 237311 - RNA, 22 nt, Human
agcuaaaaugagguuuuuggau

SEQ ID NO: 237312 - RNA, 22 nt, Human
agcgacuugacagacauguccu

SEQ ID NO: 237313 - RNA, 22 nt, Human
agcguaugaauauuugaagaga

SEQ ID NO: 237314 - RNA, 22 nt, Human
agcgagccugugcacuucuaac

SEQ ID NO: 237315 - RNA, 22 nt, Human
agcauuucuacugugucagaaa

SEQ ID NO: 237316 - RNA, 22 nt, Human
agcauuagguguguuucagagg

SEQ ID NO: 237317 - RNA, 22 nt, Human
agcauuugcuguucuagaaagu

SEQ ID NO: 237318 - RNA, 22 nt, Human
agcauucuguggucuucuaugg

SEQ ID NO: 237319 - RNA, 22 nt, Human
agcauuuuaaaacuaguuacca

SEQ ID NO: 237320 - RNA, 22 nt, Human
agcagguucaagggcaaagcug

SEQ ID NO: 237321 - RNA, 22 nt, Human
agcauauaugcaugagugugca

SEQ ID NO: 237322 - RNA, 22 nt, Human
agcaucuaucuucaaugugugu

SEQ ID NO: 237323 - RNA, 22 nt, Human
agauagaaggauugugacacau

SEQ ID NO: 237324 - RNA, 22 nt, Human
agauacaaaagauaagauuuag

SEQ ID NO: 237325 - RNA, 22 nt, Human
agauacuaagccucaagagacg

SEQ ID NO: 237326 - RNA, 22 nt, Human
agcagcaggcugggaugagucu

SEQ ID NO: 237327 - RNA, 22 nt, Human
agcagcaggugaccucgaugcc

SEQ ID NO: 237328 - RNA, 17 nt, Human
agcagcuggguugaucu

SEQ ID NO: 237329 - RNA, 22 nt, Human
agcaggaaggcuagaagcagga

SEQ ID NO: 237330 - RNA, 22 nt, Human
agcaggauggaguaacgugaaa

SEQ ID NO: 237331 - RNA, 22 nt, Human
agcaguugcuuuguauauuaaa

SEQ ID NO: 237332 - RNA, 22 nt, Human
agcagucagaucguggggaaaa

SEQ ID NO: 237333 - RNA, 18 nt, Human
acccauuauauuuguagc

SEQ ID NO: 237334 - RNA, 22 nt, Human
accuauuuauacaacugcacca

SEQ ID NO: 237335 - RNA, 22 nt, Human
accuaucugcuggauuuguugu

SEQ ID NO: 237336 - RNA, 22 nt, Human
accgaauucuauucccaauacc

SEQ ID NO: 237337 - RNA, 22 nt, Human
accucuuucuauggauuuuuug

SEQ ID NO: 237338 - RNA, 22 nt, Human
accucauucugcauagaacuuu

SEQ ID NO: 237339 - RNA, 22 nt, Human
accucuuuuugaauauagcauu

SEQ ID NO: 237340 - RNA, 22 nt, Human
accgauguggaaaauuucauuu

SEQ ID NO: 237341 - RNA, 22 nt, Human
acgugguaaaagaucuguaaaa

SEQ ID NO: 237342 - RNA, 22 nt, Human
acuaaacauaucacugcuuuac

SEQ ID NO: 237343 - RNA, 22 nt, Human
acuaaagcagcucagacgagaa

SEQ ID NO: 237344 - RNA, 22 nt, Human
acgucuacaugcaauucuuaua

SEQ ID NO: 237345 - RNA, 22 nt, Human
acgaaugacaugugauuugaaa

SEQ ID NO: 237346 - RNA, 22 nt, Human
acgaaauaaaauuaaagcccua

SEQ ID NO: 237347 - RNA, 22 nt, Human
acgcacuuuaugcuuuuaacaa

SEQ ID NO: 237348 - RNA, 22 nt, Human
acgcuucacaggugcgcauugu

SEQ ID NO: 237349 - RNA, 22 nt, Human
accuguagcccaaucauggcag

SEQ ID NO: 237350 - RNA, 22 nt, Human
acgcaacacugcuauuuuuuuc

SEQ ID NO: 237351 - RNA, 22 nt, Human
accuucguuuaguacucauuuu

SEQ ID NO: 237352 - RNA, 20 nt, Human
accuucuuugguagacggaa

SEQ ID NO: 237353 - RNA, 22 nt, Human
accuugauggagugaugaauga

SEQ ID NO: 237354 - RNA, 22 nt, Human
accuuguuguagguacaaaaga

SEQ ID NO: 237355 - RNA, 22 nt, Human
accuuagugauuuaaaaucaga

SEQ ID NO: 237356 - RNA, 22 nt, Human
acgagguaaucaauuggucuug

SEQ ID NO: 237357 - RNA, 22 nt, Human
acgauacaaucauauaguaccu

SEQ ID NO: 237358 - RNA, 22 nt, Human
accuuuuauuuucaugcuugcu

SEQ ID NO: 237359 - RNA, 22 nt, Human
acauggcaugaauaauguguac

SEQ ID NO: 237360 - RNA, 22 nt, Human
acauauaugugcauacaacuau

SEQ ID NO: 237361 - RNA, 22 nt, Human
acauggaaacacgcagccccaa

SEQ ID NO: 237362 - RNA, 22 nt, Human
acauagcuuaaaugagaagaua

SEQ ID NO: 237363 - RNA, 22 nt, Human
acauggacugguccauuaugac

SEQ ID NO: 237364 - RNA, 22 nt, Human
acaguuuucugagaaucacagg

SEQ ID NO: 237365 - RNA, 22 nt, Human
acauaaaccccccuuccccagg

SEQ ID NO: 237366 - RNA, 22 nt, Human
aauucgcugcauuccaucuagg

SEQ ID NO: 237367 - RNA, 22 nt, Human
aauucugaggccauuuauuucc

SEQ ID NO: 237368 - RNA, 22 nt, Human
aauucuaaugaguucuuaucua

SEQ ID NO: 237369 - RNA, 22 nt, Human
aauucuuuguuccucugccaag

SEQ ID NO: 237370 - RNA, 22 nt, Human
acaguuagguccuaaaauucug

SEQ ID NO: 237371 - RNA, 22 nt, Human
acauggaauuucagaagagcau

SEQ ID NO: 237372 - RNA, 22 nt, Human
acaugcuucauauuauaaccaa

SEQ ID NO: 237373 - RNA, 22 nt, Human
acaugcuuucuagguccuucug

SEQ ID NO: 237374 - RNA, 22 nt, Human
acauuguuauuccucaggaguu

SEQ ID NO: 237375 - RNA, 22 nt, Human
acauuguuuuugugacuucuau

SEQ ID NO: 237376 - RNA, 22 nt, Human
acauuuguuucucuagaguagg

SEQ ID NO: 237377 - RNA, 22 nt, Human
acauuuuaccaucuguggauga

SEQ ID NO: 237378 - RNA, 22 nt, Human
acauuuuaaaaacaguaccugg

SEQ ID NO: 237379 - RNA, 22 nt, Human
acaucuaugucugaggccuugg

SEQ ID NO: 237380 - RNA, 21 nt, Human
acauguacacauguaugcaca

SEQ ID NO: 237381 - RNA, 23 nt, Human
acauuacacgcaguaauugcccc

SEQ ID NO: 237382 - RNA, 22 nt, Human
acauguuuacaaaccucaagcc

SEQ ID NO: 237383 - RNA, 22 nt, Human
acauauggcagguugaucaaug

SEQ ID NO: 237384 - RNA, 22 nt, Human
acauuccugaagguaaugagaa

SEQ ID NO: 237385 - RNA, 22 nt, Human
acauuauuguguagugugggca

SEQ ID NO: 237386 - RNA, 22 nt, Human
acauuagaugacucuuucuuuc

SEQ ID NO: 237387 - RNA, 22 nt, Human
acaugacagugacuuuauaaga

SEQ ID NO: 237388 - RNA, 22 nt, Human
acauuucuccuacuuguuauuu

SEQ ID NO: 237389 - RNA, 22 nt, Human
acauuuugggagaaaguuguua

SEQ ID NO: 237390 - RNA, 22 nt, Human
acauuugauauggaguugugua

SEQ ID NO: 237391 - RNA, 22 nt, Human
acaugucagaaaauucagaggg

SEQ ID NO: 237392 - RNA, 22 nt, Human
acaugugugucugugugugugu

SEQ ID NO: 237393 - RNA, 22 nt, Human
accaacacgucugaguauuucc

SEQ ID NO: 237394 - RNA, 22 nt, Human
acauuuuuggguugaugucuga

SEQ ID NO: 237395 - RNA, 22 nt, Human
acauuuuguuuauggaaaagau

SEQ ID NO: 237396 - RNA, 22 nt, Human
acauucucuuuuagaaagcugu

SEQ ID NO: 237397 - RNA, 22 nt, Human
acauugcagcuccuaccuuguc

SEQ ID NO: 237398 - RNA, 22 nt, Human
accaauguucaaccuugacugc

SEQ ID NO: 237399 - RNA, 22 nt, Human
accaauaaaagcaauucacagu

SEQ ID NO: 237400 - RNA, 22 nt, Human
accaacuuuccaaagugccugg

SEQ ID NO: 237401 - RNA, 22 nt, Human
accauuauagaggacauuaugu

SEQ ID NO: 237402 - RNA, 22 nt, Human
accauuuaucagaagagacacc

SEQ ID NO: 237403 - RNA, 22 nt, Human
accauccaaaagcuuuucauca

SEQ ID NO: 237404 - RNA, 20 nt, Human
accagacagcuguuggggug

SEQ ID NO: 237405 - RNA, 22 nt, Human
agagcagcaaucuuugaaauua

SEQ ID NO: 237406 - RNA, 22 nt, Human
agagcuuuggaguaaguuuuga

SEQ ID NO: 237407 - RNA, 22 nt, Human
agaggaauuauugaguuagauu

SEQ ID NO: 237408 - RNA, 22 nt, Human
agaguguaauuaguauuuauau

SEQ ID NO: 237409 - RNA, 22 nt, Human
agauaacauguugcagauucug

SEQ ID NO: 237410 - RNA, 22 nt, Human
agauaaucacaaucuagacuuu

SEQ ID NO: 237411 - RNA, 22 nt, Human
agagcagcuuuucggaaccacu

SEQ ID NO: 237412 - RNA, 22 nt, Human
agagcaucgguggaguccccac

SEQ ID NO: 237413 - RNA, 22 nt, Human
agagcuagaaggaagcauuucu

SEQ ID NO: 237414 - RNA, 22 nt, Human
agagauuagagaagaugauaaa

SEQ ID NO: 237415 - RNA, 19 nt, Human
agagauuuucuguuuuagu

SEQ ID NO: 237416 - RNA, 22 nt, Human
agagauuuacaacuugggcuuu

SEQ ID NO: 237417 - RNA, 22 nt, Human
agagcacaggguuuugugccgg

SEQ ID NO: 237418 - RNA, 22 nt, Human
agagcaauggugcuuuaauucu

SEQ ID NO: 237419 - RNA, 22 nt, Human
agagaaauguacuagucuaacu

SEQ ID NO: 237420 - RNA, 20 nt, Human
agagaacaguuuggucacag

SEQ ID NO: 237421 - RNA, 21 nt, Human
agacugaugggaagacucugu

SEQ ID NO: 237422 - RNA, 22 nt, Human
agagaauuugggaauauaaauc

SEQ ID NO: 237423 - RNA, 22 nt, Human
agagacaagggaccucuggaga

SEQ ID NO: 237424 - RNA, 22 nt, Human
agacuguuuucccaucucuugg

SEQ ID NO: 237425 - RNA, 22 nt, Human
agacuugguaacuagugaagaa

SEQ ID NO: 237426 - RNA, 22 nt, Human
agagaaacauuaauugaugagg

SEQ ID NO: 237427 - RNA, 22 nt, Human
agacagcggugcaauaaauggu

SEQ ID NO: 237428 - RNA, 20 nt, Human
agacauugaggagagagcau

SEQ ID NO: 237429 - RNA, 22 nt, Human
agacagaacauaauuaguacug

SEQ ID NO: 237430 - RNA, 22 nt, Human
agacauuuggugugaagggagg

SEQ ID NO: 237431 - RNA, 22 nt, Human
agacauauuggcuugcuuuaau

SEQ ID NO: 237432 - RNA, 22 nt, Human
agaaccauccugguuccagcuu

SEQ ID NO: 237433 - RNA, 22 nt, Human
agaacauaucuguuuucuaacu

SEQ ID NO: 237434 - RNA, 22 nt, Human
agaaccaauacuacagcaagua

SEQ ID NO: 237435 - RNA, 22 nt, Human
agaacaagaaacccgaaaagug

SEQ ID NO: 237436 - RNA, 22 nt, Human
agaaauggggugaagcaaaugg

SEQ ID NO: 237437 - RNA, 22 nt, Human
acuuuuagccuucccacaacag

SEQ ID NO: 237438 - RNA, 22 nt, Human
agaaauuguaauaaaucugguc

SEQ ID NO: 237439 - RNA, 22 nt, Human
agaaaagagacaauguuuuugg

SEQ ID NO: 237440 - RNA, 22 nt, Human
acuuuuaaggggccuugauuua

SEQ ID NO: 237441 - RNA, 22 nt, Human
acuuugugaauagaacuggaug

SEQ ID NO: 237442 - RNA, 23 nt, Human
acuuugaggagaagaaugucagu

SEQ ID NO: 237443 - RNA, 22 nt, Human
acuuugaauuagaauuuugcug

SEQ ID NO: 237444 - RNA, 22 nt, Human
agaagcaaagcaaacacauucu

SEQ ID NO: 237445 - RNA, 21 nt, Human
agaagcggucgaaucgcagac

SEQ ID NO: 237446 - RNA, 22 nt, Human
agaagcauaagggcuuugccag

SEQ ID NO: 237447 - RNA, 19 nt, Human
agaaacaacauucuggaga

SEQ ID NO: 237448 - RNA, 22 nt, Human
agaagaaugguuugaaagauuu

SEQ ID NO: 237449 - RNA, 22 nt, Human
agaaacaagcccuagaaguccu

SEQ ID NO: 237450 - RNA, 22 nt, Human
agaaagcacccugcacuuucug

SEQ ID NO: 237451 - RNA, 19 nt, Human
agaaauagccuuccuuguc

SEQ ID NO: 237452 - RNA, 22 nt, Human
acuuuauacuagugauaguuug

SEQ ID NO: 237453 - RNA, 22 nt, Human
acuuggcuaggguuuuuaucuu

SEQ ID NO: 237454 - RNA, 22 nt, Human
acuugaagcaugaaaauaagcc

SEQ ID NO: 237455 - RNA, 22 nt, Human
acuuuaaaucuguugcuuagcu

SEQ ID NO: 237456 - RNA, 22 nt, Human
acuugggaaaugaaaauacaga

SEQ ID NO: 237457 - RNA, 22 nt, Human
acuuuuuugccaucccuccagc

SEQ ID NO: 237458 - RNA, 22 nt, Human
acuuuuaauaguagauuuuuaa

SEQ ID NO: 237459 - RNA, 22 nt, Human
acuugguccacaguaagugcuu

SEQ ID NO: 237460 - RNA, 22 nt, Human
acuuagaacagccuaugggaag

SEQ ID NO: 237461 - RNA, 22 nt, Human
acuuacuuucuauucuuguagg

SEQ ID NO: 237462 - RNA, 22 nt, Human
acuguugugaauaaugaaaugc

SEQ ID NO: 237463 - RNA, 22 nt, Human
acugugauguaaagaaauaggc

SEQ ID NO: 237464 - RNA, 22 nt, Human
acugucauuaaugaauguaaua

SEQ ID NO: 237465 - RNA, 22 nt, Human
acuggguuguuugucucaugag

SEQ ID NO: 237466 - RNA, 22 nt, Human
acugguagcugauuaaguauag

SEQ ID NO: 237467 - RNA, 22 nt, Human
acuguugagggaagcagaugaa

SEQ ID NO: 237468 - RNA, 22 nt, Human
acugcauuucauaaauuacaau

SEQ ID NO: 237469 - RNA, 22 nt, Human
acuggggaggucuggauggauc

SEQ ID NO: 237470 - RNA, 22 nt, Human
acuacuguaauuuauuguuaca

SEQ ID NO: 237471 - RNA, 22 nt, Human
acugacucacauuuugguuugc

SEQ ID NO: 237472 - RNA, 22 nt, Human
acugcauuaucaccaagaugua

SEQ ID NO: 237473 - RNA, 22 nt, Human
ccugcugcugaugcuguuucac

SEQ ID NO: 237474 - RNA, 22 nt, Human
ccugcucuaauucauucaugcu

SEQ ID NO: 237475 - RNA, 22 nt, Human
ccgauuuauucugacaguuuau

SEQ ID NO: 237476 - RNA, 22 nt, Human
ccgauuuaugucucugacuuga

SEQ ID NO: 237477 - RNA, 22 nt, Human
ccugaauuuaucugaauggugg

SEQ ID NO: 237478 - RNA, 22 nt, Human
ccucuuugcccucuuuccuucc

SEQ ID NO: 237479 - RNA, 22 nt, Human
ccucuuuugaaccaguucuuca

SEQ ID NO: 237480 - RNA, 22 nt, Human
cuaacuuugucuugguaauugc

SEQ ID NO: 237481 - RNA, 22 nt, Human
cuaagguuggcaguggaauugg

SEQ ID NO: 237482 - RNA, 22 nt, Human
cuaauaauuuacugagugcuac

SEQ ID NO: 237483 - RNA, 22 nt, Human
cuaagaaggaggaaaagugcca

SEQ ID NO: 237484 - RNA, 22 nt, Human
cgaagcuuuuguuggcgugucg

SEQ ID NO: 237485 - RNA, 22 nt, Human
cuaaaaauguucuaguaguuca

SEQ ID NO: 237486 - RNA, 22 nt, Human
cguuauagagcacucgaacuuu

SEQ ID NO: 237487 - RNA, 20 nt, Human
cguugccagcccggcccggg

SEQ ID NO: 237488 - RNA, 22 nt, Human
ccuuuuagagaagugcauccag

SEQ ID NO: 237489 - RNA, 22 nt, Human
cgguuuuuaaaagucucuucua

SEQ ID NO: 237490 - RNA, 22 nt, Human
cguauauaaauguauauacaca

SEQ ID NO: 237491 - RNA, 22 nt, Human
cggucuauuguguaucauuuca

SEQ ID NO: 237492 - RNA, 22 nt, Human
cggggugugacggugcgggccu

SEQ ID NO: 237493 - RNA, 22 nt, Human
ccuuaauaguguucuaauguuu

SEQ ID NO: 237494 - RNA, 19 nt, Human
cgguaugaauguacuaugg

SEQ ID NO: 237495 - RNA, 22 nt, Human
cggggccccccagugaaccucu

SEQ ID NO: 237496 - RNA, 22 nt, Human
ccuguguucguccucaccuugc

SEQ ID NO: 237497 - RNA, 21 nt, Human
ccugucagcccaacuuuugga

SEQ ID NO: 237498 - RNA, 22 nt, Human
cuccuugagaaugaacaaagga

SEQ ID NO: 237499 - RNA, 22 nt, Human
cuccuuuuccuacucauacuau

SEQ ID NO: 237500 - RNA, 22 nt, Human
cuccuuuacaauugugggaaaa

SEQ ID NO: 237501 - RNA, 22 nt, Human
cuccuuuuuuuaaagauggauu

SEQ ID NO: 237502 - RNA, 22 nt, Human
cucgccugacucggaugggcug

SEQ ID NO: 237503 - RNA, 22 nt, Human
cucuauuuuuucaucuuucagg

SEQ ID NO: 237504 - RNA, 22 nt, Human
cucaugcugcaaauggcuguuu

SEQ ID NO: 237505 - RNA, 22 nt, Human
cuccccuuauuccucaacauga

SEQ ID NO: 237506 - RNA, 22 nt, Human
cucccaucacaauucagggccu

SEQ ID NO: 237507 - RNA, 22 nt, Human
cucacauacaagagauggugga

SEQ ID NO: 237508 - RNA, 22 nt, Human
cuauugguaucacacugauuuc

SEQ ID NO: 237509 - RNA, 22 nt, Human
cuauacuuagaacuccauuuuc

SEQ ID NO: 237510 - RNA, 22 nt, Human
cuauaauuguacuuguuuuuua

SEQ ID NO: 237511 - RNA, 22 nt, Human
cuauauucuggaauguccauuu

SEQ ID NO: 237512 - RNA, 22 nt, Human
cuaugaaucaauuucugcaguu

SEQ ID NO: 237513 - RNA, 22 nt, Human
cgccuggccccgcagcgcuugu

SEQ ID NO: 237514 - RNA, 21 nt, Human
cuauaaaaaugguucuuugcg

SEQ ID NO: 237515 - RNA, 22 nt, Human
cuaaugaaaugauggcuccuac

SEQ ID NO: 237516 - RNA, 19 nt, Human
cggugaagagaguuuagau

SEQ ID NO: 237517 - RNA, 22 nt, Human
cgggguguggggcgguagugug

SEQ ID NO: 237518 - RNA, 22 nt, Human
cugaaggcuuugaauggaauga

SEQ ID NO: 237519 - RNA, 22 nt, Human
cugaaagacgaggggaagucgg

SEQ ID NO: 237520 - RNA, 22 nt, Human
cugaagaaagaaaauggccauc

SEQ ID NO: 237521 - RNA, 23 nt, Human
cugaaauucagaugcuaaagaua

SEQ ID NO: 237522 - RNA, 22 nt, Human
cucuuuuuuugucuuaagaacc

SEQ ID NO: 237523 - RNA, 22 nt, Human
cucuuucauucuuagguugccg

SEQ ID NO: 237524 - RNA, 22 nt, Human
cucuuucauucuguccuuguuu

SEQ ID NO: 237525 - RNA, 22 nt, Human
cucuguauauugagugcuuacu

SEQ ID NO: 237526 - RNA, 22 nt, Human
cucuuauaaagaugucucuguu

SEQ ID NO: 237527 - RNA, 22 nt, Human
cucuuagucugcuuuuuuucca

SEQ ID NO: 237528 - RNA, 22 nt, Human
cucuguguguuugugugugugu

SEQ ID NO: 237529 - RNA, 22 nt, Human
cucucuaacuagagacaggagu

SEQ ID NO: 237530 - RNA, 22 nt, Human
cccuuugucaguagucuuagug

SEQ ID NO: 237531 - RNA, 22 nt, Human
ccugcacuaccuggggcugcug

SEQ ID NO: 237532 - RNA, 22 nt, Human
ccugaggcccuggcugugcuga

SEQ ID NO: 237533 - RNA, 22 nt, Human
ccugauauggugucauuuaaac

SEQ ID NO: 237534 - RNA, 22 nt, Human
cccugggucagagcgacuucuc

SEQ ID NO: 237535 - RNA, 22 nt, Human
ccugaagaugguugauccccuu

SEQ ID NO: 237536 - RNA, 22 nt, Human
cccuaguuuauuugccuucuuu

SEQ ID NO: 237537 - RNA, 22 nt, Human
ccccuuuguagcccagcaguug

SEQ ID NO: 237538 - RNA, 22 nt, Human
ccucuagaauuaucacuuuuaa

SEQ ID NO: 237539 - RNA, 22 nt, Human
ccuaacaugguuauuguuaauu

SEQ ID NO: 237540 - RNA, 22 nt, Human
ccuauauuacaggcuugcucua

SEQ ID NO: 237541 - RNA, 22 nt, Human
ccuauuuucaaaauuguuuauc

SEQ ID NO: 237542 - RNA, 22 nt, Human
ccucaauucgugccucacauug

SEQ ID NO: 237543 - RNA, 22 nt, Human
ccguaugacuuuuuguuguugu

SEQ ID NO: 237544 - RNA, 22 nt, Human
cccuucauguagcugugugucc

SEQ ID NO: 237545 - RNA, 22 nt, Human
ccaguuuuuccagugcuuucug

SEQ ID NO: 237546 - RNA, 22 nt, Human
cccuucuguaucuucugaguuu

SEQ ID NO: 237547 - RNA, 22 nt, Human
ccauaaaagagaaucuaaauga

SEQ ID NO: 237548 - RNA, 22 nt, Human
ccgaaaaacagaaucuuggaac

SEQ ID NO: 237549 - RNA, 22 nt, Human
ccauggaaaagacgggcaggcc

SEQ ID NO: 237550 - RNA, 22 nt, Human
ccgagaucagaguaggauuugg

SEQ ID NO: 237551 - RNA, 22 nt, Human
ccauuuuccuguauggacucga

SEQ ID NO: 237552 - RNA, 22 nt, Human
ccaugugaccugugucaguugc

SEQ ID NO: 237553 - RNA, 22 nt, Human
caucaaaugcaagagcguucuu

SEQ ID NO: 237554 - RNA, 20 nt, Human
caucaacaccuugucagccu

SEQ ID NO: 237555 - RNA, 22 nt, Human
ccagauaaacauuccuuggccu

SEQ ID NO: 237556 - RNA, 22 nt, Human
ccagcaagacucgcagugggau

SEQ ID NO: 237557 - RNA, 22 nt, Human
cccaguuguuccuauucuucuu

SEQ ID NO: 237558 - RNA, 20 nt, Human
cuguuugcuaucaugagcug

SEQ ID NO: 237559 - RNA, 22 nt, Human
cuguuguucacuuugcugguga

SEQ ID NO: 237560 - RNA, 22 nt, Human
cuguuguauuuauuucccuuuc

SEQ ID NO: 237561 - RNA, 20 nt, Human
gaacauaaauaacucuuuac

SEQ ID NO: 237562 - RNA, 22 nt, Human
cuguuaucaggaguuuucacgg

SEQ ID NO: 237563 - RNA, 22 nt, Human
gaaauuucuuuguuaucuuggu

SEQ ID NO: 237564 - RNA, 20 nt, Human
cuuaugcaaaauguuaggga

SEQ ID NO: 237565 - RNA, 23 nt, Human
cuuauauaaucauuagaaaccau

SEQ ID NO: 237566 - RNA, 22 nt, Human
cuuacauuuguuuaguguuucc

SEQ ID NO: 237567 - RNA, 22 nt, Human
cuucaacuucuguuuuaaggaa

SEQ ID NO: 237568 - RNA, 22 nt, Human
cuucacaaaauauuucauuaua

SEQ ID NO: 237569 - RNA, 22 nt, Human
gaaaugucaagauauguuugga

SEQ ID NO: 237570 - RNA, 22 nt, Human
cugugugugcacacguguaugg

SEQ ID NO: 237571 - RNA, 22 nt, Human
gaaagcuuggaaacgacuuuau

SEQ ID NO: 237572 - RNA, 22 nt, Human
cuguggaaugcaguugcgagca

SEQ ID NO: 237573 - RNA, 22 nt, Human
gaaagcauucuggaggggcaga

SEQ ID NO: 237574 - RNA, 22 nt, Human
gaaagaggcugucagggaaugg

SEQ ID NO: 237575 - RNA, 22 nt, Human
cuggauuaaacaguuugauacu

SEQ ID NO: 237576 - RNA, 22 nt, Human
cuggaugucugggaggcuuccc

SEQ ID NO: 237577 - RNA, 22 nt, Human
cuuuuaaucuaauuuuuauauu

SEQ ID NO: 237578 - RNA, 22 nt, Human
cuuuguaaucaauaagucuuuu

SEQ ID NO: 237579 - RNA, 22 nt, Human
cuuugcaaagagagaaaguggg

SEQ ID NO: 237580 - RNA, 21 nt, Human
cuuuggcaagggagaagucac

SEQ ID NO: 237581 - RNA, 22 nt, Human
cuuuggauuuuuugcuuuugua

SEQ ID NO: 237582 - RNA, 20 nt, Human
gaauucugaagauaauuugg

SEQ ID NO: 237583 - RNA, 22 nt, Human
cuugcuuuaucugguuucucau

SEQ ID NO: 237584 - RNA, 20 nt, Human
gaaucuggucaaaugucuau

SEQ ID NO: 237585 - RNA, 22 nt, Human
cuugcucugggaauaugaguuu

SEQ ID NO: 237586 - RNA, 22 nt, Human
gaauagauuagaaagaguaugu

SEQ ID NO: 237587 - RNA, 22 nt, Human
cuucuuuucuacuggccuagaa

SEQ ID NO: 237588 - RNA, 22 nt, Human
gaagcucaguugcuuagaucuc

SEQ ID NO: 237589 - RNA, 22 nt, Human
cuucaguuaguuucaugugagc

SEQ ID NO: 237590 - RNA, 22 nt, Human
cuucacuaccuacacugccgcu

SEQ ID NO: 237591 - RNA, 22 nt, Human
cuucauaagauuguugugagga

SEQ ID NO: 237592 - RNA, 22 nt, Human
cuuccacucaguuuuucauugc

SEQ ID NO: 237593 - RNA, 22 nt, Human
cuucuuaaaguugucacagcug

SEQ ID NO: 237594 - RNA, 22 nt, Human
cuuuuaccuuaauuucgacaca

SEQ ID NO: 237595 - RNA, 19 nt, Human
cuuuuagagggagaggacu

SEQ ID NO: 237596 - RNA, 22 nt, Human
gaccaggagauuugagcuaggc

SEQ ID NO: 237597 - RNA, 22 nt, Human
gaccagaacuucuagucuaagu

SEQ ID NO: 237598 - RNA, 22 nt, Human
gacauuuauuggauuuuacgag

SEQ ID NO: 237599 - RNA, 22 nt, Human
cuuuacauuaauuucuacugau

SEQ ID NO: 237600 - RNA, 18 nt, Human
gacaaaaguacagacaga

SEQ ID NO: 237601 - RNA, 19 nt, Human
gaauugcacgagcagaggc

SEQ ID NO: 237602 - RNA, 22 nt, Human
cuuguuaacaauugguaucuuu

SEQ ID NO: 237603 - RNA, 22 nt, Human
cuuguuaaaagugacccuaaug

SEQ ID NO: 237604 - RNA, 22 nt, Human
cuuguuuuaaacuguuguggcu

SEQ ID NO: 237605 - RNA, 22 nt, Human
cuuuaaaaauguauuuuugugg

SEQ ID NO: 237606 - RNA, 22 nt, Human
gagaaggagcagaaaaucuccu

SEQ ID NO: 237607 - RNA, 22 nt, Human
gagaauaauaauaggcauggug

SEQ ID NO: 237608 - RNA, 20 nt, Human
gagaaugucauuccuuuuuu

SEQ ID NO: 237609 - RNA, 22 nt, Human
gaaagagaugucguuugucuuc

SEQ ID NO: 237610 - RNA, 22 nt, Human
gaaaagaaggcaggagcccaag

SEQ ID NO: 237611 - RNA, 20 nt, Human
gacuucaauuucuaucuuuu

SEQ ID NO: 237612 - RNA, 22 nt, Human
gaaaaacucagugggggucuuu

SEQ ID NO: 237613 - RNA, 22 nt, Human
gacugucaaauaaaucguuuac

SEQ ID NO: 237614 - RNA, 22 nt, Human
gaaaaaccacaauugguauuuu

SEQ ID NO: 237615 - RNA, 22 nt, Human
gaacuuuaauuagcuuuugucu

SEQ ID NO: 237616 - RNA, 22 nt, Human
gaagaagagauaauggggagca

SEQ ID NO: 237617 - RNA, 22 nt, Human
gaacuugagugugcuauuucuu

SEQ ID NO: 237618 - RNA, 22 nt, Human
gagcagggagaggcagagaggc

SEQ ID NO: 237619 - RNA, 22 nt, Human
gaagaugacaucggaucugucu

SEQ ID NO: 237620 - RNA, 22 nt, Human
gagcagguuauuagaaauggaa

SEQ ID NO: 237621 - RNA, 22 nt, Human
gaacaugaguuuuaugguauuu

SEQ ID NO: 237622 - RNA, 19 nt, Human
gaacuaaggggagcucugg

SEQ ID NO: 237623 - RNA, 22 nt, Human
gaacugaauguguaauguuggc

SEQ ID NO: 237624 - RNA, 22 nt, Human
gagauuguggcagcagcuguuu

SEQ ID NO: 237625 - RNA, 22 nt, Human
gagauuucauuugugaggcuca

SEQ ID NO: 237626 - RNA, 22 nt, Human
gaacaaaagauagcccaaacau

SEQ ID NO: 237627 - RNA, 22 nt, Human
gagauuuccauauuuuguaaca

SEQ ID NO: 237628 - RNA, 22 nt, Human
gaacauauuuagcaccuaauau

SEQ ID NO: 237629 - RNA, 22 nt, Human
gaacaguuucccuguagaaaau

SEQ ID NO: 237630 - RNA, 22 nt, Human
gaacaaggauucccaaagaaga

SEQ ID NO: 237631 - RNA, 22 nt, Human
gaaaugaaacacacaugcagcu

SEQ ID NO: 237632 - RNA, 22 nt, Human
gaaauagagacaguaagugucu

SEQ ID NO: 237633 - RNA, 22 nt, Human
gaaagugaauguaacauguuau

SEQ ID NO: 237634 - RNA, 22 nt, Human
gaaaucuggugauuuucuguug

SEQ ID NO: 237635 - RNA, 22 nt, Human
gaaauaggcccuuacauggaaa

SEQ ID NO: 237636 - RNA, 22 nt, Human
gagagcaaaccuguguuuggag

SEQ ID NO: 237637 - RNA, 22 nt, Human
cuugccuuugaaagcauuucuc

SEQ ID NO: 237638 - RNA, 22 nt, Human
cuucuuuuggggaugaaaaugg

SEQ ID NO: 237639 - RNA, 22 nt, Human
cuucuuucuuuucuucuucucu

SEQ ID NO: 237640 - RNA, 22 nt, Human
cuucucugcugccugccucuuu

SEQ ID NO: 237641 - RNA, 22 nt, Human
cugcagauaaguguuuugaaaa

SEQ ID NO: 237642 - RNA, 21 nt, Human
cugcacugugauuuaaaaugu

SEQ ID NO: 237643 - RNA, 22 nt, Human
cuuccuaaucuuggguuauuuu

SEQ ID NO: 237644 - RNA, 22 nt, Human
cuucauuacagcaaccauuuga

SEQ ID NO: 237645 - RNA, 22 nt, Human
cuucauuucaggcugaagaaua

SEQ ID NO: 237646 - RNA, 22 nt, Human
cugcacuggguacauagaaaca

SEQ ID NO: 237647 - RNA, 20 nt, Human
cuuguuaaauaugcagguag

SEQ ID NO: 237648 - RNA, 22 nt, Human
cuggagaacucugugcuucacu

SEQ ID NO: 237649 - RNA, 22 nt, Human
cuggaaaaauggauccugucuu

SEQ ID NO: 237650 - RNA, 22 nt, Human
cuugucuaguuccuggugaugu

SEQ ID NO: 237651 - RNA, 22 nt, Human
cuuucuuucaaguucugcuuua

SEQ ID NO: 237652 - RNA, 22 nt, Human
cuuucuuuuugguuucccccca

SEQ ID NO: 237653 - RNA, 22 nt, Human
cuuucucucaaacacacauaca

SEQ ID NO: 237654 - RNA, 22 nt, Human
cuuuauguuggggugucuuagu

SEQ ID NO: 237655 - RNA, 22 nt, Human
cuuucauuuuugggcaucugag

SEQ ID NO: 237656 - RNA, 22 nt, Human
cuuggcaaaguggcaaaauuag

SEQ ID NO: 237657 - RNA, 22 nt, Human
cuugggguuugggggcuugacc

SEQ ID NO: 237658 - RNA, 22 nt, Human
cuugguuugaaacauacucuac

SEQ ID NO: 237659 - RNA, 22 nt, Human
cugcuguuuuccccaccaucuc

SEQ ID NO: 237660 - RNA, 22 nt, Human
cuugggacucccuguagcagug

SEQ ID NO: 237661 - RNA, 22 nt, Human
cugggaaggaagggaaaaacag

SEQ ID NO: 237662 - RNA, 22 nt, Human
cucuaagcuuugguguuucacu

SEQ ID NO: 237663 - RNA, 22 nt, Human
cucuaaauguggucugcagaua

SEQ ID NO: 237664 - RNA, 19 nt, Human
cugggacaaugaaagcauc

SEQ ID NO: 237665 - RNA, 22 nt, Human
cuggcaguguccagcucgugau

SEQ ID NO: 237666 - RNA, 22 nt, Human
cucauguucuaagcuuucuuca

SEQ ID NO: 237667 - RNA, 22 nt, Human
cucaaugagcuauuuguuucau

SEQ ID NO: 237668 - RNA, 22 nt, Human
cucaauuguuuggucucugguu

SEQ ID NO: 237669 - RNA, 22 nt, Human
cuggagaacagagcuguuuaga

SEQ ID NO: 237670 - RNA, 22 nt, Human
cuggagaagagguaguauguag

SEQ ID NO: 237671 - RNA, 22 nt, Human
cugagaaauacccaagucuggu

SEQ ID NO: 237672 - RNA, 22 nt, Human
cugaguuuuucaaaucugaauu

SEQ ID NO: 237673 - RNA, 22 nt, Human
cugagguccucagagggaaagg

SEQ ID NO: 237674 - RNA, 22 nt, Human
cuuauaucaacuggaaaaauua

SEQ ID NO: 237675 - RNA, 22 nt, Human
cugaauucuuguugucggagca

SEQ ID NO: 237676 - RNA, 22 nt, Human
cugaaucaaaugacuuagccau

SEQ ID NO: 237677 - RNA, 22 nt, Human
cuguguguauaauguuugauaa

SEQ ID NO: 237678 - RNA, 22 nt, Human
cugugcuguuagcgauuuuuaa

SEQ ID NO: 237679 - RNA, 22 nt, Human
cucuuuucaaaccuguuuaugg

SEQ ID NO: 237680 - RNA, 22 nt, Human
cugugggcucucaugggaccug

SEQ ID NO: 237681 - RNA, 22 nt, Human
cugugcuucgagggcuccccgc

SEQ ID NO: 237682 - RNA, 22 nt, Human
cagguaguuagaaugaccagga

SEQ ID NO: 237683 - RNA, 22 nt, Human
cagcuuaccucccacagcucuc

SEQ ID NO: 237684 - RNA, 22 nt, Human
cagcuauuguucuguauaauga

SEQ ID NO: 237685 - RNA, 22 nt, Human
caggagaaauucacauuaguga

SEQ ID NO: 237686 - RNA, 22 nt, Human
caggcacagcuaagacuggcca

SEQ ID NO: 237687 - RNA, 22 nt, Human
cagcuuuugcagacuucuugcc

SEQ ID NO: 237688 - RNA, 22 nt, Human
cagauguuugaaugcuuaccac

SEQ ID NO: 237689 - RNA, 22 nt, Human
cagauuuagcacugauaggacu

SEQ ID NO: 237690 - RNA, 19 nt, Human
cagcaaacacuguaaaugg

SEQ ID NO: 237691 - RNA, 21 nt, Human
cagcagaaaugagaggagaaa

SEQ ID NO: 237692 - RNA, 22 nt, Human
cagaaacacuguauuuagggaa

SEQ ID NO: 237693 - RNA, 22 nt, Human
cagaaaacauuguguguauaag

SEQ ID NO: 237694 - RNA, 22 nt, Human
cagcaugcaaguccagaugugg

SEQ ID NO: 237695 - RNA, 18 nt, Human
cagcauuagcagcuucca

SEQ ID NO: 237696 - RNA, 23 nt, Human
cagagaaaauagaauaugcugug

SEQ ID NO: 237697 - RNA, 22 nt, Human
cagaggauggaaaugagaacaa

SEQ ID NO: 237698 - RNA, 22 nt, Human
cagaguaaugugauuuccaugu

SEQ ID NO: 237699 - RNA, 22 nt, Human
cagauacaacagcaggaaugaa

SEQ ID NO: 237700 - RNA, 22 nt, Human
cagaugccauagguauaguaua

SEQ ID NO: 237701 - RNA, 22 nt, Human
cagauuuaauaaaaaaugcauc

SEQ ID NO: 237702 - RNA, 22 nt, Human
cacuugauugucagaaaaaugg

SEQ ID NO: 237703 - RNA, 22 nt, Human
cagagcagaaaccugggugauu

SEQ ID NO: 237704 - RNA, 22 nt, Human
cacaauuuccauugagcagcag

SEQ ID NO: 237705 - RNA, 22 nt, Human
caauuuggaaagcaugcccccc

SEQ ID NO: 237706 - RNA, 22 nt, Human
caguaucucccauucacagugu

SEQ ID NO: 237707 - RNA, 22 nt, Human
cagguauuugaaggcaguggga

SEQ ID NO: 237708 - RNA, 22 nt, Human
caggucauaacuaugcaugaac

SEQ ID NO: 237709 - RNA, 17 nt, Human
cagugcuguuuuagaaa

SEQ ID NO: 237710 - RNA, 22 nt, Human
caguauguuuauuagaacugca

SEQ ID NO: 237711 - RNA, 22 nt, Human
caucauuuggcuuuagggccug

SEQ ID NO: 237712 - RNA, 22 nt, Human
caguagcuuuuugcagacaaga

SEQ ID NO: 237713 - RNA, 22 nt, Human
caucaacagucuacuuuuugcc

SEQ ID NO: 237714 - RNA, 23 nt, Human
cauauucagaaacaccuaguggu

SEQ ID NO: 237715 - RNA, 22 nt, Human
cauaauuggugcuuauuaaaug

SEQ ID NO: 237716 - RNA, 22 nt, Human
cauaccuugguaagagugauca

SEQ ID NO: 237717 - RNA, 22 nt, Human
cagguauaugugugucuaauac

SEQ ID NO: 237718 - RNA, 22 nt, Human
caugguaaucggggccaucugu

SEQ ID NO: 237719 - RNA, 22 nt, Human
caugggaauaaaguuauuucaa

SEQ ID NO: 237720 - RNA, 22 nt, Human
caugguacugccacagaagagu

SEQ ID NO: 237721 - RNA, 22 nt, Human
cauacauguuagcaguagccuu

SEQ ID NO: 237722 - RNA, 22 nt, Human
cauagcuagcaccuucuuuucu

SEQ ID NO: 237723 - RNA, 22 nt, Human
cauaggaaauugcuguuaugga

SEQ ID NO: 237724 - RNA, 22 nt, Human
caguuuuauacacugcagcucc

SEQ ID NO: 237725 - RNA, 22 nt, Human
caguuuuucaaaauuacaugau

SEQ ID NO: 237726 - RNA, 21 nt, Human
caguuugcuauuuuaguauga

SEQ ID NO: 237727 - RNA, 22 nt, Human
caguugcagagugauguguuug

SEQ ID NO: 237728 - RNA, 22 nt, Human
caugcagauugccaggcucccu

SEQ ID NO: 237729 - RNA, 22 nt, Human
caguguugcuaaugaauucauu

SEQ ID NO: 237730 - RNA, 21 nt, Human
caguucuaagugucaucuuuu

SEQ ID NO: 237731 - RNA, 22 nt, Human
caguucacggcugguaugaauu

SEQ ID NO: 237732 - RNA, 22 nt, Human
caguucaagauuguugcuuucu

SEQ ID NO: 237733 - RNA, 22 nt, Human
caguguuuagcacagugcuugg

SEQ ID NO: 237734 - RNA, 22 nt, Human
caguggaugucucauaguguga

SEQ ID NO: 237735 - RNA, 22 nt, Human
caguuaaugauaggaauucggu

SEQ ID NO: 237736 - RNA, 22 nt, Human
caugaugacagcauuccuuuua

SEQ ID NO: 237737 - RNA, 20 nt, Human
caugaugcaaacaguaacgu

SEQ ID NO: 237738 - RNA, 22 nt, Human
caugauguuaucaagcacaaag

SEQ ID NO: 237739 - RNA, 22 nt, Human
caugaauaauucuuuuucuugg

SEQ ID NO: 237740 - RNA, 22 nt, Human
cagucaaauuugaaaacuuuga

SEQ ID NO: 237741 - RNA, 22 nt, Human
caucuaaaauaagccuuauaau

SEQ ID NO: 237742 - RNA, 22 nt, Human
auuucauccauuaagaguacuc

SEQ ID NO: 237743 - RNA, 22 nt, Human
auuuccacaaauuaagauugca

SEQ ID NO: 237744 - RNA, 22 nt, Human
auuucauuuuagaaauaagugu

SEQ ID NO: 237745 - RNA, 19 nt, Human
auuuccuggcauauaucac

SEQ ID NO: 237746 - RNA, 22 nt, Human
auuuaucugcucuucgcguuga

SEQ ID NO: 237747 - RNA, 22 nt, Human
auuucaacagaguuugaaggca

SEQ ID NO: 237748 - RNA, 22 nt, Human
auuucagcagcccauguuugga

SEQ ID NO: 237749 - RNA, 22 nt, Human
auuucagaaugaaaggaaaaau

SEQ ID NO: 237750 - RNA, 17 nt, Human
auuguuuuuaauuugca

SEQ ID NO: 237751 - RNA, 23 nt, Human
auuuccuaaaagauaaucauuac

SEQ ID NO: 237752 - RNA, 22 nt, Human
auuuggggacagagugggggua

SEQ ID NO: 237753 - RNA, 22 nt, Human
auuuccugugaacuuuucugau

SEQ ID NO: 237754 - RNA, 22 nt, Human
auuucuguaauucugaggagug

SEQ ID NO: 237755 - RNA, 22 nt, Human
auuuaaagaguaauacaaucca

SEQ ID NO: 237756 - RNA, 22 nt, Human
auuuauuugaagagccauugca

SEQ ID NO: 237757 - RNA, 22 nt, Human
auuucacucuuaauugcuuccu

SEQ ID NO: 237758 - RNA, 22 nt, Human
auuuauuuucccucaaguaccu

SEQ ID NO: 237759 - RNA, 22 nt, Human
auuuaggacagugucugaauug

SEQ ID NO: 237760 - RNA, 22 nt, Human
auuuagagaaguagcaaggucc

SEQ ID NO: 237761 - RNA, 22 nt, Human
auuuagacaacaagccuucucc

SEQ ID NO: 237762 - RNA, 22 nt, Human
auuuaaaggaagugggugauaa

SEQ ID NO: 237763 - RNA, 22 nt, Human
auuuaaguuacuucucuuuccu

SEQ ID NO: 237764 - RNA, 22 nt, Human
auuuaagugagucuuuaaaaua

SEQ ID NO: 237765 - RNA, 22 nt, Human
auugacuucccaucaggugagu

SEQ ID NO: 237766 - RNA, 22 nt, Human
auuuaaaaacugguacaacagg

SEQ ID NO: 237767 - RNA, 22 nt, Human
auugaaauuaauuucugcuuuc

SEQ ID NO: 237768 - RNA, 22 nt, Human
auuguuuugugaaacauaguga

SEQ ID NO: 237769 - RNA, 22 nt, Human
auugugaaugccugucagucuu

SEQ ID NO: 237770 - RNA, 22 nt, Human
auucuuuauuuucuguacuugc

SEQ ID NO: 237771 - RNA, 22 nt, Human
auuguagucuggacuuuuggga

SEQ ID NO: 237772 - RNA, 22 nt, Human
auuaguagcacacagagaucag

SEQ ID NO: 237773 - RNA, 22 nt, Human
auuagguaguauaaucuuuguu

SEQ ID NO: 237774 - RNA, 22 nt, Human
auuacagauuauaaauuugagc

SEQ ID NO: 237775 - RNA, 22 nt, Human
auuagaagagcuuuuuacucuu

SEQ ID NO: 237776 - RNA, 22 nt, Human
auuaauaucaauauauuauaug

SEQ ID NO: 237777 - RNA, 22 nt, Human
auuaauguguaugauauaaauu

SEQ ID NO: 237778 - RNA, 22 nt, Human
auuacagaagauaugcucaaca

SEQ ID NO: 237779 - RNA, 20 nt, Human
auuaauuuuuagggcucacc

SEQ ID NO: 237780 - RNA, 22 nt, Human
auuuuacuaugauaguugagaa

SEQ ID NO: 237781 - RNA, 22 nt, Human
auuuuaccauuaguuuguaaua

SEQ ID NO: 237782 - RNA, 22 nt, Human
auuucagaguagaucguuauuu

SEQ ID NO: 237783 - RNA, 18 nt, Human
auuuguggggguuauaga

SEQ ID NO: 237784 - RNA, 22 nt, Human
auuugccaguuacucacaccac

SEQ ID NO: 237785 - RNA, 22 nt, Human
auuugcauguuuauuucuuaga

SEQ ID NO: 237786 - RNA, 22 nt, Human
auuugaaguauaaguaauugcu

SEQ ID NO: 237787 - RNA, 22 nt, Human
auuugacuugguaagacuuaag

SEQ ID NO: 237788 - RNA, 22 nt, Human
auuuuugguuucaccugcacgc

SEQ ID NO: 237789 - RNA, 22 nt, Human
auuuuugugucacaucuaggaa

SEQ ID NO: 237790 - RNA, 22 nt, Human
auuuggaaacaugcugaccaug

SEQ ID NO: 237791 - RNA, 22 nt, Human
caaagaugccaaaaggaagaca

SEQ ID NO: 237792 - RNA, 22 nt, Human
caaagaaccuucgagacagggc

SEQ ID NO: 237793 - RNA, 22 nt, Human
caaagaagagauuuacagagcu

SEQ ID NO: 237794 - RNA, 22 nt, Human
caaaagcaaagaucuuugauug

SEQ ID NO: 237795 - RNA, 22 nt, Human
caaaaauacuugccuguaucug

SEQ ID NO: 237796 - RNA, 22 nt, Human
auuuuuuuuccugucucuuuca

SEQ ID NO: 237797 - RNA, 22 nt, Human
caaccaguagcugaguucaaaa

SEQ ID NO: 237798 - RNA, 22 nt, Human
caacacaucaguucagucuuga

SEQ ID NO: 237799 - RNA, 22 nt, Human
caacaagcgcucagagcaaagc

SEQ ID NO: 237800 - RNA, 22 nt, Human
caaauacaaauacgggcagcuu

SEQ ID NO: 237801 - RNA, 22 nt, Human
caaauuuuuauuuaccaucugc

SEQ ID NO: 237802 - RNA, 22 nt, Human
auuuuucucucaugugcaacua

SEQ ID NO: 237803 - RNA, 22 nt, Human
auuuuucacauuuugggggaca

SEQ ID NO: 237804 - RNA, 22 nt, Human
cacaaagugucaggggagagaa

SEQ ID NO: 237805 - RNA, 22 nt, Human
caauugcuuccuucuguaagua

SEQ ID NO: 237806 - RNA, 22 nt, Human
cacaacaaaaaauaaguaugag

SEQ ID NO: 237807 - RNA, 22 nt, Human
cacaagacuaaguggcagagca

SEQ ID NO: 237808 - RNA, 22 nt, Human
caacuucuauucagucugcagu

SEQ ID NO: 237809 - RNA, 22 nt, Human
caacauuucaaggucuuuagga

SEQ ID NO: 237810 - RNA, 20 nt, Human
caacacugcccauuguuugc

SEQ ID NO: 237811 - RNA, 22 nt, Human
caauggguuuucuauagagugc

SEQ ID NO: 237812 - RNA, 22 nt, Human
caaaguauuuagcugacucgcu

SEQ ID NO: 237813 - RNA, 22 nt, Human
caaugaaaauuuaaguugcagc

SEQ ID NO: 237814 - RNA, 22 nt, Human
caaaggaauuacauguuucgga

SEQ ID NO: 237815 - RNA, 22 nt, Human
caaaggauguguagugcaacca

SEQ ID NO: 237816 - RNA, 22 nt, Human
caagugaguauguauuguguag

SEQ ID NO: 237817 - RNA, 22 nt, Human
caauaauugcuuuccagaguua

SEQ ID NO: 237818 - RNA, 22 nt, Human
caaguauuuauugaggcccugu

SEQ ID NO: 237819 - RNA, 22 nt, Human
caaguaugagaaagcuauuacc

SEQ ID NO: 237820 - RNA, 22 nt, Human
caagauauguccuguuacuaag

SEQ ID NO: 237821 - RNA, 22 nt, Human
caaaacauucagagagcucacu

SEQ ID NO: 237822 - RNA, 22 nt, Human
caaagagaugcaccauauuucu

SEQ ID NO: 237823 - RNA, 22 nt, Human
caaggaaaacagaugaucaaca

SEQ ID NO: 237824 - RNA, 22 nt, Human
caagucucuagaaugcaauagu

SEQ ID NO: 237825 - RNA, 22 nt, Human
caauaguaaucaaugcaguuag

SEQ ID NO: 237826 - RNA, 22 nt, Human
caccaccaguaccaucacacgc

SEQ ID NO: 237827 - RNA, 22 nt, Human
caccaucagacuucugggcagg

SEQ ID NO: 237828 - RNA, 22 nt, Human
caaggggagcugguauggaugg

SEQ ID NO: 237829 - RNA, 22 nt, Human
cacauuuuccagaagaaucaga

SEQ ID NO: 237830 - RNA, 22 nt, Human
cacauuucagcacucagggcau

SEQ ID NO: 237831 - RNA, 22 nt, Human
cacaucaaacuuacuaagauuu

SEQ ID NO: 237832 - RNA, 23 nt, Human
cacaggcagaaaucaagacggua

SEQ ID NO: 237833 - RNA, 22 nt, Human
cacaggacuuggcuucucacag

SEQ ID NO: 237834 - RNA, 22 nt, Human
caagcagauauuuuagucaaga

SEQ ID NO: 237835 - RNA, 22 nt, Human
cacaucucagggcuacaggcag

SEQ ID NO: 237836 - RNA, 22 nt, Human
cacauuaagcccaagcauagaa

SEQ ID NO: 237837 - RNA, 22 nt, Human
cacagcagcaucauuuaucugg

SEQ ID NO: 237838 - RNA, 22 nt, Human
caacuucugcuuucuuccuugc

SEQ ID NO: 237839 - RNA, 22 nt, Human
caagaaaaaacaugaugagugu

SEQ ID NO: 237840 - RNA, 22 nt, Human
caagaaccuagcgaucagguaa

SEQ ID NO: 237841 - RNA, 22 nt, Human
caagaaguugacagccagguga

SEQ ID NO: 237842 - RNA, 20 nt, Human
cacagcugacgaguauccaa

SEQ ID NO: 237843 - RNA, 22 nt, Human
augcuaaucaaacuuucugcag

SEQ ID NO: 237844 - RNA, 22 nt, Human
augcuacauuuugguuuauaaa

SEQ ID NO: 237845 - RNA, 22 nt, Human
augcagauguagauucugaaau

SEQ ID NO: 237846 - RNA, 22 nt, Human
augcagcggucagaggaacuca

SEQ ID NO: 237847 - RNA, 22 nt, Human
augcagaaucucuuuccugagg

SEQ ID NO: 237848 - RNA, 19 nt, Human
augcacgugaaaugcauuu

SEQ ID NO: 237849 - RNA, 22 nt, Human
augaucaagaauuuuguauucc

SEQ ID NO: 237850 - RNA, 22 nt, Human
augccccuuuauauguuaaguc

SEQ ID NO: 237851 - RNA, 19 nt, Human
augcaauguuaucaauaac

SEQ ID NO: 237852 - RNA, 22 nt, Human
augcuagaaaauuucauauuau

SEQ ID NO: 237853 - RNA, 22 nt, Human
augcucuuaauugcuagauaag

SEQ ID NO: 237854 - RNA, 22 nt, Human
augcuuuauuggagacagucau

SEQ ID NO: 237855 - RNA, 22 nt, Human
augcuugcccauguuucugaag

SEQ ID NO: 237856 - RNA, 22 nt, Human
augcugcuuguccauuuauuug

SEQ ID NO: 237857 - RNA, 22 nt, Human
augcuucuguugcuuaggaggu

SEQ ID NO: 237858 - RNA, 22 nt, Human
augcugugccuggaaagcggcu

SEQ ID NO: 237859 - RNA, 22 nt, Human
augcuugaaaguuauuucauuu

SEQ ID NO: 237860 - RNA, 22 nt, Human
augaugaugguuuaacuucagg

SEQ ID NO: 237861 - RNA, 22 nt, Human
augaucacagugucagucauua

SEQ ID NO: 237862 - RNA, 22 nt, Human
augaugauuauucauuuucugu

SEQ ID NO: 237863 - RNA, 22 nt, Human
augauuacagcaugauguuuca

SEQ ID NO: 237864 - RNA, 22 nt, Human
augauguuggaauuuuaacuua

SEQ ID NO: 237865 - RNA, 22 nt, Human
augaauuaucugguguuggaaa

SEQ ID NO: 237866 - RNA, 22 nt, Human
augaauuugaacaccagguugg

SEQ ID NO: 237867 - RNA, 22 nt, Human
augaggaacagcaagaauauuu

SEQ ID NO: 237868 - RNA, 22 nt, Human
augauuuguuaacagacuuaau

SEQ ID NO: 237869 - RNA, 22 nt, Human
augcacuacuagaugcaaaagu

SEQ ID NO: 237870 - RNA, 22 nt, Human
augcacuugacucuauuccaca

SEQ ID NO: 237871 - RNA, 22 nt, Human
augauuauuugaaugaagagga

SEQ ID NO: 237872 - RNA, 22 nt, Human
augaccauccagaaguccagcu

SEQ ID NO: 237873 - RNA, 22 nt, Human
augacuauaaauaggagauugu

SEQ ID NO: 237874 - RNA, 22 nt, Human
aucuuaguuauuuggagaaacc

SEQ ID NO: 237875 - RNA, 20 nt, Human
aucugguggggaauaacuuc

SEQ ID NO: 237876 - RNA, 22 nt, Human
aucuucaggggcaauggagaua

SEQ ID NO: 237877 - RNA, 22 nt, Human
aucuucaaggacgccaagaucc

SEQ ID NO: 237878 - RNA, 22 nt, Human
augacugaugcugacucauggg

SEQ ID NO: 237879 - RNA, 22 nt, Human
augagaaauaauuguguacuga

SEQ ID NO: 237880 - RNA, 23 nt, Human
augaaaugauacuuuauucacug

SEQ ID NO: 237881 - RNA, 19 nt, Human
augaaauagcauuuucuga

SEQ ID NO: 237882 - RNA, 22 nt, Human
auuaugugagggacuuaaucau

SEQ ID NO: 237883 - RNA, 22 nt, Human
auuauucaaggugaggguaaaa

SEQ ID NO: 237884 - RNA, 22 nt, Human
auuauuugcuuaagcuggucuc

SEQ ID NO: 237885 - RNA, 22 nt, Human
auuaaacuaaauuaugaauugg

SEQ ID NO: 237886 - RNA, 22 nt, Human
auuaaaaaugagaguagggauu

SEQ ID NO: 237887 - RNA, 22 nt, Human
auuaaagcuaguugagauuuaa

SEQ ID NO: 237888 - RNA, 22 nt, Human
auuaaauagcagaagaaagaug

SEQ ID NO: 237889 - RNA, 18 nt, Human
auucauuugcguuuggcu

SEQ ID NO: 237890 - RNA, 22 nt, Human
auucauuuuuacaucaccaaua

SEQ ID NO: 237891 - RNA, 22 nt, Human
auucaucuguacuucaauaucu

SEQ ID NO: 237892 - RNA, 22 nt, Human
auuaaguuauuaagcuaaauau

SEQ ID NO: 237893 - RNA, 22 nt, Human
auucaaugcacauguuuuggau

SEQ ID NO: 237894 - RNA, 22 nt, Human
auucaguucuaaggucagugcc

SEQ ID NO: 237895 - RNA, 19 nt, Human
auucaagugcuuagagauc

SEQ ID NO: 237896 - RNA, 22 nt, Human
auucaagagcccauguuuccug

SEQ ID NO: 237897 - RNA, 22 nt, Human
auuauaauucauuaggcuuagu

SEQ ID NO: 237898 - RNA, 22 nt, Human
auuauacauuaggagauugauu

SEQ ID NO: 237899 - RNA, 22 nt, Human
auguuuuaaaaaacaggcuacc

SEQ ID NO: 237900 - RNA, 22 nt, Human
auuaugaauuguguuacgaaga

SEQ ID NO: 237901 - RNA, 23 nt, Human
auuaugaagaagacucgccuguu

SEQ ID NO: 237902 - RNA, 21 nt, Human
auuauagugacuaaauugaua

SEQ ID NO: 237903 - RNA, 22 nt, Human
auguuuuuugaaaauguauuuu

SEQ ID NO: 237904 - RNA, 22 nt, Human
auuagaaaugacaugugggaau

SEQ ID NO: 237905 - RNA, 22 nt, Human
auuacugaggcaaaguaguuuu

SEQ ID NO: 237906 - RNA, 22 nt, Human
auuaagacugcccauguuuuua

SEQ ID NO: 237907 - RNA, 22 nt, Human
auuaagucugacuggauuguau

SEQ ID NO: 237908 - RNA, 22 nt, Human
auguuuaauuugaaauuuuauu

SEQ ID NO: 237909 - RNA, 22 nt, Human
auguguuuugaccccugcuaaa

SEQ ID NO: 237910 - RNA, 22 nt, Human
auguauguauguauauacacac

SEQ ID NO: 237911 - RNA, 22 nt, Human
auguaguccuuauuugacauaa

SEQ ID NO: 237912 - RNA, 22 nt, Human
augguuuugugaaaaugcuuug

SEQ ID NO: 237913 - RNA, 22 nt, Human
augguuuuguccucuuugguuc

SEQ ID NO: 237914 - RNA, 22 nt, Human
augugcauguauguaucauauu

SEQ ID NO: 237915 - RNA, 22 nt, Human
auguucucagguuguauuuauu

SEQ ID NO: 237916 - RNA, 22 nt, Human
auguugaguggaugaacaaaca

SEQ ID NO: 237917 - RNA, 22 nt, Human
auguguuuccaacagagaggga

SEQ ID NO: 237918 - RNA, 22 nt, Human
augugucauuauccagaauaac

SEQ ID NO: 237919 - RNA, 21 nt, Human
auguguucugauagugcuugc

SEQ ID NO: 237920 - RNA, 22 nt, Human
auguguguaugugugcauguau

SEQ ID NO: 237921 - RNA, 22 nt, Human
auguguguaugacugaaucuau

SEQ ID NO: 237922 - RNA, 22 nt, Human
augguugugaaagagcaaagac

SEQ ID NO: 237923 - RNA, 22 nt, Human
augguuagcuauuuuucucuca

SEQ ID NO: 237924 - RNA, 22 nt, Human
auguaaauauuuauauaugcau

SEQ ID NO: 237925 - RNA, 22 nt, Human
auguaugagagauucuuuuauu

SEQ ID NO: 237926 - RNA, 22 nt, Human
auguauauauacauguauugua

SEQ ID NO: 237927 - RNA, 22 nt, Human
auguauuuauguauguguuaua

SEQ ID NO: 237928 - RNA, 22 nt, Human
augugaaagagguguucagugg

SEQ ID NO: 237929 - RNA, 22 nt, Human
auauucaaugaggucauauaag

SEQ ID NO: 237930 - RNA, 22 nt, Human
auauuauuaaaauagauggaua

SEQ ID NO: 237931 - RNA, 22 nt, Human
auauuugucuguuuuaguggca

SEQ ID NO: 237932 - RNA, 22 nt, Human
auauuuuacagcucucguugaa

SEQ ID NO: 237933 - RNA, 22 nt, Human
auauuucuacaggcugauuuua

SEQ ID NO: 237934 - RNA, 21 nt, Human
auauuguugggguuuucuuuu

SEQ ID NO: 237935 - RNA, 22 nt, Human
aucaaugggucaaagagaaggu

SEQ ID NO: 237936 - RNA, 22 nt, Human
auauuuuugcagaauuuuucgu

SEQ ID NO: 237937 - RNA, 22 nt, Human
aucaaaauguguagucuugauc

SEQ ID NO: 237938 - RNA, 22 nt, Human
aucagaagaaauggaugugacu

SEQ ID NO: 237939 - RNA, 22 nt, Human
aucacauggauuuuaucuuuug

SEQ ID NO: 237940 - RNA, 22 nt, Human
aucacacaccuguuaaauugug

SEQ ID NO: 237941 - RNA, 22 nt, Human
aucaaaauuuucagauacuaca

SEQ ID NO: 237942 - RNA, 22 nt, Human
aucacaaauggaaucaccuccc

SEQ ID NO: 237943 - RNA, 22 nt, Human
aucaauaaccauagugguuaca

SEQ ID NO: 237944 - RNA, 20 nt, Human
aucaagugucuugccaggca

SEQ ID NO: 237945 - RNA, 22 nt, Human
aucagugcacgcgaugggcaga

SEQ ID NO: 237946 - RNA, 22 nt, Human
aucauaugugauaccauaauga

SEQ ID NO: 237947 - RNA, 22 nt, Human
aucauccuagaaggaagcuagg

SEQ ID NO: 237948 - RNA, 22 nt, Human
aucaugcugacacaguuuaucu

SEQ ID NO: 237949 - RNA, 21 nt, Human
aucagaaucucuagauuugga

SEQ ID NO: 237950 - RNA, 22 nt, Human
aucauguuauguacaaauauga

SEQ ID NO: 237951 - RNA, 22 nt, Human
auccagaaguauuuuggguacu

SEQ ID NO: 237952 - RNA, 22 nt, Human
auccuugacuguagugauauua

SEQ ID NO: 237953 - RNA, 22 nt, Human
auccucucuuaugaacaacugu

SEQ ID NO: 237954 - RNA, 22 nt, Human
aucguuaugauagagaaagaga

SEQ ID NO: 237955 - RNA, 22 nt, Human
aucgcagaguggaaauugauga

SEQ ID NO: 237956 - RNA, 22 nt, Human
aucuaaaacuacgaauacuacc

SEQ ID NO: 237957 - RNA, 22 nt, Human
aucaucuaaaauuggcucagau

SEQ ID NO: 237958 - RNA, 22 nt, Human
auccacuagagggugaacucug

SEQ ID NO: 237959 - RNA, 22 nt, Human
aucauaccaguuuccaucagga

SEQ ID NO: 237960 - RNA, 22 nt, Human
aucauugcuaguaaggaucuug

SEQ ID NO: 237961 - RNA, 22 nt, Human
aucauuuuuauuagcugggguu

SEQ ID NO: 237962 - RNA, 22 nt, Human
aucauuuggaaauuuggccuaa

SEQ ID NO: 237963 - RNA, 22 nt, Human
aucauguauauuuuugcuauua

SEQ ID NO: 237964 - RNA, 22 nt, Human
aucauguauaugcagcguuugu

SEQ ID NO: 237965 - RNA, 22 nt, Human
auccucaaggaauuaaauaggg

SEQ ID NO: 237966 - RNA, 22 nt, Human
aucauuaacagugcagggguag

SEQ ID NO: 237967 - RNA, 22 nt, Human
aucauugaaaauuuaugcauuu

SEQ ID NO: 237968 - RNA, 22 nt, Human
aucauuugaacagaauuuguuu

SEQ ID NO: 237969 - RNA, 22 nt, Human
auauugcuuuauucuugaauau

SEQ ID NO: 237970 - RNA, 21 nt, Human
auauugguaucuuuuuaaauc

SEQ ID NO: 237971 - RNA, 22 nt, Human
auauguuaugccauuuucaagg

SEQ ID NO: 237972 - RNA, 22 nt, Human
auauguuuuaguagaaucccaa

SEQ ID NO: 237973 - RNA, 22 nt, Human
auauaguuggguuucauucuac

SEQ ID NO: 237974 - RNA, 22 nt, Human
auauauacuuugacacauucug

SEQ ID NO: 237975 - RNA, 21 nt, Human
auauggauauuauuuuguguc

SEQ ID NO: 237976 - RNA, 22 nt, Human
auauguaguuucagaaguggaa

SEQ ID NO: 237977 - RNA, 22 nt, Human
auauuuguacagcuugugaguu

SEQ ID NO: 237978 - RNA, 22 nt, Human
auauuugcccccaugcccuggc

SEQ ID NO: 237979 - RNA, 22 nt, Human
auauuuguuagcugcuuuggag

SEQ ID NO: 237980 - RNA, 22 nt, Human
auauuuguuuggcagaguucag

SEQ ID NO: 237981 - RNA, 23 nt, Human
auaugucaugcaccagcacuuua

SEQ ID NO: 237982 - RNA, 22 nt, Human
auauuguagcaucacugucuug

SEQ ID NO: 237983 - RNA, 22 nt, Human
auaucugaugacgugacuaugu

SEQ ID NO: 237984 - RNA, 22 nt, Human
auaugagaggaggagcaucagu

SEQ ID NO: 237985 - RNA, 22 nt, Human
auaugcagaaaauaaaggaauu

SEQ ID NO: 237986 - RNA, 22 nt, Human
auauggugauuuuaugcaggaa

SEQ ID NO: 237987 - RNA, 22 nt, Human
auauaguacauguauauauaua

SEQ ID NO: 237988 - RNA, 22 nt, Human
auagcacuuaauaugaaacagu

SEQ ID NO: 237989 - RNA, 22 nt, Human
auagaugaggaaauucaggugc

SEQ ID NO: 237990 - RNA, 22 nt, Human
auagauguauucauuguuuggc

SEQ ID NO: 237991 - RNA, 22 nt, Human
auauauguauauacacauauau

SEQ ID NO: 237992 - RNA, 22 nt, Human
auauaaugugugcuuuauugaa

SEQ ID NO: 237993 - RNA, 22 nt, Human
auauaugcaacaagaaagcaua

SEQ ID NO: 237994 - RNA, 22 nt, Human
auauauguauauaugugugugu

SEQ ID NO: 237995 - RNA, 22 nt, Human
auaucuaggcugaauguaaaau

SEQ ID NO: 237996 - RNA, 22 nt, Human
auagcaucaugcuaucccccuu

SEQ ID NO: 237997 - RNA, 22 nt, Human
auagcuauuauuauuucuguua

SEQ ID NO: 237998 - RNA, 22 nt, Human
auaguuaucuguggauaagguu

SEQ ID NO: 237999 - RNA, 22 nt, Human
auaguuaagguguacugaagau

SEQ ID NO: 238000 - RNA, 22 nt, Human
auaugcacauguacauguauau

SEQ ID NO: 238001 - RNA, 22 nt, Human
auaugaagaaugaucugaagua

SEQ ID NO: 238002 - RNA, 22 nt, Human
auaucuuguuuuugauuucuug

SEQ ID NO: 238003 - RNA, 22 nt, Human
auaguuuuagauacugagaaaa

SEQ ID NO: 238004 - RNA, 22 nt, Human
auauaagucacauuaaggaggu

SEQ ID NO: 238005 - RNA, 22 nt, Human
auauaaugcaguaggugauuaa

SEQ ID NO: 238006 - RNA, 22 nt, Human
auauaagauaauaacuuuuuua

SEQ ID NO: 238007 - RNA, 22 nt, Human
auagacauuuauagagaaugac

SEQ ID NO: 238008 - RNA, 22 nt, Human
auagagaggaacagcaagaacu

SEQ ID NO: 238009 - RNA, 22 nt, Human
auagaauggcaccagcaucuac

SEQ ID NO: 238010 - RNA, 22 nt, Human
auaguaaauguuaacagcaaca

SEQ ID NO: 238011 - RNA, 22 nt, Human
auagcaguauuaugagauaacu

SEQ ID NO: 238012 - RNA, 19 nt, Human
auagcagaagucauuuuca

SEQ ID NO: 238013 - RNA, 22 nt, Human
auaggacuguacagaauacaag

SEQ ID NO: 238014 - RNA, 22 nt, Human
auacuacaucacagccaagaag

SEQ ID NO: 238015 - RNA, 22 nt, Human
auacugagauguuaauagggug

SEQ ID NO: 238016 - RNA, 22 nt, Human
auacauauaugcacauuaauau

SEQ ID NO: 238017 - RNA, 22 nt, Human
auacaucuuaacgcgcucuugg

SEQ ID NO: 238018 - RNA, 22 nt, Human
auagacuagccaaagacuucug

SEQ ID NO: 238019 - RNA, 22 nt, Human
auagaguguguguuauguguga

SEQ ID NO: 238020 - RNA, 22 nt, Human
auaccaaugaaucccugagaau

SEQ ID NO: 238021 - RNA, 22 nt, Human
auacaugugugugcauacaugu

SEQ ID NO: 238022 - RNA, 21 nt, Human
auaccaaaagaacaccuuguu

SEQ ID NO: 238023 - RNA, 22 nt, Human
auagauuuuaucagauuuuauc

SEQ ID NO: 238024 - RNA, 22 nt, Human
auagauugcucauauauuacuu

SEQ ID NO: 238025 - RNA, 22 nt, Human
auagaugacaguuaggaagcug

SEQ ID NO: 238026 - RNA, 22 nt, Human
agugaaaacugaaucaccuucc

SEQ ID NO: 238027 - RNA, 21 nt, Human
agugagugacagaagaagguu

SEQ ID NO: 238028 - RNA, 22 nt, Human
agugaauuagccuauuuguaaa

SEQ ID NO: 238029 - RNA, 23 nt, Human
auacuuuuuuucuacguuaucuc

SEQ ID NO: 238030 - RNA, 22 nt, Human
auagaaauagacaaugcaaaga

SEQ ID NO: 238031 - RNA, 22 nt, Human
auacuuccugcuucccugaucu

SEQ ID NO: 238032 - RNA, 22 nt, Human
uuuuuuuccaguuauucauuuu

SEQ ID NO: 238033 - RNA, 22 nt, Human
uuuuuguuauuuagguguagag

SEQ ID NO: 238034 - RNA, 22 nt, Human
uuuuugggccaaauauauuuac

SEQ ID NO: 238035 - RNA, 22 nt, Human
uuuuuuuagaaagaucauaguu

SEQ ID NO: 238036 - RNA, 22 nt, Human
uuuuuuuaaguuuugauuuuag

SEQ ID NO: 238037 - RNA, 22 nt, Human
uuuuuugguuuggggauuauuu

SEQ ID NO: 238038 - RNA, 22 nt, Human
uuuuucuccauuccaggugccu

SEQ ID NO: 238039 - RNA, 21 nt, Human
uuuuucuccagaguuuccacu

SEQ ID NO: 238040 - RNA, 22 nt, Human
uuuuuaaaauuaggacggcacg

SEQ ID NO: 238041 - RNA, 22 nt, Human
uuuuguuacugauuauuaaaau

SEQ ID NO: 238042 - RNA, 22 nt, Human
uuuuuagcauaugucaaaucag

SEQ ID NO: 238043 - RNA, 22 nt, Human
uuuuuaauuuuaagcuauuugu

SEQ ID NO: 238044 - RNA, 22 nt, Human
uuuuucagacuaauagggcaua

SEQ ID NO: 238045 - RNA, 22 nt, Human
uuuuucacacuccuuuccaguu

SEQ ID NO: 238046 - RNA, 22 nt, Human
uuuuuauaagauuuaaaaugua

SEQ ID NO: 238047 - RNA, 22 nt, Human
uuuuuagggauuaguguuugag

SEQ ID NO: 238048 - RNA, 21 nt, Human
uuuuguguugcgcacuuugag

SEQ ID NO: 238049 - RNA, 22 nt, Human
uuuugucuguggaaagcugcua

SEQ ID NO: 238050 - RNA, 22 nt, Human
uuuuggauugcuaacucagggu

SEQ ID NO: 238051 - RNA, 22 nt, Human
uuuuggaaaaaccaguauggaa

SEQ ID NO: 238052 - RNA, 22 nt, Human
uuuugguaguccagaguuuagu

SEQ ID NO: 238053 - RNA, 22 nt, Human
uuuugguauggcuugauagagu

SEQ ID NO: 238054 - RNA, 22 nt, Human
uuuuccuuccugucucuuuauu

SEQ ID NO: 238055 - RNA, 23 nt, Human
uuuuccaaaucgacucucuaguu

SEQ ID NO: 238056 - RNA, 22 nt, Human
uuuucuacaaucacucuggaag

SEQ ID NO: 238057 - RNA, 22 nt, Human
uuuucuaggcccuggauuaugu

SEQ ID NO: 238058 - RNA, 22 nt, Human
uuuucggagaauguuaaugugu

SEQ ID NO: 238059 - RNA, 22 nt, Human
uuuucuguuuaugaaauugugu

SEQ ID NO: 238060 - RNA, 22 nt, Human
uuuucucuuugcuucucuaaaa

SEQ ID NO: 238061 - RNA, 22 nt, Human
uuuucuucggugcuggguugau

SEQ ID NO: 238062 - RNA, 22 nt, Human
uuuugcaaauuacuaaauuucu

SEQ ID NO: 238063 - RNA, 22 nt, Human
uuuugaauaauucagaaacagc

SEQ ID NO: 238064 - RNA, 22 nt, Human
uuuugagucuggcaguuuuguu

SEQ ID NO: 238065 - RNA, 22 nt, Human
uuuugauacaaguuguaaaaaa

SEQ ID NO: 238066 - RNA, 22 nt, Human
uuuuaggauuugaguugcugga

SEQ ID NO: 238067 - RNA, 22 nt, Human
uuuuagccagaguuuaucacag

SEQ ID NO: 238068 - RNA, 22 nt, Human
uuuuaucagagcuugcagugug

SEQ ID NO: 238069 - RNA, 22 nt, Human
uuuuauaaaaccuguuugaccu

SEQ ID NO: 238070 - RNA, 22 nt, Human
uuuuaguaauacuuuggccuuu

SEQ ID NO: 238071 - RNA, 22 nt, Human
uuuucaauuuucauuugcaaga

SEQ ID NO: 238072 - RNA, 22 nt, Human
uuuucaaucaaguuuauuuaua

SEQ ID NO: 238073 - RNA, 22 nt, Human
uuuucaguuccaucucugcucu

SEQ ID NO: 238074 - RNA, 22 nt, Human
uuuucacugacuuggucuggaa

SEQ ID NO: 238075 - RNA, 22 nt, Human
uuuucaacuuuauuuuccccca

SEQ ID NO: 238076 - RNA, 22 nt, Human
uuuuaucuuacauggaaucucc

SEQ ID NO: 238077 - RNA, 22 nt, Human
uuuuacauuuuauucguuuauu

SEQ ID NO: 238078 - RNA, 22 nt, Human
uuuuaacuuuggguucucuuua

SEQ ID NO: 238079 - RNA, 23 nt, Human
uuuuacaagagugcauuugucuc

SEQ ID NO: 238080 - RNA, 23 nt, Human
uuuuaauaguaugacaugagcug

SEQ ID NO: 238081 - RNA, 22 nt, Human
uuuuaauaguauaucuagacac

SEQ ID NO: 238082 - RNA, 22 nt, Human
uuuuaaaguaauugaagcuugu

SEQ ID NO: 238083 - RNA, 22 nt, Human
uuuuaaaagguugcuguuauaa

SEQ ID NO: 238084 - RNA, 22 nt, Human
uuuagagauaaaugcucuccca

SEQ ID NO: 238085 - RNA, 22 nt, Human
uuuguguuggaagaaaugcuac

SEQ ID NO: 238086 - RNA, 22 nt, Human
uuuacuauuaguauuucauuuu

SEQ ID NO: 238087 - RNA, 22 nt, Human
uuuacucagucugagcaggugu

SEQ ID NO: 238088 - RNA, 22 nt, Human
uuuaaugucuuuggccuuuaau

SEQ ID NO: 238089 - RNA, 22 nt, Human
uuuaaugucuuggaaaaagacu

SEQ ID NO: 238090 - RNA, 22 nt, Human
uuuguuuauuuacuuugggccu

SEQ ID NO: 238091 - RNA, 22 nt, Human
uuuguugucuucauaauacuuu

SEQ ID NO: 238092 - RNA, 23 nt, Human
uuuguugguuuaagaguagcaga

SEQ ID NO: 238093 - RNA, 19 nt, Human
uuuguuguaucagagcuuu

SEQ ID NO: 238094 - RNA, 22 nt, Human
uuuguugaauggcaggauuuua

SEQ ID NO: 238095 - RNA, 21 nt, Human
uuuguucaggggcaaaguuaa

SEQ ID NO: 238096 - RNA, 22 nt, Human
uuuuuauguaaaauauuaaaag

SEQ ID NO: 238097 - RNA, 22 nt, Human
uuuuucuccucucucuuucauu

SEQ ID NO: 238098 - RNA, 22 nt, Human
uuuuuaccugguguccagcuuc

SEQ ID NO: 238099 - RNA, 22 nt, Human
uuuuuagcuguuauuguggaag

SEQ ID NO: 238100 - RNA, 22 nt, Human
uuuuuauaagagcagcagaguu

SEQ ID NO: 238101 - RNA, 22 nt, Human
uuuuuaagguuuguuuauauau

SEQ ID NO: 238102 - RNA, 22 nt, Human
uuuuguuuacauuaaauuuuga

SEQ ID NO: 238103 - RNA, 22 nt, Human
uuuuuaaaagaugauuuaauga

SEQ ID NO: 238104 - RNA, 18 nt, Human
uuuuguguuuauucugca

SEQ ID NO: 238105 - RNA, 22 nt, Human
uucuuaaugcauccuguguuca

SEQ ID NO: 238106 - RNA, 22 nt, Human
uucuuacuaaguagaguacuca

SEQ ID NO: 238107 - RNA, 22 nt, Human
uuuugguuugaguauuuuuuuu

SEQ ID NO: 238108 - RNA, 22 nt, Human
uuuuguagauuggaaaaucugg

SEQ ID NO: 238109 - RNA, 22 nt, Human
uucuguguauggaagaaugucc

SEQ ID NO: 238110 - RNA, 22 nt, Human
uucuguucugcuuucuccaucc

SEQ ID NO: 238111 - RNA, 22 nt, Human
uuuuuuguggcuggaagaaaaa

SEQ ID NO: 238112 - RNA, 19 nt, Human
uugaauguuugauagucuc

SEQ ID NO: 238113 - RNA, 22 nt, Human
uugaaucauauguaauugacuu

SEQ ID NO: 238114 - RNA, 22 nt, Human
uugaauggaauuggaaucuuau

SEQ ID NO: 238115 - RNA, 18 nt, Human
uuuuuuguucuguuuugu

SEQ ID NO: 238116 - RNA, 22 nt, Human
uuuuuuguuccuugguuuuugu

SEQ ID NO: 238117 - RNA, 22 nt, Human
uugacuauacucuggcggaaaa

SEQ ID NO: 238118 - RNA, 22 nt, Human
uuuuuuuuacuccggacagcuc

SEQ ID NO: 238119 - RNA, 22 nt, Human
uuuuuuuguagguguaugaaaa

SEQ ID NO: 238120 - RNA, 22 nt, Human
uugaaaauuaauagguguacaa

SEQ ID NO: 238121 - RNA, 22 nt, Human
uugaaaaguuuguuacucacau

SEQ ID NO: 238122 - RNA, 20 nt, Human
uugaaagucagggcuccagu

SEQ ID NO: 238123 - RNA, 22 nt, Human
uuuuuucuucucuaucuuaaua

SEQ ID NO: 238124 - RNA, 22 nt, Human
uuuuuuccuguuugucuuuggg

SEQ ID NO: 238125 - RNA, 22 nt, Human
uucgucauuguuguugguuuuc

SEQ ID NO: 238126 - RNA, 22 nt, Human
uuccuaauugccaugaaguuau

SEQ ID NO: 238127 - RNA, 22 nt, Human
uuuguucuagauaacugguaau

SEQ ID NO: 238128 - RNA, 22 nt, Human
uucguugaagcaacgacuuugg

SEQ ID NO: 238129 - RNA, 22 nt, Human
uuuuauguuccugaagcuaucu

SEQ ID NO: 238130 - RNA, 19 nt, Human
uuuucaacguccgguucau

SEQ ID NO: 238131 - RNA, 22 nt, Human
uuuuauuuguauguugaaugua

SEQ ID NO: 238132 - RNA, 22 nt, Human
uucuagauagucugauauuccu

SEQ ID NO: 238133 - RNA, 22 nt, Human
uucuaguuacagaagccuugcu

SEQ ID NO: 238134 - RNA, 20 nt, Human
uucuccacaggguggaggag

SEQ ID NO: 238135 - RNA, 22 nt, Human
uucuguacuagaucuuaucagu

SEQ ID NO: 238136 - RNA, 22 nt, Human
uuuuggagaaaugggacuuaau

SEQ ID NO: 238137 - RNA, 20 nt, Human
uucuguggcccguuuaagug

SEQ ID NO: 238138 - RNA, 22 nt, Human
uucucugcgcuccggcccaguu

SEQ ID NO: 238139 - RNA, 22 nt, Human
uucugaaggcaggggcuaucuu

SEQ ID NO: 238140 - RNA, 22 nt, Human
uucugaaacauugcuauuuucc

SEQ ID NO: 238141 - RNA, 22 nt, Human
uuuucugauccuucuaacuuga

SEQ ID NO: 238142 - RNA, 22 nt, Human
uuuuccgaccuuaggaaggaac

SEQ ID NO: 238143 - RNA, 22 nt, Human
uuggggccggcgcggaggaggg

SEQ ID NO: 238144 - RNA, 22 nt, Human
uugguaccaagcaaacuuucug

SEQ ID NO: 238145 - RNA, 22 nt, Human
uugguauuuguuuaaauuacac

SEQ ID NO: 238146 - RNA, 22 nt, Human
uuggugaugaaagugcugcgcu

SEQ ID NO: 238147 - RNA, 22 nt, Human
uuggugaugcccaccuuuucau

SEQ ID NO: 238148 - RNA, 22 nt, Human
uuggugaugcuaggaauguagu

SEQ ID NO: 238149 - RNA, 22 nt, Human
uuguacuuguucuguuuccuug

SEQ ID NO: 238150 - RNA, 20 nt, Human
uuguacuuaugugagaagga

SEQ ID NO: 238151 - RNA, 19 nt, Human
uugucuuagcugcauaaga

SEQ ID NO: 238152 - RNA, 22 nt, Human
uuguauaaagauggcuagaucc

SEQ ID NO: 238153 - RNA, 22 nt, Human
uuuaaaacagcauuuaaaaggu

SEQ ID NO: 238154 - RNA, 22 nt, Human
uuuaaaacaguacguuuucuua

SEQ ID NO: 238155 - RNA, 22 nt, Human
uuguuuuucucuagggaaggcu

SEQ ID NO: 238156 - RNA, 22 nt, Human
uuguuuucuaguguuuugaaua

SEQ ID NO: 238157 - RNA, 22 nt, Human
uuguuuguaaggcucuuagaau

SEQ ID NO: 238158 - RNA, 22 nt, Human
uuuaacauaugaaagaauauuu

SEQ ID NO: 238159 - RNA, 22 nt, Human
uuuaaauuucugaaucuugagg

SEQ ID NO: 238160 - RNA, 22 nt, Human
uuuaaacuaacaguacacguug

SEQ ID NO: 238161 - RNA, 22 nt, Human
uuuaaaccuaucuaagaaauag

SEQ ID NO: 238162 - RNA, 22 nt, Human
uuuaaaccuuggaagccacaua

SEQ ID NO: 238163 - RNA, 22 nt, Human
uuuaaucaauaaccuccugggu

SEQ ID NO: 238164 - RNA, 22 nt, Human
uuuaaucaguugguaauauuga

SEQ ID NO: 238165 - RNA, 22 nt, Human
uuuaaugaugucuaugccuguu

SEQ ID NO: 238166 - RNA, 18 nt, Human
uuuaauaagccuguuaug

SEQ ID NO: 238167 - RNA, 22 nt, Human
uuuaaguuaguauggguuaggu

SEQ ID NO: 238168 - RNA, 22 nt, Human
uuuaauauuacacuuaccuugu

SEQ ID NO: 238169 - RNA, 22 nt, Human
uuggaaaugcauuuguuauuau

SEQ ID NO: 238170 - RNA, 22 nt, Human
uuggaagacagccgucuuuauu

SEQ ID NO: 238171 - RNA, 22 nt, Human
uugcugguggcucugauuucau

SEQ ID NO: 238172 - RNA, 22 nt, Human
uugcuuaaaucgcuuaaacugg

SEQ ID NO: 238173 - RNA, 22 nt, Human
uugcuuucuuuguagguuuucc

SEQ ID NO: 238174 - RNA, 22 nt, Human
uugcuggaguagaaaacuuaac

SEQ ID NO: 238175 - RNA, 22 nt, Human
uugcugggauucauugaagggu

SEQ ID NO: 238176 - RNA, 22 nt, Human
uugaguuuacauuguauuagcc

SEQ ID NO: 238177 - RNA, 22 nt, Human
uugcaugauuuaagaauaucug

SEQ ID NO: 238178 - RNA, 22 nt, Human
uugcauauguccagccaugcau

SEQ ID NO: 238179 - RNA, 22 nt, Human
uugcagugucaucuagacgugg

SEQ ID NO: 238180 - RNA, 22 nt, Human
uugcguaauuugagauuguaaa

SEQ ID NO: 238181 - RNA, 20 nt, Human
uugcggccuaacagccccuu

SEQ ID NO: 238182 - RNA, 22 nt, Human
uugccauacuugaaaggagaaa

SEQ ID NO: 238183 - RNA, 22 nt, Human
uuauuuaagaucuuaauauaua

SEQ ID NO: 238184 - RNA, 22 nt, Human
uuauuucuucucgaagcuuggg

SEQ ID NO: 238185 - RNA, 22 nt, Human
uuucugaugaaguagaaagacc

SEQ ID NO: 238186 - RNA, 22 nt, Human
uuucugagccacauauaauuug

SEQ ID NO: 238187 - RNA, 22 nt, Human
uuucucugggugaugagguggc

SEQ ID NO: 238188 - RNA, 22 nt, Human
uuucuuccaucuggcuuuauuu

SEQ ID NO: 238189 - RNA, 22 nt, Human
uuucuguucuguuggauucuuu

SEQ ID NO: 238190 - RNA, 22 nt, Human
uuucuuaaaagcuuuuaaaguu

SEQ ID NO: 238191 - RNA, 22 nt, Human
uuugaugagaaaugacuuaagu

SEQ ID NO: 238192 - RNA, 22 nt, Human
uuugaguacagcugccuuuuug

SEQ ID NO: 238193 - RNA, 22 nt, Human
uuugagaaugucaaucacaaga

SEQ ID NO: 238194 - RNA, 22 nt, Human
uuugaguaagauguugauacug

SEQ ID NO: 238195 - RNA, 22 nt, Human
uuugaauauacuucaaacaaag

SEQ ID NO: 238196 - RNA, 22 nt, Human
uucaaaccuaucuaagaaauag

SEQ ID NO: 238197 - RNA, 22 nt, Human
uucaacaacuugguucaaaugg

SEQ ID NO: 238198 - RNA, 22 nt, Human
uucaaacacugugcaauugggu

SEQ ID NO: 238199 - RNA, 22 nt, Human
uucaaacaguguagaauauaug

SEQ ID NO: 238200 - RNA, 22 nt, Human
uucaaaaugcagaauaguuugg

SEQ ID NO: 238201 - RNA, 22 nt, Human
uuugaaaggagcuuuauccaga

SEQ ID NO: 238202 - RNA, 22 nt, Human
uuugaagauaaauauggagaaa

SEQ ID NO: 238203 - RNA, 22 nt, Human
uuucuuuuucuacaccuuagcu

SEQ ID NO: 238204 - RNA, 22 nt, Human
uuauuuuuguaacacuguauag

SEQ ID NO: 238205 - RNA, 22 nt, Human
uuucuuugggcccuggcagucu

SEQ ID NO: 238206 - RNA, 22 nt, Human
uuauuuuguagcucugaucuuu

SEQ ID NO: 238207 - RNA, 22 nt, Human
uuauuuuuaggaauguagaggu

SEQ ID NO: 238208 - RNA, 22 nt, Human
uucaguuccucuuuugggcucu

SEQ ID NO: 238209 - RNA, 22 nt, Human
uucaguaugcugaaugauuuuu

SEQ ID NO: 238210 - RNA, 22 nt, Human
uucaguuugaauucuguagaac

SEQ ID NO: 238211 - RNA, 22 nt, Human
uuuggguauuaguuuagcuaga

SEQ ID NO: 238212 - RNA, 22 nt, Human
uuuggggcucauuugcuuuugu

SEQ ID NO: 238213 - RNA, 22 nt, Human
uuugggguuuuuuggugaaauc

SEQ ID NO: 238214 - RNA, 22 nt, Human
uucagacugcccauguuugcca

SEQ ID NO: 238215 - RNA, 22 nt, Human
uuugauuuuuugagcaguguau

SEQ ID NO: 238216 - RNA, 23 nt, Human
uuugcaaauuggacacaaccaca

SEQ ID NO: 238217 - RNA, 22 nt, Human
uuugcauuaguuuagauuucaa

SEQ ID NO: 238218 - RNA, 22 nt, Human
uucaggggcaaauacauuuuga

SEQ ID NO: 238219 - RNA, 22 nt, Human
uuugcauuugagagaggaaaca

SEQ ID NO: 238220 - RNA, 22 nt, Human
uuuggcaagcagaugaagguag

SEQ ID NO: 238221 - RNA, 22 nt, Human
uuuggccauuuguaugcaugau

SEQ ID NO: 238222 - RNA, 22 nt, Human
uuuguguuuucaggcacauggc

SEQ ID NO: 238223 - RNA, 22 nt, Human
uuccccagaaaaguaaacaagg

SEQ ID NO: 238224 - RNA, 22 nt, Human
uuuguuaugguuggaagcagga

SEQ ID NO: 238225 - RNA, 17 nt, Human
uuugugauggcagaugc

SEQ ID NO: 238226 - RNA, 22 nt, Human
uucccauuccagcucgaucaau

SEQ ID NO: 238227 - RNA, 22 nt, Human
uuuguauuguuuauuucauuuu

SEQ ID NO: 238228 - RNA, 22 nt, Human
uuugguguuuucaggaauauac

SEQ ID NO: 238229 - RNA, 22 nt, Human
uuuguacuuucuaauguauuua

SEQ ID NO: 238230 - RNA, 21 nt, Human
uucauucauggcauaauauag

SEQ ID NO: 238231 - RNA, 22 nt, Human
uucauuuccauuuuauagauaa

SEQ ID NO: 238232 - RNA, 22 nt, Human
uucauugauuuccuuggaauaa

SEQ ID NO: 238233 - RNA, 22 nt, Human
uuuguaaguuuguucuccuggg

SEQ ID NO: 238234 - RNA, 22 nt, Human
uuucauguuggauacuguuuca

SEQ ID NO: 238235 - RNA, 22 nt, Human
uuuccagacaugguuuuucaaa

SEQ ID NO: 238236 - RNA, 22 nt, Human
uuauauuuuauuuaauuaaaua

SEQ ID NO: 238237 - RNA, 22 nt, Human
uuaucaaaaaauaguacuuuga

SEQ ID NO: 238238 - RNA, 22 nt, Human
uuaucugugcuuuacugacaga

SEQ ID NO: 238239 - RNA, 22 nt, Human
uuaucuguuuuaaugaauaauu

SEQ ID NO: 238240 - RNA, 22 nt, Human
uuaugggcgaugcaaaccugau

SEQ ID NO: 238241 - RNA, 22 nt, Human
uuauaguuuucaaggauuggag

SEQ ID NO: 238242 - RNA, 22 nt, Human
uuucacugaguaggagagcacu

SEQ ID NO: 238243 - RNA, 22 nt, Human
uuucacuucgaucagaguuuuu

SEQ ID NO: 238244 - RNA, 22 nt, Human
uuauacuucugccagaggacaa

SEQ ID NO: 238245 - RNA, 22 nt, Human
uuucaugauuaacuuagugaau

SEQ ID NO: 238246 - RNA, 22 nt, Human
uuauauuaaaaaucgcuaacag

SEQ ID NO: 238247 - RNA, 22 nt, Human
uuucagguggaaguuuuagaug

SEQ ID NO: 238248 - RNA, 22 nt, Human
uuucagaaauggcacugaaauc

SEQ ID NO: 238249 - RNA, 22 nt, Human
uuucagacugcccauguuugcc

SEQ ID NO: 238250 - RNA, 22 nt, Human
uuucuacacuucgugguguuuu

SEQ ID NO: 238251 - RNA, 22 nt, Human
uuucuauuuacagugcuaggua

SEQ ID NO: 238252 - RNA, 22 nt, Human
uuucuaaaauuacugcagucgg

SEQ ID NO: 238253 - RNA, 22 nt, Human
uuuccuuuguuuugguauaugu

SEQ ID NO: 238254 - RNA, 22 nt, Human
uuauuguagcacuuuggcagug

SEQ ID NO: 238255 - RNA, 22 nt, Human
uuaugucauuugaauuaauuuu

SEQ ID NO: 238256 - RNA, 22 nt, Human
uuaugguuuaauauccagcaca

SEQ ID NO: 238257 - RNA, 22 nt, Human
uuauguugauaggaaucugauu

SEQ ID NO: 238258 - RNA, 22 nt, Human
uuauuccauagaagucaaggaa

SEQ ID NO: 238259 - RNA, 22 nt, Human
uuauucuuagccucgguauuuc

SEQ ID NO: 238260 - RNA, 22 nt, Human
uuuaggaagaucugaaggaaga

SEQ ID NO: 238261 - RNA, 19 nt, Human
uuuagcuacugugguauua

SEQ ID NO: 238262 - RNA, 22 nt, Human
uuuagcaaggagaaauaauccu

SEQ ID NO: 238263 - RNA, 22 nt, Human
uuagagaauagacuuuacccug

SEQ ID NO: 238264 - RNA, 22 nt, Human
uuacuggaauauaaagauaaga

SEQ ID NO: 238265 - RNA, 22 nt, Human
uuacucucugaggcacucaaaa

SEQ ID NO: 238266 - RNA, 22 nt, Human
uuagaauggaaucauuugcauu

SEQ ID NO: 238267 - RNA, 22 nt, Human
uuuacaagucuguugaucccaa

SEQ ID NO: 238268 - RNA, 21 nt, Human
uguuugcuuuuggagcaacug

SEQ ID NO: 238269 - RNA, 22 nt, Human
uguuugaugugcacgugugugu

SEQ ID NO: 238270 - RNA, 22 nt, Human
uuuaucucugcauagaagugau

SEQ ID NO: 238271 - RNA, 22 nt, Human
uuaggaauugcuucauguuugg

SEQ ID NO: 238272 - RNA, 22 nt, Human
uuuaucaucuucugaauuugga

SEQ ID NO: 238273 - RNA, 22 nt, Human
uuuaucaggccaucuuaugucu

SEQ ID NO: 238274 - RNA, 22 nt, Human
uuagccuccaguuuucucauuu

SEQ ID NO: 238275 - RNA, 22 nt, Human
uuagcccaggacuuuuuauagc

SEQ ID NO: 238276 - RNA, 22 nt, Human
uuagagagaggagagagagaga

SEQ ID NO: 238277 - RNA, 22 nt, Human
uuagcacugucugguuaucuug

SEQ ID NO: 238278 - RNA, 19 nt, Human
uuuauuugagacaugccuu

SEQ ID NO: 238279 - RNA, 22 nt, Human
uuuaugauguagccuagagcug

SEQ ID NO: 238280 - RNA, 22 nt, Human
uuuauuuacuuucgguucugcu

SEQ ID NO: 238281 - RNA, 22 nt, Human
uuuauugcuaugucuugauugu

SEQ ID NO: 238282 - RNA, 22 nt, Human
uuauaaaccgcuaacagcacuu

SEQ ID NO: 238283 - RNA, 22 nt, Human
uuucacauacaguguauaguag

SEQ ID NO: 238284 - RNA, 19 nt, Human
uuucacaaagagagcguga

SEQ ID NO: 238285 - RNA, 22 nt, Human
uuucaaguagagggaucgcuag

SEQ ID NO: 238286 - RNA, 22 nt, Human
uggcuugacaucaauacuuauu

SEQ ID NO: 238287 - RNA, 22 nt, Human
uuccccuuaagagacaguugga

SEQ ID NO: 238288 - RNA, 22 nt, Human
uucuagaagggccuaggcauaa

SEQ ID NO: 238289 - RNA, 22 nt, Human
ugggguguuacacaacauugag

SEQ ID NO: 238290 - RNA, 22 nt, Human
uucuagacaauugaaaacuguu

SEQ ID NO: 238291 - RNA, 22 nt, Human
uucuagcucauggugacagauc

SEQ ID NO: 238292 - RNA, 22 nt, Human
uucucaauggcaacuuguugcu

SEQ ID NO: 238293 - RNA, 18 nt, Human
uucuaaauucuguuuuua

SEQ ID NO: 238294 - RNA, 22 nt, Human
uucuaauauuaugauuucuaag

SEQ ID NO: 238295 - RNA, 22 nt, Human
uucguucagcgcuugcgcaugc

SEQ ID NO: 238296 - RNA, 22 nt, Human
uucuaagaaauggaaaacgauu

SEQ ID NO: 238297 - RNA, 22 nt, Human
uucagguacuaagugcugauuc

SEQ ID NO: 238298 - RNA, 22 nt, Human
uucagguuuuaugguaaugcuu

SEQ ID NO: 238299 - RNA, 22 nt, Human
uggcauuuuguagcuguguauc

SEQ ID NO: 238300 - RNA, 22 nt, Human
uucagguuuuuaaguucugccu

SEQ ID NO: 238301 - RNA, 22 nt, Human
uggccaaucagcugugaccugc

SEQ ID NO: 238302 - RNA, 22 nt, Human
uucaguuuugcuuuuaaucaug

SEQ ID NO: 238303 - RNA, 22 nt, Human
uucauagaagggaguuuuuccu

SEQ ID NO: 238304 - RNA, 22 nt, Human
uucauauuguggucuugcauuc

SEQ ID NO: 238305 - RNA, 22 nt, Human
uucauacuguuuaaguucuguu

SEQ ID NO: 238306 - RNA, 22 nt, Human
uucauaugaauuggguuuuuuu

SEQ ID NO: 238307 - RNA, 19 nt, Human
uuccacugcuuagcauugc

SEQ ID NO: 238308 - RNA, 22 nt, Human
uuccacuguucaguucugguca

SEQ ID NO: 238309 - RNA, 22 nt, Human
uggcucuucucaagcauuggcu

SEQ ID NO: 238310 - RNA, 22 nt, Human
uucauuagcguaggauguguac

SEQ ID NO: 238311 - RNA, 22 nt, Human
uucauugcuacuuaaaauacca

SEQ ID NO: 238312 - RNA, 22 nt, Human
uucaugucuuugauucugauaa

SEQ ID NO: 238313 - RNA, 22 nt, Human
uucauuauuaauaauagcagcu

SEQ ID NO: 238314 - RNA, 22 nt, Human
uucagaauguacugauagaaca

SEQ ID NO: 238315 - RNA, 21 nt, Human
uggcauacugcuaaaaagugu

SEQ ID NO: 238316 - RNA, 22 nt, Human
uucagcaagugucucuacuguc

SEQ ID NO: 238317 - RNA, 22 nt, Human
uucaggaucuaggaguauuuuu

SEQ ID NO: 238318 - RNA, 22 nt, Human
uucacuuuuuccugguccauuu

SEQ ID NO: 238319 - RNA, 22 nt, Human
uggcagaaugaagacuggggcc

SEQ ID NO: 238320 - RNA, 22 nt, Human
uggauauuuuguaugugcguuu

SEQ ID NO: 238321 - RNA, 21 nt, Human
uggauauugaguaguuucuga

SEQ ID NO: 238322 - RNA, 22 nt, Human
uucaauuacaucagaaucuaaa

SEQ ID NO: 238323 - RNA, 22 nt, Human
uucaauggaauucuuagguuuc

SEQ ID NO: 238324 - RNA, 23 nt, Human
uucaccaaugcuguccaaguacc

SEQ ID NO: 238325 - RNA, 22 nt, Human
uucacauucauuucuuauguuu

SEQ ID NO: 238326 - RNA, 21 nt, Human
uucaaccagcaauuggcagaa

SEQ ID NO: 238327 - RNA, 22 nt, Human
uuauuuuuguuuguuaagccua

SEQ ID NO: 238328 - RNA, 22 nt, Human
uggaggaggaugcauuuguugu

SEQ ID NO: 238329 - RNA, 22 nt, Human
uuauuuaaguauuuauugaagu

SEQ ID NO: 238330 - RNA, 22 nt, Human
uuauuuucgugugugugugugu

SEQ ID NO: 238331 - RNA, 22 nt, Human
uuauuuuauaaagagaagacuu

SEQ ID NO: 238332 - RNA, 22 nt, Human
uuauuugguuuuggcuuuagcu

SEQ ID NO: 238333 - RNA, 22 nt, Human
uuauuucaggcauuuguaaaug

SEQ ID NO: 238334 - RNA, 22 nt, Human
uuauuucauguaaaauuuaugu

SEQ ID NO: 238335 - RNA, 22 nt, Human
uuauuugcccauguuuagcaga

SEQ ID NO: 238336 - RNA, 22 nt, Human
uuauuuaaaauguagguuggga

SEQ ID NO: 238337 - RNA, 22 nt, Human
uuauuguuuggguauaauuuga

SEQ ID NO: 238338 - RNA, 22 nt, Human
uuauuaauacaugcaccugcau

SEQ ID NO: 238339 - RNA, 22 nt, Human
ugcuauuuuguuuucaguccau

SEQ ID NO: 238340 - RNA, 22 nt, Human
ugcuaguuuuugauacuuuugc

SEQ ID NO: 238341 - RNA, 22 nt, Human
ugcuauuaagagaaagugaaca

SEQ ID NO: 238342 - RNA, 20 nt, Human
ugcuaucugcucucccuucu

SEQ ID NO: 238343 - RNA, 22 nt, Human
uucuguuuaaccuggaaagugu

SEQ ID NO: 238344 - RNA, 22 nt, Human
uucuguucuuuguccccuuggu

SEQ ID NO: 238345 - RNA, 22 nt, Human
uggugcaggauuuauuuaacua

SEQ ID NO: 238346 - RNA, 22 nt, Human
uucugaugccuggguugcuucu

SEQ ID NO: 238347 - RNA, 22 nt, Human
uucuuggcacagaugagauucu

SEQ ID NO: 238348 - RNA, 22 nt, Human
uucuugucuuuguuauguagga

SEQ ID NO: 238349 - RNA, 22 nt, Human
uucuugugugaauauaauuaca

SEQ ID NO: 238350 - RNA, 22 nt, Human
uucuucauucccuuacuuccga

SEQ ID NO: 238351 - RNA, 22 nt, Human
uucuuauuuuucguaaauccug

SEQ ID NO: 238352 - RNA, 22 nt, Human
uucuuagauuuuauuucuucug

SEQ ID NO: 238353 - RNA, 22 nt, Human
ugguuuuuuguaggauaaacau

SEQ ID NO: 238354 - RNA, 22 nt, Human
uucuuuucuucccuguuuauua

SEQ ID NO: 238355 - RNA, 22 nt, Human
ugguuuguauauguuugugaga

SEQ ID NO: 238356 - RNA, 21 nt, Human
ugguuuuaucuugguggcugc

SEQ ID NO: 238357 - RNA, 23 nt, Human
uucuuuccuuaucccauuuacuu

SEQ ID NO: 238358 - RNA, 22 nt, Human
uguaauguuagaaacaauugcu

SEQ ID NO: 238359 - RNA, 22 nt, Human
uugaaaucuucccuccugucug

SEQ ID NO: 238360 - RNA, 22 nt, Human
uguacagauaucaggagugagg

SEQ ID NO: 238361 - RNA, 22 nt, Human
uugaaaacugucaccuuuauuc

SEQ ID NO: 238362 - RNA, 22 nt, Human
uugaacguguaggaagcugguu

SEQ ID NO: 238363 - RNA, 22 nt, Human
uugaaccaggauaaacauagaa

SEQ ID NO: 238364 - RNA, 22 nt, Human
uugaacauuagaauaaguaauu

SEQ ID NO: 238365 - RNA, 22 nt, Human
uugaacaguuuugucagguuca

SEQ ID NO: 238366 - RNA, 22 nt, Human
ugugaaugacuguguucuuugc

SEQ ID NO: 238367 - RNA, 23 nt, Human
ugugaauggccuucuuuagaggu

SEQ ID NO: 238368 - RNA, 22 nt, Human
ugugauaauauuauuagagcuc

SEQ ID NO: 238369 - RNA, 22 nt, Human
ugugaugagaugaacuguagac

SEQ ID NO: 238370 - RNA, 22 nt, Human
ugugauugcauugcagauuacu

SEQ ID NO: 238371 - RNA, 19 nt, Human
ugugaagaccucagugcgg

SEQ ID NO: 238372 - RNA, 22 nt, Human
ugucuuugaccuuaagaaguuu

SEQ ID NO: 238373 - RNA, 22 nt, Human
uugcacagaugcacaugguugc

SEQ ID NO: 238374 - RNA, 22 nt, Human
uguccuuucagagcuccuuuug

SEQ ID NO: 238375 - RNA, 22 nt, Human
uugcaagauaguguauuuuuca

SEQ ID NO: 238376 - RNA, 22 nt, Human
uugcagagaacuaaagggagua

SEQ ID NO: 238377 - RNA, 19 nt, Human
uguauuuauauuucugugc

SEQ ID NO: 238378 - RNA, 22 nt, Human
uguauuugaagaaagagcuucu

SEQ ID NO: 238379 - RNA, 18 nt, Human
uguauuguucacuucugu

SEQ ID NO: 238380 - RNA, 22 nt, Human
uguauugaggauucauuuuugu

SEQ ID NO: 238381 - RNA, 22 nt, Human
uguauauuuucuguauaaaaua

SEQ ID NO: 238382 - RNA, 21 nt, Human
uugauuuagcagaucuagcug

SEQ ID NO: 238383 - RNA, 22 nt, Human
uguccuauuugugauaggugac

SEQ ID NO: 238384 - RNA, 22 nt, Human
uugauuugcagaagguguagag

SEQ ID NO: 238385 - RNA, 22 nt, Human
uugauuaauugaugaaccucuc

SEQ ID NO: 238386 - RNA, 22 nt, Human
ugucauauagaauguucuauga

SEQ ID NO: 238387 - RNA, 22 nt, Human
uuggugauguagcagcaauugu

SEQ ID NO: 238388 - RNA, 22 nt, Human
uuggugauugggaauggauggg

SEQ ID NO: 238389 - RNA, 19 nt, Human
uguugcagcuugaucggua

SEQ ID NO: 238390 - RNA, 22 nt, Human
uguuggaaucuucuagucuucc

SEQ ID NO: 238391 - RNA, 19 nt, Human
uuggugaagguucacugac

SEQ ID NO: 238392 - RNA, 22 nt, Human
uuguacaaauaggaaccucuga

SEQ ID NO: 238393 - RNA, 22 nt, Human
uuguacuuaaauaugcaaauag

SEQ ID NO: 238394 - RNA, 22 nt, Human
uugguguuucacuuccuugucg

SEQ ID NO: 238395 - RNA, 22 nt, Human
uugguguaauacaagcaauuug

SEQ ID NO: 238396 - RNA, 22 nt, Human
uguuggugcacugaaaggcagg

SEQ ID NO: 238397 - RNA, 18 nt, Human
uguugguguucacucacu

SEQ ID NO: 238398 - RNA, 22 nt, Human
uguucuuacuaaguaccugaaa

SEQ ID NO: 238399 - RNA, 22 nt, Human
uguucuucaaacucaguuccac

SEQ ID NO: 238400 - RNA, 22 nt, Human
uuggggaaaaagaccuaaugac

SEQ ID NO: 238401 - RNA, 22 nt, Human
uguguguauauauuuuuauaug

SEQ ID NO: 238402 - RNA, 22 nt, Human
ugugugggcgaagacagccuuu

SEQ ID NO: 238403 - RNA, 22 nt, Human
uguuaaaaagucccuguuuugu

SEQ ID NO: 238404 - RNA, 23 nt, Human
uugcuuuugccccaaaagaguua

SEQ ID NO: 238405 - RNA, 22 nt, Human
uugcuuuuugggguuuacuggg

SEQ ID NO: 238406 - RNA, 22 nt, Human
uugcuuuuuuggguuuacuggg

SEQ ID NO: 238407 - RNA, 22 nt, Human
uuggaaaagaaauacucauaua

SEQ ID NO: 238408 - RNA, 22 nt, Human
uguguggaaaugcuguauaugu

SEQ ID NO: 238409 - RNA, 22 nt, Human
ugugguuuguaagcaaagcaaa

SEQ ID NO: 238410 - RNA, 20 nt, Human
uuggagaucacguguccagg

SEQ ID NO: 238411 - RNA, 22 nt, Human
ugugcuaauguuaggauugaau

SEQ ID NO: 238412 - RNA, 22 nt, Human
uugcucaugucaccaaagcaca

SEQ ID NO: 238413 - RNA, 22 nt, Human
ugugcagaaaacacuuaagaac

SEQ ID NO: 238414 - RNA, 22 nt, Human
uguggcucugaugucauaaagg

SEQ ID NO: 238415 - RNA, 22 nt, Human
ugcauuuucuaccacacccacu

SEQ ID NO: 238416 - RNA, 22 nt, Human
ugcauuuugaaggaaaaaaaug

SEQ ID NO: 238417 - RNA, 22 nt, Human
ugcauuuuuaauuuggaaaaaa

SEQ ID NO: 238418 - RNA, 22 nt, Human
ugccaucaugucagauuuggga

SEQ ID NO: 238419 - RNA, 22 nt, Human
ugccuaaaccauuccccuuccu

SEQ ID NO: 238420 - RNA, 22 nt, Human
uguguguauauauauguaucau

SEQ ID NO: 238421 - RNA, 22 nt, Human
uguguguaugagcauuuguaug

SEQ ID NO: 238422 - RNA, 22 nt, Human
ugccuacuuuaguacuuuaaag

SEQ ID NO: 238423 - RNA, 21 nt, Human
uguguaccuucuuccgagcuc

SEQ ID NO: 238424 - RNA, 19 nt, Human
uguguaccuaauguuugug

SEQ ID NO: 238425 - RNA, 22 nt, Human
ugugcaguauugaaauauaugu

SEQ ID NO: 238426 - RNA, 22 nt, Human
ugugcaucuggaggcaauguuu

SEQ ID NO: 238427 - RNA, 22 nt, Human
ugcauuacuuugauaagcgucu

SEQ ID NO: 238428 - RNA, 22 nt, Human
ugcauaugcauguaccuguguu

SEQ ID NO: 238429 - RNA, 22 nt, Human
ugcgccuccugcugccugcccu

SEQ ID NO: 238430 - RNA, 22 nt, Human
uguugaaacagcuauugacuuu

SEQ ID NO: 238431 - RNA, 22 nt, Human
uguucuuaacuuuuguguauau

SEQ ID NO: 238432 - RNA, 22 nt, Human
uguugaagcaccucugucuuuc

SEQ ID NO: 238433 - RNA, 21 nt, Human
uguugcuugucugagacuaug

SEQ ID NO: 238434 - RNA, 22 nt, Human
uguugaucucuuuccaaauucu

SEQ ID NO: 238435 - RNA, 22 nt, Human
uguguuuaaacuauaugccugc

SEQ ID NO: 238436 - RNA, 22 nt, Human
uguguuucggauagcagauucu

SEQ ID NO: 238437 - RNA, 22 nt, Human
uguguguucauccccucaacau

SEQ ID NO: 238438 - RNA, 19 nt, Human
uguguguguuuuguuugaa

SEQ ID NO: 238439 - RNA, 22 nt, Human
uguguguguguguguguuugug

SEQ ID NO: 238440 - RNA, 22 nt, Human
uguuaacugccaggacagaucg

SEQ ID NO: 238441 - RNA, 22 nt, Human
uguguuuuucauuuuaaguccu

SEQ ID NO: 238442 - RNA, 22 nt, Human
ugccuuuggcuguucugugacc

SEQ ID NO: 238443 - RNA, 23 nt, Human
uguuaucacauguuccuuuaaau

SEQ ID NO: 238444 - RNA, 22 nt, Human
uguuacugaaugucucugcuuu

SEQ ID NO: 238445 - RNA, 22 nt, Human
ugagcuauuucaccauauagau

SEQ ID NO: 238446 - RNA, 22 nt, Human
uggugcacgugggcagucggcc

SEQ ID NO: 238447 - RNA, 19 nt, Human
ugaggauugagguccagua

SEQ ID NO: 238448 - RNA, 22 nt, Human
uggucugggaagaucacaauua

SEQ ID NO: 238449 - RNA, 22 nt, Human
ugacauuugagagagauauaca

SEQ ID NO: 238450 - RNA, 22 nt, Human
uguaauuugguuagauuucuuu

SEQ ID NO: 238451 - RNA, 22 nt, Human
uguaauucuaauccagagcugg

SEQ ID NO: 238452 - RNA, 22 nt, Human
uguacauacauagauauacaca

SEQ ID NO: 238453 - RNA, 22 nt, Human
uguaaagguuuuagagcagaga

SEQ ID NO: 238454 - RNA, 22 nt, Human
uguaaagugguauuuaauuuua

SEQ ID NO: 238455 - RNA, 22 nt, Human
uguaaauucuauacacuuaaaa

SEQ ID NO: 238456 - RNA, 22 nt, Human
ugaugaucaugcagguugguuu

SEQ ID NO: 238457 - RNA, 23 nt, Human
uguaaaacaccguuauugcaccu

SEQ ID NO: 238458 - RNA, 22 nt, Human
uguaaagaaagacgcagaguua

SEQ ID NO: 238459 - RNA, 22 nt, Human
ugaguuuaggccaggauauggu

SEQ ID NO: 238460 - RNA, 22 nt, Human
ugaggucaggcagggguuuggc

SEQ ID NO: 238461 - RNA, 22 nt, Human
ugagguguuugugcaccaucug

SEQ ID NO: 238462 - RNA, 22 nt, Human
ugagguauuuggauuuauauuu

SEQ ID NO: 238463 - RNA, 22 nt, Human
ugguugauuaauuuugccaagc

SEQ ID NO: 238464 - RNA, 23 nt, Human
uggugugaggaaggaagacuuua

SEQ ID NO: 238465 - RNA, 22 nt, Human
ugagguuacauuaggaauaacc

SEQ ID NO: 238466 - RNA, 22 nt, Human
uggugugggauccugggaagga

SEQ ID NO: 238467 - RNA, 22 nt, Human
ugcaagagcccaaacuauauac

SEQ ID NO: 238468 - RNA, 22 nt, Human
ugcaaauucuuuacucugugau

SEQ ID NO: 238469 - RNA, 22 nt, Human
ugucauuuauucucuuauucua

SEQ ID NO: 238470 - RNA, 22 nt, Human
ugauugauaaugaagacaguca

SEQ ID NO: 238471 - RNA, 22 nt, Human
uguauuuauuuuucaacuacca

SEQ ID NO: 238472 - RNA, 22 nt, Human
uguauuuuuucccugaaauaaa

SEQ ID NO: 238473 - RNA, 22 nt, Human
ugauucacgcuucucuuuaaac

SEQ ID NO: 238474 - RNA, 22 nt, Human
ugauguauaaaaagagugaaau

SEQ ID NO: 238475 - RNA, 22 nt, Human
uguauauguguguagcauguua

SEQ ID NO: 238476 - RNA, 22 nt, Human
uguauaugucugugagcuauua

SEQ ID NO: 238477 - RNA, 22 nt, Human
ugauuagccguccuuuuauuaa

SEQ ID NO: 238478 - RNA, 20 nt, Human
ugauuauuccaacaagaaug

SEQ ID NO: 238479 - RNA, 22 nt, Human
ugauuagauacuucagaugaca

SEQ ID NO: 238480 - RNA, 22 nt, Human
ugaugugugaauucuuaaaugu

SEQ ID NO: 238481 - RNA, 22 nt, Human
uguauguguuuuauguguguuu

SEQ ID NO: 238482 - RNA, 22 nt, Human
uguaucuguguguauguguuua

SEQ ID NO: 238483 - RNA, 22 nt, Human
ugauucaguacuuucucuaacu

SEQ ID NO: 238484 - RNA, 22 nt, Human
ugauucacagacuucacaaggc

SEQ ID NO: 238485 - RNA, 22 nt, Human
uguacuacaugauuauugacca

SEQ ID NO: 238486 - RNA, 22 nt, Human
uguagacaugcuuuucugauga

SEQ ID NO: 238487 - RNA, 22 nt, Human
ugauggaucuguuggcggguuu

SEQ ID NO: 238488 - RNA, 23 nt, Human
uguauacacccugugcaucuggg

SEQ ID NO: 238489 - RNA, 22 nt, Human
uguauaaaauggaaugucagaa

SEQ ID NO: 238490 - RNA, 22 nt, Human
uguaguguuuagucuagugucg

SEQ ID NO: 238491 - RNA, 22 nt, Human
ugggaaaauagcuauuuugaaa

SEQ ID NO: 238492 - RNA, 22 nt, Human
ugaacagugugagggugugacc

SEQ ID NO: 238493 - RNA, 22 nt, Human
ugggaaacucuaaacuugagua

SEQ ID NO: 238494 - RNA, 22 nt, Human
ugaacauuuuugcuugcagcuu

SEQ ID NO: 238495 - RNA, 22 nt, Human
ugaaccaugaauuacaggagca

SEQ ID NO: 238496 - RNA, 22 nt, Human
ugggaaggggagcuggaaagga

SEQ ID NO: 238497 - RNA, 22 nt, Human
ucuuugcauggacauguguuuu

SEQ ID NO: 238498 - RNA, 22 nt, Human
ucuuuguuagucagaauugauc

SEQ ID NO: 238499 - RNA, 22 nt, Human
uggcuucugguuuauccuuaua

SEQ ID NO: 238500 - RNA, 22 nt, Human
ugaacagacuauucucccaugu

SEQ ID NO: 238501 - RNA, 22 nt, Human
ugggauucucagaaacacagag

SEQ ID NO: 238502 - RNA, 22 nt, Human
ugggcaguccagcuggaaacgg

SEQ ID NO: 238503 - RNA, 23 nt, Human
ugaagugaaauuucacaagggac

SEQ ID NO: 238504 - RNA, 22 nt, Human
ugaauaaucuuggguauuaaua

SEQ ID NO: 238505 - RNA, 22 nt, Human
ugaauaaauaaacuuuuacuac

SEQ ID NO: 238506 - RNA, 22 nt, Human
ugaauagucaaagcacaagagg

SEQ ID NO: 238507 - RNA, 22 nt, Human
ugaauagcaccuugaguaauga

SEQ ID NO: 238508 - RNA, 22 nt, Human
ugaaguuuagaaaaagugccuu

SEQ ID NO: 238509 - RNA, 22 nt, Human
ugggccccucuucuucaguugg

SEQ ID NO: 238510 - RNA, 22 nt, Human
ugaaucagaccuucauugggua

SEQ ID NO: 238511 - RNA, 22 nt, Human
ugaaucaaugaauugcacuuca

SEQ ID NO: 238512 - RNA, 22 nt, Human
ugacagaggagcuggaaugauu

SEQ ID NO: 238513 - RNA, 22 nt, Human
ugacaagagaccccuccgcagg

SEQ ID NO: 238514 - RNA, 22 nt, Human
ugaauucaaacuuuuuaacaag

SEQ ID NO: 238515 - RNA, 22 nt, Human
ugaauuacacugggaucagggc

SEQ ID NO: 238516 - RNA, 22 nt, Human
ugaaucugagccugcgcaaagu

SEQ ID NO: 238517 - RNA, 22 nt, Human
ugaauggugcccuagagggaug

SEQ ID NO: 238518 - RNA, 22 nt, Human
ugaaugcuacccugcuggcucu

SEQ ID NO: 238519 - RNA, 22 nt, Human
ugaaugaacugaugaacuuaac

SEQ ID NO: 238520 - RNA, 22 nt, Human
uggggcuccuccuggcaggagg

SEQ ID NO: 238521 - RNA, 22 nt, Human
uggaaaugcuuagaggugaucu

SEQ ID NO: 238522 - RNA, 22 nt, Human
uggaagaaaugguugagccaug

SEQ ID NO: 238523 - RNA, 22 nt, Human
uggaagaagcuacaagcgguga

SEQ ID NO: 238524 - RNA, 22 nt, Human
uggaacugguuugcuucagacu

SEQ ID NO: 238525 - RNA, 22 nt, Human
uggaaauacaagaaguauguca

SEQ ID NO: 238526 - RNA, 22 nt, Human
uggaaauagauguaggaaauug

SEQ ID NO: 238527 - RNA, 21 nt, Human
ucuagaccuugggcagucacu

SEQ ID NO: 238528 - RNA, 22 nt, Human
uggagauauucuauauuuuaua

SEQ ID NO: 238529 - RNA, 22 nt, Human
uggaagaucugguguagcuccu

SEQ ID NO: 238530 - RNA, 22 nt, Human
uggaauuaucugaagugauuug

SEQ ID NO: 238531 - RNA, 22 nt, Human
ucuugugagcugagauaaagcc

SEQ ID NO: 238532 - RNA, 22 nt, Human
ucuuggcaguucuugugcuuuu

SEQ ID NO: 238533 - RNA, 22 nt, Human
ucuuuauuucccuaacuugcua

SEQ ID NO: 238534 - RNA, 19 nt, Human
ucuugcaucuuccuacugu

SEQ ID NO: 238535 - RNA, 22 nt, Human
ucuugauggugauguuguguca

SEQ ID NO: 238536 - RNA, 22 nt, Human
uggauuagugcugaaaugaugg

SEQ ID NO: 238537 - RNA, 22 nt, Human
uggcacaguuaaaguuguagaa

SEQ ID NO: 238538 - RNA, 22 nt, Human
ucuuauucuuuuaaacaacgca

SEQ ID NO: 238539 - RNA, 22 nt, Human
uccuucuguuguuuauuuuaaa

SEQ ID NO: 238540 - RNA, 22 nt, Human
uccuuucaaauuuauuugacau

SEQ ID NO: 238541 - RNA, 22 nt, Human
uccuuuuuagguuauuguacau

SEQ ID NO: 238542 - RNA, 22 nt, Human
ucgaaacuucucauuuaucugu

SEQ ID NO: 238543 - RNA, 22 nt, Human
uccuuuucuuugaggaaggugu

SEQ ID NO: 238544 - RNA, 22 nt, Human
uccugaggaaauuucaccuagu

SEQ ID NO: 238545 - RNA, 21 nt, Human
uccucucuaaguuccgccccg

SEQ ID NO: 238546 - RNA, 22 nt, Human
ugccaauuaccuauuucugaga

SEQ ID NO: 238547 - RNA, 22 nt, Human
ugcauguuuuaagugaagcuga

SEQ ID NO: 238548 - RNA, 22 nt, Human
ugcauuauaacaauaaggcuua

SEQ ID NO: 238549 - RNA, 22 nt, Human
ugcauucugaacguaaauguga

SEQ ID NO: 238550 - RNA, 22 nt, Human
ucccuuuuagccccgcccuccu

SEQ ID NO: 238551 - RNA, 22 nt, Human
ucccuuuggagguguccagcac

SEQ ID NO: 238552 - RNA, 22 nt, Human
ucccuuuuuaauugugucccug

SEQ ID NO: 238553 - RNA, 22 nt, Human
ugcagcuucucugcaacaggag

SEQ ID NO: 238554 - RNA, 22 nt, Human
ugcaugcagcuggucgggcgcc

SEQ ID NO: 238555 - RNA, 22 nt, Human
ugcaugaucucacuuacaggug

SEQ ID NO: 238556 - RNA, 21 nt, Human
uccuaaaggaaauacucaauu

SEQ ID NO: 238557 - RNA, 22 nt, Human
ugcauguuucuguauguuaaug

SEQ ID NO: 238558 - RNA, 21 nt, Human
ugcuaagugucacaugucugc

SEQ ID NO: 238559 - RNA, 23 nt, Human
ugcuaaaggcagaauauucaccu

SEQ ID NO: 238560 - RNA, 21 nt, Human
ugcguaugucuuguauuacuc

SEQ ID NO: 238561 - RNA, 22 nt, Human
ugccuuuuguguuuggcuaauc

SEQ ID NO: 238562 - RNA, 22 nt, Human
ugcucagaagacuuacugguua

SEQ ID NO: 238563 - RNA, 22 nt, Human
ugcucgauuauuucauuuugca

SEQ ID NO: 238564 - RNA, 22 nt, Human
ugcuaaugaauggaggaucuga

SEQ ID NO: 238565 - RNA, 22 nt, Human
ucgucaaaguaaugucauagca

SEQ ID NO: 238566 - RNA, 22 nt, Human
ugcagacuguuucuugacugaa

SEQ ID NO: 238567 - RNA, 17 nt, Human
ucccacuucauuuucca

SEQ ID NO: 238568 - RNA, 18 nt, Human
ugcagcuuugugauuggc

SEQ ID NO: 238569 - RNA, 20 nt, Human
ugcagcucccccgcaguuuc

SEQ ID NO: 238570 - RNA, 19 nt, Human
ugcaagcuuuuucuuguua

SEQ ID NO: 238571 - RNA, 22 nt, Human
ugcaacuacccccaggauuuua

SEQ ID NO: 238572 - RNA, 22 nt, Human
uccauuuacuauucucauaucg

SEQ ID NO: 238573 - RNA, 22 nt, Human
ugcacauuucucacaauguaca

SEQ ID NO: 238574 - RNA, 23 nt, Human
ugcaaugcagcuagauguaaaau

SEQ ID NO: 238575 - RNA, 22 nt, Human
ugcaaugagcuucuuugauaaa

SEQ ID NO: 238576 - RNA, 22 nt, Human
uccacuaucagaccuguagucu

SEQ ID NO: 238577 - RNA, 22 nt, Human
uccagaaagccguugacuuauu

SEQ ID NO: 238578 - RNA, 22 nt, Human
ugauuugauuuguuuaugccug

SEQ ID NO: 238579 - RNA, 23 nt, Human
ugcaaaauuugcagaguucgaug

SEQ ID NO: 238580 - RNA, 22 nt, Human
ugcaaaaagagcgaggagcccu

SEQ ID NO: 238581 - RNA, 22 nt, Human
uccaaauagcuggaugauggug

SEQ ID NO: 238582 - RNA, 22 nt, Human
uccaacuuaauugggaagauua

SEQ ID NO: 238583 - RNA, 22 nt, Human
uccaaauucccaugacagaagu

SEQ ID NO: 238584 - RNA, 22 nt, Human
ugaugaaguuggaaggaaaguu

SEQ ID NO: 238585 - RNA, 22 nt, Human
ucauuuaauuuggaacucagag

SEQ ID NO: 238586 - RNA, 22 nt, Human
ucauuagauuccugugguggau

SEQ ID NO: 238587 - RNA, 22 nt, Human
ugaucauugaacaucgaguuaa

SEQ ID NO: 238588 - RNA, 22 nt, Human
ugauaguaucugauuauuucac

SEQ ID NO: 238589 - RNA, 20 nt, Human
ucauucagaaucaguaugca

SEQ ID NO: 238590 - RNA, 22 nt, Human
ucauuauuuugauguauuuccu

SEQ ID NO: 238591 - RNA, 22 nt, Human
ucauuguuucugcuuuucauga

SEQ ID NO: 238592 - RNA, 22 nt, Human
ucauugugugugcuucuugggc

SEQ ID NO: 238593 - RNA, 22 nt, Human
ucauuguguaguagagguggca

SEQ ID NO: 238594 - RNA, 22 nt, Human
ugagugugugcugcuuacauuc

SEQ ID NO: 238595 - RNA, 22 nt, Human
ugaguacauuugauuaucagag

SEQ ID NO: 238596 - RNA, 22 nt, Human
ucauaucauuuugaaagcugag

SEQ ID NO: 238597 - RNA, 22 nt, Human
ugauagcaugcucucaguaaaa

SEQ ID NO: 238598 - RNA, 22 nt, Human
ugaguuuuggaagauguuacag

SEQ ID NO: 238599 - RNA, 23 nt, Human
ugaggucuuggaaguucuguuug

SEQ ID NO: 238600 - RNA, 22 nt, Human
ugacuuauuaaaaguuuuuauu

SEQ ID NO: 238601 - RNA, 22 nt, Human
uagugcuucauucuauugguuu

SEQ ID NO: 238602 - RNA, 20 nt, Human
ucuaaugaagugagcuuagc

SEQ ID NO: 238603 - RNA, 22 nt, Human
ucuacugagugcugagauuuug

SEQ ID NO: 238604 - RNA, 22 nt, Human
ucuagagaauuuggaaauuaag

SEQ ID NO: 238605 - RNA, 22 nt, Human
ucuucuuacauuaaguugaaac

SEQ ID NO: 238606 - RNA, 22 nt, Human
uauucuucagcauaaaaauucu

SEQ ID NO: 238607 - RNA, 22 nt, Human
uauugguagauggagagagaca

SEQ ID NO: 238608 - RNA, 22 nt, Human
uauuguauuagcucuuggagau

SEQ ID NO: 238609 - RNA, 22 nt, Human
uauugauuuuguugcuaccugg

SEQ ID NO: 238610 - RNA, 22 nt, Human
uauuggcucagucagaaguuuu

SEQ ID NO: 238611 - RNA, 22 nt, Human
ucuuguuaaagguuaaagguga

SEQ ID NO: 238612 - RNA, 22 nt, Human
ucuuggucccugagcucuuuca

SEQ ID NO: 238613 - RNA, 22 nt, Human
ucuuucucauccaaacuaguug

SEQ ID NO: 238614 - RNA, 22 nt, Human
ucuuuaaggggccuuuguguca

SEQ ID NO: 238615 - RNA, 22 nt, Human
ucuuuaaauucuuaugagugaa

SEQ ID NO: 238616 - RNA, 22 nt, Human
uauugugaaggccaugugcuaa

SEQ ID NO: 238617 - RNA, 22 nt, Human
uauuuaaagucagcaacuuuuc

SEQ ID NO: 238618 - RNA, 22 nt, Human
uauuuacgcaaacaauugugca

SEQ ID NO: 238619 - RNA, 22 nt, Human
ucuuugcagaauuuaacuuugc

SEQ ID NO: 238620 - RNA, 22 nt, Human
uauuuacuguguucaucccucu

SEQ ID NO: 238621 - RNA, 19 nt, Human
ucuuugcuuuucuaagagg

SEQ ID NO: 238622 - RNA, 22 nt, Human
ucuuugcugacacuuacacugu

SEQ ID NO: 238623 - RNA, 17 nt, Human
ucuuuuacuuucucucc

SEQ ID NO: 238624 - RNA, 22 nt, Human
uauuuaggcagaaagugauauu

SEQ ID NO: 238625 - RNA, 20 nt, Human
uauuucaaugugccaaguuu

SEQ ID NO: 238626 - RNA, 22 nt, Human
uauuuaugcaucacuuuuuucc

SEQ ID NO: 238627 - RNA, 22 nt, Human
uauuuuuaccuaauuuaugaga

SEQ ID NO: 238628 - RNA, 22 nt, Human
uauuuuuacuguuugaugauuc

SEQ ID NO: 238629 - RNA, 22 nt, Human
ugaagaauuccauggcuuccau

SEQ ID NO: 238630 - RNA, 22 nt, Human
ugaacuguccuuguugucuaga

SEQ ID NO: 238631 - RNA, 22 nt, Human
ugaacuuacauugaggaauucu

SEQ ID NO: 238632 - RNA, 22 nt, Human
ugaacuaauguuguguccuaau

SEQ ID NO: 238633 - RNA, 22 nt, Human
ugaaauuuuuuggagauaauuu

SEQ ID NO: 238634 - RNA, 22 nt, Human
ucaacauguuuuuuaaaagaaa

SEQ ID NO: 238635 - RNA, 22 nt, Human
ugaagacuucuuuuggucacca

SEQ ID NO: 238636 - RNA, 22 nt, Human
ugaagccaugcuaaauguuaca

SEQ ID NO: 238637 - RNA, 22 nt, Human
ugaagacaguuuuacucaugag

SEQ ID NO: 238638 - RNA, 22 nt, Human
ucaaaaauaagauauucuggac

SEQ ID NO: 238639 - RNA, 22 nt, Human
uauuuuuuuaacauuuauugua

SEQ ID NO: 238640 - RNA, 22 nt, Human
uauuuuuguuuaccaguuaaca

SEQ ID NO: 238641 - RNA, 22 nt, Human
ucaaagaucuuugcuuuugggg

SEQ ID NO: 238642 - RNA, 22 nt, Human
ugaaaaauauuuuuagaaauaa

SEQ ID NO: 238643 - RNA, 22 nt, Human
ugaaaaaugcuuuaaugcaugu

SEQ ID NO: 238644 - RNA, 22 nt, Human
ugaaagcuggcucugcagagug

SEQ ID NO: 238645 - RNA, 22 nt, Human
ugaaaggaauuuaaauguuguu

SEQ ID NO: 238646 - RNA, 22 nt, Human
ugaaauugaguaccucuuuaua

SEQ ID NO: 238647 - RNA, 22 nt, Human
uauuuugaggugaaagaguuug

SEQ ID NO: 238648 - RNA, 23 nt, Human
uauuuuccccuguaauauguauu

SEQ ID NO: 238649 - RNA, 22 nt, Human
uauuuuauuuagguuuaguugu

SEQ ID NO: 238650 - RNA, 22 nt, Human
ucuuuucagccagcugguagga

SEQ ID NO: 238651 - RNA, 22 nt, Human
ucuuuuaucuguuguguaacaa

SEQ ID NO: 238652 - RNA, 22 nt, Human
ucuuuugugauuuucugaagca

SEQ ID NO: 238653 - RNA, 22 nt, Human
ucuuuugaacauccaggauguc

SEQ ID NO: 238654 - RNA, 22 nt, Human
uauuucaugagugaauaucuag

SEQ ID NO: 238655 - RNA, 22 nt, Human
uauuuacuuugaggaaguuguu

SEQ ID NO: 238656 - RNA, 22 nt, Human
uauuuuaaaagcauuaauucuu

SEQ ID NO: 238657 - RNA, 22 nt, Human
uauuugauggaacucuugcuuu

SEQ ID NO: 238658 - RNA, 22 nt, Human
ucuuuuuaugucaaaaucgaug

SEQ ID NO: 238659 - RNA, 22 nt, Human
ugaccuuuuuaaauuauuuuua

SEQ ID NO: 238660 - RNA, 22 nt, Human
ucagauaauccaauagagagga

SEQ ID NO: 238661 - RNA, 22 nt, Human
ucagcaaugggauucaggcuuu

SEQ ID NO: 238662 - RNA, 23 nt, Human
ugaccauauauccaucagauaua

SEQ ID NO: 238663 - RNA, 22 nt, Human
ugacaucuagauaaaugggaca

SEQ ID NO: 238664 - RNA, 22 nt, Human
ugacacagaccaaguggugcug

SEQ ID NO: 238665 - RNA, 22 nt, Human
ucacuguuucaccgucugaagg

SEQ ID NO: 238666 - RNA, 22 nt, Human
ugaauuuuggcaauuuucugug

SEQ ID NO: 238667 - RNA, 22 nt, Human
ugaauuuguaggaauucuccau

SEQ ID NO: 238668 - RNA, 22 nt, Human
ugaauuucuuuuuaaaauauua

SEQ ID NO: 238669 - RNA, 22 nt, Human
ucagagacaucagguuguagca

SEQ ID NO: 238670 - RNA, 22 nt, Human
ucagaagguacugaagacaugg

SEQ ID NO: 238671 - RNA, 22 nt, Human
ucacuaugcccagaauacaguu

SEQ ID NO: 238672 - RNA, 22 nt, Human
ucacugaacucucauagagaaa

SEQ ID NO: 238673 - RNA, 22 nt, Human
ucacucuuuaucuuuuaugucu

SEQ ID NO: 238674 - RNA, 22 nt, Human
ugaauuauaugguauugaacau

SEQ ID NO: 238675 - RNA, 22 nt, Human
ucaccaggauugggcuguaggc

SEQ ID NO: 238676 - RNA, 22 nt, Human
ugaauguggucaggaaauuguu

SEQ ID NO: 238677 - RNA, 22 nt, Human
ugaaugaagcacuguaauucuc

SEQ ID NO: 238678 - RNA, 22 nt, Human
ugaauuagagugaaggaaagcu

SEQ ID NO: 238679 - RNA, 22 nt, Human
ucacaagaagaaauuaaacugu

SEQ ID NO: 238680 - RNA, 22 nt, Human
ucaauuuauguggcuauucauu

SEQ ID NO: 238681 - RNA, 22 nt, Human
ucaagcuggaaaugaagaaucu

SEQ ID NO: 238682 - RNA, 22 nt, Human
ucaagcacugugcaaugagcuu

SEQ ID NO: 238683 - RNA, 22 nt, Human
ucaagaagauaaugucuagggu

SEQ ID NO: 238684 - RNA, 22 nt, Human
ugaagcuaguauuaacucagau

SEQ ID NO: 238685 - RNA, 22 nt, Human
guucauuucaagucuaauccau

SEQ ID NO: 238686 - RNA, 22 nt, Human
uauguuuugcaaauaucaaaca

SEQ ID NO: 238687 - RNA, 22 nt, Human
uauuaaaagagaaaaagccacc

SEQ ID NO: 238688 - RNA, 22 nt, Human
uauuaauugugguuauuguauu

SEQ ID NO: 238689 - RNA, 22 nt, Human
guuauuuugucuuguucaugaa

SEQ ID NO: 238690 - RNA, 22 nt, Human
guuauuguuauugcguugucga

SEQ ID NO: 238691 - RNA, 22 nt, Human
uaugugugugcguguguuuugc

SEQ ID NO: 238692 - RNA, 22 nt, Human
guguuagcauggaacagaacgc

SEQ ID NO: 238693 - RNA, 22 nt, Human
guguguggacgucugagcccag

SEQ ID NO: 238694 - RNA, 22 nt, Human
gugugugucuacuuucaucucu

SEQ ID NO: 238695 - RNA, 22 nt, Human
uaugguuagugcuguagauuau

SEQ ID NO: 238696 - RNA, 22 nt, Human
uaugggaaggauuugucuuuca

SEQ ID NO: 238697 - RNA, 18 nt, Human
uaugugucuguuacaacu

SEQ ID NO: 238698 - RNA, 21 nt, Human
guuaccacugaugcaacagga

SEQ ID NO: 238699 - RNA, 22 nt, Human
uaugguuucuccugcagauuug

SEQ ID NO: 238700 - RNA, 22 nt, Human
uauguaacaccauuuacaaagu

SEQ ID NO: 238701 - RNA, 18 nt, Human
uauuuacuguguguuacc

SEQ ID NO: 238702 - RNA, 22 nt, Human
uauuucaguuaagaugagguca

SEQ ID NO: 238703 - RNA, 22 nt, Human
uauugaucuuugaaaccuuggu

SEQ ID NO: 238704 - RNA, 22 nt, Human
uauuguuuuaagguguauuaau

SEQ ID NO: 238705 - RNA, 22 nt, Human
uauuuuggaugcauugagaugc

SEQ ID NO: 238706 - RNA, 22 nt, Human
guugauaauuaauagcuuuuga

SEQ ID NO: 238707 - RNA, 22 nt, Human
guugauuuaaccucaccuuuga

SEQ ID NO: 238708 - RNA, 22 nt, Human
guucuuuacuucgcaucugcua

SEQ ID NO: 238709 - RNA, 22 nt, Human
uauuucuagggcaugaaaauaa

SEQ ID NO: 238710 - RNA, 22 nt, Human
uauuucaucugaacuucccaac

SEQ ID NO: 238711 - RNA, 18 nt, Human
uauuugugugugugugug

SEQ ID NO: 238712 - RNA, 22 nt, Human
uauuuguauugucuuaucacuu

SEQ ID NO: 238713 - RNA, 22 nt, Human
uauaugaggauauuuuaaagcu

SEQ ID NO: 238714 - RNA, 22 nt, Human
uaucaguagaacaauggacauu

SEQ ID NO: 238715 - RNA, 22 nt, Human
uaucacauaaaugaggaauauu

SEQ ID NO: 238716 - RNA, 22 nt, Human
uauauuaaagugcuuugcagug

SEQ ID NO: 238717 - RNA, 22 nt, Human
uaucuguagucucaugguuccu

SEQ ID NO: 238718 - RNA, 22 nt, Human
uaucuuagaagaaaugggucca

SEQ ID NO: 238719 - RNA, 22 nt, Human
guguauuucuagaagaaaugaa

SEQ ID NO: 238720 - RNA, 22 nt, Human
uaucuguauuguagaacuguug

SEQ ID NO: 238721 - RNA, 22 nt, Human
uauccuaagguaguuuuaguuu

SEQ ID NO: 238722 - RNA, 23 nt, Human
uaucccauacagagagugguaca

SEQ ID NO: 238723 - RNA, 22 nt, Human
gugugguguuaagcaaauuaau

SEQ ID NO: 238724 - RNA, 22 nt, Human
guguguauguagguauauaugu

SEQ ID NO: 238725 - RNA, 22 nt, Human
uaugauuuucaugguagaguua

SEQ ID NO: 238726 - RNA, 22 nt, Human
gugucuuggaacuggaauugag

SEQ ID NO: 238727 - RNA, 19 nt, Human
uaugacaaguacuaguucu

SEQ ID NO: 238728 - RNA, 22 nt, Human
uaguuuucuuuuguguuauucu

SEQ ID NO: 238729 - RNA, 22 nt, Human
uaguuucuaauguugaaauuau

SEQ ID NO: 238730 - RNA, 23 nt, Human
uaguuucaucuccacccugcccu

SEQ ID NO: 238731 - RNA, 22 nt, Human
uaguuagaucuccaguuugguu

SEQ ID NO: 238732 - RNA, 22 nt, Human
uaguuggguagacaguucuaca

SEQ ID NO: 238733 - RNA, 22 nt, Human
uagcauacagauauuuaacucu

SEQ ID NO: 238734 - RNA, 22 nt, Human
uagcauuuagaacaccuugaga

SEQ ID NO: 238735 - RNA, 22 nt, Human
uagcauuuauugggcuagcaaa

SEQ ID NO: 238736 - RNA, 22 nt, Human
uauaggugagugaagcucagga

SEQ ID NO: 238737 - RNA, 22 nt, Human
uauagcaagagaaccauuacca

SEQ ID NO: 238738 - RNA, 22 nt, Human
uauauauaauguguacagguga

SEQ ID NO: 238739 - RNA, 22 nt, Human
uauauacuugaaaauugcugag

SEQ ID NO: 238740 - RNA, 22 nt, Human
uauauacacgcacauauacaua

SEQ ID NO: 238741 - RNA, 22 nt, Human
uauacauauacaaaugcacaua

SEQ ID NO: 238742 - RNA, 22 nt, Human
uauaaagaccuuauccuucaua

SEQ ID NO: 238743 - RNA, 18 nt, Human
uauaaacacacuuagguu

SEQ ID NO: 238744 - RNA, 22 nt, Human
uauaagaaaagucauuaucaaa

SEQ ID NO: 238745 - RNA, 22 nt, Human
ucaagucaauagguuaguaggu

SEQ ID NO: 238746 - RNA, 22 nt, Human
guugucguucccccugcuuaaa

SEQ ID NO: 238747 - RNA, 22 nt, Human
guugauuuaggguuuugguuuu

SEQ ID NO: 238748 - RNA, 22 nt, Human
guugauauggaaacucuagguu

SEQ ID NO: 238749 - RNA, 22 nt, Human
guuuaaaagcaaccaacaggcu

SEQ ID NO: 238750 - RNA, 22 nt, Human
guuuaaguuaaaauuuaccugc

SEQ ID NO: 238751 - RNA, 22 nt, Human
ucacauugcauuuucucauuug

SEQ ID NO: 238752 - RNA, 22 nt, Human
ucaauuggcuacaaauaaugua

SEQ ID NO: 238753 - RNA, 21 nt, Human
ucaagugcccaagguuuguuu

SEQ ID NO: 238754 - RNA, 22 nt, Human
ucacaguucaacuaguucagau

SEQ ID NO: 238755 - RNA, 22 nt, Human
guuuacaacaucuuguccuuca

SEQ ID NO: 238756 - RNA, 22 nt, Human
guuuccaagucucucaacaccc

SEQ ID NO: 238757 - RNA, 22 nt, Human
guuugaacagaaggguugauca

SEQ ID NO: 238758 - RNA, 22 nt, Human
ucacuuuacaucuguaaaagga

SEQ ID NO: 238759 - RNA, 22 nt, Human
ucacucgccuuuucguucgccg

SEQ ID NO: 238760 - RNA, 22 nt, Human
ucacugaauuucaagcuagugg

SEQ ID NO: 238761 - RNA, 22 nt, Human
uaaaaugcucagauaaauauau

SEQ ID NO: 238762 - RNA, 22 nt, Human
uaaaauaccacauauggugcuc

SEQ ID NO: 238763 - RNA, 22 nt, Human
uaaacugacagugagggagagu

SEQ ID NO: 238764 - RNA, 22 nt, Human
ucagcucacaauguugagaaag

SEQ ID NO: 238765 - RNA, 22 nt, Human
uaaaaaccuuguauuuaacucu

SEQ ID NO: 238766 - RNA, 22 nt, Human
ucagcaguuaagcuucccugcc

SEQ ID NO: 238767 - RNA, 22 nt, Human
guuuguuugccagcuuaguaaa

SEQ ID NO: 238768 - RNA, 22 nt, Human
guuugguucucauuguuuuucu

SEQ ID NO: 238769 - RNA, 22 nt, Human
ucagaacuaacuuugcugaacc

SEQ ID NO: 238770 - RNA, 22 nt, Human
guuuuauaacuauagugagaau

SEQ ID NO: 238771 - RNA, 22 nt, Human
guuuuaucuauguaauuauaaa

SEQ ID NO: 238772 - RNA, 22 nt, Human
ucagaaacuaaauguggauuug

SEQ ID NO: 238773 - RNA, 22 nt, Human
ucagaaggagagacagcgugga

SEQ ID NO: 238774 - RNA, 22 nt, Human
guuuucuaaaacacauauaagu

SEQ ID NO: 238775 - RNA, 22 nt, Human
guuuuauguuuuauagacacaa

SEQ ID NO: 238776 - RNA, 22 nt, Human
guuuuguagucuggagacuguc

SEQ ID NO: 238777 - RNA, 22 nt, Human
guuuucuuguuaauuuugaacg

SEQ ID NO: 238778 - RNA, 22 nt, Human
guuuugaugugauuucucaugu

SEQ ID NO: 238779 - RNA, 22 nt, Human
guuuuggagauguccauuuucc

SEQ ID NO: 238780 - RNA, 22 nt, Human
guuuuuacuuccaaugcuauga

SEQ ID NO: 238781 - RNA, 22 nt, Human
uacuuaucuuagggaugcuugc

SEQ ID NO: 238782 - RNA, 22 nt, Human
uacuuagagucgggaugcacaa

SEQ ID NO: 238783 - RNA, 22 nt, Human
uacuuacacugaagcaaagaua

SEQ ID NO: 238784 - RNA, 22 nt, Human
uagaaguuaaaggaauacagaa

SEQ ID NO: 238785 - RNA, 22 nt, Human
uagacauuuacuuugaaaaaau

SEQ ID NO: 238786 - RNA, 22 nt, Human
uccuaagaaacagacugaaaag

SEQ ID NO: 238787 - RNA, 22 nt, Human
uagagauagccaaguccuucaa

SEQ ID NO: 238788 - RNA, 22 nt, Human
uagagaaauuacagcuuucuuu

SEQ ID NO: 238789 - RNA, 23 nt, Human
uagacugcaggcuccuugagggc

SEQ ID NO: 238790 - RNA, 19 nt, Human
uccuacaugagacagagag

SEQ ID NO: 238791 - RNA, 22 nt, Human
uccuaccucaaaaggcaccagc

SEQ ID NO: 238792 - RNA, 20 nt, Human
uccuacauugacccucuucc

SEQ ID NO: 238793 - RNA, 20 nt, Human
uccuaugagcuguuaaauug

SEQ ID NO: 238794 - RNA, 22 nt, Human
uccucaaauccuagccucaucg

SEQ ID NO: 238795 - RNA, 22 nt, Human
uccucuuguguguuccgguacc

SEQ ID NO: 238796 - RNA, 23 nt, Human
uccugcagauaagcugguugaca

SEQ ID NO: 238797 - RNA, 22 nt, Human
uccucuucucuagagccggaau

SEQ ID NO: 238798 - RNA, 18 nt, Human
uccuuucaccccuucucu

SEQ ID NO: 238799 - RNA, 22 nt, Human
ucuaacuaagcuuuaaaagguc

SEQ ID NO: 238800 - RNA, 22 nt, Human
ucuaaagcuccuuccacuaaaa

SEQ ID NO: 238801 - RNA, 22 nt, Human
ucuaaaaauuagaaauuagguc

SEQ ID NO: 238802 - RNA, 22 nt, Human
uagugcauaccuaacauuuuug

SEQ ID NO: 238803 - RNA, 22 nt, Human
uagugauuuaagaaaggugacu

SEQ ID NO: 238804 - RNA, 22 nt, Human
ucuaauagauuuggaguggaaa

SEQ ID NO: 238805 - RNA, 22 nt, Human
uaguauuuguaauuaucaaagc

SEQ ID NO: 238806 - RNA, 22 nt, Human
uaguagcuguuguuuuuuaaac

SEQ ID NO: 238807 - RNA, 20 nt, Human
uaguaugggagaagaucucc

SEQ ID NO: 238808 - RNA, 22 nt, Human
uagguuguuguggggauuaagu

SEQ ID NO: 238809 - RNA, 22 nt, Human
uagguauguuaacugugcaauu

SEQ ID NO: 238810 - RNA, 22 nt, Human
uaguacuaaauagggugauaaa

SEQ ID NO: 238811 - RNA, 22 nt, Human
uaguaauauuccuacauuaugu

SEQ ID NO: 238812 - RNA, 22 nt, Human
ucgcuuuaauggucuucacagc

SEQ ID NO: 238813 - RNA, 20 nt, Human
ucgcugcaagggaaauggag

SEQ ID NO: 238814 - RNA, 22 nt, Human
uaggcauguaaaagugaguucg

SEQ ID NO: 238815 - RNA, 22 nt, Human
uaggcaauauuagacuuugucu

SEQ ID NO: 238816 - RNA, 22 nt, Human
uaggauugguguauguagguuu

SEQ ID NO: 238817 - RNA, 22 nt, Human
ucgcuauuauuuuagguucuca

SEQ ID NO: 238818 - RNA, 22 nt, Human
uaccuagaagagacuuuucugg

SEQ ID NO: 238819 - RNA, 22 nt, Human
uaccucauguucaggaggauca

SEQ ID NO: 238820 - RNA, 22 nt, Human
uacuaucauuuuuuguugccaa

SEQ ID NO: 238821 - RNA, 22 nt, Human
uacuuaaaacacauuuagcauu

SEQ ID NO: 238822 - RNA, 22 nt, Human
uacugguguauuucuucuuauu

SEQ ID NO: 238823 - RNA, 22 nt, Human
uacucgaaaucagagagaauaa

SEQ ID NO: 238824 - RNA, 20 nt, Human
uaccaucauuggcaaaccuc

SEQ ID NO: 238825 - RNA, 22 nt, Human
uccagaaaucucuguugauugu

SEQ ID NO: 238826 - RNA, 22 nt, Human
uaccaauuaaauagccaaucua

SEQ ID NO: 238827 - RNA, 22 nt, Human
uacauuguguuaaaacagaaga

SEQ ID NO: 238828 - RNA, 22 nt, Human
uacaugggcguguucaguuagu

SEQ ID NO: 238829 - RNA, 22 nt, Human
uacacacacaugcauguacgug

SEQ ID NO: 238830 - RNA, 22 nt, Human
uacauaauagcaaggugcuguc

SEQ ID NO: 238831 - RNA, 22 nt, Human
uacauaauucauuagcuccucu

SEQ ID NO: 238832 - RNA, 22 nt, Human
uacauagaauauauaaaugucg

SEQ ID NO: 238833 - RNA, 22 nt, Human
uacagucauaagguuucucucc

SEQ ID NO: 238834 - RNA, 22 nt, Human
uacagugaggcgagauucacca

SEQ ID NO: 238835 - RNA, 22 nt, Human
uacaauguucgcauucucucug

SEQ ID NO: 238836 - RNA, 22 nt, Human
uacagauaaaaaugcuguucuu

SEQ ID NO: 238837 - RNA, 22 nt, Human
ucaugacaacuugcacaguuuu

SEQ ID NO: 238838 - RNA, 22 nt, Human
ucaucccuuccugcacuauuag

SEQ ID NO: 238839 - RNA, 22 nt, Human
uaagcacuuuauaugcuuuauc

SEQ ID NO: 238840 - RNA, 23 nt, Human
uaagccacgugacccuuuauuug

SEQ ID NO: 238841 - RNA, 22 nt, Human
uaagaaaggggaaguuccucuu

SEQ ID NO: 238842 - RNA, 22 nt, Human
uaaagaggagaauuaagucagc

SEQ ID NO: 238843 - RNA, 22 nt, Human
uaaagacaauuucgagcuguag

SEQ ID NO: 238844 - RNA, 22 nt, Human
uaaagcacucaaaauuguagcu

SEQ ID NO: 238845 - RNA, 23 nt, Human
uaaagauaguuuaaaggugaguu

SEQ ID NO: 238846 - RNA, 19 nt, Human
uaagaaucaccaggggugu

SEQ ID NO: 238847 - RNA, 22 nt, Human
uaagaauguuuguugaguaaau

SEQ ID NO: 238848 - RNA, 22 nt, Human
uaagagcagacacaaccugaga

SEQ ID NO: 238849 - RNA, 22 nt, Human
uaagauauugagugguaauuug

SEQ ID NO: 238850 - RNA, 22 nt, Human
uacaaaugaucaucucuuugaa

SEQ ID NO: 238851 - RNA, 22 nt, Human
uacaaauugccugacggcaggu

SEQ ID NO: 238852 - RNA, 22 nt, Human
uaauucuucaauccaguguuca

SEQ ID NO: 238853 - RNA, 22 nt, Human
uaauucuagauugacauuuuga

SEQ ID NO: 238854 - RNA, 22 nt, Human
uacaaucaggcucuagcuucuc

SEQ ID NO: 238855 - RNA, 22 nt, Human
uacaaauguuucuucuccuuuu

SEQ ID NO: 238856 - RNA, 22 nt, Human
uacaaauuguuuugccacaaag

SEQ ID NO: 238857 - RNA, 22 nt, Human
uacaagcucuuguagggggaaa

SEQ ID NO: 238858 - RNA, 20 nt, Human
uacaaggauguucaucagag

SEQ ID NO: 238859 - RNA, 22 nt, Human
uaagugugcauguguauuauau

SEQ ID NO: 238860 - RNA, 22 nt, Human
uaauagauagggagaguugcug

SEQ ID NO: 238861 - RNA, 21 nt, Human
uaauaauugggggcagggugg

SEQ ID NO: 238862 - RNA, 22 nt, Human
uaauaauuaacagugauggguc

SEQ ID NO: 238863 - RNA, 23 nt, Human
ucauugcucaagauaaugguuga

SEQ ID NO: 238864 - RNA, 22 nt, Human
ucauugguugcauaauuugauc

SEQ ID NO: 238865 - RNA, 22 nt, Human
ucauugguugcguaauuugauu

SEQ ID NO: 238866 - RNA, 22 nt, Human
uaaugaugaacacuuggaagaa

SEQ ID NO: 238867 - RNA, 22 nt, Human
uacugauggagauaggcuauca

SEQ ID NO: 238868 - RNA, 22 nt, Human
uacucucuuccauacaaucugu

SEQ ID NO: 238869 - RNA, 22 nt, Human
uacucauuggagaauuacgagg

SEQ ID NO: 238870 - RNA, 22 nt, Human
gugaagcaagggucaccugugg

SEQ ID NO: 238871 - RNA, 22 nt, Human
gugaagaugccucaggugaccc

SEQ ID NO: 238872 - RNA, 22 nt, Human
uacuuaauuuuaaaagcuagau

SEQ ID NO: 238873 - RNA, 22 nt, Human
uacaguauuuuuuaagaaaaaa

SEQ ID NO: 238874 - RNA, 22 nt, Human
uacuaaagaaugaguuaaguuu

SEQ ID NO: 238875 - RNA, 22 nt, Human
uacuauuuugacaugaaauuga

SEQ ID NO: 238876 - RNA, 22 nt, Human
uacuaccugcaggaacaauuag

SEQ ID NO: 238877 - RNA, 22 nt, Human
uacuagacugagaaucagcuga

SEQ ID NO: 238878 - RNA, 22 nt, Human
uaccauaaagcaggcaaaugag

SEQ ID NO: 238879 - RNA, 22 nt, Human
gucuauaaccuuuccaauuacc

SEQ ID NO: 238880 - RNA, 22 nt, Human
gucuauucaucauucaucaaac

SEQ ID NO: 238881 - RNA, 22 nt, Human
uacaaagugauuuuggaauuga

SEQ ID NO: 238882 - RNA, 22 nt, Human
uaauaguugaaggucaucacua

SEQ ID NO: 238883 - RNA, 22 nt, Human
uaaguuguagaacguuuucuua

SEQ ID NO: 238884 - RNA, 22 nt, Human
uaauaaaaauuuaauucacauu

SEQ ID NO: 238885 - RNA, 22 nt, Human
uaauaagugcuggcuguacauc

SEQ ID NO: 238886 - RNA, 22 nt, Human
uaauaacuacacucagaggacc

SEQ ID NO: 238887 - RNA, 22 nt, Human
gucucuuuugauuuuucacuca

SEQ ID NO: 238888 - RNA, 22 nt, Human
uacaacuuacuugaauggcuuu

SEQ ID NO: 238889 - RNA, 20 nt, Human
uacaauauucccacuuugcu

SEQ ID NO: 238890 - RNA, 22 nt, Human
uacaccaugcuccagcaggaca

SEQ ID NO: 238891 - RNA, 22 nt, Human
gugccuaaugacccauuuaucc

SEQ ID NO: 238892 - RNA, 22 nt, Human
uagauuuaaaaagggugggaug

SEQ ID NO: 238893 - RNA, 22 nt, Human
uagauuguaagcuccuugaggg

SEQ ID NO: 238894 - RNA, 22 nt, Human
uagcacauaguaggcacaggcu

SEQ ID NO: 238895 - RNA, 22 nt, Human
gugcuacacaaauguuaguugu

SEQ ID NO: 238896 - RNA, 22 nt, Human
gugccaaauagcuugauuaaga

SEQ ID NO: 238897 - RNA, 22 nt, Human
uagaugcugagcuuaagagaau

SEQ ID NO: 238898 - RNA, 22 nt, Human
gugcagcugguggagucugggg

SEQ ID NO: 238899 - RNA, 22 nt, Human
uagaguauuuguuuacuaaguu

SEQ ID NO: 238900 - RNA, 22 nt, Human
gugcacuugaucuagacagauu

SEQ ID NO: 238901 - RNA, 22 nt, Human
uagacugugagcuccuugaggg

SEQ ID NO: 238902 - RNA, 22 nt, Human
uagaaguagaaucauuagggcu

SEQ ID NO: 238903 - RNA, 19 nt, Human
gugauauuuauuauuuauu

SEQ ID NO: 238904 - RNA, 22 nt, Human
uagaaugggaggggaaucaucc

SEQ ID NO: 238905 - RNA, 22 nt, Human
gugaguugugugaguaagcaga

SEQ ID NO: 238906 - RNA, 22 nt, Human
gugauggggagagcgcagcuuu

SEQ ID NO: 238907 - RNA, 22 nt, Human
gugaugaagguggagaaucaga

SEQ ID NO: 238908 - RNA, 19 nt, Human
gugaugaugccacuccaac

SEQ ID NO: 238909 - RNA, 22 nt, Human
guuuuucuagaaaucuccuccu

SEQ ID NO: 238910 - RNA, 22 nt, Human
uaaaaguuagcuaggacaaagu

SEQ ID NO: 238911 - RNA, 22 nt, Human
uaaagaagaaaaggcuucaggc

SEQ ID NO: 238912 - RNA, 22 nt, Human
guaaauacuaugagauaaugaa

SEQ ID NO: 238913 - RNA, 22 nt, Human
uaaaugauaguauugaagguag

SEQ ID NO: 238914 - RNA, 22 nt, Human
uaaaugagcaccucuaguuuug

SEQ ID NO: 238915 - RNA, 22 nt, Human
guuuugauggaguguguuaaau

SEQ ID NO: 238916 - RNA, 22 nt, Human
guuuugaagagaagcaagucug

SEQ ID NO: 238917 - RNA, 22 nt, Human
guuuuguucaugaacauugggu

SEQ ID NO: 238918 - RNA, 22 nt, Human
ggucauagagcuggaaauuggc

SEQ ID NO: 238919 - RNA, 22 nt, Human
guuuuaaucuccuuauuccuaa

SEQ ID NO: 238920 - RNA, 22 nt, Human
guuuuagugauaagaacaccaa

SEQ ID NO: 238921 - RNA, 22 nt, Human
guugcuaugaaauuaaaauuua

SEQ ID NO: 238922 - RNA, 22 nt, Human
gguggagacucagauuuguugc

SEQ ID NO: 238923 - RNA, 22 nt, Human
guaguucuuucucaauguucaa

SEQ ID NO: 238924 - RNA, 22 nt, Human
guaguggaauuuagaguauaau

SEQ ID NO: 238925 - RNA, 22 nt, Human
guagucuuaggaaugauuuugu

SEQ ID NO: 238926 - RNA, 22 nt, Human
guaguauuuucugaggacuggu

SEQ ID NO: 238927 - RNA, 22 nt, Human
guauauuuaugagcauuagccu

SEQ ID NO: 238928 - RNA, 22 nt, Human
uaacuuuucuguucaauuuucc

SEQ ID NO: 238929 - RNA, 22 nt, Human
uaaauuugugaauuagcuauca

SEQ ID NO: 238930 - RNA, 23 nt, Human
uaaauuuuauucugauaacacag

SEQ ID NO: 238931 - RNA, 22 nt, Human
uaacaacuuucugguguaacuu

SEQ ID NO: 238932 - RNA, 23 nt, Human
uaacacaguccuggucuuuggcc

SEQ ID NO: 238933 - RNA, 22 nt, Human
guaauucugugugaaucuauua

SEQ ID NO: 238934 - RNA, 22 nt, Human
uaacccaaaggcaaugucucga

SEQ ID NO: 238935 - RNA, 22 nt, Human
uaacauuagcuuugcucaugca

SEQ ID NO: 238936 - RNA, 22 nt, Human
guagaucaugaaaauucacugc

SEQ ID NO: 238937 - RNA, 22 nt, Human
guagccacugaaguaaggccac

SEQ ID NO: 238938 - RNA, 22 nt, Human
guaggaaaugaauaagguaccu

SEQ ID NO: 238939 - RNA, 22 nt, Human
gucagauucuuucauuugcuga

SEQ ID NO: 238940 - RNA, 22 nt, Human
guauuuggacugccuguucauu

SEQ ID NO: 238941 - RNA, 21 nt, Human
uaagcuaaacauucaguuaac

SEQ ID NO: 238942 - RNA, 22 nt, Human
gucacaaaugauuuagcaauca

SEQ ID NO: 238943 - RNA, 22 nt, Human
uaagaaacauuuuuaugacagu

SEQ ID NO: 238944 - RNA, 22 nt, Human
uaacuuuuuauccuguuaaaug

SEQ ID NO: 238945 - RNA, 22 nt, Human
guaucaggacuaaauuauggau

SEQ ID NO: 238946 - RNA, 22 nt, Human
uaagacuuuaccaggcucaaau

SEQ ID NO: 238947 - RNA, 22 nt, Human
guaucuuuauuuuaauuaagau

SEQ ID NO: 238948 - RNA, 22 nt, Human
guauuaagaaaugccugugaaa

SEQ ID NO: 238949 - RNA, 22 nt, Human
guaugugucuuagaacuuggga

SEQ ID NO: 238950 - RNA, 22 nt, Human
guaugugguaccaugcaacggg

SEQ ID NO: 238951 - RNA, 22 nt, Human
gggcaugugauggacgugugcc

SEQ ID NO: 238952 - RNA, 19 nt, Human
gggccucacccacaccucc

SEQ ID NO: 238953 - RNA, 22 nt, Human
gggccccgggcgcggcugcggg

SEQ ID NO: 238954 - RNA, 22 nt, Human
guggaaauaugggcaacaaaga

SEQ ID NO: 238955 - RNA, 22 nt, Human
gggcaguuucaugugguucaac

SEQ ID NO: 238956 - RNA, 22 nt, Human
guggccuuccuguuccuuugaa

SEQ ID NO: 238957 - RNA, 22 nt, Human
gugguuugcugguguacguuua

SEQ ID NO: 238958 - RNA, 23 nt, Human
gugguguaaaugccaaaaugaaa

SEQ ID NO: 238959 - RNA, 22 nt, Human
guguaucagaggcuguguuaua

SEQ ID NO: 238960 - RNA, 22 nt, Human
guggucaagaccgggaauagga

SEQ ID NO: 238961 - RNA, 22 nt, Human
guggugaacauuugcaucugcu

SEQ ID NO: 238962 - RNA, 22 nt, Human
guguugaaaaguagcacugcuu

SEQ ID NO: 238963 - RNA, 22 nt, Human
guguucuuuguagaggaucuug

SEQ ID NO: 238964 - RNA, 18 nt, Human
gggcuuugggguucuauc

SEQ ID NO: 238965 - RNA, 22 nt, Human
guguuaaucauuuuugauuuug

SEQ ID NO: 238966 - RNA, 22 nt, Human
gugucauuggcuucccaagucc

SEQ ID NO: 238967 - RNA, 22 nt, Human
guugagaagaccauuuuguuca

SEQ ID NO: 238968 - RNA, 22 nt, Human
guugagaaucucuagcuuagga

SEQ ID NO: 238969 - RNA, 22 nt, Human
guugagacugaaguucugaaag

SEQ ID NO: 238970 - RNA, 22 nt, Human
gguagauacaaaaagauugugg

SEQ ID NO: 238971 - RNA, 22 nt, Human
gguaauugaaaguuuguugaug

SEQ ID NO: 238972 - RNA, 22 nt, Human
gguaaucuccucauugacguua

SEQ ID NO: 238973 - RNA, 22 nt, Human
guugagacguguauuggaaucu

SEQ ID NO: 238974 - RNA, 22 nt, Human
gguaagcugcuguagggucaga

SEQ ID NO: 238975 - RNA, 22 nt, Human
guugcaaaugggaagaugguua

SEQ ID NO: 238976 - RNA, 22 nt, Human
guucgucuguggugugaggugc

SEQ ID NO: 238977 - RNA, 22 nt, Human
guuccgcugcaaggccaggaaa

SEQ ID NO: 238978 - RNA, 22 nt, Human
guucuucagauuccauuucagu

SEQ ID NO: 238979 - RNA, 22 nt, Human
ggguguggaggugacacauuug

SEQ ID NO: 238980 - RNA, 22 nt, Human
guuauacuuaugugcaaaaaua

SEQ ID NO: 238981 - RNA, 23 nt, Human
guuauugcuggugcuggccagcc

SEQ ID NO: 238982 - RNA, 22 nt, Human
guuauuaaauauuuuggugauu

SEQ ID NO: 238983 - RNA, 22 nt, Human
guuacagagcugcuaugugugc

SEQ ID NO: 238984 - RNA, 22 nt, Human
guuagaauggacaaagcugaaa

SEQ ID NO: 238985 - RNA, 22 nt, Human
guuaaaaugauuugugauuuau

SEQ ID NO: 238986 - RNA, 22 nt, Human
ggggaagagagaagaaugaucu

SEQ ID NO: 238987 - RNA, 22 nt, Human
guguugaugugucuguauucua

SEQ ID NO: 238988 - RNA, 22 nt, Human
ggggaauaaacacuuugucacu

SEQ ID NO: 238989 - RNA, 22 nt, Human
guguuggugagcucauuuccac

SEQ ID NO: 238990 - RNA, 22 nt, Human
ggaagauagaaguucaaaaguu

SEQ ID NO: 238991 - RNA, 19 nt, Human
gcugggauaggauguauuu

SEQ ID NO: 238992 - RNA, 22 nt, Human
ggaauaauauuacagauacagu

SEQ ID NO: 238993 - RNA, 22 nt, Human
ggaagugagcucauuacuuuag

SEQ ID NO: 238994 - RNA, 22 nt, Human
ggacaauuguacucgauuucaa

SEQ ID NO: 238995 - RNA, 23 nt, Human
ggaauuucagaugugaaauaaaa

SEQ ID NO: 238996 - RNA, 22 nt, Human
ggaauugagcaagggguggggc

SEQ ID NO: 238997 - RNA, 22 nt, Human
ggauuucuucucauaacugaga

SEQ ID NO: 238998 - RNA, 22 nt, Human
ggagccucuaaacaguuaucaa

SEQ ID NO: 238999 - RNA, 22 nt, Human
ggaugauacuuggagaaauauu

SEQ ID NO: 239000 - RNA, 22 nt, Human
gcucccaauuccuuuuacaauu

SEQ ID NO: 239001 - RNA, 22 nt, Human
gcucaacucaacgucauuugaa

SEQ ID NO: 239002 - RNA, 22 nt, Human
gcuauuggcuaauuguugcaac

SEQ ID NO: 239003 - RNA, 22 nt, Human
ggcagauaaacaauguuguaua

SEQ ID NO: 239004 - RNA, 22 nt, Human
gcgguuauggcagagauuacag

SEQ ID NO: 239005 - RNA, 22 nt, Human
gcugacuauaaggcugcucugu

SEQ ID NO: 239006 - RNA, 22 nt, Human
gcucuugcuuuuucuagaaaga

SEQ ID NO: 239007 - RNA, 22 nt, Human
gcugcgcugggacgccaccaac

SEQ ID NO: 239008 - RNA, 22 nt, Human
ggcuuauauguauucccagaga

SEQ ID NO: 239009 - RNA, 22 nt, Human
ggcuguggcagcuggaaguggu

SEQ ID NO: 239010 - RNA, 22 nt, Human
ggcugcagggaacaggaugggu

SEQ ID NO: 239011 - RNA, 22 nt, Human
ggugggccaaauuaaacauaua

SEQ ID NO: 239012 - RNA, 22 nt, Human
gguguaaggaagauggaagaug

SEQ ID NO: 239013 - RNA, 22 nt, Human
ggugcaauaaaguuguagaacc

SEQ ID NO: 239014 - RNA, 22 nt, Human
gguauagacaaauuauauaucc

SEQ ID NO: 239015 - RNA, 20 nt, Human
ggauugaacuauuucucagc

SEQ ID NO: 239016 - RNA, 22 nt, Human
ggucuucauucuaccagacuuu

SEQ ID NO: 239017 - RNA, 22 nt, Human
gguguagggaaacuugacuaau

SEQ ID NO: 239018 - RNA, 22 nt, Human
gguuuucagaaugcaguccugu

SEQ ID NO: 239019 - RNA, 22 nt, Human
guaccuuucuaucuagaaggua

SEQ ID NO: 239020 - RNA, 22 nt, Human
guacuacagguuugguaguggg

SEQ ID NO: 239021 - RNA, 22 nt, Human
guaaaucccucucuuuguagau

SEQ ID NO: 239022 - RNA, 22 nt, Human
gguuuuuggcucaauauuuugg

SEQ ID NO: 239023 - RNA, 22 nt, Human
guaaauaucucacgaaugauuc

SEQ ID NO: 239024 - RNA, 22 nt, Human
guaggggccagaaagacuuaga

SEQ ID NO: 239025 - RNA, 22 nt, Human
guagggguggggagguggucug

SEQ ID NO: 239026 - RNA, 22 nt, Human
guagccauuuucuagagaguua

SEQ ID NO: 239027 - RNA, 22 nt, Human
guagucauugggucugugguca

SEQ ID NO: 239028 - RNA, 22 nt, Human
guagugauuguuccucaggggu

SEQ ID NO: 239029 - RNA, 22 nt, Human
guagaaaauagauugucucuug

SEQ ID NO: 239030 - RNA, 22 nt, Human
guagaauggggcucucaaagca

SEQ ID NO: 239031 - RNA, 22 nt, Human
guacuuccauccacauauaugu

SEQ ID NO: 239032 - RNA, 22 nt, Human
guaguuuucaugguuagaaaua

SEQ ID NO: 239033 - RNA, 22 nt, Human
guaguuuuugagcuguaaucuu

SEQ ID NO: 239034 - RNA, 22 nt, Human
ggaaaaugcugaagcaucugaa

SEQ ID NO: 239035 - RNA, 22 nt, Human
ggaaaaucaaaccauuuacagu

SEQ ID NO: 239036 - RNA, 22 nt, Human
ggaaaagaauuguuaguuagug

SEQ ID NO: 239037 - RNA, 22 nt, Human
gcuuuguucauuuaguuuuuuu

SEQ ID NO: 239038 - RNA, 22 nt, Human
ggaagcuguugugagugcagca

SEQ ID NO: 239039 - RNA, 22 nt, Human
ggagauaugugaaaaagacagc

SEQ ID NO: 239040 - RNA, 23 nt, Human
ggagaaggaugucaucaaaagac

SEQ ID NO: 239041 - RNA, 22 nt, Human
ggacauggccguaguccccacg

SEQ ID NO: 239042 - RNA, 22 nt, Human
gggcuguaggagcuggaauggg

SEQ ID NO: 239043 - RNA, 22 nt, Human
ggggaagaaauagaacauuuug

SEQ ID NO: 239044 - RNA, 22 nt, Human
ggggccccuguggcuugaugcc

SEQ ID NO: 239045 - RNA, 21 nt, Human
ggggcccccacacaugccucc

SEQ ID NO: 239046 - RNA, 22 nt, Human
ggauaaaugaaggcauacagau

SEQ ID NO: 239047 - RNA, 22 nt, Human
ggguauuugacaaacugacacu

SEQ ID NO: 239048 - RNA, 22 nt, Human
ggggugugcugggagaagggau

SEQ ID NO: 239049 - RNA, 22 nt, Human
gcauuuaaauuugaacuucaga

SEQ ID NO: 239050 - RNA, 22 nt, Human
gcccaauuugaacaaagauacu

SEQ ID NO: 239051 - RNA, 22 nt, Human
gcuggaaauaacuuguguagaa

SEQ ID NO: 239052 - RNA, 22 nt, Human
gcaucuguuagagugugcaugc

SEQ ID NO: 239053 - RNA, 22 nt, Human
gcauaaaggacuauaaggauca

SEQ ID NO: 239054 - RNA, 22 nt, Human
gcuauuuagaaaggcuuggaga

SEQ ID NO: 239055 - RNA, 22 nt, Human
gcuaagucaaaaaauucaaaau

SEQ ID NO: 239056 - RNA, 22 nt, Human
gcuacaaaaccagggcaaagga

SEQ ID NO: 239057 - RNA, 22 nt, Human
gcgugcauguguguaugcgugu

SEQ ID NO: 239058 - RNA, 22 nt, Human
gcagcguguggcuaauggcucu

SEQ ID NO: 239059 - RNA, 22 nt, Human
gcggacaauggaagaugucauu

SEQ ID NO: 239060 - RNA, 22 nt, Human
gaugauuccuuuguucauugug

SEQ ID NO: 239061 - RNA, 23 nt, Human
gaugauggcaacuacauccggug

SEQ ID NO: 239062 - RNA, 22 nt, Human
gaugauaacagcauuucaacug

SEQ ID NO: 239063 - RNA, 22 nt, Human
gaugaaguaguccacuggaagg

SEQ ID NO: 239064 - RNA, 22 nt, Human
gauauuaguuuuggaaggaggg

SEQ ID NO: 239065 - RNA, 22 nt, Human
gaucauauccagucaccacuau

SEQ ID NO: 239066 - RNA, 22 nt, Human
gaucauuuucauuaauguugca

SEQ ID NO: 239067 - RNA, 22 nt, Human
gcauuuuaauuggggcaguuag

SEQ ID NO: 239068 - RNA, 22 nt, Human
gcauuucuguuuuuuuaaauga

SEQ ID NO: 239069 - RNA, 19 nt, Human
gauauugagcugagaauuc

SEQ ID NO: 239070 - RNA, 22 nt, Human
gauggacgguuuuaccagacag

SEQ ID NO: 239071 - RNA, 22 nt, Human
gauggauuuuuuauuaaaucag

SEQ ID NO: 239072 - RNA, 22 nt, Human
gauggcaaugcuagaaauuuag

SEQ ID NO: 239073 - RNA, 22 nt, Human
gauacuugaggagaucaccaca

SEQ ID NO: 239074 - RNA, 22 nt, Human
gcaugguuagacaucaauguga

SEQ ID NO: 239075 - RNA, 22 nt, Human
gcauguagucaguguugagaac

SEQ ID NO: 239076 - RNA, 22 nt, Human
gcauguucaaguuaguauauuu

SEQ ID NO: 239077 - RNA, 22 nt, Human
gcauugcuauuucuguuagugu

SEQ ID NO: 239078 - RNA, 22 nt, Human
gaguuucacguagaucaggguc

SEQ ID NO: 239079 - RNA, 22 nt, Human
gauaaauaguguuuggggacau

SEQ ID NO: 239080 - RNA, 22 nt, Human
gcaugcuguuuggaaacgauaa

SEQ ID NO: 239081 - RNA, 19 nt, Human
gaguaaaacuagagagaaa

SEQ ID NO: 239082 - RNA, 22 nt, Human
gagguguguuacuaaauuuauc

SEQ ID NO: 239083 - RNA, 22 nt, Human
gagguuuaguccauaguauuua

SEQ ID NO: 239084 - RNA, 22 nt, Human
gcacacaagagauuguuauugc

SEQ ID NO: 239085 - RNA, 22 nt, Human
gcaacguauauggguaaggaua

SEQ ID NO: 239086 - RNA, 22 nt, Human
gcaagagaagaaagaauaguuu

SEQ ID NO: 239087 - RNA, 22 nt, Human
gcaaagaauugauucauuuugc

SEQ ID NO: 239088 - RNA, 22 nt, Human
gcaaaaacaguguagucuucug

SEQ ID NO: 239089 - RNA, 21 nt, Human
gauuuuagggcagccaaacac

SEQ ID NO: 239090 - RNA, 22 nt, Human
gauuuuaaaagauguauaaggu

SEQ ID NO: 239091 - RNA, 22 nt, Human
gccugaaaugaaccagaggacu

SEQ ID NO: 239092 - RNA, 22 nt, Human
gccuuuauauuacauuuggaag

SEQ ID NO: 239093 - RNA, 22 nt, Human
gaugguuuuacauuuuaauguu

SEQ ID NO: 239094 - RNA, 22 nt, Human
gauugauguaggugauaaaucu

SEQ ID NO: 239095 - RNA, 22 nt, Human
gauugcauaugcauucugauac

SEQ ID NO: 239096 - RNA, 22 nt, Human
gaugcuaauuaaugaagaggag

SEQ ID NO: 239097 - RNA, 22 nt, Human
gagagaguaucugcugguucac

SEQ ID NO: 239098 - RNA, 22 nt, Human
gagaggcagcucaggaggucag

SEQ ID NO: 239099 - RNA, 22 nt, Human
gaugauuuuguaacuggggaca

SEQ ID NO: 239100 - RNA, 22 nt, Human
gaugauugaauaaauaugguca

SEQ ID NO: 239101 - RNA, 22 nt, Human
gagagaaggaagugaauuuccc

SEQ ID NO: 239102 - RNA, 20 nt, Human
gagaauuccagguuucugug

SEQ ID NO: 239103 - RNA, 22 nt, Human
gagaccaagcgugggugauaau

SEQ ID NO: 239104 - RNA, 22 nt, Human
gauguaucugagcugcuuaggu

SEQ ID NO: 239105 - RNA, 22 nt, Human
gaugucauguuggcagacaguu

SEQ ID NO: 239106 - RNA, 22 nt, Human
gagcagcucgagaaggaagcag

SEQ ID NO: 239107 - RNA, 22 nt, Human
gaugguggaggaaucgcugaag

SEQ ID NO: 239108 - RNA, 22 nt, Human
gagcacauguggagagucuggg

SEQ ID NO: 239109 - RNA, 22 nt, Human
gagcacuucagcauaaaucaca

SEQ ID NO: 239110 - RNA, 22 nt, Human
gaugggaaggugguaaaguuua

SEQ ID NO: 239111 - RNA, 22 nt, Human
gauggugcaauuaucgugcaug

SEQ ID NO: 239112 - RNA, 22 nt, Human
gagcuuuguuccgugguggcac

SEQ ID NO: 239113 - RNA, 22 nt, Human
gauuuuuaaaaguaguuuugaa

SEQ ID NO: 239114 - RNA, 22 nt, Human
gcaaaugacuuagucacuccag

SEQ ID NO: 239115 - RNA, 22 nt, Human
gauuuugaaccuuauuuggaaa

SEQ ID NO: 239116 - RNA, 22 nt, Human
gauuuucauuauagcuaguuuc

SEQ ID NO: 239117 - RNA, 22 nt, Human
gauuugucuauauucaaauaug

SEQ ID NO: 239118 - RNA, 22 nt, Human
gauuucuucauuuaaaaauauu

SEQ ID NO: 239119 - RNA, 22 nt, Human
gauuucauaaaacgagaaacuc

SEQ ID NO: 239120 - RNA, 22 nt, Human
gauugcaucaauauuuagagua

SEQ ID NO: 239121 - RNA, 22 nt, Human
gauugauuuaauaugagaggau

SEQ ID NO: 239122 - RNA, 22 nt, Human
gauugggagugugacauuguau

SEQ ID NO: 239123 - RNA, 22 nt, Human
gauuggucacacaauaguauau

SEQ ID NO: 239124 - RNA, 22 nt, Human
gauuguagacauauuagacugc

SEQ ID NO: 239125 - RNA, 22 nt, Human
gauucuaucauucuguauauua

SEQ ID NO: 239126 - RNA, 22 nt, Human
gauucagagcugcaacaaagaa

SEQ ID NO: 239127 - RNA, 22 nt, Human
gauuaucaccaaauggccuccu

SEQ ID NO: 239128 - RNA, 22 nt, Human
gauuaagauuacauauuuaagu

SEQ ID NO: 239129 - RNA, 22 nt, Human
gauuaaaggucuugauuauaag

SEQ ID NO: 239130 - RNA, 22 nt, Human
gauguuuugaaagaagaauaca

SEQ ID NO: 239131 - RNA, 22 nt, Human
gagcagcugagcuggaaugaga

SEQ ID NO: 239132 - RNA, 22 nt, Human
gcaauuggaaugaauucuauuu

SEQ ID NO: 239133 - RNA, 22 nt, Human
gcacaaguccuccgacagcacg

SEQ ID NO: 239134 - RNA, 22 nt, Human
gaggcucagagggacuuucaag

SEQ ID NO: 239135 - RNA, 22 nt, Human
gaggaugacaaagaaggcagac

SEQ ID NO: 239136 - RNA, 22 nt, Human
gcacauauuuagaucuugaugu

SEQ ID NO: 239137 - RNA, 21 nt, Human
gcagcaugagaaagccccaaa

SEQ ID NO: 239138 - RNA, 22 nt, Human
gcagcauuaccaagacauggca

SEQ ID NO: 239139 - RNA, 22 nt, Human
gcagagcugucuaagucacuuc

SEQ ID NO: 239140 - RNA, 22 nt, Human
gcagaggcaaagucuggaugac

SEQ ID NO: 239141 - RNA, 22 nt, Human
gcagcagugugggcugaaccua

SEQ ID NO: 239142 - RNA, 22 nt, Human
gcagcaauaaaacugaaggugu

SEQ ID NO: 239143 - RNA, 22 nt, Human
gcagaugagagugugaucuggg

SEQ ID NO: 239144 - RNA, 22 nt, Human
gcagauaguaggagcuaaucuu

SEQ ID NO: 239145 - RNA, 22 nt, Human
aaaagacaaggaucuggaguga

SEQ ID NO: 239146 - RNA, 22 nt, Human
aaaaauuucuggugaaaugccu

SEQ ID NO: 239147 - RNA, 22 nt, Human
aaaaguuguaauauuuccuuua

SEQ ID NO: 239148 - RNA, 22 nt, Human
aaaagguuauagcuuugccuug

SEQ ID NO: 239149 - RNA, 22 nt, Human
aaaagggucugacacugcuuga

SEQ ID NO: 239150 - RNA, 22 nt, Human
aaaaggauauuuggugcaaagc

SEQ ID NO: 239151 - RNA, 22 nt, Human
aaaaggaagaguuuucagagac

SEQ ID NO: 239152 - RNA, 22 nt, Human
aaaagcauuauuagucugggug

SEQ ID NO: 239153 - RNA, 22 nt, Human
aaaagauguaaacauauauuaa

SEQ ID NO: 239154 - RNA, 22 nt, Human
aaaagcgaagagaacugaaguu

SEQ ID NO: 239155 - RNA, 22 nt, Human
aaaaugggaaaauuuuagauua

SEQ ID NO: 239156 - RNA, 18 nt, Human
aaacgguuucaugcugua

SEQ ID NO: 239157 - RNA, 22 nt, Human
aaacgcauucuuacaugcuucc

SEQ ID NO: 239158 - RNA, 22 nt, Human
aaacaccaagagcuagcuauua

SEQ ID NO: 239159 - RNA, 22 nt, Human
aaacacacaacauauuuuggaa

SEQ ID NO: 239160 - RNA, 22 nt, Human
aaacaagagcuuacauggcugc

SEQ ID NO: 239161 - RNA, 22 nt, Human
aaacaauaauaauuaggaagga

SEQ ID NO: 239162 - RNA, 22 nt, Human
aaacaaauccaauaauaaaauu

SEQ ID NO: 239163 - RNA, 22 nt, Human
aaaaguauaagugucuccugau

SEQ ID NO: 239164 - RNA, 22 nt, Human
aaaagguauuuagcgauugcau

SEQ ID NO: 239165 - RNA, 22 nt, Human
aaaauauuuaucuagcucuuaa

SEQ ID NO: 239166 - RNA, 17 nt, Human
aaaaucaaaggaggugc

SEQ ID NO: 239167 - RNA, 22 nt, Human
aaaauauucuauaucaaagaua

SEQ ID NO: 239168 - RNA, 22 nt, Human
aaaauuuccuuggaccauuuuu

SEQ ID NO: 239169 - RNA, 22 nt, Human
aaagaucaguuaacgccaucaa

SEQ ID NO: 239170 - RNA, 20 nt, Human
aaagauacuuuuuguaaugg

SEQ ID NO: 239171 - RNA, 22 nt, Human
aaagaugucauacacauuaaga

SEQ ID NO: 239172 - RNA, 22 nt, Human
aaagaugaaguucagcgaagaa

SEQ ID NO: 239173 - RNA, 22 nt, Human
aaagcauuuguuucuccuggaa

SEQ ID NO: 239174 - RNA, 22 nt, Human
aaagccaagucugauuuuguug

SEQ ID NO: 239175 - RNA, 22 nt, Human
aaagcaaauaguugcuuaauau

SEQ ID NO: 239176 - RNA, 22 nt, Human
aaagccaagguccauguacuuu

SEQ ID NO: 239177 - RNA, 17 nt, Human
aaagccgaucagauguu

SEQ ID NO: 239178 - RNA, 22 nt, Human
aaagcugaaacgaaaugacaac

SEQ ID NO: 239179 - RNA, 22 nt, Human
aaagccauaucuauucuauucu

SEQ ID NO: 239180 - RNA, 22 nt, Human
aaagcagguugcaauuacagug

SEQ ID NO: 239181 - RNA, 22 nt, Human
aaagcauucuaaccgaucgacg

SEQ ID NO: 239182 - RNA, 22 nt, Human
aaagcagucuguuuuaaccuga

SEQ ID NO: 239183 - RNA, 22 nt, Human
aaagggagauaaaguaauuuua

SEQ ID NO: 239184 - RNA, 22 nt, Human
aaaggggugguauuucuuuugg

SEQ ID NO: 239185 - RNA, 21 nt, Human
aaagaagagcucagagguaga

SEQ ID NO: 239186 - RNA, 22 nt, Human
aaagagugugcauguaccugug

SEQ ID NO: 239187 - RNA, 22 nt, Human
aaagaagugucuuacucccucu

SEQ ID NO: 239188 - RNA, 22 nt, Human
aaagacaauaauucucucuagc

SEQ ID NO: 239189 - RNA, 22 nt, Human
aaagaguuaagagucuuaagcu

SEQ ID NO: 239190 - RNA, 22 nt, Human
aaacuuuugaaggaggaaaaag

SEQ ID NO: 239191 - RNA, 22 nt, Human
aaacgcaauuucuugcauguca

SEQ ID NO: 239192 - RNA, 22 nt, Human
aaagcaaagaucuguagcccaa

SEQ ID NO: 239193 - RNA, 23 nt, Human
aaagaggugaauccaggacaagc

SEQ ID NO: 239194 - RNA, 22 nt, Human
aaauuaacuaucacuuuuguga

SEQ ID NO: 239195 - RNA, 22 nt, Human
aaauuaggcccugauuuuaugu

SEQ ID NO: 239196 - RNA, 22 nt, Human
aaauggauaaucaagauaauca

SEQ ID NO: 239197 - RNA, 22 nt, Human
aaaugguguucuuuagaugaaa

SEQ ID NO: 239198 - RNA, 22 nt, Human
aaauguaaacuguauuuauaaa

SEQ ID NO: 239199 - RNA, 22 nt, Human
aaauccaucaaaucuucuagaa

SEQ ID NO: 239200 - RNA, 22 nt, Human
aaaucugaauuaaaaucugguu

SEQ ID NO: 239201 - RNA, 22 nt, Human
aaauauauauaauauauauauu

SEQ ID NO: 239202 - RNA, 22 nt, Human
aaauauagugacacuuauaguc

SEQ ID NO: 239203 - RNA, 22 nt, Human
aaaugcucgccagguuuuauua

SEQ ID NO: 239204 - RNA, 22 nt, Human
aaaucuuccugaaauuuguuca

SEQ ID NO: 239205 - RNA, 22 nt, Human
aaaucuuucacauauuuuuuau

SEQ ID NO: 239206 - RNA, 22 nt, Human
aaaugcacaauaaaguaaaggc

SEQ ID NO: 239207 - RNA, 22 nt, Human
aaauaugguaucugccaaacua

SEQ ID NO: 239208 - RNA, 22 nt, Human
aaauauuagacauaccuggaga

SEQ ID NO: 239209 - RNA, 22 nt, Human
aaaucauguuaaagagggaguu

SEQ ID NO: 239210 - RNA, 22 nt, Human
aaaucaaaagugguuauuuuau

SEQ ID NO: 239211 - RNA, 22 nt, Human
aaauuagucacaccagugucuu

SEQ ID NO: 239212 - RNA, 20 nt, Human
aaauugaacaagccaggcug

SEQ ID NO: 239213 - RNA, 22 nt, Human
aaauguauuagccuaugugaga

SEQ ID NO: 239214 - RNA, 22 nt, Human
aacaaaacauuuuacgaauaua

SEQ ID NO: 239215 - RNA, 22 nt, Human
aacaaagaacuuucuuccuuug

SEQ ID NO: 239216 - RNA, 22 nt, Human
aacaaccuaguaguaucuuuca

SEQ ID NO: 239217 - RNA, 22 nt, Human
aacauuuauguuuugaccaagu

SEQ ID NO: 239218 - RNA, 22 nt, Human
aacauuuccggccuuuuguucu

SEQ ID NO: 239219 - RNA, 19 nt, Human
aacaaaauaguucuaguua

SEQ ID NO: 239220 - RNA, 22 nt, Human
aacaaagaaaagcuugagguuu

SEQ ID NO: 239221 - RNA, 21 nt, Human
aaagugguaaggauuauuuug

SEQ ID NO: 239222 - RNA, 22 nt, Human
aaaguagaugagaauuuuguug

SEQ ID NO: 239223 - RNA, 22 nt, Human
aaauauugaauuugaggaugua

SEQ ID NO: 239224 - RNA, 22 nt, Human
aaaguugcauccuaugaccuca

SEQ ID NO: 239225 - RNA, 22 nt, Human
aaauauuaaugaugaagguagu

SEQ ID NO: 239226 - RNA, 22 nt, Human
aaauauauccuucuguccugcc

SEQ ID NO: 239227 - RNA, 22 nt, Human
aaauaggaguagugauguauua

SEQ ID NO: 239228 - RNA, 23 nt, Human
aaauaauaauuucucuguuggga

SEQ ID NO: 239229 - RNA, 22 nt, Human
aaaguuguccuuugugccuuua

SEQ ID NO: 239230 - RNA, 22 nt, Human
aaaucaagucagcugaauucca

SEQ ID NO: 239231 - RNA, 22 nt, Human
aaauagucagaaaucaacgugc

SEQ ID NO: 239232 - RNA, 22 nt, Human
aaauauuugaaugguguaagau

SEQ ID NO: 239233 - RNA, 22 nt, Human
aaaucugaaggaaacagcuuca

SEQ ID NO: 239234 - RNA, 22 nt, Human
aaaucauagccaugaacauuug

SEQ ID NO: 239235 - RNA, 22 nt, Human
aaagccuacagucaugguuaga

SEQ ID NO: 239236 - RNA, 22 nt, Human
aaaggcaugugcaacuacaaau

SEQ ID NO: 239237 - RNA, 22 nt, Human
aaagcccuccaggguauacauu

SEQ ID NO: 239238 - RNA, 22 nt, Human
aaaggaaacuaugaaucucugg

SEQ ID NO: 239239 - RNA, 22 nt, Human
aaaguguuuaacaaauugcuuu

SEQ ID NO: 239240 - RNA, 22 nt, Human
aaaguuaauucuuguuuuuuau

SEQ ID NO: 239241 - RNA, 22 nt, Human
aaaguguuaacacuggcuacuu

SEQ ID NO: 239242 - RNA, 22 nt, Human
aaagucugaaaaaguuuguggg

SEQ ID NO: 239243 - RNA, 22 nt, Human
aaaguagaauaauaaacccuug

SEQ ID NO: 239244 - RNA, 22 nt, Human
aaauaggucaaucagacuauga

SEQ ID NO: 239245 - RNA, 22 nt, Human
aaauagauuugacuacuuggug

SEQ ID NO: 239246 - RNA, 22 nt, Human
aaagguguagacucaguuaugc

SEQ ID NO: 239247 - RNA, 22 nt, Human
aaaguuacccaaucucuaugaa

SEQ ID NO: 239248 - RNA, 22 nt, Human
aaaguaaagccuauuuaauaau

SEQ ID NO: 239249 - RNA, 22 nt, Human
aaaguuacacgacuauuuaugu

SEQ ID NO: 239250 - RNA, 22 nt, Human
aauugcauucauuuguauauuu

SEQ ID NO: 239251 - RNA, 22 nt, Human
aauugccaagaauuagugauac

SEQ ID NO: 239252 - RNA, 22 nt, Human
aauugauauuagauuugucuca

SEQ ID NO: 239253 - RNA, 22 nt, Human
aauugcuuucacaaguguuaua

SEQ ID NO: 239254 - RNA, 22 nt, Human
aauuauucaugucugggcagcc

SEQ ID NO: 239255 - RNA, 22 nt, Human
aauuauucucucaacugagaug

SEQ ID NO: 239256 - RNA, 22 nt, Human
aauuauucuugccuagguuuaa

SEQ ID NO: 239257 - RNA, 22 nt, Human
aauugguuugaauaaauaaaga

SEQ ID NO: 239258 - RNA, 22 nt, Human
aauuguuagaaaugacuguuuu

SEQ ID NO: 239259 - RNA, 22 nt, Human
aauuuaaguuauugcuaaugug

SEQ ID NO: 239260 - RNA, 22 nt, Human
aauuuaauugguuuuuacuugu

SEQ ID NO: 239261 - RNA, 22 nt, Human
aauuucaucugagacugggagc

SEQ ID NO: 239262 - RNA, 22 nt, Human
aauuuauccuuuugcuaaagca

SEQ ID NO: 239263 - RNA, 20 nt, Human
aauuuagaguuuuaccaagg

SEQ ID NO: 239264 - RNA, 22 nt, Human
aauuuuauuagacaggcauaau

SEQ ID NO: 239265 - RNA, 22 nt, Human
aauuuuagcuaaagauccaugg

SEQ ID NO: 239266 - RNA, 22 nt, Human
aauuuuauuuuuuccccuagau

SEQ ID NO: 239267 - RNA, 22 nt, Human
acaaaaauauuguagaagugcu

SEQ ID NO: 239268 - RNA, 22 nt, Human
aauuucagaccaacgagucagg

SEQ ID NO: 239269 - RNA, 22 nt, Human
aauuucuuuagagguacugauc

SEQ ID NO: 239270 - RNA, 22 nt, Human
aauuucuccuuuucaguuagau

SEQ ID NO: 239271 - RNA, 22 nt, Human
aauuugcuccaaugucaguucu

SEQ ID NO: 239272 - RNA, 22 nt, Human
aauuucuuucagcugcuuuaag

SEQ ID NO: 239273 - RNA, 22 nt, Human
acaaagugaaaagcaucgaauu

SEQ ID NO: 239274 - RNA, 18 nt, Human
acaaaaauagugcuuugg

SEQ ID NO: 239275 - RNA, 22 nt, Human
acaaauuuaaauguugucuguu

SEQ ID NO: 239276 - RNA, 22 nt, Human
acaaccaugucaguucaaacca

SEQ ID NO: 239277 - RNA, 20 nt, Human
acaaccacugcucacaguuu

SEQ ID NO: 239278 - RNA, 22 nt, Human
acaacagaacuccugggauuuu

SEQ ID NO: 239279 - RNA, 22 nt, Human
aauuauguugaaauaugagaac

SEQ ID NO: 239280 - RNA, 22 nt, Human
aauuauguuugcuuuagaugga

SEQ ID NO: 239281 - RNA, 22 nt, Human
aauuauuaucauuaucuuccug

SEQ ID NO: 239282 - RNA, 22 nt, Human
aauuauuaagcuuucuccagug

SEQ ID NO: 239283 - RNA, 22 nt, Human
aauuauuauguggaagacgacg

SEQ ID NO: 239284 - RNA, 22 nt, Human
aauuaaauguuugguuugagcu

SEQ ID NO: 239285 - RNA, 22 nt, Human
aauuaacuggguucucagaugc

SEQ ID NO: 239286 - RNA, 22 nt, Human
aauguguauguguauauauaug

SEQ ID NO: 239287 - RNA, 22 nt, Human
aauguuuuucaaguguggagca

SEQ ID NO: 239288 - RNA, 22 nt, Human
aauguggaguugguuuccuucc

SEQ ID NO: 239289 - RNA, 22 nt, Human
aaugugguauuuuggcauucuu

SEQ ID NO: 239290 - RNA, 22 nt, Human
aauguuaguauuuaagagcuug

SEQ ID NO: 239291 - RNA, 22 nt, Human
aauguucauauggguagcagau

SEQ ID NO: 239292 - RNA, 23 nt, Human
aaugugaaauugaguuuuuguua

SEQ ID NO: 239293 - RNA, 22 nt, Human
aaugguagaguauuuuaauccu

SEQ ID NO: 239294 - RNA, 22 nt, Human
aaugugcauaacuuuauaaauu

SEQ ID NO: 239295 - RNA, 22 nt, Human
aauggcuagcauguaaaauauc

SEQ ID NO: 239296 - RNA, 22 nt, Human
aaugggauaggucuucaggaau

SEQ ID NO: 239297 - RNA, 22 nt, Human
aauccaaacaggauuaccuauc

SEQ ID NO: 239298 - RNA, 22 nt, Human
aaucaugguacaaguaagcacg

SEQ ID NO: 239299 - RNA, 22 nt, Human
aaucaucuguuguucccuugga

SEQ ID NO: 239300 - RNA, 22 nt, Human
aaugcuuuuugcgaaaugugca

SEQ ID NO: 239301 - RNA, 22 nt, Human
aaugcugugauuuauuaaguau

SEQ ID NO: 239302 - RNA, 22 nt, Human
aaugcugaaugcauguuuccau

SEQ ID NO: 239303 - RNA, 22 nt, Human
aaucgguugaacccaggaagug

SEQ ID NO: 239304 - RNA, 22 nt, Human
aaucuacaaugaaaaaauguuu

SEQ ID NO: 239305 - RNA, 22 nt, Human
aaugcgcagaguggugugugca

SEQ ID NO: 239306 - RNA, 22 nt, Human
aauggaaaaagaacuguuuaaa

SEQ ID NO: 239307 - RNA, 22 nt, Human
aauggauaacaccgguucuguc

SEQ ID NO: 239308 - RNA, 22 nt, Human
aauggagugguucuugcccucu

SEQ ID NO: 239309 - RNA, 22 nt, Human
aauggaugauuaaauggaugaa

SEQ ID NO: 239310 - RNA, 22 nt, Human
aauggcaaaaguuucggaaauu

SEQ ID NO: 239311 - RNA, 22 nt, Human
aaugcugugggauagggcuccu

SEQ ID NO: 239312 - RNA, 22 nt, Human
acauaaauagcacugugaauuu

SEQ ID NO: 239313 - RNA, 22 nt, Human
acaguuuuccuugguauagaac

SEQ ID NO: 239314 - RNA, 22 nt, Human
acaucacuugguuaaugugguc

SEQ ID NO: 239315 - RNA, 22 nt, Human
acagguauuaugaagccuauuu

SEQ ID NO: 239316 - RNA, 22 nt, Human
acagguaucccuuucuaccuga

SEQ ID NO: 239317 - RNA, 22 nt, Human
acaggauuuucagggaagguga

SEQ ID NO: 239318 - RNA, 22 nt, Human
acaggacaaaaaucuggauggc

SEQ ID NO: 239319 - RNA, 22 nt, Human
acagcucaggcccaucaacccc

SEQ ID NO: 239320 - RNA, 22 nt, Human
acagcugagaugcuacuugugg

SEQ ID NO: 239321 - RNA, 22 nt, Human
acaggaaugaagaugagagagu

SEQ ID NO: 239322 - RNA, 23 nt, Human
acagcaagaggaccagaugugag

SEQ ID NO: 239323 - RNA, 22 nt, Human
acagcuauuuaaaggcuuuagg

SEQ ID NO: 239324 - RNA, 22 nt, Human
acagcauagaggaaauguggaa

SEQ ID NO: 239325 - RNA, 20 nt, Human
acagagauccucucuuuauc

SEQ ID NO: 239326 - RNA, 22 nt, Human
acagacuuaguauccugcugcu

SEQ ID NO: 239327 - RNA, 22 nt, Human
acacuuuugcgagagcaugcag

SEQ ID NO: 239328 - RNA, 22 nt, Human
acagacuuuuagacuuaugagu

SEQ ID NO: 239329 - RNA, 22 nt, Human
acagaauugggguucuugggga

SEQ ID NO: 239330 - RNA, 22 nt, Human
acagacuugaccuuggagaggc

SEQ ID NO: 239331 - RNA, 22 nt, Human
acagacaucaucaacaucuucc

SEQ ID NO: 239332 - RNA, 22 nt, Human
acacucaugcucagcuggugcu

SEQ ID NO: 239333 - RNA, 22 nt, Human
acacagugaccuacauuccaaa

SEQ ID NO: 239334 - RNA, 22 nt, Human
acacaagaaugugcacucagcc

SEQ ID NO: 239335 - RNA, 19 nt, Human
acacaccagugccugugac

SEQ ID NO: 239336 - RNA, 22 nt, Human
acaaucagcacugaguuuaucu

SEQ ID NO: 239337 - RNA, 17 nt, Human
acaaugggcaacaauau

SEQ ID NO: 239338 - RNA, 22 nt, Human
acacaacuuuauuaauuuauac

SEQ ID NO: 239339 - RNA, 22 nt, Human
acaaucuuauuaguaguauaga

SEQ ID NO: 239340 - RNA, 22 nt, Human
acaaucauuuuuccccuucagu

SEQ ID NO: 239341 - RNA, 22 nt, Human
acaauaauguuuuuagguuauu

SEQ ID NO: 239342 - RNA, 22 nt, Human
acaaguuucauuguuuagaacc

SEQ ID NO: 239343 - RNA, 22 nt, Human
acaagaaaggucugggaacaau

SEQ ID NO: 239344 - RNA, 22 nt, Human
acaacuuuaauggguuucagcu

SEQ ID NO: 239345 - RNA, 22 nt, Human
acaaggaagaaaacauuacuuu

SEQ ID NO: 239346 - RNA, 22 nt, Human
aaguuuaagguagugaugauga

SEQ ID NO: 239347 - RNA, 22 nt, Human
aaguucuuauguucugaugugc

SEQ ID NO: 239348 - RNA, 20 nt, Human
aaguugaaguuacuucaugg

SEQ ID NO: 239349 - RNA, 22 nt, Human
aagugauuuuccuacuugcuaa

SEQ ID NO: 239350 - RNA, 22 nt, Human
aauaacuuacucuaugcuuagu

SEQ ID NO: 239351 - RNA, 22 nt, Human
aauaauacaugugaugagaauu

SEQ ID NO: 239352 - RNA, 22 nt, Human
aauaacaguuuauuugagggcu

SEQ ID NO: 239353 - RNA, 22 nt, Human
aauaagaguuaagaaguauauu

SEQ ID NO: 239354 - RNA, 22 nt, Human
aauaaagcuugaaagcagggaa

SEQ ID NO: 239355 - RNA, 20 nt, Human
aauaaauauaacccauaauu

SEQ ID NO: 239356 - RNA, 21 nt, Human
aaguuucucccuaauuguugc

SEQ ID NO: 239357 - RNA, 16 nt, Human
aaguuuuaucuucuca

SEQ ID NO: 239358 - RNA, 22 nt, Human
aaucaauuauccauuuguuagu

SEQ ID NO: 239359 - RNA, 23 nt, Human
aaucacuggauuugagcaugagg

SEQ ID NO: 239360 - RNA, 22 nt, Human
aaucaaauuucuugugguuguu

SEQ ID NO: 239361 - RNA, 22 nt, Human
aauauuuaccuaccugucaucu

SEQ ID NO: 239362 - RNA, 22 nt, Human
aauauuuugggacugaggaauu

SEQ ID NO: 239363 - RNA, 22 nt, Human
aaucacuuagaacccaggaagu

SEQ ID NO: 239364 - RNA, 22 nt, Human
aaucacuucuuugucuucuuca

SEQ ID NO: 239365 - RNA, 22 nt, Human
aaucauaacaaaagcaauuaua

SEQ ID NO: 239366 - RNA, 22 nt, Human
aauaugucacacuccuuaauag

SEQ ID NO: 239367 - RNA, 22 nt, Human
aauacaaucagauuaugguagu

SEQ ID NO: 239368 - RNA, 22 nt, Human
aauaaugguuugauucucacau

SEQ ID NO: 239369 - RNA, 20 nt, Human
aauagcacagcucaaacauu

SEQ ID NO: 239370 - RNA, 22 nt, Human
aauacagcacucacaccucccu

SEQ ID NO: 239371 - RNA, 22 nt, Human
aauagaguccuguacugaauga

SEQ ID NO: 239372 - RNA, 22 nt, Human
aauaugcaaagcguguuaucug

SEQ ID NO: 239373 - RNA, 22 nt, Human
aauauuuaaauagaauuacauc

SEQ ID NO: 239374 - RNA, 22 nt, Human
aauaucuagccuuuagcagcuu

SEQ ID NO: 239375 - RNA, 22 nt, Human
aauagcaauuacccuucaacuc

SEQ ID NO: 239376 - RNA, 22 nt, Human
aauaugaugccaaauugcuaca

SEQ ID NO: 239377 - RNA, 22 nt, Human
aauaucuugaguuauaaauuca

SEQ ID NO: 239378 - RNA, 22 nt, Human
aagugauuuagagagcucuuag

SEQ ID NO: 239379 - RNA, 22 nt, Human
aagugauauaaaucgagaggga

SEQ ID NO: 239380 - RNA, 22 nt, Human
aagugauuuucccaccaucuac

SEQ ID NO: 239381 - RNA, 22 nt, Human
aagugaagccaauuuuuuuagg

SEQ ID NO: 239382 - RNA, 20 nt, Human
aagucuauuuagaguugcuu

SEQ ID NO: 239383 - RNA, 22 nt, Human
aagugaaaaaagucaguacuga

SEQ ID NO: 239384 - RNA, 22 nt, Human
aagguggugaucaucuugaagg

SEQ ID NO: 239385 - RNA, 22 nt, Human
aaguagaaaaccgcacuggacu

SEQ ID NO: 239386 - RNA, 22 nt, Human
aaguaauuugugaaggcauguu

SEQ ID NO: 239387 - RNA, 22 nt, Human
aaguaacuggggagggagggug

SEQ ID NO: 239388 - RNA, 19 nt, Human
aaguauagucagccuucua

SEQ ID NO: 239389 - RNA, 22 nt, Human
aaguagccuguuauguaguuca

SEQ ID NO: 239390 - RNA, 22 nt, Human
aagucauuaucucuucuaaucu

SEQ ID NO: 239391 - RNA, 21 nt, Human
aaguccaauaccuaaggcucc

SEQ ID NO: 239392 - RNA, 22 nt, Human
aaguccaaaacauuucucugcu

SEQ ID NO: 239393 - RNA, 23 nt, Human
aaggugaagccaccaggugagga

SEQ ID NO: 239394 - RNA, 22 nt, Human
aaggucucucgggcuuugcuga

SEQ ID NO: 239395 - RNA, 22 nt, Human
aaggcuuugugcugaguugucg

SEQ ID NO: 239396 - RNA, 22 nt, Human
aagggaaaagcugaaugagaug

SEQ ID NO: 239397 - RNA, 22 nt, Human
aagcuuugggcagaagaggauu

SEQ ID NO: 239398 - RNA, 22 nt, Human
aagaucugaccgugauggcggc

SEQ ID NO: 239399 - RNA, 22 nt, Human
aagauagaaugauguuggcuca

SEQ ID NO: 239400 - RNA, 22 nt, Human
aagcaaagucaucuagaguagu

SEQ ID NO: 239401 - RNA, 22 nt, Human
aagauuugaaaguggugcauuu

SEQ ID NO: 239402 - RNA, 22 nt, Human
aagcaaaagguuacacuucugg

SEQ ID NO: 239403 - RNA, 22 nt, Human
aagauauauaacccuuucacuu

SEQ ID NO: 239404 - RNA, 22 nt, Human
aagcaaaugguauugguauuau

SEQ ID NO: 239405 - RNA, 22 nt, Human
aagaugaucagagggcaagagg

SEQ ID NO: 239406 - RNA, 22 nt, Human
aagauauauaaggaaguucagu

SEQ ID NO: 239407 - RNA, 21 nt, Human
aagcagcugcagaauuucagu

SEQ ID NO: 239408 - RNA, 22 nt, Human
aagauuuaccacuuuauucaag

SEQ ID NO: 239409 - RNA, 22 nt, Human
aagaugaguuacaaaggaguaa

SEQ ID NO: 239410 - RNA, 22 nt, Human
aagcagaacuguuuuguuuucu

SEQ ID NO: 239411 - RNA, 23 nt, Human
aagaaugcuucugaagagcugcc

SEQ ID NO: 239412 - RNA, 22 nt, Human
aagacagaaaagcagagagagg

SEQ ID NO: 239413 - RNA, 22 nt, Human
aagaacuagauagugguguaaa

SEQ ID NO: 239414 - RNA, 22 nt, Human
aagaagcuacugucacuaucag

SEQ ID NO: 239415 - RNA, 22 nt, Human
aagaaggaaggcaagagauggg

SEQ ID NO: 239416 - RNA, 22 nt, Human
aagaaaccauauuaguuccugg

SEQ ID NO: 239417 - RNA, 22 nt, Human
aagaaagaucugaaagaagcga

SEQ ID NO: 239418 - RNA, 22 nt, Human
aaccaaaguugguauuuaauaa

SEQ ID NO: 239419 - RNA, 22 nt, Human
aagaaaagaaacauggguaugc

SEQ ID NO: 239420 - RNA, 22 nt, Human
aagaaaagguaaccgcuuaucu

SEQ ID NO: 239421 - RNA, 22 nt, Human
aagacacuuucuaaauagaagu

SEQ ID NO: 239422 - RNA, 22 nt, Human
aagaacaacugcuuuaaaagca

SEQ ID NO: 239423 - RNA, 22 nt, Human
aagaaauacagaaauggcagua

SEQ ID NO: 239424 - RNA, 22 nt, Human
aagaaauagauagaggaauacu

SEQ ID NO: 239425 - RNA, 22 nt, Human
aaggcaguuaauuuggcuagaa

SEQ ID NO: 239426 - RNA, 22 nt, Human
aaggcacuugcccagagcugca

SEQ ID NO: 239427 - RNA, 22 nt, Human
aaggaugguaacaguuucauuu

SEQ ID NO: 239428 - RNA, 22 nt, Human
aagcuguuauuucacagguuca

SEQ ID NO: 239429 - RNA, 22 nt, Human
aagcuuugaauauuagaccuug

SEQ ID NO: 239430 - RNA, 22 nt, Human
aaggaaaaaauggcuugugaua

SEQ ID NO: 239431 - RNA, 22 nt, Human
aaggaaaaccugacugaagaac

SEQ ID NO: 239432 - RNA, 22 nt, Human
aagcucuuuccacuaaaccacu

SEQ ID NO: 239433 - RNA, 22 nt, Human
aagcagugacucucagaggcag

SEQ ID NO: 239434 - RNA, 22 nt, Human
aagcaaaaucgcaucuggggcc

SEQ ID NO: 239435 - RNA, 23 nt, Human
aagcaacagacuucaucagauau

SEQ ID NO: 239436 - RNA, 22 nt, Human
aagcaaguucuaaaguaauucu

SEQ ID NO: 239437 - RNA, 22 nt, Human
auaaaaucugaagcaagaauaa

SEQ ID NO: 239438 - RNA, 22 nt, Human
auaaaacagaucaggagaauga

SEQ ID NO: 239439 - RNA, 22 nt, Human
aguuuuuaacgccauguuugaa

SEQ ID NO: 239440 - RNA, 22 nt, Human
aguuuuguuuguuuguuuguua

SEQ ID NO: 239441 - RNA, 22 nt, Human
auaaauucuaugauggauuggg

SEQ ID NO: 239442 - RNA, 22 nt, Human
auaaauuugacagcucuucaug

SEQ ID NO: 239443 - RNA, 22 nt, Human
auaaaaauguuuuuguguggua

SEQ ID NO: 239444 - RNA, 22 nt, Human
auaaagggccuuauuuuagcaa

SEQ ID NO: 239445 - RNA, 20 nt, Human
auaaauaggauuuucugaca

SEQ ID NO: 239446 - RNA, 22 nt, Human
auaaggaaagugagugcuuaaa

SEQ ID NO: 239447 - RNA, 22 nt, Human
auaaucuuugaguagaguugag

SEQ ID NO: 239448 - RNA, 22 nt, Human
auaaccaaaaauaguuuaguac

SEQ ID NO: 239449 - RNA, 22 nt, Human
auaacgaaagcaauuauuuuca

SEQ ID NO: 239450 - RNA, 22 nt, Human
auaagcuucucugcaguucagu

SEQ ID NO: 239451 - RNA, 22 nt, Human
auaaaguaaugcauauaaugug

SEQ ID NO: 239452 - RNA, 22 nt, Human
auaaucuuuccagucaguuucc

SEQ ID NO: 239453 - RNA, 22 nt, Human
auaaugccucauaggguguucc

SEQ ID NO: 239454 - RNA, 22 nt, Human
auaaaagcacaauagaguuaug

SEQ ID NO: 239455 - RNA, 21 nt, Human
auacaguucagcuuuuacuau

SEQ ID NO: 239456 - RNA, 22 nt, Human
auacauaggauauguacgugca

SEQ ID NO: 239457 - RNA, 23 nt, Human
auaaugauaaugcuauuuuuugu

SEQ ID NO: 239458 - RNA, 22 nt, Human
auaaguuauuuuaguaaaucag

SEQ ID NO: 239459 - RNA, 22 nt, Human
auaaggcauagugagucaucau

SEQ ID NO: 239460 - RNA, 22 nt, Human
auaauugaauaagagcugcagg

SEQ ID NO: 239461 - RNA, 22 nt, Human
auaccuauagcagacugagacu

SEQ ID NO: 239462 - RNA, 22 nt, Human
auacaugacucacacauucugc

SEQ ID NO: 239463 - RNA, 22 nt, Human
auaccaaugacaggaguuaggg

SEQ ID NO: 239464 - RNA, 22 nt, Human
auaaauuugccagcauauguuc

SEQ ID NO: 239465 - RNA, 22 nt, Human
auacaaaaaguggugaguguau

SEQ ID NO: 239466 - RNA, 22 nt, Human
auacacauguuauuguggaagc

SEQ ID NO: 239467 - RNA, 22 nt, Human
auaaaucaagggcaguauuucc

SEQ ID NO: 239468 - RNA, 22 nt, Human
auacacuucauguuuucaucug

SEQ ID NO: 239469 - RNA, 18 nt, Human
aguuuuuuuggcaaaagg

SEQ ID NO: 239470 - RNA, 22 nt, Human
auaaaaaguggcugcuauugga

SEQ ID NO: 239471 - RNA, 22 nt, Human
aguuuuugccucgaauucugcg

SEQ ID NO: 239472 - RNA, 22 nt, Human
aguuugauuugucuaucuucau

SEQ ID NO: 239473 - RNA, 22 nt, Human
aguuuucugccucuggaugcgu

SEQ ID NO: 239474 - RNA, 22 nt, Human
aguuuacccacuguugaaauua

SEQ ID NO: 239475 - RNA, 22 nt, Human
aguuuggaggagaaagugcggg

SEQ ID NO: 239476 - RNA, 22 nt, Human
aguuuguagguuaggaucagca

SEQ ID NO: 239477 - RNA, 22 nt, Human
aguuuggauccugcuaaaccag

SEQ ID NO: 239478 - RNA, 23 nt, Human
aguuuacguauucauucuuacuc

SEQ ID NO: 239479 - RNA, 22 nt, Human
aguuuaaauuguucuaucagaa

SEQ ID NO: 239480 - RNA, 22 nt, Human
aguuucaguuaguugggugaca

SEQ ID NO: 239481 - RNA, 22 nt, Human
aguuucuugaagacugauguuu

SEQ ID NO: 239482 - RNA, 21 nt, Human
aguuguacuguauagcagaug

SEQ ID NO: 239483 - RNA, 22 nt, Human
aguugguguuagaguuuuucag

SEQ ID NO: 239484 - RNA, 22 nt, Human
aguugguauuuacugcaguugg

SEQ ID NO: 239485 - RNA, 22 nt, Human
aguugcuaauacaaaaaguccc

SEQ ID NO: 239486 - RNA, 22 nt, Human
aguuggcauuuuauuuaaguau

SEQ ID NO: 239487 - RNA, 22 nt, Human
aguugguggaagcuaagcuucu

SEQ ID NO: 239488 - RNA, 22 nt, Human
aguuguuuuucuuagauuuuag

SEQ ID NO: 239489 - RNA, 22 nt, Human
aguucucaagguuaggaaaagu

SEQ ID NO: 239490 - RNA, 22 nt, Human
aguucuuugcucccugcuuuuu

SEQ ID NO: 239491 - RNA, 22 nt, Human
aguggugaucuguuacagucac

SEQ ID NO: 239492 - RNA, 22 nt, Human
agugcuuuauguuguugugcaa

SEQ ID NO: 239493 - RNA, 20 nt, Human
agugauuuguuaguacauug

SEQ ID NO: 239494 - RNA, 22 nt, Human
agugaugcuuuggagaagaucc

SEQ ID NO: 239495 - RNA, 20 nt, Human
agucuuaucugcauuuagaa

SEQ ID NO: 239496 - RNA, 22 nt, Human
agugaaauaugcccauugcugu

SEQ ID NO: 239497 - RNA, 22 nt, Human
agugaaagaaaacuguuagaac

SEQ ID NO: 239498 - RNA, 19 nt, Human
agugaacuccauaucaggu

SEQ ID NO: 239499 - RNA, 22 nt, Human
aguagagacgggguuuuaguag

SEQ ID NO: 239500 - RNA, 22 nt, Human
aguagggugaggaggggaguga

SEQ ID NO: 239501 - RNA, 22 nt, Human
aguagucacuucacccauccca

SEQ ID NO: 239502 - RNA, 22 nt, Human
aguacuuggaaaaaugcccacu

SEQ ID NO: 239503 - RNA, 22 nt, Human
aguagacuuuuuauuuguuuug

SEQ ID NO: 239504 - RNA, 22 nt, Human
aguagaauuacagguuuucucu

SEQ ID NO: 239505 - RNA, 22 nt, Human
agugaagauagagccaggucug

SEQ ID NO: 239506 - RNA, 22 nt, Human
agugagaguauuaaugugaacu

SEQ ID NO: 239507 - RNA, 22 nt, Human
agugauguaauggugaauguga

SEQ ID NO: 239508 - RNA, 21 nt, Human
agugaguagagcacugaguca

SEQ ID NO: 239509 - RNA, 22 nt, Human
agugaugauccaaaugaauuga

SEQ ID NO: 239510 - RNA, 22 nt, Human
aguucaauuguuuuguaaaagu

SEQ ID NO: 239511 - RNA, 22 nt, Human
aguucauaucuacuuuuccauc

SEQ ID NO: 239512 - RNA, 22 nt, Human
aguuauuaagaaaauuuugcca

SEQ ID NO: 239513 - RNA, 22 nt, Human
aguuauuuuucacuauuaggcu

SEQ ID NO: 239514 - RNA, 22 nt, Human
aguuaguagacuuuuccauuua

SEQ ID NO: 239515 - RNA, 22 nt, Human
aguuaaucuuguauuaaugguu

SEQ ID NO: 239516 - RNA, 22 nt, Human
aguguuuuaagaaaguaauuuu

SEQ ID NO: 239517 - RNA, 20 nt, Human
aguguuggugcuuuucccag

SEQ ID NO: 239518 - RNA, 22 nt, Human
aguuacuauuacuuauuauuau

SEQ ID NO: 239519 - RNA, 23 nt, Human
aguuaucuaaugaaguucuucca

SEQ ID NO: 239520 - RNA, 22 nt, Human
aguuaauuauagugcuuaauau

SEQ ID NO: 239521 - RNA, 17 nt, Human
aguuacugcacuugcca

SEQ ID NO: 239522 - RNA, 22 nt, Human
aguuaggaaauaaguugaguuu

SEQ ID NO: 239523 - RNA, 22 nt, Human
aguuauggguauguauuauaau

SEQ ID NO: 239524 - RNA, 22 nt, Human
aguuaugcaagcaaguaccacu

SEQ ID NO: 239525 - RNA, 22 nt, Human
aguuaaagggggcuacagugug

SEQ ID NO: 239526 - RNA, 23 nt, Human
aguguucagcauguaguaaauac

SEQ ID NO: 239527 - RNA, 20 nt, Human
aguguugaacuacacuuccc

SEQ ID NO: 239528 - RNA, 22 nt, Human
aguguauuugccuauaaaaaug

SEQ ID NO: 239529 - RNA, 22 nt, Human
agugucagcagcuucauugucu

SEQ ID NO: 239530 - RNA, 22 nt, Human
aguguguauauaugugugugug

SEQ ID NO: 239531 - RNA, 22 nt, Human
aguguuaggaauuaauguaggg

SEQ ID NO: 239532 - RNA, 20 nt, Human
agggucucuccuggcucugc

SEQ ID NO: 239533 - RNA, 22 nt, Human
agguauuuuaugucgugugaug

SEQ ID NO: 239534 - RNA, 22 nt, Human
aggguaauaacaguauggugau

SEQ ID NO: 239535 - RNA, 22 nt, Human
agggcauacauuuuccugagau

SEQ ID NO: 239536 - RNA, 20 nt, Human
agggauuugguugguauugu

SEQ ID NO: 239537 - RNA, 22 nt, Human
aguaagaaagaaugauaggccu

SEQ ID NO: 239538 - RNA, 22 nt, Human
aguaaaugaaagcaauuuuaga

SEQ ID NO: 239539 - RNA, 22 nt, Human
aguaacuuaagcaauuguguau

SEQ ID NO: 239540 - RNA, 22 nt, Human
agguuuuagagagccaggaugu

SEQ ID NO: 239541 - RNA, 18 nt, Human
aguaaauguuaaauauug

SEQ ID NO: 239542 - RNA, 22 nt, Human
agguuguaagcuuuauauaaau

SEQ ID NO: 239543 - RNA, 22 nt, Human
agguuuaggaaaacugagaguc

SEQ ID NO: 239544 - RNA, 22 nt, Human
agguuguugagaucaucuggcu

SEQ ID NO: 239545 - RNA, 22 nt, Human
agguuuauggagcaccacaucu

SEQ ID NO: 239546 - RNA, 22 nt, Human
aggugcuuaaagaauguguggu

SEQ ID NO: 239547 - RNA, 22 nt, Human
aggugagaacguggaggggcgg

SEQ ID NO: 239548 - RNA, 22 nt, Human
aggugauauuauguauuucuau

SEQ ID NO: 239549 - RNA, 22 nt, Human
aggugauaugggcuucucugag

SEQ ID NO: 239550 - RNA, 19 nt, Human
aggugaugugacucuagaa

SEQ ID NO: 239551 - RNA, 22 nt, Human
agguuagaauauuuuuucaaga

SEQ ID NO: 239552 - RNA, 22 nt, Human
aggugguauuuaaaauuauuug

SEQ ID NO: 239553 - RNA, 22 nt, Human
agguguaauuacucuugcaguu

SEQ ID NO: 239554 - RNA, 22 nt, Human
aggauuuagcaugaaaugugaa

SEQ ID NO: 239555 - RNA, 22 nt, Human
aggauuagucaccauuauuauu

SEQ ID NO: 239556 - RNA, 22 nt, Human
aggagguagggugugaaacagc

SEQ ID NO: 239557 - RNA, 20 nt, Human
aggauuauguacauggaugc

SEQ ID NO: 239558 - RNA, 22 nt, Human
aggauugaaaaaacacauauau

SEQ ID NO: 239559 - RNA, 22 nt, Human
aggauuuauuccagaaaugcaa

SEQ ID NO: 239560 - RNA, 22 nt, Human
aggcaauuuuuaggguuguugu

SEQ ID NO: 239561 - RNA, 22 nt, Human
aggaauuugggguuacaugaug

SEQ ID NO: 239562 - RNA, 22 nt, Human
aggaacaguuucaaagagugaa

SEQ ID NO: 239563 - RNA, 22 nt, Human
aggaauuucacugcguuuuuua

SEQ ID NO: 239564 - RNA, 22 nt, Human
aggaauuuuaauaugcuugucu

SEQ ID NO: 239565 - RNA, 22 nt, Human
aggaauugucgucauguauaau

SEQ ID NO: 239566 - RNA, 22 nt, Human
aggaaauaagggcacuucagau

SEQ ID NO: 239567 - RNA, 22 nt, Human
aggcauuuaaagauguaagacu

SEQ ID NO: 239568 - RNA, 21 nt, Human
aggcauuuucuuggagauucu

SEQ ID NO: 239569 - RNA, 22 nt, Human
aggcauauaguguuuaaaaaaa

SEQ ID NO: 239570 - RNA, 22 nt, Human
aggcaguggcuuuuguuguguu

SEQ ID NO: 239571 - RNA, 22 nt, Human
aggcauuuaucaggaaauguuc

SEQ ID NO: 239572 - RNA, 22 nt, Human
aggcauuuucuuguuauuuuua

SEQ ID NO: 239573 - RNA, 22 nt, Human
aggccccacaaacucgccuuug

SEQ ID NO: 239574 - RNA, 22 nt, Human
aggauugauggcauguuuacug

SEQ ID NO: 239575 - RNA, 22 nt, Human
aggcagcagggagggagaaaug

SEQ ID NO: 239576 - RNA, 22 nt, Human
aggcaauuauacuagguuuugg

SEQ ID NO: 239577 - RNA, 22 nt, Human
aggcaguguguagcuggaagag

SEQ ID NO: 239578 - RNA, 22 nt, Human
acgccugccuguacuugugggg

SEQ ID NO: 239579 - RNA, 22 nt, Human
acaucucacuucuuugaaggcu

SEQ ID NO: 239580 - RNA, 21 nt, Human
acaguaugaucaaaugugcca

SEQ ID NO: 239581 - RNA, 22 nt, Human
acuauacaguauguacgugcac

SEQ ID NO: 239582 - RNA, 22 nt, Human
acguugaaaugggcauuuuccg

SEQ ID NO: 239583 - RNA, 22 nt, Human
acguuauagaugcuucaugaaa

SEQ ID NO: 239584 - RNA, 22 nt, Human
acgugcauuacucaaaucucaa

SEQ ID NO: 239585 - RNA, 22 nt, Human
acuaauuuacagaaauuucuua

SEQ ID NO: 239586 - RNA, 22 nt, Human
acuacucagcaaacauuugcug

SEQ ID NO: 239587 - RNA, 20 nt, Human
acuagaaagucacugggggg

SEQ ID NO: 239588 - RNA, 22 nt, Human
acuauauaaugcacacaguaua

SEQ ID NO: 239589 - RNA, 22 nt, Human
acuaucaacagcaucagggugu

SEQ ID NO: 239590 - RNA, 22 nt, Human
acuaucuauugucuucuucaug

SEQ ID NO: 239591 - RNA, 22 nt, Human
acugaugacaaugugaguguuc

SEQ ID NO: 239592 - RNA, 22 nt, Human
acugacuucugguauuuuuagu

SEQ ID NO: 239593 - RNA, 22 nt, Human
acugaaauggggacaguccuua

SEQ ID NO: 239594 - RNA, 22 nt, Human
acugaaaguugaugagucacug

SEQ ID NO: 239595 - RNA, 22 nt, Human
acugaaggcuggaccaugcauc

SEQ ID NO: 239596 - RNA, 22 nt, Human
acucuuauuuugaaguaauaau

SEQ ID NO: 239597 - RNA, 22 nt, Human
acuauuguccgauuucuuuacu

SEQ ID NO: 239598 - RNA, 22 nt, Human
acucaguaacuguuugcugaau

SEQ ID NO: 239599 - RNA, 22 nt, Human
acucugaaaggcuacaaaugcu

SEQ ID NO: 239600 - RNA, 22 nt, Human
acucugaggauuucaguuuuac

SEQ ID NO: 239601 - RNA, 22 nt, Human
acucugcaguaaggaauuguuu

SEQ ID NO: 239602 - RNA, 22 nt, Human
acucugagaugugucuugauuc

SEQ ID NO: 239603 - RNA, 22 nt, Human
acuucucuuuucauuaauuuug

SEQ ID NO: 239604 - RNA, 22 nt, Human
acuucuuuugcaugauucuuua

SEQ ID NO: 239605 - RNA, 22 nt, Human
acuuccuuuuuuggggauagca

SEQ ID NO: 239606 - RNA, 22 nt, Human
acuucauuugaaaugguugaau

SEQ ID NO: 239607 - RNA, 22 nt, Human
acuggauucucuuacacagaug

SEQ ID NO: 239608 - RNA, 22 nt, Human
acuucagugugguauaaaacgu

SEQ ID NO: 239609 - RNA, 22 nt, Human
acuugcauuguguaguguuuuu

SEQ ID NO: 239610 - RNA, 22 nt, Human
acuugcaucuuagagacucacc

SEQ ID NO: 239611 - RNA, 22 nt, Human
acuugauggaguuucacuguau

SEQ ID NO: 239612 - RNA, 19 nt, Human
acuugcuuucauuuaagau

SEQ ID NO: 239613 - RNA, 17 nt, Human
acuuaagacaguggaaa

SEQ ID NO: 239614 - RNA, 22 nt, Human
acuuauaaauuuaguacacugu

SEQ ID NO: 239615 - RNA, 20 nt, Human
acuuucacaugaacauuuaa

SEQ ID NO: 239616 - RNA, 22 nt, Human
acuuuaaauaucauuugguagg

SEQ ID NO: 239617 - RNA, 22 nt, Human
acuugaugcauauggaagagca

SEQ ID NO: 239618 - RNA, 22 nt, Human
acuugagcuugaaagguaugcu

SEQ ID NO: 239619 - RNA, 20 nt, Human
agaaaggaguaaagaagaga

SEQ ID NO: 239620 - RNA, 22 nt, Human
agaaauggccagacuugccccu

SEQ ID NO: 239621 - RNA, 22 nt, Human
acuuggucguggugcagcaugg

SEQ ID NO: 239622 - RNA, 22 nt, Human
agaaaagaggcuuucuaagcau

SEQ ID NO: 239623 - RNA, 22 nt, Human
agaaugucaagucaagaacaau

SEQ ID NO: 239624 - RNA, 19 nt, Human
agaauuggaaccaugaacc

SEQ ID NO: 239625 - RNA, 22 nt, Human
agaauuuguaucuacggugugc

SEQ ID NO: 239626 - RNA, 22 nt, Human
agaauauaguaaauauuuucua

SEQ ID NO: 239627 - RNA, 22 nt, Human
agacaaucaacuguugaugccu

SEQ ID NO: 239628 - RNA, 22 nt, Human
agacacauuuucagcucugcca

SEQ ID NO: 239629 - RNA, 22 nt, Human
agacaauuccauccuacguggg

SEQ ID NO: 239630 - RNA, 22 nt, Human
agaaguuuguuauguaaacaaa

SEQ ID NO: 239631 - RNA, 22 nt, Human
agaauacaauuguucaguaaua

SEQ ID NO: 239632 - RNA, 22 nt, Human
agaagguagaugcaucaggagg

SEQ ID NO: 239633 - RNA, 22 nt, Human
agaaguagacaguuggauauaa

SEQ ID NO: 239634 - RNA, 22 nt, Human
agaaguguacuuagagaacaua

SEQ ID NO: 239635 - RNA, 22 nt, Human
agaauguaagaaugcaaagauu

SEQ ID NO: 239636 - RNA, 22 nt, Human
agaaucugcauuuuaacaagau

SEQ ID NO: 239637 - RNA, 22 nt, Human
agaaucagagcagaaucuucau

SEQ ID NO: 239638 - RNA, 22 nt, Human
agaaggcaucugcucgcuucca

SEQ ID NO: 239639 - RNA, 22 nt, Human
agaagcagaaggaagcagggcc

SEQ ID NO: 239640 - RNA, 22 nt, Human
agaagcaauuggaaaguacagg

SEQ ID NO: 239641 - RNA, 22 nt, Human
agaauacuaauaagggauuugc

SEQ ID NO: 239642 - RNA, 22 nt, Human
agaauaagucuaauauauuggu

SEQ ID NO: 239643 - RNA, 22 nt, Human
agaaggcagaaaagcuuuacaa

SEQ ID NO: 239644 - RNA, 22 nt, Human
agaaaaggaagcuuagacugua

SEQ ID NO: 239645 - RNA, 22 nt, Human
agaaaauagguaguagacgggc

SEQ ID NO: 239646 - RNA, 22 nt, Human
agaagaagacccuaaggaaagg

SEQ ID NO: 239647 - RNA, 22 nt, Human
agaagauucagcaguagggugg

SEQ ID NO: 239648 - RNA, 22 nt, Human
agauaggcuuagccaagcuuuc

SEQ ID NO: 239649 - RNA, 22 nt, Human
agauaagaacauuaguaagccg

SEQ ID NO: 239650 - RNA, 22 nt, Human
agauauuauuuucuauuuauca

SEQ ID NO: 239651 - RNA, 22 nt, Human
agaugaacuuuuuuaaacugga

SEQ ID NO: 239652 - RNA, 22 nt, Human
agauauucugccuaacagguuu

SEQ ID NO: 239653 - RNA, 22 nt, Human
agaugacuaacauaguauugcu

SEQ ID NO: 239654 - RNA, 22 nt, Human
agaguaauguggaguuugugcu

SEQ ID NO: 239655 - RNA, 22 nt, Human
agaguguagugaaaagagauua

SEQ ID NO: 239656 - RNA, 22 nt, Human
agaguucaccccacugaugagu

SEQ ID NO: 239657 - RNA, 21 nt, Human
agaguugaaggcaguaaagag

SEQ ID NO: 239658 - RNA, 21 nt, Human
agaguuuucuccauuucaggc

SEQ ID NO: 239659 - RNA, 22 nt, Human
agauaaaucauuuauuaagcgg

SEQ ID NO: 239660 - RNA, 22 nt, Human
agauaaacaacucuuagcuguu

SEQ ID NO: 239661 - RNA, 22 nt, Human
agagccaugcuugugcauauau

SEQ ID NO: 239662 - RNA, 22 nt, Human
agagcuauuucuuaaaagcugu

SEQ ID NO: 239663 - RNA, 22 nt, Human
agacuauuuugugauaacuaau

SEQ ID NO: 239664 - RNA, 22 nt, Human
agacgacucuuaaggcagaauu

SEQ ID NO: 239665 - RNA, 22 nt, Human
agacacagcaauaacuacuguu

SEQ ID NO: 239666 - RNA, 22 nt, Human
agacucacuucuuucucguauu

SEQ ID NO: 239667 - RNA, 22 nt, Human
agacagaaaaguugucaaucau

SEQ ID NO: 239668 - RNA, 21 nt, Human
agauguucaguguccuaaccc

SEQ ID NO: 239669 - RNA, 22 nt, Human
agauugaugugaccauuggaag

SEQ ID NO: 239670 - RNA, 22 nt, Human
agauucgucuuuaauucaccau

SEQ ID NO: 239671 - RNA, 22 nt, Human
agcaaaauuccaaaaugcuaau

SEQ ID NO: 239672 - RNA, 22 nt, Human
agcaaaacuaaagacacagaca

SEQ ID NO: 239673 - RNA, 22 nt, Human
agcaaagccucuuugaaaaaaa

SEQ ID NO: 239674 - RNA, 19 nt, Human
agauggcaaaaugcaaaga

SEQ ID NO: 239675 - RNA, 22 nt, Human
agaugguucagaauuauaaaga

SEQ ID NO: 239676 - RNA, 22 nt, Human
agauugaacgagcuggcaugga

SEQ ID NO: 239677 - RNA, 22 nt, Human
agauggaggaaagcaguuagaa

SEQ ID NO: 239678 - RNA, 22 nt, Human
agauuucaauggauauugcaag

SEQ ID NO: 239679 - RNA, 22 nt, Human
agaugucauguguugcuccaag

SEQ ID NO: 239680 - RNA, 22 nt, Human
agauggcugggagcucuguuug

SEQ ID NO: 239681 - RNA, 22 nt, Human
agauggcuccaguguccagagg

SEQ ID NO: 239682 - RNA, 22 nt, Human
agaucauuaaccaccuguucug

SEQ ID NO: 239683 - RNA, 22 nt, Human
agaugaugugugucuucagcua

SEQ ID NO: 239684 - RNA, 22 nt, Human
agauguugucucuuacguuuga

SEQ ID NO: 239685 - RNA, 22 nt, Human
agauuaagcauuauaauuauaa

SEQ ID NO: 239686 - RNA, 22 nt, Human
agauuauuuaagacaggaacca

SEQ ID NO: 239687 - RNA, 22 nt, Human
agauaucuuguuggcauaaaug

SEQ ID NO: 239688 - RNA, 23 nt, Human
agaugaugaauaaagagugagga

SEQ ID NO: 239689 - RNA, 22 nt, Human
agccacacuuagucacaaagau

SEQ ID NO: 239690 - RNA, 22 nt, Human
agccagcauauauauaguugaa

SEQ ID NO: 239691 - RNA, 22 nt, Human
agccagugcagcuggaaauuca

SEQ ID NO: 239692 - RNA, 22 nt, Human
agcaguuuauccucauaaugga

SEQ ID NO: 239693 - RNA, 22 nt, Human
agccccaauuacagcugugcug

SEQ ID NO: 239694 - RNA, 22 nt, Human
agccccuaaaguagcuguucuu

SEQ ID NO: 239695 - RNA, 22 nt, Human
agccuugcaugauuucauucau

SEQ ID NO: 239696 - RNA, 22 nt, Human
agccuaauuuguaggucugugu

SEQ ID NO: 239697 - RNA, 22 nt, Human
agccuauucaucugaucuugaa

SEQ ID NO: 239698 - RNA, 22 nt, Human
agcacuuuagaauuuagaguug

SEQ ID NO: 239699 - RNA, 22 nt, Human
agcagauaaagguugcauuucu

SEQ ID NO: 239700 - RNA, 22 nt, Human
agcacuugggugauaguacuuu

SEQ ID NO: 239701 - RNA, 22 nt, Human
agcaauguuggccuauauaccu

SEQ ID NO: 239702 - RNA, 22 nt, Human
agcaaaguacugagcucaaagg

SEQ ID NO: 239703 - RNA, 22 nt, Human
agcaauucagagcauggacuuu

SEQ ID NO: 239704 - RNA, 19 nt, Human
agcaccuaucuggauaagg

SEQ ID NO: 239705 - RNA, 22 nt, Human
agcacauguuucuuuugcaauu

SEQ ID NO: 239706 - RNA, 22 nt, Human
agauuuuacggaguauuagggu

SEQ ID NO: 239707 - RNA, 22 nt, Human
agcacagugccugacauauaug

SEQ ID NO: 239708 - RNA, 22 nt, Human
agcaauucugaaauuacuugac

SEQ ID NO: 239709 - RNA, 22 nt, Human
agcaugaauugccauuuauuaa

SEQ ID NO: 239710 - RNA, 20 nt, Human
agcauucaacuuucuauguu

SEQ ID NO: 239711 - RNA, 22 nt, Human
gaauuacagaguuguuaaguca

SEQ ID NO: 239712 - RNA, 22 nt, Human
gaauuacuccaguguguggguu

SEQ ID NO: 239713 - RNA, 22 nt, Human
gaauguuaaugcacuucuagcu

SEQ ID NO: 239714 - RNA, 22 nt, Human
gaauguuugagugccaugugac

SEQ ID NO: 239715 - RNA, 22 nt, Human
gaaugggaauuauggugggacu

SEQ ID NO: 239716 - RNA, 19 nt, Human
gaauggguucuguagggag

SEQ ID NO: 239717 - RNA, 22 nt, Human
gaauuagacggcaucacauggg

SEQ ID NO: 239718 - RNA, 22 nt, Human
gaauuagguaauagaacuagua

SEQ ID NO: 239719 - RNA, 22 nt, Human
gaauucuaguucuguaucucug

SEQ ID NO: 239720 - RNA, 22 nt, Human
gaagugagcauccuaguuaacc

SEQ ID NO: 239721 - RNA, 22 nt, Human
gaaguucuuagucucauuugca

SEQ ID NO: 239722 - RNA, 22 nt, Human
gaauaagaauccacuucuggca

SEQ ID NO: 239723 - RNA, 22 nt, Human
gaaguauuucugaguugcccag

SEQ ID NO: 239724 - RNA, 22 nt, Human
gaauaccauuuacauuugaaaa

SEQ ID NO: 239725 - RNA, 22 nt, Human
gaauaauuuugaucagaaggga

SEQ ID NO: 239726 - RNA, 22 nt, Human
gaauacaaauaauaccaaggug

SEQ ID NO: 239727 - RNA, 22 nt, Human
gaauauuuaucucagcugcaga

SEQ ID NO: 239728 - RNA, 22 nt, Human
gaauggaugcuggucaguuugg

SEQ ID NO: 239729 - RNA, 22 nt, Human
gaaugcauuuuuuaaaagcaua

SEQ ID NO: 239730 - RNA, 22 nt, Human
gaauggagaacccuggacacug

SEQ ID NO: 239731 - RNA, 22 nt, Human
gaauggaacauagcaacaucuu

SEQ ID NO: 239732 - RNA, 22 nt, Human
gaaguaaugugauugcucaggg

SEQ ID NO: 239733 - RNA, 22 nt, Human
gaaguaaaacaguaacuuuguu

SEQ ID NO: 239734 - RNA, 22 nt, Human
gaaggugcugaaacagaaauuu

SEQ ID NO: 239735 - RNA, 22 nt, Human
gaagcuucgaaagagugauuuc

SEQ ID NO: 239736 - RNA, 22 nt, Human
gaaggaaaagacgugcuaagua

SEQ ID NO: 239737 - RNA, 18 nt, Human
gaagcaacaguucugagu

SEQ ID NO: 239738 - RNA, 22 nt, Human
gaagcagguucuucaggaugaa

SEQ ID NO: 239739 - RNA, 22 nt, Human
gaagcaccuggacggugccugg

SEQ ID NO: 239740 - RNA, 22 nt, Human
gaagccaacacgugggagggag

SEQ ID NO: 239741 - RNA, 22 nt, Human
gaaaaucaugaaaguguguugu

SEQ ID NO: 239742 - RNA, 22 nt, Human
gaaaaugcacacauacacaccc

SEQ ID NO: 239743 - RNA, 22 nt, Human
gauauucauaggcagguauuua

SEQ ID NO: 239744 - RNA, 22 nt, Human
gauauuuugugaaaaaacaacu

SEQ ID NO: 239745 - RNA, 22 nt, Human
gaucacuuugauuagauguccu

SEQ ID NO: 239746 - RNA, 22 nt, Human
gagaaugagucagagcuggcug

SEQ ID NO: 239747 - RNA, 22 nt, Human
gagaaguaggaauaucaggagu

SEQ ID NO: 239748 - RNA, 22 nt, Human
gagaaguagcgucuucccgggg

SEQ ID NO: 239749 - RNA, 22 nt, Human
gagaaaaauuucuuugcugcac

SEQ ID NO: 239750 - RNA, 22 nt, Human
gagaaauagauucaugguagau

SEQ ID NO: 239751 - RNA, 22 nt, Human
gauauauuucaaauucuuuugc

SEQ ID NO: 239752 - RNA, 22 nt, Human
gauagaaagagaaucagaacuu

SEQ ID NO: 239753 - RNA, 22 nt, Human
gauacuuuguggaauccuggau

SEQ ID NO: 239754 - RNA, 22 nt, Human
gacuugauugguuugucaaguu

SEQ ID NO: 239755 - RNA, 22 nt, Human
gacuugcucaaaucagauuuua

SEQ ID NO: 239756 - RNA, 22 nt, Human
gauaauuauaggcuaagccacu

SEQ ID NO: 239757 - RNA, 22 nt, Human
gauacaugucacaaguugugca

SEQ ID NO: 239758 - RNA, 21 nt, Human
gacuacaauauguaaucuaau

SEQ ID NO: 239759 - RNA, 22 nt, Human
gacuaaauaaaagccaaacuuc

SEQ ID NO: 239760 - RNA, 22 nt, Human
gaguuggggcugcguguuucca

SEQ ID NO: 239761 - RNA, 22 nt, Human
gacauugaauugaauccagauu

SEQ ID NO: 239762 - RNA, 22 nt, Human
gaguagaacagauagucaagaa

SEQ ID NO: 239763 - RNA, 22 nt, Human
gaguauuacuaaaauucgccua

SEQ ID NO: 239764 - RNA, 22 nt, Human
gaguauucuauguauauuauug

SEQ ID NO: 239765 - RNA, 22 nt, Human
gagguuauucuucuaucaguau

SEQ ID NO: 239766 - RNA, 22 nt, Human
gaggugauuccucccauguaau

SEQ ID NO: 239767 - RNA, 22 nt, Human
gacaauuucucaauauagaaac

SEQ ID NO: 239768 - RNA, 22 nt, Human
gacaaguagguuauuuuuagca

SEQ ID NO: 239769 - RNA, 22 nt, Human
gacaagaugacaucauggcuuc

SEQ ID NO: 239770 - RNA, 22 nt, Human
gagguagaggaaaagauuauca

SEQ ID NO: 239771 - RNA, 22 nt, Human
gaggucacacugauagucuuga

SEQ ID NO: 239772 - RNA, 22 nt, Human
cuugcaaugaaggcacacuuau

SEQ ID NO: 239773 - RNA, 22 nt, Human
cuucucuuccuucucauccuca

SEQ ID NO: 239774 - RNA, 22 nt, Human
gaagucaggaaggagauugaag

SEQ ID NO: 239775 - RNA, 21 nt, Human
gaaguagcucugagaaaagug

SEQ ID NO: 239776 - RNA, 22 nt, Human
cuucuaauucuuauguaagcuu

SEQ ID NO: 239777 - RNA, 22 nt, Human
gaagaugcugcuuguucacggg

SEQ ID NO: 239778 - RNA, 22 nt, Human
gaagauuauuacucauugcagg

SEQ ID NO: 239779 - RNA, 22 nt, Human
cuuccguuacugacaaaauguu

SEQ ID NO: 239780 - RNA, 22 nt, Human
cuuggugcgaagagucagggga

SEQ ID NO: 239781 - RNA, 23 nt, Human
cuugugacagcaauuauagcaag

SEQ ID NO: 239782 - RNA, 22 nt, Human
gacaacuucaguaaaguagauu

SEQ ID NO: 239783 - RNA, 22 nt, Human
cuuggggucuuacuuguacccu

SEQ ID NO: 239784 - RNA, 22 nt, Human
cuuuaguaaaacguauuuagga

SEQ ID NO: 239785 - RNA, 22 nt, Human
cuuggggauuuuaaagaccucu

SEQ ID NO: 239786 - RNA, 22 nt, Human
cuuggggcuugcuguuguagcc

SEQ ID NO: 239787 - RNA, 22 nt, Human
gaaugguuagugaacaaauuug

SEQ ID NO: 239788 - RNA, 22 nt, Human
gaaugguuauaugauguuuaaa

SEQ ID NO: 239789 - RNA, 22 nt, Human
gagaaaacauacuuaguguccu

SEQ ID NO: 239790 - RNA, 22 nt, Human
gagaacaaggaagagucggcag

SEQ ID NO: 239791 - RNA, 22 nt, Human
gagaacagauaugaugacuuca

SEQ ID NO: 239792 - RNA, 22 nt, Human
gacuucaagaugaaucuuuggg

SEQ ID NO: 239793 - RNA, 22 nt, Human
cuuuuugcccuugggcuuccug

SEQ ID NO: 239794 - RNA, 22 nt, Human
gacuuaaaugcuccccucaggg

SEQ ID NO: 239795 - RNA, 22 nt, Human
cuuuuucaugggugaugagugg

SEQ ID NO: 239796 - RNA, 22 nt, Human
gacuguuggcagauguuugagu

SEQ ID NO: 239797 - RNA, 22 nt, Human
cuuugugcagcagaaaugugug

SEQ ID NO: 239798 - RNA, 22 nt, Human
gacagcaggaugugaggggaug

SEQ ID NO: 239799 - RNA, 22 nt, Human
cuuucugauguaaggaacuagg

SEQ ID NO: 239800 - RNA, 22 nt, Human
gacagguagacaugaauauuaa

SEQ ID NO: 239801 - RNA, 22 nt, Human
gacagcguaucaauugaacaua

SEQ ID NO: 239802 - RNA, 22 nt, Human
gacagcguguuuugcaugaaca

SEQ ID NO: 239803 - RNA, 22 nt, Human
cuuugauuucucugguccaauc

SEQ ID NO: 239804 - RNA, 20 nt, Human
cuuauuuuggagaacuuuuc

SEQ ID NO: 239805 - RNA, 22 nt, Human
cugaugcucuggauguagucaa

SEQ ID NO: 239806 - RNA, 22 nt, Human
cuggagaucaguuggacaacag

SEQ ID NO: 239807 - RNA, 22 nt, Human
cuggcuuucauggcgcaguuga

SEQ ID NO: 239808 - RNA, 22 nt, Human
cuuuucauuucauggaauacaa

SEQ ID NO: 239809 - RNA, 22 nt, Human
cuuuucaaacaggacagguccu

SEQ ID NO: 239810 - RNA, 21 nt, Human
cuuuucuagucccagccccgc

SEQ ID NO: 239811 - RNA, 22 nt, Human
gaaaaagagaaggaguucagua

SEQ ID NO: 239812 - RNA, 22 nt, Human
gaaaaagucuuaaaguaaggca

SEQ ID NO: 239813 - RNA, 22 nt, Human
gaaaaauggguuguuugaagau

SEQ ID NO: 239814 - RNA, 22 nt, Human
cuuuuuuucuccauauuucugg

SEQ ID NO: 239815 - RNA, 22 nt, Human
cuggggccccagcucggccccu

SEQ ID NO: 239816 - RNA, 22 nt, Human
cuuuuucuugugguuaauaucu

SEQ ID NO: 239817 - RNA, 22 nt, Human
cuuuuugccuugaagugaccuc

SEQ ID NO: 239818 - RNA, 22 nt, Human
cuuuuucuuaucuuuuucuaug

SEQ ID NO: 239819 - RNA, 22 nt, Human
cuuuuuaaaguaaauggcuaga

SEQ ID NO: 239820 - RNA, 22 nt, Human
cuuuugcaauagugacacugau

SEQ ID NO: 239821 - RNA, 22 nt, Human
gaacauuucugcagaugucuga

SEQ ID NO: 239822 - RNA, 22 nt, Human
gaacagauucaucuaguggcua

SEQ ID NO: 239823 - RNA, 22 nt, Human
gaaccauuuaauggagaugcuc

SEQ ID NO: 239824 - RNA, 22 nt, Human
cuguuaauugugaauuuuacau

SEQ ID NO: 239825 - RNA, 22 nt, Human
gaagaaggaagaucaugcuuga

SEQ ID NO: 239826 - RNA, 22 nt, Human
gaacuuaauauacaaucaguuc

SEQ ID NO: 239827 - RNA, 22 nt, Human
cugugguuucuaugggccuuga

SEQ ID NO: 239828 - RNA, 22 nt, Human
cugugguuuuauuuauuugaag

SEQ ID NO: 239829 - RNA, 22 nt, Human
cugugaaugguggccacgcguu

SEQ ID NO: 239830 - RNA, 22 nt, Human
gaaacauuuguugaguacuugc

SEQ ID NO: 239831 - RNA, 21 nt, Human
gaaaaucuaaugugacaaugc

SEQ ID NO: 239832 - RNA, 22 nt, Human
cuguaaguggugaaauuaguuu

SEQ ID NO: 239833 - RNA, 22 nt, Human
gaaaauaguucaucacaaugau

SEQ ID NO: 239834 - RNA, 22 nt, Human
gaaaaucaggauggaugugagg

SEQ ID NO: 239835 - RNA, 22 nt, Human
gaaaaguuuaaccuuguacauu

SEQ ID NO: 239836 - RNA, 22 nt, Human
cugguacuggaggaguucagag

SEQ ID NO: 239837 - RNA, 22 nt, Human
gaaaagaaaggaugguaugugu

SEQ ID NO: 239838 - RNA, 22 nt, Human
gaaaagcucuuuagaagagguu

SEQ ID NO: 239839 - RNA, 22 nt, Human
gaaaaguauuaugugaggguuc

SEQ ID NO: 239840 - RNA, 22 nt, Human
cuagaaaguaugcuuuuauaau

SEQ ID NO: 239841 - RNA, 22 nt, Human
cuacacgauaaauuuuaguggu

SEQ ID NO: 239842 - RNA, 22 nt, Human
cuaauugcuggcugcuggcaga

SEQ ID NO: 239843 - RNA, 23 nt, Human
cuaagcuugaguauagcuuagga

SEQ ID NO: 239844 - RNA, 22 nt, Human
cuacauuuacacaguuaggcuu

SEQ ID NO: 239845 - RNA, 22 nt, Human
cugcuguuuucugggcuucuua

SEQ ID NO: 239846 - RNA, 22 nt, Human
cugcuguugagguuccaggcca

SEQ ID NO: 239847 - RNA, 22 nt, Human
cuauguuuugcuagugaugggu

SEQ ID NO: 239848 - RNA, 22 nt, Human
cuauguuucagauauauauaua

SEQ ID NO: 239849 - RNA, 22 nt, Human
cuauaucuguggauaguguaug

SEQ ID NO: 239850 - RNA, 22 nt, Human
cugcugcuugauugcaggaagu

SEQ ID NO: 239851 - RNA, 22 nt, Human
cuaguauuaagugugaguaaaa

SEQ ID NO: 239852 - RNA, 22 nt, Human
cugagcuuuucucugcuucuua

SEQ ID NO: 239853 - RNA, 22 nt, Human
cucugcguggcugggcccaggg

SEQ ID NO: 239854 - RNA, 22 nt, Human
cgugaaaugcagaaaguugugg

SEQ ID NO: 239855 - RNA, 22 nt, Human
cugaugucaaauuuaucaaagc

SEQ ID NO: 239856 - RNA, 22 nt, Human
cugaucuuaaguaacauuauuu

SEQ ID NO: 239857 - RNA, 22 nt, Human
cugauagagcauuagugugaga

SEQ ID NO: 239858 - RNA, 22 nt, Human
cugauaauaaccauuuuaaaau

SEQ ID NO: 239859 - RNA, 22 nt, Human
cuaaaccaauauauuuucuucc

SEQ ID NO: 239860 - RNA, 16 nt, Human
cuaaaaugucuacuug

SEQ ID NO: 239861 - RNA, 20 nt, Human
cuaaaacaggugucuaguga

SEQ ID NO: 239862 - RNA, 22 nt, Human
cuaaaacuuuuccaaauuaugu

SEQ ID NO: 239863 - RNA, 22 nt, Human
cugcaguaacuauuuucaauaa

SEQ ID NO: 239864 - RNA, 22 nt, Human
cugauguuuaucucaagaguuc

SEQ ID NO: 239865 - RNA, 20 nt, Human
cugauguucgugcuuccugg

SEQ ID NO: 239866 - RNA, 22 nt, Human
cugauuguagccacugugauga

SEQ ID NO: 239867 - RNA, 22 nt, Human
cugauuucaaauggugcuagau

SEQ ID NO: 239868 - RNA, 22 nt, Human
cugaugugcauguggggggaug

SEQ ID NO: 239869 - RNA, 22 nt, Human
cuuacaauuuucuuggacuuuu

SEQ ID NO: 239870 - RNA, 22 nt, Human
cuguuuuugccugugacaaaaa

SEQ ID NO: 239871 - RNA, 22 nt, Human
cuuauuugcccauguuucuuua

SEQ ID NO: 239872 - RNA, 22 nt, Human
cuuauuagaaagaaaagacaug

SEQ ID NO: 239873 - RNA, 22 nt, Human
cugaacuaagcccaaagacacu

SEQ ID NO: 239874 - RNA, 22 nt, Human
cugaaagcaaaguaauucuuaa

SEQ ID NO: 239875 - RNA, 22 nt, Human
cugaaagacagccaggcaaagc

SEQ ID NO: 239876 - RNA, 20 nt, Human
cucuuucugcuuuaugccuc

SEQ ID NO: 239877 - RNA, 22 nt, Human
cucuuuuuccuaugaaaucuau

SEQ ID NO: 239878 - RNA, 19 nt, Human
cugaaacacagagagggcu

SEQ ID NO: 239879 - RNA, 21 nt, Human
cugugggaaggccugaggucu

SEQ ID NO: 239880 - RNA, 22 nt, Human
cuguguugggauggugcgcgca

SEQ ID NO: 239881 - RNA, 22 nt, Human
cuguguuguuugaguagcuuga

SEQ ID NO: 239882 - RNA, 22 nt, Human
cuggugaagccuucggagaccc

SEQ ID NO: 239883 - RNA, 22 nt, Human
cugguuuauuucauaguuuguu

SEQ ID NO: 239884 - RNA, 22 nt, Human
cugguuuuccaauguuuugacu

SEQ ID NO: 239885 - RNA, 22 nt, Human
cucugugucugauucugggaag

SEQ ID NO: 239886 - RNA, 22 nt, Human
cuccaacugccacuguacugga

SEQ ID NO: 239887 - RNA, 22 nt, Human
cucauagguuuggaaccaggua

SEQ ID NO: 239888 - RNA, 20 nt, Human
cucauugcuuucauuuucuu

SEQ ID NO: 239889 - RNA, 22 nt, Human
cuggucaauaaucauguaguac

SEQ ID NO: 239890 - RNA, 22 nt, Human
cugggagaggaaccucgagggu

SEQ ID NO: 239891 - RNA, 22 nt, Human
cugggguggugcaggccucaug

SEQ ID NO: 239892 - RNA, 22 nt, Human
cugggguaucugccacaacucu

SEQ ID NO: 239893 - RNA, 22 nt, Human
cucaagugacucagccugguug

SEQ ID NO: 239894 - RNA, 22 nt, Human
cucaauuuuuauugcuuuuuug

SEQ ID NO: 239895 - RNA, 22 nt, Human
cuauuauuauugucguuuuaca

SEQ ID NO: 239896 - RNA, 22 nt, Human
cuauuaauggccaggagucaug

SEQ ID NO: 239897 - RNA, 22 nt, Human
cucaaaauccauaaaaucaggu

SEQ ID NO: 239898 - RNA, 22 nt, Human
cucaucagagcccuccucuggc

SEQ ID NO: 239899 - RNA, 22 nt, Human
cucaggaaaauauugaagaagu

SEQ ID NO: 239900 - RNA, 22 nt, Human
cucaguauugacgaaagagauu

SEQ ID NO: 239901 - RNA, 22 nt, Human
cucaggugagcgagcuaaauua

SEQ ID NO: 239902 - RNA, 22 nt, Human
cgcgcuuugggcaguguggcug

SEQ ID NO: 239903 - RNA, 22 nt, Human
cuauuuucccauaugguugaca

SEQ ID NO: 239904 - RNA, 22 nt, Human
cuaguuuuaagcuccuugaggu

SEQ ID NO: 239905 - RNA, 22 nt, Human
cucugcuagaaggucaaucucu

SEQ ID NO: 239906 - RNA, 22 nt, Human
cucugauuuuucuaauacuuca

SEQ ID NO: 239907 - RNA, 22 nt, Human
cuccuauugaucaguacuauuu

SEQ ID NO: 239908 - RNA, 22 nt, Human
cuccaaaucugauugcuaccuu

SEQ ID NO: 239909 - RNA, 22 nt, Human
cucaugaauggcucuuugugcu

SEQ ID NO: 239910 - RNA, 22 nt, Human
ccuuuuguuucccuuuauguuc

SEQ ID NO: 239911 - RNA, 22 nt, Human
ccuuuuuagaugugcgaauguu

SEQ ID NO: 239912 - RNA, 22 nt, Human
ccuuucuaacagauuguggauc

SEQ ID NO: 239913 - RNA, 22 nt, Human
ccuuugcccugagaaauguucc

SEQ ID NO: 239914 - RNA, 22 nt, Human
cgucauuuguaaaugaucaaga

SEQ ID NO: 239915 - RNA, 22 nt, Human
ccuucucuucuuggaaggaacu

SEQ ID NO: 239916 - RNA, 22 nt, Human
ccuugauaugcuucagagaauu

SEQ ID NO: 239917 - RNA, 22 nt, Human
ccuugggagcgcccuguccggg

SEQ ID NO: 239918 - RNA, 22 nt, Human
cuacuuucuucuucagaauugu

SEQ ID NO: 239919 - RNA, 22 nt, Human
cuagagaaaaagcuuagguacg

SEQ ID NO: 239920 - RNA, 22 nt, Human
cgaguaauuggaaauuugcuau

SEQ ID NO: 239921 - RNA, 22 nt, Human
cgagguuuaugaguuuguguuc

SEQ ID NO: 239922 - RNA, 22 nt, Human
cuacugaagcaugcuuauaugu

SEQ ID NO: 239923 - RNA, 22 nt, Human
cuacugaugccccgcugugccu

SEQ ID NO: 239924 - RNA, 22 nt, Human
cuacuucuguggcucuaagaga

SEQ ID NO: 239925 - RNA, 22 nt, Human
cuaaacacuauucuggaaauag

SEQ ID NO: 239926 - RNA, 22 nt, Human
cuaaauuuuuuagugaaauagg

SEQ ID NO: 239927 - RNA, 22 nt, Human
cuaaagacagcaagacaucauc

SEQ ID NO: 239928 - RNA, 22 nt, Human
cuaaacuucauauguugcuuua

SEQ ID NO: 239929 - RNA, 19 nt, Human
cuacaguguuuuucuuucc

SEQ ID NO: 239930 - RNA, 22 nt, Human
cuacauaaauuuaucacagacu

SEQ ID NO: 239931 - RNA, 22 nt, Human
cgaaaaagaagugcaccauguu

SEQ ID NO: 239932 - RNA, 22 nt, Human
cggaagcacuagacacugacac

SEQ ID NO: 239933 - RNA, 22 nt, Human
ccuugguuuagcaauuuuucuu

SEQ ID NO: 239934 - RNA, 22 nt, Human
ccuuuuaucgcgaagaacucca

SEQ ID NO: 239935 - RNA, 22 nt, Human
ccuuuuaagggagacuagagau

SEQ ID NO: 239936 - RNA, 22 nt, Human
ccugucuuuucugaucauacua

SEQ ID NO: 239937 - RNA, 22 nt, Human
ccuuagaaaaucauggaauauu

SEQ ID NO: 239938 - RNA, 22 nt, Human
cauuauucaggcuuuggaauuu

SEQ ID NO: 239939 - RNA, 22 nt, Human
cauuacaagaaauagcauaaug

SEQ ID NO: 239940 - RNA, 22 nt, Human
cauuaccuggggagaggauacc

SEQ ID NO: 239941 - RNA, 22 nt, Human
cauucauagaaucaguuuggga

SEQ ID NO: 239942 - RNA, 22 nt, Human
cauuccaaguauauacaugaua

SEQ ID NO: 239943 - RNA, 22 nt, Human
ccacuauaucaaggauuuuguu

SEQ ID NO: 239944 - RNA, 22 nt, Human
caugugguauugugagauccac

SEQ ID NO: 239945 - RNA, 22 nt, Human
cauguaaguucacagucgaugu

SEQ ID NO: 239946 - RNA, 21 nt, Human
caugguaaguacaaagaugac

SEQ ID NO: 239947 - RNA, 22 nt, Human
caugugacuuagguuuuaucac

SEQ ID NO: 239948 - RNA, 22 nt, Human
caugcuaacacguugcucaccg

SEQ ID NO: 239949 - RNA, 22 nt, Human
caugggaaauauaagaauuuuc

SEQ ID NO: 239950 - RNA, 22 nt, Human
ccaaaauauuagugcuuaagua

SEQ ID NO: 239951 - RNA, 22 nt, Human
cauuuuuuuuccccuccuggua

SEQ ID NO: 239952 - RNA, 22 nt, Human
ccaaagaauuuggaaaaucuga

SEQ ID NO: 239953 - RNA, 22 nt, Human
ccaaacauuucaaauuuagaga

SEQ ID NO: 239954 - RNA, 22 nt, Human
caugauucccacauugcgauca

SEQ ID NO: 239955 - RNA, 22 nt, Human
caugaugagaguaauaacacag

SEQ ID NO: 239956 - RNA, 22 nt, Human
cauuuugguccucauguguagc

SEQ ID NO: 239957 - RNA, 22 nt, Human
caucuuuguuuuggauauaauc

SEQ ID NO: 239958 - RNA, 22 nt, Human
cauuuagagaagauuacaagga

SEQ ID NO: 239959 - RNA, 22 nt, Human
caugaagugaaaagguuaauuu

SEQ ID NO: 239960 - RNA, 22 nt, Human
caugaugaacugugcuguuagg

SEQ ID NO: 239961 - RNA, 22 nt, Human
caugauaacacuucuguuuaau

SEQ ID NO: 239962 - RNA, 22 nt, Human
cauccuauuacugaggcucccc

SEQ ID NO: 239963 - RNA, 22 nt, Human
caucugcagccucugcauuccc

SEQ ID NO: 239964 - RNA, 22 nt, Human
cauuggaugagggccucaucga

SEQ ID NO: 239965 - RNA, 22 nt, Human
cauugcugccaaggugagcugg

SEQ ID NO: 239966 - RNA, 20 nt, Human
cauuccugaggaauucaugu

SEQ ID NO: 239967 - RNA, 22 nt, Human
caucagucugaaagccagggag

SEQ ID NO: 239968 - RNA, 22 nt, Human
cauuccaagaaguaguucugca

SEQ ID NO: 239969 - RNA, 22 nt, Human
cauucauaagacuuugcucuug

SEQ ID NO: 239970 - RNA, 22 nt, Human
caucaauagguauuugagagac

SEQ ID NO: 239971 - RNA, 22 nt, Human
cagguuuuuauuacaacuuuga

SEQ ID NO: 239972 - RNA, 22 nt, Human
cauauacauauacaugcauaca

SEQ ID NO: 239973 - RNA, 22 nt, Human
caucaguaaaguacuuuuaugu

SEQ ID NO: 239974 - RNA, 22 nt, Human
ccaucuuugcucuuuuauugca

SEQ ID NO: 239975 - RNA, 19 nt, Human
ccaguuuuuuaauauucaa

SEQ ID NO: 239976 - RNA, 22 nt, Human
ccauaaaguaggaaacacuaca

SEQ ID NO: 239977 - RNA, 22 nt, Human
ccauuucacaucccugacaugu

SEQ ID NO: 239978 - RNA, 22 nt, Human
ccaaauuguuguuguuguuguu

SEQ ID NO: 239979 - RNA, 22 nt, Human
ccaaauuaccuucuuggauuca

SEQ ID NO: 239980 - RNA, 21 nt, Human
ccacaauucuaguuacauaug

SEQ ID NO: 239981 - RNA, 22 nt, Human
ccaauuuuggaauuauuaggca

SEQ ID NO: 239982 - RNA, 22 nt, Human
ccagugcuuccaggaauacggu

SEQ ID NO: 239983 - RNA, 22 nt, Human
ccagucagccuaguucuucuuu

SEQ ID NO: 239984 - RNA, 22 nt, Human
cauuuugguaauguucguuugc

SEQ ID NO: 239985 - RNA, 22 nt, Human
cauuuuuccucaggcaauuuga

SEQ ID NO: 239986 - RNA, 22 nt, Human
ccaaagaagcaaugagaauagu

SEQ ID NO: 239987 - RNA, 22 nt, Human
cauuuacguaacaguaacgcug

SEQ ID NO: 239988 - RNA, 22 nt, Human
cauuucaaacaguuacagcugc

SEQ ID NO: 239989 - RNA, 22 nt, Human
cauuucuugugagccgcauccu

SEQ ID NO: 239990 - RNA, 22 nt, Human
cauuugacaauugggauagauc

SEQ ID NO: 239991 - RNA, 23 nt, Human
cauuugauccucacaauaaaugg

SEQ ID NO: 239992 - RNA, 22 nt, Human
cauuuuaucagcacacgucacu

SEQ ID NO: 239993 - RNA, 22 nt, Human
cauuuucugcaagucugcucaa

SEQ ID NO: 239994 - RNA, 22 nt, Human
cauugguacaaaauguacuuug

SEQ ID NO: 239995 - RNA, 22 nt, Human
cauuuacauaacaguaacgcug

SEQ ID NO: 239996 - RNA, 22 nt, Human
cauuuaucacuugcuaaacaua

SEQ ID NO: 239997 - RNA, 22 nt, Human
cauuccuaccauaucugcucuu

SEQ ID NO: 239998 - RNA, 22 nt, Human
ccacuuucuaaauuggcgauuu

SEQ ID NO: 239999 - RNA, 22 nt, Human
cauugcugugggcauuugcugc

SEQ ID NO: 240000 - RNA, 22 nt, Human
cauugcaaccccaaaaagaaca

SEQ ID NO: 240001 - RNA, 20 nt, Human
ccagaagagaagaaaaggaa

SEQ ID NO: 240002 - RNA, 22 nt, Human
cagaaauuggcagagaagaccu

SEQ ID NO: 240003 - RNA, 22 nt, Human
cagaaagaaguggggauagagg

SEQ ID NO: 240004 - RNA, 22 nt, Human
cacuucaguacuagaggaugaa

SEQ ID NO: 240005 - RNA, 22 nt, Human
cacuuauuuuuccuuugugauu

SEQ ID NO: 240006 - RNA, 22 nt, Human
cagagagcguccauccggugcc

SEQ ID NO: 240007 - RNA, 22 nt, Human
cagaaguugcuugagagagagc

SEQ ID NO: 240008 - RNA, 22 nt, Human
caccaucugaauauucuccaag

SEQ ID NO: 240009 - RNA, 23 nt, Human
cacucgcaggcccagcucucagg

SEQ ID NO: 240010 - RNA, 23 nt, Human
cacuggugggguuuaaaagaagc

SEQ ID NO: 240011 - RNA, 21 nt, Human
cacuguauagcaggagaaaac

SEQ ID NO: 240012 - RNA, 22 nt, Human
caaugccaggaaccugggggaa

SEQ ID NO: 240013 - RNA, 22 nt, Human
cacucaaacugaaauccuuuuu

SEQ ID NO: 240014 - RNA, 22 nt, Human
caauguuuuuccuuccuuaaua

SEQ ID NO: 240015 - RNA, 20 nt, Human
caauguuggcaguauagagc

SEQ ID NO: 240016 - RNA, 22 nt, Human
cacugguugccucuuucuguuc

SEQ ID NO: 240017 - RNA, 22 nt, Human
cacagcaggcagaacgugggca

SEQ ID NO: 240018 - RNA, 22 nt, Human
cacuguugagcaauguacagug

SEQ ID NO: 240019 - RNA, 22 nt, Human
cacuuagugcuuuuguguuucu

SEQ ID NO: 240020 - RNA, 22 nt, Human
cacuuaaaauucagggcuuaua

SEQ ID NO: 240021 - RNA, 22 nt, Human
cacagauaaggcuuugucccca

SEQ ID NO: 240022 - RNA, 22 nt, Human
cacagaauuaagggagaaauau

SEQ ID NO: 240023 - RNA, 22 nt, Human
cacugcugaggcccguguuacu

SEQ ID NO: 240024 - RNA, 22 nt, Human
caccaaaauaucccuuuguaca

SEQ ID NO: 240025 - RNA, 22 nt, Human
cacauuguuuggucagagcaua

SEQ ID NO: 240026 - RNA, 22 nt, Human
cagacaaauccuuaugagacug

SEQ ID NO: 240027 - RNA, 22 nt, Human
cacuugagagcugaagaagucu

SEQ ID NO: 240028 - RNA, 18 nt, Human
cacagcauccaaguuaug

SEQ ID NO: 240029 - RNA, 22 nt, Human
cagaaaaaaaugcagacuagca

SEQ ID NO: 240030 - RNA, 22 nt, Human
cacuuuuucccccuggugucau

SEQ ID NO: 240031 - RNA, 22 nt, Human
cacauaaggacauuauugaaag

SEQ ID NO: 240032 - RNA, 22 nt, Human
cacauaguuuaucuucauuuuc

SEQ ID NO: 240033 - RNA, 22 nt, Human
cacuuguuaaaugccaauggca

SEQ ID NO: 240034 - RNA, 22 nt, Human
caggauuuaauaagauaguguu

SEQ ID NO: 240035 - RNA, 22 nt, Human
caggcacaagaucggcuagaua

SEQ ID NO: 240036 - RNA, 20 nt, Human
caggccuucaggauggcugg

SEQ ID NO: 240037 - RNA, 22 nt, Human
cagcuucacuuaaaacaugcaa

SEQ ID NO: 240038 - RNA, 22 nt, Human
cagcuugcccugauguggaaga

SEQ ID NO: 240039 - RNA, 22 nt, Human
caggacuuccucuaugguggcg

SEQ ID NO: 240040 - RNA, 22 nt, Human
cagccccucuucucuccucgga

SEQ ID NO: 240041 - RNA, 22 nt, Human
cauagacauugauagguuauau

SEQ ID NO: 240042 - RNA, 22 nt, Human
caggugauuuuguuuucaaaug

SEQ ID NO: 240043 - RNA, 22 nt, Human
cauaaucaagggguugugaugu

SEQ ID NO: 240044 - RNA, 22 nt, Human
cauaagaauauuuaguggcagc

SEQ ID NO: 240045 - RNA, 22 nt, Human
cauaaauuuuaccuuguaagug

SEQ ID NO: 240046 - RNA, 22 nt, Human
cauauuaugcauguuguucuuu

SEQ ID NO: 240047 - RNA, 22 nt, Human
cauaguuuguucuuuuuuauug

SEQ ID NO: 240048 - RNA, 22 nt, Human
cauaucuccagguucugcugga

SEQ ID NO: 240049 - RNA, 22 nt, Human
cauaucuuaaacaucaucucug

SEQ ID NO: 240050 - RNA, 22 nt, Human
cauaggugguagaauggggaga

SEQ ID NO: 240051 - RNA, 22 nt, Human
caguugcuauugagagaacaca

SEQ ID NO: 240052 - RNA, 22 nt, Human
caggaggaaaguuccacucaac

SEQ ID NO: 240053 - RNA, 22 nt, Human
caggauauguucaagguuuucu

SEQ ID NO: 240054 - RNA, 22 nt, Human
caggaagucugaauucugagag

SEQ ID NO: 240055 - RNA, 22 nt, Human
caggacacagacacuaaauaua

SEQ ID NO: 240056 - RNA, 22 nt, Human
augggauuugaaaaguggaaau

SEQ ID NO: 240057 - RNA, 22 nt, Human
augcuuucucuucuauuucuca

SEQ ID NO: 240058 - RNA, 22 nt, Human
auggauuggguugauggcauac

SEQ ID NO: 240059 - RNA, 19 nt, Human
augggaagcggccagcgga

SEQ ID NO: 240060 - RNA, 22 nt, Human
auggaacauuaaucuucaaaug

SEQ ID NO: 240061 - RNA, 22 nt, Human
auggaauuuaaauuuugguguc

SEQ ID NO: 240062 - RNA, 22 nt, Human
auggaaggggagguagggagga

SEQ ID NO: 240063 - RNA, 22 nt, Human
augggcauggauggccgagucu

SEQ ID NO: 240064 - RNA, 19 nt, Human
augguauugcuggguuuuu

SEQ ID NO: 240065 - RNA, 22 nt, Human
auggacguuuguguauuaugua

SEQ ID NO: 240066 - RNA, 22 nt, Human
auggaagagacaaugcuaucug

SEQ ID NO: 240067 - RNA, 22 nt, Human
augcauaugugugcaagugugu

SEQ ID NO: 240068 - RNA, 22 nt, Human
augcaaaaucuuauuuuuucua

SEQ ID NO: 240069 - RNA, 22 nt, Human
augauucuaccaaugccaucuu

SEQ ID NO: 240070 - RNA, 22 nt, Human
augccacuguuuaugucacuua

SEQ ID NO: 240071 - RNA, 22 nt, Human
augcccagaacccccuggaugg

SEQ ID NO: 240072 - RNA, 22 nt, Human
augccaccucuucugauuccag

SEQ ID NO: 240073 - RNA, 22 nt, Human
auguuuaaguguuuugccccaa

SEQ ID NO: 240074 - RNA, 22 nt, Human
auguuugugauugcugaaaaga

SEQ ID NO: 240075 - RNA, 19 nt, Human
auguuuccauuucuggaua

SEQ ID NO: 240076 - RNA, 22 nt, Human
auguuuuauacacauguaucac

SEQ ID NO: 240077 - RNA, 22 nt, Human
auguuuucauuuagaagcuaau

SEQ ID NO: 240078 - RNA, 22 nt, Human
auguuuucuugucuggagaagu

SEQ ID NO: 240079 - RNA, 22 nt, Human
auguuuugaguuuuuuuacacc

SEQ ID NO: 240080 - RNA, 22 nt, Human
auuaaaaaaagauaaugaguua

SEQ ID NO: 240081 - RNA, 19 nt, Human
auguucugaauuacuguaa

SEQ ID NO: 240082 - RNA, 22 nt, Human
auuaaagcaugaauaauaugua

SEQ ID NO: 240083 - RNA, 22 nt, Human
auguuguugaacucuuugcaug

SEQ ID NO: 240084 - RNA, 22 nt, Human
auguugcugauccuguggcugu

SEQ ID NO: 240085 - RNA, 22 nt, Human
augugauacuccuucuagugga

SEQ ID NO: 240086 - RNA, 22 nt, Human
augugagcuggaugaauuuaua

SEQ ID NO: 240087 - RNA, 22 nt, Human
auguacugacuguacuuuuaaa

SEQ ID NO: 240088 - RNA, 22 nt, Human
augguguaggugaagagaacau

SEQ ID NO: 240089 - RNA, 22 nt, Human
auggugaaaugauuugauguca

SEQ ID NO: 240090 - RNA, 22 nt, Human
augggaauggauugagugggug

SEQ ID NO: 240091 - RNA, 22 nt, Human
augguguaagacuguauuucuu

SEQ ID NO: 240092 - RNA, 22 nt, Human
auggugaugaugaugaugauaa

SEQ ID NO: 240093 - RNA, 22 nt, Human
augugcucaggucuauaucuca

SEQ ID NO: 240094 - RNA, 22 nt, Human
auguaaugucaaucuucagugg

SEQ ID NO: 240095 - RNA, 22 nt, Human
augguuagauggaugagaugug

SEQ ID NO: 240096 - RNA, 22 nt, Human
auguaacauaugugaucgcauu

SEQ ID NO: 240097 - RNA, 22 nt, Human
augaguaaguucugauuagauu

SEQ ID NO: 240098 - RNA, 22 nt, Human
augagugugugguucuaaauga

SEQ ID NO: 240099 - RNA, 18 nt, Human
augauaauguuugcauca

SEQ ID NO: 240100 - RNA, 22 nt, Human
augcauaucuccuaucuccuca

SEQ ID NO: 240101 - RNA, 22 nt, Human
augcaguuagguaauagucuca

SEQ ID NO: 240102 - RNA, 22 nt, Human
augauuaagguacgucauuucu

SEQ ID NO: 240103 - RNA, 22 nt, Human
augcacaagguagauuauuauu

SEQ ID NO: 240104 - RNA, 22 nt, Human
augaaacucuagcuuucagcac

SEQ ID NO: 240105 - RNA, 22 nt, Human
augaaaacgugugugugugugu

SEQ ID NO: 240106 - RNA, 22 nt, Human
aucuuuuuucacaauuuauuuu

SEQ ID NO: 240107 - RNA, 22 nt, Human
augauaucuuguuuuucaugca

SEQ ID NO: 240108 - RNA, 22 nt, Human
augaguuaaguagcccuucaug

SEQ ID NO: 240109 - RNA, 23 nt, Human
augcaacauugccaguaugggca

SEQ ID NO: 240110 - RNA, 22 nt, Human
augaacugcaguauaaacuugg

SEQ ID NO: 240111 - RNA, 22 nt, Human
aucuguucuucaaaauauuaca

SEQ ID NO: 240112 - RNA, 22 nt, Human
augaacuaagagucauuagugu

SEQ ID NO: 240113 - RNA, 22 nt, Human
augaagguggacagauuuuuuu

SEQ ID NO: 240114 - RNA, 22 nt, Human
augaaggauagggcaaaauuuu

SEQ ID NO: 240115 - RNA, 22 nt, Human
aucuuugauuuuggcuuuuagg

SEQ ID NO: 240116 - RNA, 22 nt, Human
augaaaacggaccagagcuauu

SEQ ID NO: 240117 - RNA, 19 nt, Human
aucuuucagcagcuccccu

SEQ ID NO: 240118 - RNA, 22 nt, Human
augaggauuagcaucugcaaau

SEQ ID NO: 240119 - RNA, 22 nt, Human
augaccuucuuuccuuaaauuu

SEQ ID NO: 240120 - RNA, 22 nt, Human
augacagcuaaggaauguguag

SEQ ID NO: 240121 - RNA, 21 nt, Human
aucugugucauuagguggcag

SEQ ID NO: 240122 - RNA, 22 nt, Human
aucuuagagagucguguuuugu

SEQ ID NO: 240123 - RNA, 20 nt, Human
aucuuaucuaucuuuuguuc

SEQ ID NO: 240124 - RNA, 22 nt, Human
aucuacuuugggaguuucucuu

SEQ ID NO: 240125 - RNA, 22 nt, Human
aucuaaucugccuuccuaaucu

SEQ ID NO: 240126 - RNA, 22 nt, Human
aucuucuauguguaggcauuuu

SEQ ID NO: 240127 - RNA, 22 nt, Human
aucuucaaagcacaucguuugu

SEQ ID NO: 240128 - RNA, 22 nt, Human
aucuugaaacauauaugcauuu

SEQ ID NO: 240129 - RNA, 22 nt, Human
aucuuuguaaguaaucaaagcu

SEQ ID NO: 240130 - RNA, 22 nt, Human
aucugugauuuuggcaagauuu

SEQ ID NO: 240131 - RNA, 18 nt, Human
auccuuugaucaucuguc

SEQ ID NO: 240132 - RNA, 22 nt, Human
aucucuguaaaccauaaauuga

SEQ ID NO: 240133 - RNA, 22 nt, Human
auacuaagcucauuacauuuug

SEQ ID NO: 240134 - RNA, 22 nt, Human
auacaauugcaauggaagauga

SEQ ID NO: 240135 - RNA, 19 nt, Human
auacacguguauacauaca

SEQ ID NO: 240136 - RNA, 22 nt, Human
auccuucaaaaggaauagcagg

SEQ ID NO: 240137 - RNA, 22 nt, Human
auuuuuagagugaaagaauuaa

SEQ ID NO: 240138 - RNA, 22 nt, Human
caaaauuguugaugcugcuuug

SEQ ID NO: 240139 - RNA, 22 nt, Human
caaaggaaagagaaaaagucuu

SEQ ID NO: 240140 - RNA, 22 nt, Human
caaacauuuguuggaaccccug

SEQ ID NO: 240141 - RNA, 22 nt, Human
caaauacguuuggcuggagcac

SEQ ID NO: 240142 - RNA, 22 nt, Human
caaaucagaucagagacaggcu

SEQ ID NO: 240143 - RNA, 22 nt, Human
caaaugaugcauggcuagugag

SEQ ID NO: 240144 - RNA, 22 nt, Human
caaaugcaguggucgugcugga

SEQ ID NO: 240145 - RNA, 22 nt, Human
auuuuuuuggucauaugagaua

SEQ ID NO: 240146 - RNA, 19 nt, Human
caagagcaaagucuuauga

SEQ ID NO: 240147 - RNA, 22 nt, Human
auuuuuucaugugugguugaga

SEQ ID NO: 240148 - RNA, 22 nt, Human
auuuuucuuucacauuuucuua

SEQ ID NO: 240149 - RNA, 22 nt, Human
caaaaaauccauagaaagaggu

SEQ ID NO: 240150 - RNA, 22 nt, Human
caagcacaauuucuacauguua

SEQ ID NO: 240151 - RNA, 22 nt, Human
caaauguuugguggcauuuugu

SEQ ID NO: 240152 - RNA, 22 nt, Human
auuuuugguuauaaaauaguuu

SEQ ID NO: 240153 - RNA, 22 nt, Human
auuuuugugcuuuauuggggua

SEQ ID NO: 240154 - RNA, 23 nt, Human
auuuuuccacacacagacucagu

SEQ ID NO: 240155 - RNA, 22 nt, Human
auuuuuuuaggcugucagccgc

SEQ ID NO: 240156 - RNA, 22 nt, Human
auuuuagagaaacaaacguagg

SEQ ID NO: 240157 - RNA, 22 nt, Human
auuuuuagucuugcugcaauca

SEQ ID NO: 240158 - RNA, 22 nt, Human
auuuuuaucuaaaauccacuuu

SEQ ID NO: 240159 - RNA, 22 nt, Human
auuuuuauuugccuaugauaua

SEQ ID NO: 240160 - RNA, 21 nt, Human
auuuuucagaaggaugugaua

SEQ ID NO: 240161 - RNA, 22 nt, Human
auuuucauauggguuauuugua

SEQ ID NO: 240162 - RNA, 22 nt, Human
auuuuauuuugggaucuuuuua

SEQ ID NO: 240163 - RNA, 19 nt, Human
auuuugguucuuuccauuc

SEQ ID NO: 240164 - RNA, 22 nt, Human
auuuuguugaaacccuuguugu

SEQ ID NO: 240165 - RNA, 22 nt, Human
auuuucuucauuuugauuguau

SEQ ID NO: 240166 - RNA, 22 nt, Human
auuuucuugucucuguuguagg

SEQ ID NO: 240167 - RNA, 22 nt, Human
auuguuuccccggaauuauuca

SEQ ID NO: 240168 - RNA, 22 nt, Human
auugaaguguacguuugaucua

SEQ ID NO: 240169 - RNA, 20 nt, Human
auucuuguuccauuucccag

SEQ ID NO: 240170 - RNA, 21 nt, Human
auuggcagaucucuggauugu

SEQ ID NO: 240171 - RNA, 23 nt, Human
auugccuguagaucuucacuuuc

SEQ ID NO: 240172 - RNA, 22 nt, Human
auugauuuugugcuuuccuacg

SEQ ID NO: 240173 - RNA, 22 nt, Human
auugaugaaaauaguuauuuua

SEQ ID NO: 240174 - RNA, 22 nt, Human
auuuaagacuguggugcaguuu

SEQ ID NO: 240175 - RNA, 22 nt, Human
auugaguucaccucuuucagaa

SEQ ID NO: 240176 - RNA, 22 nt, Human
auugagaaaauucgagcaaguu

SEQ ID NO: 240177 - RNA, 23 nt, Human
auuugcugaucguagaugacuag

SEQ ID NO: 240178 - RNA, 22 nt, Human
auuguuacuggguuaauuugga

SEQ ID NO: 240179 - RNA, 22 nt, Human
auuugaaaaucuaugaugugca

SEQ ID NO: 240180 - RNA, 19 nt, Human
auugcaguguaaaacuauu

SEQ ID NO: 240181 - RNA, 22 nt, Human
auuggagacauuaagucuaaga

SEQ ID NO: 240182 - RNA, 22 nt, Human
auuggaagacgcuggaggcacu

SEQ ID NO: 240183 - RNA, 22 nt, Human
auuuccagcagcauauuugucu

SEQ ID NO: 240184 - RNA, 22 nt, Human
auuguauugcguuugcgaaugu

SEQ ID NO: 240185 - RNA, 22 nt, Human
auuuacugagguaaauaaacug

SEQ ID NO: 240186 - RNA, 22 nt, Human
auuuauauauuuuguucuggua

SEQ ID NO: 240187 - RNA, 22 nt, Human
auuuauccuugggguagagcca

SEQ ID NO: 240188 - RNA, 22 nt, Human
auuucauaaaaacuuuaccuga

SEQ ID NO: 240189 - RNA, 22 nt, Human
auuuggucuacauuuuccaaau

SEQ ID NO: 240190 - RNA, 22 nt, Human
auuauggacuuucuuguuuggg

SEQ ID NO: 240191 - RNA, 22 nt, Human
auuaucugacugaguagucugu

SEQ ID NO: 240192 - RNA, 22 nt, Human
auuaucuauccgccaacaguaa

SEQ ID NO: 240193 - RNA, 22 nt, Human
auucuaauaagcguuuugucgc

SEQ ID NO: 240194 - RNA, 22 nt, Human
auuauaguuuugcccuuaagaa

SEQ ID NO: 240195 - RNA, 21 nt, Human
auuaagacaauggcaaugggu

SEQ ID NO: 240196 - RNA, 22 nt, Human
auguuguuuauggguuaucaag

SEQ ID NO: 240197 - RNA, 23 nt, Human
auuauuucaggguuuugacuugc

SEQ ID NO: 240198 - RNA, 22 nt, Human
auuauucuuugggaaaguugaa

SEQ ID NO: 240199 - RNA, 21 nt, Human
auucugauguuucuauuguuu

SEQ ID NO: 240200 - RNA, 22 nt, Human
auucugaagcagaaaaggcaga

SEQ ID NO: 240201 - RNA, 22 nt, Human
auucuguaggcuuuuguuaaaa

SEQ ID NO: 240202 - RNA, 22 nt, Human
auucuguuuuaccauuuucuuu

SEQ ID NO: 240203 - RNA, 22 nt, Human
auucuguuuaauacacgaaagg

SEQ ID NO: 240204 - RNA, 17 nt, Human
auucuuauacucuguga

SEQ ID NO: 240205 - RNA, 22 nt, Human
auucaagauagaaggauuuuca

SEQ ID NO: 240206 - RNA, 17 nt, Human
auucaugaacauguccu

SEQ ID NO: 240207 - RNA, 22 nt, Human
auucauauagcgcuuacagccu

SEQ ID NO: 240208 - RNA, 22 nt, Human
auugaauuagauguuguagucc

SEQ ID NO: 240209 - RNA, 22 nt, Human
auugacagagguguaguugaga

SEQ ID NO: 240210 - RNA, 22 nt, Human
auucucuauugguaaauuugac

SEQ ID NO: 240211 - RNA, 22 nt, Human
auugacagaaaauuggauggca

SEQ ID NO: 240212 - RNA, 22 nt, Human
auucuaugaaugacuguuagau

SEQ ID NO: 240213 - RNA, 22 nt, Human
auucuagaguuucaauccaagg

SEQ ID NO: 240214 - RNA, 17 nt, Human
auucuaguuggcuuuuu

SEQ ID NO: 240215 - RNA, 22 nt, Human
auugaaauuugcuuccucacug

SEQ ID NO: 240216 - RNA, 22 nt, Human
auucucauguuuuaaaaaaguu

SEQ ID NO: 240217 - RNA, 22 nt, Human
auucucauguuaccaaauucua

SEQ ID NO: 240218 - RNA, 22 nt, Human
auucuacucuuuaaauaugaaa

SEQ ID NO: 240219 - RNA, 22 nt, Human
auucuucauguugaagcuguca

SEQ ID NO: 240220 - RNA, 22 nt, Human
auucuuuucucuaaaugaugaa

SEQ ID NO: 240221 - RNA, 22 nt, Human
auucuuuagaguccuucaaaua

SEQ ID NO: 240222 - RNA, 22 nt, Human
auucuugauauagauaguuaau

SEQ ID NO: 240223 - RNA, 22 nt, Human
auugcauucaugcuccccuuag

SEQ ID NO: 240224 - RNA, 22 nt, Human
auucuuauaaaaaguguugacu

SEQ ID NO: 240225 - RNA, 22 nt, Human
auugaugccugaaaaauaugua

SEQ ID NO: 240226 - RNA, 18 nt, Human
auugagcaugacagaccu

SEQ ID NO: 240227 - RNA, 22 nt, Human
auugaguacuugcugggcucuc

SEQ ID NO: 240228 - RNA, 22 nt, Human
auugaguauuguaaauaaaaca

SEQ ID NO: 240229 - RNA, 22 nt, Human
auucucuguacagaagguaccg

SEQ ID NO: 240230 - RNA, 22 nt, Human
auucuguugguuuaauagucaa

SEQ ID NO: 240231 - RNA, 20 nt, Human
auucuguguaaauguccugu

SEQ ID NO: 240232 - RNA, 22 nt, Human
auucuuacaaagcagagucugu

SEQ ID NO: 240233 - RNA, 22 nt, Human
auugagacugaaauuacugaag

SEQ ID NO: 240234 - RNA, 22 nt, Human
auugagaugcuuaaaucuucac

SEQ ID NO: 240235 - RNA, 22 nt, Human
uuugugauaaguggauucaagg

SEQ ID NO: 240236 - RNA, 22 nt, Human
uuucuuccuucuugaucauuug

SEQ ID NO: 240237 - RNA, 22 nt, Human
uuucuguugugaccugacucuu

SEQ ID NO: 240238 - RNA, 22 nt, Human
uuugaagaaacagucuuaagag

SEQ ID NO: 240239 - RNA, 18 nt, Human
uuucuuuuauuccagguc

SEQ ID NO: 240240 - RNA, 22 nt, Human
uuucuuugcugguuggcucucc

SEQ ID NO: 240241 - RNA, 22 nt, Human
uuucuugugauuuugaugaacu

SEQ ID NO: 240242 - RNA, 22 nt, Human
uuucuaguagcuacagcaccau

SEQ ID NO: 240243 - RNA, 19 nt, Human
uuucucacugagucguuug

SEQ ID NO: 240244 - RNA, 22 nt, Human
uuucucuuguauuugaaucacu

SEQ ID NO: 240245 - RNA, 22 nt, Human
uuuccuguuuugguuuggagag

SEQ ID NO: 240246 - RNA, 22 nt, Human
uuucuaaaaccagaguuuauaa

SEQ ID NO: 240247 - RNA, 22 nt, Human
uuucuauauucaguuucauaaa

SEQ ID NO: 240248 - RNA, 22 nt, Human
uuucuaguauauaacuagaucu

SEQ ID NO: 240249 - RNA, 22 nt, Human
uuucuacauuuguaaccagauu

SEQ ID NO: 240250 - RNA, 21 nt, Human
uuucauuaguacaucaauuug

SEQ ID NO: 240251 - RNA, 22 nt, Human
uuuccaguuguucuagaaagcu

SEQ ID NO: 240252 - RNA, 21 nt, Human
uuucauaggguuaaaggguua

SEQ ID NO: 240253 - RNA, 22 nt, Human
uuucagcaugacuguuaucuuu

SEQ ID NO: 240254 - RNA, 22 nt, Human
uuucauagaggcagcggcggau

SEQ ID NO: 240255 - RNA, 22 nt, Human
uuucaucccugucagugaaggc

SEQ ID NO: 240256 - RNA, 22 nt, Human
uuugcuguccaauauucagggu

SEQ ID NO: 240257 - RNA, 22 nt, Human
uuuggaugcugucauaugcugc

SEQ ID NO: 240258 - RNA, 22 nt, Human
uuuggcuacucuucauugguga

SEQ ID NO: 240259 - RNA, 22 nt, Human
uuuggaggaaugaguuuaauau

SEQ ID NO: 240260 - RNA, 22 nt, Human
uuugggaaguaauuaauugcag

SEQ ID NO: 240261 - RNA, 22 nt, Human
uuuguauuucaaggcacucuca

SEQ ID NO: 240262 - RNA, 22 nt, Human
uuuguaguuguggaugcugaag

SEQ ID NO: 240263 - RNA, 22 nt, Human
uuugucaucuuccauauuugca

SEQ ID NO: 240264 - RNA, 22 nt, Human
uuuggucaucaaagacaaguaa

SEQ ID NO: 240265 - RNA, 22 nt, Human
uuugauauaaaggcuugggcug

SEQ ID NO: 240266 - RNA, 22 nt, Human
uuugauuuuguuuauagugccg

SEQ ID NO: 240267 - RNA, 22 nt, Human
uuugcacuuaaauuuacaacac

SEQ ID NO: 240268 - RNA, 22 nt, Human
uuugcaaaguccauugaaguua

SEQ ID NO: 240269 - RNA, 22 nt, Human
uuugcuguaaugcaugucagag

SEQ ID NO: 240270 - RNA, 23 nt, Human
uuugaaucauuguggggcuuuug

SEQ ID NO: 240271 - RNA, 22 nt, Human
uuugaauauuaugucccacuuu

SEQ ID NO: 240272 - RNA, 22 nt, Human
uuugacaccaggagagaaaaca

SEQ ID NO: 240273 - RNA, 22 nt, Human
uuugaagaccuuaucucuaaau

SEQ ID NO: 240274 - RNA, 22 nt, Human
uuugagguuuagcucacuauuu

SEQ ID NO: 240275 - RNA, 22 nt, Human
uuugaugauuuucuagagugua

SEQ ID NO: 240276 - RNA, 22 nt, Human
uuuacaaggcaguuauuuuccu

SEQ ID NO: 240277 - RNA, 22 nt, Human
uuuaccugucuguagaacauaa

SEQ ID NO: 240278 - RNA, 22 nt, Human
uuguugcaagccuggaaucugg

SEQ ID NO: 240279 - RNA, 22 nt, Human
uuguugcuguugaacccugcug

SEQ ID NO: 240280 - RNA, 22 nt, Human
uuguuuaaagaacuucugacuu

SEQ ID NO: 240281 - RNA, 22 nt, Human
uuuaccuuauguaaauaagagu

SEQ ID NO: 240282 - RNA, 22 nt, Human
uuuagauguucccucuacccug

SEQ ID NO: 240283 - RNA, 22 nt, Human
uuuagguuguguucuggcaugu

SEQ ID NO: 240284 - RNA, 22 nt, Human
uuuaggauaacuccaguuuucc

SEQ ID NO: 240285 - RNA, 22 nt, Human
uuuaggaauuugcugggcauga

SEQ ID NO: 240286 - RNA, 22 nt, Human
uuuauauauauguaggagcaca

SEQ ID NO: 240287 - RNA, 22 nt, Human
uuuauaauuacguaaaauauuu

SEQ ID NO: 240288 - RNA, 22 nt, Human
uuuauaauuguuauguuaccca

SEQ ID NO: 240289 - RNA, 22 nt, Human
uuuagugagugugaaucaaaug

SEQ ID NO: 240290 - RNA, 22 nt, Human
uuuaguugcuuuaguugagcug

SEQ ID NO: 240291 - RNA, 22 nt, Human
uuuauaagccagacacugcguu

SEQ ID NO: 240292 - RNA, 22 nt, Human
uuuauucacuuaucaggaacga

SEQ ID NO: 240293 - RNA, 22 nt, Human
uuuauguugagcaaaauaccac

SEQ ID NO: 240294 - RNA, 22 nt, Human
uuuauuuagguaaacaugaguu

SEQ ID NO: 240295 - RNA, 22 nt, Human
uuuaugucaaaaguaaaaugaa

SEQ ID NO: 240296 - RNA, 22 nt, Human
uuuauuugggauuucucaucug

SEQ ID NO: 240297 - RNA, 22 nt, Human
uuuauuuggugguguuacuguu

SEQ ID NO: 240298 - RNA, 22 nt, Human
uuuauugaccugaguaucagca

SEQ ID NO: 240299 - RNA, 22 nt, Human
uuuauucuuugcuagguuccau

SEQ ID NO: 240300 - RNA, 22 nt, Human
uuuauuuuccaugucucuaggu

SEQ ID NO: 240301 - RNA, 22 nt, Human
uuuauuugugguaguguaaucu

SEQ ID NO: 240302 - RNA, 22 nt, Human
uuguauuaauacacuccuuuuc

SEQ ID NO: 240303 - RNA, 22 nt, Human
uuguauuguuugcgucuguguu

SEQ ID NO: 240304 - RNA, 22 nt, Human
uuguggagaggaagcaaggagg

SEQ ID NO: 240305 - RNA, 22 nt, Human
uugugauuaauaacuuuucucu

SEQ ID NO: 240306 - RNA, 22 nt, Human
uugugacuauuuuucauugaag

SEQ ID NO: 240307 - RNA, 22 nt, Human
uugugcauuuuguuuuacuuau

SEQ ID NO: 240308 - RNA, 22 nt, Human
uuggggaugccccuacgggcua

SEQ ID NO: 240309 - RNA, 22 nt, Human
uugguuuuauucguauuuguau

SEQ ID NO: 240310 - RNA, 22 nt, Human
uuguaauaguguuuuacguugu

SEQ ID NO: 240311 - RNA, 22 nt, Human
uuguaaguuuuagguguuucaa

SEQ ID NO: 240312 - RNA, 22 nt, Human
uugggaaauuugaaaauaaaag

SEQ ID NO: 240313 - RNA, 22 nt, Human
uuggcuuuucaguuuuaaguua

SEQ ID NO: 240314 - RNA, 22 nt, Human
uuggcuguguugaaaacgugga

SEQ ID NO: 240315 - RNA, 22 nt, Human
uuggaggccacagucaucuuua

SEQ ID NO: 240316 - RNA, 22 nt, Human
uuggauagaauuuaaauugucu

SEQ ID NO: 240317 - RNA, 20 nt, Human
uugauucacaaaaagcuuag

SEQ ID NO: 240318 - RNA, 22 nt, Human
uugauucauuuguucccauuuu

SEQ ID NO: 240319 - RNA, 22 nt, Human
uugagaugacuuaaaucacugu

SEQ ID NO: 240320 - RNA, 22 nt, Human
uugagauuuggagguaauuccc

SEQ ID NO: 240321 - RNA, 22 nt, Human
uuuuuugucuugaagaaauggu

SEQ ID NO: 240322 - RNA, 22 nt, Human
uugacacauuagagcuuguaaa

SEQ ID NO: 240323 - RNA, 22 nt, Human
uugauaacuuagcugggcugcu

SEQ ID NO: 240324 - RNA, 22 nt, Human
uugagauggccuuuuuuauacu

SEQ ID NO: 240325 - RNA, 22 nt, Human
uugaugacauuuagcauaauug

SEQ ID NO: 240326 - RNA, 22 nt, Human
uugaugagucacuuucuguaaa

SEQ ID NO: 240327 - RNA, 22 nt, Human
uugaauaaggcauaaagauacu

SEQ ID NO: 240328 - RNA, 20 nt, Human
uuuuuuaaauagagcuguug

SEQ ID NO: 240329 - RNA, 22 nt, Human
uuuuuuaaucaaguaggaaaca

SEQ ID NO: 240330 - RNA, 21 nt, Human
uuuuuggagggguggggagga

SEQ ID NO: 240331 - RNA, 22 nt, Human
uugaauuuagguuuaugugaaa

SEQ ID NO: 240332 - RNA, 22 nt, Human
uuuuuggacccaucuucuuuuu

SEQ ID NO: 240333 - RNA, 22 nt, Human
uuuuuguaaaugaaguuuuauu

SEQ ID NO: 240334 - RNA, 22 nt, Human
uuuuugaauaagugcaucauca

SEQ ID NO: 240335 - RNA, 22 nt, Human
uuuuucugacugcuaacaaaaa

SEQ ID NO: 240336 - RNA, 22 nt, Human
uuuuucuuugcuuuccacuggc

SEQ ID NO: 240337 - RNA, 22 nt, Human
uugaaaaaaucugaggaggacc

SEQ ID NO: 240338 - RNA, 22 nt, Human
uucuuuuuagcugguuguaaga

SEQ ID NO: 240339 - RNA, 22 nt, Human
uuuuugcuuuuuugucaucuaa

SEQ ID NO: 240340 - RNA, 22 nt, Human
uuuuugcccuaaagaagucauu

SEQ ID NO: 240341 - RNA, 22 nt, Human
uucuuccagugaaacgugcauc

SEQ ID NO: 240342 - RNA, 22 nt, Human
uucuucgacuguauaaaaguau

SEQ ID NO: 240343 - RNA, 21 nt, Human
uucuuugaagacccauuugag

SEQ ID NO: 240344 - RNA, 22 nt, Human
uucuugcuuccggugcuccagg

SEQ ID NO: 240345 - RNA, 22 nt, Human
uuuucucucacuucacauauuu

SEQ ID NO: 240346 - RNA, 22 nt, Human
uuuucucaguuuuuuucaaaag

SEQ ID NO: 240347 - RNA, 22 nt, Human
uuuuccuucugauacuccauuu

SEQ ID NO: 240348 - RNA, 22 nt, Human
uuuucuacaaaucuggacuuuu

SEQ ID NO: 240349 - RNA, 22 nt, Human
uuuucucacugagagccuugau

SEQ ID NO: 240350 - RNA, 22 nt, Human
uuuugguauaauuuaaaauuaa

SEQ ID NO: 240351 - RNA, 22 nt, Human
uucuguuuauaauuugcaguug

SEQ ID NO: 240352 - RNA, 22 nt, Human
uuuugcuucuaguauauuuuuu

SEQ ID NO: 240353 - RNA, 22 nt, Human
uuuugcuagaaaucaccaauac

SEQ ID NO: 240354 - RNA, 22 nt, Human
uuuuagagacagcauggagaaa

SEQ ID NO: 240355 - RNA, 22 nt, Human
uuuuacuuuucccacuuacagc

SEQ ID NO: 240356 - RNA, 22 nt, Human
uuuuagaagcauuuaugagauu

SEQ ID NO: 240357 - RNA, 22 nt, Human
uuuuacaaugcaaauucuugcu

SEQ ID NO: 240358 - RNA, 22 nt, Human
uucuacauugugaaguucuuua

SEQ ID NO: 240359 - RNA, 22 nt, Human
uucuacuagugguugauggccu

SEQ ID NO: 240360 - RNA, 22 nt, Human
uuuuaauccucuugguaucuua

SEQ ID NO: 240361 - RNA, 22 nt, Human
uuuuaauucaacauuugcuuuu

SEQ ID NO: 240362 - RNA, 22 nt, Human
uuuuaaucagguauuugaguau

SEQ ID NO: 240363 - RNA, 22 nt, Human
uucucucaguuaaacuuuguga

SEQ ID NO: 240364 - RNA, 22 nt, Human
uuuuccuuagaaauacauugau

SEQ ID NO: 240365 - RNA, 22 nt, Human
uuuucauuguuaguuucuccuu

SEQ ID NO: 240366 - RNA, 22 nt, Human
uuuucauagccagaaacugaaa

SEQ ID NO: 240367 - RNA, 21 nt, Human
uucuauauugagaauuggcua

SEQ ID NO: 240368 - RNA, 22 nt, Human
uuuuauaauacccuugacuaau

SEQ ID NO: 240369 - RNA, 22 nt, Human
uuccuuuuuaauuaaucuaauu

SEQ ID NO: 240370 - RNA, 22 nt, Human
uuuuaacuuuaccauuucuuca

SEQ ID NO: 240371 - RNA, 22 nt, Human
uuuuaaguauuuucuuuuuuua

SEQ ID NO: 240372 - RNA, 22 nt, Human
uuuuaaauggcuuuuacuuuuc

SEQ ID NO: 240373 - RNA, 22 nt, Human
uuuuaaauaaacuacacugauu

SEQ ID NO: 240374 - RNA, 22 nt, Human
uuccuuuucuucuaccacaugu

SEQ ID NO: 240375 - RNA, 22 nt, Human
uuccuucccccuucuuugccuu

SEQ ID NO: 240376 - RNA, 22 nt, Human
uuccuuuaaccaagagcaguac

SEQ ID NO: 240377 - RNA, 22 nt, Human
uuuguuugcuaguauuuuguuu

SEQ ID NO: 240378 - RNA, 22 nt, Human
uuuguuuccagccuuuugucuu

SEQ ID NO: 240379 - RNA, 17 nt, Human
uuuguuucauacuucau

SEQ ID NO: 240380 - RNA, 22 nt, Human
uuuguuuuggugucaugcguga

SEQ ID NO: 240381 - RNA, 22 nt, Human
uuuguuugcugagugaauucaa

SEQ ID NO: 240382 - RNA, 22 nt, Human
uuuuaaaacaugucaaaaugug

SEQ ID NO: 240383 - RNA, 22 nt, Human
uuccagauguuuaaguucugcu

SEQ ID NO: 240384 - RNA, 22 nt, Human
uuccacaugaucauuguaauaa

SEQ ID NO: 240385 - RNA, 22 nt, Human
uuccacauucggaauuuucuga

SEQ ID NO: 240386 - RNA, 23 nt, Human
uuugggaaauagccuauaggcac

SEQ ID NO: 240387 - RNA, 22 nt, Human
uuugggaaacuuaggggucaga

SEQ ID NO: 240388 - RNA, 22 nt, Human
uuccauuacuaaugccugcaau

SEQ ID NO: 240389 - RNA, 22 nt, Human
uuccauuccauaucagguacag

SEQ ID NO: 240390 - RNA, 18 nt, Human
uuccauuuuucagucuuc

SEQ ID NO: 240391 - RNA, 22 nt, Human
uuuguucaccuagcaaacuuuu

SEQ ID NO: 240392 - RNA, 21 nt, Human
uuuguucacacacagggcagc

SEQ ID NO: 240393 - RNA, 22 nt, Human
uuuguucaguuuguugugggug

SEQ ID NO: 240394 - RNA, 22 nt, Human
uucauauuuaauuggucaucaa

SEQ ID NO: 240395 - RNA, 22 nt, Human
uucaucauuuuccauuccucuu

SEQ ID NO: 240396 - RNA, 22 nt, Human
uucauccucuaguacugaagug

SEQ ID NO: 240397 - RNA, 22 nt, Human
uucauagggagcaucuaccuau

SEQ ID NO: 240398 - RNA, 22 nt, Human
uucaggugguuuaagaauugga

SEQ ID NO: 240399 - RNA, 22 nt, Human
uucagguuauugaagagcuuuc

SEQ ID NO: 240400 - RNA, 22 nt, Human
uuuggcugucauuugaaaaugu

SEQ ID NO: 240401 - RNA, 22 nt, Human
uucagcugcuugccugaaguca

SEQ ID NO: 240402 - RNA, 22 nt, Human
uucagauuuguuuuuguuucug

SEQ ID NO: 240403 - RNA, 22 nt, Human
uucagcauaggcugcucuucaa

SEQ ID NO: 240404 - RNA, 22 nt, Human
uuaguuaauaaauauugagugu

SEQ ID NO: 240405 - RNA, 22 nt, Human
uuagugaagaagcaucuuuagu

SEQ ID NO: 240406 - RNA, 20 nt, Human
uuaguuacuuagugagaguc

SEQ ID NO: 240407 - RNA, 22 nt, Human
uucacaauuuuaaaaaguggaa

SEQ ID NO: 240408 - RNA, 22 nt, Human
uucagaauuaucauaauuuuga

SEQ ID NO: 240409 - RNA, 22 nt, Human
uucacuuuuucucugcuugaga

SEQ ID NO: 240410 - RNA, 22 nt, Human
uucagaaagugaaucuuguuau

SEQ ID NO: 240411 - RNA, 22 nt, Human
uucacguuguugaagaaaauac

SEQ ID NO: 240412 - RNA, 22 nt, Human
uugggugcugcacccuucaaca

SEQ ID NO: 240413 - RNA, 22 nt, Human
uguugaugaccacaauuuaugc

SEQ ID NO: 240414 - RNA, 22 nt, Human
uugguuuacucuggggauaucu

SEQ ID NO: 240415 - RNA, 22 nt, Human
uuggucaagacugauaucaaga

SEQ ID NO: 240416 - RNA, 22 nt, Human
uugguauucaguuggauuugga

SEQ ID NO: 240417 - RNA, 17 nt, Human
uguuguguggauuuucc

SEQ ID NO: 240418 - RNA, 22 nt, Human
uuguauguuucugugcacauga

SEQ ID NO: 240419 - RNA, 22 nt, Human
uugguuuuuugguguaucuuau

SEQ ID NO: 240420 - RNA, 22 nt, Human
uguuuaucaguagacucaaguu

SEQ ID NO: 240421 - RNA, 22 nt, Human
uguuuaaauagaacauacugca

SEQ ID NO: 240422 - RNA, 22 nt, Human
uguuuuguuuagguuuguuuuu

SEQ ID NO: 240423 - RNA, 22 nt, Human
uguuuuuucccccccuucuaaa

SEQ ID NO: 240424 - RNA, 22 nt, Human
uguuuucuauuaccugagauug

SEQ ID NO: 240425 - RNA, 22 nt, Human
uugucauuuucuuaauguuccu

SEQ ID NO: 240426 - RNA, 21 nt, Human
uguuuuguaauagauacuaug

SEQ ID NO: 240427 - RNA, 22 nt, Human
uguuuaguuuugcaccaauaaa

SEQ ID NO: 240428 - RNA, 22 nt, Human
uugucuuucguauggaacacua

SEQ ID NO: 240429 - RNA, 22 nt, Human
uugugaggaugugcuuuuuagu

SEQ ID NO: 240430 - RNA, 22 nt, Human
uguguuguuggggauguuuuca

SEQ ID NO: 240431 - RNA, 21 nt, Human
uguguuuauauguguuuauau

SEQ ID NO: 240432 - RNA, 20 nt, Human
uugggaagccuacaccauuc

SEQ ID NO: 240433 - RNA, 22 nt, Human
uugggagaaaguuaacuuucua

SEQ ID NO: 240434 - RNA, 19 nt, Human
uguucuacuugcuaguauu

SEQ ID NO: 240435 - RNA, 22 nt, Human
uguuaguauuggcaaauuuguu

SEQ ID NO: 240436 - RNA, 22 nt, Human
uguuauugccucaugagacucc

SEQ ID NO: 240437 - RNA, 22 nt, Human
uguguauaugugugugugugug

SEQ ID NO: 240438 - RNA, 22 nt, Human
uguguauguauguauguaugua

SEQ ID NO: 240439 - RNA, 22 nt, Human
uuggagaaagcugcaggcucug

SEQ ID NO: 240440 - RNA, 22 nt, Human
uuggaauuugagaccaagaaaa

SEQ ID NO: 240441 - RNA, 22 nt, Human
uugcuaagguuuaacuauugga

SEQ ID NO: 240442 - RNA, 22 nt, Human
uuggaagagagauggggagaga

SEQ ID NO: 240443 - RNA, 22 nt, Human
uuggaaauguagaaaagcagau

SEQ ID NO: 240444 - RNA, 22 nt, Human
uuggauugugaaaguauucucu

SEQ ID NO: 240445 - RNA, 22 nt, Human
uguguguuguuuugccagaaua

SEQ ID NO: 240446 - RNA, 22 nt, Human
ugugucuuuggcgaugucugga

SEQ ID NO: 240447 - RNA, 22 nt, Human
uuguuuucuugaugaaauuauu

SEQ ID NO: 240448 - RNA, 22 nt, Human
uuaaucuauuucauauaaggga

SEQ ID NO: 240449 - RNA, 22 nt, Human
uuaaugauuaauguggacccaa

SEQ ID NO: 240450 - RNA, 22 nt, Human
uuguuugguugacugauuuacc

SEQ ID NO: 240451 - RNA, 22 nt, Human
uuguuuuaguagaaguuacaug

SEQ ID NO: 240452 - RNA, 22 nt, Human
uuaauauuaagauauugagugg

SEQ ID NO: 240453 - RNA, 22 nt, Human
uuaauauuuauugguaaucacu

SEQ ID NO: 240454 - RNA, 22 nt, Human
uuaaucagacauucucaaguuu

SEQ ID NO: 240455 - RNA, 22 nt, Human
uuaauacugugucuuuuuuaau

SEQ ID NO: 240456 - RNA, 22 nt, Human
uuguuuuaaaaagaauaacuac

SEQ ID NO: 240457 - RNA, 22 nt, Human
uuaauguuuuagaaugagagug

SEQ ID NO: 240458 - RNA, 22 nt, Human
uuaauguugacacacuagcaca

SEQ ID NO: 240459 - RNA, 22 nt, Human
uuaaugcauguaaaugugcaaa

SEQ ID NO: 240460 - RNA, 22 nt, Human
uuaaugcagguacuguuacaau

SEQ ID NO: 240461 - RNA, 23 nt, Human
uuuaaacaauguggucguggugg

SEQ ID NO: 240462 - RNA, 22 nt, Human
uuuaaaauguuuuauuuauuua

SEQ ID NO: 240463 - RNA, 22 nt, Human
uuuaaauaguugguuuuuuugc

SEQ ID NO: 240464 - RNA, 22 nt, Human
uuuaaagucaggcuguaguggu

SEQ ID NO: 240465 - RNA, 22 nt, Human
uuguuguuguuguuauuuaguu

SEQ ID NO: 240466 - RNA, 22 nt, Human
uuguuauuauuauuuucguucu

SEQ ID NO: 240467 - RNA, 22 nt, Human
uuaauaaauugugguaccagag

SEQ ID NO: 240468 - RNA, 22 nt, Human
uuaaguauauccauuugacugg

SEQ ID NO: 240469 - RNA, 22 nt, Human
uuaaguauggaggccuaacuga

SEQ ID NO: 240470 - RNA, 22 nt, Human
uuaaaauuguuaacuuugguga

SEQ ID NO: 240471 - RNA, 22 nt, Human
uuaaagaguuuauuacuuguaa

SEQ ID NO: 240472 - RNA, 22 nt, Human
uuaaagguacuccuaagcgggg

SEQ ID NO: 240473 - RNA, 22 nt, Human
uuguuauaggaucagugucacu

SEQ ID NO: 240474 - RNA, 22 nt, Human
uuguguugaagugguuagggcg

SEQ ID NO: 240475 - RNA, 22 nt, Human
uuguguuuaaucuguuccacua

SEQ ID NO: 240476 - RNA, 22 nt, Human
uuaacuaguauuuuuaguccug

SEQ ID NO: 240477 - RNA, 22 nt, Human
uuaagggauugagauggaauga

SEQ ID NO: 240478 - RNA, 22 nt, Human
uuaacauuguccuuagcagauu

SEQ ID NO: 240479 - RNA, 22 nt, Human
uuaaacauuuccacuugccagu

SEQ ID NO: 240480 - RNA, 22 nt, Human
uuacuuaucugaugugauuuuu

SEQ ID NO: 240481 - RNA, 18 nt, Human
uuuacgaacucacuugag

SEQ ID NO: 240482 - RNA, 22 nt, Human
uuuacuaauuaguuuuggaaca

SEQ ID NO: 240483 - RNA, 22 nt, Human
uuuagaaugaaugcaagagaau

SEQ ID NO: 240484 - RNA, 22 nt, Human
uuuacuuuugguaaggucauuu

SEQ ID NO: 240485 - RNA, 21 nt, Human
uuacuaagagagcagagggac

SEQ ID NO: 240486 - RNA, 22 nt, Human
uuuaauuauaucugggcaguua

SEQ ID NO: 240487 - RNA, 22 nt, Human
uuaccuuuucuuguuuacaagu

SEQ ID NO: 240488 - RNA, 19 nt, Human
uuuaaugugugcugcaauc

SEQ ID NO: 240489 - RNA, 22 nt, Human
uuaauugggugcuuuguaaaua

SEQ ID NO: 240490 - RNA, 22 nt, Human
uuuaauauucucuuugaaggaa

SEQ ID NO: 240491 - RNA, 22 nt, Human
uuuaagguacagcuagcagcau

SEQ ID NO: 240492 - RNA, 22 nt, Human
uuacacaugaagguccaauguu

SEQ ID NO: 240493 - RNA, 22 nt, Human
uuacaacgcacacagauuucac

SEQ ID NO: 240494 - RNA, 20 nt, Human
uuuagucauuuccuaggaaa

SEQ ID NO: 240495 - RNA, 22 nt, Human
uuuaguauaguaugugcucaaa

SEQ ID NO: 240496 - RNA, 22 nt, Human
uuuaggugucugcucauugaag

SEQ ID NO: 240497 - RNA, 22 nt, Human
uuagaguucaagcuuuaggaaa

SEQ ID NO: 240498 - RNA, 22 nt, Human
uuaccugccucaaacacgaaug

SEQ ID NO: 240499 - RNA, 22 nt, Human
uuagauaaaucagcccugagua

SEQ ID NO: 240500 - RNA, 22 nt, Human
uuagauaguaaauagcacuaag

SEQ ID NO: 240501 - RNA, 22 nt, Human
uuagaaaaaggcuguggucuua

SEQ ID NO: 240502 - RNA, 22 nt, Human
uuuagcaaaaaagcucugcgua

SEQ ID NO: 240503 - RNA, 22 nt, Human
uuuagaugcuguauguuauuuc

SEQ ID NO: 240504 - RNA, 22 nt, Human
uuagguuuaugaggucugcauu

SEQ ID NO: 240505 - RNA, 22 nt, Human
uuaguauuuucaccauaugagg

SEQ ID NO: 240506 - RNA, 22 nt, Human
uuuaugguacaggaaugcuguu

SEQ ID NO: 240507 - RNA, 22 nt, Human
uuaguccuaaauuuagauuuuc

SEQ ID NO: 240508 - RNA, 22 nt, Human
uuuauguuuguuuuugaaauaa

SEQ ID NO: 240509 - RNA, 22 nt, Human
uuaggcuaauagagauggaaug

SEQ ID NO: 240510 - RNA, 22 nt, Human
uuagaugcugugauuuuucaaa

SEQ ID NO: 240511 - RNA, 22 nt, Human
uuagggacagcucuguagguga

SEQ ID NO: 240512 - RNA, 22 nt, Human
uuaggcuuuauugaaaacaaua

SEQ ID NO: 240513 - RNA, 22 nt, Human
uuuauaaacacaagaugggcuc

SEQ ID NO: 240514 - RNA, 22 nt, Human
uuuagugaagcuuugcauuuca

SEQ ID NO: 240515 - RNA, 22 nt, Human
uguaggcacauguauauauccc

SEQ ID NO: 240516 - RNA, 22 nt, Human
uguagcucaaggaauuguucuc

SEQ ID NO: 240517 - RNA, 22 nt, Human
uugaaagucuaagaauagguau

SEQ ID NO: 240518 - RNA, 22 nt, Human
uugaagaagucaaaagcugcag

SEQ ID NO: 240519 - RNA, 22 nt, Human
uguagugaaauuaaaccaaagc

SEQ ID NO: 240520 - RNA, 22 nt, Human
uguaguguauagaauuccagca

SEQ ID NO: 240521 - RNA, 20 nt, Human
uguacuauaaaagguugagu

SEQ ID NO: 240522 - RNA, 22 nt, Human
uguaccucagauuauugaucuc

SEQ ID NO: 240523 - RNA, 22 nt, Human
uugaaagaacaauucugugaug

SEQ ID NO: 240524 - RNA, 22 nt, Human
uguacauuuacaaaagcuuuau

SEQ ID NO: 240525 - RNA, 22 nt, Human
uugaaaaaugcccagcagacaa

SEQ ID NO: 240526 - RNA, 17 nt, Human
ugguucuuuuccugacc

SEQ ID NO: 240527 - RNA, 23 nt, Human
ugguuuucagaagaccuuguuag

SEQ ID NO: 240528 - RNA, 22 nt, Human
uucuuuuaauuucugucugcag

SEQ ID NO: 240529 - RNA, 22 nt, Human
uucuuuguccuagcauucuaca

SEQ ID NO: 240530 - RNA, 22 nt, Human
uucuuuuaauagagauccugug

SEQ ID NO: 240531 - RNA, 22 nt, Human
uguaaucaugguagaggcaaag

SEQ ID NO: 240532 - RNA, 22 nt, Human
uugaaaaaauguguuuaaggag

SEQ ID NO: 240533 - RNA, 22 nt, Human
uucuucuuuccuauaauuaauu

SEQ ID NO: 240534 - RNA, 22 nt, Human
uucuucuucuuccucauccuca

SEQ ID NO: 240535 - RNA, 22 nt, Human
ugguuauauaaggauuaaauac

SEQ ID NO: 240536 - RNA, 22 nt, Human
uucuguuuuuauucuaucucug

SEQ ID NO: 240537 - RNA, 22 nt, Human
uucugugacuccucagagauuu

SEQ ID NO: 240538 - RNA, 22 nt, Human
uugcaucagcaggcauaauugg

SEQ ID NO: 240539 - RNA, 22 nt, Human
ugugauugucuucugaaaguca

SEQ ID NO: 240540 - RNA, 22 nt, Human
uugccuacaaacgaaucuaucu

SEQ ID NO: 240541 - RNA, 23 nt, Human
uugcauuaauguggaggcacagg

SEQ ID NO: 240542 - RNA, 22 nt, Human
uugcaugugugaaaugcacaga

SEQ ID NO: 240543 - RNA, 22 nt, Human
uugccaggagacaucuggagcc

SEQ ID NO: 240544 - RNA, 22 nt, Human
uugccaggggacaucuggagcc

SEQ ID NO: 240545 - RNA, 22 nt, Human
ugucuuaugcugcauagacuau

SEQ ID NO: 240546 - RNA, 20 nt, Human
uugcaaagugaauagcaauu

SEQ ID NO: 240547 - RNA, 22 nt, Human
ugucuagacauuagcuucagcu

SEQ ID NO: 240548 - RNA, 22 nt, Human
uugauuccagcguuccaucagc

SEQ ID NO: 240549 - RNA, 22 nt, Human
uugaggguggauugucagggga

SEQ ID NO: 240550 - RNA, 22 nt, Human
uugauagauuuuagaggcaggc

SEQ ID NO: 240551 - RNA, 22 nt, Human
uugaugacuaaagaaagcugcu

SEQ ID NO: 240552 - RNA, 22 nt, Human
ugucauuggugaucugaugccu

SEQ ID NO: 240553 - RNA, 21 nt, Human
uguauacacacauuguaccaa

SEQ ID NO: 240554 - RNA, 22 nt, Human
uugacacauggcuucaauugca

SEQ ID NO: 240555 - RNA, 22 nt, Human
uugaauaguuuuggauagcaua

SEQ ID NO: 240556 - RNA, 22 nt, Human
uugaaggugggaggauuuauau

SEQ ID NO: 240557 - RNA, 21 nt, Human
uugaaguggguagcuggcggg

SEQ ID NO: 240558 - RNA, 22 nt, Human
uucccugugcaguauguuccaa

SEQ ID NO: 240559 - RNA, 22 nt, Human
ugggagagaaauuuaaguuuuu

SEQ ID NO: 240560 - RNA, 22 nt, Human
uuccucauuuuguuaauuuuac

SEQ ID NO: 240561 - RNA, 22 nt, Human
uuccccuucuaauacucaauuu

SEQ ID NO: 240562 - RNA, 22 nt, Human
uuccuaagugcugguaugaggc

SEQ ID NO: 240563 - RNA, 20 nt, Human
uuccuuucuuucuuuuuuuu

SEQ ID NO: 240564 - RNA, 22 nt, Human
ugggauucugaaaauggauuac

SEQ ID NO: 240565 - RNA, 20 nt, Human
uuccuuaucuguaaagugga

SEQ ID NO: 240566 - RNA, 18 nt, Human
uucgucauggggaucgua

SEQ ID NO: 240567 - RNA, 22 nt, Human
uggcugggagcuggaacugggc

SEQ ID NO: 240568 - RNA, 22 nt, Human
uggcugaugucuguucuguuau

SEQ ID NO: 240569 - RNA, 22 nt, Human
ugggaagccaguaucagacuaa

SEQ ID NO: 240570 - RNA, 22 nt, Human
uggagccugauggauaggaacg

SEQ ID NO: 240571 - RNA, 22 nt, Human
uuaucuuuuaaaaacacuugug

SEQ ID NO: 240572 - RNA, 22 nt, Human
uuauggauuagaguuugauucu

SEQ ID NO: 240573 - RNA, 22 nt, Human
uuaugugcuacacauaauuugu

SEQ ID NO: 240574 - RNA, 22 nt, Human
uucauuuuauauuagagcuguu

SEQ ID NO: 240575 - RNA, 22 nt, Human
uuccaaaugacaaugggcugua

SEQ ID NO: 240576 - RNA, 22 nt, Human
ugguauaaaaaaaugaguauaa

SEQ ID NO: 240577 - RNA, 22 nt, Human
ugguaugaaggaggccggcagc

SEQ ID NO: 240578 - RNA, 21 nt, Human
ugguccaaggacucauaccug

SEQ ID NO: 240579 - RNA, 22 nt, Human
uucuggacuuccaaauggcuuc

SEQ ID NO: 240580 - RNA, 22 nt, Human
ugguaauuuaacaaaauuguca

SEQ ID NO: 240581 - RNA, 22 nt, Human
ugguacaaaaaagauuuuggac

SEQ ID NO: 240582 - RNA, 22 nt, Human
ugguaaaguguacugaauauga

SEQ ID NO: 240583 - RNA, 22 nt, Human
uggguguguccauauuuugacu

SEQ ID NO: 240584 - RNA, 22 nt, Human
uucucuauuugcugcaccucuc

SEQ ID NO: 240585 - RNA, 22 nt, Human
ugggugugggguaggguaagag

SEQ ID NO: 240586 - RNA, 22 nt, Human
uucuccacguucuucucggccu

SEQ ID NO: 240587 - RNA, 22 nt, Human
uucuauaagagaugaauacagu

SEQ ID NO: 240588 - RNA, 22 nt, Human
uucuaguuacucuuaaaugcug

SEQ ID NO: 240589 - RNA, 22 nt, Human
uuauaaguaagggucucuggca

SEQ ID NO: 240590 - RNA, 22 nt, Human
uuauacugaaagucuuuuaaua

SEQ ID NO: 240591 - RNA, 18 nt, Human
uuauacaauuuuuuuuca

SEQ ID NO: 240592 - RNA, 22 nt, Human
uuauaggugauuaauuuuaacc

SEQ ID NO: 240593 - RNA, 22 nt, Human
uuauaucagaaggugagauuga

SEQ ID NO: 240594 - RNA, 22 nt, Human
uggaaugaaagaaaaauuguag

SEQ ID NO: 240595 - RNA, 22 nt, Human
uuauaagugccucuuuauuuuc

SEQ ID NO: 240596 - RNA, 22 nt, Human
uggagaaauaacauuuggauuc

SEQ ID NO: 240597 - RNA, 22 nt, Human
uggagagcaggugaaggaaaga

SEQ ID NO: 240598 - RNA, 19 nt, Human
uuauccacagggaauuuau

SEQ ID NO: 240599 - RNA, 22 nt, Human
uuaguuacuugacucaagaccc

SEQ ID NO: 240600 - RNA, 22 nt, Human
uuaguuauaggugaaucagaga

SEQ ID NO: 240601 - RNA, 22 nt, Human
uuaguuaccacugcagaucuuu

SEQ ID NO: 240602 - RNA, 22 nt, Human
uuagucauucccucuugauauu

SEQ ID NO: 240603 - RNA, 22 nt, Human
uuaguauuuuuugaaugaugaa

SEQ ID NO: 240604 - RNA, 22 nt, Human
uuagaguguguguaguagggug

SEQ ID NO: 240605 - RNA, 22 nt, Human
uuagaugugaucagcuggcuua

SEQ ID NO: 240606 - RNA, 22 nt, Human
uuagaugaaaaucggaacaugu

SEQ ID NO: 240607 - RNA, 22 nt, Human
uggaagaaaacuuggaaggcau

SEQ ID NO: 240608 - RNA, 22 nt, Human
uuagagauuuuauguuaaugua

SEQ ID NO: 240609 - RNA, 22 nt, Human
uggaaauaguugugagucaggc

SEQ ID NO: 240610 - RNA, 22 nt, Human
uuagaguacaggauuguuuuaa

SEQ ID NO: 240611 - RNA, 22 nt, Human
uuagagaagcacuguaggugaa

SEQ ID NO: 240612 - RNA, 22 nt, Human
uuagacagagcuccuugagggc

SEQ ID NO: 240613 - RNA, 22 nt, Human
uuagaaauguccuacuaauaug

SEQ ID NO: 240614 - RNA, 22 nt, Human
uuacuuacagggggucaggcug

SEQ ID NO: 240615 - RNA, 22 nt, Human
uuacuuucugggauaucaaaug

SEQ ID NO: 240616 - RNA, 22 nt, Human
uuacuuuuuucccccuuagaug

SEQ ID NO: 240617 - RNA, 22 nt, Human
uggaaagauuuaaaauaacgag

SEQ ID NO: 240618 - RNA, 22 nt, Human
uuaccauaguacuaucaguuua

SEQ ID NO: 240619 - RNA, 22 nt, Human
ugcuuguuuuguggcuucagcu

SEQ ID NO: 240620 - RNA, 19 nt, Human
uuacaugacauaugaagga

SEQ ID NO: 240621 - RNA, 22 nt, Human
uuacaguuuacauaagaauugu

SEQ ID NO: 240622 - RNA, 22 nt, Human
uuacaugcuugugcagguuuug

SEQ ID NO: 240623 - RNA, 22 nt, Human
uuacaagaucuuugaaggcaag

SEQ ID NO: 240624 - RNA, 22 nt, Human
ugcuuguuuguuuucuuccauu

SEQ ID NO: 240625 - RNA, 22 nt, Human
uuacaucacuuuacuuaauaau

SEQ ID NO: 240626 - RNA, 22 nt, Human
ugcuuuauucgacaucugguag

SEQ ID NO: 240627 - RNA, 22 nt, Human
uggaaaacgcaguuuaauuuuu

SEQ ID NO: 240628 - RNA, 21 nt, Human
ugcuuuuguugucagcugcug

SEQ ID NO: 240629 - RNA, 22 nt, Human
uggaaaagaugucuuccugaau

SEQ ID NO: 240630 - RNA, 22 nt, Human
ugcuuuuggcagcaguguuuau

SEQ ID NO: 240631 - RNA, 22 nt, Human
ugcuuuggcccaacauugaugc

SEQ ID NO: 240632 - RNA, 23 nt, Human
uuacuaugaaaauuccagucacu

SEQ ID NO: 240633 - RNA, 20 nt, Human
uuacucaaccaggcuucuac

SEQ ID NO: 240634 - RNA, 22 nt, Human
ugcuguugacuuuguuguucuu

SEQ ID NO: 240635 - RNA, 22 nt, Human
uuaauaaggaccugugacaugc

SEQ ID NO: 240636 - RNA, 21 nt, Human
uuaaugcuaugcagaaaaucu

SEQ ID NO: 240637 - RNA, 22 nt, Human
uuaauguggaagaguuuggcua

SEQ ID NO: 240638 - RNA, 22 nt, Human
uuaauucuugagcugucuuucc

SEQ ID NO: 240639 - RNA, 22 nt, Human
uuaauuguuagauagauuauag

SEQ ID NO: 240640 - RNA, 22 nt, Human
uuaagagaagaguaucuagaac

SEQ ID NO: 240641 - RNA, 22 nt, Human
uuaacgaauugugcauaauucc

SEQ ID NO: 240642 - RNA, 23 nt, Human
uuaagacuggcugaacuuaguag

SEQ ID NO: 240643 - RNA, 22 nt, Human
uuaaaagaauccuguuauccuc

SEQ ID NO: 240644 - RNA, 22 nt, Human
uuaaaucaggcaucauuucagu

SEQ ID NO: 240645 - RNA, 22 nt, Human
uguuuuuauucuuaauguuuca

SEQ ID NO: 240646 - RNA, 22 nt, Human
uguuuuuagcuguuuuuuggau

SEQ ID NO: 240647 - RNA, 22 nt, Human
uguuuuuuagagugauacuuuu

SEQ ID NO: 240648 - RNA, 22 nt, Human
uguuuuucaagcauuuauuaau

SEQ ID NO: 240649 - RNA, 22 nt, Human
ugcucuuucaggcauagaccuu

SEQ ID NO: 240650 - RNA, 22 nt, Human
uguuuaagugguuaaaggauuc

SEQ ID NO: 240651 - RNA, 22 nt, Human
ugcugacuauacauuuagcauu

SEQ ID NO: 240652 - RNA, 22 nt, Human
uguguguguguguguaauauau

SEQ ID NO: 240653 - RNA, 21 nt, Human
uguugguugugggaaggagga

SEQ ID NO: 240654 - RNA, 19 nt, Human
uguugugggccacuaacua

SEQ ID NO: 240655 - RNA, 22 nt, Human
uguuguagaaaggaaaguggcc

SEQ ID NO: 240656 - RNA, 22 nt, Human
uguuguucuuuuucuucuuguu

SEQ ID NO: 240657 - RNA, 22 nt, Human
ugcucuuguauccaaaagugau

SEQ ID NO: 240658 - RNA, 22 nt, Human
ugagaaauauacaccagacaca

SEQ ID NO: 240659 - RNA, 22 nt, Human
ugagaaaacaguuuguaauaau

SEQ ID NO: 240660 - RNA, 22 nt, Human
ugguaaaugucuaacaaucacu

SEQ ID NO: 240661 - RNA, 22 nt, Human
ugagacaaaguuguuggauguu

SEQ ID NO: 240662 - RNA, 22 nt, Human
ugagaagucagucuauugugaa

SEQ ID NO: 240663 - RNA, 22 nt, Human
uggucacagauuuacaggaaug

SEQ ID NO: 240664 - RNA, 22 nt, Human
ugguauauuugaccauaugugu

SEQ ID NO: 240665 - RNA, 21 nt, Human
ugagagucuguguauuuuuag

SEQ ID NO: 240666 - RNA, 22 nt, Human
ugguagacaacagcagugggac

SEQ ID NO: 240667 - RNA, 22 nt, Human
ugguauaaaaauuugugaaugu

SEQ ID NO: 240668 - RNA, 22 nt, Human
ugacuaauacagaaacuacaag

SEQ ID NO: 240669 - RNA, 22 nt, Human
ugggugugcaccuacgaucucu

SEQ ID NO: 240670 - RNA, 22 nt, Human
ugacugguauuuguaaaccaua

SEQ ID NO: 240671 - RNA, 22 nt, Human
uggguguggaagcagcgugggg

SEQ ID NO: 240672 - RNA, 22 nt, Human
ugacuuuucuccucugaaguuu

SEQ ID NO: 240673 - RNA, 22 nt, Human
ucuuuuucccugguuccuuuuu

SEQ ID NO: 240674 - RNA, 22 nt, Human
ugaucaacagggcuggaaagag

SEQ ID NO: 240675 - RNA, 20 nt, Human
ugauaugcgguacagagagg

SEQ ID NO: 240676 - RNA, 20 nt, Human
ugauaggcauugacauaagg

SEQ ID NO: 240677 - RNA, 22 nt, Human
uguagaaguuaauugaugagua

SEQ ID NO: 240678 - RNA, 21 nt, Human
ugagucuuagagaacuucagg

SEQ ID NO: 240679 - RNA, 19 nt, Human
ugaguacuaaugagauuga

SEQ ID NO: 240680 - RNA, 22 nt, Human
ugguuucagacagacucgaacu

SEQ ID NO: 240681 - RNA, 19 nt, Human
ugagauuguaugaggagau

SEQ ID NO: 240682 - RNA, 22 nt, Human
ugguuauggaacuggcuauggc

SEQ ID NO: 240683 - RNA, 22 nt, Human
ugguuagucaugguacugcagc

SEQ ID NO: 240684 - RNA, 22 nt, Human
uggugguaggggugguuucuga

SEQ ID NO: 240685 - RNA, 22 nt, Human
ugucucuagggcagauagagug

SEQ ID NO: 240686 - RNA, 22 nt, Human
ugucugaauuguaauguugcgu

SEQ ID NO: 240687 - RNA, 21 nt, Human
ugcaaugcauugacagcagca

SEQ ID NO: 240688 - RNA, 22 nt, Human
ugucuuuagagugaacagaaga

SEQ ID NO: 240689 - RNA, 22 nt, Human
ugcagaacacaguagacagaac

SEQ ID NO: 240690 - RNA, 22 nt, Human
ugugacaugauggcgucaugua

SEQ ID NO: 240691 - RNA, 22 nt, Human
ugugaagaauuaaugugaauca

SEQ ID NO: 240692 - RNA, 22 nt, Human
ugucuuuuaaaaauguguaaaa

SEQ ID NO: 240693 - RNA, 22 nt, Human
ugugaaugacuuuguucuuugc

SEQ ID NO: 240694 - RNA, 22 nt, Human
ugucacaccucguuuagcauuc

SEQ ID NO: 240695 - RNA, 22 nt, Human
ugauuucauaugacagcuuuuu

SEQ ID NO: 240696 - RNA, 22 nt, Human
ugauuuagguauuuucuuuugu

SEQ ID NO: 240697 - RNA, 22 nt, Human
ugaugcuagaacuuccaagaua

SEQ ID NO: 240698 - RNA, 22 nt, Human
ugaugaugccaaaauuuggcau

SEQ ID NO: 240699 - RNA, 22 nt, Human
ugcaagugccauggauucaggu

SEQ ID NO: 240700 - RNA, 22 nt, Human
ugcaaauuuuuuuauuuuuccu

SEQ ID NO: 240701 - RNA, 22 nt, Human
ugugcuugucuguuuugauugu

SEQ ID NO: 240702 - RNA, 22 nt, Human
ugcaucugagcacuacggugga

SEQ ID NO: 240703 - RNA, 22 nt, Human
ugcaucuaaguggcuaacaacc

SEQ ID NO: 240704 - RNA, 22 nt, Human
ugcagcuuuugguuucuagaug

SEQ ID NO: 240705 - RNA, 22 nt, Human
ugcaggaacucgaaaacuauag

SEQ ID NO: 240706 - RNA, 22 nt, Human
ugugauuucaaagggugucuuu

SEQ ID NO: 240707 - RNA, 22 nt, Human
ugugucauuugagaggagacga

SEQ ID NO: 240708 - RNA, 22 nt, Human
ugccccuagaggcguugcagcu

SEQ ID NO: 240709 - RNA, 22 nt, Human
ugcauguuauuguggcaagaau

SEQ ID NO: 240710 - RNA, 22 nt, Human
ugauugaauaauguuaugugaa

SEQ ID NO: 240711 - RNA, 22 nt, Human
ugauucuuugaccaaaaaauug

SEQ ID NO: 240712 - RNA, 22 nt, Human
ugauguaggacauuauuauuuc

SEQ ID NO: 240713 - RNA, 22 nt, Human
ugauguaaaauaggaaguucua

SEQ ID NO: 240714 - RNA, 22 nt, Human
ucauuugggauuuuuuauaauu

SEQ ID NO: 240715 - RNA, 22 nt, Human
ucauuuguauucuacaaagcac

SEQ ID NO: 240716 - RNA, 19 nt, Human
uccaaaauacuuguuacug

SEQ ID NO: 240717 - RNA, 22 nt, Human
ucauuuuaucaggaauggaauc

SEQ ID NO: 240718 - RNA, 22 nt, Human
ugaugaugaagaaauauuauca

SEQ ID NO: 240719 - RNA, 22 nt, Human
ugauaugguaauaagauauucu

SEQ ID NO: 240720 - RNA, 22 nt, Human
ucaucauccuuuuuugaagagu

SEQ ID NO: 240721 - RNA, 22 nt, Human
ucauacuuuuuugacccuugug

SEQ ID NO: 240722 - RNA, 22 nt, Human
ucauaaguuguugacuagcaaa

SEQ ID NO: 240723 - RNA, 22 nt, Human
ucauaaaggugccacucaguuu

SEQ ID NO: 240724 - RNA, 22 nt, Human
ucauaaaaucaguguccauugu

SEQ ID NO: 240725 - RNA, 20 nt, Human
ucaguuucccuauuagguug

SEQ ID NO: 240726 - RNA, 22 nt, Human
ucaucuauaaguagcaucuggg

SEQ ID NO: 240727 - RNA, 20 nt, Human
ucaucuuucaaauuugugac

SEQ ID NO: 240728 - RNA, 22 nt, Human
ucaucuuucuuuauggaaauac

SEQ ID NO: 240729 - RNA, 22 nt, Human
ucaucuuuauaaugcaaguuuu

SEQ ID NO: 240730 - RNA, 22 nt, Human
ugauauaaaagauucuuauuga

SEQ ID NO: 240731 - RNA, 20 nt, Human
ucagugggaaagugagagug

SEQ ID NO: 240732 - RNA, 22 nt, Human
ucaguugauggcaguuaauguc

SEQ ID NO: 240733 - RNA, 22 nt, Human
ucaguuuaauuggaucuuuuuc

SEQ ID NO: 240734 - RNA, 22 nt, Human
ugagcuuugguaccuucauuug

SEQ ID NO: 240735 - RNA, 22 nt, Human
ugaggaaugugacaaaaccaag

SEQ ID NO: 240736 - RNA, 22 nt, Human
ugagccauguucaugaguucau

SEQ ID NO: 240737 - RNA, 22 nt, Human
ugagauuuagaacuggauuuca

SEQ ID NO: 240738 - RNA, 23 nt, Human
ucagugaaggaacaacuaaauag

SEQ ID NO: 240739 - RNA, 22 nt, Human
ucagugauccagauauuugagc

SEQ ID NO: 240740 - RNA, 22 nt, Human
ugagauucuguucagaaaaaug

SEQ ID NO: 240741 - RNA, 22 nt, Human
ugagauguaauguaguacuuug

SEQ ID NO: 240742 - RNA, 22 nt, Human
ucagguuuaagugacuggaauc

SEQ ID NO: 240743 - RNA, 22 nt, Human
ucagguuuaagcuacuggaauc

SEQ ID NO: 240744 - RNA, 22 nt, Human
ugagaagaggucuuuugggaug

SEQ ID NO: 240745 - RNA, 22 nt, Human
ugagaauuuaacuugauuagga

SEQ ID NO: 240746 - RNA, 22 nt, Human
ugagaacacuuuucucuuugcu

SEQ ID NO: 240747 - RNA, 18 nt, Human
ucagggaaacuuugccug

SEQ ID NO: 240748 - RNA, 22 nt, Human
ucugugugugugcauaugcaug

SEQ ID NO: 240749 - RNA, 22 nt, Human
ucagucauacuuuaugauugaa

SEQ ID NO: 240750 - RNA, 22 nt, Human
ugagacuuggggggcugagggc

SEQ ID NO: 240751 - RNA, 22 nt, Human
ugagagaggugaaaugacuuuc

SEQ ID NO: 240752 - RNA, 22 nt, Human
ucagucacugugaaaugaauuu

SEQ ID NO: 240753 - RNA, 22 nt, Human
ucaguauuagugcauuaucagg

SEQ ID NO: 240754 - RNA, 22 nt, Human
ugauugggacauuuuguuuucu

SEQ ID NO: 240755 - RNA, 22 nt, Human
ucccaauuuacuagaugaauga

SEQ ID NO: 240756 - RNA, 23 nt, Human
ucccaacuuugaaauauuccaca

SEQ ID NO: 240757 - RNA, 22 nt, Human
ugauuugaaaccuuuggcaaga

SEQ ID NO: 240758 - RNA, 22 nt, Human
ugauugguauguauguuuguca

SEQ ID NO: 240759 - RNA, 22 nt, Human
ucccccuugucguuugagguuu

SEQ ID NO: 240760 - RNA, 22 nt, Human
ugcauaaauauuguugggagua

SEQ ID NO: 240761 - RNA, 22 nt, Human
ugcagugcagcuggaauaucuu

SEQ ID NO: 240762 - RNA, 22 nt, Human
ugcaguugcguuugcauuccau

SEQ ID NO: 240763 - RNA, 22 nt, Human
uccuuguuggaauauccuuacc

SEQ ID NO: 240764 - RNA, 22 nt, Human
uccuuguucugauuuuucuggg

SEQ ID NO: 240765 - RNA, 21 nt, Human
uccuuguuucuuccaaaacug

SEQ ID NO: 240766 - RNA, 22 nt, Human
uccuuuauuuaugggcagugua

SEQ ID NO: 240767 - RNA, 22 nt, Human
ugcauugccucuauucauuaua

SEQ ID NO: 240768 - RNA, 22 nt, Human
ugcaucauuaagguacaguugg

SEQ ID NO: 240769 - RNA, 22 nt, Human
ugcauaagguuaaauuagcaga

SEQ ID NO: 240770 - RNA, 22 nt, Human
ugcccagagccucuuaccucca

SEQ ID NO: 240771 - RNA, 22 nt, Human
ucuauuguuauccuuuccauuu

SEQ ID NO: 240772 - RNA, 23 nt, Human
ucucaccaggauaugacugucac

SEQ ID NO: 240773 - RNA, 22 nt, Human
ucucagaagaaacaucugcugg

SEQ ID NO: 240774 - RNA, 22 nt, Human
ucuauauucuauguucuucuuu

SEQ ID NO: 240775 - RNA, 21 nt, Human
ucuauccuggcuuuccacuug

SEQ ID NO: 240776 - RNA, 20 nt, Human
ugcuguggguaagcuuuaua

SEQ ID NO: 240777 - RNA, 22 nt, Human
ugcuggaaggguaguauuaacu

SEQ ID NO: 240778 - RNA, 22 nt, Human
ucucugugaauggcgucaccug

SEQ ID NO: 240779 - RNA, 20 nt, Human
ucucuuuuucuucuuuucuc

SEQ ID NO: 240780 - RNA, 22 nt, Human
ugcuuucaaaacucagaggaau

SEQ ID NO: 240781 - RNA, 22 nt, Human
ugcuuucaaugaauuguauacu

SEQ ID NO: 240782 - RNA, 22 nt, Human
ugcuuucagauaucuguuucaa

SEQ ID NO: 240783 - RNA, 22 nt, Human
ucugaaauuuuaguuauagaaa

SEQ ID NO: 240784 - RNA, 22 nt, Human
ucugaauauguuuaucaucucu

SEQ ID NO: 240785 - RNA, 22 nt, Human
uggaaaauuuagaaagauuuau

SEQ ID NO: 240786 - RNA, 22 nt, Human
ugcuuuuguaucagaguauuca

SEQ ID NO: 240787 - RNA, 22 nt, Human
ugcuuacgcaaccuguguuugg

SEQ ID NO: 240788 - RNA, 22 nt, Human
ugcuucuuuaggauguaguuau

SEQ ID NO: 240789 - RNA, 22 nt, Human
ucucuggacggacauuuaaggu

SEQ ID NO: 240790 - RNA, 22 nt, Human
ugcuuggauuuccaaaugguuu

SEQ ID NO: 240791 - RNA, 22 nt, Human
ucuucagacuguuguucuuuug

SEQ ID NO: 240792 - RNA, 22 nt, Human
ucuucacagaugcauauacuuc

SEQ ID NO: 240793 - RNA, 22 nt, Human
ucuucaaauacagucauauuga

SEQ ID NO: 240794 - RNA, 22 nt, Human
ucuucuauaucuacauaugcaa

SEQ ID NO: 240795 - RNA, 22 nt, Human
ucuucauuucuggggaauuggc

SEQ ID NO: 240796 - RNA, 22 nt, Human
uggcaguagagcuggaacuuga

SEQ ID NO: 240797 - RNA, 21 nt, Human
ucuuccaacacugacaccaug

SEQ ID NO: 240798 - RNA, 22 nt, Human
ucuuccacuugaaccuucuguc

SEQ ID NO: 240799 - RNA, 22 nt, Human
ucuuuaagugugugccuccagg

SEQ ID NO: 240800 - RNA, 22 nt, Human
ucuuuaucugugagcagucucc

SEQ ID NO: 240801 - RNA, 20 nt, Human
uggcaugaaauuuuccaagc

SEQ ID NO: 240802 - RNA, 22 nt, Human
ucuucuuauuuuaugaucgcuu

SEQ ID NO: 240803 - RNA, 22 nt, Human
uggcaguugcaguaacuuguau

SEQ ID NO: 240804 - RNA, 22 nt, Human
uggccaaauuggccugauguau

SEQ ID NO: 240805 - RNA, 22 nt, Human
uggccccauuuuucuggagccu

SEQ ID NO: 240806 - RNA, 22 nt, Human
ucuguauuuuuuacacacaugc

SEQ ID NO: 240807 - RNA, 22 nt, Human
ucuguaguaugguacuuauuua

SEQ ID NO: 240808 - RNA, 22 nt, Human
ucuguagcuaauucucuuuaaa

SEQ ID NO: 240809 - RNA, 21 nt, Human
ucuguuguguguugaggacuu

SEQ ID NO: 240810 - RNA, 22 nt, Human
ucuguuguauggcugucuaauu

SEQ ID NO: 240811 - RNA, 22 nt, Human
uggauaugaaacaaaacaagag

SEQ ID NO: 240812 - RNA, 22 nt, Human
ucuguguuccuggcaccaaacu

SEQ ID NO: 240813 - RNA, 22 nt, Human
ucuguucacaauuacacacacu

SEQ ID NO: 240814 - RNA, 22 nt, Human
ucuggcucaggagcuguguuca

SEQ ID NO: 240815 - RNA, 22 nt, Human
ucuggugcacucugauauuuga

SEQ ID NO: 240816 - RNA, 22 nt, Human
ucugauaaggaaggauuaaaag

SEQ ID NO: 240817 - RNA, 22 nt, Human
uauacucaauaaauauuuggag

SEQ ID NO: 240818 - RNA, 22 nt, Human
uauaaugucuuuguugaaaucu

SEQ ID NO: 240819 - RNA, 22 nt, Human
uauagccuuacaagauauuaua

SEQ ID NO: 240820 - RNA, 22 nt, Human
uauaagaaacaaggcaaauuuu

SEQ ID NO: 240821 - RNA, 22 nt, Human
uauaaucuugcccauaguauuu

SEQ ID NO: 240822 - RNA, 22 nt, Human
uauaggaugaugucauguugcu

SEQ ID NO: 240823 - RNA, 22 nt, Human
ucuccuaauuacauacuugauu

SEQ ID NO: 240824 - RNA, 23 nt, Human
ucuccccuccagcccucccuccu

SEQ ID NO: 240825 - RNA, 21 nt, Human
ucucauuuuaacacagaguug

SEQ ID NO: 240826 - RNA, 20 nt, Human
ucucauuuugauuucgcauu

SEQ ID NO: 240827 - RNA, 22 nt, Human
ucucauacguuuccagguguca

SEQ ID NO: 240828 - RNA, 22 nt, Human
uaguugguggagcgauuugucu

SEQ ID NO: 240829 - RNA, 21 nt, Human
ucucauacauaguaggaacca

SEQ ID NO: 240830 - RNA, 22 nt, Human
uaguuucuucaacugucccagc

SEQ ID NO: 240831 - RNA, 22 nt, Human
uaguuuuaagcugacauuguuc

SEQ ID NO: 240832 - RNA, 22 nt, Human
uaguuagagggaagcgacucgg

SEQ ID NO: 240833 - RNA, 22 nt, Human
uaguuauuucugcacuuaauga

SEQ ID NO: 240834 - RNA, 22 nt, Human
uaguuaaugauagggagagggg

SEQ ID NO: 240835 - RNA, 22 nt, Human
uaguucauucucucuauuccug

SEQ ID NO: 240836 - RNA, 23 nt, Human
uaguguuauuaauuaguaaggau

SEQ ID NO: 240837 - RNA, 22 nt, Human
uaggauaacaauuuguaguuuc

SEQ ID NO: 240838 - RNA, 22 nt, Human
uaguugaauuuaucaguagcau

SEQ ID NO: 240839 - RNA, 22 nt, Human
ucuaugcuacguuccucugaaa

SEQ ID NO: 240840 - RNA, 22 nt, Human
ucuaugaagucuuccuuuccuc

SEQ ID NO: 240841 - RNA, 22 nt, Human
ucuauuauauuuacacgagagu

SEQ ID NO: 240842 - RNA, 22 nt, Human
ucugacuucuuuuauuaucauu

SEQ ID NO: 240843 - RNA, 22 nt, Human
uaucugcuggagguaauuacuc

SEQ ID NO: 240844 - RNA, 22 nt, Human
uaucuuugccuuggguuuuguu

SEQ ID NO: 240845 - RNA, 22 nt, Human
uaucuagguacacaucuccucu

SEQ ID NO: 240846 - RNA, 22 nt, Human
uauccuaaaggguaguguggga

SEQ ID NO: 240847 - RNA, 22 nt, Human
ucucuucacuuguaugcuauca

SEQ ID NO: 240848 - RNA, 18 nt, Human
ucugaaggaaugauucca

SEQ ID NO: 240849 - RNA, 22 nt, Human
ucugaagagaacucuuaguguu

SEQ ID NO: 240850 - RNA, 22 nt, Human
ucucuuuuuuuaaaacucuaug

SEQ ID NO: 240851 - RNA, 22 nt, Human
uauauguagcucaaaaauuccc

SEQ ID NO: 240852 - RNA, 22 nt, Human
uauauuuguccuagcuccuagc

SEQ ID NO: 240853 - RNA, 22 nt, Human
uaucaguccaggguuuugugac

SEQ ID NO: 240854 - RNA, 22 nt, Human
uauauauaugcaccacaugugu

SEQ ID NO: 240855 - RNA, 22 nt, Human
ucucuguaguugggcagcugcu

SEQ ID NO: 240856 - RNA, 22 nt, Human
uauaugcagauuuucaucaucg

SEQ ID NO: 240857 - RNA, 22 nt, Human
uauaugcacucagguguaugug

SEQ ID NO: 240858 - RNA, 22 nt, Human
uauauaauacacaaauauguac

SEQ ID NO: 240859 - RNA, 22 nt, Human
uauauacacugauuaggauuuu

SEQ ID NO: 240860 - RNA, 22 nt, Human
uauauauacauauagaauaugu

SEQ ID NO: 240861 - RNA, 20 nt, Human
ucucuaacaugaaugcuauc

SEQ ID NO: 240862 - RNA, 22 nt, Human
uaugaucuuaggauggaacuuc

SEQ ID NO: 240863 - RNA, 22 nt, Human
uaugccaaaaauaaguuuuaug

SEQ ID NO: 240864 - RNA, 22 nt, Human
uaugaauauaccacaauuuagg

SEQ ID NO: 240865 - RNA, 19 nt, Human
uaugaaguugauaaaaguu

SEQ ID NO: 240866 - RNA, 22 nt, Human
uaugaguauagugcaccauggu

SEQ ID NO: 240867 - RNA, 22 nt, Human
ucugaucagaagacaaaugagg

SEQ ID NO: 240868 - RNA, 22 nt, Human
ucugauucucuuguugaccuag

SEQ ID NO: 240869 - RNA, 22 nt, Human
uaugugugaguauauaugcaca

SEQ ID NO: 240870 - RNA, 22 nt, Human
uaugugguuugucauuuaauau

SEQ ID NO: 240871 - RNA, 22 nt, Human
uauguguaauuaaauacuauag

SEQ ID NO: 240872 - RNA, 22 nt, Human
uaugugaaauggaauauagaaa

SEQ ID NO: 240873 - RNA, 22 nt, Human
ucuggcucuccagugcucuuag

SEQ ID NO: 240874 - RNA, 22 nt, Human
uauguauguauguauguauaug

SEQ ID NO: 240875 - RNA, 22 nt, Human
uauguauauccagguaagggcu

SEQ ID NO: 240876 - RNA, 22 nt, Human
uauggcuaguguguuuguaaca

SEQ ID NO: 240877 - RNA, 22 nt, Human
uauggcuucucagucaugaaaa

SEQ ID NO: 240878 - RNA, 22 nt, Human
ucugcuguugaucaugacuagc

SEQ ID NO: 240879 - RNA, 22 nt, Human
uauguacauauauguguauaua

SEQ ID NO: 240880 - RNA, 22 nt, Human
ucuucacugaagcuuugcaucu

SEQ ID NO: 240881 - RNA, 22 nt, Human
ucuuauuucuuucuuuuccugu

SEQ ID NO: 240882 - RNA, 22 nt, Human
ucuuauugugaugaugaagaac

SEQ ID NO: 240883 - RNA, 22 nt, Human
ucuuaaguuccaggugugcuca

SEQ ID NO: 240884 - RNA, 22 nt, Human
ucuuacuguccucuguuuuucu

SEQ ID NO: 240885 - RNA, 21 nt, Human
ucuuauacagcaauagaucug

SEQ ID NO: 240886 - RNA, 22 nt, Human
ucuguuuugugcuuuguuuucu

SEQ ID NO: 240887 - RNA, 22 nt, Human
ucuuaaauaugaaaaggauuau

SEQ ID NO: 240888 - RNA, 22 nt, Human
ucuguuuuuaucuauucuguua

SEQ ID NO: 240889 - RNA, 22 nt, Human
uauuauggguuuuuguguaaau

SEQ ID NO: 240890 - RNA, 22 nt, Human
ucuguucagaagaggugaaagu

SEQ ID NO: 240891 - RNA, 22 nt, Human
ucuguuauaaaucacacugcau

SEQ ID NO: 240892 - RNA, 22 nt, Human
ucuguuuuccaggaaucucaua

SEQ ID NO: 240893 - RNA, 21 nt, Human
ucugugcuuuuuuggcuccua

SEQ ID NO: 240894 - RNA, 20 nt, Human
ucugugugccaucaccuaac

SEQ ID NO: 240895 - RNA, 22 nt, Human
uauguugucuuguucagccaua

SEQ ID NO: 240896 - RNA, 22 nt, Human
uauguucaauaccagguucuuu

SEQ ID NO: 240897 - RNA, 22 nt, Human
uauguuaauuaccagcacugau

SEQ ID NO: 240898 - RNA, 22 nt, Human
uauguuaaauguuugauguuua

SEQ ID NO: 240899 - RNA, 22 nt, Human
uaagcguuugggaguuaugaac

SEQ ID NO: 240900 - RNA, 22 nt, Human
uaagcuauuccugaagaagguu

SEQ ID NO: 240901 - RNA, 22 nt, Human
ucauauugguagagauguguaa

SEQ ID NO: 240902 - RNA, 22 nt, Human
ucauaagucucauauaugucca

SEQ ID NO: 240903 - RNA, 22 nt, Human
ucauuagcuaucagaguggaac

SEQ ID NO: 240904 - RNA, 22 nt, Human
ucauuagaccucucugguucag

SEQ ID NO: 240905 - RNA, 22 nt, Human
ucauggguauaauuuuagaugu

SEQ ID NO: 240906 - RNA, 22 nt, Human
ucaugauaauacaggccuucua

SEQ ID NO: 240907 - RNA, 22 nt, Human
ucauuagucuuuaauacauaau

SEQ ID NO: 240908 - RNA, 22 nt, Human
ucauuauuuggaauaugggacu

SEQ ID NO: 240909 - RNA, 22 nt, Human
uaaguauguuagaaaaucaagu

SEQ ID NO: 240910 - RNA, 19 nt, Human
uaaguagaugacugaugcu

SEQ ID NO: 240911 - RNA, 22 nt, Human
uaaggaaaugcaaauuuaagaa

SEQ ID NO: 240912 - RNA, 18 nt, Human
uccaaaccuuuuacuucc

SEQ ID NO: 240913 - RNA, 22 nt, Human
uacagauggacacuguuucaag

SEQ ID NO: 240914 - RNA, 18 nt, Human
uacagauguaugucuaca

SEQ ID NO: 240915 - RNA, 17 nt, Human
ucauuuauccucuuugg

SEQ ID NO: 240916 - RNA, 22 nt, Human
ucauuuaucgcugccuuuuaaa

SEQ ID NO: 240917 - RNA, 17 nt, Human
ucauuucaguaaaucca

SEQ ID NO: 240918 - RNA, 22 nt, Human
uacaaucacccaaagagccaga

SEQ ID NO: 240919 - RNA, 22 nt, Human
uaauccaaaacugaaucugugg

SEQ ID NO: 240920 - RNA, 22 nt, Human
uaauauauuuuuuaagggaugu

SEQ ID NO: 240921 - RNA, 22 nt, Human
ucauuguuuacugucuuuuuuc

SEQ ID NO: 240922 - RNA, 22 nt, Human
uaauugaacguucauuuuuaau

SEQ ID NO: 240923 - RNA, 22 nt, Human
uaauugagauuucuggcugcuu

SEQ ID NO: 240924 - RNA, 22 nt, Human
uaauuugauuucucccuggaaa

SEQ ID NO: 240925 - RNA, 22 nt, Human
uaauuucauuuugcaaugaucu

SEQ ID NO: 240926 - RNA, 18 nt, Human
uaacugguuucuucccau

SEQ ID NO: 240927 - RNA, 22 nt, Human
uaacuguuuugaauauuguggu

SEQ ID NO: 240928 - RNA, 22 nt, Human
uaacuugaauacauucuuuuca

SEQ ID NO: 240929 - RNA, 22 nt, Human
uaacauuucggugacaguggga

SEQ ID NO: 240930 - RNA, 22 nt, Human
uaacauuuaguuuuaagauggu

SEQ ID NO: 240931 - RNA, 22 nt, Human
uaacaguauacuacaucauauu

SEQ ID NO: 240932 - RNA, 22 nt, Human
uaacacauagauauuuuaacuu

SEQ ID NO: 240933 - RNA, 22 nt, Human
uaacagugcuacaguuacuuuc

SEQ ID NO: 240934 - RNA, 22 nt, Human
ucagucugguggaugcucauug

SEQ ID NO: 240935 - RNA, 22 nt, Human
uaaauuccuagucacaaacuuc

SEQ ID NO: 240936 - RNA, 22 nt, Human
uaaauuggaauaaugagaagug

SEQ ID NO: 240937 - RNA, 22 nt, Human
uaaaugcucuuuaaaagugcuu

SEQ ID NO: 240938 - RNA, 22 nt, Human
uaaauguacugaggcaacagga

SEQ ID NO: 240939 - RNA, 22 nt, Human
uaaauguugcuugugcugcuca

SEQ ID NO: 240940 - RNA, 22 nt, Human
uaaaggaguguauaauuguagu

SEQ ID NO: 240941 - RNA, 22 nt, Human
uaaagcauguuucaguaagguu

SEQ ID NO: 240942 - RNA, 22 nt, Human
ucaagcaaggaauccuuuugua

SEQ ID NO: 240943 - RNA, 22 nt, Human
uaaaugaaaggguuuaauuuau

SEQ ID NO: 240944 - RNA, 22 nt, Human
uaaaugaaaugaagugaaagcu

SEQ ID NO: 240945 - RNA, 22 nt, Human
ucaguagcauuuaauguucagu

SEQ ID NO: 240946 - RNA, 22 nt, Human
ucaguaagauugauauuucccc

SEQ ID NO: 240947 - RNA, 20 nt, Human
uccugaaauuacgugauuca

SEQ ID NO: 240948 - RNA, 22 nt, Human
uagcagaacaauagucaaugau

SEQ ID NO: 240949 - RNA, 22 nt, Human
uagaugaacagaaagccacugu

SEQ ID NO: 240950 - RNA, 22 nt, Human
uagaugguguccagaaagagaa

SEQ ID NO: 240951 - RNA, 19 nt, Human
uagauuagagcauaggguu

SEQ ID NO: 240952 - RNA, 22 nt, Human
uagaacaaacagcauguuugau

SEQ ID NO: 240953 - RNA, 22 nt, Human
uagaaauaaacacugcuaccuu

SEQ ID NO: 240954 - RNA, 22 nt, Human
uagaagaacaugucaaacuaua

SEQ ID NO: 240955 - RNA, 22 nt, Human
ucccuucagcuccagcucugcu

SEQ ID NO: 240956 - RNA, 22 nt, Human
ucccuucccaccccugccuuuu

SEQ ID NO: 240957 - RNA, 22 nt, Human
ucccuuuucauccuaucccagc

SEQ ID NO: 240958 - RNA, 23 nt, Human
ucccuuuguucuugcuaggaugu

SEQ ID NO: 240959 - RNA, 22 nt, Human
uccuaaauuuguacuagcauuu

SEQ ID NO: 240960 - RNA, 22 nt, Human
uccucaucuuaucaucccaaga

SEQ ID NO: 240961 - RNA, 22 nt, Human
uagaguaagugugugcugagcu

SEQ ID NO: 240962 - RNA, 22 nt, Human
uagaggcuagugguuaugaccu

SEQ ID NO: 240963 - RNA, 22 nt, Human
uacuuuaauugcaaaaauaaau

SEQ ID NO: 240964 - RNA, 22 nt, Human
ucccugcgugagaaagcacuua

SEQ ID NO: 240965 - RNA, 22 nt, Human
ucccugcagggccauugugcag

SEQ ID NO: 240966 - RNA, 22 nt, Human
uacugaauuacugcugguaaau

SEQ ID NO: 240967 - RNA, 22 nt, Human
uacugaagaugccaucacaagc

SEQ ID NO: 240968 - RNA, 22 nt, Human
uacugaaagagugguggacucu

SEQ ID NO: 240969 - RNA, 22 nt, Human
uacuugaaaugggcaucaagag

SEQ ID NO: 240970 - RNA, 22 nt, Human
uacagcgaaaauuuagcuugau

SEQ ID NO: 240971 - RNA, 22 nt, Human
uccaaugugccuuauuuugagc

SEQ ID NO: 240972 - RNA, 22 nt, Human
uccaaggcagacacauuuuuug

SEQ ID NO: 240973 - RNA, 22 nt, Human
uccaggacgccgacgugucggc

SEQ ID NO: 240974 - RNA, 22 nt, Human
uccauaugaucuguuguauggu

SEQ ID NO: 240975 - RNA, 22 nt, Human
uacguaauagcuuuauuuuggg

SEQ ID NO: 240976 - RNA, 22 nt, Human
uacuaaacugcauuucuaucua

SEQ ID NO: 240977 - RNA, 22 nt, Human
guggaaauuuuaggaucaucuu

SEQ ID NO: 240978 - RNA, 22 nt, Human
gugcuguuagcgguuuauaaca

SEQ ID NO: 240979 - RNA, 22 nt, Human
uaggauauuuuagaaugguaca

SEQ ID NO: 240980 - RNA, 22 nt, Human
uagccuguuuuuaugagaauuu

SEQ ID NO: 240981 - RNA, 22 nt, Human
uagccaaguguuuuucaugacc

SEQ ID NO: 240982 - RNA, 22 nt, Human
uagcauuucacugaucuucacu

SEQ ID NO: 240983 - RNA, 22 nt, Human
uagccaaguuuucuuugaaagu

SEQ ID NO: 240984 - RNA, 22 nt, Human
uagaagagcaugucaaacuaua

SEQ ID NO: 240985 - RNA, 22 nt, Human
uagaagaugccuuaaaguugaa

SEQ ID NO: 240986 - RNA, 22 nt, Human
uagcugucauuggaucagaagg

SEQ ID NO: 240987 - RNA, 20 nt, Human
uagcuucaccuagagauagc

SEQ ID NO: 240988 - RNA, 21 nt, Human
uagcuugaucauuuuauuucc

SEQ ID NO: 240989 - RNA, 22 nt, Human
gugggcccaagcagcggcggcc

SEQ ID NO: 240990 - RNA, 22 nt, Human
gugggagaaugggaggaguaau

SEQ ID NO: 240991 - RNA, 22 nt, Human
uaguggaaccuucuaaaugacg

SEQ ID NO: 240992 - RNA, 22 nt, Human
uaguguuauuucuuaugugcua

SEQ ID NO: 240993 - RNA, 22 nt, Human
uagugcuuaaaacagaauuuuc

SEQ ID NO: 240994 - RNA, 22 nt, Human
uaguauuguguuguuugacagu

SEQ ID NO: 240995 - RNA, 22 nt, Human
uaguaugugccuguugucucug

SEQ ID NO: 240996 - RNA, 20 nt, Human
guggcagugguggcagcagu

SEQ ID NO: 240997 - RNA, 22 nt, Human
guggcaguaaagcuggaaaagu

SEQ ID NO: 240998 - RNA, 22 nt, Human
uaguacuugauuuuaaauguua

SEQ ID NO: 240999 - RNA, 22 nt, Human
uaguaauagcuguaaagugugu

SEQ ID NO: 241000 - RNA, 22 nt, Human
uaggucuuggagguggggcugg

SEQ ID NO: 241001 - RNA, 22 nt, Human
uagguuuugugucagaguagaa

SEQ ID NO: 241002 - RNA, 22 nt, Human
uaggugucuggacaacuuugua

SEQ ID NO: 241003 - RNA, 22 nt, Human
uagguuguaagaggucuuuugu

SEQ ID NO: 241004 - RNA, 22 nt, Human
guugggugccagaggcuucacg

SEQ ID NO: 241005 - RNA, 22 nt, Human
guugggguuucaguggcaguca

SEQ ID NO: 241006 - RNA, 22 nt, Human
guuggggccuggagucucuugg

SEQ ID NO: 241007 - RNA, 22 nt, Human
ucaaauaugggccagaggaaau

SEQ ID NO: 241008 - RNA, 22 nt, Human
ucaacagaagugauagcuauua

SEQ ID NO: 241009 - RNA, 22 nt, Human
guugggauugaaggugccucua

SEQ ID NO: 241010 - RNA, 20 nt, Human
guugggagaagugucagcug

SEQ ID NO: 241011 - RNA, 22 nt, Human
uauuuuagccaacagaaugaug

SEQ ID NO: 241012 - RNA, 22 nt, Human
uauuuucucugccacacuucca

SEQ ID NO: 241013 - RNA, 21 nt, Human
guugcuccuucuuuuucuugc

SEQ ID NO: 241014 - RNA, 22 nt, Human
uauuuguuuuuaaugcugggug

SEQ ID NO: 241015 - RNA, 22 nt, Human
uauuuuagaagauuuggagaaa

SEQ ID NO: 241016 - RNA, 22 nt, Human
guucuucucuuguaauggaauc

SEQ ID NO: 241017 - RNA, 17 nt, Human
guucucaaacugacuga

SEQ ID NO: 241018 - RNA, 22 nt, Human
guuccucugaaggauuuucaga

SEQ ID NO: 241019 - RNA, 22 nt, Human
guucggcuuccuaugucaugag

SEQ ID NO: 241020 - RNA, 22 nt, Human
uauuaugguuguagguuaacaa

SEQ ID NO: 241021 - RNA, 22 nt, Human
uauuacugccacaucauuaggu

SEQ ID NO: 241022 - RNA, 22 nt, Human
uauucagugcugguucuuuuuc

SEQ ID NO: 241023 - RNA, 22 nt, Human
uauucauuuuuauuugugacug

SEQ ID NO: 241024 - RNA, 22 nt, Human
guguucuuuaugguuguagugu

SEQ ID NO: 241025 - RNA, 22 nt, Human
guguucuucacuguuagaaggu

SEQ ID NO: 241026 - RNA, 22 nt, Human
uauguauaacuugauaggauga

SEQ ID NO: 241027 - RNA, 22 nt, Human
guguuuauguuuuugcuaggga

SEQ ID NO: 241028 - RNA, 22 nt, Human
guguuuguauccuccauauaac

SEQ ID NO: 241029 - RNA, 22 nt, Human
uaugccuaccuccaaaauauau

SEQ ID NO: 241030 - RNA, 22 nt, Human
uauguauauaaaugugugugug

SEQ ID NO: 241031 - RNA, 22 nt, Human
guguuguaguguguguuucuuu

SEQ ID NO: 241032 - RNA, 22 nt, Human
guuaauaugcaaaacggaugcg

SEQ ID NO: 241033 - RNA, 22 nt, Human
guuaaaugcagauucugacuca

SEQ ID NO: 241034 - RNA, 22 nt, Human
uaugucuauugacuuaggauuu

SEQ ID NO: 241035 - RNA, 22 nt, Human
uaugugaguaccugucaugugc

SEQ ID NO: 241036 - RNA, 20 nt, Human
uaugugcaguuugguuuauc

SEQ ID NO: 241037 - RNA, 22 nt, Human
uaugaaagguuuuuucuugaaa

SEQ ID NO: 241038 - RNA, 22 nt, Human
uaugaaggauacaccucugauu

SEQ ID NO: 241039 - RNA, 22 nt, Human
guguagauuuguucaccuauua

SEQ ID NO: 241040 - RNA, 22 nt, Human
guguauaguggugucgguagaa

SEQ ID NO: 241041 - RNA, 22 nt, Human
uauccauaccuucaaguuugcu

SEQ ID NO: 241042 - RNA, 22 nt, Human
uauccaucuucuuugagaaugg

SEQ ID NO: 241043 - RNA, 22 nt, Human
uauggacagcuuucuuuguguu

SEQ ID NO: 241044 - RNA, 22 nt, Human
uaugcuguauucuguauguuag

SEQ ID NO: 241045 - RNA, 22 nt, Human
uaugcauaauuggauaaguaga

SEQ ID NO: 241046 - RNA, 21 nt, Human
uaucauuuuuuccccugagau

SEQ ID NO: 241047 - RNA, 22 nt, Human
uauccaaaggaacaaucacagc

SEQ ID NO: 241048 - RNA, 22 nt, Human
uaucauuuuacugugacauuuu

SEQ ID NO: 241049 - RNA, 22 nt, Human
uaucauuaggagugcugcucgg

SEQ ID NO: 241050 - RNA, 22 nt, Human
gugguggugaggcaaggggugu

SEQ ID NO: 241051 - RNA, 22 nt, Human
guggugguguuggugacaaguu

SEQ ID NO: 241052 - RNA, 22 nt, Human
gugguuugacccuucagguaaa

SEQ ID NO: 241053 - RNA, 22 nt, Human
guggugauuugggucuagcuuu

SEQ ID NO: 241054 - RNA, 22 nt, Human
gugguaaagugugccugugguc

SEQ ID NO: 241055 - RNA, 22 nt, Human
guacuugauucauuauugcauu

SEQ ID NO: 241056 - RNA, 22 nt, Human
guaugaguggauagauguaucu

SEQ ID NO: 241057 - RNA, 22 nt, Human
guagauaauuuuggaaagcugg

SEQ ID NO: 241058 - RNA, 22 nt, Human
guagagcagaaacauggagaaa

SEQ ID NO: 241059 - RNA, 22 nt, Human
guauugauuguuuuaaaagauu

SEQ ID NO: 241060 - RNA, 22 nt, Human
uaagaccuuuuugaaaucacug

SEQ ID NO: 241061 - RNA, 21 nt, Human
uaagaacauuaucuucuuccu

SEQ ID NO: 241062 - RNA, 22 nt, Human
guauggaguuuuguugcacuuc

SEQ ID NO: 241063 - RNA, 22 nt, Human
uaagauuuuuacaaauagagug

SEQ ID NO: 241064 - RNA, 22 nt, Human
uaagauggaagaaaaggcggau

SEQ ID NO: 241065 - RNA, 22 nt, Human
uaaguaauugugguuuuugcca

SEQ ID NO: 241066 - RNA, 22 nt, Human
gucaucugagggacgagauuuc

SEQ ID NO: 241067 - RNA, 22 nt, Human
gucagugcuuuaguucaggaug

SEQ ID NO: 241068 - RNA, 22 nt, Human
uaagucaagagcuagaaaaagc

SEQ ID NO: 241069 - RNA, 22 nt, Human
uaauaucuuuacacauuuucaa

SEQ ID NO: 241070 - RNA, 22 nt, Human
uaauccaaaccaggaauucccu

SEQ ID NO: 241071 - RNA, 22 nt, Human
uaauauaacugccaguuaaggu

SEQ ID NO: 241072 - RNA, 23 nt, Human
gucauuacuguuaccuuauucuu

SEQ ID NO: 241073 - RNA, 22 nt, Human
uaagugguagaaagagaaaggu

SEQ ID NO: 241074 - RNA, 22 nt, Human
gucaugaugauacagguggagg

SEQ ID NO: 241075 - RNA, 22 nt, Human
guccuuaaauacgaugaacaug

SEQ ID NO: 241076 - RNA, 22 nt, Human
uaauuuagugcauuuccuagua

SEQ ID NO: 241077 - RNA, 22 nt, Human
uaauuauuaauuuuagguugcu

SEQ ID NO: 241078 - RNA, 22 nt, Human
uaauucuacagggaacucugga

SEQ ID NO: 241079 - RNA, 22 nt, Human
gugacuaugguggagaucagua

SEQ ID NO: 241080 - RNA, 22 nt, Human
gugacugagcuggcaaaguaug

SEQ ID NO: 241081 - RNA, 20 nt, Human
gugaaguuuucugaagacag

SEQ ID NO: 241082 - RNA, 22 nt, Human
uacuuuuuucacuucuagcccc

SEQ ID NO: 241083 - RNA, 22 nt, Human
uacuuuggugaaauuggaaaua

SEQ ID NO: 241084 - RNA, 22 nt, Human
uacuugcaaggcucuuggaaua

SEQ ID NO: 241085 - RNA, 22 nt, Human
uacuugaacaucacuaagagaa

SEQ ID NO: 241086 - RNA, 22 nt, Human
uacuugucuuuauuuuaaugcu

SEQ ID NO: 241087 - RNA, 22 nt, Human
uaccuuuuuauucuuaaggccg

SEQ ID NO: 241088 - RNA, 22 nt, Human
uacguuuuauaucuuuuggaau

SEQ ID NO: 241089 - RNA, 22 nt, Human
uacugggugagcugggcuggga

SEQ ID NO: 241090 - RNA, 22 nt, Human
gugaaauuguacacucaguacc

SEQ ID NO: 241091 - RNA, 22 nt, Human
uacuucuuuuguaaaguauuga

SEQ ID NO: 241092 - RNA, 22 nt, Human
uacuucauucaaguucgcuaua

SEQ ID NO: 241093 - RNA, 18 nt, Human
gucuguuccuuuaauguc

SEQ ID NO: 241094 - RNA, 22 nt, Human
gucuuuguaguuuuaauuugag

SEQ ID NO: 241095 - RNA, 22 nt, Human
gucuuugagccucaguuuccuc

SEQ ID NO: 241096 - RNA, 22 nt, Human
uacaaaauucaaauaauguuug

SEQ ID NO: 241097 - RNA, 22 nt, Human
uaauuuugucacagugacaugc

SEQ ID NO: 241098 - RNA, 22 nt, Human
gucugguggaguuguauauacu

SEQ ID NO: 241099 - RNA, 22 nt, Human
gucgagaacauucauuaugcaa

SEQ ID NO: 241100 - RNA, 22 nt, Human
uaaaguguacaagucauaagua

SEQ ID NO: 241101 - RNA, 22 nt, Human
uaaauaugcaugugguauucau

SEQ ID NO: 241102 - RNA, 22 nt, Human
guaagaauauacccaggaguca

SEQ ID NO: 241103 - RNA, 22 nt, Human
guaacuuuuuccucauuggcua

SEQ ID NO: 241104 - RNA, 22 nt, Human
guaaauuaugucugggucaguu

SEQ ID NO: 241105 - RNA, 22 nt, Human
guaauugcucauauggcaccug

SEQ ID NO: 241106 - RNA, 22 nt, Human
guacauauccuuuacguuuugu

SEQ ID NO: 241107 - RNA, 22 nt, Human
uaaauuagauucccagcgcuau

SEQ ID NO: 241108 - RNA, 22 nt, Human
guacuaguuaaaaauagaauua

SEQ ID NO: 241109 - RNA, 22 nt, Human
guaagguuggaugcaaucaacu

SEQ ID NO: 241110 - RNA, 22 nt, Human
guacauauggcacaugcuauuu

SEQ ID NO: 241111 - RNA, 22 nt, Human
uaaagugaaguucagaauggcu

SEQ ID NO: 241112 - RNA, 22 nt, Human
gguuugauauguuugugauucu

SEQ ID NO: 241113 - RNA, 22 nt, Human
uaaaaucaugacagauugacau

SEQ ID NO: 241114 - RNA, 22 nt, Human
uaaaguauucaaguagcuuucu

SEQ ID NO: 241115 - RNA, 22 nt, Human
uaaacgaagcuucaugcuugaa

SEQ ID NO: 241116 - RNA, 22 nt, Human
gguguggguguuaguuugcuua

SEQ ID NO: 241117 - RNA, 22 nt, Human
ggugugggcagaugcccuacuu

SEQ ID NO: 241118 - RNA, 22 nt, Human
gguguauucuccaguuuuagca

SEQ ID NO: 241119 - RNA, 22 nt, Human
gguugaagcuacuuucuggaug

SEQ ID NO: 241120 - RNA, 21 nt, Human
uaaaagaugacaagacagcuc

SEQ ID NO: 241121 - RNA, 22 nt, Human
uaaaaccauucauugaccuaug

SEQ ID NO: 241122 - RNA, 22 nt, Human
uaaaacuaugcaaccuacuacc

SEQ ID NO: 241123 - RNA, 22 nt, Human
uaaaaauuagauauguauuuag

SEQ ID NO: 241124 - RNA, 23 nt, Human
guuuuugcugcagcugaagaagg

SEQ ID NO: 241125 - RNA, 22 nt, Human
guuuguguauauguguauuuuu

SEQ ID NO: 241126 - RNA, 22 nt, Human
gguguaaucacaagcuggaauu

SEQ ID NO: 241127 - RNA, 22 nt, Human
ggucaucacugagagcagaucc

SEQ ID NO: 241128 - RNA, 22 nt, Human
guuguuuucagcccagcauuag

SEQ ID NO: 241129 - RNA, 22 nt, Human
guuguuagccucacauuuagga

SEQ ID NO: 241130 - RNA, 22 nt, Human
guuguuaagugcugguuguuag

SEQ ID NO: 241131 - RNA, 22 nt, Human
guuggaaauaucagucacguga

SEQ ID NO: 241132 - RNA, 22 nt, Human
gugcuugaguaaaaauagucuu

SEQ ID NO: 241133 - RNA, 22 nt, Human
guugggcugaagugugugcuua

SEQ ID NO: 241134 - RNA, 22 nt, Human
guugggaauucggagagaaaua

SEQ ID NO: 241135 - RNA, 22 nt, Human
guuuaagcagauugcuguggug

SEQ ID NO: 241136 - RNA, 22 nt, Human
guuuagauguagauucucuggu

SEQ ID NO: 241137 - RNA, 22 nt, Human
guuuaucagagagcagaggugg

SEQ ID NO: 241138 - RNA, 22 nt, Human
guuuauuucuuaucaucacuau

SEQ ID NO: 241139 - RNA, 22 nt, Human
guuuauucuuuuauuugugaga

SEQ ID NO: 241140 - RNA, 22 nt, Human
guuguuuuuguuaaaacaguga

SEQ ID NO: 241141 - RNA, 22 nt, Human
ggucucugggacguuggaucgc

SEQ ID NO: 241142 - RNA, 22 nt, Human
ggugaucucagucuagaugguu

SEQ ID NO: 241143 - RNA, 22 nt, Human
guuucuguguugauugugcccu

SEQ ID NO: 241144 - RNA, 22 nt, Human
guuucuguggacucugcuuagg

SEQ ID NO: 241145 - RNA, 22 nt, Human
guuuccuuuugugguuuuucua

SEQ ID NO: 241146 - RNA, 22 nt, Human
ggugauaaaaagcauuuaaauu

SEQ ID NO: 241147 - RNA, 22 nt, Human
ggugacauuggagagacaggug

SEQ ID NO: 241148 - RNA, 22 nt, Human
gucuauuuauagacagauccua

SEQ ID NO: 241149 - RNA, 23 nt, Human
gucucacaaccaccugagaaaau

SEQ ID NO: 241150 - RNA, 22 nt, Human
ggcugggaggcggaggcugaga

SEQ ID NO: 241151 - RNA, 22 nt, Human
guccuuuauuugaacaugacau

SEQ ID NO: 241152 - RNA, 19 nt, Human
guccaaauggaaccccuug

SEQ ID NO: 241153 - RNA, 22 nt, Human
ggcuauuguuuuaaaaaaugag

SEQ ID NO: 241154 - RNA, 22 nt, Human
guauuaugaaugccgaggcggc

SEQ ID NO: 241155 - RNA, 22 nt, Human
guauuauauaaccauugguucu

SEQ ID NO: 241156 - RNA, 22 nt, Human
guauuggcaguauacauagcac

SEQ ID NO: 241157 - RNA, 22 nt, Human
guauuugcaaucacaaacaaaa

SEQ ID NO: 241158 - RNA, 22 nt, Human
guauuugacaccagugaauggu

SEQ ID NO: 241159 - RNA, 22 nt, Human
gucaaugcuuaguuugccugaa

SEQ ID NO: 241160 - RNA, 22 nt, Human
gucacuuuuaagggccuuuucu

SEQ ID NO: 241161 - RNA, 22 nt, Human
guauaaagaugccauacuuacu

SEQ ID NO: 241162 - RNA, 22 nt, Human
guauaaauaucuauauuguuac

SEQ ID NO: 241163 - RNA, 22 nt, Human
gguuucuuuccucucugugccu

SEQ ID NO: 241164 - RNA, 22 nt, Human
gguuuauucccacaaaggaagu

SEQ ID NO: 241165 - RNA, 22 nt, Human
gguuuucacgauccucccuuuu

SEQ ID NO: 241166 - RNA, 21 nt, Human
guaucuuucuuuuaaaauauc

SEQ ID NO: 241167 - RNA, 22 nt, Human
gugaugaaggccugcaccuggu

SEQ ID NO: 241168 - RNA, 22 nt, Human
gugaugugugaaggucugcagg

SEQ ID NO: 241169 - RNA, 22 nt, Human
gugauggucgagcgcuuguugu

SEQ ID NO: 241170 - RNA, 22 nt, Human
gugauucaucuggggccuuauu

SEQ ID NO: 241171 - RNA, 22 nt, Human
gugauuucaaauauagagugag

SEQ ID NO: 241172 - RNA, 22 nt, Human
gugcauauguguguauacaaac

SEQ ID NO: 241173 - RNA, 22 nt, Human
gugccgcuggagcuggaauuga

SEQ ID NO: 241174 - RNA, 22 nt, Human
gugcugcaugagcaucacguag

SEQ ID NO: 241175 - RNA, 22 nt, Human
gugaaggcaugugugcugugcu

SEQ ID NO: 241176 - RNA, 22 nt, Human
gugaagcacaugggcguugggu

SEQ ID NO: 241177 - RNA, 22 nt, Human
gugauauaacaauuuagggaau

SEQ ID NO: 241178 - RNA, 22 nt, Human
gugaaaugaagugacuggauau

SEQ ID NO: 241179 - RNA, 22 nt, Human
gugaaaauaguaaccuggcuag

SEQ ID NO: 241180 - RNA, 21 nt, Human
ggcuguuaauagugauuagaa

SEQ ID NO: 241181 - RNA, 22 nt, Human
gugaaaaauggccaucaggaca

SEQ ID NO: 241182 - RNA, 22 nt, Human
gggaaaaaggaguuagagauaa

SEQ ID NO: 241183 - RNA, 22 nt, Human
gcuguugcaaucaaggccaugg

SEQ ID NO: 241184 - RNA, 22 nt, Human
gcuguguucauccugcccaggu

SEQ ID NO: 241185 - RNA, 22 nt, Human
gggaaaaaggaaccuuauuacu

SEQ ID NO: 241186 - RNA, 22 nt, Human
ggcuuuuguuauaaucaggccu

SEQ ID NO: 241187 - RNA, 20 nt, Human
ggcauuuuuuaguugagcuu

SEQ ID NO: 241188 - RNA, 22 nt, Human
gggaagugagcuggaaucaagg

SEQ ID NO: 241189 - RNA, 22 nt, Human
gcuuauugcuuauagauaggaa

SEQ ID NO: 241190 - RNA, 22 nt, Human
gcuuaugauguuuacauaaaag

SEQ ID NO: 241191 - RNA, 22 nt, Human
gcuucucauguuuauuuuuaca

SEQ ID NO: 241192 - RNA, 22 nt, Human
ggaaguuaguucuuggcaaagg

SEQ ID NO: 241193 - RNA, 22 nt, Human
ggaagcugucugcccggcgcuc

SEQ ID NO: 241194 - RNA, 22 nt, Human
ggaauauaaaucagaugcuccg

SEQ ID NO: 241195 - RNA, 22 nt, Human
ggaaguuugagcaucuguuucc

SEQ ID NO: 241196 - RNA, 22 nt, Human
ggaagaagagggagcuguggga

SEQ ID NO: 241197 - RNA, 17 nt, Human
ggaagaaaaggaucauc

SEQ ID NO: 241198 - RNA, 22 nt, Human
gggagauuuguguaggaaaacu

SEQ ID NO: 241199 - RNA, 19 nt, Human
gggagaaaaucuuuauccu

SEQ ID NO: 241200 - RNA, 22 nt, Human
gcuuuugcaaagcuggagaauu

SEQ ID NO: 241201 - RNA, 22 nt, Human
ggguuuuaccagauguguggug

SEQ ID NO: 241202 - RNA, 22 nt, Human
gguaacagaagagcacuuggca

SEQ ID NO: 241203 - RNA, 22 nt, Human
ggaugaguuguauauaggauuc

SEQ ID NO: 241204 - RNA, 22 nt, Human
ggaguguaagugacucaccugg

SEQ ID NO: 241205 - RNA, 22 nt, Human
gggugcuuaagcuuguuuguaa

SEQ ID NO: 241206 - RNA, 22 nt, Human
ggagaugaaugugguaaaacug

SEQ ID NO: 241207 - RNA, 22 nt, Human
ggaugauuuucaguuguguggg

SEQ ID NO: 241208 - RNA, 22 nt, Human
ggucaaucaugggucauugucu

SEQ ID NO: 241209 - RNA, 22 nt, Human
ggcagaaaacaauaaccauuuc

SEQ ID NO: 241210 - RNA, 22 nt, Human
ggcacacugaaguuugagaacc

SEQ ID NO: 241211 - RNA, 22 nt, Human
gguguuaaccagcuaaaguuug

SEQ ID NO: 241212 - RNA, 19 nt, Human
gguuaccagugugucuggc

SEQ ID NO: 241213 - RNA, 22 nt, Human
gguuauuucugauuauaugaua

SEQ ID NO: 241214 - RNA, 22 nt, Human
ggugaguaguggaaaugaauga

SEQ ID NO: 241215 - RNA, 20 nt, Human
ggcaucugacaacuaguugc

SEQ ID NO: 241216 - RNA, 21 nt, Human
ggcauguagccagcaaaggua

SEQ ID NO: 241217 - RNA, 22 nt, Human
ggcauggugggggaggacuugg

SEQ ID NO: 241218 - RNA, 22 nt, Human
gaugucuauguccagggccauc

SEQ ID NO: 241219 - RNA, 22 nt, Human
gauguuaauauguuucaccaaa

SEQ ID NO: 241220 - RNA, 22 nt, Human
gccccaaccccuccuuggucua

SEQ ID NO: 241221 - RNA, 22 nt, Human
gaugaagaaacucaaccaagaa

SEQ ID NO: 241222 - RNA, 22 nt, Human
gccaggcagcagcgaggauggu

SEQ ID NO: 241223 - RNA, 22 nt, Human
gaugcauccuuucugucuucuc

SEQ ID NO: 241224 - RNA, 22 nt, Human
gaguugauggccauugaguuga

SEQ ID NO: 241225 - RNA, 23 nt, Human
gcaucgcaggucuaagauuagcu

SEQ ID NO: 241226 - RNA, 22 nt, Human
gcaucuguuguguuaauuuaca

SEQ ID NO: 241227 - RNA, 22 nt, Human
gaguuauuuuuccuguuuuuua

SEQ ID NO: 241228 - RNA, 22 nt, Human
gaguucaaagaucuaggaagag

SEQ ID NO: 241229 - RNA, 22 nt, Human
gaguuaaauagcuuaggauuca

SEQ ID NO: 241230 - RNA, 22 nt, Human
gaguauuuaccacuaaaugguu

SEQ ID NO: 241231 - RNA, 22 nt, Human
gaguauuagaagaguaguuauu

SEQ ID NO: 241232 - RNA, 22 nt, Human
gcaguuguagcuguuucuacuc

SEQ ID NO: 241233 - RNA, 22 nt, Human
gcaguuaccuauuuuguagaaa

SEQ ID NO: 241234 - RNA, 22 nt, Human
gcauaacaacagacucuguguu

SEQ ID NO: 241235 - RNA, 22 nt, Human
gcauaauauugagaaauuauua

SEQ ID NO: 241236 - RNA, 22 nt, Human
gcagucauggguagaacucaag

SEQ ID NO: 241237 - RNA, 22 nt, Human
gcaguaaauugagagucauguu

SEQ ID NO: 241238 - RNA, 22 nt, Human
gaguaugugaggaaguaaagaa

SEQ ID NO: 241239 - RNA, 22 nt, Human
gaguaaaagaugaggcaguaga

SEQ ID NO: 241240 - RNA, 22 nt, Human
gaguaauuuucuuaaaacauca

SEQ ID NO: 241241 - RNA, 18 nt, Human
gaugaagaggaagaggag

SEQ ID NO: 241242 - RNA, 22 nt, Human
gagaauuauacaugagcuauuu

SEQ ID NO: 241243 - RNA, 22 nt, Human
gauuaagugaauuggagaaaag

SEQ ID NO: 241244 - RNA, 22 nt, Human
gauuaagaaagauagaugugga

SEQ ID NO: 241245 - RNA, 22 nt, Human
gauuuugcuuuagugaaggaag

SEQ ID NO: 241246 - RNA, 22 nt, Human
gccucuuugcucuuugguuguu

SEQ ID NO: 241247 - RNA, 22 nt, Human
gcaccauagagaagagacacaa

SEQ ID NO: 241248 - RNA, 22 nt, Human
gcacauaugcuguaagcacaug

SEQ ID NO: 241249 - RNA, 22 nt, Human
gcaauagccuacaugcgucaga

SEQ ID NO: 241250 - RNA, 20 nt, Human
gcgcaguuccgggcgcgucu

SEQ ID NO: 241251 - RNA, 22 nt, Human
gcgcagugagguuaagaaugca

SEQ ID NO: 241252 - RNA, 22 nt, Human
gcagaguauaaguguggagcug

SEQ ID NO: 241253 - RNA, 21 nt, Human
gcagaguauagauuaggagcc

SEQ ID NO: 241254 - RNA, 22 nt, Human
gcagauaaaauuuuugauggga

SEQ ID NO: 241255 - RNA, 22 nt, Human
gccugcugggcucuuccugcug

SEQ ID NO: 241256 - RNA, 22 nt, Human
gcagcuuuggagguggaacucu

SEQ ID NO: 241257 - RNA, 22 nt, Human
gcaggacuucuguuuaaccagu

SEQ ID NO: 241258 - RNA, 22 nt, Human
gcagguuguuuaaauuaggauu

SEQ ID NO: 241259 - RNA, 22 nt, Human
gcaguauuguguguggucaugg

SEQ ID NO: 241260 - RNA, 18 nt, Human
gcugaaauucuaaacaaa

SEQ ID NO: 241261 - RNA, 22 nt, Human
gcucgauugucaguguuaggga

SEQ ID NO: 241262 - RNA, 22 nt, Human
gcaugaauggaacccccugagu

SEQ ID NO: 241263 - RNA, 22 nt, Human
gcauaguuuucauagguguuuu

SEQ ID NO: 241264 - RNA, 22 nt, Human
gcauauuuuaaaguguaaccug

SEQ ID NO: 241265 - RNA, 22 nt, Human
gcauagauauguaaugcaucau

SEQ ID NO: 241266 - RNA, 22 nt, Human
gcuagauugucacuugaguguc

SEQ ID NO: 241267 - RNA, 22 nt, Human
gcuaguaagugauagagcugag

SEQ ID NO: 241268 - RNA, 22 nt, Human
gcuagaaacuguuuaaucucuu

SEQ ID NO: 241269 - RNA, 22 nt, Human
gcuuguauguguauauauacau

SEQ ID NO: 241270 - RNA, 22 nt, Human
gcuuguuagcaaugcagaaucu

SEQ ID NO: 241271 - RNA, 22 nt, Human
gcuuucagggucacugucaaca

SEQ ID NO: 241272 - RNA, 22 nt, Human
gcuuucacugcaauagaugaau

SEQ ID NO: 241273 - RNA, 22 nt, Human
gcuugcaucaggggcuggggcc

SEQ ID NO: 241274 - RNA, 22 nt, Human
gcuuuucaaguuacaauuagcu

SEQ ID NO: 241275 - RNA, 22 nt, Human
gcuuuuaaauuaucugacaaug

SEQ ID NO: 241276 - RNA, 22 nt, Human
gcuuuguugauggugagucugu

SEQ ID NO: 241277 - RNA, 22 nt, Human
ggaaaaauggguggugauauga

SEQ ID NO: 241278 - RNA, 22 nt, Human
gccugcaggaaggugugccugu

SEQ ID NO: 241279 - RNA, 22 nt, Human
ggaaauauaagcaguuugugug

SEQ ID NO: 241280 - RNA, 22 nt, Human
ggaaauguguguaagaaaguau

SEQ ID NO: 241281 - RNA, 22 nt, Human
ggaaagaggacaucuuacuucu

SEQ ID NO: 241282 - RNA, 22 nt, Human
ggaaagagaaacaugaacuaga

SEQ ID NO: 241283 - RNA, 22 nt, Human
gcuuagaugcugucauucacca

SEQ ID NO: 241284 - RNA, 22 nt, Human
gcuuauuagguuauuucaagga

SEQ ID NO: 241285 - RNA, 22 nt, Human
gcuguugagucagacaaguuuu

SEQ ID NO: 241286 - RNA, 22 nt, Human
gcuguuggaggaguucagugcu

SEQ ID NO: 241287 - RNA, 22 nt, Human
gcuguuuaaguggaauuuguuu

SEQ ID NO: 241288 - RNA, 21 nt, Human
gcuguagauucacaaagaggu

SEQ ID NO: 241289 - RNA, 22 nt, Human
gcugucauggacaugucuguuu

SEQ ID NO: 241290 - RNA, 22 nt, Human
gcccuagaguugagagcaccca

SEQ ID NO: 241291 - RNA, 22 nt, Human
gcccgccaacuugccagcggug

SEQ ID NO: 241292 - RNA, 22 nt, Human
gcauggaaaagggaugcuaacu

SEQ ID NO: 241293 - RNA, 23 nt, Human
gcugagcaccagccauaucuuuu

SEQ ID NO: 241294 - RNA, 22 nt, Human
ggcaugcaaaugugggugaccu

SEQ ID NO: 241295 - RNA, 22 nt, Human
gcuagcugugcuuggaaguuug

SEQ ID NO: 241296 - RNA, 22 nt, Human
gcgugcauggccguguguaugc

SEQ ID NO: 241297 - RNA, 22 nt, Human
ggcaauuacguauuagucaugu

SEQ ID NO: 241298 - RNA, 22 nt, Human
ggauaauugaugauuuauaaga

SEQ ID NO: 241299 - RNA, 20 nt, Human
gcgcuucccuacgcucugcu

SEQ ID NO: 241300 - RNA, 19 nt, Human
ggacuuaggcagacuaauu

SEQ ID NO: 241301 - RNA, 22 nt, Human
ggacauagaucuagacuuuaaa

SEQ ID NO: 241302 - RNA, 22 nt, Human
ggagaagaggagcuggaagccu

SEQ ID NO: 241303 - RNA, 22 nt, Human
ggacuuuggauuuuauucuaaa

SEQ ID NO: 241304 - RNA, 22 nt, Human
ggacuuggcagugucaaauuua

SEQ ID NO: 241305 - RNA, 22 nt, Human
ggaauuauuuuaaauagacauu

SEQ ID NO: 241306 - RNA, 22 nt, Human
ggaauuaagaggcuggacaggg

SEQ ID NO: 241307 - RNA, 22 nt, Human
uuuuuuaaucaaguaggaaaca

SEQ ID NO: 241308 - RNA, 22 nt, Human
ugcacacaguucucaggaaaga

SEQ ID NO: 241309 - RNA, 22 nt, Human
ucuuuuucccugguuccuuuuu

SEQ ID NO: 241310 - RNA, 22 nt, Human
aaaucuuucacauauuuuuuau

SEQ ID NO: 241311 - RNA, 22 nt, Human
ggcaaggaagaaagcagaaguu

SEQ ID NO: 241312 - RNA, 21 nt, Human
gggagaguagcgguagggagg

SEQ ID NO: 241313 - RNA, 22 nt, Human
ucagagccagacacacagcaga

SEQ ID NO: 241314 - RNA, 22 nt, Human
aggaagaagggacagaauuuug

SEQ ID NO: 241315 - RNA, 22 nt, Human
uccucagcaagacgcuggcagc

SEQ ID NO: 241316 - RNA, 22 nt, Human
ucugagugacguccugacagga

SEQ ID NO: 241317 - RNA, 22 nt, Human
ggaagcugucugcccggcgcuc

SEQ ID NO: 241318 - RNA, 22 nt, Human
auauuuuugcagaauuuuucgu

SEQ ID NO: 241319 - RNA, 20 nt, Human
gggaauggauggauugcucc

SEQ ID NO: 241320 - RNA, 22 nt, Human
uggaggcccagcugggggccgg

SEQ ID NO: 241321 - RNA, 22 nt, Human
caucuaaaauaagccuuauaau

SEQ ID NO: 241322 - RNA, 22 nt, Human
uuucuacauuuguaaccagauu

SEQ ID NO: 241323 - RNA, 22 nt, Human
uguaaauucuauacacuuaaaa

SEQ ID NO: 241324 - RNA, 22 nt, Human
cggcccggccucgcggcgcaug

SEQ ID NO: 241325 - RNA, 23 nt, Human
gaugauggcaacuacauccggug

SEQ ID NO: 241326 - RNA, 22 nt, Human
gcuguguaugaugcaggcaccu

SEQ ID NO: 241327 - RNA, 22 nt, Human
uggcucacaggaggcagaggug

SEQ ID NO: 241328 - RNA, 22 nt, Human
uguuuccuaagugucucugaag

SEQ ID NO: 241329 - RNA, 22 nt, Human
acuuguaaaauagagauaggga

SEQ ID NO: 241330 - RNA, 22 nt, Human
caagggcagaggcagggccccg

SEQ ID NO: 241331 - RNA, 22 nt, Human
uaguauuuguaauuaucaaagc

SEQ ID NO: 241332 - RNA, 22 nt, Human
ucggcuccucccuggaaagggg

SEQ ID NO: 241333 - RNA, 22 nt, Human
caacuucuauucagucugcagu

SEQ ID NO: 241334 - RNA, 22 nt, Human
uacagauaaaaaugcuguucuu

SEQ ID NO: 241335 - RNA, 22 nt, Human
ccaaggcuguggggcugugcag

SEQ ID NO: 241336 - RNA, 20 nt, Human
ucagugggaaagugagagug

SEQ ID NO: 241337 - RNA, 22 nt, Human
uggaugagugaauggauaaauc

SEQ ID NO: 241338 - RNA, 22 nt, Human
cagaccuggaaaacaggcuugc

SEQ ID NO: 241339 - RNA, 22 nt, Human
cuuacaauuuucuuggacuuuu

SEQ ID NO: 241340 - RNA, 19 nt, Human
ugcagcuguaugagcuuaa

SEQ ID NO: 241341 - RNA, 20 nt, Human
cagagccaggguuuuguuuu

SEQ ID NO: 241342 - RNA, 22 nt, Human
cuggggccccagcucggccccu

SEQ ID NO: 241343 - RNA, 22 nt, Human
gcggcccggguccccagcagca

SEQ ID NO: 241344 - RNA, 22 nt, Human
ucccaaaacuugaagcaagccu

SEQ ID NO: 241345 - RNA, 20 nt, Human
uucacagaucucuaacugag

SEQ ID NO: 241346 - RNA, 22 nt, Human
agggacuugugucuguguuuuu

SEQ ID NO: 241347 - RNA, 22 nt, Human
aaugcugaaugcauguuuccau

SEQ ID NO: 241348 - RNA, 22 nt, Human
aaaguaaagccuauuuaauaau

SEQ ID NO: 241349 - RNA, 22 nt, Human
cugggaccugugugccugggcc

SEQ ID NO: 241350 - RNA, 22 nt, Human
ugccagcuccgaggagcugcag

SEQ ID NO: 241351 - RNA, 22 nt, Human
uaguuucuaauguugaaauuau

SEQ ID NO: 241352 - RNA, 22 nt, Human
gcugcgcgcagccggcgccgag

SEQ ID NO: 241353 - RNA, 22 nt, Human
gucacuuugcuugcgaugcucc

SEQ ID NO: 241354 - RNA, 22 nt, Human
agaugaugugugucuucagcua

SEQ ID NO: 241355 - RNA, 22 nt, Human
cucuuucauucuguccuuguuu

SEQ ID NO: 241356 - RNA, 19 nt, Human
agcaucuccacagaaaaag

SEQ ID NO: 241357 - RNA, 22 nt, Human
cagcucugcugggaggaugcag

SEQ ID NO: 241358 - RNA, 22 nt, Human
cuggccagccucccagguaccc

SEQ ID NO: 241359 - RNA, 22 nt, Human
gccaguggucagugggagggug

SEQ ID NO: 241360 - RNA, 22 nt, Human
acuuuaaauaucauuugguagg

SEQ ID NO: 241361 - RNA, 22 nt, Human
uaauuuagugcauuuccuagua

SEQ ID NO: 241362 - RNA, 22 nt, Human
agcagggagacagugcagcauu

SEQ ID NO: 241363 - RNA, 22 nt, Human
aaucauaacaaaagcaauuaua

SEQ ID NO: 241364 - RNA, 22 nt, Human
ggcagagcugugcgcccaccca

SEQ ID NO: 241365 - RNA, 22 nt, Human
aagugaggagaccucuucuuca

SEQ ID NO: 241366 - RNA, 22 nt, Human
uaauauauuuuuuaagggaugu

SEQ ID NO: 241367 - RNA, 22 nt, Human
agugccuggcugauggguccug

SEQ ID NO: 241368 - RNA, 18 nt, Human
ggccucagccuggccgga

SEQ ID NO: 241369 - RNA, 23 nt, Human
aggcagcaugcaacaggccauuu

SEQ ID NO: 241370 - RNA, 18 nt, Human
uuuccucauuugcagacu

SEQ ID NO: 241371 - RNA, 22 nt, Human
auguguguaugacugaaucuau

SEQ ID NO: 241372 - RNA, 22 nt, Human
guuauuguuauugcguugucga

SEQ ID NO: 241373 - RNA, 22 nt, Human
uacaaaugaucaucucuuugaa

SEQ ID NO: 241374 - RNA, 22 nt, Human
uuaaaauuguuaacuuugguga

SEQ ID NO: 241375 - RNA, 22 nt, Human
gcuuucagggucacugucaaca

SEQ ID NO: 241376 - RNA, 22 nt, Human
aggcucagcaucugauucauau

SEQ ID NO: 241377 - RNA, 22 nt, Human
auagaugacaguuaggaagcug

SEQ ID NO: 241378 - RNA, 22 nt, Human
caauccccaggucccagaacag

SEQ ID NO: 241379 - RNA, 22 nt, Human
aagaggcuacagcccugugucu

SEQ ID NO: 241380 - RNA, 22 nt, Human
ugugggcguggguuggggaggg

SEQ ID NO: 241381 - RNA, 20 nt, Human
uaguggaccuugaaggccuc

SEQ ID NO: 241382 - RNA, 22 nt, Human
ucuccaggaaagacacuggacu

SEQ ID NO: 241383 - RNA, 22 nt, Human
uggaaguggcaggggagacgua

SEQ ID NO: 241384 - RNA, 22 nt, Human
acucugcaguaaggaauuguuu

SEQ ID NO: 241385 - RNA, 22 nt, Human
augcuuucucuucuauuucuca

SEQ ID NO: 241386 - RNA, 22 nt, Human
ggggaggguuuggaugagaguc

SEQ ID NO: 241387 - RNA, 22 nt, Human
gggcaggggcagugguggcauu

SEQ ID NO: 241388 - RNA, 22 nt, Human
aaaucauagccaugaacauuug

SEQ ID NO: 241389 - RNA, 22 nt, Human
cagcuccaucuugcuuauacca

SEQ ID NO: 241390 - RNA, 21 nt, Human
uaagaacauuaucuucuuccu

SEQ ID NO: 241391 - RNA, 22 nt, Human
gugacugagcuggcaaaguaug

SEQ ID NO: 241392 - RNA, 22 nt, Human
caaggaaaacagaugaucaaca

SEQ ID NO: 241393 - RNA, 22 nt, Human
uguagcucaaggaauuguucuc

SEQ ID NO: 241394 - RNA, 19 nt, Human
uucuuuccccaccccuacc

SEQ ID NO: 241395 - RNA, 22 nt, Human
cuucuuuucuacuggccuagaa

SEQ ID NO: 241396 - RNA, 19 nt, Human
caggucuucuuggaggacu

SEQ ID NO: 241397 - RNA, 20 nt, Human
ucacuguaauugccuacauu

SEQ ID NO: 241398 - RNA, 22 nt, Human
uauguggcaggugggagaucag

SEQ ID NO: 241399 - RNA, 22 nt, Human
uggcucuucucaagcauuggcu

SEQ ID NO: 241400 - RNA, 22 nt, Human
uggaagggagcuggaauuugga

SEQ ID NO: 241401 - RNA, 22 nt, Human
uuuccuaggaaaugauugaagu

SEQ ID NO: 241402 - RNA, 22 nt, Human
ccuggggcucugcacagagcag

SEQ ID NO: 241403 - RNA, 22 nt, Human
aggccagggacaaugaggcaga

SEQ ID NO: 241404 - RNA, 22 nt, Human
gggcaagaagcuggaagcauuc

SEQ ID NO: 241405 - RNA, 22 nt, Human
gcugcuacagagcuggaggggg

SEQ ID NO: 241406 - RNA, 22 nt, Human
ggaaguggauucagggcugcua

SEQ ID NO: 241407 - RNA, 22 nt, Human
uguugaagcaccucugucuuuc

SEQ ID NO: 241408 - RNA, 22 nt, Human
cuuucuuucaaguucugcuuua

SEQ ID NO: 241409 - RNA, 18 nt, Human
uucaggcucuugcaugaa

SEQ ID NO: 241410 - RNA, 21 nt, Human
ggcugcucgugaugaacuuca

SEQ ID NO: 241411 - RNA, 19 nt, Human
uuacaugacauaugaagga

SEQ ID NO: 241412 - RNA, 22 nt, Human
ugcuuucagauaucuguuucaa

SEQ ID NO: 241413 - RNA, 17 nt, Human
agcagcuggguugaucu

SEQ ID NO: 241414 - RNA, 22 nt, Human
ggcuagggagacagagggcaug

SEQ ID NO: 241415 - RNA, 22 nt, Human
uuagaaauguccuacuaauaug

SEQ ID NO: 241416 - RNA, 22 nt, Human
uucuauaagagaugaauacagu

SEQ ID NO: 241417 - RNA, 22 nt, Human
aggggaggggaguaucaggauu

SEQ ID NO: 241418 - RNA, 22 nt, Human
uguuggaaucuucuagucuucc

SEQ ID NO: 241419 - RNA, 22 nt, Human
caauggagccaagaggaggaaa

SEQ ID NO: 241420 - RNA, 22 nt, Human
agcucuuccuccauucuggcca

SEQ ID NO: 241421 - RNA, 22 nt, Human
aaagcgagccggcuuggaggga

SEQ ID NO: 241422 - RNA, 23 nt, Human
gugugccuuuaucuucuguacuc

SEQ ID NO: 241423 - RNA, 22 nt, Human
uggucuuuccuucauuguccag

SEQ ID NO: 241424 - RNA, 22 nt, Human
agcagcugagccccagcuguga

SEQ ID NO: 241425 - RNA, 22 nt, Human
gcagagcugucuaagucacuuc

SEQ ID NO: 241426 - RNA, 17 nt, Human
ugaggcugucucccugg

SEQ ID NO: 241427 - RNA, 22 nt, Human
acaggaaugaagaugagagagu

SEQ ID NO: 241428 - RNA, 22 nt, Human
ucuggaggucucagggcgggaa

SEQ ID NO: 241429 - RNA, 22 nt, Human
ugcuuggagaaucagucccagc

SEQ ID NO: 241430 - RNA, 22 nt, Human
agagcaucgguggaguccccac

SEQ ID NO: 241431 - RNA, 22 nt, Human
uguguuguuggggauguuuuca

SEQ ID NO: 241432 - RNA, 22 nt, Human
agcaaaauuccaaaaugcuaau

SEQ ID NO: 241433 - RNA, 22 nt, Human
uuuugcuucuaguauauuuuuu

SEQ ID NO: 241434 - RNA, 19 nt, Human
agcuccucaccucucgcgg

SEQ ID NO: 241435 - RNA, 22 nt, Human
aagcugcagacccccugucuca

SEQ ID NO: 241436 - RNA, 22 nt, Human
cagggggacuuguuagguuuua

SEQ ID NO: 241437 - RNA, 22 nt, Human
uuaaugauuaauguggacccaa

SEQ ID NO: 241438 - RNA, 22 nt, Human
uggaaauagauguaggaaauug

SEQ ID NO: 241439 - RNA, 22 nt, Human
uauaaagaccuuauccuucaua

SEQ ID NO: 241440 - RNA, 20 nt, Human
cugauagauucuuccccaga

SEQ ID NO: 241441 - RNA, 22 nt, Human
ugcagcagaauauggcugcagg

SEQ ID NO: 241442 - RNA, 22 nt, Human
cccgccggccacaccggccgcc

SEQ ID NO: 241443 - RNA, 22 nt, Human
uuaacauuguccuuagcagauu

SEQ ID NO: 241444 - RNA, 22 nt, Human
ugcuccucugcaugucugcggc

SEQ ID NO: 241445 - RNA, 23 nt, Human
ugggagcuauguuuggaaugggg

SEQ ID NO: 241446 - RNA, 22 nt, Human
ucggccggagggggcgggcgca

SEQ ID NO: 241447 - RNA, 22 nt, Human
ggcugcuauuggucuggcuugg

SEQ ID NO: 241448 - RNA, 22 nt, Human
gcucagagaugucugcugccuu

SEQ ID NO: 241449 - RNA, 22 nt, Human
cacacgagcccuggagccagca

SEQ ID NO: 241450 - RNA, 22 nt, Human
aaagcugaaacgaaaugacaac

SEQ ID NO: 241451 - RNA, 22 nt, Human
ugguggcuuuucguagguucac

SEQ ID NO: 241452 - RNA, 22 nt, Human
uauauaauacacaaauauguac

SEQ ID NO: 241453 - RNA, 20 nt, Human
uuguacuuaugugagaagga

SEQ ID NO: 241454 - RNA, 22 nt, Human
aaauguuucauucuauuuuuag

SEQ ID NO: 241455 - RNA, 22 nt, Human
ucucucugcuguccagcguuau

SEQ ID NO: 241456 - RNA, 22 nt, Human
gcgccgacccucccugccggac

SEQ ID NO: 241457 - RNA, 22 nt, Human
acuuugccuucuuacuguguug

SEQ ID NO: 241458 - RNA, 22 nt, Human
acaugugugucugugugugugu

SEQ ID NO: 241459 - RNA, 22 nt, Human
gggugcuucauaggugaugcug

SEQ ID NO: 241460 - RNA, 22 nt, Human
gcuguggaaaaugggucuccaa

SEQ ID NO: 241461 - RNA, 22 nt, Human
uauuucaugagugaauaucuag

SEQ ID NO: 241462 - RNA, 22 nt, Human
cggcgccccgcgcgggcggcuc

SEQ ID NO: 241463 - RNA, 22 nt, Human
caguggacacuuccucuacaau

SEQ ID NO: 241464 - RNA, 22 nt, Human
ugccgccgugggucccgacgcg

SEQ ID NO: 241465 - RNA, 22 nt, Human
ggcagcagaacuggcccuguau

SEQ ID NO: 241466 - RNA, 22 nt, Human
gcuucuguuaggauguggcuua

SEQ ID NO: 241467 - RNA, 23 nt, Human
uugcuuuugccccaaaagaguua

SEQ ID NO: 241468 - RNA, 22 nt, Human
uuuuccuuccugucucuuuauu

SEQ ID NO: 241469 - RNA, 19 nt, Human
ccucggggucugaagucag

SEQ ID NO: 241470 - RNA, 22 nt, Human
uaaaacuaugcaaccuacuacc

SEQ ID NO: 241471 - RNA, 22 nt, Human
auccugugggguauugcugcau

SEQ ID NO: 241472 - RNA, 23 nt, Human
ucagugaaggaacaacuaaauag

SEQ ID NO: 241473 - RNA, 22 nt, Human
aucaaaauguguagucuugauc

SEQ ID NO: 241474 - RNA, 22 nt, Human
agggcaguuaugaaugucucca

SEQ ID NO: 241475 - RNA, 22 nt, Human
cucuguguguuugugugugugu

SEQ ID NO: 241476 - RNA, 22 nt, Human
gugaucagaagaaccugccgaa

SEQ ID NO: 241477 - RNA, 22 nt, Human
aagccucaugccagauccaggu

SEQ ID NO: 241478 - RNA, 22 nt, Human
uuggaggccacagucaucuuua

SEQ ID NO: 241479 - RNA, 22 nt, Human
aggggaagagugagguuuuggu

SEQ ID NO: 241480 - RNA, 22 nt, Human
cacauuuuccagaagaaucaga

SEQ ID NO: 241481 - RNA, 17 nt, Human
uuagagcuacauguuga

SEQ ID NO: 241482 - RNA, 21 nt, Human
gcagcucaggauauagacuug

SEQ ID NO: 241483 - RNA, 22 nt, Human
gaggggaaggguguucaauggg

SEQ ID NO: 241484 - RNA, 22 nt, Human
cuccuuugagcaaaucuuugau

SEQ ID NO: 241485 - RNA, 22 nt, Human
gugaaauuguacacucaguacc

SEQ ID NO: 241486 - RNA, 22 nt, Human
uuauuuucgugugugugugugu

SEQ ID NO: 241487 - RNA, 22 nt, Human
cucagaugcacacaggugaggg

SEQ ID NO: 241488 - RNA, 22 nt, Human
uuuuuuuuacuccggacagcuc

SEQ ID NO: 241489 - RNA, 22 nt, Human
uccacaaagucuaugagaguug

SEQ ID NO: 241490 - RNA, 22 nt, Human
cugguacuggaggaguucagag

SEQ ID NO: 241491 - RNA, 18 nt, Human
aggcuggggaucacaggg

SEQ ID NO: 241492 - RNA, 22 nt, Human
ugaaagcuggcucugcagagug

SEQ ID NO: 241493 - RNA, 22 nt, Human
guugagaaucucuagcuuagga

SEQ ID NO: 241494 - RNA, 21 nt, Human
uaagcuaaacauucaguuaac

SEQ ID NO: 241495 - RNA, 22 nt, Human
cucagcgagggaaagaggccgc

SEQ ID NO: 241496 - RNA, 22 nt, Human
cguggccacaguggagcugagc

SEQ ID NO: 241497 - RNA, 22 nt, Human
uggacagugguggggaggagga

SEQ ID NO: 241498 - RNA, 22 nt, Human
guugcggaguguagcgaugcuu

SEQ ID NO: 241499 - RNA, 22 nt, Human
uacaggaggaugugcagccagg

SEQ ID NO: 241500 - RNA, 22 nt, Human
uaguuucuucaacugucccagc

SEQ ID NO: 241501 - RNA, 22 nt, Human
auggaguguggccaggcaguaa

SEQ ID NO: 241502 - RNA, 22 nt, Human
aggccaggcgccggcgcgagac

SEQ ID NO: 241503 - RNA, 22 nt, Human
uuuguuuccagccuuuugucuu

SEQ ID NO: 241504 - RNA, 22 nt, Human
cacaugugggcacagggcugca

SEQ ID NO: 241505 - RNA, 20 nt, Human
ccugggcuccaggagccccg

SEQ ID NO: 241506 - RNA, 22 nt, Human
uuuuuaagguuuguuuauauau

SEQ ID NO: 241507 - RNA, 22 nt, Human
agagacaggguuuugucguguu

SEQ ID NO: 241508 - RNA, 22 nt, Human
aagcgggcagcggccugcgcca

SEQ ID NO: 241509 - RNA, 22 nt, Human
ugagggaguguggauacaguag

SEQ ID NO: 241510 - RNA, 22 nt, Human
cagaaauuggcagagaagaccu

SEQ ID NO: 241511 - RNA, 22 nt, Human
uggcucagcgcggccuggucuu

SEQ ID NO: 241512 - RNA, 22 nt, Human
auaaaucaagggcaguauuucc

SEQ ID NO: 241513 - RNA, 22 nt, Human
aucucacuucugucauguggca

SEQ ID NO: 241514 - RNA, 22 nt, Human
ccuuuuaucgcgaagaacucca

SEQ ID NO: 241515 - RNA, 22 nt, Human
uguauaaaauggaaugucagaa

SEQ ID NO: 241516 - RNA, 22 nt, Human
ugagacucuccugugcagccuc

SEQ ID NO: 241517 - RNA, 22 nt, Human
gggggacagugugccuggugug

SEQ ID NO: 241518 - RNA, 22 nt, Human
uccaaggacuaaauucuagauu

SEQ ID NO: 241519 - RNA, 22 nt, Human
uggggcuggccaggaggagucu

SEQ ID NO: 241520 - RNA, 22 nt, Human
uugccaggggacaucuggagcc

SEQ ID NO: 241521 - RNA, 22 nt, Human
uaaggaaaugcaaauuuaagaa

SEQ ID NO: 241522 - RNA, 22 nt, Human
aggggcagccucacaauccucu

SEQ ID NO: 241523 - RNA, 22 nt, Human
gaggagcuucagaggaaucuua

SEQ ID NO: 241524 - RNA, 20 nt, Human
aggaacuggaagggaggaaa

SEQ ID NO: 241525 - RNA, 22 nt, Human
cacagcuggggaagcugaggcc

SEQ ID NO: 241526 - RNA, 22 nt, Human
acucauuuggauuuuggaguuu

SEQ ID NO: 241527 - RNA, 22 nt, Human
auaaaaauguuuuuguguggua

SEQ ID NO: 241528 - RNA, 23 nt, Human
uuugaaucauuguggggcuuuug

SEQ ID NO: 241529 - RNA, 22 nt, Human
uucuuuuaauagagauccugug

SEQ ID NO: 241530 - RNA, 22 nt, Human
aauuaaauguuugguuugagcu

SEQ ID NO: 241531 - RNA, 22 nt, Human
aagccagccaguuccagcagcu

SEQ ID NO: 241532 - RNA, 22 nt, Human
gucuuucuuuuacauauuugug

SEQ ID NO: 241533 - RNA, 23 nt, Human
caggggacaggugaccugggcuc

SEQ ID NO: 241534 - RNA, 22 nt, Human
uuuuucuccucucucuuucauu

SEQ ID NO: 241535 - RNA, 22 nt, Human
ugaguucugacugagcaugggg

SEQ ID NO: 241536 - RNA, 22 nt, Human
gcagggcucagccgcucccacc

SEQ ID NO: 241537 - RNA, 22 nt, Human
aaugaauaaauuuuaaagacag

SEQ ID NO: 241538 - RNA, 22 nt, Human
ggaagcuguugugagugcagca

SEQ ID NO: 241539 - RNA, 22 nt, Human
ugggaaggggagcuggaaagga

SEQ ID NO: 241540 - RNA, 22 nt, Human
acauauaugugcauacaacuau

SEQ ID NO: 241541 - RNA, 22 nt, Human
gaauuagguaauagaacuagua

SEQ ID NO: 241542 - RNA, 22 nt, Human
aggggaggcugggcuggggggc

SEQ ID NO: 241543 - RNA, 18 nt, Human
augcugacacaaugugga

SEQ ID NO: 241544 - RNA, 22 nt, Human
gagggcugccacguugggcgag

SEQ ID NO: 241545 - RNA, 22 nt, Human
caggccccagggacugggcgcu

SEQ ID NO: 241546 - RNA, 22 nt, Human
uugaaaauuaauagguguacaa

SEQ ID NO: 241547 - RNA, 22 nt, Human
aagagaaaaaucuuaaucuagu

SEQ ID NO: 241548 - RNA, 22 nt, Human
aggaauuugggguuacaugaug

SEQ ID NO: 241549 - RNA, 22 nt, Human
auagaaauagacaaugcaaaga

SEQ ID NO: 241550 - RNA, 22 nt, Human
ggcagcgcuuggcugcucgaca

SEQ ID NO: 241551 - RNA, 23 nt, Human
ccagcugugccuggcccaggagc

SEQ ID NO: 241552 - RNA, 22 nt, Human
uuuuaaauggcuuuuacuuuuc

SEQ ID NO: 241553 - RNA, 21 nt, Human
uguggccauuugaaaacaggg

SEQ ID NO: 241554 - RNA, 22 nt, Human
uuuauuuuccaugucucuaggu

SEQ ID NO: 241555 - RNA, 22 nt, Human
ucuguucagaagaggugaaagu

SEQ ID NO: 241556 - RNA, 22 nt, Human
gggaggaagaguaggaauuuga

SEQ ID NO: 241557 - RNA, 22 nt, Human
auuuuuuuuccugucucuuuca

SEQ ID NO: 241558 - RNA, 22 nt, Human
gcuucucacccuuacuaucucu

SEQ ID NO: 241559 - RNA, 22 nt, Human
uucacuuuuucucugcuugaga

SEQ ID NO: 241560 - RNA, 22 nt, Human
gacuggggcauuagaguagcuu

SEQ ID NO: 241561 - RNA, 22 nt, Human
gaauauuuaucucagcugcaga

SEQ ID NO: 241562 - RNA, 22 nt, Human
uguggacaccuauuaccaguga

SEQ ID NO: 241563 - RNA, 22 nt, Human
cggggcuccgaagagcucgguu

SEQ ID NO: 241564 - RNA, 22 nt, Human
aagaugaguuacaaaggaguaa

SEQ ID NO: 241565 - RNA, 22 nt, Human
augggaggguagagugaacaga

SEQ ID NO: 241566 - RNA, 22 nt, Human
uggccccauuuuucuggagccu

SEQ ID NO: 241567 - RNA, 22 nt, Human
agggaggagggacagaaagagg

SEQ ID NO: 241568 - RNA, 22 nt, Human
gagggagugggcccgugggcac

SEQ ID NO: 241569 - RNA, 22 nt, Human
aaugugcauaacuuuauaaauu

SEQ ID NO: 241570 - RNA, 22 nt, Human
ggagacuaagaaaauagagucc

SEQ ID NO: 241571 - RNA, 22 nt, Human
uuauuuuauaaagagaagacuu

SEQ ID NO: 241572 - RNA, 22 nt, Human
uuucagagaaagcccaaagacu

SEQ ID NO: 241573 - RNA, 22 nt, Human
ggaggcccagaaggaagcccag

SEQ ID NO: 241574 - RNA, 22 nt, Human
ggaggcggaaguccaagcaggu

SEQ ID NO: 241575 - RNA, 22 nt, Human
gggaugaaugccuggcuccccc

SEQ ID NO: 241576 - RNA, 22 nt, Human
ggagugaguauguucugaugca

SEQ ID NO: 241577 - RNA, 22 nt, Human
cagcccuugcgacacccuggcu

SEQ ID NO: 241578 - RNA, 22 nt, Human
agccggccucggacagagggag

SEQ ID NO: 241579 - RNA, 22 nt, Human
caggaagucugaauucugagag

SEQ ID NO: 241580 - RNA, 22 nt, Human
ggcucagaggagcuggaacggu

SEQ ID NO: 241581 - RNA, 22 nt, Human
cgcccggcugagacgcucgccc

SEQ ID NO: 241582 - RNA, 22 nt, Human
aaauucagcagguuucaaaagc

SEQ ID NO: 241583 - RNA, 22 nt, Human
gaggcaggcggggcccaggugg

SEQ ID NO: 241584 - RNA, 22 nt, Human
agaauaagucuaauauauuggu

SEQ ID NO: 241585 - RNA, 22 nt, Human
guucuucagcccucagguccua

SEQ ID NO: 241586 - RNA, 22 nt, Human
gaggggaacaggcauucuuaag

SEQ ID NO: 241587 - RNA, 22 nt, Human
agggcucacuacaacccuggga

SEQ ID NO: 241588 - RNA, 22 nt, Human
uuauaucagaaggugagauuga

SEQ ID NO: 241589 - RNA, 22 nt, Human
uagcuucccagcuaaccauguc

SEQ ID NO: 241590 - RNA, 22 nt, Human
gaugggaggaugaauuggaccu

SEQ ID NO: 241591 - RNA, 22 nt, Human
uucugcuuuaaagcucauguuu

SEQ ID NO: 241592 - RNA, 22 nt, Human
gggggcagguuccaggccagcu

SEQ ID NO: 241593 - RNA, 22 nt, Human
aagagaggcccaaguggcuggc

SEQ ID NO: 241594 - RNA, 22 nt, Human
gcucucucuucugcaggccuua

SEQ ID NO: 241595 - RNA, 22 nt, Human
gccccaggggaggugcccugca

SEQ ID NO: 241596 - RNA, 22 nt, Human
ugauucacagacuucacaaggc

SEQ ID NO: 241597 - RNA, 22 nt, Human
uaggauugguguauguagguuu

SEQ ID NO: 241598 - RNA, 22 nt, Human
uaaaugauaguauugaagguag

SEQ ID NO: 241599 - RNA, 22 nt, Human
gaaagugaauguaacauguuau

SEQ ID NO: 241600 - RNA, 22 nt, Human
auuugccaguuacucacaccac

SEQ ID NO: 241601 - RNA, 22 nt, Human
ggaaauauaagcaguuugugug

SEQ ID NO: 241602 - RNA, 22 nt, Human
aggccgagaugacagagccacu

SEQ ID NO: 241603 - RNA, 22 nt, Human
cagcccugagagaaccaucuau

SEQ ID NO: 241604 - RNA, 22 nt, Human
caagaaaaaacaugaugagugu

SEQ ID NO: 241605 - RNA, 19 nt, Human
ucagcagauuuugcaaaca

SEQ ID NO: 241606 - RNA, 22 nt, Human
gcaggcagauccagaagcacua

SEQ ID NO: 241607 - RNA, 22 nt, Human
uggaugccuugggggaggagga

SEQ ID NO: 241608 - RNA, 22 nt, Human
caaaaauacuugccuguaucug

SEQ ID NO: 241609 - RNA, 22 nt, Human
agugaaauaugcccauugcugu

SEQ ID NO: 241610 - RNA, 22 nt, Human
augcacaagguagauuauuauu

SEQ ID NO: 241611 - RNA, 22 nt, Human
ccaggcuccccaggaggcccuu

SEQ ID NO: 241612 - RNA, 22 nt, Human
cgggagcagcucuggggcuggg

SEQ ID NO: 241613 - RNA, 22 nt, Human
uggugccuuccgagagcuguga

SEQ ID NO: 241614 - RNA, 22 nt, Human
uuucauguuggauacuguuuca

SEQ ID NO: 241615 - RNA, 23 nt, Human
gucucacaaccaccugagaaaau

SEQ ID NO: 241616 - RNA, 22 nt, Human
agccccaauuacagcugugcug

SEQ ID NO: 241617 - RNA, 22 nt, Human
acuggagcccguggaggcgcag

SEQ ID NO: 241618 - RNA, 22 nt, Human
auggacagcucuuaugugggca

SEQ ID NO: 241619 - RNA, 22 nt, Human
cagauaagcuauaaguaguacc

SEQ ID NO: 241620 - RNA, 22 nt, Human
cuucuuuccauguguuuugguu

SEQ ID NO: 241621 - RNA, 22 nt, Human
aggcgagcgcggccggugcccc

SEQ ID NO: 241622 - RNA, 22 nt, Human
cuggaagcgucggaggaagggc

SEQ ID NO: 241623 - RNA, 22 nt, Human
uuuuccuugagucggggcacag

SEQ ID NO: 241624 - RNA, 22 nt, Human
caauaccucuuggugauugggc

SEQ ID NO: 241625 - RNA, 22 nt, Human
aaugcuuuuugcgaaaugugca

SEQ ID NO: 241626 - RNA, 22 nt, Human
ugggcagggagcuggaaccaca

SEQ ID NO: 241627 - RNA, 22 nt, Human
aaacaaauccaauaauaaaauu

SEQ ID NO: 241628 - RNA, 22 nt, Human
cagagacuuuugcuccgauucu

SEQ ID NO: 241629 - RNA, 22 nt, Human
agagcagauggagcuggaagag

SEQ ID NO: 241630 - RNA, 22 nt, Human
uuuaacauaugaaagaauauuu

SEQ ID NO: 241631 - RNA, 22 nt, Human
ggcagguggcacugcugcuccc

SEQ ID NO: 241632 - RNA, 22 nt, Human
ucagaaggagagacagcgugga

SEQ ID NO: 241633 - RNA, 22 nt, Human
guuguuuuuguuaaaacaguga

SEQ ID NO: 241634 - RNA, 22 nt, Human
agagaacaggcagcuggugccg

SEQ ID NO: 241635 - RNA, 22 nt, Human
agggagucuggccgucggcugg

SEQ ID NO: 241636 - RNA, 22 nt, Human
gaccaggagauuugagcuaggc

SEQ ID NO: 241637 - RNA, 22 nt, Human
acauuugauauggaguugugua

SEQ ID NO: 241638 - RNA, 22 nt, Human
cacugcacuccagccugggcaa

SEQ ID NO: 241639 - RNA, 20 nt, Human
uugauucacaaaaagcuuag

SEQ ID NO: 241640 - RNA, 22 nt, Human
uggcgcgcucgcucucgcugag

SEQ ID NO: 241641 - RNA, 22 nt, Human
agguggucccaauggcugggca

SEQ ID NO: 241642 - RNA, 22 nt, Human
aauaucuugaguuauaaauuca

SEQ ID NO: 241643 - RNA, 22 nt, Human
cuagcagaagcuccuugagggu

SEQ ID NO: 241644 - RNA, 22 nt, Human
auggauggaagcagccugaacu

SEQ ID NO: 241645 - RNA, 20 nt, Human
cuggaguguagcaguggcug

SEQ ID NO: 241646 - RNA, 22 nt, Human
ucauacuuuuuugacccuugug

SEQ ID NO: 241647 - RNA, 22 nt, Human
ugguccuuuccauuggagacac

SEQ ID NO: 241648 - RNA, 22 nt, Human
agcaggaaggcuagaagcagga

SEQ ID NO: 241649 - RNA, 22 nt, Human
guuuauuucuuaucaucacuau

SEQ ID NO: 241650 - RNA, 22 nt, Human
agggaagaggaccagagucucu

SEQ ID NO: 241651 - RNA, 21 nt, Human
uaaaagaugacaagacagcuc

SEQ ID NO: 241652 - RNA, 22 nt, Human
ccauuucacaucccugacaugu

SEQ ID NO: 241653 - RNA, 22 nt, Human
cucuggggaagugcacucgcug

SEQ ID NO: 241654 - RNA, 22 nt, Human
agggaugugcagggcuugccau

SEQ ID NO: 241655 - RNA, 22 nt, Human
uuuucaauuuucauuugcaaga

SEQ ID NO: 241656 - RNA, 22 nt, Human
gcaguccuuaggagaggaagua

SEQ ID NO: 241657 - RNA, 22 nt, Human
ccucaggaauuuauucuucugu

SEQ ID NO: 241658 - RNA, 22 nt, Human
cggugcuuuccauaucagcagc

SEQ ID NO: 241659 - RNA, 22 nt, Human
uuggaggcagagucuugcugag

SEQ ID NO: 241660 - RNA, 23 nt, Human
cuuauauaaucauuagaaaccau

SEQ ID NO: 241661 - RNA, 22 nt, Human
ugaaauuuuuuggagauaauuu

SEQ ID NO: 241662 - RNA, 22 nt, Human
uccauguauugcuaacaaauag

SEQ ID NO: 241663 - RNA, 22 nt, Human
ggggaggaagcuggaacacggg

SEQ ID NO: 241664 - RNA, 22 nt, Human
uggggggacagauggagaggac

SEQ ID NO: 241665 - RNA, 21 nt, Human
cuuugccuccagcagccgcag

SEQ ID NO: 241666 - RNA, 22 nt, Human
augcaaaaucuuauuuuuucua

SEQ ID NO: 241667 - RNA, 22 nt, Human
ugggaagaggaggcagggggca

SEQ ID NO: 241668 - RNA, 22 nt, Human
guuuauucuuuuauuugugaga

SEQ ID NO: 241669 - RNA, 22 nt, Human
uguuuuuuagagugauacuuuu

SEQ ID NO: 241670 - RNA, 22 nt, Human
gcgggcgcuguggccccggccu

SEQ ID NO: 241671 - RNA, 21 nt, Human
augcgcgguggagugagcgaa

SEQ ID NO: 241672 - RNA, 22 nt, Human
cauuuugguaauguucguuugc

SEQ ID NO: 241673 - RNA, 22 nt, Human
aaggggaauaguaggaccuggg

SEQ ID NO: 241674 - RNA, 22 nt, Human
gggcugcuccgcccgcugcgcc

SEQ ID NO: 241675 - RNA, 22 nt, Human
aauucuguugguuagaguugga

SEQ ID NO: 241676 - RNA, 22 nt, Human
agcggcaggaagcgcgcaagcg

SEQ ID NO: 241677 - RNA, 22 nt, Human
uggagagcaaugaggggcaggc

SEQ ID NO: 241678 - RNA, 22 nt, Human
gccagccggugaguggaagcgg

SEQ ID NO: 241679 - RNA, 22 nt, Human
uggcccugaaucaaggccagca

SEQ ID NO: 241680 - RNA, 22 nt, Human
uggggcauacgugaaauaauuu

SEQ ID NO: 241681 - RNA, 22 nt, Human
cauuccuucucagguacuggca

SEQ ID NO: 241682 - RNA, 22 nt, Human
agcaaggguugguuuucugaca

SEQ ID NO: 241683 - RNA, 22 nt, Human
ggcagcagaaccaacuguggcu

SEQ ID NO: 241684 - RNA, 22 nt, Human
gagcuggacauacaggaaacca

SEQ ID NO: 241685 - RNA, 20 nt, Human
cuuauuuuggagaacuuuuc

SEQ ID NO: 241686 - RNA, 20 nt, Human
gccaaggaggagaaacaggc

SEQ ID NO: 241687 - RNA, 22 nt, Human
aaagggagauaaaguaauuuua

SEQ ID NO: 241688 - RNA, 22 nt, Human
aaucacuucuuugucuucuuca

SEQ ID NO: 241689 - RNA, 22 nt, Human
uuaccuuggaccggguaucaga

SEQ ID NO: 241690 - RNA, 22 nt, Human
gugugucucaguugcuccgaag

SEQ ID NO: 241691 - RNA, 22 nt, Human
cuuuaaaaauguauuuuugugg

SEQ ID NO: 241692 - RNA, 22 nt, Human
aaauauuaaugaugaagguagu

SEQ ID NO: 241693 - RNA, 22 nt, Human
auaugcacauguacauguauau

SEQ ID NO: 241694 - RNA, 22 nt, Human
aggcaggggagcuggaagggua

SEQ ID NO: 241695 - RNA, 22 nt, Human
agauuuucuuuuccaucuuugu

SEQ ID NO: 241696 - RNA, 22 nt, Human
ggccgggcaugcgagcugagcg

SEQ ID NO: 241697 - RNA, 22 nt, Human
uuaauguugacacacuagcaca

SEQ ID NO: 241698 - RNA, 22 nt, Human
uggggagacauggaguaaaaga

SEQ ID NO: 241699 - RNA, 22 nt, Human
uuuuauaauacccuugacuaau

SEQ ID NO: 241700 - RNA, 21 nt, Human
uggcaggcagcuggaagcuug

SEQ ID NO: 241701 - RNA, 22 nt, Human
gaggcuccgccggggcgggccg

SEQ ID NO: 241702 - RNA, 22 nt, Human
uuguuuucuaguguuuugaaua

SEQ ID NO: 241703 - RNA, 22 nt, Human
gccugccucugacuggggcuga

SEQ ID NO: 241704 - RNA, 22 nt, Human
uucuucuucuuccucauccuca

SEQ ID NO: 241705 - RNA, 22 nt, Human
aaauguaaacuguauuuauaaa

SEQ ID NO: 241706 - RNA, 22 nt, Human
aaaauaaccuucauuugcauug

SEQ ID NO: 241707 - RNA, 22 nt, Human
cagcccuguugcgcuuccggcg

SEQ ID NO: 241708 - RNA, 22 nt, Human
ggcugugaaguacguugaaggu

SEQ ID NO: 241709 - RNA, 22 nt, Human
aaauucuuccaggaggaaauac

SEQ ID NO: 241710 - RNA, 22 nt, Human
gaaaagcucuuuagaagagguu

SEQ ID NO: 241711 - RNA, 21 nt, Human
auauuguugggguuuucuuuu

SEQ ID NO: 241712 - RNA, 22 nt, Human
cgaccccugaaaauggcagcca

SEQ ID NO: 241713 - RNA, 22 nt, Human
gcgcgcucugcgaggacacgcu

SEQ ID NO: 241714 - RNA, 22 nt, Human
uugaaucauauguaauugacuu

SEQ ID NO: 241715 - RNA, 22 nt, Human
ugggaagaguuagagacagcug

SEQ ID NO: 241716 - RNA, 22 nt, Human
uuauuuaaaauguagguuggga

SEQ ID NO: 241717 - RNA, 22 nt, Human
uaugaggagaacauuccugaac

SEQ ID NO: 241718 - RNA, 22 nt, Human
uauuuuagccaacagaaugaug

SEQ ID NO: 241719 - RNA, 22 nt, Human
gguuuucacgauccucccuuuu

SEQ ID NO: 241720 - RNA, 22 nt, Human
uuuuuuuaaguuuugauuuuag

SEQ ID NO: 241721 - RNA, 17 nt, Human
ucuuuuacuuucucucc

SEQ ID NO: 241722 - RNA, 22 nt, Human
uauaagaaaagucauuaucaaa

SEQ ID NO: 241723 - RNA, 22 nt, Human
aaugcuaaagaagaaggaguag

SEQ ID NO: 241724 - RNA, 22 nt, Human
cugguuuauuucauaguuuguu

SEQ ID NO: 241725 - RNA, 22 nt, Human
uugauagauuuuagaggcaggc

SEQ ID NO: 241726 - RNA, 22 nt, Human
aggaaauaagggcacuucagau

SEQ ID NO: 241727 - RNA, 22 nt, Human
aucuucuuucaucagccccuca

SEQ ID NO: 241728 - RNA, 22 nt, Human
uuuuuauaagauuuaaaaugua

SEQ ID NO: 241729 - RNA, 22 nt, Human
auguuccaugacuaugcaugaa

SEQ ID NO: 241730 - RNA, 22 nt, Human
uuauuuuuguaacacuguauag

SEQ ID NO: 241731 - RNA, 20 nt, Human
gggcucugcauccaucagcc

SEQ ID NO: 241732 - RNA, 22 nt, Human
gggcaugcagcaauucuguggu

SEQ ID NO: 241733 - RNA, 22 nt, Human
ggaggccgugcugugcugccag

SEQ ID NO: 241734 - RNA, 22 nt, Human
ggagcucacuacgaaauaagcu

SEQ ID NO: 241735 - RNA, 22 nt, Human
cagggacugcaggaggacaggu

SEQ ID NO: 241736 - RNA, 22 nt, Human
uucuccaccugcuccucccacc

SEQ ID NO: 241737 - RNA, 18 nt, Human
aguaaauguuaaauauug

SEQ ID NO: 241738 - RNA, 22 nt, Human
cuacuucucccuagaucagaaa

SEQ ID NO: 241739 - RNA, 22 nt, Human
gagaugugguucaaggguguuu

SEQ ID NO: 241740 - RNA, 22 nt, Human
gagggggaaaagggcagcagag

SEQ ID NO: 241741 - RNA, 22 nt, Human
ggcuggggccuguugaagaugc

SEQ ID NO: 241742 - RNA, 22 nt, Human
cuccacagccccuccaguggca

SEQ ID NO: 241743 - RNA, 22 nt, Human
uuuguacuuucuaauguauuua

SEQ ID NO: 241744 - RNA, 22 nt, Human
caggccgccacugcagcagcug

SEQ ID NO: 241745 - RNA, 22 nt, Human
augcugugccuggaaagcggcu

SEQ ID NO: 241746 - RNA, 22 nt, Human
agugagaguauuaaugugaacu

SEQ ID NO: 241747 - RNA, 22 nt, Human
gauggggaaaaaauggaucuuu

SEQ ID NO: 241748 - RNA, 22 nt, Human
gcaggaagauugcagaaggcug

SEQ ID NO: 241749 - RNA, 22 nt, Human
auuuucauauggguuauuugua

SEQ ID NO: 241750 - RNA, 22 nt, Human
ccuaggauuaaaauaauaauua

SEQ ID NO: 241751 - RNA, 22 nt, Human
ggggaaggaaggggagggcacg

SEQ ID NO: 241752 - RNA, 22 nt, Human
ggggaagugguggggcuccgag

SEQ ID NO: 241753 - RNA, 22 nt, Human
ucuguucaugucuuuuuaagug

SEQ ID NO: 241754 - RNA, 22 nt, Human
cggcugcagcggagcaggcugg

SEQ ID NO: 241755 - RNA, 22 nt, Human
agcugacagugcauggagggac

SEQ ID NO: 241756 - RNA, 22 nt, Human
gugggagggaguccugggagca

SEQ ID NO: 241757 - RNA, 22 nt, Human
guacauauccuuuacguuuugu

SEQ ID NO: 241758 - RNA, 22 nt, Human
gcgggccggcaggggaggaguu

SEQ ID NO: 241759 - RNA, 22 nt, Human
guuuacaacaucuuguccuuca

SEQ ID NO: 241760 - RNA, 22 nt, Human
ugacuaauacagaaacuacaag

SEQ ID NO: 241761 - RNA, 22 nt, Human
aaauauuugaaugguguaagau

SEQ ID NO: 241762 - RNA, 22 nt, Human
agccuggagcaggcucugcucu

SEQ ID NO: 241763 - RNA, 22 nt, Human
uauuuguauugucuuaucacuu

SEQ ID NO: 241764 - RNA, 22 nt, Human
ugcucacugcuuguguucaguu

SEQ ID NO: 241765 - RNA, 22 nt, Human
gaaagggggcuuggacacuggc

SEQ ID NO: 241766 - RNA, 22 nt, Human
ucccugcugggcgaucuucucu

SEQ ID NO: 241767 - RNA, 17 nt, Human
auucuuauacucuguga

SEQ ID NO: 241768 - RNA, 21 nt, Human
gcgcgcucgugcucgacgcgc

SEQ ID NO: 241769 - RNA, 22 nt, Human
gagcagacugcacaguucuugc

SEQ ID NO: 241770 - RNA, 22 nt, Human
gcuggaaauaacuuguguagaa

SEQ ID NO: 241771 - RNA, 22 nt, Human
gcuggaagggccagcuuucagg

SEQ ID NO: 241772 - RNA, 22 nt, Human
uggaaaguuggaagucucagga

SEQ ID NO: 241773 - RNA, 22 nt, Human
ggggcaucguugauugcauggu

SEQ ID NO: 241774 - RNA, 22 nt, Human
augaaaacggaccagagcuauu

SEQ ID NO: 241775 - RNA, 22 nt, Human
uggaugcuccaaguagaccuua

SEQ ID NO: 241776 - RNA, 22 nt, Human
uggcgcgcagccugcuggugcu

SEQ ID NO: 241777 - RNA, 22 nt, Human
auuaaaaaugagaguagggauu

SEQ ID NO: 241778 - RNA, 22 nt, Human
ucuggggaugagugaugucgua

SEQ ID NO: 241779 - RNA, 22 nt, Human
uaccuggauaaauguacaaccg

SEQ ID NO: 241780 - RNA, 22 nt, Human
uucacauucauuucuuauguuu

SEQ ID NO: 241781 - RNA, 22 nt, Human
ggagauggucacagguaaacau

SEQ ID NO: 241782 - RNA, 22 nt, Human
uuuaaaacagcauuuaaaaggu

SEQ ID NO: 241783 - RNA, 22 nt, Human
ugcugcacccuucauuuuccca

SEQ ID NO: 241784 - RNA, 22 nt, Human
uagcugucauuggaucagaagg

SEQ ID NO: 241785 - RNA, 22 nt, Human
uuucucuuguauuugaaucacu

SEQ ID NO: 241786 - RNA, 22 nt, Human
aucguuaugauagagaaagaga

SEQ ID NO: 241787 - RNA, 22 nt, Human
uauauauaauguguacagguga

SEQ ID NO: 241788 - RNA, 22 nt, Human
ggaggccagagaagagccaggc

SEQ ID NO: 241789 - RNA, 22 nt, Human
cugcagagaccuaggucagguu

SEQ ID NO: 241790 - RNA, 22 nt, Human
gcugucccccaaagaugcuccu

SEQ ID NO: 241791 - RNA, 22 nt, Human
guuauuuugucuuguucaugaa

SEQ ID NO: 241792 - RNA, 22 nt, Human
uggcaaggccacaggugcaguu

SEQ ID NO: 241793 - RNA, 22 nt, Human
ugugaagaauuaaugugaauca

SEQ ID NO: 241794 - RNA, 22 nt, Human
ggcacaggcugguaccaguuca

SEQ ID NO: 241795 - RNA, 22 nt, Human
uggagcugguucuggggaagcu

SEQ ID NO: 241796 - RNA, 22 nt, Human
aagagaggaaagggugugaggu

SEQ ID NO: 241797 - RNA, 22 nt, Human
cauaaauuuuaccuuguaagug

SEQ ID NO: 241798 - RNA, 22 nt, Human
uauauacacgcacauauacaua

SEQ ID NO: 241799 - RNA, 22 nt, Human
gcuguugugaggaucagcauau

SEQ ID NO: 241800 - RNA, 22 nt, Human
cucggcccuggucuuacgggac

SEQ ID NO: 241801 - RNA, 22 nt, Human
cagagccagcuguccuuggcau

SEQ ID NO: 241802 - RNA, 22 nt, Human
uugucuuucguauggaacacua

SEQ ID NO: 241803 - RNA, 22 nt, Human
aaauggaaguuuguucucagcc

SEQ ID NO: 241804 - RNA, 22 nt, Human
uaugugaaauggaauauagaaa

SEQ ID NO: 241805 - RNA, 22 nt, Human
uuguuauuauuauuuucguucu

SEQ ID NO: 241806 - RNA, 22 nt, Human
uuucuugugauuuugaugaacu

SEQ ID NO: 241807 - RNA, 22 nt, Human
gcagcccucuuggucacuaggc

SEQ ID NO: 241808 - RNA, 22 nt, Human
gcucagccuuuuguucuauuca

SEQ ID NO: 241809 - RNA, 22 nt, Human
acaauaauguuuuuagguuauu

SEQ ID NO: 241810 - RNA, 22 nt, Human
aauucuuuguuccucugccaag

SEQ ID NO: 241811 - RNA, 22 nt, Human
uucucugcgcuccggcccaguu

SEQ ID NO: 241812 - RNA, 22 nt, Human
gggagccucccacugggggaag

SEQ ID NO: 241813 - RNA, 22 nt, Human
auucaggacucuuccuugaaga

SEQ ID NO: 241814 - RNA, 21 nt, Human
aggugaaggcgagggggacag

SEQ ID NO: 241815 - RNA, 22 nt, Human
auuuuguugaaacccuuguugu

SEQ ID NO: 241816 - RNA, 22 nt, Human
aggggcugagaguuugaugugg

SEQ ID NO: 241817 - RNA, 22 nt, Human
ccuccuuuccuguuuuccugag

SEQ ID NO: 241818 - RNA, 22 nt, Human
uuaucuuuuaaaaacacuugug

SEQ ID NO: 241819 - RNA, 22 nt, Human
guuuaaaagcaaccaacaggcu

SEQ ID NO: 241820 - RNA, 22 nt, Human
aucuucaaagcacaucguuugu

SEQ ID NO: 241821 - RNA, 20 nt, Human
gcucuucuccgggucugccu

SEQ ID NO: 241822 - RNA, 22 nt, Human
aucauguauauuuuugcuauua

SEQ ID NO: 241823 - RNA, 22 nt, Human
uugcuuucuuuguagguuuucc

SEQ ID NO: 241824 - RNA, 22 nt, Human
uugugugugcccaccuguggcc

SEQ ID NO: 241825 - RNA, 22 nt, Human
guguugaugugucuguauucua

SEQ ID NO: 241826 - RNA, 22 nt, Human
ggugaguagaaguaguuggcuu

SEQ ID NO: 241827 - RNA, 22 nt, Human
ucgcccagguuggagugcagug

SEQ ID NO: 241828 - RNA, 22 nt, Human
gggaaauagagcuggaaccuug

SEQ ID NO: 241829 - RNA, 22 nt, Human
agaggcaggcagcagagaagau

SEQ ID NO: 241830 - RNA, 22 nt, Human
acuauauaaugcacacaguaua

SEQ ID NO: 241831 - RNA, 22 nt, Human
agcaauucugaaauuacuugac

SEQ ID NO: 241832 - RNA, 22 nt, Human
uuuugaauaauucagaaacagc

SEQ ID NO: 241833 - RNA, 22 nt, Human
ucuuggucccugagcucuuuca

SEQ ID NO: 241834 - RNA, 22 nt, Human
uuucacuucgaucagaguuuuu

SEQ ID NO: 241835 - RNA, 22 nt, Human
ggcagucuuucccuugagcucu

SEQ ID NO: 241836 - RNA, 23 nt, Human
uuuuccaaaucgacucucuaguu

SEQ ID NO: 241837 - RNA, 22 nt, Human
guuuccaggcuuugguaugguu

SEQ ID NO: 241838 - RNA, 22 nt, Human
aaauauuagacauaccuggaga

SEQ ID NO: 241839 - RNA, 22 nt, Human
gcccugucagcucucauggaca

SEQ ID NO: 241840 - RNA, 22 nt, Human
agcucuucugacucuaggcuca

SEQ ID NO: 241841 - RNA, 22 nt, Human
agcagggagaccaucucuuccu

SEQ ID NO: 241842 - RNA, 22 nt, Human
acugucuuguuguaugugagcu

SEQ ID NO: 241843 - RNA, 22 nt, Human
gaaccauuuaauggagaugcuc

SEQ ID NO: 241844 - RNA, 22 nt, Human
ugcccacuucaaaaucuucauu

SEQ ID NO: 241845 - RNA, 22 nt, Human
uggaagugucagcaggcugguu

SEQ ID NO: 241846 - RNA, 22 nt, Human
uagggaggguuugggguggagg

SEQ ID NO: 241847 - RNA, 22 nt, Human
cauggcaggugcagauucugug

SEQ ID NO: 241848 - RNA, 22 nt, Human
ucucuucacuuguaugcuauca

SEQ ID NO: 241849 - RNA, 22 nt, Human
auucuuuucucuaaaugaugaa

SEQ ID NO: 241850 - RNA, 23 nt, Human
aacugcaagguugcugggaagua

SEQ ID NO: 241851 - RNA, 22 nt, Human
auauuuuacagcucucguugaa

SEQ ID NO: 241852 - RNA, 22 nt, Human
uuuguuugcugagugaauucaa

SEQ ID NO: 241853 - RNA, 22 nt, Human
agcaggagagacuggcccaaaa

SEQ ID NO: 241854 - RNA, 22 nt, Human
ucuucuuuccuuuugugcauuu

SEQ ID NO: 241855 - RNA, 20 nt, Human
aggggcuguaguuagaugac

SEQ ID NO: 241856 - RNA, 18 nt, Human
ccuccccuguggaggucc

SEQ ID NO: 241857 - RNA, 22 nt, Human
uguccuuuauauguuuuuuagu

SEQ ID NO: 241858 - RNA, 22 nt, Human
agaaacaagcccuagaaguccu

SEQ ID NO: 241859 - RNA, 22 nt, Human
uuuacaaggcaguuauuuuccu

SEQ ID NO: 241860 - RNA, 19 nt, Human
uagaggagaauggcaaaga

SEQ ID NO: 241861 - RNA, 22 nt, Human
gcagggcucuggagucaggcug

SEQ ID NO: 241862 - RNA, 22 nt, Human
uucuucgacuguauaaaaguau

SEQ ID NO: 241863 - RNA, 22 nt, Human
uuucagaaauggcacugaaauc

SEQ ID NO: 241864 - RNA, 22 nt, Human
uucccaggugugagugagguga

SEQ ID NO: 241865 - RNA, 21 nt, Human
guucuuaguuauauucucaau

SEQ ID NO: 241866 - RNA, 22 nt, Human
cuguuaauugugaauuuuacau

SEQ ID NO: 241867 - RNA, 22 nt, Human
uagacugagcuccuugaggaca

SEQ ID NO: 241868 - RNA, 21 nt, Human
agaugaggauacugaggccua

SEQ ID NO: 241869 - RNA, 22 nt, Human
ucccuguggauuaaggagaugu

SEQ ID NO: 241870 - RNA, 22 nt, Human
aauaugcaaagcguguuaucug

SEQ ID NO: 241871 - RNA, 22 nt, Human
uuuuccuuaacagagggagaaa

SEQ ID NO: 241872 - RNA, 22 nt, Human
aaggccuaggaguugacauggg

SEQ ID NO: 241873 - RNA, 22 nt, Human
aauuucagaccaacgagucagg

SEQ ID NO: 241874 - RNA, 22 nt, Human
aagugaaaaaagucaguacuga

SEQ ID NO: 241875 - RNA, 20 nt, Human
gaacauaaauaacucuuuac

SEQ ID NO: 241876 - RNA, 22 nt, Human
uauauauaugcaccacaugugu

SEQ ID NO: 241877 - RNA, 22 nt, Human
uacauuugauuuuugcuucuuu

SEQ ID NO: 241878 - RNA, 22 nt, Human
auugcaggucguguggaaguga

SEQ ID NO: 241879 - RNA, 22 nt, Human
ucccuugacauuacuugggagg

SEQ ID NO: 241880 - RNA, 22 nt, Human
cuccaugagccaggagggcuac

SEQ ID NO: 241881 - RNA, 22 nt, Human
uacuuacacugaagcaaagaua

SEQ ID NO: 241882 - RNA, 22 nt, Human
ugcuuucaaaacucagaggaau

SEQ ID NO: 241883 - RNA, 22 nt, Human
ccaggcucaccuggagccccug

SEQ ID NO: 241884 - RNA, 21 nt, Human
ucuggggacaagguccaggaa

SEQ ID NO: 241885 - RNA, 22 nt, Human
gaaugggaauuauggugggacu

SEQ ID NO: 241886 - RNA, 17 nt, Human
ucuguguccgcucaguc

SEQ ID NO: 241887 - RNA, 22 nt, Human
uggagucuugcuuugggagugc

SEQ ID NO: 241888 - RNA, 22 nt, Human
aauauuuaaauagaauuacauc

SEQ ID NO: 241889 - RNA, 22 nt, Human
agauucucccuccuggcgcugu

SEQ ID NO: 241890 - RNA, 22 nt, Human
uucauacuguuuaaguucuguu

SEQ ID NO: 241891 - RNA, 22 nt, Human
aagagaaaugcuuuaacuuuau

SEQ ID NO: 241892 - RNA, 22 nt, Human
aagggagagggagaagguggga

SEQ ID NO: 241893 - RNA, 22 nt, Human
ugcggagggagcagucggcugu

SEQ ID NO: 241894 - RNA, 22 nt, Human
aggaggcucucagguccucccc

SEQ ID NO: 241895 - RNA, 22 nt, Human
auggaggaugugcagcaugggc

SEQ ID NO: 241896 - RNA, 22 nt, Human
caucuuuguuuuggauauaauc

SEQ ID NO: 241897 - RNA, 22 nt, Human
gcugcaggaggugguagggucu

SEQ ID NO: 241898 - RNA, 22 nt, Human
aauuauguugaaauaugagaac

SEQ ID NO: 241899 - RNA, 22 nt, Human
agggcugggcuuggcaggcugg

SEQ ID NO: 241900 - RNA, 22 nt, Human
agagggagagauuggcaaucag

SEQ ID NO: 241901 - RNA, 21 nt, Human
uuccauggacccugucagugu

SEQ ID NO: 241902 - RNA, 22 nt, Human
agcggcgcgucuccgagcugga

SEQ ID NO: 241903 - RNA, 22 nt, Human
cugccucucaugccugcuugcu

SEQ ID NO: 241904 - RNA, 22 nt, Human
uggaguuuuaaucuguacagaa

SEQ ID NO: 241905 - RNA, 22 nt, Human
uucuuuuaauuucugucugcag

SEQ ID NO: 241906 - RNA, 22 nt, Human
gucugcagcacugugcacgguc

SEQ ID NO: 241907 - RNA, 22 nt, Human
aaauguuugguggauaaaagga

SEQ ID NO: 241908 - RNA, 22 nt, Human
guucaaucucucaugcauuuuc

SEQ ID NO: 241909 - RNA, 22 nt, Human
cauccagcuccugggggccacc

SEQ ID NO: 241910 - RNA, 22 nt, Human
uccaugaguuuuuuaguuucac

SEQ ID NO: 241911 - RNA, 20 nt, Human
agucuucaggugugaggauu

SEQ ID NO: 241912 - RNA, 18 nt, Human
acuguccucaggacguug

SEQ ID NO: 241913 - RNA, 22 nt, Human
ugcaggagcaccagcucacccu

SEQ ID NO: 241914 - RNA, 22 nt, Human
ccggcugcugaggcggccccgg

SEQ ID NO: 241915 - RNA, 22 nt, Human
ugucuuugaccuuaagaaguuu

SEQ ID NO: 241916 - RNA, 22 nt, Human
uuuucucaguuuuuuucaaaag

SEQ ID NO: 241917 - RNA, 21 nt, Human
ugccccucuuuucuuuccuuc

SEQ ID NO: 241918 - RNA, 18 nt, Human
cccagaggaaugccugga

SEQ ID NO: 241919 - RNA, 22 nt, Human
ccagccugccaagcccagcccu

SEQ ID NO: 241920 - RNA, 22 nt, Human
ugccuucugccaaggacggugc

SEQ ID NO: 241921 - RNA, 22 nt, Human
aaaugcuuuaauugaguucaug

SEQ ID NO: 241922 - RNA, 21 nt, Human
gggagugaguaaugauggggg

SEQ ID NO: 241923 - RNA, 22 nt, Human
cuguccauuuucgugccuccuu

SEQ ID NO: 241924 - RNA, 22 nt, Human
ugagaaaacaguuuguaauaau

SEQ ID NO: 241925 - RNA, 22 nt, Human
uuauuuaagaucuuaauauaua

SEQ ID NO: 241926 - RNA, 22 nt, Human
gagaaaaauuucuuugcugcac

SEQ ID NO: 241927 - RNA, 22 nt, Human
ccagggaggucauagugcuggu

SEQ ID NO: 241928 - RNA, 22 nt, Human
uucagaauguacugauagaaca

SEQ ID NO: 241929 - RNA, 22 nt, Human
agggcgugguggugcuggagca

SEQ ID NO: 241930 - RNA, 22 nt, Human
uuuucacugacuuggucuggaa

SEQ ID NO: 241931 - RNA, 22 nt, Human
cuucuuuuggggaugaaaaugg

SEQ ID NO: 241932 - RNA, 22 nt, Human
uggcucacuuccguggagaggu

SEQ ID NO: 241933 - RNA, 22 nt, Human
cggccgcgggauggcgggcagc

SEQ ID NO: 241934 - RNA, 22 nt, Human
auucuucauguugaagcuguca

SEQ ID NO: 241935 - RNA, 22 nt, Human
aaauucagauggcuuucuuuuc

SEQ ID NO: 241936 - RNA, 22 nt, Human
acuguugagggaagcagaugaa

SEQ ID NO: 241937 - RNA, 22 nt, Human
agcacauguuucuuuugcaauu

SEQ ID NO: 241938 - RNA, 22 nt, Human
gaggggaaggauuucuucagaa

SEQ ID NO: 241939 - RNA, 16 nt, Human
gaauuccauugcucug

SEQ ID NO: 241940 - RNA, 23 nt, Human
agauaaggaagcauuugagccag

SEQ ID NO: 241941 - RNA, 22 nt, Human
agggggaauccugcuuauggau

SEQ ID NO: 241942 - RNA, 22 nt, Human
uucagaauuaucauaauuuuga

SEQ ID NO: 241943 - RNA, 21 nt, Human
gccgugcgccuccaggcgcgc

SEQ ID NO: 241944 - RNA, 20 nt, Human
aauaaauauaacccauaauu

SEQ ID NO: 241945 - RNA, 22 nt, Human
cacaugugugugccuacaugca

SEQ ID NO: 241946 - RNA, 22 nt, Human
gagggaggugacaaggacauag

SEQ ID NO: 241947 - RNA, 22 nt, Human
gagccucaggguuuuguugaca

SEQ ID NO: 241948 - RNA, 22 nt, Human
ggcuuguccuucugguugucuu

SEQ ID NO: 241949 - RNA, 22 nt, Human
uguguuguuuggggauguccau

SEQ ID NO: 241950 - RNA, 22 nt, Human
uucuugucuuuguuauguagga

SEQ ID NO: 241951 - RNA, 22 nt, Human
acauuuccaaagaugccaguca

SEQ ID NO: 241952 - RNA, 22 nt, Human
gaggagcugggucagggagaca

SEQ ID NO: 241953 - RNA, 22 nt, Human
caggggaagccagcugccaugu

SEQ ID NO: 241954 - RNA, 22 nt, Human
cuuuuuaaaguaaauggcuaga

SEQ ID NO: 241955 - RNA, 22 nt, Human
ggcccgcgcugcuggcgcgcca

SEQ ID NO: 241956 - RNA, 22 nt, Human
acuuuauacuagugauaguuug

SEQ ID NO: 241957 - RNA, 22 nt, Human
cagggccaggccucaggggcgc

SEQ ID NO: 241958 - RNA, 22 nt, Human
aacucaggagagaguaacaggg

SEQ ID NO: 241959 - RNA, 22 nt, Human
uuucuaaaaccagaguuuauaa

SEQ ID NO: 241960 - RNA, 22 nt, Human
uacuauuuugacaugaaauuga

SEQ ID NO: 241961 - RNA, 22 nt, Human
uuggugauguagcagcaauugu

SEQ ID NO: 241962 - RNA, 22 nt, Human
uucacccuucucuggcuuucag

SEQ ID NO: 241963 - RNA, 17 nt, Human
auuguuuuuaauuugca

SEQ ID NO: 241964 - RNA, 22 nt, Human
ugaggaagugguuguaugguuu

SEQ ID NO: 241965 - RNA, 22 nt, Human
gguagacugagcuccuugagga

SEQ ID NO: 241966 - RNA, 22 nt, Human
uagcauuuauugggcuagcaaa

SEQ ID NO: 241967 - RNA, 22 nt, Human
gcauaauauugagaaauuauua

SEQ ID NO: 241968 - RNA, 22 nt, Human
aaaauauucuauaucaaagaua

SEQ ID NO: 241969 - RNA, 22 nt, Human
aacuagugucuguaugauaagg

SEQ ID NO: 241970 - RNA, 22 nt, Human
uuuaaauaguugguuuuuuugc

SEQ ID NO: 241971 - RNA, 22 nt, Human
ugagggaggggaaugugugcag

SEQ ID NO: 241972 - RNA, 22 nt, Human
agcacagugccugacauauaug

SEQ ID NO: 241973 - RNA, 22 nt, Human
cacuaggauccuucuucuucuu

SEQ ID NO: 241974 - RNA, 20 nt, Human
ggcagagcuaugucuguugc

SEQ ID NO: 241975 - RNA, 22 nt, Human
aggauggauagcaaggaagccg

SEQ ID NO: 241976 - RNA, 22 nt, Human
gagcgcacagaaggaagcagcc

SEQ ID NO: 241977 - RNA, 22 nt, Human
agcagccgccgccgccgcgcac

SEQ ID NO: 241978 - RNA, 22 nt, Human
uguagcuccuaaagcccagcug

SEQ ID NO: 241979 - RNA, 22 nt, Human
uuuuuuguggcuggaagaaaaa

SEQ ID NO: 241980 - RNA, 22 nt, Human
agggcaggguuggugcuggugc

SEQ ID NO: 241981 - RNA, 22 nt, Human
gccggguguuccugggaagaug

SEQ ID NO: 241982 - RNA, 22 nt, Human
uaugucuauugacuuaggauuu

SEQ ID NO: 241983 - RNA, 22 nt, Human
cguggcaguagagcuggaacuu

SEQ ID NO: 241984 - RNA, 22 nt, Human
aaauauugaauuugaggaugua

SEQ ID NO: 241985 - RNA, 22 nt, Human
gaggugcaggggcccgggcugg

SEQ ID NO: 241986 - RNA, 22 nt, Human
caugcuaacacguugcucaccg

SEQ ID NO: 241987 - RNA, 22 nt, Human
aaugaaaaucugucaguucaag

SEQ ID NO: 241988 - RNA, 22 nt, Human
guaagaauauacccaggaguca

SEQ ID NO: 241989 - RNA, 22 nt, Human
gauuuucauuauagcuaguuuc

SEQ ID NO: 241990 - RNA, 22 nt, Human
guuuuaucuauguaauuauaaa

SEQ ID NO: 241991 - RNA, 22 nt, Human
ugcugcacucacaggaagaguu

SEQ ID NO: 241992 - RNA, 22 nt, Human
gggggagcuacaggucccuugg

SEQ ID NO: 241993 - RNA, 22 nt, Human
guuuuucuuugauuuagaacca

SEQ ID NO: 241994 - RNA, 22 nt, Human
cauuucaaacaguuacagcugc

SEQ ID NO: 241995 - RNA, 22 nt, Human
aagcccucagagccucuuugac

SEQ ID NO: 241996 - RNA, 22 nt, Human
aaggugggacugagaggggaca

SEQ ID NO: 241997 - RNA, 22 nt, Human
auacaucuuaacgcgcucuugg

SEQ ID NO: 241998 - RNA, 22 nt, Human
ucagcucucucuuggugaucuc

SEQ ID NO: 241999 - RNA, 18 nt, Human
guucaagcauuuugcucu

SEQ ID NO: 242000 - RNA, 22 nt, Human
uacuuuaauugcaaaaauaaau

SEQ ID NO: 242001 - RNA, 22 nt, Human
uucacugugauguuuaagagaa

SEQ ID NO: 242002 - RNA, 22 nt, Human
caccucagagcuccuucuucuc

SEQ ID NO: 242003 - RNA, 22 nt, Human
aauaugaugccaaauugcuaca

SEQ ID NO: 242004 - RNA, 22 nt, Human
gcucagagaaaacuggggcuug

SEQ ID NO: 242005 - RNA, 22 nt, Human
uuuuccuuagaaauacauugau

SEQ ID NO: 242006 - RNA, 20 nt, Human
agugauuuguuaguacauug

SEQ ID NO: 242007 - RNA, 22 nt, Human
gcagguggaagcagcagacuca

SEQ ID NO: 242008 - RNA, 23 nt, Human
ucagaccaaccucuugcuggaac

SEQ ID NO: 242009 - RNA, 22 nt, Human
uaguuccucuucucagggccau

SEQ ID NO: 242010 - RNA, 22 nt, Human
cagcaugguggagcugcucuuu

SEQ ID NO: 242011 - RNA, 20 nt, Human
gaauucugaagauaauuugg

SEQ ID NO: 242012 - RNA, 22 nt, Human
ucgcucgcuggcuccugcccgc

SEQ ID NO: 242013 - RNA, 22 nt, Human
uugucaggaacuaugauuaugc

SEQ ID NO: 242014 - RNA, 22 nt, Human
gcuuauuagguuauuucaagga

SEQ ID NO: 242015 - RNA, 23 nt, Human
auaaugauaaugcuauuuuuugu

SEQ ID NO: 242016 - RNA, 22 nt, Human
uccaaggacucuugucagcugu

SEQ ID NO: 242017 - RNA, 22 nt, Human
cgccgccgccugcccgcgcccc

SEQ ID NO: 242018 - RNA, 20 nt, Human
uccccuccacuuuccuccua

SEQ ID NO: 242019 - RNA, 22 nt, Human
gcacccagggcaggaagugagg

SEQ ID NO: 242020 - RNA, 22 nt, Human
uucauaugaauuggguuuuuuu

SEQ ID NO: 242021 - RNA, 22 nt, Human
gaacauuucugcagaugucuga

SEQ ID NO: 242022 - RNA, 22 nt, Human
agccgcgcuguuccugcugcug

SEQ ID NO: 242023 - RNA, 22 nt, Human
aggaaauaggaccagacaaagc

SEQ ID NO: 242024 - RNA, 20 nt, Human
uuggggacaggagugugaug

SEQ ID NO: 242025 - RNA, 22 nt, Human
cuaggaugcuguaauggugucu

SEQ ID NO: 242026 - RNA, 22 nt, Human
cuucuuucuuuucuucuucucu

SEQ ID NO: 242027 - RNA, 22 nt, Human
uuuaaauuucugaaucuugagg

SEQ ID NO: 242028 - RNA, 19 nt, Human
ucaggaggucgaccuggca

SEQ ID NO: 242029 - RNA, 22 nt, Human
gacaagaagaacggagguuuca

SEQ ID NO: 242030 - RNA, 22 nt, Human
gugggugauacugccgugggag

SEQ ID NO: 242031 - RNA, 22 nt, Human
auuguuuugugaaacauaguga

SEQ ID NO: 242032 - RNA, 20 nt, Human
uggaugacuucaggcagccu

SEQ ID NO: 242033 - RNA, 20 nt, Human
ugcugugugucuacuguggg

SEQ ID NO: 242034 - RNA, 22 nt, Human
gggcgcgccaggagcugcgcgg

SEQ ID NO: 242035 - RNA, 20 nt, Human
aauagcacagcucaaacauu

SEQ ID NO: 242036 - RNA, 22 nt, Human
uucaaaaugcagaauaguuugg

SEQ ID NO: 242037 - RNA, 22 nt, Human
guggaaggaauuaacagacuag

SEQ ID NO: 242038 - RNA, 22 nt, Human
augcaccugucuuuuaaggaua

SEQ ID NO: 242039 - RNA, 22 nt, Human
aggggauggagcuggaaggcag

SEQ ID NO: 242040 - RNA, 22 nt, Human
aauauuuugggacugaggaauu

SEQ ID NO: 242041 - RNA, 22 nt, Human
gggccuguccccccaggagaac

SEQ ID NO: 242042 - RNA, 22 nt, Human
gggagguaaugggggugcaggg

SEQ ID NO: 242043 - RNA, 22 nt, Human
cuauauucuggaauguccauuu

SEQ ID NO: 242044 - RNA, 22 nt, Human
cccagaggcugaguugggagca

SEQ ID NO: 242045 - RNA, 22 nt, Human
auuuccagcagcauauuugucu

SEQ ID NO: 242046 - RNA, 22 nt, Human
ugaggaggugcuaccagcgucu

SEQ ID NO: 242047 - RNA, 22 nt, Human
cggagggcccucaggacugggu

SEQ ID NO: 242048 - RNA, 21 nt, Human
acaaaaccuaacuuggcugcu

SEQ ID NO: 242049 - RNA, 22 nt, Human
aacccugaacuuaguucuagga

SEQ ID NO: 242050 - RNA, 22 nt, Human
cucucugcugucuuucgggaaa

SEQ ID NO: 242051 - RNA, 18 nt, Human
uucucucuggauaguagu

SEQ ID NO: 242052 - RNA, 22 nt, Human
gggcgcgcggagccucgccggg

SEQ ID NO: 242053 - RNA, 22 nt, Human
ccagggcuggaggaggucagga

SEQ ID NO: 242054 - RNA, 22 nt, Human
augccugcugucaggaacucuu

SEQ ID NO: 242055 - RNA, 22 nt, Human
auaucugaugacgugacuaugu

SEQ ID NO: 242056 - RNA, 19 nt, Human
acuggggcaggcugggcuu

SEQ ID NO: 242057 - RNA, 22 nt, Human
agcgcccguugagucgcgcggu

SEQ ID NO: 242058 - RNA, 22 nt, Human
cggcugcgguucaccuagggca

SEQ ID NO: 242059 - RNA, 22 nt, Human
aggaacaguuucaaagagugaa

SEQ ID NO: 242060 - RNA, 22 nt, Human
cagaaaaaaaugcagacuagca

SEQ ID NO: 242061 - RNA, 22 nt, Human
agggcaguuuuacugaaaggug

SEQ ID NO: 242062 - RNA, 22 nt, Human
auuucauuuuagaaauaagugu

SEQ ID NO: 242063 - RNA, 22 nt, Human
uggaagaucugguguagcuccu

SEQ ID NO: 242064 - RNA, 22 nt, Human
agagggagagaccuccgugccu

SEQ ID NO: 242065 - RNA, 22 nt, Human
ugugugcuaguuuugucaguau

SEQ ID NO: 242066 - RNA, 22 nt, Human
uucccugugcaguauguuccaa

SEQ ID NO: 242067 - RNA, 22 nt, Human
guuuucuccugcuauacagugc

SEQ ID NO: 242068 - RNA, 22 nt, Human
cacugcaaccuccaccucccgg

SEQ ID NO: 242069 - RNA, 22 nt, Human
ucacugaacucucauagagaaa

SEQ ID NO: 242070 - RNA, 22 nt, Human
gugucccaaagauuagaaauca

SEQ ID NO: 242071 - RNA, 19 nt, Human
ggagcagauaaacauacuu

SEQ ID NO: 242072 - RNA, 22 nt, Human
uucauggauuugugaaauuuag

SEQ ID NO: 242073 - RNA, 22 nt, Human
uggacacugguggauauggaau

SEQ ID NO: 242074 - RNA, 22 nt, Human
ggcuggagcaggcugcacagug

SEQ ID NO: 242075 - RNA, 22 nt, Human
cuugucuaguuccuggugaugu

SEQ ID NO: 242076 - RNA, 22 nt, Human
ucauuguuuacugucuuuuuuc

SEQ ID NO: 242077 - RNA, 22 nt, Human
ucuucaugaaauugauugcuua

SEQ ID NO: 242078 - RNA, 22 nt, Human
uggggcugguaccguaauauau

SEQ ID NO: 242079 - RNA, 22 nt, Human
uaaaaauuagauauguauuuag

SEQ ID NO: 242080 - RNA, 22 nt, Human
uauauauacauauagaauaugu

SEQ ID NO: 242081 - RNA, 22 nt, Human
uggcagccugcgugaaggagcu

SEQ ID NO: 242082 - RNA, 22 nt, Human
aggcaguguggagggcuguugc

SEQ ID NO: 242083 - RNA, 22 nt, Human
uagaccugugggggcagcgggc

SEQ ID NO: 242084 - RNA, 22 nt, Human
agauggggccugaggacacugu

SEQ ID NO: 242085 - RNA, 22 nt, Human
aaaacauuuaggguuuuuuuua

SEQ ID NO: 242086 - RNA, 22 nt, Human
uauuuaaagucagcaacuuuuc

SEQ ID NO: 242087 - RNA, 22 nt, Human
ucuucuuugugguugcccaagg

SEQ ID NO: 242088 - RNA, 22 nt, Human
ugggggagggagaguugauggg

SEQ ID NO: 242089 - RNA, 22 nt, Human
uucaugucuuugauucugauaa

SEQ ID NO: 242090 - RNA, 22 nt, Human
uagcacauaguaggcacaggcu

SEQ ID NO: 242091 - RNA, 22 nt, Human
ggcuccaggguaccccuggaug

SEQ ID NO: 242092 - RNA, 22 nt, Human
agcuccucagauuuggguggcg

SEQ ID NO: 242093 - RNA, 22 nt, Human
aaaauauguugagauacugaaa

SEQ ID NO: 242094 - RNA, 22 nt, Human
uggaagugggcaucaccaucca

SEQ ID NO: 242095 - RNA, 21 nt, Human
acauccaggguccucacugcc

SEQ ID NO: 242096 - RNA, 22 nt, Human
uauauuaaagugcuuugcagug

SEQ ID NO: 242097 - RNA, 20 nt, Human
agaaggagagaugaggcaaa

SEQ ID NO: 242098 - RNA, 22 nt, Human
cccgugggaugagaggcccugg

SEQ ID NO: 242099 - RNA, 22 nt, Human
agugaggggagaaugaggugga

SEQ ID NO: 242100 - RNA, 22 nt, Human
auuuuuagucuugcugcaauca

SEQ ID NO: 242101 - RNA, 22 nt, Human
gaggaggcuggagaggccagga

SEQ ID NO: 242102 - RNA, 22 nt, Human
ucucugaccuccaccccaggag

SEQ ID NO: 242103 - RNA, 22 nt, Human
ucuuuauuucccuaacuugcua

SEQ ID NO: 242104 - RNA, 19 nt, Human
gauauugagcugagaauuc

SEQ ID NO: 242105 - RNA, 19 nt, Human
auguuuccauuucuggaua

SEQ ID NO: 242106 - RNA, 22 nt, Human
aguuuccacuggagacacugug

SEQ ID NO: 242107 - RNA, 22 nt, Human
ucagcugggagaaaguuuuagg

SEQ ID NO: 242108 - RNA, 22 nt, Human
ugggggaggaggagacagacug

SEQ ID NO: 242109 - RNA, 20 nt, Human
uuuuuuaaauagagcuguug

SEQ ID NO: 242110 - RNA, 19 nt, Human
uccuacaugagacagagag

SEQ ID NO: 242111 - RNA, 22 nt, Human
auuagugguguauuuggcacua

SEQ ID NO: 242112 - RNA, 20 nt, Human
cuccuccccucggccccacc

SEQ ID NO: 242113 - RNA, 22 nt, Human
uagacauuuacuuugaaaaaau

SEQ ID NO: 242114 - RNA, 22 nt, Human
aaacuuuaggcacauggaucua

SEQ ID NO: 242115 - RNA, 22 nt, Human
uaauuccacacucccgcaagcg

SEQ ID NO: 242116 - RNA, 22 nt, Human
ucacugaauuucaagcuagugg

SEQ ID NO: 242117 - RNA, 22 nt, Human
ugggagagaagcugaggcaggg

SEQ ID NO: 242118 - RNA, 22 nt, Human
gagaacaaggaagagucggcag

SEQ ID NO: 242119 - RNA, 22 nt, Human
uucuagcucauggugacagauc

SEQ ID NO: 242120 - RNA, 22 nt, Human
auauguuaugccauuuucaagg

SEQ ID NO: 242121 - RNA, 22 nt, Human
auaucuaggcugaauguaaaau

SEQ ID NO: 242122 - RNA, 22 nt, Human
agguggcuaugaggaugcaguc

SEQ ID NO: 242123 - RNA, 22 nt, Human
cucaaugagcuauuuguuucau

SEQ ID NO: 242124 - RNA, 22 nt, Human
gaaggaagcugucuggaugugu

SEQ ID NO: 242125 - RNA, 22 nt, Human
guaaauaucucacgaaugauuc

SEQ ID NO: 242126 - RNA, 22 nt, Human
auugaaauuugcuuccucacug

SEQ ID NO: 242127 - RNA, 22 nt, Human
cuccuugguuccggcguuggag

SEQ ID NO: 242128 - RNA, 22 nt, Human
gagaacagauaugaugacuuca

SEQ ID NO: 242129 - RNA, 22 nt, Human
aaaaacuuaccccagggcaagg

SEQ ID NO: 242130 - RNA, 22 nt, Human
acagccaacgucuuucuuacuu

SEQ ID NO: 242131 - RNA, 22 nt, Human
auguaugagagauucuuuuauu

SEQ ID NO: 242132 - RNA, 20 nt, Human
gccggggcauaggggccguc

SEQ ID NO: 242133 - RNA, 22 nt, Human
ggccugcuaccagcugugaccu

SEQ ID NO: 242134 - RNA, 22 nt, Human
guuaaaaugauuugugauuuau

SEQ ID NO: 242135 - RNA, 22 nt, Human
ccugccagaaaagagggaguuc

SEQ ID NO: 242136 - RNA, 22 nt, Human
uaugggcaagagauaggugguc

SEQ ID NO: 242137 - RNA, 22 nt, Human
gaauuccaggugagagaaggua

SEQ ID NO: 242138 - RNA, 22 nt, Human
uagacugugagcuccuugaggg

SEQ ID NO: 242139 - RNA, 22 nt, Human
uucaaacaguguagaauauaug

SEQ ID NO: 242140 - RNA, 22 nt, Human
uuauuguuuggguauaauuuga

SEQ ID NO: 242141 - RNA, 22 nt, Human
caaaucuguuaauuucaaguug

SEQ ID NO: 242142 - RNA, 22 nt, Human
aagaaaccauauuaguuccugg

SEQ ID NO: 242143 - RNA, 22 nt, Human
ccccauggaaaacccaccuagg

SEQ ID NO: 242144 - RNA, 22 nt, Human
cuagcacagugcuuggcacaca

SEQ ID NO: 242145 - RNA, 22 nt, Human
auuuuagagaaacaaacguagg

SEQ ID NO: 242146 - RNA, 22 nt, Human
acuugcauuguguaguguuuuu

SEQ ID NO: 242147 - RNA, 22 nt, Human
uuucacugaguaggagagcacu

SEQ ID NO: 242148 - RNA, 22 nt, Human
cucacugucagcugcagggcuu

SEQ ID NO: 242149 - RNA, 21 nt, Human
aagagcgccgggcagggcuga

SEQ ID NO: 242150 - RNA, 22 nt, Human
caguagcuuuuugcagacaaga

SEQ ID NO: 242151 - RNA, 22 nt, Human
ggggaggugugcaggacaccuc

SEQ ID NO: 242152 - RNA, 22 nt, Human
ucagcucacaauguugagaaag

SEQ ID NO: 242153 - RNA, 22 nt, Human
cucugugucugauucugggaag

SEQ ID NO: 242154 - RNA, 22 nt, Human
agauaaaucauuuauuaagcgg

SEQ ID NO: 242155 - RNA, 22 nt, Human
cggaggcugcuuucuguugcua

SEQ ID NO: 242156 - RNA, 22 nt, Human
ugcuuucaaugaauuguauacu

SEQ ID NO: 242157 - RNA, 22 nt, Human
ucuggcaguugccgcuucaguc

SEQ ID NO: 242158 - RNA, 19 nt, Human
ccacacacuggucucuggg

SEQ ID NO: 242159 - RNA, 22 nt, Human
gaucccagaggcggggauagga

SEQ ID NO: 242160 - RNA, 22 nt, Human
guccccugcguguucauccugg

SEQ ID NO: 242161 - RNA, 22 nt, Human
aggcauauaguguuuaaaaaaa

SEQ ID NO: 242162 - RNA, 22 nt, Human
auuuucuugucucuguuguagg

SEQ ID NO: 242163 - RNA, 22 nt, Human
aagaaggaaggcaagagauggg

SEQ ID NO: 242164 - RNA, 22 nt, Human
gaguucuagauguauuauuaau

SEQ ID NO: 242165 - RNA, 22 nt, Human
cuccagcucgcgagcucugcuc

SEQ ID NO: 242166 - RNA, 22 nt, Human
uuuaucaggccaucuuaugucu

SEQ ID NO: 242167 - RNA, 22 nt, Human
ccgcucuuugagacucucccga

SEQ ID NO: 242168 - RNA, 22 nt, Human
cugcccgcaugcaggaaugcug

SEQ ID NO: 242169 - RNA, 22 nt, Human
uggcaagcuguuggcagauagc

SEQ ID NO: 242170 - RNA, 22 nt, Human
uuauuucauguaaaauuuaugu

SEQ ID NO: 242171 - RNA, 22 nt, Human
gccggagagccaacaccacgga

SEQ ID NO: 242172 - RNA, 22 nt, Human
uucucuugccuucucuuuuauc

SEQ ID NO: 242173 - RNA, 22 nt, Human
cuaaaccaauauauuuucuucc

SEQ ID NO: 242174 - RNA, 22 nt, Human
augugaaagagguguucagugg

SEQ ID NO: 242175 - RNA, 22 nt, Human
guuuggguggcuagagaaagaa

SEQ ID NO: 242176 - RNA, 21 nt, Human
agcgcugcauccaccauggcu

SEQ ID NO: 242177 - RNA, 22 nt, Human
ucacuguuucaccgucugaagg

SEQ ID NO: 242178 - RNA, 22 nt, Human
gcaggccgauuuguuagaaguc

SEQ ID NO: 242179 - RNA, 22 nt, Human
aauaagaguuaagaaguauauu

SEQ ID NO: 242180 - RNA, 22 nt, Human
cugucucugauaagcucgaggg

SEQ ID NO: 242181 - RNA, 20 nt, Human
accccuccccacuccucgcc

SEQ ID NO: 242182 - RNA, 22 nt, Human
uauuuuuaccuaauuuaugaga

SEQ ID NO: 242183 - RNA, 22 nt, Human
acuucuuuugcaugauucuuua

SEQ ID NO: 242184 - RNA, 22 nt, Human
auuaaaaaaagauaaugaguua

SEQ ID NO: 242185 - RNA, 22 nt, Human
caaauguuugguggcauuuugu

SEQ ID NO: 242186 - RNA, 22 nt, Human
accuccauggcccacaucuagu

SEQ ID NO: 242187 - RNA, 18 nt, Human
acaaaaauagugcuuugg

SEQ ID NO: 242188 - RNA, 22 nt, Human
gcauccugacuauggugguggu

SEQ ID NO: 242189 - RNA, 22 nt, Human
ggcagggaauucagagggaagg

SEQ ID NO: 242190 - RNA, 21 nt, Human
caguuugcuauuuuaguauga

SEQ ID NO: 242191 - RNA, 22 nt, Human
cacagugugguauauuucccaa

SEQ ID NO: 242192 - RNA, 22 nt, Human
gagcagcucgagaaggaagcag

SEQ ID NO: 242193 - RNA, 22 nt, Human
augggagggagcagugaguguu

SEQ ID NO: 242194 - RNA, 22 nt, Human
aggaaauaguuuagucccaaaa

SEQ ID NO: 242195 - RNA, 22 nt, Human
gucuugugaagacggcagaaag

SEQ ID NO: 242196 - RNA, 22 nt, Human
cuaaauucuauauccuugcuuc

SEQ ID NO: 242197 - RNA, 22 nt, Human
cuccagagagaaaggaggccgc

SEQ ID NO: 242198 - RNA, 22 nt, Human
uuccgcuuucaauggcuuggcu

SEQ ID NO: 242199 - RNA, 22 nt, Human
uuggggagaagagcuggucagg

SEQ ID NO: 242200 - RNA, 22 nt, Human
gcccagccucagggcaucagcu

SEQ ID NO: 242201 - RNA, 22 nt, Human
uccuuuauuuaugggcagugua

SEQ ID NO: 242202 - RNA, 22 nt, Human
ccuuucuaacagauuguggauc

SEQ ID NO: 242203 - RNA, 22 nt, Human
auaaaguaaugcauauaaugug

SEQ ID NO: 242204 - RNA, 22 nt, Human
aagugauuuucccaccaucuac

SEQ ID NO: 242205 - RNA, 22 nt, Human
ggcaggaaguaaggaugcuaca

SEQ ID NO: 242206 - RNA, 22 nt, Human
gagcgcgcaaucucuccagcug

SEQ ID NO: 242207 - RNA, 22 nt, Human
cagguggauggcgagcccugca

SEQ ID NO: 242208 - RNA, 22 nt, Human
ugcggugcgcccgggcgagugc

SEQ ID NO: 242209 - RNA, 22 nt, Human
cagcuggaggagcagcuuccag

SEQ ID NO: 242210 - RNA, 19 nt, Human
auagcagaagucauuuuca

SEQ ID NO: 242211 - RNA, 22 nt, Human
ucuucaaauacagucauauuga

SEQ ID NO: 242212 - RNA, 22 nt, Human
uggcucaguaaucgagucuccu

SEQ ID NO: 242213 - RNA, 22 nt, Human
auuuuugugucacaucuaggaa

SEQ ID NO: 242214 - RNA, 17 nt, Human
ugguucuuuuccugacc

SEQ ID NO: 242215 - RNA, 22 nt, Human
uuggugaugcccaccuuuucau

SEQ ID NO: 242216 - RNA, 22 nt, Human
gggaaaauguuucugagacaaa

SEQ ID NO: 242217 - RNA, 22 nt, Human
uccucccugcacucagugaagu

SEQ ID NO: 242218 - RNA, 22 nt, Human
aaggaacuucagggcgaaugga

SEQ ID NO: 242219 - RNA, 22 nt, Human
ucccaaguguuuggcgaggaga

SEQ ID NO: 242220 - RNA, 22 nt, Human
uucuucuuuccuauaauuaauu

SEQ ID NO: 242221 - RNA, 22 nt, Human
uuauuuaaguauuuauugaagu

SEQ ID NO: 242222 - RNA, 22 nt, Human
uuuauaauuacguaaaauauuu

SEQ ID NO: 242223 - RNA, 20 nt, Human
uuggagaucacguguccagg

SEQ ID NO: 242224 - RNA, 22 nt, Human
cuucuuaaaguugucacagcug

SEQ ID NO: 242225 - RNA, 22 nt, Human
cuuggggauuuuaaagaccucu

SEQ ID NO: 242226 - RNA, 22 nt, Human
gggcucuuaauuuuuuucucua

SEQ ID NO: 242227 - RNA, 22 nt, Human
aucacuagaguuacauugccag

SEQ ID NO: 242228 - RNA, 22 nt, Human
aggugagaacguggaggggcgg

SEQ ID NO: 242229 - RNA, 22 nt, Human
ugcugcacuuauggcucugagg

SEQ ID NO: 242230 - RNA, 22 nt, Human
ugguucuagaugagaugaugag

SEQ ID NO: 242231 - RNA, 22 nt, Human
gcaggggguaaggggcagggcu

SEQ ID NO: 242232 - RNA, 18 nt, Human
auucauuugcguuuggcu

SEQ ID NO: 242233 - RNA, 22 nt, Human
ucacuuccuugcagcuguagaa

SEQ ID NO: 242234 - RNA, 23 nt, Human
uuucugaguuuuuuaaaagucca

SEQ ID NO: 242235 - RNA, 22 nt, Human
cuucuucaucuuuuggaggaac

SEQ ID NO: 242236 - RNA, 22 nt, Human
auuuuacuaugauaguugagaa

SEQ ID NO: 242237 - RNA, 22 nt, Human
agauaagaacauuaguaagccg

SEQ ID NO: 242238 - RNA, 22 nt, Human
uauuuuuuuaacauuuauugua

SEQ ID NO: 242239 - RNA, 22 nt, Human
guguuggugagcucauuuccac

SEQ ID NO: 242240 - RNA, 22 nt, Human
gcagccugaguuuagcucgucg

SEQ ID NO: 242241 - RNA, 19 nt, Human
cuuguggcuaugcagauac

SEQ ID NO: 242242 - RNA, 22 nt, Human
gcucuucuaaguuuacccuucc

SEQ ID NO: 242243 - RNA, 22 nt, Human
aguuauuuuucacuauuaggcu

SEQ ID NO: 242244 - RNA, 22 nt, Human
gagcagcugagcuggaaugaga

SEQ ID NO: 242245 - RNA, 22 nt, Human
ugucccaucacagaggagacua

SEQ ID NO: 242246 - RNA, 22 nt, Human
ugcagcuuuugguuucuagaug

SEQ ID NO: 242247 - RNA, 22 nt, Human
uaugaauauaccacaauuuagg

SEQ ID NO: 242248 - RNA, 22 nt, Human
uucuaauauuaugauuucuaag

SEQ ID NO: 242249 - RNA, 22 nt, Human
gaaaaauggguuguuugaagau

SEQ ID NO: 242250 - RNA, 22 nt, Human
uuguuuuaguagaaguuacaug

SEQ ID NO: 242251 - RNA, 22 nt, Human
gaggcuugccacuguccauggc

SEQ ID NO: 242252 - RNA, 22 nt, Human
gcgcggcgcggguccucggccu

SEQ ID NO: 242253 - RNA, 22 nt, Human
ugucuuuuaaaaauguguaaaa

SEQ ID NO: 242254 - RNA, 22 nt, Human
uacaaauugccugacggcaggu

SEQ ID NO: 242255 - RNA, 22 nt, Human
acauuccugaagguaaugagaa

SEQ ID NO: 242256 - RNA, 22 nt, Human
agugccaucuuuaacuguccca

SEQ ID NO: 242257 - RNA, 22 nt, Human
gcugcagggagcuggaaggcuc

SEQ ID NO: 242258 - RNA, 22 nt, Human
gaggcagaggaugggacuguau

SEQ ID NO: 242259 - RNA, 22 nt, Human
gcuuucacugcaauagaugaau

SEQ ID NO: 242260 - RNA, 22 nt, Human
gugcugggaggcccaggaugga

SEQ ID NO: 242261 - RNA, 22 nt, Human
uauuuccugcguuucugugagc

SEQ ID NO: 242262 - RNA, 22 nt, Human
uuaaacauuuccacuugccagu

SEQ ID NO: 242263 - RNA, 22 nt, Human
gacuugauugguuugucaaguu

SEQ ID NO: 242264 - RNA, 22 nt, Human
ugcgccccgcgggccuucgggc

SEQ ID NO: 242265 - RNA, 22 nt, Human
agcgcgcggggcugcggcaggg

SEQ ID NO: 242266 - RNA, 22 nt, Human
aggcgaagggaccagacgguag

SEQ ID NO: 242267 - RNA, 22 nt, Human
uuuuaaaguaauugaagcuugu

SEQ ID NO: 242268 - RNA, 22 nt, Human
aauguaaauaauuguaaaauuu

SEQ ID NO: 242269 - RNA, 22 nt, Human
guaauucugugugaaucuauua

SEQ ID NO: 242270 - RNA, 22 nt, Human
gggacugguuguguguggugug

SEQ ID NO: 242271 - RNA, 22 nt, Human
uguauuuuuucccugaaauaaa

SEQ ID NO: 242272 - RNA, 22 nt, Human
aguggagguuacagcuguacau

SEQ ID NO: 242273 - RNA, 22 nt, Human
cuccucccagcccaggcgccac

SEQ ID NO: 242274 - RNA, 22 nt, Human
ugggcagggauuuggggaaacu

SEQ ID NO: 242275 - RNA, 22 nt, Human
cacugguugccucuuucuguuc

SEQ ID NO: 242276 - RNA, 22 nt, Human
uuuuucuuugcuuuccacuggc

SEQ ID NO: 242277 - RNA, 22 nt, Human
ucuugccuuuucuagcuucuag

SEQ ID NO: 242278 - RNA, 22 nt, Human
uauguuuugcaaauaucaaaca

SEQ ID NO: 242279 - RNA, 22 nt, Human
uuauuuuuaggaauguagaggu

SEQ ID NO: 242280 - RNA, 22 nt, Human
ggagagcuagugagcuggaggu

SEQ ID NO: 242281 - RNA, 22 nt, Human
uuugcaggaaauguacugaaug

SEQ ID NO: 242282 - RNA, 22 nt, Human
uucauuagcacauuuccuuggu

SEQ ID NO: 242283 - RNA, 22 nt, Human
uauauguagcucaaaaauuccc

SEQ ID NO: 242284 - RNA, 21 nt, Human
agccgggacaacguggacccc

SEQ ID NO: 242285 - RNA, 22 nt, Human
gggcuguggggccugcagaagg

SEQ ID NO: 242286 - RNA, 22 nt, Human
uguuuagcucugacuaugugau

SEQ ID NO: 242287 - RNA, 22 nt, Human
uuuucauagccagaaacugaaa

SEQ ID NO: 242288 - RNA, 22 nt, Human
gagaggcagcucaggaggucag

SEQ ID NO: 242289 - RNA, 22 nt, Human
cuguggcugcgcccugggggag

SEQ ID NO: 242290 - RNA, 22 nt, Human
aacacuaaaggucaguuagaag

SEQ ID NO: 242291 - RNA, 22 nt, Human
gggagggucugagagcugcacc

SEQ ID NO: 242292 - RNA, 22 nt, Human
aggggaggcugcgggcugccgu

SEQ ID NO: 242293 - RNA, 22 nt, Human
uccgggagcccccggaggagga

SEQ ID NO: 242294 - RNA, 20 nt, Human
ccuguucacugcgcaguuuc

SEQ ID NO: 242295 - RNA, 22 nt, Human
uuucaugauuaacuuagugaau

SEQ ID NO: 242296 - RNA, 22 nt, Human
uuuucauuguuaguuucuccuu

SEQ ID NO: 242297 - RNA, 22 nt, Human
ucugcaugccucaggaggccug

SEQ ID NO: 242298 - RNA, 22 nt, Human
auguacugacuguacuuuuaaa

SEQ ID NO: 242299 - RNA, 23 nt, Human
ugcugcgggacccgagcgcgcgc

SEQ ID NO: 242300 - RNA, 22 nt, Human
aggggcagaggaugauggaaga

SEQ ID NO: 242301 - RNA, 22 nt, Human
gcaguuugugauguggcaguca

SEQ ID NO: 242302 - RNA, 23 nt, Human
aaguggugacugugcuacugaga

SEQ ID NO: 242303 - RNA, 22 nt, Human
uaauauaacugccaguuaaggu

SEQ ID NO: 242304 - RNA, 19 nt, Human
ggaggguguccucaguguc

SEQ ID NO: 242305 - RNA, 22 nt, Human
uaaaaucaugacagauugacau

SEQ ID NO: 242306 - RNA, 22 nt, Human
ccggcggguggagcaugcgcgg

SEQ ID NO: 242307 - RNA, 23 nt, Human
aagaaugcuucugaagagcugcc

SEQ ID NO: 242308 - RNA, 22 nt, Human
uuuaaugaugucuaugccuguu

SEQ ID NO: 242309 - RNA, 22 nt, Human
ugcuggagccauguuuucucua

SEQ ID NO: 242310 - RNA, 22 nt, Human
gaauucuaguucuguaucucug

SEQ ID NO: 242311 - RNA, 22 nt, Human
gcucagcuggagagggacgggu

SEQ ID NO: 242312 - RNA, 22 nt, Human
guucuucagauuccauuucagu

SEQ ID NO: 242313 - RNA, 22 nt, Human
ggacauaguugcuauggagagu

SEQ ID NO: 242314 - RNA, 22 nt, Human
uaggggguuuuucuagagauug

SEQ ID NO: 242315 - RNA, 22 nt, Human
acaguuuucugagaaucacagg

SEQ ID NO: 242316 - RNA, 22 nt, Human
auuaaauagcagaagaaagaug

SEQ ID NO: 242317 - RNA, 22 nt, Human
ggccgggugggaggcagcggag

SEQ ID NO: 242318 - RNA, 22 nt, Human
cccaggccguguaaucagcagc

SEQ ID NO: 242319 - RNA, 19 nt, Human
agagucuccacuccacuug

SEQ ID NO: 242320 - RNA, 22 nt, Human
guucuacaugacacucaacauu

SEQ ID NO: 242321 - RNA, 22 nt, Human
aggauagacuucagaaggcaua

SEQ ID NO: 242322 - RNA, 22 nt, Human
auagcacuuaauaugaaacagu

SEQ ID NO: 242323 - RNA, 22 nt, Human
cagcuggggagagacauggcag

SEQ ID NO: 242324 - RNA, 19 nt, Human
cagagacuguaacacuuuu

SEQ ID NO: 242325 - RNA, 22 nt, Human
ggacggggagcuggaaagggga

SEQ ID NO: 242326 - RNA, 22 nt, Human
guauauuuaugagcauuagccu

SEQ ID NO: 242327 - RNA, 22 nt, Human
gaaggggacuccauggaaugau

SEQ ID NO: 242328 - RNA, 22 nt, Human
gaacauauuuagcaccuaauau

SEQ ID NO: 242329 - RNA, 22 nt, Human
cucaugcugcaaauggcuguuu

SEQ ID NO: 242330 - RNA, 22 nt, Human
gugugugucuacuuucaucucu

SEQ ID NO: 242331 - RNA, 22 nt, Human
guguucuuuguagaggaucuug

SEQ ID NO: 242332 - RNA, 22 nt, Human
aaauuaaaguuuuauuuagagc

SEQ ID NO: 242333 - RNA, 22 nt, Human
gugccugcucauucucaauauu

SEQ ID NO: 242334 - RNA, 22 nt, Human
caucucagguuuguucugagac

SEQ ID NO: 242335 - RNA, 22 nt, Human
acuuuuccuggguagcuccugg

SEQ ID NO: 242336 - RNA, 22 nt, Human
uuggaggucucugugguggugg

SEQ ID NO: 242337 - RNA, 22 nt, Human
cggggcucugcacaggccagga

SEQ ID NO: 242338 - RNA, 22 nt, Human
aggcagagaggucuuccuggaa

SEQ ID NO: 242339 - RNA, 22 nt, Human
aauuuaauugguuuuuacuugu

SEQ ID NO: 242340 - RNA, 22 nt, Human
uacauguggagauaacugaagc

SEQ ID NO: 242341 - RNA, 22 nt, Human
ggcugguggcgggcagcacaga

SEQ ID NO: 242342 - RNA, 22 nt, Human
cccggcucggcuucuuccccac

SEQ ID NO: 242343 - RNA, 22 nt, Human
aagcauuuuagauaaagcauca

SEQ ID NO: 242344 - RNA, 22 nt, Human
ugcaggagcccaggaauacuau

SEQ ID NO: 242345 - RNA, 22 nt, Human
gauauauuucaaauucuuuugc

SEQ ID NO: 242346 - RNA, 22 nt, Human
aaauauauauaauauauauauu

SEQ ID NO: 242347 - RNA, 22 nt, Human
ucgagcucagcagggaggugcg

SEQ ID NO: 242348 - RNA, 22 nt, Human
guccuguguaaguacuugcuca

SEQ ID NO: 242349 - RNA, 19 nt, Human
aacaaaauaguucuaguua

SEQ ID NO: 242350 - RNA, 22 nt, Human
caaagaugccaaaaggaagaca

SEQ ID NO: 242351 - RNA, 22 nt, Human
ugugucuuuggcgaugucugga

SEQ ID NO: 242352 - RNA, 22 nt, Human
auauaguacauguauauauaua

SEQ ID NO: 242353 - RNA, 22 nt, Human
ugcuggaguggcacuguguggc

SEQ ID NO: 242354 - RNA, 22 nt, Human
ucagcuucaucuugagcccaca

SEQ ID NO: 242355 - RNA, 22 nt, Human
ucauaucauuuugaaagcugag

SEQ ID NO: 242356 - RNA, 22 nt, Human
aaauuuuguugaaaaauauuuu

SEQ ID NO: 242357 - RNA, 22 nt, Human
ggacuggugaagccuucggaga

SEQ ID NO: 242358 - RNA, 22 nt, Human
ucacaucugugugauugucauu

SEQ ID NO: 242359 - RNA, 22 nt, Human
gguggcagaggaggcgggagag

SEQ ID NO: 242360 - RNA, 22 nt, Human
cugaaagacagccaggcaaagc

SEQ ID NO: 242361 - RNA, 22 nt, Human
agcggaggaggcggagcaggga

SEQ ID NO: 242362 - RNA, 22 nt, Human
aaugagauggaggacucuuaau

SEQ ID NO: 242363 - RNA, 22 nt, Human
ggggcgaguguggaccgcagcc

SEQ ID NO: 242364 - RNA, 22 nt, Human
auggagguuugucugguuuugu

SEQ ID NO: 242365 - RNA, 22 nt, Human
uuauuugcccauguuuagcaga

SEQ ID NO: 242366 - RNA, 22 nt, Human
caggggcuccaggugagccugg

SEQ ID NO: 242367 - RNA, 22 nt, Human
ggagacagauggcgucucaguu

SEQ ID NO: 242368 - RNA, 22 nt, Human
auggaggugagccccccauccu

SEQ ID NO: 242369 - RNA, 22 nt, Human
auaaaagcacaauagaguuaug

SEQ ID NO: 242370 - RNA, 21 nt, Human
acugggcuagccugacuucug

SEQ ID NO: 242371 - RNA, 22 nt, Human
gacagugucccucuggggugga

SEQ ID NO: 242372 - RNA, 22 nt, Human
cagagagcguccauccggugcc

SEQ ID NO: 242373 - RNA, 22 nt, Human
cccauggaaggguuggcccaga

SEQ ID NO: 242374 - RNA, 22 nt, Human
ggaaauguguguaagaaaguau

SEQ ID NO: 242375 - RNA, 22 nt, Human
guagaacucuuuccugcguggg

SEQ ID NO: 242376 - RNA, 22 nt, Human
caaggaguuuggggaccaagga

SEQ ID NO: 242377 - RNA, 20 nt, Human
agcauucaacuuucuauguu

SEQ ID NO: 242378 - RNA, 20 nt, Human
ucugugugccaucaccuaac

SEQ ID NO: 242379 - RNA, 21 nt, Human
uccccugugccuggcauacag

SEQ ID NO: 242380 - RNA, 22 nt, Human
ggaagauagaaguucaaaaguu

SEQ ID NO: 242381 - RNA, 22 nt, Human
caggaggugugucccaccgggu

SEQ ID NO: 242382 - RNA, 22 nt, Human
ugcuggagucucuugacccugg

SEQ ID NO: 242383 - RNA, 22 nt, Human
gaggugauuccucccauguaau

SEQ ID NO: 242384 - RNA, 22 nt, Human
ggcagagguagcuggaaccagg

SEQ ID NO: 242385 - RNA, 22 nt, Human
agcacgcccaccuccugcggcg

SEQ ID NO: 242386 - RNA, 22 nt, Human
cuucucugcugccugccucuuu

SEQ ID NO: 242387 - RNA, 22 nt, Human
aucuaaaacuacgaauacuacc

SEQ ID NO: 242388 - RNA, 22 nt, Human
auuuuuuuggucauaugagaua

SEQ ID NO: 242389 - RNA, 20 nt, Human
ucucuuuuucuucuuuucuc

SEQ ID NO: 242390 - RNA, 22 nt, Human
agcugaggccccgcagcagggu

SEQ ID NO: 242391 - RNA, 22 nt, Human
uggaagggguuacgcagcagga

SEQ ID NO: 242392 - RNA, 22 nt, Human
uuuuauuuguauguugaaugua

SEQ ID NO: 242393 - RNA, 22 nt, Human
aauagagacaguuuaacaauau

SEQ ID NO: 242394 - RNA, 22 nt, Human
uuauuuuuguuuguuaagccua

SEQ ID NO: 242395 - RNA, 22 nt, Human
uguacauacauagauauacaca

SEQ ID NO: 242396 - RNA, 22 nt, Human
uggggcuccuccuggcaggagg

SEQ ID NO: 242397 - RNA, 22 nt, Human
ucagucucuggggcuucuguuu

SEQ ID NO: 242398 - RNA, 22 nt, Human
aucuguuccccuaugcucucua

SEQ ID NO: 242399 - RNA, 22 nt, Human
uuuuagaagcauuuaugagauu

SEQ ID NO: 242400 - RNA, 22 nt, Human
auaaggaaagugagugcuuaaa

SEQ ID NO: 242401 - RNA, 22 nt, Human
uauuucaguuaagaugagguca

SEQ ID NO: 242402 - RNA, 22 nt, Human
caguggagaccugccugcugga

SEQ ID NO: 242403 - RNA, 22 nt, Human
uauacauauacaaaugcacaua

SEQ ID NO: 242404 - RNA, 22 nt, Human
uuuuuuccuguuugucuuuggg

SEQ ID NO: 242405 - RNA, 22 nt, Human
uuauauuuuauuuaauuaaaua

SEQ ID NO: 242406 - RNA, 22 nt, Human
uaaaguauucaaguagcuuucu

SEQ ID NO: 242407 - RNA, 22 nt, Human
uggaagcccagaaggaagcaga

SEQ ID NO: 242408 - RNA, 20 nt, Human
acacaccugcucagacugag

SEQ ID NO: 242409 - RNA, 22 nt, Human
cacuguugagcaauguacagug

SEQ ID NO: 242410 - RNA, 22 nt, Human
ggcugcagggaacaggaugggu

SEQ ID NO: 242411 - RNA, 22 nt, Human
caaggaaaugucagaaaggcaa

SEQ ID NO: 242412 - RNA, 22 nt, Human
acagacuuuuagacuuaugagu

SEQ ID NO: 242413 - RNA, 22 nt, Human
ugaaaaauauuuuuagaaauaa

SEQ ID NO: 242414 - RNA, 20 nt, Human
ugccagagagcucauacccu

SEQ ID NO: 242415 - RNA, 22 nt, Human
gaggguggggaauagacugcua

SEQ ID NO: 242416 - RNA, 22 nt, Human
ggauaauguauuuuaaaauggg

SEQ ID NO: 242417 - RNA, 22 nt, Human
gaggagggagcuggaagcucuu

SEQ ID NO: 242418 - RNA, 22 nt, Human
agcugugaccuucaagagcuac

SEQ ID NO: 242419 - RNA, 22 nt, Human
uccuuucaaauuuauuugacau

SEQ ID NO: 242420 - RNA, 22 nt, Human
agggcugcugcuccgggcccag

SEQ ID NO: 242421 - RNA, 22 nt, Human
ggcucacuguaccugccgccgc

SEQ ID NO: 242422 - RNA, 22 nt, Human
uucauagaagggaguuuuuccu

SEQ ID NO: 242423 - RNA, 22 nt, Human
aggcaguguguagcuggaagag

SEQ ID NO: 242424 - RNA, 22 nt, Human
agcaagggucucucauggcuug

SEQ ID NO: 242425 - RNA, 20 nt, Human
ccuuguggaugucuuuuuug

SEQ ID NO: 242426 - RNA, 20 nt, Human
acacagccuagaguuuggcu

SEQ ID NO: 242427 - RNA, 22 nt, Human
gaaggagaggauugugaggcug

SEQ ID NO: 242428 - RNA, 22 nt, Human
ggcuccagauguccccuggcaa

SEQ ID NO: 242429 - RNA, 22 nt, Human
uuuuccuucugauacuccauuu

SEQ ID NO: 242430 - RNA, 22 nt, Human
gagguagcgugcagggcccgaa

SEQ ID NO: 242431 - RNA, 22 nt, Human
gaggcucagagggacuuucaag

SEQ ID NO: 242432 - RNA, 22 nt, Human
cuccccuuauuccucaacauga

SEQ ID NO: 242433 - RNA, 22 nt, Human
aaaacuuucagggauacagaaa

SEQ ID NO: 242434 - RNA, 22 nt, Human
guggguauauauaugugugcug

SEQ ID NO: 242435 - RNA, 20 nt, Human
acuagaaagucacugggggg

SEQ ID NO: 242436 - RNA, 22 nt, Human
gcuguggacacagcucucuuca

SEQ ID NO: 242437 - RNA, 22 nt, Human
uauuuucucugccacacuucca

SEQ ID NO: 242438 - RNA, 22 nt, Human
ccccccaaauguuacagugacc

SEQ ID NO: 242439 - RNA, 20 nt, Human
uggagggaggaggggcccaa

SEQ ID NO: 242440 - RNA, 22 nt, Human
ggcucccgugggaugguggagc

SEQ ID NO: 242441 - RNA, 22 nt, Human
cacacacacacacacucucaca

SEQ ID NO: 242442 - RNA, 22 nt, Human
agcuugagauaauucaagcuga

SEQ ID NO: 242443 - RNA, 22 nt, Human
agggaguuccgaucugugcacc

SEQ ID NO: 242444 - RNA, 20 nt, Human
cucuuuaugagaccacuguc

SEQ ID NO: 242445 - RNA, 22 nt, Human
cacauguguaccugccucucug

SEQ ID NO: 242446 - RNA, 22 nt, Human
ugagagggagacagcucuagca

SEQ ID NO: 242447 - RNA, 22 nt, Human
ggcugggagguggcgaggaggc

SEQ ID NO: 242448 - RNA, 22 nt, Human
agcuagugcaguucucaaaugg

SEQ ID NO: 242449 - RNA, 22 nt, Human
ccagccugagcuugcugcccuc

SEQ ID NO: 242450 - RNA, 20 nt, Human
gagaauuccagguuucugug

SEQ ID NO: 242451 - RNA, 22 nt, Human
uucauuuccauuuuauagauaa

SEQ ID NO: 242452 - RNA, 22 nt, Human
uucuugugugaauauaauuaca

SEQ ID NO: 242453 - RNA, 22 nt, Human
auacauauaugcacauuaauau

SEQ ID NO: 242454 - RNA, 22 nt, Human
uuuugccuauuguaucaucgua

SEQ ID NO: 242455 - RNA, 22 nt, Human
aggggcugugucauuuguccua

SEQ ID NO: 242456 - RNA, 22 nt, Human
guuuucuuguuaauuuugaacg

SEQ ID NO: 242457 - RNA, 22 nt, Human
ucauuauuuugauguauuuccu

SEQ ID NO: 242458 - RNA, 22 nt, Human
ggcuguggcagcuggaaguggu

SEQ ID NO: 242459 - RNA, 22 nt, Human
gcgcgccugccucccgcggugc

SEQ ID NO: 242460 - RNA, 22 nt, Human
ggcugugguggacgcgggaaac

SEQ ID NO: 242461 - RNA, 21 nt, Human
ccgaggagugcggggagcccc

SEQ ID NO: 242462 - RNA, 22 nt, Human
uuguacaaauaggaaccucuga

SEQ ID NO: 242463 - RNA, 20 nt, Human
gacaugagggagcaaagagc

SEQ ID NO: 242464 - RNA, 22 nt, Human
aaaauauaaaggauguggguuu

SEQ ID NO: 242465 - RNA, 22 nt, Human
aagagggguggucugugaggau

SEQ ID NO: 242466 - RNA, 22 nt, Human
ggcucccccauggcugacagac

SEQ ID NO: 242467 - RNA, 22 nt, Human
agagauacugcaggccauaaau

SEQ ID NO: 242468 - RNA, 21 nt, Human
ugcuuucugugcuuuuucugc

SEQ ID NO: 242469 - RNA, 22 nt, Human
ggauggugauguacccagucau

SEQ ID NO: 242470 - RNA, 22 nt, Human
uacugcaguuccugcugucucc

SEQ ID NO: 242471 - RNA, 22 nt, Human
cagcuccagcccaggcagcucc

SEQ ID NO: 242472 - RNA, 22 nt, Human
ggacauugaagcuggaaaggga

SEQ ID NO: 242473 - RNA, 22 nt, Human
ugaaugaacugaugaacuuaac

SEQ ID NO: 242474 - RNA, 22 nt, Human
cuggagaacucugugcuucacu

SEQ ID NO: 242475 - RNA, 22 nt, Human
aagcucagcugguggugauugc

SEQ ID NO: 242476 - RNA, 22 nt, Human
cuggcaguguccagcucgugau

SEQ ID NO: 242477 - RNA, 22 nt, Human
uuacuuuuuucccccuuagaug

SEQ ID NO: 242478 - RNA, 22 nt, Human
ucauuguuucugcuuuucauga

SEQ ID NO: 242479 - RNA, 22 nt, Human
cccagagggcugaggauaugaa

SEQ ID NO: 242480 - RNA, 22 nt, Human
uucugugacuccucagagauuu

SEQ ID NO: 242481 - RNA, 22 nt, Human
ccagcaggagacuagcaacaua

SEQ ID NO: 242482 - RNA, 22 nt, Human
uauuuuaaaagcauuaauucuu

SEQ ID NO: 242483 - RNA, 22 nt, Human
cacauuaagcccaagcauagaa

SEQ ID NO: 242484 - RNA, 22 nt, Human
uauuuuauuuagguuuaguugu

SEQ ID NO: 242485 - RNA, 22 nt, Human
uaaaugaaaggguuuaauuuau

SEQ ID NO: 242486 - RNA, 19 nt, Human
acccaugcucuguggacuu

SEQ ID NO: 242487 - RNA, 20 nt, Human
uucacagaggacucagguca

SEQ ID NO: 242488 - RNA, 18 nt, Human
uuuaauaagccuguuaug

SEQ ID NO: 242489 - RNA, 22 nt, Human
augcggcugugggggaauggga

SEQ ID NO: 242490 - RNA, 22 nt, Human
ucaaauaugggccagaggaaau

SEQ ID NO: 242491 - RNA, 22 nt, Human
uucccagggaucucuaguauuu

SEQ ID NO: 242492 - RNA, 22 nt, Human
uuauuccauagaagucaaggaa

SEQ ID NO: 242493 - RNA, 22 nt, Human
ggcagugguaggagcccaggag

SEQ ID NO: 242494 - RNA, 22 nt, Human
auuuaaaaacugguacaacagg

SEQ ID NO: 242495 - RNA, 22 nt, Human
acuuauaaauuuaguacacugu

SEQ ID NO: 242496 - RNA, 22 nt, Human
gagcuggagaaacacauaagaa

SEQ ID NO: 242497 - RNA, 22 nt, Human
ccaggaguccgugggucuugag

SEQ ID NO: 242498 - RNA, 22 nt, Human
auaguaaauguuaacagcaaca

SEQ ID NO: 242499 - RNA, 22 nt, Human
auuuuucuuucacauuuucuua

SEQ ID NO: 242500 - RNA, 22 nt, Human
gcuggggaucgaaggcagagcc

SEQ ID NO: 242501 - RNA, 22 nt, Human
uuauuucaggcauuuguaaaug

SEQ ID NO: 242502 - RNA, 22 nt, Human
ugaccucaagcaugcggagggc

SEQ ID NO: 242503 - RNA, 22 nt, Human
ccagcugggucccugcuggggc

SEQ ID NO: 242504 - RNA, 22 nt, Human
uuuuaaauaaacuacacugauu

SEQ ID NO: 242505 - RNA, 22 nt, Human
augaaaacgugugugugugugu

SEQ ID NO: 242506 - RNA, 22 nt, Human
gcacagauaaucugccuuacca

SEQ ID NO: 242507 - RNA, 22 nt, Human
auucaaugcacauguuuuggau

SEQ ID NO: 242508 - RNA, 22 nt, Human
auuaauaucaauauauuauaug

SEQ ID NO: 242509 - RNA, 22 nt, Human
aauguugaaccuuuuuggccug

SEQ ID NO: 242510 - RNA, 22 nt, Human
ggagccucuaaacaguuaucaa

SEQ ID NO: 242511 - RNA, 22 nt, Human
ggugcuucgauagguguccaua

SEQ ID NO: 242512 - RNA, 22 nt, Human
cccuguccugcuaggcccuggu

SEQ ID NO: 242513 - RNA, 22 nt, Human
gugauggucgagcgcuuguugu

SEQ ID NO: 242514 - RNA, 22 nt, Human
gaguggccugccccagccaggc

SEQ ID NO: 242515 - RNA, 22 nt, Human
uggaaggggagcuggaaagggg

SEQ ID NO: 242516 - RNA, 22 nt, Human
cagcuguggagauggggugcau
